United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 110

SEQ ID NO: 3903353 - RNA, 12 nt, Shigella flexneri 2a str. 301
agcgucagccug

SEQ ID NO: 3903354 - RNA, 17 nt, Shigella flexneri 2a str. 301
agcgucagcuuucagag

SEQ ID NO: 3903355 - RNA, 11 nt, Shigella flexneri 2a str. 301
agcgucaguuc

SEQ ID NO: 3903356 - RNA, 19 nt, Shigella flexneri 2a str. 301
agcguccacagccaacaca

SEQ ID NO: 3903357 - RNA, 21 nt, Shigella flexneri 2a str. 301
agcguccacagccaacacauu

SEQ ID NO: 3903358 - RNA, 16 nt, Shigella flexneri 2a str. 301
agcguccagcccuccg

SEQ ID NO: 3903359 - RNA, 15 nt, Shigella flexneri 2a str. 301
agcgucccacgaccg

SEQ ID NO: 3903360 - RNA, 19 nt, Shigella flexneri 2a str. 301
agcgucccaguaacguccc

SEQ ID NO: 3903361 - RNA, 19 nt, Shigella flexneri 2a str. 301
agcgucgcaucaggcauga

SEQ ID NO: 3903362 - RNA, 16 nt, Shigella flexneri 2a str. 301
agcugauucagauaau

SEQ ID NO: 3903363 - RNA, 20 nt, Shigella flexneri 2a str. 301
agcugauugaaauagccaau

SEQ ID NO: 3903364 - RNA, 15 nt, Shigella flexneri 2a str. 301
agcugcaaccauuug

SEQ ID NO: 3903365 - RNA, 15 nt, Shigella flexneri 2a str. 301
agcugcaagaugaau

SEQ ID NO: 3903366 - RNA, 23 nt, Shigella flexneri 2a str. 301
agcugcacacagggcgcuagcca

SEQ ID NO: 3903367 - RNA, 13 nt, Shigella flexneri 2a str. 301
agcugccaguugu

SEQ ID NO: 3903368 - RNA, 16 nt, Shigella flexneri 2a str. 301
agcugccaguugucgg

SEQ ID NO: 3903369 - RNA, 18 nt, Shigella flexneri 2a str. 301
agcugccgacgccaguuc

SEQ ID NO: 3903370 - RNA, 15 nt, Shigella flexneri 2a str. 301
agcugccgccaggcu

SEQ ID NO: 3903371 - RNA, 17 nt, Shigella flexneri 2a str. 301
agcugccguccccauca

SEQ ID NO: 3903372 - RNA, 18 nt, Shigella flexneri 2a str. 301
agcugccuguacggcagu

SEQ ID NO: 3903373 - RNA, 16 nt, Shigella flexneri 2a str. 301
agcugcuacgccguca

SEQ ID NO: 3903374 - RNA, 20 nt, Shigella flexneri 2a str. 301
agcugcugacggugauaauc

SEQ ID NO: 3903375 - RNA, 23 nt, Shigella flexneri 2a str. 301
agcugcuuuuccggucagcaauc

SEQ ID NO: 3903376 - RNA, 23 nt, Shigella flexneri 2a str. 301
agcuggaaaaucuacguuaaaaa

SEQ ID NO: 3903377 - RNA, 12 nt, Shigella flexneri 2a str. 301
agcuggcaaagu

SEQ ID NO: 3903378 - RNA, 18 nt, Shigella flexneri 2a str. 301
agcuggcaacgcgccgcc

SEQ ID NO: 3903379 - RNA, 19 nt, Shigella flexneri 2a str. 301
agcuggcaacgcgccgcca

SEQ ID NO: 3903380 - RNA, 22 nt, Shigella flexneri 2a str. 301
agcuggcgacgccucuauuaaa

SEQ ID NO: 3903381 - RNA, 18 nt, Shigella flexneri 2a str. 301
agcuggcucgacaaaaug

SEQ ID NO: 3903382 - RNA, 19 nt, Shigella flexneri 2a str. 301
agcuggucugaaucaacac

SEQ ID NO: 3903383 - RNA, 21 nt, Shigella flexneri 2a str. 301
agcugguucucgcuucugagc

SEQ ID NO: 3903384 - RNA, 13 nt, Shigella flexneri 2a str. 301
agcuguaucccag

SEQ ID NO: 3903385 - RNA, 23 nt, Shigella flexneri 2a str. 301
agcugucaucgggugcaguggcu

SEQ ID NO: 3903386 - RNA, 22 nt, Shigella flexneri 2a str. 301
agcugucccaagugauuuuuaa

SEQ ID NO: 3903387 - RNA, 13 nt, Shigella flexneri 2a str. 301
agcuguccgauuu

SEQ ID NO: 3903388 - RNA, 21 nt, Shigella flexneri 2a str. 301
agcugugggguauuuccaggg

SEQ ID NO: 3903389 - RNA, 15 nt, Shigella flexneri 2a str. 301
agcuguucaggagaa

SEQ ID NO: 3903390 - RNA, 14 nt, Shigella flexneri 2a str. 301
agcuguuguaauga

SEQ ID NO: 3903391 - RNA, 14 nt, Shigella flexneri 2a str. 301
agcuuaaucaccag

SEQ ID NO: 3903392 - RNA, 15 nt, Shigella flexneri 2a str. 301
agcuuacguaaccca

SEQ ID NO: 3903393 - RNA, 20 nt, Shigella flexneri 2a str. 301
agcuuacguuacccagcacg

SEQ ID NO: 3903394 - RNA, 14 nt, Shigella flexneri 2a str. 301
agcuuauccagcaa

SEQ ID NO: 3903395 - RNA, 20 nt, Shigella flexneri 2a str. 301
agcuuaucuguucagcaaaa

SEQ ID NO: 3903396 - RNA, 18 nt, Shigella flexneri 2a str. 301
agcuuauuaacagucagu

SEQ ID NO: 3903397 - RNA, 12 nt, Shigella flexneri 2a str. 301
agcuucacccgc

SEQ ID NO: 3903398 - RNA, 21 nt, Shigella flexneri 2a str. 301
agcuucacgcgccagcuuagu

SEQ ID NO: 3903399 - RNA, 14 nt, Shigella flexneri 2a str. 301
agcuucacuuucag

SEQ ID NO: 3903400 - RNA, 21 nt, Shigella flexneri 2a str. 301
agcuucaggcacccgccguua

SEQ ID NO: 3903401 - RNA, 16 nt, Shigella flexneri 2a str. 301
agcuucuguuauucca

SEQ ID NO: 3903402 - RNA, 18 nt, Shigella flexneri 2a str. 301
agcuucuuauccagcugc

SEQ ID NO: 3903403 - RNA, 19 nt, Shigella flexneri 2a str. 301
agcuucuuauccagcugcg

SEQ ID NO: 3903404 - RNA, 21 nt, Shigella flexneri 2a str. 301
agcuucuucaaaaaagucaga

SEQ ID NO: 3903405 - RNA, 17 nt, Shigella flexneri 2a str. 301
agcuugaaggguuuuau

SEQ ID NO: 3903406 - RNA, 19 nt, Shigella flexneri 2a str. 301
agcuugccgcgcucugcca

SEQ ID NO: 3903407 - RNA, 16 nt, Shigella flexneri 2a str. 301
agcuugcgauccugca

SEQ ID NO: 3903408 - RNA, 16 nt, Shigella flexneri 2a str. 301
agcuugcgucgccagu

SEQ ID NO: 3903409 - RNA, 20 nt, Shigella flexneri 2a str. 301
agcuugcguguuuuauauaa

SEQ ID NO: 3903410 - RNA, 13 nt, Shigella flexneri 2a str. 301
agcuuggcagagc

SEQ ID NO: 3903411 - RNA, 17 nt, Shigella flexneri 2a str. 301
agcuuuaaauuacugag

SEQ ID NO: 3903412 - RNA, 15 nt, Shigella flexneri 2a str. 301
agcuuuaucccuucg

SEQ ID NO: 3903413 - RNA, 20 nt, Shigella flexneri 2a str. 301
agcuuucagagaagcaccgc

SEQ ID NO: 3903414 - RNA, 15 nt, Shigella flexneri 2a str. 301
agcuuuccacgcagg

SEQ ID NO: 3903415 - RNA, 19 nt, Shigella flexneri 2a str. 301
agcuuucgcuuaacgccca

SEQ ID NO: 3903416 - RNA, 15 nt, Shigella flexneri 2a str. 301
agcuuuggugaaaaa

SEQ ID NO: 3903417 - RNA, 17 nt, Shigella flexneri 2a str. 301
agcuuugugcuucaguu

SEQ ID NO: 3903418 - RNA, 21 nt, Shigella flexneri 2a str. 301
agcuuugugcuucaguuccug

SEQ ID NO: 3903419 - RNA, 20 nt, Shigella flexneri 2a str. 301
agcuuuuccauaucaagcau

SEQ ID NO: 3903420 - RNA, 22 nt, Shigella flexneri 2a str. 301
agcuuuuccauaucaagcauga

SEQ ID NO: 3903421 - RNA, 22 nt, Shigella flexneri 2a str. 301
agcuuuucgcccuggacaacau

SEQ ID NO: 3903422 - RNA, 19 nt, Shigella flexneri 2a str. 301
agcuuuuuaaucgccaucu

SEQ ID NO: 3903423 - RNA, 15 nt, Shigella flexneri 2a str. 301
agcuuuuuauagcaa

SEQ ID NO: 3903424 - RNA, 13 nt, Shigella flexneri 2a str. 301
aggaaaaaaauua

SEQ ID NO: 3903425 - RNA, 23 nt, Shigella flexneri 2a str. 301
aggaaaacaauguucaucugcau

SEQ ID NO: 3903426 - RNA, 14 nt, Shigella flexneri 2a str. 301
aggaaaaccagaau

SEQ ID NO: 3903427 - RNA, 13 nt, Shigella flexneri 2a str. 301
aggaaaauacagc

SEQ ID NO: 3903428 - RNA, 12 nt, Shigella flexneri 2a str. 301
aggaaaaucagc

SEQ ID NO: 3903429 - RNA, 19 nt, Shigella flexneri 2a str. 301
aggaaacccaacgcaaaga

SEQ ID NO: 3903430 - RNA, 14 nt, Shigella flexneri 2a str. 301
aggaaacuccagcc

SEQ ID NO: 3903431 - RNA, 21 nt, Shigella flexneri 2a str. 301
aggaaacucucaaaacaacac

SEQ ID NO: 3903432 - RNA, 13 nt, Shigella flexneri 2a str. 301
aggaaaguaaauu

SEQ ID NO: 3903433 - RNA, 11 nt, Shigella flexneri 2a str. 301
aggaaauaaau

SEQ ID NO: 3903434 - RNA, 15 nt, Shigella flexneri 2a str. 301
aggaaauaauauagu

SEQ ID NO: 3903435 - RNA, 14 nt, Shigella flexneri 2a str. 301
aggaaaucgucgag

SEQ ID NO: 3903436 - RNA, 21 nt, Shigella flexneri 2a str. 301
aggaacaucccuugugcacug

SEQ ID NO: 3903437 - RNA, 18 nt, Shigella flexneri 2a str. 301
aggaaccuccauguccag

SEQ ID NO: 3903438 - RNA, 20 nt, Shigella flexneri 2a str. 301
aggaaccugugacagcagcg

SEQ ID NO: 3903439 - RNA, 20 nt, Shigella flexneri 2a str. 301
aggaacgaucccagcgugga

SEQ ID NO: 3903440 - RNA, 23 nt, Shigella flexneri 2a str. 301
aggaacgcgccaagauagaacca

SEQ ID NO: 3903441 - RNA, 15 nt, Shigella flexneri 2a str. 301
aggaacggcauuuac

SEQ ID NO: 3903442 - RNA, 21 nt, Shigella flexneri 2a str. 301
aggaacgggauugccagcaua

SEQ ID NO: 3903443 - RNA, 15 nt, Shigella flexneri 2a str. 301
aggaagauuacgcug

SEQ ID NO: 3903444 - RNA, 20 nt, Shigella flexneri 2a str. 301
aggaagccggaauuuuccuu

SEQ ID NO: 3903445 - RNA, 22 nt, Shigella flexneri 2a str. 301
aggaagccggaauuuuccuucg

SEQ ID NO: 3903446 - RNA, 20 nt, Shigella flexneri 2a str. 301
aggaagcuuucgcaguagau

SEQ ID NO: 3903447 - RNA, 21 nt, Shigella flexneri 2a str. 301
aggaagcuuucgcaguagauc

SEQ ID NO: 3903448 - RNA, 17 nt, Shigella flexneri 2a str. 301
aggaaggcaagaaagcg

SEQ ID NO: 3903449 - RNA, 21 nt, Shigella flexneri 2a str. 301
aggaagggauugugcaggcgc

SEQ ID NO: 3903450 - RNA, 14 nt, Shigella flexneri 2a str. 301
aggaaucagauacu

SEQ ID NO: 3903451 - RNA, 22 nt, Shigella flexneri 2a str. 301
aggaaucauuguuauaucaauu

SEQ ID NO: 3903452 - RNA, 16 nt, Shigella flexneri 2a str. 301
aggaaucgcuguugag

SEQ ID NO: 3903453 - RNA, 20 nt, Shigella flexneri 2a str. 301
aggaaugcagucgcuguauu

SEQ ID NO: 3903454 - RNA, 20 nt, Shigella flexneri 2a str. 301
aggaauucagaaaaauacaa

SEQ ID NO: 3903455 - RNA, 15 nt, Shigella flexneri 2a str. 301
aggaauugauucauc

SEQ ID NO: 3903456 - RNA, 21 nt, Shigella flexneri 2a str. 301
aggacagagacgcacugcuug

SEQ ID NO: 3903457 - RNA, 15 nt, Shigella flexneri 2a str. 301
aggacagucagaccg

SEQ ID NO: 3903458 - RNA, 19 nt, Shigella flexneri 2a str. 301
aggacagugggauuaaaaa

SEQ ID NO: 3903459 - RNA, 14 nt, Shigella flexneri 2a str. 301
aggacguuaaagaa

SEQ ID NO: 3903460 - RNA, 15 nt, Shigella flexneri 2a str. 301
aggacguuaaagaaa

SEQ ID NO: 3903461 - RNA, 22 nt, Shigella flexneri 2a str. 301
aggacguucaccgucaccccug

SEQ ID NO: 3903462 - RNA, 16 nt, Shigella flexneri 2a str. 301
aggccgaggcacagca

SEQ ID NO: 3903463 - RNA, 17 nt, Shigella flexneri 2a str. 301
aggccgaggcacagcag

SEQ ID NO: 3903464 - RNA, 14 nt, Shigella flexneri 2a str. 301
aggccggagcaugc

SEQ ID NO: 3903465 - RNA, 15 nt, Shigella flexneri 2a str. 301
aggccggagccagcc

SEQ ID NO: 3903466 - RNA, 16 nt, Shigella flexneri 2a str. 301
aggccggauguggcgu

SEQ ID NO: 3903467 - RNA, 15 nt, Shigella flexneri 2a str. 301
aggccguggaucaca

SEQ ID NO: 3903468 - RNA, 19 nt, Shigella flexneri 2a str. 301
aggccuaacaccaucagug

SEQ ID NO: 3903469 - RNA, 21 nt, Shigella flexneri 2a str. 301
aggccuaacaccaucaguggc

SEQ ID NO: 3903470 - RNA, 19 nt, Shigella flexneri 2a str. 301
aggccuacaaaaucuauug

SEQ ID NO: 3903471 - RNA, 21 nt, Shigella flexneri 2a str. 301
aggccuacaacuccguugaaa

SEQ ID NO: 3903472 - RNA, 16 nt, Shigella flexneri 2a str. 301
aggccuauugacgcug

SEQ ID NO: 3903473 - RNA, 22 nt, Shigella flexneri 2a str. 301
aggccugauaagcgcagcgcau

SEQ ID NO: 3903474 - RNA, 14 nt, Shigella flexneri 2a str. 301
aggccugauaagug

SEQ ID NO: 3903475 - RNA, 15 nt, Shigella flexneri 2a str. 301
aggccuggacucuua

SEQ ID NO: 3903476 - RNA, 16 nt, Shigella flexneri 2a str. 301
aggccugggcgaugau

SEQ ID NO: 3903477 - RNA, 17 nt, Shigella flexneri 2a str. 301
aggccuguggugauuca

SEQ ID NO: 3903478 - RNA, 22 nt, Shigella flexneri 2a str. 301
aggccuugaacucugaaucgcu

SEQ ID NO: 3903479 - RNA, 19 nt, Shigella flexneri 2a str. 301
aggcgaacaugcgcuggug

SEQ ID NO: 3903480 - RNA, 23 nt, Shigella flexneri 2a str. 301
aggcgaaucuuagugcgccugau

SEQ ID NO: 3903481 - RNA, 14 nt, Shigella flexneri 2a str. 301
aggcgaaugcguuu

SEQ ID NO: 3903482 - RNA, 17 nt, Shigella flexneri 2a str. 301
aggcgaccguuuucacc

SEQ ID NO: 3903483 - RNA, 16 nt, Shigella flexneri 2a str. 301
aggcgacgaauagcau

SEQ ID NO: 3903484 - RNA, 18 nt, Shigella flexneri 2a str. 301
aggcgagaucggcaggca

SEQ ID NO: 3903485 - RNA, 21 nt, Shigella flexneri 2a str. 301
aggcgagaucggcaggcaggu

SEQ ID NO: 3903486 - RNA, 15 nt, Shigella flexneri 2a str. 301
aggcgagcgcggcug

SEQ ID NO: 3903487 - RNA, 19 nt, Shigella flexneri 2a str. 301
aggcgaggcggacugaaua

SEQ ID NO: 3903488 - RNA, 16 nt, Shigella flexneri 2a str. 301
aggcgaugaaauucac

SEQ ID NO: 3903489 - RNA, 14 nt, Shigella flexneri 2a str. 301
aggcgauguucugg

SEQ ID NO: 3903490 - RNA, 17 nt, Shigella flexneri 2a str. 301
aggcgcaacccgugaag

SEQ ID NO: 3903491 - RNA, 13 nt, Shigella flexneri 2a str. 301
aggcgcaauggcg

SEQ ID NO: 3903492 - RNA, 15 nt, Shigella flexneri 2a str. 301
aggcgcacgccgaca

SEQ ID NO: 3903493 - RNA, 16 nt, Shigella flexneri 2a str. 301
aggcgcagauacagcc

SEQ ID NO: 3903494 - RNA, 20 nt, Shigella flexneri 2a str. 301
aggcgcagauacagccucuu

SEQ ID NO: 3903495 - RNA, 22 nt, Shigella flexneri 2a str. 301
aggcgcauugcuggcugcggga

SEQ ID NO: 3903496 - RNA, 14 nt, Shigella flexneri 2a str. 301
aggcgccauuuuca

SEQ ID NO: 3903497 - RNA, 13 nt, Shigella flexneri 2a str. 301
aggcgcgcgguga

SEQ ID NO: 3903498 - RNA, 23 nt, Shigella flexneri 2a str. 301
aggcgcuaaaagcauagccccag

SEQ ID NO: 3903499 - RNA, 17 nt, Shigella flexneri 2a str. 301
aggcgcuacgcuaucag

SEQ ID NO: 3903500 - RNA, 19 nt, Shigella flexneri 2a str. 301
aggcgcugaaagaagcggu

SEQ ID NO: 3903501 - RNA, 21 nt, Shigella flexneri 2a str. 301
aggcgcugaaagaagcgguga

SEQ ID NO: 3903502 - RNA, 21 nt, Shigella flexneri 2a str. 301
aggcgcugaaggcacagaaaa

SEQ ID NO: 3903503 - RNA, 14 nt, Shigella flexneri 2a str. 301
aggcgcuggguaaa

SEQ ID NO: 3903504 - RNA, 21 nt, Shigella flexneri 2a str. 301
aggcgcugguaaucaccaccc

SEQ ID NO: 3903505 - RNA, 21 nt, Shigella flexneri 2a str. 301
aggcgcuugucgucccaggca

SEQ ID NO: 3903506 - RNA, 18 nt, Shigella flexneri 2a str. 301
aggcggacugaauacgcu

SEQ ID NO: 3903507 - RNA, 23 nt, Shigella flexneri 2a str. 301
aggcggacugaauacgcuggcgc

SEQ ID NO: 3903508 - RNA, 13 nt, Shigella flexneri 2a str. 301
aggcggcagaaca

SEQ ID NO: 3903509 - RNA, 19 nt, Shigella flexneri 2a str. 301
aggcggcggcaaucagccg

SEQ ID NO: 3903510 - RNA, 15 nt, Shigella flexneri 2a str. 301
aggcgguaaccgcca

SEQ ID NO: 3903511 - RNA, 20 nt, Shigella flexneri 2a str. 301
aggcgugaucuccuuggaga

SEQ ID NO: 3903512 - RNA, 14 nt, Shigella flexneri 2a str. 301
aggcguuaaaacag

SEQ ID NO: 3903513 - RNA, 17 nt, Shigella flexneri 2a str. 301
aggcguuaacagcgcau

SEQ ID NO: 3903514 - RNA, 20 nt, Shigella flexneri 2a str. 301
aggcguucacgacgcauccg

SEQ ID NO: 3903515 - RNA, 20 nt, Shigella flexneri 2a str. 301
aggcguucacgccgcauccg

SEQ ID NO: 3903516 - RNA, 22 nt, Shigella flexneri 2a str. 301
aggcguucacgccgcauccggc

SEQ ID NO: 3903517 - RNA, 21 nt, Shigella flexneri 2a str. 301
aggcguucuacauaaaacgcu

SEQ ID NO: 3903518 - RNA, 19 nt, Shigella flexneri 2a str. 301
aggcguugauuggcgcagg

SEQ ID NO: 3903519 - RNA, 19 nt, Shigella flexneri 2a str. 301
aggcguuuacccuucgcac

SEQ ID NO: 3903520 - RNA, 22 nt, Shigella flexneri 2a str. 301
aggcguuuacgccgcauccggc

SEQ ID NO: 3903521 - RNA, 23 nt, Shigella flexneri 2a str. 301
aggcguuuacgccgcauccggca

SEQ ID NO: 3903522 - RNA, 19 nt, Shigella flexneri 2a str. 301
aggcguuugaaaaagccaa

SEQ ID NO: 3903523 - RNA, 21 nt, Shigella flexneri 2a str. 301
aggcguuuguaacccaccaug

SEQ ID NO: 3903524 - RNA, 20 nt, Shigella flexneri 2a str. 301
aggcguuuucgccacaucag

SEQ ID NO: 3903525 - RNA, 22 nt, Shigella flexneri 2a str. 301
aggcuaaagaaaacgaauugca

SEQ ID NO: 3903526 - RNA, 19 nt, Shigella flexneri 2a str. 301
aggcuaaauaaccagcaua

SEQ ID NO: 3903527 - RNA, 23 nt, Shigella flexneri 2a str. 301
aggcuauuccacgcaucaagcau

SEQ ID NO: 3903528 - RNA, 24 nt, Shigella flexneri 2a str. 301
aggcuauuuugcguuuagcaucag

SEQ ID NO: 3903529 - RNA, 20 nt, Shigella flexneri 2a str. 301
aggcucaaagacugugccau

SEQ ID NO: 3903530 - RNA, 16 nt, Shigella flexneri 2a str. 301
aggcucucauuuuuca

SEQ ID NO: 3903531 - RNA, 14 nt, Shigella flexneri 2a str. 301
aggcucugauugcc

SEQ ID NO: 3903532 - RNA, 20 nt, Shigella flexneri 2a str. 301
aggcucugauugccuuccac

SEQ ID NO: 3903533 - RNA, 13 nt, Shigella flexneri 2a str. 301
aggcugaugacaa

SEQ ID NO: 3903534 - RNA, 15 nt, Shigella flexneri 2a str. 301
aggcugcaaagucug

SEQ ID NO: 3903535 - RNA, 17 nt, Shigella flexneri 2a str. 301
aggcugccggggagaua

SEQ ID NO: 3903536 - RNA, 20 nt, Shigella flexneri 2a str. 301
aggcugcgaacgguuuucac

SEQ ID NO: 3903537 - RNA, 15 nt, Shigella flexneri 2a str. 301
aggcuggaucagacg

SEQ ID NO: 3903538 - RNA, 20 nt, Shigella flexneri 2a str. 301
aggcuggcuuuaucacugag

SEQ ID NO: 3903539 - RNA, 15 nt, Shigella flexneri 2a str. 301
aggcugguuucucuu

SEQ ID NO: 3903540 - RNA, 16 nt, Shigella flexneri 2a str. 301
aggcuguucccacgca

SEQ ID NO: 3903541 - RNA, 21 nt, Shigella flexneri 2a str. 301
aggcuguuuuuuauacuugca

SEQ ID NO: 3903542 - RNA, 18 nt, Shigella flexneri 2a str. 301
aggcuuagcgcaacaaac

SEQ ID NO: 3903543 - RNA, 16 nt, Shigella flexneri 2a str. 301
aggcuuauccggcaug

SEQ ID NO: 3903544 - RNA, 18 nt, Shigella flexneri 2a str. 301
aggcuucaaucaauaaca

SEQ ID NO: 3903545 - RNA, 16 nt, Shigella flexneri 2a str. 301
aggcuucccaauugca

SEQ ID NO: 3903546 - RNA, 22 nt, Shigella flexneri 2a str. 301
aggcuuuaaacgauuccacuuu

SEQ ID NO: 3903547 - RNA, 19 nt, Shigella flexneri 2a str. 301
aggcuuuaauauccggugc

SEQ ID NO: 3903548 - RNA, 17 nt, Shigella flexneri 2a str. 301
aggcuuuccugauaauc

SEQ ID NO: 3903549 - RNA, 19 nt, Shigella flexneri 2a str. 301
aggcuuuccugauaaucca

SEQ ID NO: 3903550 - RNA, 16 nt, Shigella flexneri 2a str. 301
agggaaacaacaccgu

SEQ ID NO: 3903551 - RNA, 16 nt, Shigella flexneri 2a str. 301
agggaaacggagcaaa

SEQ ID NO: 3903552 - RNA, 19 nt, Shigella flexneri 2a str. 301
agggaaauaaucgggaaua

SEQ ID NO: 3903553 - RNA, 13 nt, Shigella flexneri 2a str. 301
agggaauccagca

SEQ ID NO: 3903554 - RNA, 22 nt, Shigella flexneri 2a str. 301
agggagagggccgggguggggg

SEQ ID NO: 3903555 - RNA, 19 nt, Shigella flexneri 2a str. 301
agggaggggugcaugaaaa

SEQ ID NO: 3903556 - RNA, 22 nt, Shigella flexneri 2a str. 301
agggaucauccacccgcagcaa

SEQ ID NO: 3903557 - RNA, 18 nt, Shigella flexneri 2a str. 301
agggaugaaauagacauu

SEQ ID NO: 3903558 - RNA, 14 nt, Shigella flexneri 2a str. 301
agggcaaacaccgc

SEQ ID NO: 3903559 - RNA, 21 nt, Shigella flexneri 2a str. 301
agggcaaccugcuuuaaaagc

SEQ ID NO: 3903560 - RNA, 20 nt, Shigella flexneri 2a str. 301
agggcaagcgccuaaaucca

SEQ ID NO: 3903561 - RNA, 12 nt, Shigella flexneri 2a str. 301
agguucuuugcu

SEQ ID NO: 3903562 - RNA, 19 nt, Shigella flexneri 2a str. 301
agguucuuugcugccguua

SEQ ID NO: 3903563 - RNA, 15 nt, Shigella flexneri 2a str. 301
agguugacgcugcaa

SEQ ID NO: 3903564 - RNA, 17 nt, Shigella flexneri 2a str. 301
agguugcugcgccccac

SEQ ID NO: 3903565 - RNA, 17 nt, Shigella flexneri 2a str. 301
agguuguagauuuugca

SEQ ID NO: 3903566 - RNA, 14 nt, Shigella flexneri 2a str. 301
agguugugaucauc

SEQ ID NO: 3903567 - RNA, 16 nt, Shigella flexneri 2a str. 301
agguuuaaacagagau

SEQ ID NO: 3903568 - RNA, 17 nt, Shigella flexneri 2a str. 301
agguuuaaccaucaggc

SEQ ID NO: 3903569 - RNA, 16 nt, Shigella flexneri 2a str. 301
agguuuaccagcagcc

SEQ ID NO: 3903570 - RNA, 19 nt, Shigella flexneri 2a str. 301
agguuuaccagcagcccug

SEQ ID NO: 3903571 - RNA, 17 nt, Shigella flexneri 2a str. 301
agguuuauaacggugcu

SEQ ID NO: 3903572 - RNA, 20 nt, Shigella flexneri 2a str. 301
agguuucacguaccagaugc

SEQ ID NO: 3903573 - RNA, 22 nt, Shigella flexneri 2a str. 301
agguuucauagcgucccaguaa

SEQ ID NO: 3903574 - RNA, 15 nt, Shigella flexneri 2a str. 301
agguuuccucaugca

SEQ ID NO: 3903575 - RNA, 16 nt, Shigella flexneri 2a str. 301
agguuuuaguuucgcc

SEQ ID NO: 3903576 - RNA, 14 nt, Shigella flexneri 2a str. 301
agguuuuccuucag

SEQ ID NO: 3903577 - RNA, 20 nt, Shigella flexneri 2a str. 301
agguuuucuuucaccucuuc

SEQ ID NO: 3903578 - RNA, 12 nt, Shigella flexneri 2a str. 301
aguaaaaaaaca

SEQ ID NO: 3903579 - RNA, 16 nt, Shigella flexneri 2a str. 301
aguaaaaaaacaucau

SEQ ID NO: 3903580 - RNA, 17 nt, Shigella flexneri 2a str. 301
aguaaaaaaacaucaua

SEQ ID NO: 3903581 - RNA, 22 nt, Shigella flexneri 2a str. 301
aguaaaacggauaugauuuaaa

SEQ ID NO: 3903582 - RNA, 18 nt, Shigella flexneri 2a str. 301
aguaaacgccgagcugga

SEQ ID NO: 3903583 - RNA, 15 nt, Shigella flexneri 2a str. 301
aguaaacgcuuuuuu

SEQ ID NO: 3903584 - RNA, 14 nt, Shigella flexneri 2a str. 301
aguaaaggaacaag

SEQ ID NO: 3903585 - RNA, 14 nt, Shigella flexneri 2a str. 301
aguaaaggcacaag

SEQ ID NO: 3903586 - RNA, 12 nt, Shigella flexneri 2a str. 301
aguaaaguuacc

SEQ ID NO: 3903587 - RNA, 13 nt, Shigella flexneri 2a str. 301
aguaaauaaccau

SEQ ID NO: 3903588 - RNA, 14 nt, Shigella flexneri 2a str. 301
aguaaauauugucu

SEQ ID NO: 3903589 - RNA, 18 nt, Shigella flexneri 2a str. 301
aguaaaugacagcgaaug

SEQ ID NO: 3903590 - RNA, 10 nt, Shigella flexneri 2a str. 301
aguaaauggu

SEQ ID NO: 3903591 - RNA, 22 nt, Shigella flexneri 2a str. 301
aguaaauucacugccugcugau

SEQ ID NO: 3903592 - RNA, 11 nt, Shigella flexneri 2a str. 301
aguaacaauau

SEQ ID NO: 3903593 - RNA, 21 nt, Shigella flexneri 2a str. 301
aguaacagauuguggugccga

SEQ ID NO: 3903594 - RNA, 15 nt, Shigella flexneri 2a str. 301
aguaacagguuuuga

SEQ ID NO: 3903595 - RNA, 18 nt, Shigella flexneri 2a str. 301
aguaacagguuuugauua

SEQ ID NO: 3903596 - RNA, 15 nt, Shigella flexneri 2a str. 301
aguaacccggcacca

SEQ ID NO: 3903597 - RNA, 22 nt, Shigella flexneri 2a str. 301
aguaaccuuuaucgcgcagcag

SEQ ID NO: 3903598 - RNA, 14 nt, Shigella flexneri 2a str. 301
aguaacguuugauu

SEQ ID NO: 3903599 - RNA, 21 nt, Shigella flexneri 2a str. 301
aguaacguuugauuaacgcca

SEQ ID NO: 3903600 - RNA, 22 nt, Shigella flexneri 2a str. 301
aguaacguuugauuaacgccag

SEQ ID NO: 3903601 - RNA, 15 nt, Shigella flexneri 2a str. 301
aguaacucauugcca

SEQ ID NO: 3903602 - RNA, 17 nt, Shigella flexneri 2a str. 301
aguaaggcgagaauauu

SEQ ID NO: 3903603 - RNA, 23 nt, Shigella flexneri 2a str. 301
aguaaggcugcgagguuauccgc

SEQ ID NO: 3903604 - RNA, 19 nt, Shigella flexneri 2a str. 301
aguaaggguuuuuuuaugc

SEQ ID NO: 3903605 - RNA, 23 nt, Shigella flexneri 2a str. 301
aguaaggguuuuuuuaugcccgc

SEQ ID NO: 3903606 - RNA, 21 nt, Shigella flexneri 2a str. 301
aguaagucuuccggugcauca

SEQ ID NO: 3903607 - RNA, 14 nt, Shigella flexneri 2a str. 301
aguaauaacuuccu

SEQ ID NO: 3903608 - RNA, 18 nt, Shigella flexneri 2a str. 301
aguaauaacuuccugagu

SEQ ID NO: 3903609 - RNA, 22 nt, Shigella flexneri 2a str. 301
aguaauaaugaucaguggaaga

SEQ ID NO: 3903610 - RNA, 15 nt, Shigella flexneri 2a str. 301
aguaauaccagaccu

SEQ ID NO: 3903611 - RNA, 18 nt, Shigella flexneri 2a str. 301
aguaauauccccagccua

SEQ ID NO: 3903612 - RNA, 22 nt, Shigella flexneri 2a str. 301
aguaauauucaacgucacuggg

SEQ ID NO: 3903613 - RNA, 14 nt, Shigella flexneri 2a str. 301
aguaauccuuucuc

SEQ ID NO: 3903614 - RNA, 21 nt, Shigella flexneri 2a str. 301
aguaauccuuucucaauuaac

SEQ ID NO: 3903615 - RNA, 17 nt, Shigella flexneri 2a str. 301
aguaaucgccagcaaaa

SEQ ID NO: 3903616 - RNA, 21 nt, Shigella flexneri 2a str. 301
aguaaucuacugcaccgcagg

SEQ ID NO: 3903617 - RNA, 12 nt, Shigella flexneri 2a str. 301
aguaaugccagu

SEQ ID NO: 3903618 - RNA, 16 nt, Shigella flexneri 2a str. 301
aguaauugcagcagcu

SEQ ID NO: 3903619 - RNA, 21 nt, Shigella flexneri 2a str. 301
aguacaucguagugaugccau

SEQ ID NO: 3903620 - RNA, 13 nt, Shigella flexneri 2a str. 301
aguacauuaaaau

SEQ ID NO: 3903621 - RNA, 18 nt, Shigella flexneri 2a str. 301
aguacauuguuuuccaga

SEQ ID NO: 3903622 - RNA, 15 nt, Shigella flexneri 2a str. 301
aguaccaauggcaau

SEQ ID NO: 3903623 - RNA, 19 nt, Shigella flexneri 2a str. 301
aguaccagcgcacucgcag

SEQ ID NO: 3903624 - RNA, 20 nt, Shigella flexneri 2a str. 301
aguaccagcgcacucgcaga

SEQ ID NO: 3903625 - RNA, 14 nt, Shigella flexneri 2a str. 301
aguaccaucgucca

SEQ ID NO: 3903626 - RNA, 20 nt, Shigella flexneri 2a str. 301
aguaccaucguccagcagca

SEQ ID NO: 3903627 - RNA, 18 nt, Shigella flexneri 2a str. 301
aguaccauugaagcaauc

SEQ ID NO: 3903628 - RNA, 21 nt, Shigella flexneri 2a str. 301
aguaccauuuucgcuggcaga

SEQ ID NO: 3903629 - RNA, 18 nt, Shigella flexneri 2a str. 301
aguacccaugugauuuaa

SEQ ID NO: 3903630 - RNA, 22 nt, Shigella flexneri 2a str. 301
aguacccgaugcgcgaacugga

SEQ ID NO: 3903631 - RNA, 20 nt, Shigella flexneri 2a str. 301
aguacccggccuguuuaucc

SEQ ID NO: 3903632 - RNA, 19 nt, Shigella flexneri 2a str. 301
aguaccgaacggagucggg

SEQ ID NO: 3903633 - RNA, 20 nt, Shigella flexneri 2a str. 301
aguaccuccuucacaguggc

SEQ ID NO: 3903634 - RNA, 14 nt, Shigella flexneri 2a str. 301
aguacgaaauaacu

SEQ ID NO: 3903635 - RNA, 15 nt, Shigella flexneri 2a str. 301
aguacgaaauaacug

SEQ ID NO: 3903636 - RNA, 16 nt, Shigella flexneri 2a str. 301
aguacgccaucacgca

SEQ ID NO: 3903637 - RNA, 20 nt, Shigella flexneri 2a str. 301
aguacgcccacgccagccug

SEQ ID NO: 3903638 - RNA, 18 nt, Shigella flexneri 2a str. 301
aguacgcguacacuuucc

SEQ ID NO: 3903639 - RNA, 19 nt, Shigella flexneri 2a str. 301
aguacgcguacacuuuccu

SEQ ID NO: 3903640 - RNA, 15 nt, Shigella flexneri 2a str. 301
aguacgcuuucccuu

SEQ ID NO: 3903641 - RNA, 13 nt, Shigella flexneri 2a str. 301
aguacggcagcaa

SEQ ID NO: 3903642 - RNA, 15 nt, Shigella flexneri 2a str. 301
aguacggcagcaauc

SEQ ID NO: 3903643 - RNA, 14 nt, Shigella flexneri 2a str. 301
aguacggccacugg

SEQ ID NO: 3903644 - RNA, 16 nt, Shigella flexneri 2a str. 301
aguacgggcagcgcau

SEQ ID NO: 3903645 - RNA, 23 nt, Shigella flexneri 2a str. 301
aguacguaaaacaagaucgcccu

SEQ ID NO: 3903646 - RNA, 14 nt, Shigella flexneri 2a str. 301
aguacguucacgca

SEQ ID NO: 3903647 - RNA, 18 nt, Shigella flexneri 2a str. 301
aguacugaugaauaaaua

SEQ ID NO: 3903648 - RNA, 23 nt, Shigella flexneri 2a str. 301
aguacugugaaccucgaucagag

SEQ ID NO: 3903649 - RNA, 15 nt, Shigella flexneri 2a str. 301
aguagaaauuauuuc

SEQ ID NO: 3903650 - RNA, 21 nt, Shigella flexneri 2a str. 301
aguagagugguuuuucaacau

SEQ ID NO: 3903651 - RNA, 22 nt, Shigella flexneri 2a str. 301
aguagauacccggauacaacuc

SEQ ID NO: 3903652 - RNA, 13 nt, Shigella flexneri 2a str. 301
aguagaucaacac

SEQ ID NO: 3903653 - RNA, 17 nt, Shigella flexneri 2a str. 301
aguagaucuugauuuac

SEQ ID NO: 3903654 - RNA, 16 nt, Shigella flexneri 2a str. 301
aguagcaaucggcuuu

SEQ ID NO: 3903655 - RNA, 20 nt, Shigella flexneri 2a str. 301
aguagccaauaccaaaauca

SEQ ID NO: 3903656 - RNA, 15 nt, Shigella flexneri 2a str. 301
aguagccaguaccac

SEQ ID NO: 3903657 - RNA, 20 nt, Shigella flexneri 2a str. 301
aguagcccaccuacaccggc

SEQ ID NO: 3903658 - RNA, 23 nt, Shigella flexneri 2a str. 301
aguagcuauaaaccugcuggcgc

SEQ ID NO: 3903659 - RNA, 17 nt, Shigella flexneri 2a str. 301
aguagguagaauauuuu

SEQ ID NO: 3903660 - RNA, 23 nt, Shigella flexneri 2a str. 301
aguagugauuuuaauaaaucacg

SEQ ID NO: 3903661 - RNA, 17 nt, Shigella flexneri 2a str. 301
aguaguucauccagugc

SEQ ID NO: 3903662 - RNA, 16 nt, Shigella flexneri 2a str. 301
aguaguucauccccuc

SEQ ID NO: 3903663 - RNA, 15 nt, Shigella flexneri 2a str. 301
aguaguuccagcaug

SEQ ID NO: 3903664 - RNA, 15 nt, Shigella flexneri 2a str. 301
aguauaacuacugau

SEQ ID NO: 3903665 - RNA, 17 nt, Shigella flexneri 2a str. 301
aguauauaaaaaacaau

SEQ ID NO: 3903666 - RNA, 12 nt, Shigella flexneri 2a str. 301
aguaucaauuau

SEQ ID NO: 3903667 - RNA, 12 nt, Shigella flexneri 2a str. 301
aguaucaccauc

SEQ ID NO: 3903668 - RNA, 22 nt, Shigella flexneri 2a str. 301
aguauccacacagacaauaaac

SEQ ID NO: 3903669 - RNA, 13 nt, Shigella flexneri 2a str. 301
aguauccacacca

SEQ ID NO: 3903670 - RNA, 12 nt, Shigella flexneri 2a str. 301
aguaucggcaag

SEQ ID NO: 3903671 - RNA, 11 nt, Shigella flexneri 2a str. 301
aguaucuauuc

SEQ ID NO: 3903672 - RNA, 14 nt, Shigella flexneri 2a str. 301
aguaucuauucauc

SEQ ID NO: 3903673 - RNA, 22 nt, Shigella flexneri 2a str. 301
aguaugacaacuuucaucagca

SEQ ID NO: 3903674 - RNA, 16 nt, Shigella flexneri 2a str. 301
aguaugacuuuaugcu

SEQ ID NO: 3903675 - RNA, 16 nt, Shigella flexneri 2a str. 301
aguaugagcaaacaau

SEQ ID NO: 3903676 - RNA, 13 nt, Shigella flexneri 2a str. 301
aguaugaucuugc

SEQ ID NO: 3903677 - RNA, 17 nt, Shigella flexneri 2a str. 301
aguaugcaauaacaaua

SEQ ID NO: 3903678 - RNA, 18 nt, Shigella flexneri 2a str. 301
aguauggaucaaaucucg

SEQ ID NO: 3903679 - RNA, 22 nt, Shigella flexneri 2a str. 301
aguauuaagccaguucucacca

SEQ ID NO: 3903680 - RNA, 15 nt, Shigella flexneri 2a str. 301
aguauuaccggcaga

SEQ ID NO: 3903681 - RNA, 18 nt, Shigella flexneri 2a str. 301
aguauucgcuccccugca

SEQ ID NO: 3903682 - RNA, 18 nt, Shigella flexneri 2a str. 301
aguauugcgcaaauguuu

SEQ ID NO: 3903683 - RNA, 22 nt, Shigella flexneri 2a str. 301
aguauugucuccgcugagacgc

SEQ ID NO: 3903684 - RNA, 13 nt, Shigella flexneri 2a str. 301
aguauuuccagcu

SEQ ID NO: 3903685 - RNA, 19 nt, Shigella flexneri 2a str. 301
aguauuuggcggaauuucu

SEQ ID NO: 3903686 - RNA, 21 nt, Shigella flexneri 2a str. 301
agucaaaaugcccgaucuagg

SEQ ID NO: 3903687 - RNA, 19 nt, Shigella flexneri 2a str. 301
agucaacaagcaaauguua

SEQ ID NO: 3903688 - RNA, 22 nt, Shigella flexneri 2a str. 301
agucaacgucauuaucugcaga

SEQ ID NO: 3903689 - RNA, 14 nt, Shigella flexneri 2a str. 301
agucaauuucugca

SEQ ID NO: 3903690 - RNA, 15 nt, Shigella flexneri 2a str. 301
agucaauuucugcaa

SEQ ID NO: 3903691 - RNA, 19 nt, Shigella flexneri 2a str. 301
agucaauuucugcaaaaua

SEQ ID NO: 3903692 - RNA, 15 nt, Shigella flexneri 2a str. 301
agucacaaacaucau

SEQ ID NO: 3903693 - RNA, 18 nt, Shigella flexneri 2a str. 301
agucacaaacaucaugcc

SEQ ID NO: 3903694 - RNA, 14 nt, Shigella flexneri 2a str. 301
agucacaaaucucc

SEQ ID NO: 3903695 - RNA, 16 nt, Shigella flexneri 2a str. 301
agucacgacaaagaca

SEQ ID NO: 3903696 - RNA, 20 nt, Shigella flexneri 2a str. 301
agucacggaaucccguaauc

SEQ ID NO: 3903697 - RNA, 23 nt, Shigella flexneri 2a str. 301
agucacguuguaccacugguuga

SEQ ID NO: 3903698 - RNA, 12 nt, Shigella flexneri 2a str. 301
agucacuucaca

SEQ ID NO: 3903699 - RNA, 14 nt, Shigella flexneri 2a str. 301
agucacuuuuuucc

SEQ ID NO: 3903700 - RNA, 14 nt, Shigella flexneri 2a str. 301
agucagaaacugua

SEQ ID NO: 3903701 - RNA, 19 nt, Shigella flexneri 2a str. 301
agucaggcaugaucagcgu

SEQ ID NO: 3903702 - RNA, 16 nt, Shigella flexneri 2a str. 301
agucaguggcagcaaa

SEQ ID NO: 3903703 - RNA, 14 nt, Shigella flexneri 2a str. 301
agucaguuaagcaa

SEQ ID NO: 3903704 - RNA, 16 nt, Shigella flexneri 2a str. 301
agucaucacuuucaga

SEQ ID NO: 3903705 - RNA, 17 nt, Shigella flexneri 2a str. 301
agucaucacuuucagac

SEQ ID NO: 3903706 - RNA, 19 nt, Shigella flexneri 2a str. 301
agucaucacuuucagaccg

SEQ ID NO: 3903707 - RNA, 14 nt, Shigella flexneri 2a str. 301
agucaucaguugca

SEQ ID NO: 3903708 - RNA, 20 nt, Shigella flexneri 2a str. 301
agucaucaguugcaccugau

SEQ ID NO: 3903709 - RNA, 12 nt, Shigella flexneri 2a str. 301
agucaucaucag

SEQ ID NO: 3903710 - RNA, 16 nt, Shigella flexneri 2a str. 301
agucauccggcucgua

SEQ ID NO: 3903711 - RNA, 21 nt, Shigella flexneri 2a str. 301
agucauccucucgggcgguua

SEQ ID NO: 3903712 - RNA, 20 nt, Shigella flexneri 2a str. 301
agucauccuuaaagaaaaag

SEQ ID NO: 3903713 - RNA, 16 nt, Shigella flexneri 2a str. 301
agucaucgcuuucgga

SEQ ID NO: 3903714 - RNA, 16 nt, Shigella flexneri 2a str. 301
agucaugaaauauaga

SEQ ID NO: 3903715 - RNA, 20 nt, Shigella flexneri 2a str. 301
agucauguuguuccuuuuau

SEQ ID NO: 3903716 - RNA, 16 nt, Shigella flexneri 2a str. 301
agucauuacccgugcu

SEQ ID NO: 3903717 - RNA, 19 nt, Shigella flexneri 2a str. 301
agucauuaccgaacaacaa

SEQ ID NO: 3903718 - RNA, 22 nt, Shigella flexneri 2a str. 301
agucauuaccugaaaaaacaaa

SEQ ID NO: 3903719 - RNA, 16 nt, Shigella flexneri 2a str. 301
agucauuaugcuggaa

SEQ ID NO: 3903720 - RNA, 14 nt, Shigella flexneri 2a str. 301
agucauuccuucaa

SEQ ID NO: 3903721 - RNA, 18 nt, Shigella flexneri 2a str. 301
agucauugagcuucucga

SEQ ID NO: 3903722 - RNA, 22 nt, Shigella flexneri 2a str. 301
agucauugauucgaucaaacaa

SEQ ID NO: 3903723 - RNA, 21 nt, Shigella flexneri 2a str. 301
aguccacguucaaaacgguga

SEQ ID NO: 3903724 - RNA, 22 nt, Shigella flexneri 2a str. 301
aguccagccccgcgcggcgcag

SEQ ID NO: 3903725 - RNA, 14 nt, Shigella flexneri 2a str. 301
aguccagcgccuga

SEQ ID NO: 3903726 - RNA, 18 nt, Shigella flexneri 2a str. 301
aguccauacccagcauca

SEQ ID NO: 3903727 - RNA, 15 nt, Shigella flexneri 2a str. 301
aguccaucggcggcu

SEQ ID NO: 3903728 - RNA, 15 nt, Shigella flexneri 2a str. 301
agucccaaacagcag

SEQ ID NO: 3903729 - RNA, 16 nt, Shigella flexneri 2a str. 301
agucccaggcagaagc

SEQ ID NO: 3903730 - RNA, 15 nt, Shigella flexneri 2a str. 301
aguccccacaucacu

SEQ ID NO: 3903731 - RNA, 23 nt, Shigella flexneri 2a str. 301
aguccccacgccauaccugcaca

SEQ ID NO: 3903732 - RNA, 14 nt, Shigella flexneri 2a str. 301
aguccccaguaauc

SEQ ID NO: 3903733 - RNA, 21 nt, Shigella flexneri 2a str. 301
agucccgcgacaaucgccccc

SEQ ID NO: 3903734 - RNA, 19 nt, Shigella flexneri 2a str. 301
agucccgcgauggcccggc

SEQ ID NO: 3903735 - RNA, 14 nt, Shigella flexneri 2a str. 301
agucccggcaagau

SEQ ID NO: 3903736 - RNA, 22 nt, Shigella flexneri 2a str. 301
agucccuugauaaacgccgcca

SEQ ID NO: 3903737 - RNA, 14 nt, Shigella flexneri 2a str. 301
agucccuuucaggu

SEQ ID NO: 3903738 - RNA, 22 nt, Shigella flexneri 2a str. 301
agucccuuucccaccggcaaug

SEQ ID NO: 3903739 - RNA, 14 nt, Shigella flexneri 2a str. 301
aguccgccuucaac

SEQ ID NO: 3903740 - RNA, 18 nt, Shigella flexneri 2a str. 301
aguccgcgcuugccgccg

SEQ ID NO: 3903741 - RNA, 19 nt, Shigella flexneri 2a str. 301
aguccgcgcuugccgccgg

SEQ ID NO: 3903742 - RNA, 22 nt, Shigella flexneri 2a str. 301
aguccggcugcgauauucggaa

SEQ ID NO: 3903743 - RNA, 17 nt, Shigella flexneri 2a str. 301
aguccggcuuuucgaca

SEQ ID NO: 3903744 - RNA, 12 nt, Shigella flexneri 2a str. 301
aguccguugaaa

SEQ ID NO: 3903745 - RNA, 21 nt, Shigella flexneri 2a str. 301
aguccguugaaaaugcugguu

SEQ ID NO: 3903746 - RNA, 20 nt, Shigella flexneri 2a str. 301
aguccugaccgucaccccau

SEQ ID NO: 3903747 - RNA, 15 nt, Shigella flexneri 2a str. 301
aguccugagucagaa

SEQ ID NO: 3903748 - RNA, 15 nt, Shigella flexneri 2a str. 301
aguccuguugucuuu

SEQ ID NO: 3903749 - RNA, 21 nt, Shigella flexneri 2a str. 301
aguccuguugucuuuccagac

SEQ ID NO: 3903750 - RNA, 13 nt, Shigella flexneri 2a str. 301
agucgacuucaga

SEQ ID NO: 3903751 - RNA, 12 nt, Shigella flexneri 2a str. 301
agucgccugcuu

SEQ ID NO: 3903752 - RNA, 16 nt, Shigella flexneri 2a str. 301
agucgcgcaauugcca

SEQ ID NO: 3903753 - RNA, 16 nt, Shigella flexneri 2a str. 301
agucgcgccuuacgcu

SEQ ID NO: 3903754 - RNA, 20 nt, Shigella flexneri 2a str. 301
agucgcgguccgggccgcaa

SEQ ID NO: 3903755 - RNA, 19 nt, Shigella flexneri 2a str. 301
agucgcuccugccacauau

SEQ ID NO: 3903756 - RNA, 21 nt, Shigella flexneri 2a str. 301
agucgcuugcaggaucagcuc

SEQ ID NO: 3903757 - RNA, 16 nt, Shigella flexneri 2a str. 301
agucggcagaugaaaa

SEQ ID NO: 3903758 - RNA, 15 nt, Shigella flexneri 2a str. 301
agucggcaucgccac

SEQ ID NO: 3903759 - RNA, 19 nt, Shigella flexneri 2a str. 301
agucgggauauucagcuca

SEQ ID NO: 3903760 - RNA, 20 nt, Shigella flexneri 2a str. 301
agucgggucgccguaagcaa

SEQ ID NO: 3903761 - RNA, 18 nt, Shigella flexneri 2a str. 301
agugucuuaucuggcauu

SEQ ID NO: 3903762 - RNA, 16 nt, Shigella flexneri 2a str. 301
aguguggccagagugc

SEQ ID NO: 3903763 - RNA, 16 nt, Shigella flexneri 2a str. 301
agugugggaaaaauug

SEQ ID NO: 3903764 - RNA, 21 nt, Shigella flexneri 2a str. 301
agugugggaucacaucuucaa

SEQ ID NO: 3903765 - RNA, 21 nt, Shigella flexneri 2a str. 301
aguguggggaaugauauuuuc

SEQ ID NO: 3903766 - RNA, 21 nt, Shigella flexneri 2a str. 301
aguguguauggcauugucuga

SEQ ID NO: 3903767 - RNA, 14 nt, Shigella flexneri 2a str. 301
aguguuaccuucau

SEQ ID NO: 3903768 - RNA, 17 nt, Shigella flexneri 2a str. 301
aguguuauucccaacgc

SEQ ID NO: 3903769 - RNA, 21 nt, Shigella flexneri 2a str. 301
aguguucuggcgacagcgaaa

SEQ ID NO: 3903770 - RNA, 16 nt, Shigella flexneri 2a str. 301
aguguuggaucugauc

SEQ ID NO: 3903771 - RNA, 17 nt, Shigella flexneri 2a str. 301
aguguuggauggcggcu

SEQ ID NO: 3903772 - RNA, 21 nt, Shigella flexneri 2a str. 301
aguguuggcgucagaccggca

SEQ ID NO: 3903773 - RNA, 19 nt, Shigella flexneri 2a str. 301
aguguuucgacaauaauca

SEQ ID NO: 3903774 - RNA, 17 nt, Shigella flexneri 2a str. 301
aguguuuuauguucaga

SEQ ID NO: 3903775 - RNA, 20 nt, Shigella flexneri 2a str. 301
aguguuuuauguucagauaa

SEQ ID NO: 3903776 - RNA, 21 nt, Shigella flexneri 2a str. 301
aguguuuuauguucagauaau

SEQ ID NO: 3903777 - RNA, 16 nt, Shigella flexneri 2a str. 301
aguguuuugaggugua

SEQ ID NO: 3903778 - RNA, 19 nt, Shigella flexneri 2a str. 301
aguuaaaggugguguugac

SEQ ID NO: 3903779 - RNA, 20 nt, Shigella flexneri 2a str. 301
aguuaaccaaaaauuuccac

SEQ ID NO: 3903780 - RNA, 20 nt, Shigella flexneri 2a str. 301
aguuaaccugaaaccggaaa

SEQ ID NO: 3903781 - RNA, 16 nt, Shigella flexneri 2a str. 301
aguuaauccacagcaa

SEQ ID NO: 3903782 - RNA, 17 nt, Shigella flexneri 2a str. 301
aguuacagcucucacuu

SEQ ID NO: 3903783 - RNA, 13 nt, Shigella flexneri 2a str. 301
aguuaccuguggc

SEQ ID NO: 3903784 - RNA, 14 nt, Shigella flexneri 2a str. 301
aguuacgugcugcg

SEQ ID NO: 3903785 - RNA, 20 nt, Shigella flexneri 2a str. 301
aguuagcaaggauguggcua

SEQ ID NO: 3903786 - RNA, 15 nt, Shigella flexneri 2a str. 301
aguuagucgcuuuca

SEQ ID NO: 3903787 - RNA, 15 nt, Shigella flexneri 2a str. 301
aguuagucugggcga

SEQ ID NO: 3903788 - RNA, 21 nt, Shigella flexneri 2a str. 301
aguuauacagacucaaaccaa

SEQ ID NO: 3903789 - RNA, 21 nt, Shigella flexneri 2a str. 301
aguuaucgcgauacaccagau

SEQ ID NO: 3903790 - RNA, 22 nt, Shigella flexneri 2a str. 301
aguucaacgcccgcuuucacca

SEQ ID NO: 3903791 - RNA, 21 nt, Shigella flexneri 2a str. 301
aguucaacgccgcuaucagau

SEQ ID NO: 3903792 - RNA, 10 nt, Shigella flexneri 2a str. 301
aguucaacgg

SEQ ID NO: 3903793 - RNA, 17 nt, Shigella flexneri 2a str. 301
aguucaacggugucgau

SEQ ID NO: 3903794 - RNA, 12 nt, Shigella flexneri 2a str. 301
aguucaagugcu

SEQ ID NO: 3903795 - RNA, 23 nt, Shigella flexneri 2a str. 301
aguucaauuggccugauaagaca

SEQ ID NO: 3903796 - RNA, 14 nt, Shigella flexneri 2a str. 301
aguucacagcgcag

SEQ ID NO: 3903797 - RNA, 17 nt, Shigella flexneri 2a str. 301
aguucacgcagcuucuc

SEQ ID NO: 3903798 - RNA, 19 nt, Shigella flexneri 2a str. 301
aguucacgcgauuucucau

SEQ ID NO: 3903799 - RNA, 12 nt, Shigella flexneri 2a str. 301
aguucacugccg

SEQ ID NO: 3903800 - RNA, 20 nt, Shigella flexneri 2a str. 301
aguucacugccguacaggca

SEQ ID NO: 3903801 - RNA, 23 nt, Shigella flexneri 2a str. 301
aguucacuugugcuguguggccu

SEQ ID NO: 3903802 - RNA, 14 nt, Shigella flexneri 2a str. 301
aguucagaaagcac

SEQ ID NO: 3903803 - RNA, 12 nt, Shigella flexneri 2a str. 301
aguucaucaacg

SEQ ID NO: 3903804 - RNA, 14 nt, Shigella flexneri 2a str. 301
aguucauccagugc

SEQ ID NO: 3903805 - RNA, 15 nt, Shigella flexneri 2a str. 301
aguucauuaagcugc

SEQ ID NO: 3903806 - RNA, 20 nt, Shigella flexneri 2a str. 301
aguuccacauaaaguagcca

SEQ ID NO: 3903807 - RNA, 18 nt, Shigella flexneri 2a str. 301
aguuccacuauuucaaua

SEQ ID NO: 3903808 - RNA, 13 nt, Shigella flexneri 2a str. 301
aguuccagcauga

SEQ ID NO: 3903809 - RNA, 20 nt, Shigella flexneri 2a str. 301
aguuccagggcagcaguuca

SEQ ID NO: 3903810 - RNA, 13 nt, Shigella flexneri 2a str. 301
aguuccaguucau

SEQ ID NO: 3903811 - RNA, 22 nt, Shigella flexneri 2a str. 301
aguucccuacucucgcaugggg

SEQ ID NO: 3903812 - RNA, 21 nt, Shigella flexneri 2a str. 301
aguuccgcaaagcccaucacc

SEQ ID NO: 3903813 - RNA, 23 nt, Shigella flexneri 2a str. 301
aguuccgcuucgccaaugugggu

SEQ ID NO: 3903814 - RNA, 19 nt, Shigella flexneri 2a str. 301
aguuccgggaucaccagac

SEQ ID NO: 3903815 - RNA, 22 nt, Shigella flexneri 2a str. 301
aguuccgggaucugauucugau

SEQ ID NO: 3903816 - RNA, 15 nt, Shigella flexneri 2a str. 301
aguuccgugagcgga

SEQ ID NO: 3903817 - RNA, 16 nt, Shigella flexneri 2a str. 301
aguuccuacugcuccu

SEQ ID NO: 3903818 - RNA, 22 nt, Shigella flexneri 2a str. 301
aguuccugcaacuucucuuucg

SEQ ID NO: 3903819 - RNA, 14 nt, Shigella flexneri 2a str. 301
aguucgagaaaaau

SEQ ID NO: 3903820 - RNA, 15 nt, Shigella flexneri 2a str. 301
aguucgccaucaaau

SEQ ID NO: 3903821 - RNA, 16 nt, Shigella flexneri 2a str. 301
aguucgcgaaaguuac

SEQ ID NO: 3903822 - RNA, 18 nt, Shigella flexneri 2a str. 301
aguucgucgcguuugccc

SEQ ID NO: 3903823 - RNA, 19 nt, Shigella flexneri 2a str. 301
aguucguugguguccacgc

SEQ ID NO: 3903824 - RNA, 18 nt, Shigella flexneri 2a str. 301
aguucuacaaucugcccg

SEQ ID NO: 3903825 - RNA, 22 nt, Shigella flexneri 2a str. 301
aguucugcagcccgaacgguca

SEQ ID NO: 3903826 - RNA, 16 nt, Shigella flexneri 2a str. 301
aguucugccaggcugg

SEQ ID NO: 3903827 - RNA, 14 nt, Shigella flexneri 2a str. 301
aguucuucaaaaau

SEQ ID NO: 3903828 - RNA, 20 nt, Shigella flexneri 2a str. 301
aguucuuucucugcaaauau

SEQ ID NO: 3903829 - RNA, 23 nt, Shigella flexneri 2a str. 301
aguucuuuuauuguuaaguuuau

SEQ ID NO: 3903830 - RNA, 14 nt, Shigella flexneri 2a str. 301
aguugaaaaacaug

SEQ ID NO: 3903831 - RNA, 13 nt, Shigella flexneri 2a str. 301
aguugaucaaaua

SEQ ID NO: 3903832 - RNA, 13 nt, Shigella flexneri 2a str. 301
aguugaucaccag

SEQ ID NO: 3903833 - RNA, 14 nt, Shigella flexneri 2a str. 301
aguugaucaccagu

SEQ ID NO: 3903834 - RNA, 13 nt, Shigella flexneri 2a str. 301
aguugaucgccaa

SEQ ID NO: 3903835 - RNA, 17 nt, Shigella flexneri 2a str. 301
aguugauuaauuucauu

SEQ ID NO: 3903836 - RNA, 23 nt, Shigella flexneri 2a str. 301
aguugauuacacaaauccagcac

SEQ ID NO: 3903837 - RNA, 18 nt, Shigella flexneri 2a str. 301
aguugauucggccaguaa

SEQ ID NO: 3903838 - RNA, 20 nt, Shigella flexneri 2a str. 301
aguugauucggccaguaacc

SEQ ID NO: 3903839 - RNA, 21 nt, Shigella flexneri 2a str. 301
aguugauuggcgcgaaccauc

SEQ ID NO: 3903840 - RNA, 21 nt, Shigella flexneri 2a str. 301
aguugcagcaacucuuuuucc

SEQ ID NO: 3903841 - RNA, 16 nt, Shigella flexneri 2a str. 301
aguugcagcaagccau

SEQ ID NO: 3903842 - RNA, 17 nt, Shigella flexneri 2a str. 301
aguugcagcgucaucaa

SEQ ID NO: 3903843 - RNA, 14 nt, Shigella flexneri 2a str. 301
aguugccacccggc

SEQ ID NO: 3903844 - RNA, 17 nt, Shigella flexneri 2a str. 301
aguugccacccggcuga

SEQ ID NO: 3903845 - RNA, 14 nt, Shigella flexneri 2a str. 301
aguugcucucaaag

SEQ ID NO: 3903846 - RNA, 18 nt, Shigella flexneri 2a str. 301
aguugcucugcagcagcc

SEQ ID NO: 3903847 - RNA, 15 nt, Shigella flexneri 2a str. 301
aguugcuucaucuca

SEQ ID NO: 3903848 - RNA, 19 nt, Shigella flexneri 2a str. 301
aguugcuucaucucaguga

SEQ ID NO: 3903849 - RNA, 15 nt, Shigella flexneri 2a str. 301
aguuggcagaauuug

SEQ ID NO: 3903850 - RNA, 18 nt, Shigella flexneri 2a str. 301
aguuguaaucauauuaaa

SEQ ID NO: 3903851 - RNA, 23 nt, Shigella flexneri 2a str. 301
aguuguaaucauauuaaauuuuu

SEQ ID NO: 3903852 - RNA, 20 nt, Shigella flexneri 2a str. 301
aguugucgauaaacaguuuc

SEQ ID NO: 3903853 - RNA, 16 nt, Shigella flexneri 2a str. 301
aguugugcaccaccaa

SEQ ID NO: 3903854 - RNA, 16 nt, Shigella flexneri 2a str. 301
aguuguucaacaguaa

SEQ ID NO: 3903855 - RNA, 23 nt, Shigella flexneri 2a str. 301
aguuguugauaauuagugcugcu

SEQ ID NO: 3903856 - RNA, 13 nt, Shigella flexneri 2a str. 301
aguuguugcugaa

SEQ ID NO: 3903857 - RNA, 16 nt, Shigella flexneri 2a str. 301
aguuguugcugaauuu

SEQ ID NO: 3903858 - RNA, 15 nt, Shigella flexneri 2a str. 301
aguuguuuacaguau

SEQ ID NO: 3903859 - RNA, 15 nt, Shigella flexneri 2a str. 301
aguuuaauucuuuga

SEQ ID NO: 3903860 - RNA, 15 nt, Shigella flexneri 2a str. 301
aguuuaauugccauu

SEQ ID NO: 3903861 - RNA, 19 nt, Shigella flexneri 2a str. 301
auaacaccagccagaauua

SEQ ID NO: 3903862 - RNA, 20 nt, Shigella flexneri 2a str. 301
auaacaccgauuuuguaaaa

SEQ ID NO: 3903863 - RNA, 22 nt, Shigella flexneri 2a str. 301
auaacaccgauuuuguaaaaga

SEQ ID NO: 3903864 - RNA, 18 nt, Shigella flexneri 2a str. 301
auaacacgguaaugacuc

SEQ ID NO: 3903865 - RNA, 10 nt, Shigella flexneri 2a str. 301
auaacagaau

SEQ ID NO: 3903866 - RNA, 23 nt, Shigella flexneri 2a str. 301
auaacagaccuuucgaacccaac

SEQ ID NO: 3903867 - RNA, 11 nt, Shigella flexneri 2a str. 301
auaacagagcg

SEQ ID NO: 3903868 - RNA, 18 nt, Shigella flexneri 2a str. 301
auaacagagcgaaggaga

SEQ ID NO: 3903869 - RNA, 15 nt, Shigella flexneri 2a str. 301
auaacagcccgccaa

SEQ ID NO: 3903870 - RNA, 14 nt, Shigella flexneri 2a str. 301
auaaccaaaugacu

SEQ ID NO: 3903871 - RNA, 23 nt, Shigella flexneri 2a str. 301
auaaccaacggcgagccagcgca

SEQ ID NO: 3903872 - RNA, 21 nt, Shigella flexneri 2a str. 301
auaaccaauguggguguuaag

SEQ ID NO: 3903873 - RNA, 23 nt, Shigella flexneri 2a str. 301
auaaccacguucauuucauacag

SEQ ID NO: 3903874 - RNA, 21 nt, Shigella flexneri 2a str. 301
auaaccagcguuuccagcacc

SEQ ID NO: 3903875 - RNA, 12 nt, Shigella flexneri 2a str. 301
auaaccaucagc

SEQ ID NO: 3903876 - RNA, 10 nt, Shigella flexneri 2a str. 301
auaaccaucg

SEQ ID NO: 3903877 - RNA, 18 nt, Shigella flexneri 2a str. 301
auaaccauuccacgggca

SEQ ID NO: 3903878 - RNA, 15 nt, Shigella flexneri 2a str. 301
auaacccaguacaac

SEQ ID NO: 3903879 - RNA, 20 nt, Shigella flexneri 2a str. 301
auaacccgcuguaaaugcug

SEQ ID NO: 3903880 - RNA, 16 nt, Shigella flexneri 2a str. 301
auaaccgcaaaaccaa

SEQ ID NO: 3903881 - RNA, 20 nt, Shigella flexneri 2a str. 301
auaaccgcaaaaccaacgcc

SEQ ID NO: 3903882 - RNA, 20 nt, Shigella flexneri 2a str. 301
auaaccgguauuacuccaga

SEQ ID NO: 3903883 - RNA, 22 nt, Shigella flexneri 2a str. 301
auaaccguacgcaucaccagac

SEQ ID NO: 3903884 - RNA, 17 nt, Shigella flexneri 2a str. 301
auaaccucuuucuuugc

SEQ ID NO: 3903885 - RNA, 18 nt, Shigella flexneri 2a str. 301
auaaccugaauauuagua

SEQ ID NO: 3903886 - RNA, 17 nt, Shigella flexneri 2a str. 301
auaaccugcaaaauagu

SEQ ID NO: 3903887 - RNA, 13 nt, Shigella flexneri 2a str. 301
auaacgcgucuca

SEQ ID NO: 3903888 - RNA, 21 nt, Shigella flexneri 2a str. 301
auaacgcuccuacaccgaaca

SEQ ID NO: 3903889 - RNA, 13 nt, Shigella flexneri 2a str. 301
auaacgcuggcag

SEQ ID NO: 3903890 - RNA, 22 nt, Shigella flexneri 2a str. 301
auaacggaggacuuauggcugg

SEQ ID NO: 3903891 - RNA, 15 nt, Shigella flexneri 2a str. 301
auaacggugcaaccc

SEQ ID NO: 3903892 - RNA, 23 nt, Shigella flexneri 2a str. 301
auaacggugcaacccgccagguu

SEQ ID NO: 3903893 - RNA, 22 nt, Shigella flexneri 2a str. 301
auaacguaaugcuuauuucacc

SEQ ID NO: 3903894 - RNA, 19 nt, Shigella flexneri 2a str. 301
auaacgugacggcuuuuuu

SEQ ID NO: 3903895 - RNA, 15 nt, Shigella flexneri 2a str. 301
auaacguuauauccc

SEQ ID NO: 3903896 - RNA, 19 nt, Shigella flexneri 2a str. 301
auaacguugaugcaggcag

SEQ ID NO: 3903897 - RNA, 13 nt, Shigella flexneri 2a str. 301
auaacuacugaug

SEQ ID NO: 3903898 - RNA, 17 nt, Shigella flexneri 2a str. 301
auaacucccuauaaugc

SEQ ID NO: 3903899 - RNA, 21 nt, Shigella flexneri 2a str. 301
auaacucucuuuugcuugaca

SEQ ID NO: 3903900 - RNA, 16 nt, Shigella flexneri 2a str. 301
auaacugaauaauaca

SEQ ID NO: 3903901 - RNA, 12 nt, Shigella flexneri 2a str. 301
auaacugcuauu

SEQ ID NO: 3903902 - RNA, 20 nt, Shigella flexneri 2a str. 301
auaacuucacuaaucaauuu

SEQ ID NO: 3903903 - RNA, 12 nt, Shigella flexneri 2a str. 301
auaacuuccuga

SEQ ID NO: 3903904 - RNA, 13 nt, Shigella flexneri 2a str. 301
auaacuuccugag

SEQ ID NO: 3903905 - RNA, 16 nt, Shigella flexneri 2a str. 301
auaagaagcuuuucuc

SEQ ID NO: 3903906 - RNA, 19 nt, Shigella flexneri 2a str. 301
auaagacagcgucacauca

SEQ ID NO: 3903907 - RNA, 17 nt, Shigella flexneri 2a str. 301
auaagacgcguuagcau

SEQ ID NO: 3903908 - RNA, 19 nt, Shigella flexneri 2a str. 301
auaagacuggcaaaugaca

SEQ ID NO: 3903909 - RNA, 20 nt, Shigella flexneri 2a str. 301
auaagacuggcaaaugacau

SEQ ID NO: 3903910 - RNA, 22 nt, Shigella flexneri 2a str. 301
auaagacuggcaaaugacauaa

SEQ ID NO: 3903911 - RNA, 19 nt, Shigella flexneri 2a str. 301
auaagauaacccugcauau

SEQ ID NO: 3903912 - RNA, 17 nt, Shigella flexneri 2a str. 301
auaagaugcuacaacau

SEQ ID NO: 3903913 - RNA, 14 nt, Shigella flexneri 2a str. 301
auaagcacuacucu

SEQ ID NO: 3903914 - RNA, 17 nt, Shigella flexneri 2a str. 301
auaagcaucuauuauug

SEQ ID NO: 3903915 - RNA, 16 nt, Shigella flexneri 2a str. 301
auaagccaaauccagc

SEQ ID NO: 3903916 - RNA, 17 nt, Shigella flexneri 2a str. 301
auaagccaaauccagcg

SEQ ID NO: 3903917 - RNA, 15 nt, Shigella flexneri 2a str. 301
auaagccaccucaac

SEQ ID NO: 3903918 - RNA, 19 nt, Shigella flexneri 2a str. 301
auaagcccagaacaaauaa

SEQ ID NO: 3903919 - RNA, 22 nt, Shigella flexneri 2a str. 301
auaagcccagaacaaauaaaua

SEQ ID NO: 3903920 - RNA, 15 nt, Shigella flexneri 2a str. 301
auaaggcgcaauaau

SEQ ID NO: 3903921 - RNA, 17 nt, Shigella flexneri 2a str. 301
auaaggcguuacgcagc

SEQ ID NO: 3903922 - RNA, 20 nt, Shigella flexneri 2a str. 301
auaagguaucgcgaaaaaaa

SEQ ID NO: 3903923 - RNA, 22 nt, Shigella flexneri 2a str. 301
auaaggucacguccccugggga

SEQ ID NO: 3903924 - RNA, 14 nt, Shigella flexneri 2a str. 301
auaaguaaugaacu

SEQ ID NO: 3903925 - RNA, 14 nt, Shigella flexneri 2a str. 301
auaaguacgauaca

SEQ ID NO: 3903926 - RNA, 13 nt, Shigella flexneri 2a str. 301
auaagugcuuuag

SEQ ID NO: 3903927 - RNA, 13 nt, Shigella flexneri 2a str. 301
auaauaaucauca

SEQ ID NO: 3903928 - RNA, 14 nt, Shigella flexneri 2a str. 301
auaauaaucaucac

SEQ ID NO: 3903929 - RNA, 21 nt, Shigella flexneri 2a str. 301
auaauacacuaacagaacaau

SEQ ID NO: 3903930 - RNA, 23 nt, Shigella flexneri 2a str. 301
auaauacagcccagacaaaugaa

SEQ ID NO: 3903931 - RNA, 22 nt, Shigella flexneri 2a str. 301
auaauacucagugaacaauuaa

SEQ ID NO: 3903932 - RNA, 19 nt, Shigella flexneri 2a str. 301
auaauagguaaacauccgu

SEQ ID NO: 3903933 - RNA, 19 nt, Shigella flexneri 2a str. 301
auaauaguauuaagccagu

SEQ ID NO: 3903934 - RNA, 15 nt, Shigella flexneri 2a str. 301
auaauauccuuuccc

SEQ ID NO: 3903935 - RNA, 13 nt, Shigella flexneri 2a str. 301
auaauaucuccag

SEQ ID NO: 3903936 - RNA, 11 nt, Shigella flexneri 2a str. 301
auaauaucuuu

SEQ ID NO: 3903937 - RNA, 21 nt, Shigella flexneri 2a str. 301
auaauauuccgcugacuuuau

SEQ ID NO: 3903938 - RNA, 15 nt, Shigella flexneri 2a str. 301
auaauauuuuugcgu

SEQ ID NO: 3903939 - RNA, 23 nt, Shigella flexneri 2a str. 301
auaauauuuuugcguccuggcaa

SEQ ID NO: 3903940 - RNA, 14 nt, Shigella flexneri 2a str. 301
auaaucacaauggu

SEQ ID NO: 3903941 - RNA, 13 nt, Shigella flexneri 2a str. 301
auaaucaccagua

SEQ ID NO: 3903942 - RNA, 16 nt, Shigella flexneri 2a str. 301
auaaucaccaucagca

SEQ ID NO: 3903943 - RNA, 20 nt, Shigella flexneri 2a str. 301
auaaucaccugccuucacuu

SEQ ID NO: 3903944 - RNA, 17 nt, Shigella flexneri 2a str. 301
auaaucaggaauauggu

SEQ ID NO: 3903945 - RNA, 13 nt, Shigella flexneri 2a str. 301
auaaucaucccac

SEQ ID NO: 3903946 - RNA, 19 nt, Shigella flexneri 2a str. 301
auaaucauuucgccugaaa

SEQ ID NO: 3903947 - RNA, 22 nt, Shigella flexneri 2a str. 301
auaauccaguacgcguacacuu

SEQ ID NO: 3903948 - RNA, 22 nt, Shigella flexneri 2a str. 301
auaauccaucccgcucuguaag

SEQ ID NO: 3903949 - RNA, 15 nt, Shigella flexneri 2a str. 301
auaauccccauauca

SEQ ID NO: 3903950 - RNA, 20 nt, Shigella flexneri 2a str. 301
auaauccccauaucaggcac

SEQ ID NO: 3903951 - RNA, 21 nt, Shigella flexneri 2a str. 301
auaauccccauaucaggcaca

SEQ ID NO: 3903952 - RNA, 15 nt, Shigella flexneri 2a str. 301
auaaucccggcacca

SEQ ID NO: 3903953 - RNA, 20 nt, Shigella flexneri 2a str. 301
auaauccugccgagauacag

SEQ ID NO: 3903954 - RNA, 14 nt, Shigella flexneri 2a str. 301
auaaucgaaaacau

SEQ ID NO: 3903955 - RNA, 20 nt, Shigella flexneri 2a str. 301
auaaucgaaaacaucauggu

SEQ ID NO: 3903956 - RNA, 15 nt, Shigella flexneri 2a str. 301
auaaucgaaccaaac

SEQ ID NO: 3903957 - RNA, 16 nt, Shigella flexneri 2a str. 301
auaaucgaucgcguaa

SEQ ID NO: 3903958 - RNA, 21 nt, Shigella flexneri 2a str. 301
auaaucgaucgcguaauaaaa

SEQ ID NO: 3903959 - RNA, 22 nt, Shigella flexneri 2a str. 301
auaaucgaucgcguaauaaaau

SEQ ID NO: 3903960 - RNA, 17 nt, Shigella flexneri 2a str. 301
auaaucgauugcacauu

SEQ ID NO: 3903961 - RNA, 21 nt, Shigella flexneri 2a str. 301
auacccagaaucucuuuuguu

SEQ ID NO: 3903962 - RNA, 13 nt, Shigella flexneri 2a str. 301
auaccccacagcc

SEQ ID NO: 3903963 - RNA, 13 nt, Shigella flexneri 2a str. 301
auaccccagcgca

SEQ ID NO: 3903964 - RNA, 16 nt, Shigella flexneri 2a str. 301
auacccugaaucaauc

SEQ ID NO: 3903965 - RNA, 22 nt, Shigella flexneri 2a str. 301
auacccugaaucaaucagagcc

SEQ ID NO: 3903966 - RNA, 15 nt, Shigella flexneri 2a str. 301
auaccgaaaucgcca

SEQ ID NO: 3903967 - RNA, 18 nt, Shigella flexneri 2a str. 301
auaccgaagaguaaccaa

SEQ ID NO: 3903968 - RNA, 22 nt, Shigella flexneri 2a str. 301
auaccgagcagccacugcggca

SEQ ID NO: 3903969 - RNA, 16 nt, Shigella flexneri 2a str. 301
auaccgauaucgccau

SEQ ID NO: 3903970 - RNA, 17 nt, Shigella flexneri 2a str. 301
auaccgauuacucagca

SEQ ID NO: 3903971 - RNA, 17 nt, Shigella flexneri 2a str. 301
auaccgcacgcucaaag

SEQ ID NO: 3903972 - RNA, 14 nt, Shigella flexneri 2a str. 301
auaccgcaucagca

SEQ ID NO: 3903973 - RNA, 17 nt, Shigella flexneri 2a str. 301
auaccgcaucagcaucg

SEQ ID NO: 3903974 - RNA, 18 nt, Shigella flexneri 2a str. 301
auaccgccugcaaauaaa

SEQ ID NO: 3903975 - RNA, 14 nt, Shigella flexneri 2a str. 301
auaccggacacacu

SEQ ID NO: 3903976 - RNA, 19 nt, Shigella flexneri 2a str. 301
auaccggcgucccaucggc

SEQ ID NO: 3903977 - RNA, 15 nt, Shigella flexneri 2a str. 301
auaccgggaucaggu

SEQ ID NO: 3903978 - RNA, 17 nt, Shigella flexneri 2a str. 301
auaccgggcguccugcu

SEQ ID NO: 3903979 - RNA, 19 nt, Shigella flexneri 2a str. 301
auaccggugcaccuucaag

SEQ ID NO: 3903980 - RNA, 14 nt, Shigella flexneri 2a str. 301
auaccguaacgacu

SEQ ID NO: 3903981 - RNA, 20 nt, Shigella flexneri 2a str. 301
auaccgucaggauaaacucc

SEQ ID NO: 3903982 - RNA, 18 nt, Shigella flexneri 2a str. 301
auaccguucucuuuaaaa

SEQ ID NO: 3903983 - RNA, 22 nt, Shigella flexneri 2a str. 301
auaccguuucgcagucgccagc

SEQ ID NO: 3903984 - RNA, 17 nt, Shigella flexneri 2a str. 301
auaccuaacauuuuacu

SEQ ID NO: 3903985 - RNA, 13 nt, Shigella flexneri 2a str. 301
auaccugccuggu

SEQ ID NO: 3903986 - RNA, 14 nt, Shigella flexneri 2a str. 301
auaccuuacacuca

SEQ ID NO: 3903987 - RNA, 17 nt, Shigella flexneri 2a str. 301
auaccuuacacucaaau

SEQ ID NO: 3903988 - RNA, 15 nt, Shigella flexneri 2a str. 301
auaccuugcugcucc

SEQ ID NO: 3903989 - RNA, 13 nt, Shigella flexneri 2a str. 301
auacgcaccgcuc

SEQ ID NO: 3903990 - RNA, 18 nt, Shigella flexneri 2a str. 301
auacgcaccgcuccaucg

SEQ ID NO: 3903991 - RNA, 19 nt, Shigella flexneri 2a str. 301
auacgcaccgcuccaucgc

SEQ ID NO: 3903992 - RNA, 16 nt, Shigella flexneri 2a str. 301
auacgcaccuuuacca

SEQ ID NO: 3903993 - RNA, 16 nt, Shigella flexneri 2a str. 301
auacgcagcaucauca

SEQ ID NO: 3903994 - RNA, 17 nt, Shigella flexneri 2a str. 301
auacgcauaugcaucag

SEQ ID NO: 3903995 - RNA, 16 nt, Shigella flexneri 2a str. 301
auacgccaucgccagc

SEQ ID NO: 3903996 - RNA, 19 nt, Shigella flexneri 2a str. 301
auacgccaucgccagcagc

SEQ ID NO: 3903997 - RNA, 19 nt, Shigella flexneri 2a str. 301
auacgccucacagggcucu

SEQ ID NO: 3903998 - RNA, 18 nt, Shigella flexneri 2a str. 301
auacgcgcauucuuuacu

SEQ ID NO: 3903999 - RNA, 14 nt, Shigella flexneri 2a str. 301
auacgcgcuaauca

SEQ ID NO: 3904000 - RNA, 12 nt, Shigella flexneri 2a str. 301
auacgcucaucg

SEQ ID NO: 3904001 - RNA, 15 nt, Shigella flexneri 2a str. 301
auacgcucgaacagc

SEQ ID NO: 3904002 - RNA, 14 nt, Shigella flexneri 2a str. 301
auacgcuggcugaa

SEQ ID NO: 3904003 - RNA, 16 nt, Shigella flexneri 2a str. 301
auacgcuggcugaaca

SEQ ID NO: 3904004 - RNA, 21 nt, Shigella flexneri 2a str. 301
auacgcuggcugaacauuaaa

SEQ ID NO: 3904005 - RNA, 16 nt, Shigella flexneri 2a str. 301
auacgcuugcgcaucg

SEQ ID NO: 3904006 - RNA, 16 nt, Shigella flexneri 2a str. 301
auacggaauaucgcug

SEQ ID NO: 3904007 - RNA, 17 nt, Shigella flexneri 2a str. 301
auacggguuuuccccuu

SEQ ID NO: 3904008 - RNA, 18 nt, Shigella flexneri 2a str. 301
auacggugucacgguguc

SEQ ID NO: 3904009 - RNA, 15 nt, Shigella flexneri 2a str. 301
auacguacaaacgcu

SEQ ID NO: 3904010 - RNA, 16 nt, Shigella flexneri 2a str. 301
auacguaggccugaua

SEQ ID NO: 3904011 - RNA, 20 nt, Shigella flexneri 2a str. 301
auacguccaccccagcagaa

SEQ ID NO: 3904012 - RNA, 20 nt, Shigella flexneri 2a str. 301
auacgugccgguaaugcuga

SEQ ID NO: 3904013 - RNA, 22 nt, Shigella flexneri 2a str. 301
auacguugcauaaaugccgcaa

SEQ ID NO: 3904014 - RNA, 14 nt, Shigella flexneri 2a str. 301
auacguuucaccag

SEQ ID NO: 3904015 - RNA, 13 nt, Shigella flexneri 2a str. 301
auacguuugccag

SEQ ID NO: 3904016 - RNA, 18 nt, Shigella flexneri 2a str. 301
auacuccccuuucuuauu

SEQ ID NO: 3904017 - RNA, 21 nt, Shigella flexneri 2a str. 301
auacuccugauggucuauugc

SEQ ID NO: 3904018 - RNA, 13 nt, Shigella flexneri 2a str. 301
auacucuccucca

SEQ ID NO: 3904019 - RNA, 19 nt, Shigella flexneri 2a str. 301
auacucugucugaucuggu

SEQ ID NO: 3904020 - RNA, 13 nt, Shigella flexneri 2a str. 301
auacucuuuccau

SEQ ID NO: 3904021 - RNA, 21 nt, Shigella flexneri 2a str. 301
auacucuuugguauucaaccg

SEQ ID NO: 3904022 - RNA, 15 nt, Shigella flexneri 2a str. 301
auacugacagcgcgc

SEQ ID NO: 3904023 - RNA, 14 nt, Shigella flexneri 2a str. 301
auacugacaucagc

SEQ ID NO: 3904024 - RNA, 23 nt, Shigella flexneri 2a str. 301
auacugauaauaaauaacagugc

SEQ ID NO: 3904025 - RNA, 20 nt, Shigella flexneri 2a str. 301
auacugaucgucaucaaacg

SEQ ID NO: 3904026 - RNA, 22 nt, Shigella flexneri 2a str. 301
auacugcuccccgaacgauugu

SEQ ID NO: 3904027 - RNA, 15 nt, Shigella flexneri 2a str. 301
auacugcuuaaacca

SEQ ID NO: 3904028 - RNA, 22 nt, Shigella flexneri 2a str. 301
auacugcuuaaaccauuccagc

SEQ ID NO: 3904029 - RNA, 23 nt, Shigella flexneri 2a str. 301
auacuggauagauauucuccagc

SEQ ID NO: 3904030 - RNA, 17 nt, Shigella flexneri 2a str. 301
auacuggauuucauucg

SEQ ID NO: 3904031 - RNA, 16 nt, Shigella flexneri 2a str. 301
auacuggcuaagaagc

SEQ ID NO: 3904032 - RNA, 13 nt, Shigella flexneri 2a str. 301
auacugguuucug

SEQ ID NO: 3904033 - RNA, 18 nt, Shigella flexneri 2a str. 301
auacuguuuaucuuccca

SEQ ID NO: 3904034 - RNA, 17 nt, Shigella flexneri 2a str. 301
auacuuauaagcucaau

SEQ ID NO: 3904035 - RNA, 13 nt, Shigella flexneri 2a str. 301
auacuuauuauga

SEQ ID NO: 3904036 - RNA, 16 nt, Shigella flexneri 2a str. 301
auacuucaauauaugc

SEQ ID NO: 3904037 - RNA, 22 nt, Shigella flexneri 2a str. 301
auacuucauaacguuuuuucgu

SEQ ID NO: 3904038 - RNA, 19 nt, Shigella flexneri 2a str. 301
auacuuucacaaaaauaau

SEQ ID NO: 3904039 - RNA, 23 nt, Shigella flexneri 2a str. 301
auacuuucaucaaacgaccaauc

SEQ ID NO: 3904040 - RNA, 16 nt, Shigella flexneri 2a str. 301
auacuuuuucaagaau

SEQ ID NO: 3904041 - RNA, 19 nt, Shigella flexneri 2a str. 301
auagaaacucauaugcagc

SEQ ID NO: 3904042 - RNA, 15 nt, Shigella flexneri 2a str. 301
auagaaagugacugc

SEQ ID NO: 3904043 - RNA, 18 nt, Shigella flexneri 2a str. 301
auagaacaaaagaccuga

SEQ ID NO: 3904044 - RNA, 16 nt, Shigella flexneri 2a str. 301
auagaacaucucuucc

SEQ ID NO: 3904045 - RNA, 22 nt, Shigella flexneri 2a str. 301
auagaaccuuccauguugguau

SEQ ID NO: 3904046 - RNA, 11 nt, Shigella flexneri 2a str. 301
auagaauagcc

SEQ ID NO: 3904047 - RNA, 13 nt, Shigella flexneri 2a str. 301
auagacuucccuc

SEQ ID NO: 3904048 - RNA, 14 nt, Shigella flexneri 2a str. 301
auagacuucccucc

SEQ ID NO: 3904049 - RNA, 16 nt, Shigella flexneri 2a str. 301
auagagauagccugau

SEQ ID NO: 3904050 - RNA, 19 nt, Shigella flexneri 2a str. 301
auagagcaaccaccugcaa

SEQ ID NO: 3904051 - RNA, 14 nt, Shigella flexneri 2a str. 301
auagagcgccugca

SEQ ID NO: 3904052 - RNA, 16 nt, Shigella flexneri 2a str. 301
auagagcgccugcaga

SEQ ID NO: 3904053 - RNA, 22 nt, Shigella flexneri 2a str. 301
auagaggaauggcagauaaaau

SEQ ID NO: 3904054 - RNA, 23 nt, Shigella flexneri 2a str. 301
auagaguaucggcucguuacuuu

SEQ ID NO: 3904055 - RNA, 18 nt, Shigella flexneri 2a str. 301
auagaguguuccucugcc

SEQ ID NO: 3904056 - RNA, 17 nt, Shigella flexneri 2a str. 301
auagauaucaugcucug

SEQ ID NO: 3904057 - RNA, 22 nt, Shigella flexneri 2a str. 301
auagaucuaaaugccacugaau

SEQ ID NO: 3904058 - RNA, 20 nt, Shigella flexneri 2a str. 301
auagauuuuuaaugcuuuuu

SEQ ID NO: 3904059 - RNA, 19 nt, Shigella flexneri 2a str. 301
auagcaaaguaauaaugau

SEQ ID NO: 3904060 - RNA, 18 nt, Shigella flexneri 2a str. 301
auagcaacagcagccaac

SEQ ID NO: 3904061 - RNA, 18 nt, Shigella flexneri 2a str. 301
auaucacccuuuucugcc

SEQ ID NO: 3904062 - RNA, 22 nt, Shigella flexneri 2a str. 301
auaucagccugaaugcuuucau

SEQ ID NO: 3904063 - RNA, 23 nt, Shigella flexneri 2a str. 301
auaucagugauauauuuuuaaau

SEQ ID NO: 3904064 - RNA, 14 nt, Shigella flexneri 2a str. 301
auaucaucaaaauu

SEQ ID NO: 3904065 - RNA, 15 nt, Shigella flexneri 2a str. 301
auaucaucaaaauua

SEQ ID NO: 3904066 - RNA, 15 nt, Shigella flexneri 2a str. 301
auaucaucauuugca

SEQ ID NO: 3904067 - RNA, 18 nt, Shigella flexneri 2a str. 301
auauccacccgcagccau

SEQ ID NO: 3904068 - RNA, 21 nt, Shigella flexneri 2a str. 301
auauccaccgggguaaaucca

SEQ ID NO: 3904069 - RNA, 22 nt, Shigella flexneri 2a str. 301
auauccacgcgauacuuuuuca

SEQ ID NO: 3904070 - RNA, 13 nt, Shigella flexneri 2a str. 301
auauccagauaga

SEQ ID NO: 3904071 - RNA, 11 nt, Shigella flexneri 2a str. 301
auauccagcca

SEQ ID NO: 3904072 - RNA, 22 nt, Shigella flexneri 2a str. 301
auauccagcgcggcgaaggugc

SEQ ID NO: 3904073 - RNA, 21 nt, Shigella flexneri 2a str. 301
auauccauagucacuaccugu

SEQ ID NO: 3904074 - RNA, 21 nt, Shigella flexneri 2a str. 301
auauccccccaugaaauaaaa

SEQ ID NO: 3904075 - RNA, 15 nt, Shigella flexneri 2a str. 301
auaucccgccagcac

SEQ ID NO: 3904076 - RNA, 19 nt, Shigella flexneri 2a str. 301
auaucccgccagcaccagc

SEQ ID NO: 3904077 - RNA, 14 nt, Shigella flexneri 2a str. 301
auauccgccaggcu

SEQ ID NO: 3904078 - RNA, 15 nt, Shigella flexneri 2a str. 301
auauccgccaggcug

SEQ ID NO: 3904079 - RNA, 19 nt, Shigella flexneri 2a str. 301
auauccggugcaacugcuu

SEQ ID NO: 3904080 - RNA, 18 nt, Shigella flexneri 2a str. 301
auauccgucacuucagga

SEQ ID NO: 3904081 - RNA, 16 nt, Shigella flexneri 2a str. 301
auauccucaagaauau

SEQ ID NO: 3904082 - RNA, 14 nt, Shigella flexneri 2a str. 301
auauccugauacuc

SEQ ID NO: 3904083 - RNA, 20 nt, Shigella flexneri 2a str. 301
auauccugcgcuuccugcaa

SEQ ID NO: 3904084 - RNA, 17 nt, Shigella flexneri 2a str. 301
auaucgacgaaccauuu

SEQ ID NO: 3904085 - RNA, 14 nt, Shigella flexneri 2a str. 301
auaucgacgaccug

SEQ ID NO: 3904086 - RNA, 17 nt, Shigella flexneri 2a str. 301
auaucgagaucauccau

SEQ ID NO: 3904087 - RNA, 20 nt, Shigella flexneri 2a str. 301
auaucgauuucuacacccag

SEQ ID NO: 3904088 - RNA, 15 nt, Shigella flexneri 2a str. 301
auaucgcgcagaaau

SEQ ID NO: 3904089 - RNA, 17 nt, Shigella flexneri 2a str. 301
auaucgcggauaugcag

SEQ ID NO: 3904090 - RNA, 16 nt, Shigella flexneri 2a str. 301
auaucgcuggcagaaa

SEQ ID NO: 3904091 - RNA, 23 nt, Shigella flexneri 2a str. 301
auaucggcaccagcgcagaagag

SEQ ID NO: 3904092 - RNA, 14 nt, Shigella flexneri 2a str. 301
auaucguuaucacc

SEQ ID NO: 3904093 - RNA, 24 nt, Shigella flexneri 2a str. 301
auaucguucaagagacugcuggcu

SEQ ID NO: 3904094 - RNA, 23 nt, Shigella flexneri 2a str. 301
auaucguucugccagauagagua

SEQ ID NO: 3904095 - RNA, 16 nt, Shigella flexneri 2a str. 301
auaucuaaugucauaa

SEQ ID NO: 3904096 - RNA, 20 nt, Shigella flexneri 2a str. 301
auaucuaugguuuuuucuac

SEQ ID NO: 3904097 - RNA, 23 nt, Shigella flexneri 2a str. 301
auaucuaugguuuuuucuacaca

SEQ ID NO: 3904098 - RNA, 14 nt, Shigella flexneri 2a str. 301
auaucuccuauugu

SEQ ID NO: 3904099 - RNA, 19 nt, Shigella flexneri 2a str. 301
auaucuccuccgaugacgg

SEQ ID NO: 3904100 - RNA, 19 nt, Shigella flexneri 2a str. 301
auaucugccggaagacaca

SEQ ID NO: 3904101 - RNA, 18 nt, Shigella flexneri 2a str. 301
auaucuucuguugcaggg

SEQ ID NO: 3904102 - RNA, 13 nt, Shigella flexneri 2a str. 301
auaucuuuucuua

SEQ ID NO: 3904103 - RNA, 20 nt, Shigella flexneri 2a str. 301
auaucuuuucuuaacaaaaa

SEQ ID NO: 3904104 - RNA, 12 nt, Shigella flexneri 2a str. 301
auaucuuuuuug

SEQ ID NO: 3904105 - RNA, 15 nt, Shigella flexneri 2a str. 301
auaugagcgcaaaug

SEQ ID NO: 3904106 - RNA, 13 nt, Shigella flexneri 2a str. 301
auaugauaaaccu

SEQ ID NO: 3904107 - RNA, 15 nt, Shigella flexneri 2a str. 301
auaugauuuaaaaaa

SEQ ID NO: 3904108 - RNA, 17 nt, Shigella flexneri 2a str. 301
auaugcaucaugaaaac

SEQ ID NO: 3904109 - RNA, 23 nt, Shigella flexneri 2a str. 301
auaugccagccccagcgucagca

SEQ ID NO: 3904110 - RNA, 20 nt, Shigella flexneri 2a str. 301
auaugccgcccuaaagggcg

SEQ ID NO: 3904111 - RNA, 15 nt, Shigella flexneri 2a str. 301
auaugccggcaucaa

SEQ ID NO: 3904112 - RNA, 16 nt, Shigella flexneri 2a str. 301
auaugccggcaucaaa

SEQ ID NO: 3904113 - RNA, 22 nt, Shigella flexneri 2a str. 301
auaugcgggcguuuugcuuuuu

SEQ ID NO: 3904114 - RNA, 22 nt, Shigella flexneri 2a str. 301
auaugcggugccauuaaaccaa

SEQ ID NO: 3904115 - RNA, 15 nt, Shigella flexneri 2a str. 301
auaugcuggcagugg

SEQ ID NO: 3904116 - RNA, 14 nt, Shigella flexneri 2a str. 301
auaugcuuaauguu

SEQ ID NO: 3904117 - RNA, 13 nt, Shigella flexneri 2a str. 301
auauggaaaaaua

SEQ ID NO: 3904118 - RNA, 21 nt, Shigella flexneri 2a str. 301
auauggaaaaauauucaccaa

SEQ ID NO: 3904119 - RNA, 22 nt, Shigella flexneri 2a str. 301
auauggaacggaugcagcauca

SEQ ID NO: 3904120 - RNA, 12 nt, Shigella flexneri 2a str. 301
auauggagcaaa

SEQ ID NO: 3904121 - RNA, 16 nt, Shigella flexneri 2a str. 301
auauggcccaucaucu

SEQ ID NO: 3904122 - RNA, 15 nt, Shigella flexneri 2a str. 301
auauggcggcggcuu

SEQ ID NO: 3904123 - RNA, 21 nt, Shigella flexneri 2a str. 301
auauguaagcagaaaagccaa

SEQ ID NO: 3904124 - RNA, 13 nt, Shigella flexneri 2a str. 301
auaugucgcgcca

SEQ ID NO: 3904125 - RNA, 18 nt, Shigella flexneri 2a str. 301
auaugugaucgaauauau

SEQ ID NO: 3904126 - RNA, 13 nt, Shigella flexneri 2a str. 301
auauguuuuaaag

SEQ ID NO: 3904127 - RNA, 17 nt, Shigella flexneri 2a str. 301
auauguuuuugcaguag

SEQ ID NO: 3904128 - RNA, 16 nt, Shigella flexneri 2a str. 301
auauuaaauuuuuuca

SEQ ID NO: 3904129 - RNA, 22 nt, Shigella flexneri 2a str. 301
auauuaaauuuuuucacuguuc

SEQ ID NO: 3904130 - RNA, 13 nt, Shigella flexneri 2a str. 301
auauuaacgacaa

SEQ ID NO: 3904131 - RNA, 12 nt, Shigella flexneri 2a str. 301
auauuaauacaa

SEQ ID NO: 3904132 - RNA, 14 nt, Shigella flexneri 2a str. 301
auauuaaucaucau

SEQ ID NO: 3904133 - RNA, 15 nt, Shigella flexneri 2a str. 301
auauuaaucaucauu

SEQ ID NO: 3904134 - RNA, 23 nt, Shigella flexneri 2a str. 301
auauuacgagucacaaacaucau

SEQ ID NO: 3904135 - RNA, 17 nt, Shigella flexneri 2a str. 301
auauuagcauuaaguaa

SEQ ID NO: 3904136 - RNA, 20 nt, Shigella flexneri 2a str. 301
auauuagccgccagcucuuu

SEQ ID NO: 3904137 - RNA, 18 nt, Shigella flexneri 2a str. 301
auauuagucaauuaaaaa

SEQ ID NO: 3904138 - RNA, 20 nt, Shigella flexneri 2a str. 301
auauuauccccugcgauggu

SEQ ID NO: 3904139 - RNA, 15 nt, Shigella flexneri 2a str. 301
auauuauugaaauca

SEQ ID NO: 3904140 - RNA, 17 nt, Shigella flexneri 2a str. 301
auauucaacaccgaugc

SEQ ID NO: 3904141 - RNA, 17 nt, Shigella flexneri 2a str. 301
auauucaacgucacugg

SEQ ID NO: 3904142 - RNA, 12 nt, Shigella flexneri 2a str. 301
auauucaccacg

SEQ ID NO: 3904143 - RNA, 11 nt, Shigella flexneri 2a str. 301
auauucauuuu

SEQ ID NO: 3904144 - RNA, 15 nt, Shigella flexneri 2a str. 301
auauuccccagacga

SEQ ID NO: 3904145 - RNA, 21 nt, Shigella flexneri 2a str. 301
auauuccccggucagcagcac

SEQ ID NO: 3904146 - RNA, 18 nt, Shigella flexneri 2a str. 301
auauuccgcaccugccag

SEQ ID NO: 3904147 - RNA, 20 nt, Shigella flexneri 2a str. 301
auauuccugaauggugaccu

SEQ ID NO: 3904148 - RNA, 11 nt, Shigella flexneri 2a str. 301
auauuccugca

SEQ ID NO: 3904149 - RNA, 20 nt, Shigella flexneri 2a str. 301
auauuccuuuaucauuaaca

SEQ ID NO: 3904150 - RNA, 20 nt, Shigella flexneri 2a str. 301
auauucgacaccaucuuccu

SEQ ID NO: 3904151 - RNA, 21 nt, Shigella flexneri 2a str. 301
auauucgacaccaucuuccuc

SEQ ID NO: 3904152 - RNA, 17 nt, Shigella flexneri 2a str. 301
auauucgccgcccugca

SEQ ID NO: 3904153 - RNA, 14 nt, Shigella flexneri 2a str. 301
auauucgcuuucag

SEQ ID NO: 3904154 - RNA, 14 nt, Shigella flexneri 2a str. 301
auauucggcuccag

SEQ ID NO: 3904155 - RNA, 13 nt, Shigella flexneri 2a str. 301
auauucguucaga

SEQ ID NO: 3904156 - RNA, 16 nt, Shigella flexneri 2a str. 301
auauucucaaaauaca

SEQ ID NO: 3904157 - RNA, 17 nt, Shigella flexneri 2a str. 301
auauucucaaaauacag

SEQ ID NO: 3904158 - RNA, 16 nt, Shigella flexneri 2a str. 301
auauucuccagcuuca

SEQ ID NO: 3904159 - RNA, 14 nt, Shigella flexneri 2a str. 301
auauugaugcucac

SEQ ID NO: 3904160 - RNA, 19 nt, Shigella flexneri 2a str. 301
auauugccgaagaccagau

SEQ ID NO: 3904161 - RNA, 15 nt, Shigella flexneri 2a str. 301
aucaauugcuaccga

SEQ ID NO: 3904162 - RNA, 21 nt, Shigella flexneri 2a str. 301
aucaauuuaucguauuggccg

SEQ ID NO: 3904163 - RNA, 21 nt, Shigella flexneri 2a str. 301
aucaauuuauugaauuuacac

SEQ ID NO: 3904164 - RNA, 13 nt, Shigella flexneri 2a str. 301
aucaauuugccca

SEQ ID NO: 3904165 - RNA, 20 nt, Shigella flexneri 2a str. 301
aucaauuugcuucuggcugg

SEQ ID NO: 3904166 - RNA, 21 nt, Shigella flexneri 2a str. 301
aucaauuuucccuucugagau

SEQ ID NO: 3904167 - RNA, 23 nt, Shigella flexneri 2a str. 301
aucacaaaacgaauaauugcugg

SEQ ID NO: 3904168 - RNA, 13 nt, Shigella flexneri 2a str. 301
aucacaagaccua

SEQ ID NO: 3904169 - RNA, 15 nt, Shigella flexneri 2a str. 301
aucacaauaaucgcc

SEQ ID NO: 3904170 - RNA, 16 nt, Shigella flexneri 2a str. 301
aucacaauagaaauau

SEQ ID NO: 3904171 - RNA, 14 nt, Shigella flexneri 2a str. 301
aucacacagcgguu

SEQ ID NO: 3904172 - RNA, 18 nt, Shigella flexneri 2a str. 301
aucacaccugcucagccc

SEQ ID NO: 3904173 - RNA, 15 nt, Shigella flexneri 2a str. 301
aucacacuaccggaa

SEQ ID NO: 3904174 - RNA, 11 nt, Shigella flexneri 2a str. 301
aucacagcaga

SEQ ID NO: 3904175 - RNA, 13 nt, Shigella flexneri 2a str. 301
aucacaggcgcga

SEQ ID NO: 3904176 - RNA, 18 nt, Shigella flexneri 2a str. 301
aucacauaaucgaaaaca

SEQ ID NO: 3904177 - RNA, 13 nt, Shigella flexneri 2a str. 301
aucacaucccagc

SEQ ID NO: 3904178 - RNA, 15 nt, Shigella flexneri 2a str. 301
aucacauccugauag

SEQ ID NO: 3904179 - RNA, 21 nt, Shigella flexneri 2a str. 301
aucacaugcuggaaccacagc

SEQ ID NO: 3904180 - RNA, 22 nt, Shigella flexneri 2a str. 301
aucaccacaauauuauggcugu

SEQ ID NO: 3904181 - RNA, 15 nt, Shigella flexneri 2a str. 301
aucaccacagacaaa

SEQ ID NO: 3904182 - RNA, 15 nt, Shigella flexneri 2a str. 301
aucaccaccacgacc

SEQ ID NO: 3904183 - RNA, 22 nt, Shigella flexneri 2a str. 301
aucaccagaucguaauggucgu

SEQ ID NO: 3904184 - RNA, 20 nt, Shigella flexneri 2a str. 301
aucaccaguaccgccgccau

SEQ ID NO: 3904185 - RNA, 17 nt, Shigella flexneri 2a str. 301
aucaccaguccaucggc

SEQ ID NO: 3904186 - RNA, 18 nt, Shigella flexneri 2a str. 301
aucaccauauucagcagc

SEQ ID NO: 3904187 - RNA, 13 nt, Shigella flexneri 2a str. 301
aucaccauccacg

SEQ ID NO: 3904188 - RNA, 19 nt, Shigella flexneri 2a str. 301
aucacccuuuucugccgcu

SEQ ID NO: 3904189 - RNA, 15 nt, Shigella flexneri 2a str. 301
aucaccgccagcaag

SEQ ID NO: 3904190 - RNA, 14 nt, Shigella flexneri 2a str. 301
aucaccuccagccu

SEQ ID NO: 3904191 - RNA, 14 nt, Shigella flexneri 2a str. 301
aucaccugcacaug

SEQ ID NO: 3904192 - RNA, 15 nt, Shigella flexneri 2a str. 301
aucaccugcuggacg

SEQ ID NO: 3904193 - RNA, 15 nt, Shigella flexneri 2a str. 301
aucaccuuacggcac

SEQ ID NO: 3904194 - RNA, 23 nt, Shigella flexneri 2a str. 301
aucaccuuacggcacuccucuuc

SEQ ID NO: 3904195 - RNA, 17 nt, Shigella flexneri 2a str. 301
aucacgaagcccauuuc

SEQ ID NO: 3904196 - RNA, 15 nt, Shigella flexneri 2a str. 301
aucacgacagcacca

SEQ ID NO: 3904197 - RNA, 21 nt, Shigella flexneri 2a str. 301
aucacgaccuguaccuucagc

SEQ ID NO: 3904198 - RNA, 18 nt, Shigella flexneri 2a str. 301
aucacgaugcuaaaaaca

SEQ ID NO: 3904199 - RNA, 14 nt, Shigella flexneri 2a str. 301
aucacgauugcugc

SEQ ID NO: 3904200 - RNA, 12 nt, Shigella flexneri 2a str. 301
aucacgcagcug

SEQ ID NO: 3904201 - RNA, 12 nt, Shigella flexneri 2a str. 301
aucacgcaucac

SEQ ID NO: 3904202 - RNA, 21 nt, Shigella flexneri 2a str. 301
aucacgccaauaccgcccaga

SEQ ID NO: 3904203 - RNA, 15 nt, Shigella flexneri 2a str. 301
aucacgcgccugcca

SEQ ID NO: 3904204 - RNA, 21 nt, Shigella flexneri 2a str. 301
aucacgcgguuacgcaccggu

SEQ ID NO: 3904205 - RNA, 21 nt, Shigella flexneri 2a str. 301
aucacgcugaauuuaucgacu

SEQ ID NO: 3904206 - RNA, 17 nt, Shigella flexneri 2a str. 301
aucacgcugcugauuaa

SEQ ID NO: 3904207 - RNA, 13 nt, Shigella flexneri 2a str. 301
aucacgucgccuu

SEQ ID NO: 3904208 - RNA, 21 nt, Shigella flexneri 2a str. 301
aucacguugcuguugguucag

SEQ ID NO: 3904209 - RNA, 14 nt, Shigella flexneri 2a str. 301
aucacuaacgacau

SEQ ID NO: 3904210 - RNA, 17 nt, Shigella flexneri 2a str. 301
aucacuaugaaaauaaa

SEQ ID NO: 3904211 - RNA, 23 nt, Shigella flexneri 2a str. 301
aucacuccauccagcaacaacag

SEQ ID NO: 3904212 - RNA, 16 nt, Shigella flexneri 2a str. 301
aucacuccccgccguu

SEQ ID NO: 3904213 - RNA, 19 nt, Shigella flexneri 2a str. 301
aucacucggggcuuuucuc

SEQ ID NO: 3904214 - RNA, 15 nt, Shigella flexneri 2a str. 301
aucacugagucagcc

SEQ ID NO: 3904215 - RNA, 15 nt, Shigella flexneri 2a str. 301
aucacuucaucgccg

SEQ ID NO: 3904216 - RNA, 14 nt, Shigella flexneri 2a str. 301
aucacuuccagcag

SEQ ID NO: 3904217 - RNA, 15 nt, Shigella flexneri 2a str. 301
aucacuuccagcagu

SEQ ID NO: 3904218 - RNA, 14 nt, Shigella flexneri 2a str. 301
aucacuucgccgau

SEQ ID NO: 3904219 - RNA, 16 nt, Shigella flexneri 2a str. 301
aucacuuguucagcga

SEQ ID NO: 3904220 - RNA, 13 nt, Shigella flexneri 2a str. 301
aucacuuucagac

SEQ ID NO: 3904221 - RNA, 17 nt, Shigella flexneri 2a str. 301
aucacuuuugaaaucaa

SEQ ID NO: 3904222 - RNA, 17 nt, Shigella flexneri 2a str. 301
aucagaaacacacuuuc

SEQ ID NO: 3904223 - RNA, 19 nt, Shigella flexneri 2a str. 301
aucagaaacacacuuucca

SEQ ID NO: 3904224 - RNA, 14 nt, Shigella flexneri 2a str. 301
aucagaaaugccag

SEQ ID NO: 3904225 - RNA, 13 nt, Shigella flexneri 2a str. 301
aucagaaggguug

SEQ ID NO: 3904226 - RNA, 19 nt, Shigella flexneri 2a str. 301
aucagaaugcgcucuuccg

SEQ ID NO: 3904227 - RNA, 22 nt, Shigella flexneri 2a str. 301
aucagaauuuuucgcuaaaaaa

SEQ ID NO: 3904228 - RNA, 21 nt, Shigella flexneri 2a str. 301
aucagacaaaugucacugcuu

SEQ ID NO: 3904229 - RNA, 16 nt, Shigella flexneri 2a str. 301
aucagacaccagccag

SEQ ID NO: 3904230 - RNA, 19 nt, Shigella flexneri 2a str. 301
aucagaccuucgcuaucaa

SEQ ID NO: 3904231 - RNA, 16 nt, Shigella flexneri 2a str. 301
aucagacgacccacga

SEQ ID NO: 3904232 - RNA, 14 nt, Shigella flexneri 2a str. 301
aucagacuggcggc

SEQ ID NO: 3904233 - RNA, 23 nt, Shigella flexneri 2a str. 301
aucagaggcgaaccgcugucacc

SEQ ID NO: 3904234 - RNA, 16 nt, Shigella flexneri 2a str. 301
aucagaguugaaaaac

SEQ ID NO: 3904235 - RNA, 18 nt, Shigella flexneri 2a str. 301
aucagaguugaaaaacau

SEQ ID NO: 3904236 - RNA, 13 nt, Shigella flexneri 2a str. 301
aucagauccgcac

SEQ ID NO: 3904237 - RNA, 14 nt, Shigella flexneri 2a str. 301
aucagaucgcgacc

SEQ ID NO: 3904238 - RNA, 18 nt, Shigella flexneri 2a str. 301
aucagaucguugaacccg

SEQ ID NO: 3904239 - RNA, 16 nt, Shigella flexneri 2a str. 301
aucagauggcggcugg

SEQ ID NO: 3904240 - RNA, 19 nt, Shigella flexneri 2a str. 301
aucagauggcggcuggcgc

SEQ ID NO: 3904241 - RNA, 22 nt, Shigella flexneri 2a str. 301
aucagauucacgguauuauuca

SEQ ID NO: 3904242 - RNA, 15 nt, Shigella flexneri 2a str. 301
aucagauucagcagc

SEQ ID NO: 3904243 - RNA, 20 nt, Shigella flexneri 2a str. 301
aucagauucgauagagaacg

SEQ ID NO: 3904244 - RNA, 24 nt, Shigella flexneri 2a str. 301
aucagcaaauuuggcaucgaggau

SEQ ID NO: 3904245 - RNA, 16 nt, Shigella flexneri 2a str. 301
aucagcaacgaaguaa

SEQ ID NO: 3904246 - RNA, 16 nt, Shigella flexneri 2a str. 301
aucagcaauuuuuccu

SEQ ID NO: 3904247 - RNA, 15 nt, Shigella flexneri 2a str. 301
aucagcacaaaucgg

SEQ ID NO: 3904248 - RNA, 18 nt, Shigella flexneri 2a str. 301
aucagcagauaucccgcc

SEQ ID NO: 3904249 - RNA, 19 nt, Shigella flexneri 2a str. 301
aucagcagcggagaaaugu

SEQ ID NO: 3904250 - RNA, 13 nt, Shigella flexneri 2a str. 301
aucagcaguucac

SEQ ID NO: 3904251 - RNA, 21 nt, Shigella flexneri 2a str. 301
aucagcaguuuuuccccugcc

SEQ ID NO: 3904252 - RNA, 17 nt, Shigella flexneri 2a str. 301
aucagcauaaucaccag

SEQ ID NO: 3904253 - RNA, 18 nt, Shigella flexneri 2a str. 301
aucagcaucccaccugaa

SEQ ID NO: 3904254 - RNA, 15 nt, Shigella flexneri 2a str. 301
aucagcauccgcacg

SEQ ID NO: 3904255 - RNA, 11 nt, Shigella flexneri 2a str. 301
aucagcaugac

SEQ ID NO: 3904256 - RNA, 17 nt, Shigella flexneri 2a str. 301
aucagcaugacaaaaaa

SEQ ID NO: 3904257 - RNA, 22 nt, Shigella flexneri 2a str. 301
aucagcaugacaaaaaagccaa

SEQ ID NO: 3904258 - RNA, 12 nt, Shigella flexneri 2a str. 301
aucagcauucuc

SEQ ID NO: 3904259 - RNA, 20 nt, Shigella flexneri 2a str. 301
aucagcauucucaucaccau

SEQ ID NO: 3904260 - RNA, 14 nt, Shigella flexneri 2a str. 301
aucagccacuuccu

SEQ ID NO: 3904261 - RNA, 19 nt, Shigella flexneri 2a str. 301
aucagccacuuccugcucg

SEQ ID NO: 3904262 - RNA, 21 nt, Shigella flexneri 2a str. 301
aucaugccugaugcgacgcuu

SEQ ID NO: 3904263 - RNA, 21 nt, Shigella flexneri 2a str. 301
aucauggcauccuguuuucug

SEQ ID NO: 3904264 - RNA, 19 nt, Shigella flexneri 2a str. 301
aucauggcgaugagaauca

SEQ ID NO: 3904265 - RNA, 17 nt, Shigella flexneri 2a str. 301
aucaugguaucgggcag

SEQ ID NO: 3904266 - RNA, 17 nt, Shigella flexneri 2a str. 301
aucaugucgcccacgcc

SEQ ID NO: 3904267 - RNA, 19 nt, Shigella flexneri 2a str. 301
aucauuaaaguuaucgccg

SEQ ID NO: 3904268 - RNA, 14 nt, Shigella flexneri 2a str. 301
aucauuacaaccgc

SEQ ID NO: 3904269 - RNA, 13 nt, Shigella flexneri 2a str. 301
aucauuagcccaa

SEQ ID NO: 3904270 - RNA, 21 nt, Shigella flexneri 2a str. 301
aucauuagcccaauaaucacc

SEQ ID NO: 3904271 - RNA, 23 nt, Shigella flexneri 2a str. 301
aucauuagcccaauaaucaccgu

SEQ ID NO: 3904272 - RNA, 15 nt, Shigella flexneri 2a str. 301
aucauuagucacaaa

SEQ ID NO: 3904273 - RNA, 13 nt, Shigella flexneri 2a str. 301
aucauucccgccc

SEQ ID NO: 3904274 - RNA, 20 nt, Shigella flexneri 2a str. 301
aucauuggccggaauaccac

SEQ ID NO: 3904275 - RNA, 13 nt, Shigella flexneri 2a str. 301
aucauuuaaaaag

SEQ ID NO: 3904276 - RNA, 20 nt, Shigella flexneri 2a str. 301
aucauuuaaaaagaaaaaac

SEQ ID NO: 3904277 - RNA, 21 nt, Shigella flexneri 2a str. 301
aucauuuaaaaagaaaaaacu

SEQ ID NO: 3904278 - RNA, 22 nt, Shigella flexneri 2a str. 301
aucauuuuacguugcauuucca

SEQ ID NO: 3904279 - RNA, 14 nt, Shigella flexneri 2a str. 301
aucauuuuuuuaau

SEQ ID NO: 3904280 - RNA, 15 nt, Shigella flexneri 2a str. 301
auccaaacauggcac

SEQ ID NO: 3904281 - RNA, 23 nt, Shigella flexneri 2a str. 301
auccaaaccgggugguaauacca

SEQ ID NO: 3904282 - RNA, 15 nt, Shigella flexneri 2a str. 301
auccaacaauagugc

SEQ ID NO: 3904283 - RNA, 21 nt, Shigella flexneri 2a str. 301
auccaaccauccccaucugcu

SEQ ID NO: 3904284 - RNA, 21 nt, Shigella flexneri 2a str. 301
auccaacugauguagucauac

SEQ ID NO: 3904285 - RNA, 22 nt, Shigella flexneri 2a str. 301
auccaagucaacgucauuaucu

SEQ ID NO: 3904286 - RNA, 12 nt, Shigella flexneri 2a str. 301
auccaaugccgc

SEQ ID NO: 3904287 - RNA, 19 nt, Shigella flexneri 2a str. 301
auccaaugccgcagcggcg

SEQ ID NO: 3904288 - RNA, 13 nt, Shigella flexneri 2a str. 301
auccacagcaaug

SEQ ID NO: 3904289 - RNA, 14 nt, Shigella flexneri 2a str. 301
auccacagcaaugc

SEQ ID NO: 3904290 - RNA, 16 nt, Shigella flexneri 2a str. 301
auccacagcaaugcau

SEQ ID NO: 3904291 - RNA, 22 nt, Shigella flexneri 2a str. 301
auccacaggguguauucaugcc

SEQ ID NO: 3904292 - RNA, 20 nt, Shigella flexneri 2a str. 301
auccaccaguggacggcuga

SEQ ID NO: 3904293 - RNA, 17 nt, Shigella flexneri 2a str. 301
auccacccgcagcaagc

SEQ ID NO: 3904294 - RNA, 16 nt, Shigella flexneri 2a str. 301
auccacccgcagccau

SEQ ID NO: 3904295 - RNA, 16 nt, Shigella flexneri 2a str. 301
auccaccgccacgccg

SEQ ID NO: 3904296 - RNA, 22 nt, Shigella flexneri 2a str. 301
auccaccuccagcuccgccagc

SEQ ID NO: 3904297 - RNA, 22 nt, Shigella flexneri 2a str. 301
auccaccuucuguaacuggaag

SEQ ID NO: 3904298 - RNA, 18 nt, Shigella flexneri 2a str. 301
auccacgauacgcugcac

SEQ ID NO: 3904299 - RNA, 19 nt, Shigella flexneri 2a str. 301
auccacgauacgcugcaca

SEQ ID NO: 3904300 - RNA, 15 nt, Shigella flexneri 2a str. 301
auccacgauuaucac

SEQ ID NO: 3904301 - RNA, 19 nt, Shigella flexneri 2a str. 301
auccacgcauuaauaaggu

SEQ ID NO: 3904302 - RNA, 18 nt, Shigella flexneri 2a str. 301
auccacgccuuuuuucac

SEQ ID NO: 3904303 - RNA, 19 nt, Shigella flexneri 2a str. 301
auccagaaacucugcggca

SEQ ID NO: 3904304 - RNA, 24 nt, Shigella flexneri 2a str. 301
auccagacuaauuuuucccucuuc

SEQ ID NO: 3904305 - RNA, 15 nt, Shigella flexneri 2a str. 301
auccagauagaacau

SEQ ID NO: 3904306 - RNA, 14 nt, Shigella flexneri 2a str. 301
auccagauggcuau

SEQ ID NO: 3904307 - RNA, 16 nt, Shigella flexneri 2a str. 301
auccagauuuauaaaa

SEQ ID NO: 3904308 - RNA, 20 nt, Shigella flexneri 2a str. 301
auccagauuuauaaaagaaa

SEQ ID NO: 3904309 - RNA, 15 nt, Shigella flexneri 2a str. 301
auccagcaacaacag

SEQ ID NO: 3904310 - RNA, 19 nt, Shigella flexneri 2a str. 301
auccagcagcccuugcuuc

SEQ ID NO: 3904311 - RNA, 16 nt, Shigella flexneri 2a str. 301
auccagcagugacuca

SEQ ID NO: 3904312 - RNA, 19 nt, Shigella flexneri 2a str. 301
auccagcagugacucacga

SEQ ID NO: 3904313 - RNA, 20 nt, Shigella flexneri 2a str. 301
auccagcagugacucacgaa

SEQ ID NO: 3904314 - RNA, 14 nt, Shigella flexneri 2a str. 301
auccagccaaacau

SEQ ID NO: 3904315 - RNA, 14 nt, Shigella flexneri 2a str. 301
auccagccacggcu

SEQ ID NO: 3904316 - RNA, 17 nt, Shigella flexneri 2a str. 301
auccagccacggcucca

SEQ ID NO: 3904317 - RNA, 18 nt, Shigella flexneri 2a str. 301
auccagccacggcuccag

SEQ ID NO: 3904318 - RNA, 12 nt, Shigella flexneri 2a str. 301
auccagccaguc

SEQ ID NO: 3904319 - RNA, 15 nt, Shigella flexneri 2a str. 301
auccagcccugccag

SEQ ID NO: 3904320 - RNA, 21 nt, Shigella flexneri 2a str. 301
auccagccuacaaauuugugc

SEQ ID NO: 3904321 - RNA, 16 nt, Shigella flexneri 2a str. 301
auccagcgcaaaggga

SEQ ID NO: 3904322 - RNA, 17 nt, Shigella flexneri 2a str. 301
auccagcgcgcgcagca

SEQ ID NO: 3904323 - RNA, 21 nt, Shigella flexneri 2a str. 301
auccagcggugcgcgauuaug

SEQ ID NO: 3904324 - RNA, 16 nt, Shigella flexneri 2a str. 301
auccagcucuuuucca

SEQ ID NO: 3904325 - RNA, 23 nt, Shigella flexneri 2a str. 301
auccagcucuuuuccagccauca

SEQ ID NO: 3904326 - RNA, 16 nt, Shigella flexneri 2a str. 301
auccagcugcgcgcga

SEQ ID NO: 3904327 - RNA, 20 nt, Shigella flexneri 2a str. 301
auccagcuuuuagaucacuc

SEQ ID NO: 3904328 - RNA, 17 nt, Shigella flexneri 2a str. 301
auccagcuuuucccagc

SEQ ID NO: 3904329 - RNA, 19 nt, Shigella flexneri 2a str. 301
auccagggaucaacauuca

SEQ ID NO: 3904330 - RNA, 15 nt, Shigella flexneri 2a str. 301
auccaggguuuuauu

SEQ ID NO: 3904331 - RNA, 17 nt, Shigella flexneri 2a str. 301
auccagguguauuguuc

SEQ ID NO: 3904332 - RNA, 14 nt, Shigella flexneri 2a str. 301
auccaguacaugaa

SEQ ID NO: 3904333 - RNA, 20 nt, Shigella flexneri 2a str. 301
auccagugcucauccuucag

SEQ ID NO: 3904334 - RNA, 23 nt, Shigella flexneri 2a str. 301
auccaguggcuguguaagaaucc

SEQ ID NO: 3904335 - RNA, 20 nt, Shigella flexneri 2a str. 301
auccaguguaaaacagcacu

SEQ ID NO: 3904336 - RNA, 15 nt, Shigella flexneri 2a str. 301
auccaguuccuucaa

SEQ ID NO: 3904337 - RNA, 14 nt, Shigella flexneri 2a str. 301
auccauaagguccu

SEQ ID NO: 3904338 - RNA, 15 nt, Shigella flexneri 2a str. 301
auccauaccagcaca

SEQ ID NO: 3904339 - RNA, 18 nt, Shigella flexneri 2a str. 301
auccauaccagcacauaa

SEQ ID NO: 3904340 - RNA, 15 nt, Shigella flexneri 2a str. 301
auccauacucuuucc

SEQ ID NO: 3904341 - RNA, 14 nt, Shigella flexneri 2a str. 301
auccaucaaagguu

SEQ ID NO: 3904342 - RNA, 18 nt, Shigella flexneri 2a str. 301
auccaucaaagguuuuuc

SEQ ID NO: 3904343 - RNA, 19 nt, Shigella flexneri 2a str. 301
auccaucaaagguuuuuca

SEQ ID NO: 3904344 - RNA, 18 nt, Shigella flexneri 2a str. 301
auccaucacuucaucauc

SEQ ID NO: 3904345 - RNA, 16 nt, Shigella flexneri 2a str. 301
auccaucagaccuucg

SEQ ID NO: 3904346 - RNA, 21 nt, Shigella flexneri 2a str. 301
auccaucagacuuugcgccau

SEQ ID NO: 3904347 - RNA, 18 nt, Shigella flexneri 2a str. 301
auccaucgccagcucaaa

SEQ ID NO: 3904348 - RNA, 18 nt, Shigella flexneri 2a str. 301
auccaugacaucuccagc

SEQ ID NO: 3904349 - RNA, 22 nt, Shigella flexneri 2a str. 301
auccaugcgcauuaagccauga

SEQ ID NO: 3904350 - RNA, 16 nt, Shigella flexneri 2a str. 301
auccauucaucgccuu

SEQ ID NO: 3904351 - RNA, 21 nt, Shigella flexneri 2a str. 301
auccauuccggccaucgccug

SEQ ID NO: 3904352 - RNA, 21 nt, Shigella flexneri 2a str. 301
auccauucggcgauuaacaag

SEQ ID NO: 3904353 - RNA, 13 nt, Shigella flexneri 2a str. 301
auccauuuucuau

SEQ ID NO: 3904354 - RNA, 22 nt, Shigella flexneri 2a str. 301
auccauuuucuauuuugcauua

SEQ ID NO: 3904355 - RNA, 11 nt, Shigella flexneri 2a str. 301
aucccaaagcu

SEQ ID NO: 3904356 - RNA, 16 nt, Shigella flexneri 2a str. 301
aucccacauccuacca

SEQ ID NO: 3904357 - RNA, 12 nt, Shigella flexneri 2a str. 301
aucccacugcca

SEQ ID NO: 3904358 - RNA, 15 nt, Shigella flexneri 2a str. 301
aucccagaagaauau

SEQ ID NO: 3904359 - RNA, 17 nt, Shigella flexneri 2a str. 301
aucccagaucgcuuucc

SEQ ID NO: 3904360 - RNA, 20 nt, Shigella flexneri 2a str. 301
aucccagcaguuuccgcgcc

SEQ ID NO: 3904361 - RNA, 16 nt, Shigella flexneri 2a str. 301
aucccaggccaaaucc

SEQ ID NO: 3904362 - RNA, 23 nt, Shigella flexneri 2a str. 301
aucgaagagacaaaaaaggugcu

SEQ ID NO: 3904363 - RNA, 15 nt, Shigella flexneri 2a str. 301
aucgaagccgucagc

SEQ ID NO: 3904364 - RNA, 16 nt, Shigella flexneri 2a str. 301
aucgacaaaaucggaa

SEQ ID NO: 3904365 - RNA, 15 nt, Shigella flexneri 2a str. 301
aucgacaaucaccag

SEQ ID NO: 3904366 - RNA, 16 nt, Shigella flexneri 2a str. 301
aucgacaguaccagca

SEQ ID NO: 3904367 - RNA, 16 nt, Shigella flexneri 2a str. 301
aucgacaguugcugcg

SEQ ID NO: 3904368 - RNA, 19 nt, Shigella flexneri 2a str. 301
aucgacaguuucaccugcu

SEQ ID NO: 3904369 - RNA, 13 nt, Shigella flexneri 2a str. 301
aucgaccaaccuu

SEQ ID NO: 3904370 - RNA, 18 nt, Shigella flexneri 2a str. 301
aucgaccaaccuugcgcc

SEQ ID NO: 3904371 - RNA, 13 nt, Shigella flexneri 2a str. 301
aucgaccgcuuca

SEQ ID NO: 3904372 - RNA, 16 nt, Shigella flexneri 2a str. 301
aucgacgcgccagcac

SEQ ID NO: 3904373 - RNA, 21 nt, Shigella flexneri 2a str. 301
aucgacgcguccaggcucgcc

SEQ ID NO: 3904374 - RNA, 17 nt, Shigella flexneri 2a str. 301
aucgacggcguauugca

SEQ ID NO: 3904375 - RNA, 20 nt, Shigella flexneri 2a str. 301
aucgacuaacuucugaucua

SEQ ID NO: 3904376 - RNA, 17 nt, Shigella flexneri 2a str. 301
aucgagaucggccagca

SEQ ID NO: 3904377 - RNA, 18 nt, Shigella flexneri 2a str. 301
aucgagaucggccagcac

SEQ ID NO: 3904378 - RNA, 15 nt, Shigella flexneri 2a str. 301
aucgagaugaucuuc

SEQ ID NO: 3904379 - RNA, 14 nt, Shigella flexneri 2a str. 301
aucgagccgauuaa

SEQ ID NO: 3904380 - RNA, 22 nt, Shigella flexneri 2a str. 301
aucgagcgccguugcgcccauc

SEQ ID NO: 3904381 - RNA, 21 nt, Shigella flexneri 2a str. 301
aucgaggaaaaccagaaucug

SEQ ID NO: 3904382 - RNA, 19 nt, Shigella flexneri 2a str. 301
aucgaggccauauuucaca

SEQ ID NO: 3904383 - RNA, 14 nt, Shigella flexneri 2a str. 301
aucgauaaaccagc

SEQ ID NO: 3904384 - RNA, 15 nt, Shigella flexneri 2a str. 301
aucgaugcuguugcu

SEQ ID NO: 3904385 - RNA, 21 nt, Shigella flexneri 2a str. 301
aucgaugcuguugcuccuuaa

SEQ ID NO: 3904386 - RNA, 18 nt, Shigella flexneri 2a str. 301
aucgaugggauauaaccc

SEQ ID NO: 3904387 - RNA, 17 nt, Shigella flexneri 2a str. 301
aucgauugcacauuccc

SEQ ID NO: 3904388 - RNA, 22 nt, Shigella flexneri 2a str. 301
aucgauuuggcucaacaacugc

SEQ ID NO: 3904389 - RNA, 13 nt, Shigella flexneri 2a str. 301
aucgauuuucaaa

SEQ ID NO: 3904390 - RNA, 17 nt, Shigella flexneri 2a str. 301
aucgauuuucaaaauau

SEQ ID NO: 3904391 - RNA, 18 nt, Shigella flexneri 2a str. 301
aucgcaaauugacuacac

SEQ ID NO: 3904392 - RNA, 21 nt, Shigella flexneri 2a str. 301
aucgcaaugauuuugauggaa

SEQ ID NO: 3904393 - RNA, 15 nt, Shigella flexneri 2a str. 301
aucgcaccaaacggg

SEQ ID NO: 3904394 - RNA, 17 nt, Shigella flexneri 2a str. 301
aucgcacguugucagca

SEQ ID NO: 3904395 - RNA, 21 nt, Shigella flexneri 2a str. 301
aucgcacguugucagcaacug

SEQ ID NO: 3904396 - RNA, 22 nt, Shigella flexneri 2a str. 301
aucgcacugaugugacaucacc

SEQ ID NO: 3904397 - RNA, 12 nt, Shigella flexneri 2a str. 301
aucgcagaugaa

SEQ ID NO: 3904398 - RNA, 15 nt, Shigella flexneri 2a str. 301
aucgcagcaaacgaa

SEQ ID NO: 3904399 - RNA, 17 nt, Shigella flexneri 2a str. 301
aucgcagcacuggugcu

SEQ ID NO: 3904400 - RNA, 12 nt, Shigella flexneri 2a str. 301
aucgcagcgcaa

SEQ ID NO: 3904401 - RNA, 21 nt, Shigella flexneri 2a str. 301
aucgcagcgcaagcugaacag

SEQ ID NO: 3904402 - RNA, 18 nt, Shigella flexneri 2a str. 301
aucgcaucaaucuuuuuc

SEQ ID NO: 3904403 - RNA, 21 nt, Shigella flexneri 2a str. 301
aucgcauggcugcgaaucgcu

SEQ ID NO: 3904404 - RNA, 23 nt, Shigella flexneri 2a str. 301
aucgcauucaggaccucacggaa

SEQ ID NO: 3904405 - RNA, 16 nt, Shigella flexneri 2a str. 301
aucgccaaagcggcag

SEQ ID NO: 3904406 - RNA, 15 nt, Shigella flexneri 2a str. 301
aucgccagcagccau

SEQ ID NO: 3904407 - RNA, 12 nt, Shigella flexneri 2a str. 301
aucgccagcauc

SEQ ID NO: 3904408 - RNA, 17 nt, Shigella flexneri 2a str. 301
aucgccagcaucggcag

SEQ ID NO: 3904409 - RNA, 22 nt, Shigella flexneri 2a str. 301
aucgccagcguuggcaguucga

SEQ ID NO: 3904410 - RNA, 19 nt, Shigella flexneri 2a str. 301
aucgccagugccgcccacc

SEQ ID NO: 3904411 - RNA, 20 nt, Shigella flexneri 2a str. 301
aucgccauaauaagcgccau

SEQ ID NO: 3904412 - RNA, 12 nt, Shigella flexneri 2a str. 301
aucgccaucagg

SEQ ID NO: 3904413 - RNA, 12 nt, Shigella flexneri 2a str. 301
aucgccaucagu

SEQ ID NO: 3904414 - RNA, 21 nt, Shigella flexneri 2a str. 301
aucgccaucuuuacaccuuac

SEQ ID NO: 3904415 - RNA, 20 nt, Shigella flexneri 2a str. 301
aucgcccaguugaucaccag

SEQ ID NO: 3904416 - RNA, 17 nt, Shigella flexneri 2a str. 301
aucgccccggucaucaa

SEQ ID NO: 3904417 - RNA, 22 nt, Shigella flexneri 2a str. 301
aucgcccgccaagcaguuggca

SEQ ID NO: 3904418 - RNA, 19 nt, Shigella flexneri 2a str. 301
aucgcccgcuuccagcgca

SEQ ID NO: 3904419 - RNA, 21 nt, Shigella flexneri 2a str. 301
aucgcccggauauccacccgc

SEQ ID NO: 3904420 - RNA, 18 nt, Shigella flexneri 2a str. 301
aucgcccugcuccagcaa

SEQ ID NO: 3904421 - RNA, 22 nt, Shigella flexneri 2a str. 301
aucgccgcacuuucuccucccu

SEQ ID NO: 3904422 - RNA, 14 nt, Shigella flexneri 2a str. 301
aucgccgcuggaaa

SEQ ID NO: 3904423 - RNA, 16 nt, Shigella flexneri 2a str. 301
aucgccgcuggcgcgg

SEQ ID NO: 3904424 - RNA, 22 nt, Shigella flexneri 2a str. 301
aucgccgggaacagaauaacgu

SEQ ID NO: 3904425 - RNA, 18 nt, Shigella flexneri 2a str. 301
aucgccuaccaacgacau

SEQ ID NO: 3904426 - RNA, 15 nt, Shigella flexneri 2a str. 301
aucgccuccagcgcu

SEQ ID NO: 3904427 - RNA, 16 nt, Shigella flexneri 2a str. 301
aucgccugaauuacug

SEQ ID NO: 3904428 - RNA, 16 nt, Shigella flexneri 2a str. 301
aucgccugccgcagga

SEQ ID NO: 3904429 - RNA, 19 nt, Shigella flexneri 2a str. 301
aucgccuggacaucaugcu

SEQ ID NO: 3904430 - RNA, 22 nt, Shigella flexneri 2a str. 301
aucgccuguggcguaaagccuu

SEQ ID NO: 3904431 - RNA, 23 nt, Shigella flexneri 2a str. 301
aucgccuuuugcccggcaacaac

SEQ ID NO: 3904432 - RNA, 21 nt, Shigella flexneri 2a str. 301
aucgcgaaaaaaaagauggcu

SEQ ID NO: 3904433 - RNA, 16 nt, Shigella flexneri 2a str. 301
aucgcgaaaccacggu

SEQ ID NO: 3904434 - RNA, 16 nt, Shigella flexneri 2a str. 301
aucgcgaagaaagcgg

SEQ ID NO: 3904435 - RNA, 17 nt, Shigella flexneri 2a str. 301
aucgcgauacaccagau

SEQ ID NO: 3904436 - RNA, 14 nt, Shigella flexneri 2a str. 301
aucgcgaucgccaa

SEQ ID NO: 3904437 - RNA, 19 nt, Shigella flexneri 2a str. 301
aucgcgauggcaagcggug

SEQ ID NO: 3904438 - RNA, 20 nt, Shigella flexneri 2a str. 301
aucgcgaugggucgccgcaa

SEQ ID NO: 3904439 - RNA, 14 nt, Shigella flexneri 2a str. 301
aucgcgcaacgucg

SEQ ID NO: 3904440 - RNA, 14 nt, Shigella flexneri 2a str. 301
aucgcgcagcagau

SEQ ID NO: 3904441 - RNA, 12 nt, Shigella flexneri 2a str. 301
aucgcgcaucag

SEQ ID NO: 3904442 - RNA, 14 nt, Shigella flexneri 2a str. 301
aucgcgccaaucag

SEQ ID NO: 3904443 - RNA, 19 nt, Shigella flexneri 2a str. 301
aucgcgccaaucagcgcag

SEQ ID NO: 3904444 - RNA, 16 nt, Shigella flexneri 2a str. 301
aucgcgcccaaaccac

SEQ ID NO: 3904445 - RNA, 23 nt, Shigella flexneri 2a str. 301
aucgcgccgccgcccaugaugac

SEQ ID NO: 3904446 - RNA, 18 nt, Shigella flexneri 2a str. 301
aucgcgcuaauuccaguc

SEQ ID NO: 3904447 - RNA, 17 nt, Shigella flexneri 2a str. 301
aucgcgcuuaucgccag

SEQ ID NO: 3904448 - RNA, 14 nt, Shigella flexneri 2a str. 301
aucgcggcacacag

SEQ ID NO: 3904449 - RNA, 14 nt, Shigella flexneri 2a str. 301
aucgcggcacagaa

SEQ ID NO: 3904450 - RNA, 24 nt, Shigella flexneri 2a str. 301
aucgcggcgauauccagcgcggcg

SEQ ID NO: 3904451 - RNA, 23 nt, Shigella flexneri 2a str. 301
aucgcggcuuauugcuucaagau

SEQ ID NO: 3904452 - RNA, 22 nt, Shigella flexneri 2a str. 301
aucgcguaaggcuucaaucaau

SEQ ID NO: 3904453 - RNA, 14 nt, Shigella flexneri 2a str. 301
aucgcguaaugcuu

SEQ ID NO: 3904454 - RNA, 23 nt, Shigella flexneri 2a str. 301
aucgcguuugcgcuccggcggca

SEQ ID NO: 3904455 - RNA, 13 nt, Shigella flexneri 2a str. 301
aucgcuacaccaa

SEQ ID NO: 3904456 - RNA, 22 nt, Shigella flexneri 2a str. 301
aucgcuauuaacccgcaacagc

SEQ ID NO: 3904457 - RNA, 15 nt, Shigella flexneri 2a str. 301
aucgcucagcgcauc

SEQ ID NO: 3904458 - RNA, 21 nt, Shigella flexneri 2a str. 301
aucgcucaucagcuccgguau

SEQ ID NO: 3904459 - RNA, 18 nt, Shigella flexneri 2a str. 301
aucgcucaucugcugcgu

SEQ ID NO: 3904460 - RNA, 14 nt, Shigella flexneri 2a str. 301
aucgcuccacgcca

SEQ ID NO: 3904461 - RNA, 17 nt, Shigella flexneri 2a str. 301
aucgcucgucgcgacga

SEQ ID NO: 3904462 - RNA, 17 nt, Shigella flexneri 2a str. 301
aucucaaucgcacccgc

SEQ ID NO: 3904463 - RNA, 16 nt, Shigella flexneri 2a str. 301
aucucaaucuucacgu

SEQ ID NO: 3904464 - RNA, 21 nt, Shigella flexneri 2a str. 301
aucucaauuuucacuuucggc

SEQ ID NO: 3904465 - RNA, 13 nt, Shigella flexneri 2a str. 301
aucucaccagauu

SEQ ID NO: 3904466 - RNA, 23 nt, Shigella flexneri 2a str. 301
aucucacccauagauaccuucuu

SEQ ID NO: 3904467 - RNA, 16 nt, Shigella flexneri 2a str. 301
aucucaccguugccaa

SEQ ID NO: 3904468 - RNA, 19 nt, Shigella flexneri 2a str. 301
aucucagauaaaugcaaac

SEQ ID NO: 3904469 - RNA, 22 nt, Shigella flexneri 2a str. 301
aucucagauaaaugcaaacgca

SEQ ID NO: 3904470 - RNA, 16 nt, Shigella flexneri 2a str. 301
aucucauagcgcccuu

SEQ ID NO: 3904471 - RNA, 13 nt, Shigella flexneri 2a str. 301
aucucaucagcgu

SEQ ID NO: 3904472 - RNA, 17 nt, Shigella flexneri 2a str. 301
aucuccagauaauuaug

SEQ ID NO: 3904473 - RNA, 13 nt, Shigella flexneri 2a str. 301
aucuccagcgcau

SEQ ID NO: 3904474 - RNA, 17 nt, Shigella flexneri 2a str. 301
aucuccgcacagcgguu

SEQ ID NO: 3904475 - RNA, 14 nt, Shigella flexneri 2a str. 301
aucuccgcuggagc

SEQ ID NO: 3904476 - RNA, 14 nt, Shigella flexneri 2a str. 301
aucuccggccugca

SEQ ID NO: 3904477 - RNA, 18 nt, Shigella flexneri 2a str. 301
aucuccggcgguaaaugc

SEQ ID NO: 3904478 - RNA, 15 nt, Shigella flexneri 2a str. 301
aucucgccagugacc

SEQ ID NO: 3904479 - RNA, 21 nt, Shigella flexneri 2a str. 301
aucucgcucaaaaauccagau

SEQ ID NO: 3904480 - RNA, 15 nt, Shigella flexneri 2a str. 301
aucucgguggaaaau

SEQ ID NO: 3904481 - RNA, 16 nt, Shigella flexneri 2a str. 301
aucucgguggaaaaua

SEQ ID NO: 3904482 - RNA, 17 nt, Shigella flexneri 2a str. 301
aucucgguggaaaauag

SEQ ID NO: 3904483 - RNA, 14 nt, Shigella flexneri 2a str. 301
aucucguugaucac

SEQ ID NO: 3904484 - RNA, 18 nt, Shigella flexneri 2a str. 301
aucucguugaucacccac

SEQ ID NO: 3904485 - RNA, 18 nt, Shigella flexneri 2a str. 301
aucucuacaccaacgccc

SEQ ID NO: 3904486 - RNA, 14 nt, Shigella flexneri 2a str. 301
aucucucgcaucag

SEQ ID NO: 3904487 - RNA, 16 nt, Shigella flexneri 2a str. 301
aucucugcgcuaucca

SEQ ID NO: 3904488 - RNA, 23 nt, Shigella flexneri 2a str. 301
aucucugcgcuauccagcgcaua

SEQ ID NO: 3904489 - RNA, 22 nt, Shigella flexneri 2a str. 301
aucucuucacgcuuugcaggcu

SEQ ID NO: 3904490 - RNA, 18 nt, Shigella flexneri 2a str. 301
aucucuuccagaauaucu

SEQ ID NO: 3904491 - RNA, 12 nt, Shigella flexneri 2a str. 301
aucucuucccau

SEQ ID NO: 3904492 - RNA, 20 nt, Shigella flexneri 2a str. 301
aucucuuccggcaccacaaa

SEQ ID NO: 3904493 - RNA, 14 nt, Shigella flexneri 2a str. 301
aucucuucgccugc

SEQ ID NO: 3904494 - RNA, 18 nt, Shigella flexneri 2a str. 301
aucucuucgccugccugc

SEQ ID NO: 3904495 - RNA, 16 nt, Shigella flexneri 2a str. 301
aucucuugcuggcauu

SEQ ID NO: 3904496 - RNA, 17 nt, Shigella flexneri 2a str. 301
aucucuuuccacaaugu

SEQ ID NO: 3904497 - RNA, 11 nt, Shigella flexneri 2a str. 301
aucugaauauu

SEQ ID NO: 3904498 - RNA, 14 nt, Shigella flexneri 2a str. 301
aucugaaucaaaau

SEQ ID NO: 3904499 - RNA, 15 nt, Shigella flexneri 2a str. 301
aucugaaucaaaauc

SEQ ID NO: 3904500 - RNA, 12 nt, Shigella flexneri 2a str. 301
aucugaaucagc

SEQ ID NO: 3904501 - RNA, 24 nt, Shigella flexneri 2a str. 301
aucugaauggcugcauuccuuguu

SEQ ID NO: 3904502 - RNA, 12 nt, Shigella flexneri 2a str. 301
aucugacaacac

SEQ ID NO: 3904503 - RNA, 18 nt, Shigella flexneri 2a str. 301
aucugaccgaaugcaguc

SEQ ID NO: 3904504 - RNA, 19 nt, Shigella flexneri 2a str. 301
aucugauagugauccauca

SEQ ID NO: 3904505 - RNA, 22 nt, Shigella flexneri 2a str. 301
aucugauauaccgccgccagca

SEQ ID NO: 3904506 - RNA, 14 nt, Shigella flexneri 2a str. 301
aucugaucaauaua

SEQ ID NO: 3904507 - RNA, 18 nt, Shigella flexneri 2a str. 301
aucugaugauauuuuucc

SEQ ID NO: 3904508 - RNA, 15 nt, Shigella flexneri 2a str. 301
aucugauuaauauug

SEQ ID NO: 3904509 - RNA, 19 nt, Shigella flexneri 2a str. 301
aucugcaaaucgaucucaa

SEQ ID NO: 3904510 - RNA, 15 nt, Shigella flexneri 2a str. 301
aucugcaauuacugc

SEQ ID NO: 3904511 - RNA, 14 nt, Shigella flexneri 2a str. 301
aucugcacggugug

SEQ ID NO: 3904512 - RNA, 18 nt, Shigella flexneri 2a str. 301
aucugccagaaggauuga

SEQ ID NO: 3904513 - RNA, 18 nt, Shigella flexneri 2a str. 301
aucugccagauaauggcu

SEQ ID NO: 3904514 - RNA, 12 nt, Shigella flexneri 2a str. 301
aucugccagcaa

SEQ ID NO: 3904515 - RNA, 16 nt, Shigella flexneri 2a str. 301
aucugccagcguaaau

SEQ ID NO: 3904516 - RNA, 14 nt, Shigella flexneri 2a str. 301
aucugccccauugc

SEQ ID NO: 3904517 - RNA, 23 nt, Shigella flexneri 2a str. 301
aucugccgaacaggcugcucgca

SEQ ID NO: 3904518 - RNA, 21 nt, Shigella flexneri 2a str. 301
aucugccgauacgcuggaugg

SEQ ID NO: 3904519 - RNA, 18 nt, Shigella flexneri 2a str. 301
aucugccuuauugaagcu

SEQ ID NO: 3904520 - RNA, 14 nt, Shigella flexneri 2a str. 301
aucugcgggaacau

SEQ ID NO: 3904521 - RNA, 22 nt, Shigella flexneri 2a str. 301
aucugcgggaacauaugcacau

SEQ ID NO: 3904522 - RNA, 19 nt, Shigella flexneri 2a str. 301
aucugcggguuagucugca

SEQ ID NO: 3904523 - RNA, 20 nt, Shigella flexneri 2a str. 301
aucugcggguuagucugcau

SEQ ID NO: 3904524 - RNA, 21 nt, Shigella flexneri 2a str. 301
aucugcguaucgcccugccaa

SEQ ID NO: 3904525 - RNA, 16 nt, Shigella flexneri 2a str. 301
aucugcgucgcuuucc

SEQ ID NO: 3904526 - RNA, 15 nt, Shigella flexneri 2a str. 301
aucugcguggcgcgc

SEQ ID NO: 3904527 - RNA, 18 nt, Shigella flexneri 2a str. 301
aucugcuccuguugaugu

SEQ ID NO: 3904528 - RNA, 13 nt, Shigella flexneri 2a str. 301
aucugcuguucua

SEQ ID NO: 3904529 - RNA, 14 nt, Shigella flexneri 2a str. 301
aucuggauccacga

SEQ ID NO: 3904530 - RNA, 15 nt, Shigella flexneri 2a str. 301
aucuggauccacgau

SEQ ID NO: 3904531 - RNA, 17 nt, Shigella flexneri 2a str. 301
aucuggcacuauuggcg

SEQ ID NO: 3904532 - RNA, 20 nt, Shigella flexneri 2a str. 301
aucuggcauaaacaaagcgc

SEQ ID NO: 3904533 - RNA, 16 nt, Shigella flexneri 2a str. 301
aucuggcgagucacca

SEQ ID NO: 3904534 - RNA, 16 nt, Shigella flexneri 2a str. 301
aucuggcuugccagca

SEQ ID NO: 3904535 - RNA, 22 nt, Shigella flexneri 2a str. 301
aucugguguuaaaucuguucau

SEQ ID NO: 3904536 - RNA, 23 nt, Shigella flexneri 2a str. 301
aucuguauggcccggaaacccug

SEQ ID NO: 3904537 - RNA, 13 nt, Shigella flexneri 2a str. 301
aucugucauaaca

SEQ ID NO: 3904538 - RNA, 15 nt, Shigella flexneri 2a str. 301
aucugucauaacaca

SEQ ID NO: 3904539 - RNA, 19 nt, Shigella flexneri 2a str. 301
aucugucuguacggcagug

SEQ ID NO: 3904540 - RNA, 23 nt, Shigella flexneri 2a str. 301
aucugucuguacggcagugaaca

SEQ ID NO: 3904541 - RNA, 13 nt, Shigella flexneri 2a str. 301
aucugugaacuca

SEQ ID NO: 3904542 - RNA, 22 nt, Shigella flexneri 2a str. 301
aucugugugggcacucgaagau

SEQ ID NO: 3904543 - RNA, 16 nt, Shigella flexneri 2a str. 301
aucuguucagcaaaaa

SEQ ID NO: 3904544 - RNA, 23 nt, Shigella flexneri 2a str. 301
aucuguuccggcguacgggcaaa

SEQ ID NO: 3904545 - RNA, 13 nt, Shigella flexneri 2a str. 301
aucuguugcugcc

SEQ ID NO: 3904546 - RNA, 16 nt, Shigella flexneri 2a str. 301
aucuguugugccacau

SEQ ID NO: 3904547 - RNA, 21 nt, Shigella flexneri 2a str. 301
aucuguuugccagucuggcuu

SEQ ID NO: 3904548 - RNA, 11 nt, Shigella flexneri 2a str. 301
aucuguuuuag

SEQ ID NO: 3904549 - RNA, 19 nt, Shigella flexneri 2a str. 301
aucuuacggcugcggaugu

SEQ ID NO: 3904550 - RNA, 14 nt, Shigella flexneri 2a str. 301
aucuuagguaauga

SEQ ID NO: 3904551 - RNA, 15 nt, Shigella flexneri 2a str. 301
aucuuagugcgccug

SEQ ID NO: 3904552 - RNA, 13 nt, Shigella flexneri 2a str. 301
aucuuaucacgau

SEQ ID NO: 3904553 - RNA, 23 nt, Shigella flexneri 2a str. 301
aucuuaucacgaugcuaaaaaca

SEQ ID NO: 3904554 - RNA, 15 nt, Shigella flexneri 2a str. 301
aucuuaugauguaaa

SEQ ID NO: 3904555 - RNA, 20 nt, Shigella flexneri 2a str. 301
aucuuaugauguaaauaaca

SEQ ID NO: 3904556 - RNA, 22 nt, Shigella flexneri 2a str. 301
aucuuaugauguaaauaacaga

SEQ ID NO: 3904557 - RNA, 20 nt, Shigella flexneri 2a str. 301
aucuuauugcucgaccuaaa

SEQ ID NO: 3904558 - RNA, 20 nt, Shigella flexneri 2a str. 301
aucuucaaccgucaccagcc

SEQ ID NO: 3904559 - RNA, 18 nt, Shigella flexneri 2a str. 301
aucuucaaucagaugugc

SEQ ID NO: 3904560 - RNA, 18 nt, Shigella flexneri 2a str. 301
aucuucacacugaugaca

SEQ ID NO: 3904561 - RNA, 15 nt, Shigella flexneri 2a str. 301
aucuucacaucauca

SEQ ID NO: 3904562 - RNA, 18 nt, Shigella flexneri 2a str. 301
augagaaaauuucauuaa

SEQ ID NO: 3904563 - RNA, 15 nt, Shigella flexneri 2a str. 301
augagaacaguucag

SEQ ID NO: 3904564 - RNA, 12 nt, Shigella flexneri 2a str. 301
augagaauaauc

SEQ ID NO: 3904565 - RNA, 12 nt, Shigella flexneri 2a str. 301
augagcaccgca

SEQ ID NO: 3904566 - RNA, 18 nt, Shigella flexneri 2a str. 301
augagcaccgcaccuaaa

SEQ ID NO: 3904567 - RNA, 13 nt, Shigella flexneri 2a str. 301
augagcagaccaa

SEQ ID NO: 3904568 - RNA, 15 nt, Shigella flexneri 2a str. 301
augagcagaccaaua

SEQ ID NO: 3904569 - RNA, 18 nt, Shigella flexneri 2a str. 301
augagcagguacuggaaa

SEQ ID NO: 3904570 - RNA, 19 nt, Shigella flexneri 2a str. 301
augagcuuucgcuucuuga

SEQ ID NO: 3904571 - RNA, 19 nt, Shigella flexneri 2a str. 301
augaggcguuaacagcgca

SEQ ID NO: 3904572 - RNA, 18 nt, Shigella flexneri 2a str. 301
augaggcuuuaauaccug

SEQ ID NO: 3904573 - RNA, 20 nt, Shigella flexneri 2a str. 301
augaggcuuuaauaccugcc

SEQ ID NO: 3904574 - RNA, 15 nt, Shigella flexneri 2a str. 301
augagguuucccgcc

SEQ ID NO: 3904575 - RNA, 23 nt, Shigella flexneri 2a str. 301
augagguuugguagcaaaacaau

SEQ ID NO: 3904576 - RNA, 16 nt, Shigella flexneri 2a str. 301
augagugccaaaaaaa

SEQ ID NO: 3904577 - RNA, 21 nt, Shigella flexneri 2a str. 301
augagugccaaaaaaauaagc

SEQ ID NO: 3904578 - RNA, 19 nt, Shigella flexneri 2a str. 301
augaguuauacagaguguu

SEQ ID NO: 3904579 - RNA, 21 nt, Shigella flexneri 2a str. 301
augaguuuggugccacgcgca

SEQ ID NO: 3904580 - RNA, 22 nt, Shigella flexneri 2a str. 301
augaguuuggugccacgcgcau

SEQ ID NO: 3904581 - RNA, 11 nt, Shigella flexneri 2a str. 301
augauaagccu

SEQ ID NO: 3904582 - RNA, 14 nt, Shigella flexneri 2a str. 301
augauaauuauuau

SEQ ID NO: 3904583 - RNA, 21 nt, Shigella flexneri 2a str. 301
augauacagccgacaaugcca

SEQ ID NO: 3904584 - RNA, 14 nt, Shigella flexneri 2a str. 301
augauagccaggcg

SEQ ID NO: 3904585 - RNA, 16 nt, Shigella flexneri 2a str. 301
augauagccauuauca

SEQ ID NO: 3904586 - RNA, 21 nt, Shigella flexneri 2a str. 301
augauaucgcuggcaggcaaa

SEQ ID NO: 3904587 - RNA, 17 nt, Shigella flexneri 2a str. 301
augauauggucaaugau

SEQ ID NO: 3904588 - RNA, 13 nt, Shigella flexneri 2a str. 301
augauauuuuucc

SEQ ID NO: 3904589 - RNA, 15 nt, Shigella flexneri 2a str. 301
augaucaaaaucaua

SEQ ID NO: 3904590 - RNA, 14 nt, Shigella flexneri 2a str. 301
augaucaccugcau

SEQ ID NO: 3904591 - RNA, 20 nt, Shigella flexneri 2a str. 301
augaucaccugcauacaaau

SEQ ID NO: 3904592 - RNA, 23 nt, Shigella flexneri 2a str. 301
augaucaccugcauacaaauaag

SEQ ID NO: 3904593 - RNA, 19 nt, Shigella flexneri 2a str. 301
augaucagcgguuuugcca

SEQ ID NO: 3904594 - RNA, 15 nt, Shigella flexneri 2a str. 301
augaucaucaaggcu

SEQ ID NO: 3904595 - RNA, 14 nt, Shigella flexneri 2a str. 301
augaucauccgccu

SEQ ID NO: 3904596 - RNA, 19 nt, Shigella flexneri 2a str. 301
augaucgaggcaaagaguu

SEQ ID NO: 3904597 - RNA, 23 nt, Shigella flexneri 2a str. 301
augaucgccaucagugccaguac

SEQ ID NO: 3904598 - RNA, 12 nt, Shigella flexneri 2a str. 301
augaucgccgua

SEQ ID NO: 3904599 - RNA, 20 nt, Shigella flexneri 2a str. 301
augaucugcgcccaauaucc

SEQ ID NO: 3904600 - RNA, 13 nt, Shigella flexneri 2a str. 301
augaucuuaugau

SEQ ID NO: 3904601 - RNA, 23 nt, Shigella flexneri 2a str. 301
augaugaucuuaugauguaaaua

SEQ ID NO: 3904602 - RNA, 14 nt, Shigella flexneri 2a str. 301
augaugaugcaaac

SEQ ID NO: 3904603 - RNA, 20 nt, Shigella flexneri 2a str. 301
augaugcaaacauggaaacc

SEQ ID NO: 3904604 - RNA, 14 nt, Shigella flexneri 2a str. 301
augaugccggaauc

SEQ ID NO: 3904605 - RNA, 18 nt, Shigella flexneri 2a str. 301
augaugcgccaauugccu

SEQ ID NO: 3904606 - RNA, 13 nt, Shigella flexneri 2a str. 301
augaugcgucuca

SEQ ID NO: 3904607 - RNA, 18 nt, Shigella flexneri 2a str. 301
augauggcauucucacuc

SEQ ID NO: 3904608 - RNA, 19 nt, Shigella flexneri 2a str. 301
augauggcauucucacucc

SEQ ID NO: 3904609 - RNA, 20 nt, Shigella flexneri 2a str. 301
augauggccuuuuugugcuu

SEQ ID NO: 3904610 - RNA, 16 nt, Shigella flexneri 2a str. 301
augauggcgauaaucu

SEQ ID NO: 3904611 - RNA, 15 nt, Shigella flexneri 2a str. 301
augauguaaauaaca

SEQ ID NO: 3904612 - RNA, 14 nt, Shigella flexneri 2a str. 301
augaugucgcuguc

SEQ ID NO: 3904613 - RNA, 13 nt, Shigella flexneri 2a str. 301
augauuccggcaa

SEQ ID NO: 3904614 - RNA, 16 nt, Shigella flexneri 2a str. 301
augauuuaauggaugu

SEQ ID NO: 3904615 - RNA, 19 nt, Shigella flexneri 2a str. 301
augauuucgucauccggug

SEQ ID NO: 3904616 - RNA, 15 nt, Shigella flexneri 2a str. 301
augauuugaucccag

SEQ ID NO: 3904617 - RNA, 15 nt, Shigella flexneri 2a str. 301
augauuuuccugagg

SEQ ID NO: 3904618 - RNA, 17 nt, Shigella flexneri 2a str. 301
augauuuugauggaaga

SEQ ID NO: 3904619 - RNA, 14 nt, Shigella flexneri 2a str. 301
augcaaaaaggcau

SEQ ID NO: 3904620 - RNA, 14 nt, Shigella flexneri 2a str. 301
augcaaacauggaa

SEQ ID NO: 3904621 - RNA, 19 nt, Shigella flexneri 2a str. 301
augcaaacauggaaaccau

SEQ ID NO: 3904622 - RNA, 18 nt, Shigella flexneri 2a str. 301
augcaacaacugaaaaaa

SEQ ID NO: 3904623 - RNA, 15 nt, Shigella flexneri 2a str. 301
augcaacuguuuuac

SEQ ID NO: 3904624 - RNA, 20 nt, Shigella flexneri 2a str. 301
augcaacuguuuuaccaaau

SEQ ID NO: 3904625 - RNA, 18 nt, Shigella flexneri 2a str. 301
augcaauaaauauguuac

SEQ ID NO: 3904626 - RNA, 18 nt, Shigella flexneri 2a str. 301
augcaccgacaauccggu

SEQ ID NO: 3904627 - RNA, 22 nt, Shigella flexneri 2a str. 301
augcaccuggggcuugccagag

SEQ ID NO: 3904628 - RNA, 14 nt, Shigella flexneri 2a str. 301
augcacgauaacgu

SEQ ID NO: 3904629 - RNA, 18 nt, Shigella flexneri 2a str. 301
augcacgcucuguucugc

SEQ ID NO: 3904630 - RNA, 20 nt, Shigella flexneri 2a str. 301
augcacucgcauccucuuua

SEQ ID NO: 3904631 - RNA, 18 nt, Shigella flexneri 2a str. 301
augcacugcaacgccuuu

SEQ ID NO: 3904632 - RNA, 21 nt, Shigella flexneri 2a str. 301
augcagaaaccaaagcgguug

SEQ ID NO: 3904633 - RNA, 14 nt, Shigella flexneri 2a str. 301
augcagauaaucgu

SEQ ID NO: 3904634 - RNA, 23 nt, Shigella flexneri 2a str. 301
augcagauccuguuggccaaccc

SEQ ID NO: 3904635 - RNA, 20 nt, Shigella flexneri 2a str. 301
augcagcauggucagguauu

SEQ ID NO: 3904636 - RNA, 22 nt, Shigella flexneri 2a str. 301
augcagcauugccugaugcgcu

SEQ ID NO: 3904637 - RNA, 15 nt, Shigella flexneri 2a str. 301
augcagccaggccau

SEQ ID NO: 3904638 - RNA, 18 nt, Shigella flexneri 2a str. 301
augcagcccagcaucaga

SEQ ID NO: 3904639 - RNA, 11 nt, Shigella flexneri 2a str. 301
augcagcgaug

SEQ ID NO: 3904640 - RNA, 16 nt, Shigella flexneri 2a str. 301
augcagcguuuccagc

SEQ ID NO: 3904641 - RNA, 16 nt, Shigella flexneri 2a str. 301
augcagcguuugcugu

SEQ ID NO: 3904642 - RNA, 20 nt, Shigella flexneri 2a str. 301
augcaggcggugcaauucca

SEQ ID NO: 3904643 - RNA, 19 nt, Shigella flexneri 2a str. 301
augcagggcaaacucugag

SEQ ID NO: 3904644 - RNA, 17 nt, Shigella flexneri 2a str. 301
augcagguuaccgguuu

SEQ ID NO: 3904645 - RNA, 15 nt, Shigella flexneri 2a str. 301
augcaguaccagaua

SEQ ID NO: 3904646 - RNA, 17 nt, Shigella flexneri 2a str. 301
augcaguaccagauaau

SEQ ID NO: 3904647 - RNA, 18 nt, Shigella flexneri 2a str. 301
augcagucgcuguauuuu

SEQ ID NO: 3904648 - RNA, 15 nt, Shigella flexneri 2a str. 301
augcagugcauccag

SEQ ID NO: 3904649 - RNA, 20 nt, Shigella flexneri 2a str. 301
augcagugcauccagcagcc

SEQ ID NO: 3904650 - RNA, 16 nt, Shigella flexneri 2a str. 301
augcagugccgcugcu

SEQ ID NO: 3904651 - RNA, 21 nt, Shigella flexneri 2a str. 301
augcauaacagauaaaucaua

SEQ ID NO: 3904652 - RNA, 15 nt, Shigella flexneri 2a str. 301
augcauaauccgccg

SEQ ID NO: 3904653 - RNA, 17 nt, Shigella flexneri 2a str. 301
augcaucagaucggcag

SEQ ID NO: 3904654 - RNA, 14 nt, Shigella flexneri 2a str. 301
augcaucagccaac

SEQ ID NO: 3904655 - RNA, 19 nt, Shigella flexneri 2a str. 301
augcaucaggaccugcucu

SEQ ID NO: 3904656 - RNA, 22 nt, Shigella flexneri 2a str. 301
augcaucaggaccugcucugcc

SEQ ID NO: 3904657 - RNA, 11 nt, Shigella flexneri 2a str. 301
augcaucagug

SEQ ID NO: 3904658 - RNA, 18 nt, Shigella flexneri 2a str. 301
augcaucaugaaaaccgu

SEQ ID NO: 3904659 - RNA, 12 nt, Shigella flexneri 2a str. 301
augcaucccgcc

SEQ ID NO: 3904660 - RNA, 16 nt, Shigella flexneri 2a str. 301
augcauccggcaguca

SEQ ID NO: 3904661 - RNA, 17 nt, Shigella flexneri 2a str. 301
augcauccggcagucag

SEQ ID NO: 3904662 - RNA, 19 nt, Shigella flexneri 2a str. 301
augcggagacucaaacccc

SEQ ID NO: 3904663 - RNA, 22 nt, Shigella flexneri 2a str. 301
augcggcaucuucuccacgcca

SEQ ID NO: 3904664 - RNA, 16 nt, Shigella flexneri 2a str. 301
augcggcgacuggaua

SEQ ID NO: 3904665 - RNA, 12 nt, Shigella flexneri 2a str. 301
augcggcgagga

SEQ ID NO: 3904666 - RNA, 17 nt, Shigella flexneri 2a str. 301
augcggcguaaaugccu

SEQ ID NO: 3904667 - RNA, 16 nt, Shigella flexneri 2a str. 301
augcggcguuaacgcc

SEQ ID NO: 3904668 - RNA, 18 nt, Shigella flexneri 2a str. 301
augcggggauuacucccc

SEQ ID NO: 3904669 - RNA, 15 nt, Shigella flexneri 2a str. 301
augcggggugcaucg

SEQ ID NO: 3904670 - RNA, 23 nt, Shigella flexneri 2a str. 301
augcggucguaaucgcccgcuuc

SEQ ID NO: 3904671 - RNA, 19 nt, Shigella flexneri 2a str. 301
augcgucagcaacaugccg

SEQ ID NO: 3904672 - RNA, 14 nt, Shigella flexneri 2a str. 301
augcguucucccuc

SEQ ID NO: 3904673 - RNA, 16 nt, Shigella flexneri 2a str. 301
augcguugucgccauc

SEQ ID NO: 3904674 - RNA, 16 nt, Shigella flexneri 2a str. 301
augcguuuagccgccg

SEQ ID NO: 3904675 - RNA, 15 nt, Shigella flexneri 2a str. 301
augcguuugccagcg

SEQ ID NO: 3904676 - RNA, 16 nt, Shigella flexneri 2a str. 301
augcguuuuccggcac

SEQ ID NO: 3904677 - RNA, 13 nt, Shigella flexneri 2a str. 301
augcuaaaaacau

SEQ ID NO: 3904678 - RNA, 22 nt, Shigella flexneri 2a str. 301
augcuaaaaacaucaugauuca

SEQ ID NO: 3904679 - RNA, 16 nt, Shigella flexneri 2a str. 301
augcuaagccgugcau

SEQ ID NO: 3904680 - RNA, 22 nt, Shigella flexneri 2a str. 301
augcucacaaccccggcaaaug

SEQ ID NO: 3904681 - RNA, 21 nt, Shigella flexneri 2a str. 301
augcucauucuuccuccagcg

SEQ ID NO: 3904682 - RNA, 20 nt, Shigella flexneri 2a str. 301
augcuccacgcugcaucgcc

SEQ ID NO: 3904683 - RNA, 18 nt, Shigella flexneri 2a str. 301
augcucgaacgccucugc

SEQ ID NO: 3904684 - RNA, 16 nt, Shigella flexneri 2a str. 301
augcucgcuggcaggc

SEQ ID NO: 3904685 - RNA, 13 nt, Shigella flexneri 2a str. 301
augcucuccacca

SEQ ID NO: 3904686 - RNA, 15 nt, Shigella flexneri 2a str. 301
augcucucccaaaua

SEQ ID NO: 3904687 - RNA, 14 nt, Shigella flexneri 2a str. 301
augcucugccagcg

SEQ ID NO: 3904688 - RNA, 12 nt, Shigella flexneri 2a str. 301
augcugaaguaa

SEQ ID NO: 3904689 - RNA, 16 nt, Shigella flexneri 2a str. 301
augcugaaucgccaaa

SEQ ID NO: 3904690 - RNA, 18 nt, Shigella flexneri 2a str. 301
augcugaaucgccaaaaa

SEQ ID NO: 3904691 - RNA, 22 nt, Shigella flexneri 2a str. 301
augcugaaucgccaaaaacaua

SEQ ID NO: 3904692 - RNA, 23 nt, Shigella flexneri 2a str. 301
augcugauuuuggucaugcuaag

SEQ ID NO: 3904693 - RNA, 14 nt, Shigella flexneri 2a str. 301
augcugcaauaaaa

SEQ ID NO: 3904694 - RNA, 15 nt, Shigella flexneri 2a str. 301
augcugcacgccauc

SEQ ID NO: 3904695 - RNA, 19 nt, Shigella flexneri 2a str. 301
augcugccgauggcgcaaa

SEQ ID NO: 3904696 - RNA, 20 nt, Shigella flexneri 2a str. 301
augcugccgauggcgcaaac

SEQ ID NO: 3904697 - RNA, 23 nt, Shigella flexneri 2a str. 301
augcugccgauggcgcaaacuua

SEQ ID NO: 3904698 - RNA, 20 nt, Shigella flexneri 2a str. 301
augcugcgccaguugcuuau

SEQ ID NO: 3904699 - RNA, 21 nt, Shigella flexneri 2a str. 301
augcugcuuuaucagaucacg

SEQ ID NO: 3904700 - RNA, 19 nt, Shigella flexneri 2a str. 301
augcuggaaccacagcgcc

SEQ ID NO: 3904701 - RNA, 18 nt, Shigella flexneri 2a str. 301
augcuggccuuuuuggca

SEQ ID NO: 3904702 - RNA, 17 nt, Shigella flexneri 2a str. 301
augcuggcugcgcucug

SEQ ID NO: 3904703 - RNA, 21 nt, Shigella flexneri 2a str. 301
augcugguaauccgagaaucg

SEQ ID NO: 3904704 - RNA, 14 nt, Shigella flexneri 2a str. 301
augcugguuuugug

SEQ ID NO: 3904705 - RNA, 21 nt, Shigella flexneri 2a str. 301
augcuguaaccagcgcagaca

SEQ ID NO: 3904706 - RNA, 19 nt, Shigella flexneri 2a str. 301
augcuguauucuucagcga

SEQ ID NO: 3904707 - RNA, 22 nt, Shigella flexneri 2a str. 301
augcuguccuaaaaaauuaaca

SEQ ID NO: 3904708 - RNA, 16 nt, Shigella flexneri 2a str. 301
augcugugaagauggc

SEQ ID NO: 3904709 - RNA, 19 nt, Shigella flexneri 2a str. 301
augcugugcgccacagaca

SEQ ID NO: 3904710 - RNA, 16 nt, Shigella flexneri 2a str. 301
augcuuccuuccuggg

SEQ ID NO: 3904711 - RNA, 16 nt, Shigella flexneri 2a str. 301
augcuugacucuguag

SEQ ID NO: 3904712 - RNA, 22 nt, Shigella flexneri 2a str. 301
augcuuuccaacuguaccagca

SEQ ID NO: 3904713 - RNA, 16 nt, Shigella flexneri 2a str. 301
augcuuugcaucccag

SEQ ID NO: 3904714 - RNA, 17 nt, Shigella flexneri 2a str. 301
augcuuugcaucccaga

SEQ ID NO: 3904715 - RNA, 19 nt, Shigella flexneri 2a str. 301
augcuuuuuacuagccugc

SEQ ID NO: 3904716 - RNA, 18 nt, Shigella flexneri 2a str. 301
auggaaaucacccagcga

SEQ ID NO: 3904717 - RNA, 18 nt, Shigella flexneri 2a str. 301
auggaaccguacagcaug

SEQ ID NO: 3904718 - RNA, 19 nt, Shigella flexneri 2a str. 301
auggaauggucaauggugg

SEQ ID NO: 3904719 - RNA, 14 nt, Shigella flexneri 2a str. 301
auggacacaggccu

SEQ ID NO: 3904720 - RNA, 15 nt, Shigella flexneri 2a str. 301
auggacacaggccua

SEQ ID NO: 3904721 - RNA, 18 nt, Shigella flexneri 2a str. 301
auggacaccagcucagug

SEQ ID NO: 3904722 - RNA, 17 nt, Shigella flexneri 2a str. 301
auggacgcagaccaaag

SEQ ID NO: 3904723 - RNA, 13 nt, Shigella flexneri 2a str. 301
auggacuuuauga

SEQ ID NO: 3904724 - RNA, 13 nt, Shigella flexneri 2a str. 301
auggagugagaau

SEQ ID NO: 3904725 - RNA, 19 nt, Shigella flexneri 2a str. 301
auggaucagaguugaaaaa

SEQ ID NO: 3904726 - RNA, 18 nt, Shigella flexneri 2a str. 301
auggaucccucuuucugg

SEQ ID NO: 3904727 - RNA, 20 nt, Shigella flexneri 2a str. 301
auggaucuuugacugaaauu

SEQ ID NO: 3904728 - RNA, 17 nt, Shigella flexneri 2a str. 301
auggauuaccgugaauc

SEQ ID NO: 3904729 - RNA, 21 nt, Shigella flexneri 2a str. 301
auggauuugaaacgaaaucuu

SEQ ID NO: 3904730 - RNA, 16 nt, Shigella flexneri 2a str. 301
auggcaaaacggcucu

SEQ ID NO: 3904731 - RNA, 15 nt, Shigella flexneri 2a str. 301
auggcaaacaaacug

SEQ ID NO: 3904732 - RNA, 17 nt, Shigella flexneri 2a str. 301
auggcaaacugauuauc

SEQ ID NO: 3904733 - RNA, 21 nt, Shigella flexneri 2a str. 301
auggcaauaaagacauccgcc

SEQ ID NO: 3904734 - RNA, 12 nt, Shigella flexneri 2a str. 301
auggcacaaugg

SEQ ID NO: 3904735 - RNA, 18 nt, Shigella flexneri 2a str. 301
auggcagauaaaauacuu

SEQ ID NO: 3904736 - RNA, 16 nt, Shigella flexneri 2a str. 301
auggcaguaucggcaa

SEQ ID NO: 3904737 - RNA, 22 nt, Shigella flexneri 2a str. 301
auggcauauuccgccaccugcg

SEQ ID NO: 3904738 - RNA, 14 nt, Shigella flexneri 2a str. 301
auggcauccgccac

SEQ ID NO: 3904739 - RNA, 16 nt, Shigella flexneri 2a str. 301
auggcauccgccacuu

SEQ ID NO: 3904740 - RNA, 21 nt, Shigella flexneri 2a str. 301
auggcauccgccacuuuaugc

SEQ ID NO: 3904741 - RNA, 23 nt, Shigella flexneri 2a str. 301
auggcauccuguuuucuggaugc

SEQ ID NO: 3904742 - RNA, 21 nt, Shigella flexneri 2a str. 301
auggcaucuacgcucucuuca

SEQ ID NO: 3904743 - RNA, 15 nt, Shigella flexneri 2a str. 301
auggcauuaauaugc

SEQ ID NO: 3904744 - RNA, 14 nt, Shigella flexneri 2a str. 301
auggcauucgucgu

SEQ ID NO: 3904745 - RNA, 17 nt, Shigella flexneri 2a str. 301
auggcauucucacucca

SEQ ID NO: 3904746 - RNA, 20 nt, Shigella flexneri 2a str. 301
auggcauucucacuccagcc

SEQ ID NO: 3904747 - RNA, 21 nt, Shigella flexneri 2a str. 301
auggcauuggccguugccauu

SEQ ID NO: 3904748 - RNA, 17 nt, Shigella flexneri 2a str. 301
auggcccagcccacugg

SEQ ID NO: 3904749 - RNA, 23 nt, Shigella flexneri 2a str. 301
auggcccccguuuuuugaaacag

SEQ ID NO: 3904750 - RNA, 17 nt, Shigella flexneri 2a str. 301
auggccgcuccaagguc

SEQ ID NO: 3904751 - RNA, 22 nt, Shigella flexneri 2a str. 301
auggccgguuuguuauccaccg

SEQ ID NO: 3904752 - RNA, 20 nt, Shigella flexneri 2a str. 301
auggccugaugugacgcugu

SEQ ID NO: 3904753 - RNA, 13 nt, Shigella flexneri 2a str. 301
auggccuuucugg

SEQ ID NO: 3904754 - RNA, 14 nt, Shigella flexneri 2a str. 301
auggcgaauggcac

SEQ ID NO: 3904755 - RNA, 12 nt, Shigella flexneri 2a str. 301
auggcgauacuc

SEQ ID NO: 3904756 - RNA, 20 nt, Shigella flexneri 2a str. 301
auggcgauuucacaagacug

SEQ ID NO: 3904757 - RNA, 17 nt, Shigella flexneri 2a str. 301
auggcgcacauugugcg

SEQ ID NO: 3904758 - RNA, 17 nt, Shigella flexneri 2a str. 301
auggcgcacucaaaacu

SEQ ID NO: 3904759 - RNA, 23 nt, Shigella flexneri 2a str. 301
auggcgcaggauaucguggcacg

SEQ ID NO: 3904760 - RNA, 13 nt, Shigella flexneri 2a str. 301
auggcgcauccag

SEQ ID NO: 3904761 - RNA, 15 nt, Shigella flexneri 2a str. 301
auggcgcgcagaaag

SEQ ID NO: 3904762 - RNA, 18 nt, Shigella flexneri 2a str. 301
augucggaugcggcguga

SEQ ID NO: 3904763 - RNA, 16 nt, Shigella flexneri 2a str. 301
augucgguacagagca

SEQ ID NO: 3904764 - RNA, 19 nt, Shigella flexneri 2a str. 301
augucguauuuauuuucca

SEQ ID NO: 3904765 - RNA, 20 nt, Shigella flexneri 2a str. 301
augucuggcgagcuccaggg

SEQ ID NO: 3904766 - RNA, 21 nt, Shigella flexneri 2a str. 301
augucuggcugagcaaacagu

SEQ ID NO: 3904767 - RNA, 17 nt, Shigella flexneri 2a str. 301
augucugucugacaacc

SEQ ID NO: 3904768 - RNA, 18 nt, Shigella flexneri 2a str. 301
augucuuuuuuccagcac

SEQ ID NO: 3904769 - RNA, 13 nt, Shigella flexneri 2a str. 301
augugaagaggaa

SEQ ID NO: 3904770 - RNA, 17 nt, Shigella flexneri 2a str. 301
augugaauggccagaca

SEQ ID NO: 3904771 - RNA, 15 nt, Shigella flexneri 2a str. 301
augugauaaauacga

SEQ ID NO: 3904772 - RNA, 13 nt, Shigella flexneri 2a str. 301
augugaugccuag

SEQ ID NO: 3904773 - RNA, 16 nt, Shigella flexneri 2a str. 301
augugcaccuuuucca

SEQ ID NO: 3904774 - RNA, 19 nt, Shigella flexneri 2a str. 301
augugcaggauuaauaaau

SEQ ID NO: 3904775 - RNA, 20 nt, Shigella flexneri 2a str. 301
augugcaggauuaauaaauu

SEQ ID NO: 3904776 - RNA, 15 nt, Shigella flexneri 2a str. 301
augugcaguuccugc

SEQ ID NO: 3904777 - RNA, 16 nt, Shigella flexneri 2a str. 301
augugcaguuccugca

SEQ ID NO: 3904778 - RNA, 17 nt, Shigella flexneri 2a str. 301
augugcaguuccugcaa

SEQ ID NO: 3904779 - RNA, 21 nt, Shigella flexneri 2a str. 301
augugccagcuucccgcuggu

SEQ ID NO: 3904780 - RNA, 14 nt, Shigella flexneri 2a str. 301
augugcuucaucag

SEQ ID NO: 3904781 - RNA, 11 nt, Shigella flexneri 2a str. 301
augugcuuuug

SEQ ID NO: 3904782 - RNA, 13 nt, Shigella flexneri 2a str. 301
auguggaaacagu

SEQ ID NO: 3904783 - RNA, 11 nt, Shigella flexneri 2a str. 301
auguggguagc

SEQ ID NO: 3904784 - RNA, 17 nt, Shigella flexneri 2a str. 301
auguguuaaaugauacc

SEQ ID NO: 3904785 - RNA, 23 nt, Shigella flexneri 2a str. 301
auguguuaaugaaaccuucuuga

SEQ ID NO: 3904786 - RNA, 13 nt, Shigella flexneri 2a str. 301
auguguuagcccu

SEQ ID NO: 3904787 - RNA, 15 nt, Shigella flexneri 2a str. 301
auguuaaccaucuca

SEQ ID NO: 3904788 - RNA, 18 nt, Shigella flexneri 2a str. 301
auguuacgaccuuccuga

SEQ ID NO: 3904789 - RNA, 15 nt, Shigella flexneri 2a str. 301
auguuacguuucucu

SEQ ID NO: 3904790 - RNA, 19 nt, Shigella flexneri 2a str. 301
auguuaucaagauauuuca

SEQ ID NO: 3904791 - RNA, 12 nt, Shigella flexneri 2a str. 301
auguuauucaug

SEQ ID NO: 3904792 - RNA, 17 nt, Shigella flexneri 2a str. 301
auguuauuuaauuacug

SEQ ID NO: 3904793 - RNA, 17 nt, Shigella flexneri 2a str. 301
auguucaauaaaagcau

SEQ ID NO: 3904794 - RNA, 22 nt, Shigella flexneri 2a str. 301
auguucaauaagcgcagccaaa

SEQ ID NO: 3904795 - RNA, 13 nt, Shigella flexneri 2a str. 301
auguucacugccg

SEQ ID NO: 3904796 - RNA, 20 nt, Shigella flexneri 2a str. 301
auguucagaaagcgccagca

SEQ ID NO: 3904797 - RNA, 21 nt, Shigella flexneri 2a str. 301
auguucagaaagcgccagcaa

SEQ ID NO: 3904798 - RNA, 19 nt, Shigella flexneri 2a str. 301
auguucagauaaugcccga

SEQ ID NO: 3904799 - RNA, 17 nt, Shigella flexneri 2a str. 301
auguucagauuguugau

SEQ ID NO: 3904800 - RNA, 15 nt, Shigella flexneri 2a str. 301
auguucaucaagcug

SEQ ID NO: 3904801 - RNA, 21 nt, Shigella flexneri 2a str. 301
auguuccggcgacacaucuaa

SEQ ID NO: 3904802 - RNA, 13 nt, Shigella flexneri 2a str. 301
auguuccuccucg

SEQ ID NO: 3904803 - RNA, 13 nt, Shigella flexneri 2a str. 301
auguuccugccag

SEQ ID NO: 3904804 - RNA, 18 nt, Shigella flexneri 2a str. 301
auguuccuucugucauga

SEQ ID NO: 3904805 - RNA, 21 nt, Shigella flexneri 2a str. 301
auguucuggucacucucgacc

SEQ ID NO: 3904806 - RNA, 12 nt, Shigella flexneri 2a str. 301
auguugagcggc

SEQ ID NO: 3904807 - RNA, 20 nt, Shigella flexneri 2a str. 301
auguugcaaaggccagccag

SEQ ID NO: 3904808 - RNA, 16 nt, Shigella flexneri 2a str. 301
auguugccacacgccc

SEQ ID NO: 3904809 - RNA, 23 nt, Shigella flexneri 2a str. 301
auguugcgcagaguuuccaggcu

SEQ ID NO: 3904810 - RNA, 17 nt, Shigella flexneri 2a str. 301
auguugcgccucaagaa

SEQ ID NO: 3904811 - RNA, 17 nt, Shigella flexneri 2a str. 301
auguuggagauaacaac

SEQ ID NO: 3904812 - RNA, 18 nt, Shigella flexneri 2a str. 301
auguuguacaugcugcuu

SEQ ID NO: 3904813 - RNA, 13 nt, Shigella flexneri 2a str. 301
auguugucucaga

SEQ ID NO: 3904814 - RNA, 16 nt, Shigella flexneri 2a str. 301
auguuguggccaguaa

SEQ ID NO: 3904815 - RNA, 21 nt, Shigella flexneri 2a str. 301
auguuguuccuuuuauuuaac

SEQ ID NO: 3904816 - RNA, 17 nt, Shigella flexneri 2a str. 301
auguuguuucucuuucu

SEQ ID NO: 3904817 - RNA, 18 nt, Shigella flexneri 2a str. 301
auguuuaguauuguuaaa

SEQ ID NO: 3904818 - RNA, 14 nt, Shigella flexneri 2a str. 301
auguuuaucuacag

SEQ ID NO: 3904819 - RNA, 19 nt, Shigella flexneri 2a str. 301
auguuucaacggaccaaua

SEQ ID NO: 3904820 - RNA, 18 nt, Shigella flexneri 2a str. 301
auguuugaaucaacauau

SEQ ID NO: 3904821 - RNA, 23 nt, Shigella flexneri 2a str. 301
auguuugaaucaacauauuaaaa

SEQ ID NO: 3904822 - RNA, 23 nt, Shigella flexneri 2a str. 301
auguuugucacugacuauuuccg

SEQ ID NO: 3904823 - RNA, 23 nt, Shigella flexneri 2a str. 301
auguuuuaacacacaauuaccuu

SEQ ID NO: 3904824 - RNA, 15 nt, Shigella flexneri 2a str. 301
auuaaaaaguaagaa

SEQ ID NO: 3904825 - RNA, 19 nt, Shigella flexneri 2a str. 301
auuaaaagcguugcggcua

SEQ ID NO: 3904826 - RNA, 21 nt, Shigella flexneri 2a str. 301
auuaaaauucaucaaauggca

SEQ ID NO: 3904827 - RNA, 17 nt, Shigella flexneri 2a str. 301
auuaaaauuucaugcug

SEQ ID NO: 3904828 - RNA, 19 nt, Shigella flexneri 2a str. 301
auuaaacgccauccggcag

SEQ ID NO: 3904829 - RNA, 12 nt, Shigella flexneri 2a str. 301
auuaaagaaagu

SEQ ID NO: 3904830 - RNA, 14 nt, Shigella flexneri 2a str. 301
auuaaagagaucga

SEQ ID NO: 3904831 - RNA, 19 nt, Shigella flexneri 2a str. 301
auuaaagagaucgaacagc

SEQ ID NO: 3904832 - RNA, 15 nt, Shigella flexneri 2a str. 301
auuaaaggcaccaau

SEQ ID NO: 3904833 - RNA, 19 nt, Shigella flexneri 2a str. 301
auuaaauccggcguuuuca

SEQ ID NO: 3904834 - RNA, 18 nt, Shigella flexneri 2a str. 301
auuaaauccugaaaccau

SEQ ID NO: 3904835 - RNA, 22 nt, Shigella flexneri 2a str. 301
auuaaauucaaugaauuaaaaa

SEQ ID NO: 3904836 - RNA, 22 nt, Shigella flexneri 2a str. 301
auuaaauucgaacggugaauuc

SEQ ID NO: 3904837 - RNA, 14 nt, Shigella flexneri 2a str. 301
auuaacaacgggcu

SEQ ID NO: 3904838 - RNA, 23 nt, Shigella flexneri 2a str. 301
auuaacaccuagugcagauaguu

SEQ ID NO: 3904839 - RNA, 15 nt, Shigella flexneri 2a str. 301
auuaacagcaaacag

SEQ ID NO: 3904840 - RNA, 18 nt, Shigella flexneri 2a str. 301
auuaacagucagucucaa

SEQ ID NO: 3904841 - RNA, 22 nt, Shigella flexneri 2a str. 301
auuaaccgggcguuauuuccag

SEQ ID NO: 3904842 - RNA, 18 nt, Shigella flexneri 2a str. 301
auuaaccucaaccacuca

SEQ ID NO: 3904843 - RNA, 20 nt, Shigella flexneri 2a str. 301
auuaacgacacucucuucaa

SEQ ID NO: 3904844 - RNA, 15 nt, Shigella flexneri 2a str. 301
auuaacgauacuucu

SEQ ID NO: 3904845 - RNA, 16 nt, Shigella flexneri 2a str. 301
auuaacgauacuucug

SEQ ID NO: 3904846 - RNA, 20 nt, Shigella flexneri 2a str. 301
auuaacgauacuucugguga

SEQ ID NO: 3904847 - RNA, 15 nt, Shigella flexneri 2a str. 301
auuaacgcaauaaug

SEQ ID NO: 3904848 - RNA, 20 nt, Shigella flexneri 2a str. 301
auuaacgccagccuguucca

SEQ ID NO: 3904849 - RNA, 19 nt, Shigella flexneri 2a str. 301
auuaacgcuuguaaaugaa

SEQ ID NO: 3904850 - RNA, 23 nt, Shigella flexneri 2a str. 301
auuaacggcguuuccuucguuau

SEQ ID NO: 3904851 - RNA, 14 nt, Shigella flexneri 2a str. 301
auuaacguuuccau

SEQ ID NO: 3904852 - RNA, 22 nt, Shigella flexneri 2a str. 301
auuaacucagcauuauuuuuaa

SEQ ID NO: 3904853 - RNA, 22 nt, Shigella flexneri 2a str. 301
auuaacugcgcgauuaucauuu

SEQ ID NO: 3904854 - RNA, 18 nt, Shigella flexneri 2a str. 301
auuaacuucccaccuuua

SEQ ID NO: 3904855 - RNA, 16 nt, Shigella flexneri 2a str. 301
auuaacuuuucauccu

SEQ ID NO: 3904856 - RNA, 21 nt, Shigella flexneri 2a str. 301
auuaagaagucgcaaugagua

SEQ ID NO: 3904857 - RNA, 17 nt, Shigella flexneri 2a str. 301
auuaagcccggucauca

SEQ ID NO: 3904858 - RNA, 20 nt, Shigella flexneri 2a str. 301
auuaagcgcaaaggccagca

SEQ ID NO: 3904859 - RNA, 22 nt, Shigella flexneri 2a str. 301
auuaagcgcaaaggccagcaau

SEQ ID NO: 3904860 - RNA, 15 nt, Shigella flexneri 2a str. 301
auuaaggcaagaaaa

SEQ ID NO: 3904861 - RNA, 24 nt, Shigella flexneri 2a str. 301
auuaaguaaugcggcaagggcgaa

SEQ ID NO: 3904862 - RNA, 16 nt, Shigella flexneri 2a str. 301
auucaaaauccgccac

SEQ ID NO: 3904863 - RNA, 13 nt, Shigella flexneri 2a str. 301
auucaaacgugaa

SEQ ID NO: 3904864 - RNA, 13 nt, Shigella flexneri 2a str. 301
auucaaacgugag

SEQ ID NO: 3904865 - RNA, 22 nt, Shigella flexneri 2a str. 301
auucaaagcgauuauagcuaac

SEQ ID NO: 3904866 - RNA, 13 nt, Shigella flexneri 2a str. 301
auucaaauuaugu

SEQ ID NO: 3904867 - RNA, 18 nt, Shigella flexneri 2a str. 301
auucaacaccgaugcaau

SEQ ID NO: 3904868 - RNA, 18 nt, Shigella flexneri 2a str. 301
auucaagacaucaauaaa

SEQ ID NO: 3904869 - RNA, 13 nt, Shigella flexneri 2a str. 301
auucaagaucaug

SEQ ID NO: 3904870 - RNA, 19 nt, Shigella flexneri 2a str. 301
auucaagauuagccugaau

SEQ ID NO: 3904871 - RNA, 20 nt, Shigella flexneri 2a str. 301
auucaauauauugcaaucau

SEQ ID NO: 3904872 - RNA, 15 nt, Shigella flexneri 2a str. 301
auucaaucucuucac

SEQ ID NO: 3904873 - RNA, 15 nt, Shigella flexneri 2a str. 301
auucaauuaauaaca

SEQ ID NO: 3904874 - RNA, 16 nt, Shigella flexneri 2a str. 301
auucaauuaauaacac

SEQ ID NO: 3904875 - RNA, 15 nt, Shigella flexneri 2a str. 301
auucaauuauaguau

SEQ ID NO: 3904876 - RNA, 18 nt, Shigella flexneri 2a str. 301
auucacacaguucuucuc

SEQ ID NO: 3904877 - RNA, 12 nt, Shigella flexneri 2a str. 301
auucacauuuaa

SEQ ID NO: 3904878 - RNA, 14 nt, Shigella flexneri 2a str. 301
auucacauuuaaac

SEQ ID NO: 3904879 - RNA, 11 nt, Shigella flexneri 2a str. 301
auucaccucug

SEQ ID NO: 3904880 - RNA, 16 nt, Shigella flexneri 2a str. 301
auucaccucugcggca

SEQ ID NO: 3904881 - RNA, 17 nt, Shigella flexneri 2a str. 301
auucacgaaucuauuca

SEQ ID NO: 3904882 - RNA, 22 nt, Shigella flexneri 2a str. 301
auucacgaaucuauucauuuau

SEQ ID NO: 3904883 - RNA, 21 nt, Shigella flexneri 2a str. 301
auucacgcaggcgagaaucaa

SEQ ID NO: 3904884 - RNA, 23 nt, Shigella flexneri 2a str. 301
auucacgccgcauccggcaucaa

SEQ ID NO: 3904885 - RNA, 18 nt, Shigella flexneri 2a str. 301
auucacgcuaucuuucaa

SEQ ID NO: 3904886 - RNA, 18 nt, Shigella flexneri 2a str. 301
auucacguucgugaacau

SEQ ID NO: 3904887 - RNA, 15 nt, Shigella flexneri 2a str. 301
auucacucuauaccg

SEQ ID NO: 3904888 - RNA, 21 nt, Shigella flexneri 2a str. 301
auucacucuauaccgcugaag

SEQ ID NO: 3904889 - RNA, 17 nt, Shigella flexneri 2a str. 301
auucacugccugcugau

SEQ ID NO: 3904890 - RNA, 17 nt, Shigella flexneri 2a str. 301
auucacuugaaguacga

SEQ ID NO: 3904891 - RNA, 16 nt, Shigella flexneri 2a str. 301
auucacuuucugaagg

SEQ ID NO: 3904892 - RNA, 23 nt, Shigella flexneri 2a str. 301
auucagaacacaaaaccgauuaa

SEQ ID NO: 3904893 - RNA, 21 nt, Shigella flexneri 2a str. 301
auucagacacgccgccagacc

SEQ ID NO: 3904894 - RNA, 22 nt, Shigella flexneri 2a str. 301
auucagacaggcgaaacccgcu

SEQ ID NO: 3904895 - RNA, 23 nt, Shigella flexneri 2a str. 301
auucagauaauccccaaugaccu

SEQ ID NO: 3904896 - RNA, 17 nt, Shigella flexneri 2a str. 301
auucagaucgguuuuuu

SEQ ID NO: 3904897 - RNA, 12 nt, Shigella flexneri 2a str. 301
auucagaucuuu

SEQ ID NO: 3904898 - RNA, 20 nt, Shigella flexneri 2a str. 301
auucagaucuuuaaugaucu

SEQ ID NO: 3904899 - RNA, 13 nt, Shigella flexneri 2a str. 301
auucagauuaugu

SEQ ID NO: 3904900 - RNA, 23 nt, Shigella flexneri 2a str. 301
auucagauugcagacaaagugag

SEQ ID NO: 3904901 - RNA, 18 nt, Shigella flexneri 2a str. 301
auucagcagcagacagcc

SEQ ID NO: 3904902 - RNA, 14 nt, Shigella flexneri 2a str. 301
auucagcccggcaa

SEQ ID NO: 3904903 - RNA, 17 nt, Shigella flexneri 2a str. 301
auucagcccggcaacgu

SEQ ID NO: 3904904 - RNA, 17 nt, Shigella flexneri 2a str. 301
auucagcguaucaauua

SEQ ID NO: 3904905 - RNA, 20 nt, Shigella flexneri 2a str. 301
auucagcgucgcgguugcug

SEQ ID NO: 3904906 - RNA, 23 nt, Shigella flexneri 2a str. 301
auucagcgucgucagcaguucac

SEQ ID NO: 3904907 - RNA, 15 nt, Shigella flexneri 2a str. 301
auucagcucaagaau

SEQ ID NO: 3904908 - RNA, 20 nt, Shigella flexneri 2a str. 301
auucaggaaacggagaucga

SEQ ID NO: 3904909 - RNA, 20 nt, Shigella flexneri 2a str. 301
auucaggccaaagccgccga

SEQ ID NO: 3904910 - RNA, 19 nt, Shigella flexneri 2a str. 301
auucaggcccgccagcgcc

SEQ ID NO: 3904911 - RNA, 14 nt, Shigella flexneri 2a str. 301
auucagguggcagu

SEQ ID NO: 3904912 - RNA, 17 nt, Shigella flexneri 2a str. 301
auucagugcaaaugcca

SEQ ID NO: 3904913 - RNA, 22 nt, Shigella flexneri 2a str. 301
auucagugcaaaugccagauaa

SEQ ID NO: 3904914 - RNA, 21 nt, Shigella flexneri 2a str. 301
auucauaagaagcuuuucuca

SEQ ID NO: 3904915 - RNA, 14 nt, Shigella flexneri 2a str. 301
auucauaaugccca

SEQ ID NO: 3904916 - RNA, 20 nt, Shigella flexneri 2a str. 301
auucauaauugcgaugccag

SEQ ID NO: 3904917 - RNA, 16 nt, Shigella flexneri 2a str. 301
auucauacagcggcca

SEQ ID NO: 3904918 - RNA, 12 nt, Shigella flexneri 2a str. 301
auucauacccug

SEQ ID NO: 3904919 - RNA, 15 nt, Shigella flexneri 2a str. 301
auucauacccugaau

SEQ ID NO: 3904920 - RNA, 19 nt, Shigella flexneri 2a str. 301
auucauaucaaacgccuga

SEQ ID NO: 3904921 - RNA, 13 nt, Shigella flexneri 2a str. 301
auucaucaaaugg

SEQ ID NO: 3904922 - RNA, 12 nt, Shigella flexneri 2a str. 301
auucaucaauuc

SEQ ID NO: 3904923 - RNA, 19 nt, Shigella flexneri 2a str. 301
auucaucgcccuuuuuuca

SEQ ID NO: 3904924 - RNA, 15 nt, Shigella flexneri 2a str. 301
auucauggugaauau

SEQ ID NO: 3904925 - RNA, 22 nt, Shigella flexneri 2a str. 301
auucauuacuuaacgucaaacg

SEQ ID NO: 3904926 - RNA, 16 nt, Shigella flexneri 2a str. 301
auucauuaguuuggcc

SEQ ID NO: 3904927 - RNA, 22 nt, Shigella flexneri 2a str. 301
auucauucaauuaauaacacau

SEQ ID NO: 3904928 - RNA, 13 nt, Shigella flexneri 2a str. 301
auucauuccuuga

SEQ ID NO: 3904929 - RNA, 23 nt, Shigella flexneri 2a str. 301
auucauugccugaugcgacgcuu

SEQ ID NO: 3904930 - RNA, 17 nt, Shigella flexneri 2a str. 301
auucauuguucucccau

SEQ ID NO: 3904931 - RNA, 21 nt, Shigella flexneri 2a str. 301
auucauuuugcuggaaaagua

SEQ ID NO: 3904932 - RNA, 22 nt, Shigella flexneri 2a str. 301
auucauuuugcuggaaaaguaa

SEQ ID NO: 3904933 - RNA, 19 nt, Shigella flexneri 2a str. 301
auuccacgauaaaauuccu

SEQ ID NO: 3904934 - RNA, 13 nt, Shigella flexneri 2a str. 301
auuccacgcauca

SEQ ID NO: 3904935 - RNA, 16 nt, Shigella flexneri 2a str. 301
auuccacgggcaauau

SEQ ID NO: 3904936 - RNA, 14 nt, Shigella flexneri 2a str. 301
auuccacucauuaa

SEQ ID NO: 3904937 - RNA, 14 nt, Shigella flexneri 2a str. 301
auuccacuuuuucg

SEQ ID NO: 3904938 - RNA, 22 nt, Shigella flexneri 2a str. 301
auuccacuuuuucgaacgcugc

SEQ ID NO: 3904939 - RNA, 14 nt, Shigella flexneri 2a str. 301
auuccagaaaagag

SEQ ID NO: 3904940 - RNA, 16 nt, Shigella flexneri 2a str. 301
auuccagcaagccacu

SEQ ID NO: 3904941 - RNA, 15 nt, Shigella flexneri 2a str. 301
auuccagcgccgcca

SEQ ID NO: 3904942 - RNA, 21 nt, Shigella flexneri 2a str. 301
auuccaguccacaucaaccag

SEQ ID NO: 3904943 - RNA, 18 nt, Shigella flexneri 2a str. 301
auuccagucugcuggcga

SEQ ID NO: 3904944 - RNA, 21 nt, Shigella flexneri 2a str. 301
auuccaguucgaucucuucgc

SEQ ID NO: 3904945 - RNA, 20 nt, Shigella flexneri 2a str. 301
auuccaucaccuuccacaua

SEQ ID NO: 3904946 - RNA, 13 nt, Shigella flexneri 2a str. 301
auuccauccugcu

SEQ ID NO: 3904947 - RNA, 22 nt, Shigella flexneri 2a str. 301
auuccauccugcucaaguaaua

SEQ ID NO: 3904948 - RNA, 20 nt, Shigella flexneri 2a str. 301
auuccaucgcuacgccuucg

SEQ ID NO: 3904949 - RNA, 21 nt, Shigella flexneri 2a str. 301
auuccauuucccugacaaauc

SEQ ID NO: 3904950 - RNA, 19 nt, Shigella flexneri 2a str. 301
auucccaggcaccgucaac

SEQ ID NO: 3904951 - RNA, 22 nt, Shigella flexneri 2a str. 301
auucccagucgcgcaauugcca

SEQ ID NO: 3904952 - RNA, 18 nt, Shigella flexneri 2a str. 301
auucccauuuauuuuucc

SEQ ID NO: 3904953 - RNA, 22 nt, Shigella flexneri 2a str. 301
auucccauuuauuuuuccucca

SEQ ID NO: 3904954 - RNA, 17 nt, Shigella flexneri 2a str. 301
auucccccuuugaccag

SEQ ID NO: 3904955 - RNA, 16 nt, Shigella flexneri 2a str. 301
auucccggaaauugcc

SEQ ID NO: 3904956 - RNA, 14 nt, Shigella flexneri 2a str. 301
auucccguuuucuu

SEQ ID NO: 3904957 - RNA, 19 nt, Shigella flexneri 2a str. 301
auucccugcuuugcaagcg

SEQ ID NO: 3904958 - RNA, 12 nt, Shigella flexneri 2a str. 301
auuccgaaucca

SEQ ID NO: 3904959 - RNA, 20 nt, Shigella flexneri 2a str. 301
auuccgaauuucauccugua

SEQ ID NO: 3904960 - RNA, 22 nt, Shigella flexneri 2a str. 301
auuccgcaccugccagcgccga

SEQ ID NO: 3904961 - RNA, 23 nt, Shigella flexneri 2a str. 301
auuccggcgcaguaugacuacau

SEQ ID NO: 3904962 - RNA, 16 nt, Shigella flexneri 2a str. 301
auugcaacgcccauca

SEQ ID NO: 3904963 - RNA, 14 nt, Shigella flexneri 2a str. 301
auugcagacaaagu

SEQ ID NO: 3904964 - RNA, 17 nt, Shigella flexneri 2a str. 301
auugcagaguacagccu

SEQ ID NO: 3904965 - RNA, 17 nt, Shigella flexneri 2a str. 301
auugcagauaccacauc

SEQ ID NO: 3904966 - RNA, 19 nt, Shigella flexneri 2a str. 301
auugcagauaccacaucaa

SEQ ID NO: 3904967 - RNA, 12 nt, Shigella flexneri 2a str. 301
auugcagcagcu

SEQ ID NO: 3904968 - RNA, 16 nt, Shigella flexneri 2a str. 301
auugcaggaagguuuu

SEQ ID NO: 3904969 - RNA, 16 nt, Shigella flexneri 2a str. 301
auugcaggggagcugc

SEQ ID NO: 3904970 - RNA, 21 nt, Shigella flexneri 2a str. 301
auugcaggguuuuguuuaaau

SEQ ID NO: 3904971 - RNA, 17 nt, Shigella flexneri 2a str. 301
auugcaguggcgugcca

SEQ ID NO: 3904972 - RNA, 17 nt, Shigella flexneri 2a str. 301
auugccacccugcggcu

SEQ ID NO: 3904973 - RNA, 20 nt, Shigella flexneri 2a str. 301
auugccacccugcggcugcu

SEQ ID NO: 3904974 - RNA, 18 nt, Shigella flexneri 2a str. 301
auugccacuucguaacca

SEQ ID NO: 3904975 - RNA, 17 nt, Shigella flexneri 2a str. 301
auugccagagcccauca

SEQ ID NO: 3904976 - RNA, 20 nt, Shigella flexneri 2a str. 301
auugccaguaacagaacgca

SEQ ID NO: 3904977 - RNA, 16 nt, Shigella flexneri 2a str. 301
auugcccgaagccaau

SEQ ID NO: 3904978 - RNA, 21 nt, Shigella flexneri 2a str. 301
auugcccgaagccaauuugcg

SEQ ID NO: 3904979 - RNA, 18 nt, Shigella flexneri 2a str. 301
auugcccggucagguggu

SEQ ID NO: 3904980 - RNA, 22 nt, Shigella flexneri 2a str. 301
auugcccuguuugucgaucauc

SEQ ID NO: 3904981 - RNA, 18 nt, Shigella flexneri 2a str. 301
auugccgaagaccagauu

SEQ ID NO: 3904982 - RNA, 13 nt, Shigella flexneri 2a str. 301
auugccgaagccu

SEQ ID NO: 3904983 - RNA, 23 nt, Shigella flexneri 2a str. 301
auugccgccagacguccggcgcu

SEQ ID NO: 3904984 - RNA, 20 nt, Shigella flexneri 2a str. 301
auugccggacagaucugccu

SEQ ID NO: 3904985 - RNA, 15 nt, Shigella flexneri 2a str. 301
auugccggaugcggc

SEQ ID NO: 3904986 - RNA, 20 nt, Shigella flexneri 2a str. 301
auugccgggcuaacuucuuu

SEQ ID NO: 3904987 - RNA, 20 nt, Shigella flexneri 2a str. 301
auugccguaagcaacgccaa

SEQ ID NO: 3904988 - RNA, 17 nt, Shigella flexneri 2a str. 301
auugccguccggcaucg

SEQ ID NO: 3904989 - RNA, 22 nt, Shigella flexneri 2a str. 301
auugccguggauuuaaugccaa

SEQ ID NO: 3904990 - RNA, 21 nt, Shigella flexneri 2a str. 301
auugccugaugcgacgcugcg

SEQ ID NO: 3904991 - RNA, 15 nt, Shigella flexneri 2a str. 301
auugccugauggccu

SEQ ID NO: 3904992 - RNA, 16 nt, Shigella flexneri 2a str. 301
auugccuggcuugccg

SEQ ID NO: 3904993 - RNA, 20 nt, Shigella flexneri 2a str. 301
auugcgaauuauaauuccuu

SEQ ID NO: 3904994 - RNA, 15 nt, Shigella flexneri 2a str. 301
auugcgacgagaaaa

SEQ ID NO: 3904995 - RNA, 15 nt, Shigella flexneri 2a str. 301
auugcgcaaauguuu

SEQ ID NO: 3904996 - RNA, 21 nt, Shigella flexneri 2a str. 301
auugcgcaccagcuugcgaca

SEQ ID NO: 3904997 - RNA, 21 nt, Shigella flexneri 2a str. 301
auugcgccagccuuucaauac

SEQ ID NO: 3904998 - RNA, 17 nt, Shigella flexneri 2a str. 301
auugcgcgacuuuuucc

SEQ ID NO: 3904999 - RNA, 22 nt, Shigella flexneri 2a str. 301
auugcgcuaaaaaguuccugua

SEQ ID NO: 3905000 - RNA, 18 nt, Shigella flexneri 2a str. 301
auugcgcugcuuguugau

SEQ ID NO: 3905001 - RNA, 18 nt, Shigella flexneri 2a str. 301
auugcggaacaucgccug

SEQ ID NO: 3905002 - RNA, 21 nt, Shigella flexneri 2a str. 301
auugcggaacaucgccugccg

SEQ ID NO: 3905003 - RNA, 15 nt, Shigella flexneri 2a str. 301
auugcggcaggucau

SEQ ID NO: 3905004 - RNA, 15 nt, Shigella flexneri 2a str. 301
auugcgugguuuuug

SEQ ID NO: 3905005 - RNA, 20 nt, Shigella flexneri 2a str. 301
auugcgugguuuuugcugac

SEQ ID NO: 3905006 - RNA, 18 nt, Shigella flexneri 2a str. 301
auugcgugucccacuggu

SEQ ID NO: 3905007 - RNA, 19 nt, Shigella flexneri 2a str. 301
auugcguuuaguuacacca

SEQ ID NO: 3905008 - RNA, 15 nt, Shigella flexneri 2a str. 301
auugcuaccgcuucg

SEQ ID NO: 3905009 - RNA, 15 nt, Shigella flexneri 2a str. 301
auugcugaaauacag

SEQ ID NO: 3905010 - RNA, 16 nt, Shigella flexneri 2a str. 301
auugcugaaauacaga

SEQ ID NO: 3905011 - RNA, 18 nt, Shigella flexneri 2a str. 301
auugcugcacauccggua

SEQ ID NO: 3905012 - RNA, 23 nt, Shigella flexneri 2a str. 301
auugcugccgauggcacaaucuc

SEQ ID NO: 3905013 - RNA, 20 nt, Shigella flexneri 2a str. 301
auugcugcugaagcaacagu

SEQ ID NO: 3905014 - RNA, 13 nt, Shigella flexneri 2a str. 301
auugcugcugccg

SEQ ID NO: 3905015 - RNA, 16 nt, Shigella flexneri 2a str. 301
auugcugcugccgcgc

SEQ ID NO: 3905016 - RNA, 22 nt, Shigella flexneri 2a str. 301
auugcugguacuuucacaggga

SEQ ID NO: 3905017 - RNA, 18 nt, Shigella flexneri 2a str. 301
auugcuguaucacuauga

SEQ ID NO: 3905018 - RNA, 19 nt, Shigella flexneri 2a str. 301
auugcugugccggaagggg

SEQ ID NO: 3905019 - RNA, 14 nt, Shigella flexneri 2a str. 301
auugcuguuuuaca

SEQ ID NO: 3905020 - RNA, 13 nt, Shigella flexneri 2a str. 301
auugcuucaagau

SEQ ID NO: 3905021 - RNA, 16 nt, Shigella flexneri 2a str. 301
auugcuucaccagcag

SEQ ID NO: 3905022 - RNA, 15 nt, Shigella flexneri 2a str. 301
auugcuucaguugcc

SEQ ID NO: 3905023 - RNA, 12 nt, Shigella flexneri 2a str. 301
auugcuucucag

SEQ ID NO: 3905024 - RNA, 13 nt, Shigella flexneri 2a str. 301
auugcuucugcuu

SEQ ID NO: 3905025 - RNA, 15 nt, Shigella flexneri 2a str. 301
auugcuucugcuuca

SEQ ID NO: 3905026 - RNA, 18 nt, Shigella flexneri 2a str. 301
auugcuuugguggucacc

SEQ ID NO: 3905027 - RNA, 17 nt, Shigella flexneri 2a str. 301
auuggaauacauauauu

SEQ ID NO: 3905028 - RNA, 17 nt, Shigella flexneri 2a str. 301
auuggagacugaugaca

SEQ ID NO: 3905029 - RNA, 20 nt, Shigella flexneri 2a str. 301
auuggagacugaugacaaac

SEQ ID NO: 3905030 - RNA, 20 nt, Shigella flexneri 2a str. 301
auuggagaguugcaccagca

SEQ ID NO: 3905031 - RNA, 22 nt, Shigella flexneri 2a str. 301
auuggagaguugcaccagcaac

SEQ ID NO: 3905032 - RNA, 14 nt, Shigella flexneri 2a str. 301
auuggaguaucacc

SEQ ID NO: 3905033 - RNA, 24 nt, Shigella flexneri 2a str. 301
auuggcauccgugguggcagccag

SEQ ID NO: 3905034 - RNA, 21 nt, Shigella flexneri 2a str. 301
auuggcgcgcguaugcgucag

SEQ ID NO: 3905035 - RNA, 22 nt, Shigella flexneri 2a str. 301
auuggcgcgcguaugcgucagc

SEQ ID NO: 3905036 - RNA, 15 nt, Shigella flexneri 2a str. 301
auuggcuucauugau

SEQ ID NO: 3905037 - RNA, 19 nt, Shigella flexneri 2a str. 301
auugggaugccgaaaaaag

SEQ ID NO: 3905038 - RNA, 17 nt, Shigella flexneri 2a str. 301
auugggcgaaagaaaag

SEQ ID NO: 3905039 - RNA, 15 nt, Shigella flexneri 2a str. 301
auugggcgaucuccc

SEQ ID NO: 3905040 - RNA, 14 nt, Shigella flexneri 2a str. 301
auuggguucaucug

SEQ ID NO: 3905041 - RNA, 17 nt, Shigella flexneri 2a str. 301
auugguaaacucaaagu

SEQ ID NO: 3905042 - RNA, 14 nt, Shigella flexneri 2a str. 301
auugguaaugacuc

SEQ ID NO: 3905043 - RNA, 18 nt, Shigella flexneri 2a str. 301
auugguaguguguuugau

SEQ ID NO: 3905044 - RNA, 21 nt, Shigella flexneri 2a str. 301
auugguaguguguuugaucac

SEQ ID NO: 3905045 - RNA, 19 nt, Shigella flexneri 2a str. 301
auuggucauuagugauuaa

SEQ ID NO: 3905046 - RNA, 17 nt, Shigella flexneri 2a str. 301
auuggucuggaacuggc

SEQ ID NO: 3905047 - RNA, 16 nt, Shigella flexneri 2a str. 301
auuggugaauugcacg

SEQ ID NO: 3905048 - RNA, 15 nt, Shigella flexneri 2a str. 301
auugguuucaaagau

SEQ ID NO: 3905049 - RNA, 16 nt, Shigella flexneri 2a str. 301
auugguuuuuugguaa

SEQ ID NO: 3905050 - RNA, 14 nt, Shigella flexneri 2a str. 301
auuguagaaaaucu

SEQ ID NO: 3905051 - RNA, 23 nt, Shigella flexneri 2a str. 301
auuguagacaacgugggcuuugu

SEQ ID NO: 3905052 - RNA, 14 nt, Shigella flexneri 2a str. 301
auugucgccacaaa

SEQ ID NO: 3905053 - RNA, 17 nt, Shigella flexneri 2a str. 301
auugucguuguacaaca

SEQ ID NO: 3905054 - RNA, 22 nt, Shigella flexneri 2a str. 301
auugucuucaagaucagcggca

SEQ ID NO: 3905055 - RNA, 15 nt, Shigella flexneri 2a str. 301
auugugauaaaaauc

SEQ ID NO: 3905056 - RNA, 12 nt, Shigella flexneri 2a str. 301
auugugcggcgg

SEQ ID NO: 3905057 - RNA, 16 nt, Shigella flexneri 2a str. 301
auuguggcguccagga

SEQ ID NO: 3905058 - RNA, 22 nt, Shigella flexneri 2a str. 301
auugugggucgauuaaauucac

SEQ ID NO: 3905059 - RNA, 21 nt, Shigella flexneri 2a str. 301
auugugguccgcuuguaggcc

SEQ ID NO: 3905060 - RNA, 14 nt, Shigella flexneri 2a str. 301
auuguguaaauuca

SEQ ID NO: 3905061 - RNA, 21 nt, Shigella flexneri 2a str. 301
auuguguaaauucaauaaauu

SEQ ID NO: 3905062 - RNA, 17 nt, Shigella flexneri 2a str. 301
auuuccaccgcuauuga

SEQ ID NO: 3905063 - RNA, 14 nt, Shigella flexneri 2a str. 301
auuuccaccucccc

SEQ ID NO: 3905064 - RNA, 15 nt, Shigella flexneri 2a str. 301
auuuccagaaaguga

SEQ ID NO: 3905065 - RNA, 18 nt, Shigella flexneri 2a str. 301
auuuccagcucaaagaua

SEQ ID NO: 3905066 - RNA, 16 nt, Shigella flexneri 2a str. 301
auuuccaggagauuaa

SEQ ID NO: 3905067 - RNA, 20 nt, Shigella flexneri 2a str. 301
auuuccaguccagcugccgu

SEQ ID NO: 3905068 - RNA, 13 nt, Shigella flexneri 2a str. 301
auuuccaguuugc

SEQ ID NO: 3905069 - RNA, 17 nt, Shigella flexneri 2a str. 301
auuuccaguuugcguuc

SEQ ID NO: 3905070 - RNA, 17 nt, Shigella flexneri 2a str. 301
auuuccauaaauugcug

SEQ ID NO: 3905071 - RNA, 23 nt, Shigella flexneri 2a str. 301
auuuccauaccuaaaaaauccca

SEQ ID NO: 3905072 - RNA, 13 nt, Shigella flexneri 2a str. 301
auuuccaucucca

SEQ ID NO: 3905073 - RNA, 15 nt, Shigella flexneri 2a str. 301
auuuccauuuuugac

SEQ ID NO: 3905074 - RNA, 19 nt, Shigella flexneri 2a str. 301
auuucccaacuguuugccg

SEQ ID NO: 3905075 - RNA, 22 nt, Shigella flexneri 2a str. 301
auuucccaccacuauuguugaa

SEQ ID NO: 3905076 - RNA, 20 nt, Shigella flexneri 2a str. 301
auuucccagauagcaacagc

SEQ ID NO: 3905077 - RNA, 14 nt, Shigella flexneri 2a str. 301
auuucccagcaaga

SEQ ID NO: 3905078 - RNA, 14 nt, Shigella flexneri 2a str. 301
auuuccccaaaacg

SEQ ID NO: 3905079 - RNA, 15 nt, Shigella flexneri 2a str. 301
auuuccccuguugca

SEQ ID NO: 3905080 - RNA, 18 nt, Shigella flexneri 2a str. 301
auuuccccuguugcaaac

SEQ ID NO: 3905081 - RNA, 15 nt, Shigella flexneri 2a str. 301
auuucccggccacgc

SEQ ID NO: 3905082 - RNA, 16 nt, Shigella flexneri 2a str. 301
auuucccggcugauaa

SEQ ID NO: 3905083 - RNA, 16 nt, Shigella flexneri 2a str. 301
auuucccgucgaagac

SEQ ID NO: 3905084 - RNA, 13 nt, Shigella flexneri 2a str. 301
auuucccugacaa

SEQ ID NO: 3905085 - RNA, 14 nt, Shigella flexneri 2a str. 301
auuucccugacaaa

SEQ ID NO: 3905086 - RNA, 16 nt, Shigella flexneri 2a str. 301
auuucccugacaaauc

SEQ ID NO: 3905087 - RNA, 23 nt, Shigella flexneri 2a str. 301
auuuccgccaccugauccaucgu

SEQ ID NO: 3905088 - RNA, 16 nt, Shigella flexneri 2a str. 301
auuuccgcgaaacagg

SEQ ID NO: 3905089 - RNA, 17 nt, Shigella flexneri 2a str. 301
auuuccgcgcaaucgcc

SEQ ID NO: 3905090 - RNA, 23 nt, Shigella flexneri 2a str. 301
auuuccgcugauucaagauuagc

SEQ ID NO: 3905091 - RNA, 20 nt, Shigella flexneri 2a str. 301
auuuccggucgcaggcagua

SEQ ID NO: 3905092 - RNA, 14 nt, Shigella flexneri 2a str. 301
auuuccugagcacu

SEQ ID NO: 3905093 - RNA, 16 nt, Shigella flexneri 2a str. 301
auuuccugagcacugg

SEQ ID NO: 3905094 - RNA, 16 nt, Shigella flexneri 2a str. 301
auuuccuuaaaaguga

SEQ ID NO: 3905095 - RNA, 21 nt, Shigella flexneri 2a str. 301
auuuccuuccuuggauauuuu

SEQ ID NO: 3905096 - RNA, 17 nt, Shigella flexneri 2a str. 301
auuuccuucgcuuuaau

SEQ ID NO: 3905097 - RNA, 15 nt, Shigella flexneri 2a str. 301
auuucgaagaaaccg

SEQ ID NO: 3905098 - RNA, 15 nt, Shigella flexneri 2a str. 301
auuucgaauuuucca

SEQ ID NO: 3905099 - RNA, 16 nt, Shigella flexneri 2a str. 301
auuucgacgggcuggu

SEQ ID NO: 3905100 - RNA, 15 nt, Shigella flexneri 2a str. 301
auuucgcagucgaua

SEQ ID NO: 3905101 - RNA, 12 nt, Shigella flexneri 2a str. 301
auuucgccgcac

SEQ ID NO: 3905102 - RNA, 14 nt, Shigella flexneri 2a str. 301
auuucgcugcccau

SEQ ID NO: 3905103 - RNA, 16 nt, Shigella flexneri 2a str. 301
auuucggcauuuuugg

SEQ ID NO: 3905104 - RNA, 17 nt, Shigella flexneri 2a str. 301
auuucggcgugcgcgcc

SEQ ID NO: 3905105 - RNA, 19 nt, Shigella flexneri 2a str. 301
auuucguagacugcagcgg

SEQ ID NO: 3905106 - RNA, 14 nt, Shigella flexneri 2a str. 301
auuucguccagcga

SEQ ID NO: 3905107 - RNA, 20 nt, Shigella flexneri 2a str. 301
auuucguccauguuggagau

SEQ ID NO: 3905108 - RNA, 22 nt, Shigella flexneri 2a str. 301
auuucguccauguuggagauaa

SEQ ID NO: 3905109 - RNA, 16 nt, Shigella flexneri 2a str. 301
auuucgucuucaucaa

SEQ ID NO: 3905110 - RNA, 13 nt, Shigella flexneri 2a str. 301
auuucguuguguc

SEQ ID NO: 3905111 - RNA, 18 nt, Shigella flexneri 2a str. 301
auuucguugugucgccag

SEQ ID NO: 3905112 - RNA, 11 nt, Shigella flexneri 2a str. 301
auuucuccccc

SEQ ID NO: 3905113 - RNA, 14 nt, Shigella flexneri 2a str. 301
auuucuccccccuc

SEQ ID NO: 3905114 - RNA, 17 nt, Shigella flexneri 2a str. 301
auuucuccccccucuga

SEQ ID NO: 3905115 - RNA, 17 nt, Shigella flexneri 2a str. 301
auuucucggcaaauuca

SEQ ID NO: 3905116 - RNA, 16 nt, Shigella flexneri 2a str. 301
auuucugauuguuaac

SEQ ID NO: 3905117 - RNA, 15 nt, Shigella flexneri 2a str. 301
auuucugccagcggg

SEQ ID NO: 3905118 - RNA, 21 nt, Shigella flexneri 2a str. 301
auuucugccuugaguuuuuca

SEQ ID NO: 3905119 - RNA, 23 nt, Shigella flexneri 2a str. 301
auuucugcugccacuuucucacu

SEQ ID NO: 3905120 - RNA, 16 nt, Shigella flexneri 2a str. 301
auuucugcuucguuaa

SEQ ID NO: 3905121 - RNA, 19 nt, Shigella flexneri 2a str. 301
auuucuguauuacagaggu

SEQ ID NO: 3905122 - RNA, 20 nt, Shigella flexneri 2a str. 301
auuucugugcagccaaaaau

SEQ ID NO: 3905123 - RNA, 13 nt, Shigella flexneri 2a str. 301
auuucuguuugcg

SEQ ID NO: 3905124 - RNA, 19 nt, Shigella flexneri 2a str. 301
auuucuucaccagccugca

SEQ ID NO: 3905125 - RNA, 21 nt, Shigella flexneri 2a str. 301
auuucuucauacuaccuggac

SEQ ID NO: 3905126 - RNA, 22 nt, Shigella flexneri 2a str. 301
auuucuuccagcguuucaagug

SEQ ID NO: 3905127 - RNA, 17 nt, Shigella flexneri 2a str. 301
auuucuuuacugacagg

SEQ ID NO: 3905128 - RNA, 15 nt, Shigella flexneri 2a str. 301
auuucuuugcgcucu

SEQ ID NO: 3905129 - RNA, 22 nt, Shigella flexneri 2a str. 301
auuucuuuguagaugauuuuuu

SEQ ID NO: 3905130 - RNA, 16 nt, Shigella flexneri 2a str. 301
auuucuuuucauaauc

SEQ ID NO: 3905131 - RNA, 15 nt, Shigella flexneri 2a str. 301
auuugaaaccgucuu

SEQ ID NO: 3905132 - RNA, 16 nt, Shigella flexneri 2a str. 301
auuugaggaguuuaau

SEQ ID NO: 3905133 - RNA, 15 nt, Shigella flexneri 2a str. 301
auuugaguucacugc

SEQ ID NO: 3905134 - RNA, 16 nt, Shigella flexneri 2a str. 301
auuugaguucacugcc

SEQ ID NO: 3905135 - RNA, 17 nt, Shigella flexneri 2a str. 301
auuugaguucacugccg

SEQ ID NO: 3905136 - RNA, 13 nt, Shigella flexneri 2a str. 301
auuugauauuuau

SEQ ID NO: 3905137 - RNA, 17 nt, Shigella flexneri 2a str. 301
auuugauugcagauucg

SEQ ID NO: 3905138 - RNA, 14 nt, Shigella flexneri 2a str. 301
auuugcccgcuugg

SEQ ID NO: 3905139 - RNA, 15 nt, Shigella flexneri 2a str. 301
auuugccuaauaaau

SEQ ID NO: 3905140 - RNA, 20 nt, Shigella flexneri 2a str. 301
auuugccuaauaaaucuaaa

SEQ ID NO: 3905141 - RNA, 23 nt, Shigella flexneri 2a str. 301
auuugcgcgaugccgccguagaa

SEQ ID NO: 3905142 - RNA, 13 nt, Shigella flexneri 2a str. 301
auuugcuccagaa

SEQ ID NO: 3905143 - RNA, 16 nt, Shigella flexneri 2a str. 301
auuugcuccagcgaac

SEQ ID NO: 3905144 - RNA, 13 nt, Shigella flexneri 2a str. 301
auuugcugacaau

SEQ ID NO: 3905145 - RNA, 20 nt, Shigella flexneri 2a str. 301
auuugcuucaauacgcucca

SEQ ID NO: 3905146 - RNA, 20 nt, Shigella flexneri 2a str. 301
auuugcuuguuucauuacuc

SEQ ID NO: 3905147 - RNA, 21 nt, Shigella flexneri 2a str. 301
auuugcuuguuucauuacucg

SEQ ID NO: 3905148 - RNA, 21 nt, Shigella flexneri 2a str. 301
auuugcuuuucauacaaucgg

SEQ ID NO: 3905149 - RNA, 20 nt, Shigella flexneri 2a str. 301
auuuggcugagugaaucaga

SEQ ID NO: 3905150 - RNA, 23 nt, Shigella flexneri 2a str. 301
auuuggguguaucuucagcugca

SEQ ID NO: 3905151 - RNA, 15 nt, Shigella flexneri 2a str. 301
auuugugcaaauuca

SEQ ID NO: 3905152 - RNA, 18 nt, Shigella flexneri 2a str. 301
auuuguggugaagccacc

SEQ ID NO: 3905153 - RNA, 16 nt, Shigella flexneri 2a str. 301
auuuguucagcaaaug

SEQ ID NO: 3905154 - RNA, 14 nt, Shigella flexneri 2a str. 301
auuuguugagcugg

SEQ ID NO: 3905155 - RNA, 17 nt, Shigella flexneri 2a str. 301
auuuguugagcuggaag

SEQ ID NO: 3905156 - RNA, 18 nt, Shigella flexneri 2a str. 301
auuuguuggcgaaaaucu

SEQ ID NO: 3905157 - RNA, 18 nt, Shigella flexneri 2a str. 301
auuuuaaauuuccucuug

SEQ ID NO: 3905158 - RNA, 14 nt, Shigella flexneri 2a str. 301
auuuuaagcaagug

SEQ ID NO: 3905159 - RNA, 20 nt, Shigella flexneri 2a str. 301
auuuuacaggguaaaaccau

SEQ ID NO: 3905160 - RNA, 13 nt, Shigella flexneri 2a str. 301
auuuuacauccug

SEQ ID NO: 3905161 - RNA, 22 nt, Shigella flexneri 2a str. 301
auuuuauugcguaaucuuuuca

SEQ ID NO: 3905162 - RNA, 13 nt, Shigella flexneri 2a str. 301
caaaaccugccgc

SEQ ID NO: 3905163 - RNA, 22 nt, Shigella flexneri 2a str. 301
caaaaccugguugguacugugg

SEQ ID NO: 3905164 - RNA, 19 nt, Shigella flexneri 2a str. 301
caaaacgccgguugcgaca

SEQ ID NO: 3905165 - RNA, 16 nt, Shigella flexneri 2a str. 301
caaaacgcgacugcaa

SEQ ID NO: 3905166 - RNA, 19 nt, Shigella flexneri 2a str. 301
caaaacgcgacugcaaaaa

SEQ ID NO: 3905167 - RNA, 21 nt, Shigella flexneri 2a str. 301
caaaacgcgacugcaaaaagc

SEQ ID NO: 3905168 - RNA, 16 nt, Shigella flexneri 2a str. 301
caaaacgugacagcau

SEQ ID NO: 3905169 - RNA, 12 nt, Shigella flexneri 2a str. 301
caaaacguggcc

SEQ ID NO: 3905170 - RNA, 20 nt, Shigella flexneri 2a str. 301
caaaacguggccuccaaaaa

SEQ ID NO: 3905171 - RNA, 21 nt, Shigella flexneri 2a str. 301
caaaacguggccuccaaaaaa

SEQ ID NO: 3905172 - RNA, 22 nt, Shigella flexneri 2a str. 301
caaaacugcacuggcuuccagc

SEQ ID NO: 3905173 - RNA, 16 nt, Shigella flexneri 2a str. 301
caaaagacaccaucgc

SEQ ID NO: 3905174 - RNA, 18 nt, Shigella flexneri 2a str. 301
caaaagauuauugcuuga

SEQ ID NO: 3905175 - RNA, 23 nt, Shigella flexneri 2a str. 301
caaaagcauuuggugucgcugaa

SEQ ID NO: 3905176 - RNA, 19 nt, Shigella flexneri 2a str. 301
caaaagcggugauaaaccc

SEQ ID NO: 3905177 - RNA, 15 nt, Shigella flexneri 2a str. 301
caaaagcuaacagag

SEQ ID NO: 3905178 - RNA, 16 nt, Shigella flexneri 2a str. 301
caaaagcuaacagagc

SEQ ID NO: 3905179 - RNA, 18 nt, Shigella flexneri 2a str. 301
caaaaggcgaaaccuccg

SEQ ID NO: 3905180 - RNA, 17 nt, Shigella flexneri 2a str. 301
caaaaguagccauuuga

SEQ ID NO: 3905181 - RNA, 18 nt, Shigella flexneri 2a str. 301
caaaagugguguugaaga

SEQ ID NO: 3905182 - RNA, 21 nt, Shigella flexneri 2a str. 301
caaaagugguguugaagaaac

SEQ ID NO: 3905183 - RNA, 15 nt, Shigella flexneri 2a str. 301
caaaauaauaaauua

SEQ ID NO: 3905184 - RNA, 12 nt, Shigella flexneri 2a str. 301
caaaauaauaca

SEQ ID NO: 3905185 - RNA, 14 nt, Shigella flexneri 2a str. 301
caaaauaauacaca

SEQ ID NO: 3905186 - RNA, 13 nt, Shigella flexneri 2a str. 301
caaaauaccaaua

SEQ ID NO: 3905187 - RNA, 20 nt, Shigella flexneri 2a str. 301
caaaauacguucucaccucu

SEQ ID NO: 3905188 - RNA, 21 nt, Shigella flexneri 2a str. 301
caaaauacguucucaccucug

SEQ ID NO: 3905189 - RNA, 16 nt, Shigella flexneri 2a str. 301
caaaauacuguuuauc

SEQ ID NO: 3905190 - RNA, 22 nt, Shigella flexneri 2a str. 301
caaaauacuguuuaucuuccca

SEQ ID NO: 3905191 - RNA, 18 nt, Shigella flexneri 2a str. 301
caaaauagguaucguaau

SEQ ID NO: 3905192 - RNA, 19 nt, Shigella flexneri 2a str. 301
caaaauagucaucucuucc

SEQ ID NO: 3905193 - RNA, 15 nt, Shigella flexneri 2a str. 301
caaaauccgccaccg

SEQ ID NO: 3905194 - RNA, 15 nt, Shigella flexneri 2a str. 301
caaaauccugccagc

SEQ ID NO: 3905195 - RNA, 19 nt, Shigella flexneri 2a str. 301
caaaaucggcaacaugacu

SEQ ID NO: 3905196 - RNA, 16 nt, Shigella flexneri 2a str. 301
caaaaucguaagcagg

SEQ ID NO: 3905197 - RNA, 18 nt, Shigella flexneri 2a str. 301
caaaaucuauugcaacau

SEQ ID NO: 3905198 - RNA, 17 nt, Shigella flexneri 2a str. 301
caaaaucuuaaagaugc

SEQ ID NO: 3905199 - RNA, 14 nt, Shigella flexneri 2a str. 301
caaaaucuucguua

SEQ ID NO: 3905200 - RNA, 20 nt, Shigella flexneri 2a str. 301
caaaaucuucguuaucccag

SEQ ID NO: 3905201 - RNA, 21 nt, Shigella flexneri 2a str. 301
caaaaucuucuaacgacauuu

SEQ ID NO: 3905202 - RNA, 15 nt, Shigella flexneri 2a str. 301
caaaaugcaucggca

SEQ ID NO: 3905203 - RNA, 16 nt, Shigella flexneri 2a str. 301
caaaauggacgcaacu

SEQ ID NO: 3905204 - RNA, 22 nt, Shigella flexneri 2a str. 301
caaaauggacgcaacuuccccu

SEQ ID NO: 3905205 - RNA, 19 nt, Shigella flexneri 2a str. 301
caaaauggguauauuugcc

SEQ ID NO: 3905206 - RNA, 22 nt, Shigella flexneri 2a str. 301
caaaaugguggagauaaacucc

SEQ ID NO: 3905207 - RNA, 17 nt, Shigella flexneri 2a str. 301
caaaauguuaucgggca

SEQ ID NO: 3905208 - RNA, 17 nt, Shigella flexneri 2a str. 301
caaaauguuuaugccug

SEQ ID NO: 3905209 - RNA, 19 nt, Shigella flexneri 2a str. 301
caaaauguuuaugccuggu

SEQ ID NO: 3905210 - RNA, 16 nt, Shigella flexneri 2a str. 301
caaaauuagaaaggga

SEQ ID NO: 3905211 - RNA, 14 nt, Shigella flexneri 2a str. 301
caaaauucugcuga

SEQ ID NO: 3905212 - RNA, 17 nt, Shigella flexneri 2a str. 301
caaaauuuaacaccauc

SEQ ID NO: 3905213 - RNA, 14 nt, Shigella flexneri 2a str. 301
caaaauuucaggcg

SEQ ID NO: 3905214 - RNA, 19 nt, Shigella flexneri 2a str. 301
caaacaacggcacuucaau

SEQ ID NO: 3905215 - RNA, 19 nt, Shigella flexneri 2a str. 301
caaacaaugagaauaccga

SEQ ID NO: 3905216 - RNA, 19 nt, Shigella flexneri 2a str. 301
caaacaauuuucauugaaa

SEQ ID NO: 3905217 - RNA, 15 nt, Shigella flexneri 2a str. 301
caaacaccagcgaau

SEQ ID NO: 3905218 - RNA, 20 nt, Shigella flexneri 2a str. 301
caaacagaugaugcgucuca

SEQ ID NO: 3905219 - RNA, 19 nt, Shigella flexneri 2a str. 301
caaacagcgcaaaacgcag

SEQ ID NO: 3905220 - RNA, 22 nt, Shigella flexneri 2a str. 301
caaacagcgccagauagccgac

SEQ ID NO: 3905221 - RNA, 11 nt, Shigella flexneri 2a str. 301
caaacaggcug

SEQ ID NO: 3905222 - RNA, 17 nt, Shigella flexneri 2a str. 301
caaacaggcugcugcug

SEQ ID NO: 3905223 - RNA, 21 nt, Shigella flexneri 2a str. 301
caaacagggcaauuaaaaauu

SEQ ID NO: 3905224 - RNA, 22 nt, Shigella flexneri 2a str. 301
caaacaguacaucuuccacuuu

SEQ ID NO: 3905225 - RNA, 23 nt, Shigella flexneri 2a str. 301
caaacagucacuuucgagcaauu

SEQ ID NO: 3905226 - RNA, 19 nt, Shigella flexneri 2a str. 301
caaacagucgcccgaccau

SEQ ID NO: 3905227 - RNA, 22 nt, Shigella flexneri 2a str. 301
caaacagucgcccgaccaucgc

SEQ ID NO: 3905228 - RNA, 22 nt, Shigella flexneri 2a str. 301
caaacagugaccaucuuccagc

SEQ ID NO: 3905229 - RNA, 18 nt, Shigella flexneri 2a str. 301
caaacaguucugcagcgu

SEQ ID NO: 3905230 - RNA, 12 nt, Shigella flexneri 2a str. 301
caaacaucaucc

SEQ ID NO: 3905231 - RNA, 13 nt, Shigella flexneri 2a str. 301
caaacaucgacuc

SEQ ID NO: 3905232 - RNA, 20 nt, Shigella flexneri 2a str. 301
caaacaugccaacaaaaucu

SEQ ID NO: 3905233 - RNA, 16 nt, Shigella flexneri 2a str. 301
caaacauugcugccag

SEQ ID NO: 3905234 - RNA, 15 nt, Shigella flexneri 2a str. 301
caaaccaacgcuguc

SEQ ID NO: 3905235 - RNA, 17 nt, Shigella flexneri 2a str. 301
caaaccacccagcagcg

SEQ ID NO: 3905236 - RNA, 15 nt, Shigella flexneri 2a str. 301
caaacccugagcggu

SEQ ID NO: 3905237 - RNA, 16 nt, Shigella flexneri 2a str. 301
caaacccuucuucaau

SEQ ID NO: 3905238 - RNA, 14 nt, Shigella flexneri 2a str. 301
caaaccucaccgcu

SEQ ID NO: 3905239 - RNA, 15 nt, Shigella flexneri 2a str. 301
caaaccucaccgcua

SEQ ID NO: 3905240 - RNA, 15 nt, Shigella flexneri 2a str. 301
caaaccucaggaaua

SEQ ID NO: 3905241 - RNA, 19 nt, Shigella flexneri 2a str. 301
caaaccugcaaugauguca

SEQ ID NO: 3905242 - RNA, 23 nt, Shigella flexneri 2a str. 301
caaaccuggcauguggcggcgcg

SEQ ID NO: 3905243 - RNA, 17 nt, Shigella flexneri 2a str. 301
caaacgacgagcgcugg

SEQ ID NO: 3905244 - RNA, 13 nt, Shigella flexneri 2a str. 301
caaacgacgcaga

SEQ ID NO: 3905245 - RNA, 16 nt, Shigella flexneri 2a str. 301
caaacgcaaacaccag

SEQ ID NO: 3905246 - RNA, 17 nt, Shigella flexneri 2a str. 301
caaacgccacagcaauu

SEQ ID NO: 3905247 - RNA, 16 nt, Shigella flexneri 2a str. 301
caaacgccagauacau

SEQ ID NO: 3905248 - RNA, 14 nt, Shigella flexneri 2a str. 301
caaacgcucccugc

SEQ ID NO: 3905249 - RNA, 16 nt, Shigella flexneri 2a str. 301
caaacgcucccugcca

SEQ ID NO: 3905250 - RNA, 17 nt, Shigella flexneri 2a str. 301
caaacgcucccugccag

SEQ ID NO: 3905251 - RNA, 18 nt, Shigella flexneri 2a str. 301
caaacgcucccugccagu

SEQ ID NO: 3905252 - RNA, 18 nt, Shigella flexneri 2a str. 301
caaacgcugacggugcca

SEQ ID NO: 3905253 - RNA, 15 nt, Shigella flexneri 2a str. 301
caaacgcuggugagu

SEQ ID NO: 3905254 - RNA, 16 nt, Shigella flexneri 2a str. 301
caaacgcuuuacucaa

SEQ ID NO: 3905255 - RNA, 23 nt, Shigella flexneri 2a str. 301
caaacgcuuuacucaacuccccg

SEQ ID NO: 3905256 - RNA, 15 nt, Shigella flexneri 2a str. 301
caaacggcgcuucca

SEQ ID NO: 3905257 - RNA, 15 nt, Shigella flexneri 2a str. 301
caaacggcuggaaca

SEQ ID NO: 3905258 - RNA, 21 nt, Shigella flexneri 2a str. 301
caaacgucgcaucugaccaga

SEQ ID NO: 3905259 - RNA, 20 nt, Shigella flexneri 2a str. 301
caaacgugacauucugacug

SEQ ID NO: 3905260 - RNA, 21 nt, Shigella flexneri 2a str. 301
caaacgugacauucugacugg

SEQ ID NO: 3905261 - RNA, 19 nt, Shigella flexneri 2a str. 301
caaacguggucgccagcau

SEQ ID NO: 3905262 - RNA, 13 nt, Shigella flexneri 2a str. 301
caaauggcauccu

SEQ ID NO: 3905263 - RNA, 13 nt, Shigella flexneri 2a str. 301
caaaugucaccag

SEQ ID NO: 3905264 - RNA, 16 nt, Shigella flexneri 2a str. 301
caaaugucaccagccg

SEQ ID NO: 3905265 - RNA, 17 nt, Shigella flexneri 2a str. 301
caaaugucagcugccag

SEQ ID NO: 3905266 - RNA, 18 nt, Shigella flexneri 2a str. 301
caaauguugcaucgccug

SEQ ID NO: 3905267 - RNA, 19 nt, Shigella flexneri 2a str. 301
caaauguugcguucaucag

SEQ ID NO: 3905268 - RNA, 19 nt, Shigella flexneri 2a str. 301
caaauguugucucagauuc

SEQ ID NO: 3905269 - RNA, 17 nt, Shigella flexneri 2a str. 301
caaauuaaacgggcgau

SEQ ID NO: 3905270 - RNA, 20 nt, Shigella flexneri 2a str. 301
caaauuacgauccaccaccg

SEQ ID NO: 3905271 - RNA, 18 nt, Shigella flexneri 2a str. 301
caaauuauuaccaucggu

SEQ ID NO: 3905272 - RNA, 21 nt, Shigella flexneri 2a str. 301
caaauucaauaaauugcagga

SEQ ID NO: 3905273 - RNA, 18 nt, Shigella flexneri 2a str. 301
caaauucaauauauugca

SEQ ID NO: 3905274 - RNA, 15 nt, Shigella flexneri 2a str. 301
caaauucauuaccaa

SEQ ID NO: 3905275 - RNA, 16 nt, Shigella flexneri 2a str. 301
caaauuccgaacaaaa

SEQ ID NO: 3905276 - RNA, 19 nt, Shigella flexneri 2a str. 301
caaauucucuauuucaccc

SEQ ID NO: 3905277 - RNA, 21 nt, Shigella flexneri 2a str. 301
caaauucuggcggcaauaacu

SEQ ID NO: 3905278 - RNA, 12 nt, Shigella flexneri 2a str. 301
caaauucuuaau

SEQ ID NO: 3905279 - RNA, 15 nt, Shigella flexneri 2a str. 301
caaauugcaccaucc

SEQ ID NO: 3905280 - RNA, 18 nt, Shigella flexneri 2a str. 301
caaauugcaccauccauu

SEQ ID NO: 3905281 - RNA, 20 nt, Shigella flexneri 2a str. 301
caaauuuaauuugcugcgga

SEQ ID NO: 3905282 - RNA, 19 nt, Shigella flexneri 2a str. 301
caaauuuaucgauaacagg

SEQ ID NO: 3905283 - RNA, 17 nt, Shigella flexneri 2a str. 301
caaauuugugcucuggc

SEQ ID NO: 3905284 - RNA, 15 nt, Shigella flexneri 2a str. 301
caaauuuugaacaga

SEQ ID NO: 3905285 - RNA, 18 nt, Shigella flexneri 2a str. 301
caaauuuugaacagaacu

SEQ ID NO: 3905286 - RNA, 20 nt, Shigella flexneri 2a str. 301
caacaaaauaauccgucagc

SEQ ID NO: 3905287 - RNA, 15 nt, Shigella flexneri 2a str. 301
caacaaaauggcaaa

SEQ ID NO: 3905288 - RNA, 16 nt, Shigella flexneri 2a str. 301
caacaaacgcaaacac

SEQ ID NO: 3905289 - RNA, 21 nt, Shigella flexneri 2a str. 301
caacaaacgcggcuacuuucu

SEQ ID NO: 3905290 - RNA, 14 nt, Shigella flexneri 2a str. 301
caacaaacgugaag

SEQ ID NO: 3905291 - RNA, 19 nt, Shigella flexneri 2a str. 301
caacaaagccacuuaauaa

SEQ ID NO: 3905292 - RNA, 12 nt, Shigella flexneri 2a str. 301
caacaaagcgcg

SEQ ID NO: 3905293 - RNA, 15 nt, Shigella flexneri 2a str. 301
caacaaauaaaagca

SEQ ID NO: 3905294 - RNA, 18 nt, Shigella flexneri 2a str. 301
caacaaauaaaagcaaaa

SEQ ID NO: 3905295 - RNA, 18 nt, Shigella flexneri 2a str. 301
caacaacaauuucacuug

SEQ ID NO: 3905296 - RNA, 20 nt, Shigella flexneri 2a str. 301
caacaacacauucaauaaca

SEQ ID NO: 3905297 - RNA, 13 nt, Shigella flexneri 2a str. 301
caacaacacccau

SEQ ID NO: 3905298 - RNA, 16 nt, Shigella flexneri 2a str. 301
caacaaccuugcguuu

SEQ ID NO: 3905299 - RNA, 12 nt, Shigella flexneri 2a str. 301
caacaacugaaa

SEQ ID NO: 3905300 - RNA, 14 nt, Shigella flexneri 2a str. 301
caacaacugaaaaa

SEQ ID NO: 3905301 - RNA, 15 nt, Shigella flexneri 2a str. 301
caacaacugaaaaaa

SEQ ID NO: 3905302 - RNA, 20 nt, Shigella flexneri 2a str. 301
caacaagugggugcuucacu

SEQ ID NO: 3905303 - RNA, 23 nt, Shigella flexneri 2a str. 301
caacaauaaaaccaguaaugauc

SEQ ID NO: 3905304 - RNA, 13 nt, Shigella flexneri 2a str. 301
caacaauagugcc

SEQ ID NO: 3905305 - RNA, 15 nt, Shigella flexneri 2a str. 301
caacaaucucuucca

SEQ ID NO: 3905306 - RNA, 17 nt, Shigella flexneri 2a str. 301
caacaaucugcaaaucg

SEQ ID NO: 3905307 - RNA, 15 nt, Shigella flexneri 2a str. 301
caacaaugccacgcc

SEQ ID NO: 3905308 - RNA, 12 nt, Shigella flexneri 2a str. 301
caacaauggcau

SEQ ID NO: 3905309 - RNA, 14 nt, Shigella flexneri 2a str. 301
caacaauggcauuu

SEQ ID NO: 3905310 - RNA, 23 nt, Shigella flexneri 2a str. 301
caacaauugcgggccaaagacca

SEQ ID NO: 3905311 - RNA, 14 nt, Shigella flexneri 2a str. 301
caacacaaaccggg

SEQ ID NO: 3905312 - RNA, 16 nt, Shigella flexneri 2a str. 301
caacacaauuuguggc

SEQ ID NO: 3905313 - RNA, 19 nt, Shigella flexneri 2a str. 301
caacacacugaauaaaaau

SEQ ID NO: 3905314 - RNA, 22 nt, Shigella flexneri 2a str. 301
caacacacugaauaaaaaugug

SEQ ID NO: 3905315 - RNA, 20 nt, Shigella flexneri 2a str. 301
caacacaucgauaagguuau

SEQ ID NO: 3905316 - RNA, 19 nt, Shigella flexneri 2a str. 301
caacacauuacugcuugcu

SEQ ID NO: 3905317 - RNA, 22 nt, Shigella flexneri 2a str. 301
caacacauuacugcuugcucug

SEQ ID NO: 3905318 - RNA, 13 nt, Shigella flexneri 2a str. 301
caacaccacugcc

SEQ ID NO: 3905319 - RNA, 14 nt, Shigella flexneri 2a str. 301
caacaccacugcca

SEQ ID NO: 3905320 - RNA, 23 nt, Shigella flexneri 2a str. 301
caacaccgggugcagacaugacg

SEQ ID NO: 3905321 - RNA, 16 nt, Shigella flexneri 2a str. 301
caacaccuaccggcug

SEQ ID NO: 3905322 - RNA, 16 nt, Shigella flexneri 2a str. 301
caacaccucagccagc

SEQ ID NO: 3905323 - RNA, 17 nt, Shigella flexneri 2a str. 301
caacaccuguuccagug

SEQ ID NO: 3905324 - RNA, 23 nt, Shigella flexneri 2a str. 301
caacacgccagcguuaucccauc

SEQ ID NO: 3905325 - RNA, 12 nt, Shigella flexneri 2a str. 301
caacagaaauaa

SEQ ID NO: 3905326 - RNA, 22 nt, Shigella flexneri 2a str. 301
caacagaaauaaucgcaauuac

SEQ ID NO: 3905327 - RNA, 21 nt, Shigella flexneri 2a str. 301
caacagacgacgagucacgga

SEQ ID NO: 3905328 - RNA, 20 nt, Shigella flexneri 2a str. 301
caacagcaauacguuucaua

SEQ ID NO: 3905329 - RNA, 16 nt, Shigella flexneri 2a str. 301
caacagcagccacacc

SEQ ID NO: 3905330 - RNA, 20 nt, Shigella flexneri 2a str. 301
caacagcggcauuacgcgcc

SEQ ID NO: 3905331 - RNA, 22 nt, Shigella flexneri 2a str. 301
caacagcgguuuugcuauccag

SEQ ID NO: 3905332 - RNA, 21 nt, Shigella flexneri 2a str. 301
caacaggcccaacuguugauc

SEQ ID NO: 3905333 - RNA, 15 nt, Shigella flexneri 2a str. 301
caacaggcgguaacc

SEQ ID NO: 3905334 - RNA, 20 nt, Shigella flexneri 2a str. 301
caacagggcgauuugcuccc

SEQ ID NO: 3905335 - RNA, 17 nt, Shigella flexneri 2a str. 301
caacagguaaggcgcga

SEQ ID NO: 3905336 - RNA, 19 nt, Shigella flexneri 2a str. 301
caacagugccaaucgucgu

SEQ ID NO: 3905337 - RNA, 18 nt, Shigella flexneri 2a str. 301
caacauacuuugcuggcu

SEQ ID NO: 3905338 - RNA, 19 nt, Shigella flexneri 2a str. 301
caacauauaucgaaaaauc

SEQ ID NO: 3905339 - RNA, 23 nt, Shigella flexneri 2a str. 301
caacauauuccgcaccugccagc

SEQ ID NO: 3905340 - RNA, 14 nt, Shigella flexneri 2a str. 301
caacaucacaccug

SEQ ID NO: 3905341 - RNA, 11 nt, Shigella flexneri 2a str. 301
caacaucaucu

SEQ ID NO: 3905342 - RNA, 22 nt, Shigella flexneri 2a str. 301
caacauccgaggacagcaucgu

SEQ ID NO: 3905343 - RNA, 20 nt, Shigella flexneri 2a str. 301
caacauccuguaaacgaaaa

SEQ ID NO: 3905344 - RNA, 22 nt, Shigella flexneri 2a str. 301
caacauccuguaaacgaaaacu

SEQ ID NO: 3905345 - RNA, 21 nt, Shigella flexneri 2a str. 301
caacaucgcaauccuuucccu

SEQ ID NO: 3905346 - RNA, 22 nt, Shigella flexneri 2a str. 301
caacaucgcauucgacauugaa

SEQ ID NO: 3905347 - RNA, 23 nt, Shigella flexneri 2a str. 301
caacaucgcauucgacauugaau

SEQ ID NO: 3905348 - RNA, 22 nt, Shigella flexneri 2a str. 301
caacaugaaaauaaccauauau

SEQ ID NO: 3905349 - RNA, 14 nt, Shigella flexneri 2a str. 301
caacaugaaacaga

SEQ ID NO: 3905350 - RNA, 16 nt, Shigella flexneri 2a str. 301
caacaugaaacagaaa

SEQ ID NO: 3905351 - RNA, 15 nt, Shigella flexneri 2a str. 301
caacaugagaacagu

SEQ ID NO: 3905352 - RNA, 16 nt, Shigella flexneri 2a str. 301
caacaugagaacaguu

SEQ ID NO: 3905353 - RNA, 18 nt, Shigella flexneri 2a str. 301
caacaugcagcccagcau

SEQ ID NO: 3905354 - RNA, 20 nt, Shigella flexneri 2a str. 301
caacaugcagcccagcauca

SEQ ID NO: 3905355 - RNA, 20 nt, Shigella flexneri 2a str. 301
caacaugcggugauuuugcc

SEQ ID NO: 3905356 - RNA, 20 nt, Shigella flexneri 2a str. 301
caacaugcuauugcgccagc

SEQ ID NO: 3905357 - RNA, 16 nt, Shigella flexneri 2a str. 301
caacauggcaaccuuc

SEQ ID NO: 3905358 - RNA, 20 nt, Shigella flexneri 2a str. 301
caacauggcaaccuucgcgg

SEQ ID NO: 3905359 - RNA, 20 nt, Shigella flexneri 2a str. 301
caaccaaagcguaaaguggc

SEQ ID NO: 3905360 - RNA, 14 nt, Shigella flexneri 2a str. 301
caaccaacggccuu

SEQ ID NO: 3905361 - RNA, 15 nt, Shigella flexneri 2a str. 301
caaccaacggccuug

SEQ ID NO: 3905362 - RNA, 18 nt, Shigella flexneri 2a str. 301
caacggcgaaucuacgga

SEQ ID NO: 3905363 - RNA, 16 nt, Shigella flexneri 2a str. 301
caacggcgagccagcg

SEQ ID NO: 3905364 - RNA, 18 nt, Shigella flexneri 2a str. 301
caacggcgagccagcgca

SEQ ID NO: 3905365 - RNA, 18 nt, Shigella flexneri 2a str. 301
caacggcggaucaccgcg

SEQ ID NO: 3905366 - RNA, 22 nt, Shigella flexneri 2a str. 301
caacggcggaucaccgcgucuu

SEQ ID NO: 3905367 - RNA, 21 nt, Shigella flexneri 2a str. 301
caacggcguaaauaguccgga

SEQ ID NO: 3905368 - RNA, 23 nt, Shigella flexneri 2a str. 301
caacgggcaccgccgccgcuucu

SEQ ID NO: 3905369 - RNA, 15 nt, Shigella flexneri 2a str. 301
caacgggcugaagaa

SEQ ID NO: 3905370 - RNA, 16 nt, Shigella flexneri 2a str. 301
caacgguucgccauca

SEQ ID NO: 3905371 - RNA, 18 nt, Shigella flexneri 2a str. 301
caacgguugcggaaccca

SEQ ID NO: 3905372 - RNA, 13 nt, Shigella flexneri 2a str. 301
caacguaacaaaa

SEQ ID NO: 3905373 - RNA, 15 nt, Shigella flexneri 2a str. 301
caacguaacaaaacu

SEQ ID NO: 3905374 - RNA, 16 nt, Shigella flexneri 2a str. 301
caacguacucugccac

SEQ ID NO: 3905375 - RNA, 17 nt, Shigella flexneri 2a str. 301
caacguagccugccauu

SEQ ID NO: 3905376 - RNA, 18 nt, Shigella flexneri 2a str. 301
caacguagcguuaaaacu

SEQ ID NO: 3905377 - RNA, 17 nt, Shigella flexneri 2a str. 301
caacguaguaucguaau

SEQ ID NO: 3905378 - RNA, 19 nt, Shigella flexneri 2a str. 301
caacguauuacgaucaaga

SEQ ID NO: 3905379 - RNA, 19 nt, Shigella flexneri 2a str. 301
caacgucauuaucugcaga

SEQ ID NO: 3905380 - RNA, 22 nt, Shigella flexneri 2a str. 301
caacguccugcaacguccugca

SEQ ID NO: 3905381 - RNA, 21 nt, Shigella flexneri 2a str. 301
caacgugacucaauggcaucc

SEQ ID NO: 3905382 - RNA, 22 nt, Shigella flexneri 2a str. 301
caacgugacucaauggcauccg

SEQ ID NO: 3905383 - RNA, 22 nt, Shigella flexneri 2a str. 301
caacguggaacaaauagacaca

SEQ ID NO: 3905384 - RNA, 17 nt, Shigella flexneri 2a str. 301
caacguggauaccgaua

SEQ ID NO: 3905385 - RNA, 14 nt, Shigella flexneri 2a str. 301
caacguuaccgggu

SEQ ID NO: 3905386 - RNA, 19 nt, Shigella flexneri 2a str. 301
caacguuguuccuuccagc

SEQ ID NO: 3905387 - RNA, 12 nt, Shigella flexneri 2a str. 301
caacucacgauu

SEQ ID NO: 3905388 - RNA, 17 nt, Shigella flexneri 2a str. 301
caacucauuuacagaaa

SEQ ID NO: 3905389 - RNA, 19 nt, Shigella flexneri 2a str. 301
caacucauuuacagaaacu

SEQ ID NO: 3905390 - RNA, 16 nt, Shigella flexneri 2a str. 301
caacucccuauaguag

SEQ ID NO: 3905391 - RNA, 13 nt, Shigella flexneri 2a str. 301
caacuccgccagc

SEQ ID NO: 3905392 - RNA, 17 nt, Shigella flexneri 2a str. 301
caacuccgucgcggugu

SEQ ID NO: 3905393 - RNA, 17 nt, Shigella flexneri 2a str. 301
caacucugggcugaaga

SEQ ID NO: 3905394 - RNA, 15 nt, Shigella flexneri 2a str. 301
caacucugguggaca

SEQ ID NO: 3905395 - RNA, 16 nt, Shigella flexneri 2a str. 301
caacucuuuuuccugc

SEQ ID NO: 3905396 - RNA, 17 nt, Shigella flexneri 2a str. 301
caacugauaaaccuuca

SEQ ID NO: 3905397 - RNA, 22 nt, Shigella flexneri 2a str. 301
caacugauguagucauacugcg

SEQ ID NO: 3905398 - RNA, 20 nt, Shigella flexneri 2a str. 301
caacugccugaugcgaugcu

SEQ ID NO: 3905399 - RNA, 20 nt, Shigella flexneri 2a str. 301
caacugcgugcugagcggcg

SEQ ID NO: 3905400 - RNA, 18 nt, Shigella flexneri 2a str. 301
caacugcuucaaaaaaau

SEQ ID NO: 3905401 - RNA, 23 nt, Shigella flexneri 2a str. 301
caacugcuucaaaaaaauucuga

SEQ ID NO: 3905402 - RNA, 19 nt, Shigella flexneri 2a str. 301
caacuggcgcgcguauuca

SEQ ID NO: 3905403 - RNA, 22 nt, Shigella flexneri 2a str. 301
caacuggcuugguaacaugcuc

SEQ ID NO: 3905404 - RNA, 19 nt, Shigella flexneri 2a str. 301
caacugggacaugauucau

SEQ ID NO: 3905405 - RNA, 22 nt, Shigella flexneri 2a str. 301
caacuguaacgcagaagguuau

SEQ ID NO: 3905406 - RNA, 21 nt, Shigella flexneri 2a str. 301
caacugugccgccgccaccga

SEQ ID NO: 3905407 - RNA, 19 nt, Shigella flexneri 2a str. 301
caacuguugauccaggagc

SEQ ID NO: 3905408 - RNA, 20 nt, Shigella flexneri 2a str. 301
caacuuaaucaucaaugcca

SEQ ID NO: 3905409 - RNA, 18 nt, Shigella flexneri 2a str. 301
caacuucaaggucaacau

SEQ ID NO: 3905410 - RNA, 19 nt, Shigella flexneri 2a str. 301
caacuucaaggucaacauu

SEQ ID NO: 3905411 - RNA, 16 nt, Shigella flexneri 2a str. 301
caacuucgcuaaaucu

SEQ ID NO: 3905412 - RNA, 21 nt, Shigella flexneri 2a str. 301
caacuuuaucuucgagauucu

SEQ ID NO: 3905413 - RNA, 13 nt, Shigella flexneri 2a str. 301
caacuuuguucug

SEQ ID NO: 3905414 - RNA, 18 nt, Shigella flexneri 2a str. 301
caacuuuguucugaauca

SEQ ID NO: 3905415 - RNA, 20 nt, Shigella flexneri 2a str. 301
caacuuuguucugaaucacg

SEQ ID NO: 3905416 - RNA, 23 nt, Shigella flexneri 2a str. 301
caacuuuuggggugcaguucaga

SEQ ID NO: 3905417 - RNA, 16 nt, Shigella flexneri 2a str. 301
caagaaacagcaguuc

SEQ ID NO: 3905418 - RNA, 15 nt, Shigella flexneri 2a str. 301
caagaaaccgaaguu

SEQ ID NO: 3905419 - RNA, 20 nt, Shigella flexneri 2a str. 301
caagaaagagcgucuggaag

SEQ ID NO: 3905420 - RNA, 20 nt, Shigella flexneri 2a str. 301
caagaacagccuuaaacuca

SEQ ID NO: 3905421 - RNA, 14 nt, Shigella flexneri 2a str. 301
caagaacgaugauu

SEQ ID NO: 3905422 - RNA, 22 nt, Shigella flexneri 2a str. 301
caagaacgcauaccccaucagc

SEQ ID NO: 3905423 - RNA, 15 nt, Shigella flexneri 2a str. 301
caagaaguaacaacu

SEQ ID NO: 3905424 - RNA, 19 nt, Shigella flexneri 2a str. 301
caagaaucaugccaaaaau

SEQ ID NO: 3905425 - RNA, 19 nt, Shigella flexneri 2a str. 301
caagaaucucuucuucgcu

SEQ ID NO: 3905426 - RNA, 17 nt, Shigella flexneri 2a str. 301
caagaauuacuucuuga

SEQ ID NO: 3905427 - RNA, 16 nt, Shigella flexneri 2a str. 301
caagacgaaaaaugaa

SEQ ID NO: 3905428 - RNA, 20 nt, Shigella flexneri 2a str. 301
caagacgaauaccuucuucc

SEQ ID NO: 3905429 - RNA, 15 nt, Shigella flexneri 2a str. 301
caagagugaacacgu

SEQ ID NO: 3905430 - RNA, 16 nt, Shigella flexneri 2a str. 301
caagauacugcauaau

SEQ ID NO: 3905431 - RNA, 13 nt, Shigella flexneri 2a str. 301
caagauagaacca

SEQ ID NO: 3905432 - RNA, 12 nt, Shigella flexneri 2a str. 301
caagauauuccg

SEQ ID NO: 3905433 - RNA, 20 nt, Shigella flexneri 2a str. 301
caagauauuccgucuccgga

SEQ ID NO: 3905434 - RNA, 21 nt, Shigella flexneri 2a str. 301
caagauauugccgauuacgua

SEQ ID NO: 3905435 - RNA, 19 nt, Shigella flexneri 2a str. 301
caagaucagcauccauauc

SEQ ID NO: 3905436 - RNA, 21 nt, Shigella flexneri 2a str. 301
caagaucucauuccaccgaaa

SEQ ID NO: 3905437 - RNA, 17 nt, Shigella flexneri 2a str. 301
caagaugcuugcgauau

SEQ ID NO: 3905438 - RNA, 17 nt, Shigella flexneri 2a str. 301
caagauugccugaugcg

SEQ ID NO: 3905439 - RNA, 12 nt, Shigella flexneri 2a str. 301
caagauuuuugc

SEQ ID NO: 3905440 - RNA, 21 nt, Shigella flexneri 2a str. 301
caagcaaacccgaccaccauu

SEQ ID NO: 3905441 - RNA, 12 nt, Shigella flexneri 2a str. 301
caagcaaaugaa

SEQ ID NO: 3905442 - RNA, 13 nt, Shigella flexneri 2a str. 301
caagcaaaugaau

SEQ ID NO: 3905443 - RNA, 15 nt, Shigella flexneri 2a str. 301
caagcaaggccaggu

SEQ ID NO: 3905444 - RNA, 18 nt, Shigella flexneri 2a str. 301
caagcaccuuauccggcc

SEQ ID NO: 3905445 - RNA, 12 nt, Shigella flexneri 2a str. 301
caagcagagaga

SEQ ID NO: 3905446 - RNA, 22 nt, Shigella flexneri 2a str. 301
caagcagagagacaaucgccac

SEQ ID NO: 3905447 - RNA, 19 nt, Shigella flexneri 2a str. 301
caagcagcgcgcagaacau

SEQ ID NO: 3905448 - RNA, 20 nt, Shigella flexneri 2a str. 301
caagcaguugguuaaucuuu

SEQ ID NO: 3905449 - RNA, 21 nt, Shigella flexneri 2a str. 301
caagcaguugguuaaucuuuu

SEQ ID NO: 3905450 - RNA, 23 nt, Shigella flexneri 2a str. 301
caagcaguugguuaaucuuuucu

SEQ ID NO: 3905451 - RNA, 19 nt, Shigella flexneri 2a str. 301
caagcaugaucgaggcaaa

SEQ ID NO: 3905452 - RNA, 19 nt, Shigella flexneri 2a str. 301
caagcaugggugaacugcu

SEQ ID NO: 3905453 - RNA, 18 nt, Shigella flexneri 2a str. 301
caagccaggcuuuaaauu

SEQ ID NO: 3905454 - RNA, 22 nt, Shigella flexneri 2a str. 301
caagccagguuuugaccagucg

SEQ ID NO: 3905455 - RNA, 21 nt, Shigella flexneri 2a str. 301
caagccaugcccgugcugaca

SEQ ID NO: 3905456 - RNA, 22 nt, Shigella flexneri 2a str. 301
caagccaugcuuugcaucccag

SEQ ID NO: 3905457 - RNA, 18 nt, Shigella flexneri 2a str. 301
caagcccagcacccagua

SEQ ID NO: 3905458 - RNA, 14 nt, Shigella flexneri 2a str. 301
caagcccgccggga

SEQ ID NO: 3905459 - RNA, 23 nt, Shigella flexneri 2a str. 301
caagcccguguuucugauacagc

SEQ ID NO: 3905460 - RNA, 20 nt, Shigella flexneri 2a str. 301
caagcccugguaacugccag

SEQ ID NO: 3905461 - RNA, 20 nt, Shigella flexneri 2a str. 301
caauaccgccugcaaauaaa

SEQ ID NO: 3905462 - RNA, 21 nt, Shigella flexneri 2a str. 301
caauaccgccugcaaauaaau

SEQ ID NO: 3905463 - RNA, 21 nt, Shigella flexneri 2a str. 301
caauaccgcguaauacaucag

SEQ ID NO: 3905464 - RNA, 23 nt, Shigella flexneri 2a str. 301
caauaccuucugcgcccgcccgc

SEQ ID NO: 3905465 - RNA, 18 nt, Shigella flexneri 2a str. 301
caauacgauuaacgccag

SEQ ID NO: 3905466 - RNA, 16 nt, Shigella flexneri 2a str. 301
caauacgcccacguuu

SEQ ID NO: 3905467 - RNA, 17 nt, Shigella flexneri 2a str. 301
caauacugacaucagca

SEQ ID NO: 3905468 - RNA, 20 nt, Shigella flexneri 2a str. 301
caauacugacaucagcaucc

SEQ ID NO: 3905469 - RNA, 19 nt, Shigella flexneri 2a str. 301
caauacugaucaucauuac

SEQ ID NO: 3905470 - RNA, 12 nt, Shigella flexneri 2a str. 301
caauacuggcag

SEQ ID NO: 3905471 - RNA, 22 nt, Shigella flexneri 2a str. 301
caauacuuaaccccagaccaau

SEQ ID NO: 3905472 - RNA, 20 nt, Shigella flexneri 2a str. 301
caauacuuauaaaccacgca

SEQ ID NO: 3905473 - RNA, 16 nt, Shigella flexneri 2a str. 301
caauacuuccgcuucc

SEQ ID NO: 3905474 - RNA, 23 nt, Shigella flexneri 2a str. 301
caauacuuucacaaaaauaauuu

SEQ ID NO: 3905475 - RNA, 18 nt, Shigella flexneri 2a str. 301
caauagacaguucuuccu

SEQ ID NO: 3905476 - RNA, 18 nt, Shigella flexneri 2a str. 301
caauagagacacaacaau

SEQ ID NO: 3905477 - RNA, 18 nt, Shigella flexneri 2a str. 301
caauagcaacugauuuau

SEQ ID NO: 3905478 - RNA, 21 nt, Shigella flexneri 2a str. 301
caauagcaccauuaaauccgg

SEQ ID NO: 3905479 - RNA, 22 nt, Shigella flexneri 2a str. 301
caauagcguuaauucgcuaaca

SEQ ID NO: 3905480 - RNA, 17 nt, Shigella flexneri 2a str. 301
caauagcuaacgaaaga

SEQ ID NO: 3905481 - RNA, 18 nt, Shigella flexneri 2a str. 301
caauagcuaacgaaagaa

SEQ ID NO: 3905482 - RNA, 23 nt, Shigella flexneri 2a str. 301
caauaggaagccggaauuuuccu

SEQ ID NO: 3905483 - RNA, 16 nt, Shigella flexneri 2a str. 301
caauagucguguuauc

SEQ ID NO: 3905484 - RNA, 18 nt, Shigella flexneri 2a str. 301
caauaguguugccgccac

SEQ ID NO: 3905485 - RNA, 22 nt, Shigella flexneri 2a str. 301
caauaguucuguugcugaaauu

SEQ ID NO: 3905486 - RNA, 17 nt, Shigella flexneri 2a str. 301
caauauagauaucaugc

SEQ ID NO: 3905487 - RNA, 18 nt, Shigella flexneri 2a str. 301
caauauauugaauuugca

SEQ ID NO: 3905488 - RNA, 19 nt, Shigella flexneri 2a str. 301
caauauauugcaaucaucu

SEQ ID NO: 3905489 - RNA, 14 nt, Shigella flexneri 2a str. 301
caauaucaaauaaa

SEQ ID NO: 3905490 - RNA, 15 nt, Shigella flexneri 2a str. 301
caauaucaucauuug

SEQ ID NO: 3905491 - RNA, 17 nt, Shigella flexneri 2a str. 301
caauaucauuacgccag

SEQ ID NO: 3905492 - RNA, 15 nt, Shigella flexneri 2a str. 301
caauauccaacaggu

SEQ ID NO: 3905493 - RNA, 23 nt, Shigella flexneri 2a str. 301
caauauccaccgggguaaaucca

SEQ ID NO: 3905494 - RNA, 19 nt, Shigella flexneri 2a str. 301
caauauccgguucacuuca

SEQ ID NO: 3905495 - RNA, 21 nt, Shigella flexneri 2a str. 301
caauauccugcgcuuccugca

SEQ ID NO: 3905496 - RNA, 23 nt, Shigella flexneri 2a str. 301
caauauccugcgcuuccugcaac

SEQ ID NO: 3905497 - RNA, 14 nt, Shigella flexneri 2a str. 301
caauaucggcacca

SEQ ID NO: 3905498 - RNA, 15 nt, Shigella flexneri 2a str. 301
caauauuaucgauuu

SEQ ID NO: 3905499 - RNA, 19 nt, Shigella flexneri 2a str. 301
caauauugaugcucacugc

SEQ ID NO: 3905500 - RNA, 11 nt, Shigella flexneri 2a str. 301
caauauuugca

SEQ ID NO: 3905501 - RNA, 15 nt, Shigella flexneri 2a str. 301
caauauuuucaaucu

SEQ ID NO: 3905502 - RNA, 12 nt, Shigella flexneri 2a str. 301
caauauuuugaa

SEQ ID NO: 3905503 - RNA, 14 nt, Shigella flexneri 2a str. 301
caaucaaaaaaggc

SEQ ID NO: 3905504 - RNA, 16 nt, Shigella flexneri 2a str. 301
caaucaaacucaauua

SEQ ID NO: 3905505 - RNA, 16 nt, Shigella flexneri 2a str. 301
caaucaaauuauccac

SEQ ID NO: 3905506 - RNA, 17 nt, Shigella flexneri 2a str. 301
caaucaaauuauccacg

SEQ ID NO: 3905507 - RNA, 12 nt, Shigella flexneri 2a str. 301
caaucacaaaua

SEQ ID NO: 3905508 - RNA, 15 nt, Shigella flexneri 2a str. 301
caaucacaaauagac

SEQ ID NO: 3905509 - RNA, 13 nt, Shigella flexneri 2a str. 301
caaucacaagacc

SEQ ID NO: 3905510 - RNA, 16 nt, Shigella flexneri 2a str. 301
caaucaccaccagcgg

SEQ ID NO: 3905511 - RNA, 19 nt, Shigella flexneri 2a str. 301
caaucacccccaccccggc

SEQ ID NO: 3905512 - RNA, 11 nt, Shigella flexneri 2a str. 301
caaucaccgca

SEQ ID NO: 3905513 - RNA, 15 nt, Shigella flexneri 2a str. 301
caaucaccgccagcg

SEQ ID NO: 3905514 - RNA, 17 nt, Shigella flexneri 2a str. 301
caaucaccgccagcggc

SEQ ID NO: 3905515 - RNA, 19 nt, Shigella flexneri 2a str. 301
caaucaccgccagcggcgu

SEQ ID NO: 3905516 - RNA, 20 nt, Shigella flexneri 2a str. 301
caaucacgucgcccaccgcg

SEQ ID NO: 3905517 - RNA, 17 nt, Shigella flexneri 2a str. 301
caaucacugccagaaua

SEQ ID NO: 3905518 - RNA, 14 nt, Shigella flexneri 2a str. 301
caaucagauaaaau

SEQ ID NO: 3905519 - RNA, 16 nt, Shigella flexneri 2a str. 301
caaucagauaaaauac

SEQ ID NO: 3905520 - RNA, 12 nt, Shigella flexneri 2a str. 301
caaucagaugug

SEQ ID NO: 3905521 - RNA, 12 nt, Shigella flexneri 2a str. 301
caaucagcaccg

SEQ ID NO: 3905522 - RNA, 14 nt, Shigella flexneri 2a str. 301
caaucagcaccgcg

SEQ ID NO: 3905523 - RNA, 16 nt, Shigella flexneri 2a str. 301
caaucagcgcagcacc

SEQ ID NO: 3905524 - RNA, 21 nt, Shigella flexneri 2a str. 301
caaucagguaagcaaaggugc

SEQ ID NO: 3905525 - RNA, 23 nt, Shigella flexneri 2a str. 301
caaucagguaagcgauaaaaaua

SEQ ID NO: 3905526 - RNA, 16 nt, Shigella flexneri 2a str. 301
caaucauauucaccac

SEQ ID NO: 3905527 - RNA, 13 nt, Shigella flexneri 2a str. 301
caaucauccauau

SEQ ID NO: 3905528 - RNA, 16 nt, Shigella flexneri 2a str. 301
caaucaucgaugcgau

SEQ ID NO: 3905529 - RNA, 18 nt, Shigella flexneri 2a str. 301
caaucaucgccuuaugcu

SEQ ID NO: 3905530 - RNA, 19 nt, Shigella flexneri 2a str. 301
caaucaucucucgcaucag

SEQ ID NO: 3905531 - RNA, 20 nt, Shigella flexneri 2a str. 301
caaucaucuuguaggccuga

SEQ ID NO: 3905532 - RNA, 19 nt, Shigella flexneri 2a str. 301
caauccacuucgccagacg

SEQ ID NO: 3905533 - RNA, 15 nt, Shigella flexneri 2a str. 301
caauccagcccugcc

SEQ ID NO: 3905534 - RNA, 17 nt, Shigella flexneri 2a str. 301
caauccauaccagcaca

SEQ ID NO: 3905535 - RNA, 15 nt, Shigella flexneri 2a str. 301
caaucccaaaauaau

SEQ ID NO: 3905536 - RNA, 14 nt, Shigella flexneri 2a str. 301
caauccccgccagc

SEQ ID NO: 3905537 - RNA, 18 nt, Shigella flexneri 2a str. 301
caaucccuuaguaacgcc

SEQ ID NO: 3905538 - RNA, 20 nt, Shigella flexneri 2a str. 301
caaucccuuucucuucaaac

SEQ ID NO: 3905539 - RNA, 20 nt, Shigella flexneri 2a str. 301
caauccggccuacaaauuca

SEQ ID NO: 3905540 - RNA, 14 nt, Shigella flexneri 2a str. 301
caauccucuuuucc

SEQ ID NO: 3905541 - RNA, 21 nt, Shigella flexneri 2a str. 301
caaucgaaaaagaaucgauua

SEQ ID NO: 3905542 - RNA, 19 nt, Shigella flexneri 2a str. 301
caaucgaccaggccaucag

SEQ ID NO: 3905543 - RNA, 15 nt, Shigella flexneri 2a str. 301
caaucgacuuuucau

SEQ ID NO: 3905544 - RNA, 18 nt, Shigella flexneri 2a str. 301
caaucgcaaucuggcagc

SEQ ID NO: 3905545 - RNA, 20 nt, Shigella flexneri 2a str. 301
caaucgcagcacuggugcug

SEQ ID NO: 3905546 - RNA, 15 nt, Shigella flexneri 2a str. 301
caaucgcauagccag

SEQ ID NO: 3905547 - RNA, 21 nt, Shigella flexneri 2a str. 301
caaucgcccccgucaccggca

SEQ ID NO: 3905548 - RNA, 15 nt, Shigella flexneri 2a str. 301
caaucgcuucaucgc

SEQ ID NO: 3905549 - RNA, 20 nt, Shigella flexneri 2a str. 301
caaucgcuucgucaagacgu

SEQ ID NO: 3905550 - RNA, 15 nt, Shigella flexneri 2a str. 301
caaucggcuuuuuau

SEQ ID NO: 3905551 - RNA, 14 nt, Shigella flexneri 2a str. 301
caaucggugcaaau

SEQ ID NO: 3905552 - RNA, 16 nt, Shigella flexneri 2a str. 301
caaucguagcccagcu

SEQ ID NO: 3905553 - RNA, 17 nt, Shigella flexneri 2a str. 301
caaucguaugaucaucc

SEQ ID NO: 3905554 - RNA, 21 nt, Shigella flexneri 2a str. 301
caaucguaugaucauccgccu

SEQ ID NO: 3905555 - RNA, 17 nt, Shigella flexneri 2a str. 301
caaucguuucaugccau

SEQ ID NO: 3905556 - RNA, 14 nt, Shigella flexneri 2a str. 301
caaucuacaaaaga

SEQ ID NO: 3905557 - RNA, 14 nt, Shigella flexneri 2a str. 301
caaucucaccaauc

SEQ ID NO: 3905558 - RNA, 14 nt, Shigella flexneri 2a str. 301
caaucucagcaaga

SEQ ID NO: 3905559 - RNA, 12 nt, Shigella flexneri 2a str. 301
caaucucagcga

SEQ ID NO: 3905560 - RNA, 20 nt, Shigella flexneri 2a str. 301
caaucucauaccagguaccg

SEQ ID NO: 3905561 - RNA, 12 nt, Shigella flexneri 2a str. 301
caauuccuucug

SEQ ID NO: 3905562 - RNA, 22 nt, Shigella flexneri 2a str. 301
caauucgcgucggcgucagcgc

SEQ ID NO: 3905563 - RNA, 14 nt, Shigella flexneri 2a str. 301
caauucuaccguug

SEQ ID NO: 3905564 - RNA, 23 nt, Shigella flexneri 2a str. 301
caauucuucuugaccguuuuacu

SEQ ID NO: 3905565 - RNA, 13 nt, Shigella flexneri 2a str. 301
caauucuuucucg

SEQ ID NO: 3905566 - RNA, 15 nt, Shigella flexneri 2a str. 301
caauugaagaauauc

SEQ ID NO: 3905567 - RNA, 14 nt, Shigella flexneri 2a str. 301
caauugacaguuua

SEQ ID NO: 3905568 - RNA, 17 nt, Shigella flexneri 2a str. 301
caauugacaguuuauuu

SEQ ID NO: 3905569 - RNA, 19 nt, Shigella flexneri 2a str. 301
caauugcauauuucaacga

SEQ ID NO: 3905570 - RNA, 18 nt, Shigella flexneri 2a str. 301
caauugccgccagcucac

SEQ ID NO: 3905571 - RNA, 14 nt, Shigella flexneri 2a str. 301
caauugccggaugc

SEQ ID NO: 3905572 - RNA, 23 nt, Shigella flexneri 2a str. 301
caauugcgcaccagcuugcgaca

SEQ ID NO: 3905573 - RNA, 18 nt, Shigella flexneri 2a str. 301
caauugcgggccaaagac

SEQ ID NO: 3905574 - RNA, 17 nt, Shigella flexneri 2a str. 301
caauugcucccugaaua

SEQ ID NO: 3905575 - RNA, 21 nt, Shigella flexneri 2a str. 301
caauuggccugauaagacagc

SEQ ID NO: 3905576 - RNA, 22 nt, Shigella flexneri 2a str. 301
caauugucccguuuugaaaagc

SEQ ID NO: 3905577 - RNA, 16 nt, Shigella flexneri 2a str. 301
caauuuacgcuuuucu

SEQ ID NO: 3905578 - RNA, 19 nt, Shigella flexneri 2a str. 301
caauuuacguuuuaaaccu

SEQ ID NO: 3905579 - RNA, 14 nt, Shigella flexneri 2a str. 301
caauuucacguuca

SEQ ID NO: 3905580 - RNA, 13 nt, Shigella flexneri 2a str. 301
caauuucaucacu

SEQ ID NO: 3905581 - RNA, 15 nt, Shigella flexneri 2a str. 301
caauuucaucacuga

SEQ ID NO: 3905582 - RNA, 12 nt, Shigella flexneri 2a str. 301
caauuuccaguu

SEQ ID NO: 3905583 - RNA, 21 nt, Shigella flexneri 2a str. 301
caauuucccgcucauagccac

SEQ ID NO: 3905584 - RNA, 14 nt, Shigella flexneri 2a str. 301
caauuucgcugccc

SEQ ID NO: 3905585 - RNA, 20 nt, Shigella flexneri 2a str. 301
caauuucucguuggucauca

SEQ ID NO: 3905586 - RNA, 22 nt, Shigella flexneri 2a str. 301
caauuucugugcagccaaaaau

SEQ ID NO: 3905587 - RNA, 20 nt, Shigella flexneri 2a str. 301
caauuuguagucauuuuuug

SEQ ID NO: 3905588 - RNA, 16 nt, Shigella flexneri 2a str. 301
caauuuucauugaaaa

SEQ ID NO: 3905589 - RNA, 14 nt, Shigella flexneri 2a str. 301
cacaaaaaccgcug

SEQ ID NO: 3905590 - RNA, 21 nt, Shigella flexneri 2a str. 301
cacaaaaaguaguuccagcau

SEQ ID NO: 3905591 - RNA, 23 nt, Shigella flexneri 2a str. 301
cacaaaaucacgucgauuuuuaa

SEQ ID NO: 3905592 - RNA, 14 nt, Shigella flexneri 2a str. 301
cacaaaaucaugag

SEQ ID NO: 3905593 - RNA, 13 nt, Shigella flexneri 2a str. 301
cacaaacaauuug

SEQ ID NO: 3905594 - RNA, 17 nt, Shigella flexneri 2a str. 301
cacaaacgccgugcaca

SEQ ID NO: 3905595 - RNA, 19 nt, Shigella flexneri 2a str. 301
cacaaaggcuugcugcauu

SEQ ID NO: 3905596 - RNA, 17 nt, Shigella flexneri 2a str. 301
cacaaauggcaaugacu

SEQ ID NO: 3905597 - RNA, 20 nt, Shigella flexneri 2a str. 301
cacaaccaccguuuuuucug

SEQ ID NO: 3905598 - RNA, 16 nt, Shigella flexneri 2a str. 301
cacaaccggaaccagc

SEQ ID NO: 3905599 - RNA, 20 nt, Shigella flexneri 2a str. 301
cacaaccggaaccagcgccu

SEQ ID NO: 3905600 - RNA, 17 nt, Shigella flexneri 2a str. 301
cacaaccugcacgaaac

SEQ ID NO: 3905601 - RNA, 18 nt, Shigella flexneri 2a str. 301
cacaacgagcgcaaugaa

SEQ ID NO: 3905602 - RNA, 20 nt, Shigella flexneri 2a str. 301
cacaacgcuuucaacaaccu

SEQ ID NO: 3905603 - RNA, 14 nt, Shigella flexneri 2a str. 301
cacaacgugggccu

SEQ ID NO: 3905604 - RNA, 14 nt, Shigella flexneri 2a str. 301
cacaacuccauaca

SEQ ID NO: 3905605 - RNA, 19 nt, Shigella flexneri 2a str. 301
cacaacuggcuugguaaca

SEQ ID NO: 3905606 - RNA, 15 nt, Shigella flexneri 2a str. 301
cacaagaccgcuucc

SEQ ID NO: 3905607 - RNA, 11 nt, Shigella flexneri 2a str. 301
cacaagacugu

SEQ ID NO: 3905608 - RNA, 22 nt, Shigella flexneri 2a str. 301
cacaagccaggacgcaguccag

SEQ ID NO: 3905609 - RNA, 14 nt, Shigella flexneri 2a str. 301
cacaagcccaugca

SEQ ID NO: 3905610 - RNA, 16 nt, Shigella flexneri 2a str. 301
cacaagcuaccagccc

SEQ ID NO: 3905611 - RNA, 19 nt, Shigella flexneri 2a str. 301
cacaaguuguuuacaguau

SEQ ID NO: 3905612 - RNA, 21 nt, Shigella flexneri 2a str. 301
cacaaguuuuuaggcaugaua

SEQ ID NO: 3905613 - RNA, 11 nt, Shigella flexneri 2a str. 301
cacaauaccuu

SEQ ID NO: 3905614 - RNA, 16 nt, Shigella flexneri 2a str. 301
cacaauagaaauauug

SEQ ID NO: 3905615 - RNA, 19 nt, Shigella flexneri 2a str. 301
cacaaucaaauccugcauc

SEQ ID NO: 3905616 - RNA, 21 nt, Shigella flexneri 2a str. 301
cacaaucaaaucgacagccag

SEQ ID NO: 3905617 - RNA, 19 nt, Shigella flexneri 2a str. 301
cacaaucagacgcaggcgc

SEQ ID NO: 3905618 - RNA, 20 nt, Shigella flexneri 2a str. 301
cacaaucauccuaccgccag

SEQ ID NO: 3905619 - RNA, 18 nt, Shigella flexneri 2a str. 301
cacaaucguguggcauca

SEQ ID NO: 3905620 - RNA, 21 nt, Shigella flexneri 2a str. 301
cacaaucguguggcaucaucc

SEQ ID NO: 3905621 - RNA, 19 nt, Shigella flexneri 2a str. 301
cacaaugccaccaauaaug

SEQ ID NO: 3905622 - RNA, 23 nt, Shigella flexneri 2a str. 301
cacaaugccugaugcgacgcuug

SEQ ID NO: 3905623 - RNA, 20 nt, Shigella flexneri 2a str. 301
cacaaugcuguaaccagcgc

SEQ ID NO: 3905624 - RNA, 12 nt, Shigella flexneri 2a str. 301
cacaauuaccuu

SEQ ID NO: 3905625 - RNA, 14 nt, Shigella flexneri 2a str. 301
cacaauuaccuucc

SEQ ID NO: 3905626 - RNA, 18 nt, Shigella flexneri 2a str. 301
cacaauuacugagagaaa

SEQ ID NO: 3905627 - RNA, 16 nt, Shigella flexneri 2a str. 301
cacaauugccagcccu

SEQ ID NO: 3905628 - RNA, 13 nt, Shigella flexneri 2a str. 301
cacaauugccgga

SEQ ID NO: 3905629 - RNA, 22 nt, Shigella flexneri 2a str. 301
cacacaagccgugaaucacucc

SEQ ID NO: 3905630 - RNA, 14 nt, Shigella flexneri 2a str. 301
cacacacgcccagc

SEQ ID NO: 3905631 - RNA, 22 nt, Shigella flexneri 2a str. 301
cacacacugcuuaacugcgcuu

SEQ ID NO: 3905632 - RNA, 13 nt, Shigella flexneri 2a str. 301
cacacauaucaca

SEQ ID NO: 3905633 - RNA, 18 nt, Shigella flexneri 2a str. 301
cacacauuauaggccuga

SEQ ID NO: 3905634 - RNA, 12 nt, Shigella flexneri 2a str. 301
cacaccaccaug

SEQ ID NO: 3905635 - RNA, 13 nt, Shigella flexneri 2a str. 301
cacaccaccguuu

SEQ ID NO: 3905636 - RNA, 16 nt, Shigella flexneri 2a str. 301
cacaccacugcgcaua

SEQ ID NO: 3905637 - RNA, 21 nt, Shigella flexneri 2a str. 301
cacaccacugcgcauaaucca

SEQ ID NO: 3905638 - RNA, 13 nt, Shigella flexneri 2a str. 301
cacaccaucaaca

SEQ ID NO: 3905639 - RNA, 18 nt, Shigella flexneri 2a str. 301
cacacccgguaucaaacc

SEQ ID NO: 3905640 - RNA, 19 nt, Shigella flexneri 2a str. 301
cacacccgguaucaaaccc

SEQ ID NO: 3905641 - RNA, 20 nt, Shigella flexneri 2a str. 301
cacacccgguaucaaacccu

SEQ ID NO: 3905642 - RNA, 19 nt, Shigella flexneri 2a str. 301
cacaccgaagacaucgcag

SEQ ID NO: 3905643 - RNA, 21 nt, Shigella flexneri 2a str. 301
cacaccgcgaucuuccacgcc

SEQ ID NO: 3905644 - RNA, 15 nt, Shigella flexneri 2a str. 301
cacaccgcggaacgc

SEQ ID NO: 3905645 - RNA, 13 nt, Shigella flexneri 2a str. 301
cacaccggcacca

SEQ ID NO: 3905646 - RNA, 18 nt, Shigella flexneri 2a str. 301
cacacgccaggccacgcu

SEQ ID NO: 3905647 - RNA, 19 nt, Shigella flexneri 2a str. 301
cacacgccgcgaggcaaau

SEQ ID NO: 3905648 - RNA, 13 nt, Shigella flexneri 2a str. 301
cacacgcgcugag

SEQ ID NO: 3905649 - RNA, 15 nt, Shigella flexneri 2a str. 301
cacacgugcaucucu

SEQ ID NO: 3905650 - RNA, 20 nt, Shigella flexneri 2a str. 301
cacacuccagucccaguuca

SEQ ID NO: 3905651 - RNA, 13 nt, Shigella flexneri 2a str. 301
cacacugaauaaa

SEQ ID NO: 3905652 - RNA, 13 nt, Shigella flexneri 2a str. 301
cacacugcuuaac

SEQ ID NO: 3905653 - RNA, 19 nt, Shigella flexneri 2a str. 301
cacacugcuuaacugcgcu

SEQ ID NO: 3905654 - RNA, 20 nt, Shigella flexneri 2a str. 301
cacacugguucccaacaaca

SEQ ID NO: 3905655 - RNA, 20 nt, Shigella flexneri 2a str. 301
cacacuucauuuuccacaau

SEQ ID NO: 3905656 - RNA, 13 nt, Shigella flexneri 2a str. 301
cacagaacaaaau

SEQ ID NO: 3905657 - RNA, 17 nt, Shigella flexneri 2a str. 301
cacagaaccggagucag

SEQ ID NO: 3905658 - RNA, 15 nt, Shigella flexneri 2a str. 301
cacagaaggccagga

SEQ ID NO: 3905659 - RNA, 11 nt, Shigella flexneri 2a str. 301
cacagaaguga

SEQ ID NO: 3905660 - RNA, 21 nt, Shigella flexneri 2a str. 301
cacagaauucccccauugaaa

SEQ ID NO: 3905661 - RNA, 13 nt, Shigella flexneri 2a str. 301
caccaccagcagc

SEQ ID NO: 3905662 - RNA, 14 nt, Shigella flexneri 2a str. 301
caccaccagcagcu

SEQ ID NO: 3905663 - RNA, 15 nt, Shigella flexneri 2a str. 301
caccaccagcagcug

SEQ ID NO: 3905664 - RNA, 12 nt, Shigella flexneri 2a str. 301
caccacccagcg

SEQ ID NO: 3905665 - RNA, 14 nt, Shigella flexneri 2a str. 301
caccacccagcgcc

SEQ ID NO: 3905666 - RNA, 15 nt, Shigella flexneri 2a str. 301
caccacccagcgccc

SEQ ID NO: 3905667 - RNA, 17 nt, Shigella flexneri 2a str. 301
caccacccguaaucacc

SEQ ID NO: 3905668 - RNA, 13 nt, Shigella flexneri 2a str. 301
caccacccugccc

SEQ ID NO: 3905669 - RNA, 22 nt, Shigella flexneri 2a str. 301
caccaccgacggacccgccggc

SEQ ID NO: 3905670 - RNA, 24 nt, Shigella flexneri 2a str. 301
caccaccgacggacccgccggcgu

SEQ ID NO: 3905671 - RNA, 17 nt, Shigella flexneri 2a str. 301
caccaccgauccugaag

SEQ ID NO: 3905672 - RNA, 15 nt, Shigella flexneri 2a str. 301
caccaccgcauccgg

SEQ ID NO: 3905673 - RNA, 21 nt, Shigella flexneri 2a str. 301
caccaccgcaucggcaucaaa

SEQ ID NO: 3905674 - RNA, 19 nt, Shigella flexneri 2a str. 301
caccaccgcccguuccacc

SEQ ID NO: 3905675 - RNA, 16 nt, Shigella flexneri 2a str. 301
caccaccugcaucucc

SEQ ID NO: 3905676 - RNA, 13 nt, Shigella flexneri 2a str. 301
caccaccugggug

SEQ ID NO: 3905677 - RNA, 14 nt, Shigella flexneri 2a str. 301
caccacgcagcagc

SEQ ID NO: 3905678 - RNA, 19 nt, Shigella flexneri 2a str. 301
caccacgccggaugaaauc

SEQ ID NO: 3905679 - RNA, 20 nt, Shigella flexneri 2a str. 301
caccacgccugccgccagca

SEQ ID NO: 3905680 - RNA, 21 nt, Shigella flexneri 2a str. 301
caccacgccugccgccagcau

SEQ ID NO: 3905681 - RNA, 15 nt, Shigella flexneri 2a str. 301
caccacgcuccauca

SEQ ID NO: 3905682 - RNA, 19 nt, Shigella flexneri 2a str. 301
caccacgcugagagaagca

SEQ ID NO: 3905683 - RNA, 19 nt, Shigella flexneri 2a str. 301
caccacgcuguagccgccg

SEQ ID NO: 3905684 - RNA, 20 nt, Shigella flexneri 2a str. 301
caccacggaaaguuuaauug

SEQ ID NO: 3905685 - RNA, 18 nt, Shigella flexneri 2a str. 301
caccacgguaagcggcgu

SEQ ID NO: 3905686 - RNA, 18 nt, Shigella flexneri 2a str. 301
caccacuccccuccugca

SEQ ID NO: 3905687 - RNA, 12 nt, Shigella flexneri 2a str. 301
caccacuccuca

SEQ ID NO: 3905688 - RNA, 15 nt, Shigella flexneri 2a str. 301
caccacuccucaaca

SEQ ID NO: 3905689 - RNA, 13 nt, Shigella flexneri 2a str. 301
caccacugcaaug

SEQ ID NO: 3905690 - RNA, 17 nt, Shigella flexneri 2a str. 301
caccacugccagcgguu

SEQ ID NO: 3905691 - RNA, 23 nt, Shigella flexneri 2a str. 301
caccacugcgcauaauccacuuu

SEQ ID NO: 3905692 - RNA, 22 nt, Shigella flexneri 2a str. 301
caccacuugcagcucauauucc

SEQ ID NO: 3905693 - RNA, 22 nt, Shigella flexneri 2a str. 301
caccacuuuacgggcaaucucc

SEQ ID NO: 3905694 - RNA, 14 nt, Shigella flexneri 2a str. 301
caccacuuuugcuc

SEQ ID NO: 3905695 - RNA, 19 nt, Shigella flexneri 2a str. 301
caccacuuuuuucaccgag

SEQ ID NO: 3905696 - RNA, 18 nt, Shigella flexneri 2a str. 301
caccagaaacaauaagua

SEQ ID NO: 3905697 - RNA, 22 nt, Shigella flexneri 2a str. 301
caccagaaaguuuuucaacacc

SEQ ID NO: 3905698 - RNA, 14 nt, Shigella flexneri 2a str. 301
caccagaaucgcca

SEQ ID NO: 3905699 - RNA, 20 nt, Shigella flexneri 2a str. 301
caccagaaucgccagcaucg

SEQ ID NO: 3905700 - RNA, 23 nt, Shigella flexneri 2a str. 301
caccagacgugauaaacauccac

SEQ ID NO: 3905701 - RNA, 14 nt, Shigella flexneri 2a str. 301
caccagagaacuga

SEQ ID NO: 3905702 - RNA, 16 nt, Shigella flexneri 2a str. 301
caccagauaaugagaa

SEQ ID NO: 3905703 - RNA, 14 nt, Shigella flexneri 2a str. 301
caccagauggcuuu

SEQ ID NO: 3905704 - RNA, 19 nt, Shigella flexneri 2a str. 301
caccagauuauaagccagu

SEQ ID NO: 3905705 - RNA, 23 nt, Shigella flexneri 2a str. 301
caccagauugugaaucgccugga

SEQ ID NO: 3905706 - RNA, 13 nt, Shigella flexneri 2a str. 301
caccagcaaauau

SEQ ID NO: 3905707 - RNA, 16 nt, Shigella flexneri 2a str. 301
caccagcaacaagcca

SEQ ID NO: 3905708 - RNA, 17 nt, Shigella flexneri 2a str. 301
caccagcaacaagccag

SEQ ID NO: 3905709 - RNA, 16 nt, Shigella flexneri 2a str. 301
caccagcaacagcgcc

SEQ ID NO: 3905710 - RNA, 17 nt, Shigella flexneri 2a str. 301
caccagcaacagcgccg

SEQ ID NO: 3905711 - RNA, 20 nt, Shigella flexneri 2a str. 301
caccagcaauaacaacacgc

SEQ ID NO: 3905712 - RNA, 22 nt, Shigella flexneri 2a str. 301
caccagcaauaacaacacgccg

SEQ ID NO: 3905713 - RNA, 23 nt, Shigella flexneri 2a str. 301
caccagcaauaauagcauccacc

SEQ ID NO: 3905714 - RNA, 14 nt, Shigella flexneri 2a str. 301
caccagcaccagcg

SEQ ID NO: 3905715 - RNA, 15 nt, Shigella flexneri 2a str. 301
caccagcaucaacaa

SEQ ID NO: 3905716 - RNA, 17 nt, Shigella flexneri 2a str. 301
caccagcaucaacaaca

SEQ ID NO: 3905717 - RNA, 12 nt, Shigella flexneri 2a str. 301
caccagccagaa

SEQ ID NO: 3905718 - RNA, 13 nt, Shigella flexneri 2a str. 301
caccagccugcaa

SEQ ID NO: 3905719 - RNA, 15 nt, Shigella flexneri 2a str. 301
caccagcgaaaguaa

SEQ ID NO: 3905720 - RNA, 23 nt, Shigella flexneri 2a str. 301
caccagcgaaaguaacaccaucc

SEQ ID NO: 3905721 - RNA, 19 nt, Shigella flexneri 2a str. 301
caccagcgauuguucaccc

SEQ ID NO: 3905722 - RNA, 20 nt, Shigella flexneri 2a str. 301
caccagcgcaauauguuucc

SEQ ID NO: 3905723 - RNA, 16 nt, Shigella flexneri 2a str. 301
caccagcggcacgcca

SEQ ID NO: 3905724 - RNA, 17 nt, Shigella flexneri 2a str. 301
caccagcgucagaaaca

SEQ ID NO: 3905725 - RNA, 18 nt, Shigella flexneri 2a str. 301
caccagcucagugaccga

SEQ ID NO: 3905726 - RNA, 17 nt, Shigella flexneri 2a str. 301
caccagcuccggcaccu

SEQ ID NO: 3905727 - RNA, 19 nt, Shigella flexneri 2a str. 301
caccaggaacgcgccaaga

SEQ ID NO: 3905728 - RNA, 20 nt, Shigella flexneri 2a str. 301
caccaggaacgcgccaagau

SEQ ID NO: 3905729 - RNA, 21 nt, Shigella flexneri 2a str. 301
caccaggaacgcgccaagaua

SEQ ID NO: 3905730 - RNA, 22 nt, Shigella flexneri 2a str. 301
caccaggaacgcgccaagauag

SEQ ID NO: 3905731 - RNA, 12 nt, Shigella flexneri 2a str. 301
caccaguaaaua

SEQ ID NO: 3905732 - RNA, 12 nt, Shigella flexneri 2a str. 301
caccaguaaauu

SEQ ID NO: 3905733 - RNA, 21 nt, Shigella flexneri 2a str. 301
caccaguaaggcaucuucuuc

SEQ ID NO: 3905734 - RNA, 23 nt, Shigella flexneri 2a str. 301
caccaguaccucuucgcuggcaa

SEQ ID NO: 3905735 - RNA, 13 nt, Shigella flexneri 2a str. 301
caccaguccagcg

SEQ ID NO: 3905736 - RNA, 23 nt, Shigella flexneri 2a str. 301
caccaguugguagguccagccgc

SEQ ID NO: 3905737 - RNA, 20 nt, Shigella flexneri 2a str. 301
caccauaaauccaacaacac

SEQ ID NO: 3905738 - RNA, 22 nt, Shigella flexneri 2a str. 301
caccauaaauccaacaacacau

SEQ ID NO: 3905739 - RNA, 14 nt, Shigella flexneri 2a str. 301
caccauaagcccgg

SEQ ID NO: 3905740 - RNA, 23 nt, Shigella flexneri 2a str. 301
caccauauaagccgagaaccggc

SEQ ID NO: 3905741 - RNA, 21 nt, Shigella flexneri 2a str. 301
caccauauucagcagcagaca

SEQ ID NO: 3905742 - RNA, 20 nt, Shigella flexneri 2a str. 301
caccaucaaaguuuuuauga

SEQ ID NO: 3905743 - RNA, 19 nt, Shigella flexneri 2a str. 301
caccaucaacaaacgccag

SEQ ID NO: 3905744 - RNA, 13 nt, Shigella flexneri 2a str. 301
caccaucagcagc

SEQ ID NO: 3905745 - RNA, 13 nt, Shigella flexneri 2a str. 301
caccaucaguggc

SEQ ID NO: 3905746 - RNA, 23 nt, Shigella flexneri 2a str. 301
caccaucauuauucucagcgguu

SEQ ID NO: 3905747 - RNA, 19 nt, Shigella flexneri 2a str. 301
caccauccccaccaaaaca

SEQ ID NO: 3905748 - RNA, 17 nt, Shigella flexneri 2a str. 301
caccauccgcccacacc

SEQ ID NO: 3905749 - RNA, 18 nt, Shigella flexneri 2a str. 301
caccaucggacggaagac

SEQ ID NO: 3905750 - RNA, 20 nt, Shigella flexneri 2a str. 301
caccaucggacggaagacgu

SEQ ID NO: 3905751 - RNA, 21 nt, Shigella flexneri 2a str. 301
caccaucguugcuaacggcca

SEQ ID NO: 3905752 - RNA, 22 nt, Shigella flexneri 2a str. 301
caccauggcuauaccccacccc

SEQ ID NO: 3905753 - RNA, 16 nt, Shigella flexneri 2a str. 301
caccauguucacugcc

SEQ ID NO: 3905754 - RNA, 19 nt, Shigella flexneri 2a str. 301
caccauguugcgcagaguu

SEQ ID NO: 3905755 - RNA, 17 nt, Shigella flexneri 2a str. 301
caccauuacgcaaugcg

SEQ ID NO: 3905756 - RNA, 16 nt, Shigella flexneri 2a str. 301
caccauuggucuuugu

SEQ ID NO: 3905757 - RNA, 16 nt, Shigella flexneri 2a str. 301
cacccaaaacaaagcc

SEQ ID NO: 3905758 - RNA, 18 nt, Shigella flexneri 2a str. 301
cacccaacacucaaacag

SEQ ID NO: 3905759 - RNA, 14 nt, Shigella flexneri 2a str. 301
cacccaauccagua

SEQ ID NO: 3905760 - RNA, 15 nt, Shigella flexneri 2a str. 301
cacccaccagcgccg

SEQ ID NO: 3905761 - RNA, 14 nt, Shigella flexneri 2a str. 301
caccgggugcagac

SEQ ID NO: 3905762 - RNA, 15 nt, Shigella flexneri 2a str. 301
caccgguucaucacg

SEQ ID NO: 3905763 - RNA, 13 nt, Shigella flexneri 2a str. 301
caccgguuuaccg

SEQ ID NO: 3905764 - RNA, 18 nt, Shigella flexneri 2a str. 301
caccguaauaguuucuga

SEQ ID NO: 3905765 - RNA, 18 nt, Shigella flexneri 2a str. 301
caccguaccaucguaagc

SEQ ID NO: 3905766 - RNA, 17 nt, Shigella flexneri 2a str. 301
caccgucaaacacagca

SEQ ID NO: 3905767 - RNA, 19 nt, Shigella flexneri 2a str. 301
caccgucaccccuguggaa

SEQ ID NO: 3905768 - RNA, 16 nt, Shigella flexneri 2a str. 301
caccgucacuucuucg

SEQ ID NO: 3905769 - RNA, 17 nt, Shigella flexneri 2a str. 301
caccgucaugccgguaa

SEQ ID NO: 3905770 - RNA, 21 nt, Shigella flexneri 2a str. 301
caccguguucaugaccgugau

SEQ ID NO: 3905771 - RNA, 12 nt, Shigella flexneri 2a str. 301
caccguuaaaua

SEQ ID NO: 3905772 - RNA, 12 nt, Shigella flexneri 2a str. 301
caccguugcccg

SEQ ID NO: 3905773 - RNA, 23 nt, Shigella flexneri 2a str. 301
caccguuucuacaagcagagaga

SEQ ID NO: 3905774 - RNA, 20 nt, Shigella flexneri 2a str. 301
caccguuucuuugccgagga

SEQ ID NO: 3905775 - RNA, 23 nt, Shigella flexneri 2a str. 301
caccguuuuuucugccucugcca

SEQ ID NO: 3905776 - RNA, 15 nt, Shigella flexneri 2a str. 301
caccucaucaccaca

SEQ ID NO: 3905777 - RNA, 12 nt, Shigella flexneri 2a str. 301
caccucaucaga

SEQ ID NO: 3905778 - RNA, 15 nt, Shigella flexneri 2a str. 301
caccucccagcgcgg

SEQ ID NO: 3905779 - RNA, 21 nt, Shigella flexneri 2a str. 301
caccucccgucgcccacacca

SEQ ID NO: 3905780 - RNA, 15 nt, Shigella flexneri 2a str. 301
caccucucgcccgcu

SEQ ID NO: 3905781 - RNA, 15 nt, Shigella flexneri 2a str. 301
caccucuuucaccaa

SEQ ID NO: 3905782 - RNA, 23 nt, Shigella flexneri 2a str. 301
caccucuuuuuccacuuccacca

SEQ ID NO: 3905783 - RNA, 16 nt, Shigella flexneri 2a str. 301
caccugaccgcgagua

SEQ ID NO: 3905784 - RNA, 18 nt, Shigella flexneri 2a str. 301
caccugauccaucgucuc

SEQ ID NO: 3905785 - RNA, 19 nt, Shigella flexneri 2a str. 301
caccugauugaccgccagc

SEQ ID NO: 3905786 - RNA, 22 nt, Shigella flexneri 2a str. 301
caccugcaacgguugauggcag

SEQ ID NO: 3905787 - RNA, 20 nt, Shigella flexneri 2a str. 301
caccugcacaccaaccgcuu

SEQ ID NO: 3905788 - RNA, 14 nt, Shigella flexneri 2a str. 301
caccugccagcgcc

SEQ ID NO: 3905789 - RNA, 15 nt, Shigella flexneri 2a str. 301
caccugccagcgccg

SEQ ID NO: 3905790 - RNA, 19 nt, Shigella flexneri 2a str. 301
caccugccagggugcuggc

SEQ ID NO: 3905791 - RNA, 17 nt, Shigella flexneri 2a str. 301
caccugccggagcgcca

SEQ ID NO: 3905792 - RNA, 20 nt, Shigella flexneri 2a str. 301
caccugcgcaggcauucaga

SEQ ID NO: 3905793 - RNA, 20 nt, Shigella flexneri 2a str. 301
caccugcggugcagccggag

SEQ ID NO: 3905794 - RNA, 20 nt, Shigella flexneri 2a str. 301
caccugcucgucauccgcca

SEQ ID NO: 3905795 - RNA, 14 nt, Shigella flexneri 2a str. 301
caccugcugauuau

SEQ ID NO: 3905796 - RNA, 12 nt, Shigella flexneri 2a str. 301
caccugcuggac

SEQ ID NO: 3905797 - RNA, 16 nt, Shigella flexneri 2a str. 301
caccuggggcuugcca

SEQ ID NO: 3905798 - RNA, 14 nt, Shigella flexneri 2a str. 301
caccuguuccauga

SEQ ID NO: 3905799 - RNA, 23 nt, Shigella flexneri 2a str. 301
caccuguugccauuucugcugcc

SEQ ID NO: 3905800 - RNA, 14 nt, Shigella flexneri 2a str. 301
caccuuaaaacaau

SEQ ID NO: 3905801 - RNA, 20 nt, Shigella flexneri 2a str. 301
caccuuacggcacuccucuu

SEQ ID NO: 3905802 - RNA, 23 nt, Shigella flexneri 2a str. 301
caccuucaacguuaggugggaac

SEQ ID NO: 3905803 - RNA, 22 nt, Shigella flexneri 2a str. 301
caccuucagcgaagcccacgcc

SEQ ID NO: 3905804 - RNA, 17 nt, Shigella flexneri 2a str. 301
caccuucuuuacugccc

SEQ ID NO: 3905805 - RNA, 14 nt, Shigella flexneri 2a str. 301
caccuuuuuccaga

SEQ ID NO: 3905806 - RNA, 17 nt, Shigella flexneri 2a str. 301
caccuuuuuuuaugcuu

SEQ ID NO: 3905807 - RNA, 23 nt, Shigella flexneri 2a str. 301
cacgaaaacagcgcagcucuggc

SEQ ID NO: 3905808 - RNA, 19 nt, Shigella flexneri 2a str. 301
cacgaaaccacugcaacag

SEQ ID NO: 3905809 - RNA, 18 nt, Shigella flexneri 2a str. 301
cacgaaaccgacugccau

SEQ ID NO: 3905810 - RNA, 22 nt, Shigella flexneri 2a str. 301
cacgaacacagugguuuuaacg

SEQ ID NO: 3905811 - RNA, 18 nt, Shigella flexneri 2a str. 301
cacgaaccguaaaagccu

SEQ ID NO: 3905812 - RNA, 22 nt, Shigella flexneri 2a str. 301
cacgaaccguccccucgccccu

SEQ ID NO: 3905813 - RNA, 15 nt, Shigella flexneri 2a str. 301
cacgaagcucucugc

SEQ ID NO: 3905814 - RNA, 16 nt, Shigella flexneri 2a str. 301
cacgaagcucucugcu

SEQ ID NO: 3905815 - RNA, 15 nt, Shigella flexneri 2a str. 301
cacgaaggugcauug

SEQ ID NO: 3905816 - RNA, 15 nt, Shigella flexneri 2a str. 301
cacgaaucgccgcau

SEQ ID NO: 3905817 - RNA, 18 nt, Shigella flexneri 2a str. 301
cacgaaucgucaguucac

SEQ ID NO: 3905818 - RNA, 17 nt, Shigella flexneri 2a str. 301
cacgaauucaacgcguu

SEQ ID NO: 3905819 - RNA, 19 nt, Shigella flexneri 2a str. 301
cacgaauuccaagcagacg

SEQ ID NO: 3905820 - RNA, 12 nt, Shigella flexneri 2a str. 301
cacgacacugcu

SEQ ID NO: 3905821 - RNA, 18 nt, Shigella flexneri 2a str. 301
cacgacagaacucguuca

SEQ ID NO: 3905822 - RNA, 21 nt, Shigella flexneri 2a str. 301
cacgacauaaacauuccacuu

SEQ ID NO: 3905823 - RNA, 19 nt, Shigella flexneri 2a str. 301
cacgacauacaccgcagcc

SEQ ID NO: 3905824 - RNA, 16 nt, Shigella flexneri 2a str. 301
cacgaccgcagcauug

SEQ ID NO: 3905825 - RNA, 21 nt, Shigella flexneri 2a str. 301
cacgaccuguaccuucagcgg

SEQ ID NO: 3905826 - RNA, 16 nt, Shigella flexneri 2a str. 301
cacgacgucuccauca

SEQ ID NO: 3905827 - RNA, 21 nt, Shigella flexneri 2a str. 301
cacgacgucuccaucaauaca

SEQ ID NO: 3905828 - RNA, 12 nt, Shigella flexneri 2a str. 301
cacgacguguuc

SEQ ID NO: 3905829 - RNA, 17 nt, Shigella flexneri 2a str. 301
cacgacguguuccugaa

SEQ ID NO: 3905830 - RNA, 20 nt, Shigella flexneri 2a str. 301
cacgacguuuuccaucgacc

SEQ ID NO: 3905831 - RNA, 23 nt, Shigella flexneri 2a str. 301
cacgacucaagaacuguugacca

SEQ ID NO: 3905832 - RNA, 15 nt, Shigella flexneri 2a str. 301
cacgaggaagauuac

SEQ ID NO: 3905833 - RNA, 21 nt, Shigella flexneri 2a str. 301
cacgaggaagauuacgcugca

SEQ ID NO: 3905834 - RNA, 23 nt, Shigella flexneri 2a str. 301
cacgaggcuggcuuuaucacuga

SEQ ID NO: 3905835 - RNA, 19 nt, Shigella flexneri 2a str. 301
cacgauaaguuugcgcauc

SEQ ID NO: 3905836 - RNA, 16 nt, Shigella flexneri 2a str. 301
cacgauaaucucugcu

SEQ ID NO: 3905837 - RNA, 13 nt, Shigella flexneri 2a str. 301
cacgaucacagca

SEQ ID NO: 3905838 - RNA, 13 nt, Shigella flexneri 2a str. 301
cacgaucagugcc

SEQ ID NO: 3905839 - RNA, 16 nt, Shigella flexneri 2a str. 301
cacgaucccuugcagu

SEQ ID NO: 3905840 - RNA, 17 nt, Shigella flexneri 2a str. 301
cacgaucgcgccagccu

SEQ ID NO: 3905841 - RNA, 14 nt, Shigella flexneri 2a str. 301
cacgaucucacgcu

SEQ ID NO: 3905842 - RNA, 12 nt, Shigella flexneri 2a str. 301
cacgaugcuaaa

SEQ ID NO: 3905843 - RNA, 21 nt, Shigella flexneri 2a str. 301
cacgauggaaccguacagcau

SEQ ID NO: 3905844 - RNA, 14 nt, Shigella flexneri 2a str. 301
cacgauguauccgg

SEQ ID NO: 3905845 - RNA, 12 nt, Shigella flexneri 2a str. 301
cacgauugcugc

SEQ ID NO: 3905846 - RNA, 19 nt, Shigella flexneri 2a str. 301
cacgauuuguaggccggau

SEQ ID NO: 3905847 - RNA, 13 nt, Shigella flexneri 2a str. 301
cacgauuuuguag

SEQ ID NO: 3905848 - RNA, 20 nt, Shigella flexneri 2a str. 301
cacgauuuuguaggccggau

SEQ ID NO: 3905849 - RNA, 16 nt, Shigella flexneri 2a str. 301
cacgcaaaaucccacu

SEQ ID NO: 3905850 - RNA, 22 nt, Shigella flexneri 2a str. 301
cacgcaaauguggcggaauacc

SEQ ID NO: 3905851 - RNA, 15 nt, Shigella flexneri 2a str. 301
cacgcaacagaccag

SEQ ID NO: 3905852 - RNA, 16 nt, Shigella flexneri 2a str. 301
cacgcaaccacaacgc

SEQ ID NO: 3905853 - RNA, 19 nt, Shigella flexneri 2a str. 301
cacgcaagguuucaguaac

SEQ ID NO: 3905854 - RNA, 15 nt, Shigella flexneri 2a str. 301
cacgcagcaagccgu

SEQ ID NO: 3905855 - RNA, 15 nt, Shigella flexneri 2a str. 301
cacgcagcgccgcgu

SEQ ID NO: 3905856 - RNA, 18 nt, Shigella flexneri 2a str. 301
cacgcagcguuggcaggu

SEQ ID NO: 3905857 - RNA, 12 nt, Shigella flexneri 2a str. 301
cacgcagcucac

SEQ ID NO: 3905858 - RNA, 24 nt, Shigella flexneri 2a str. 301
cacgcagcuucucgugaaacucac

SEQ ID NO: 3905859 - RNA, 14 nt, Shigella flexneri 2a str. 301
cacgcaggcauuau

SEQ ID NO: 3905860 - RNA, 19 nt, Shigella flexneri 2a str. 301
cacgcagggggucgcgggu

SEQ ID NO: 3905861 - RNA, 14 nt, Shigella flexneri 2a str. 301
cacguugcugcggc

SEQ ID NO: 3905862 - RNA, 19 nt, Shigella flexneri 2a str. 301
cacuaaaaucauucgugag

SEQ ID NO: 3905863 - RNA, 20 nt, Shigella flexneri 2a str. 301
cacuaaacccgaccacuucc

SEQ ID NO: 3905864 - RNA, 16 nt, Shigella flexneri 2a str. 301
cacuaacagaacaaua

SEQ ID NO: 3905865 - RNA, 21 nt, Shigella flexneri 2a str. 301
cacuaacgcauugaacucuuc

SEQ ID NO: 3905866 - RNA, 12 nt, Shigella flexneri 2a str. 301
cacuaacgcguc

SEQ ID NO: 3905867 - RNA, 20 nt, Shigella flexneri 2a str. 301
cacuaacgcgucuuaucugg

SEQ ID NO: 3905868 - RNA, 22 nt, Shigella flexneri 2a str. 301
cacuaagaauguccauuauuuc

SEQ ID NO: 3905869 - RNA, 14 nt, Shigella flexneri 2a str. 301
cacuaagcaccaaa

SEQ ID NO: 3905870 - RNA, 18 nt, Shigella flexneri 2a str. 301
cacuaaggguaaaacgac

SEQ ID NO: 3905871 - RNA, 21 nt, Shigella flexneri 2a str. 301
cacuaccauuuguucuuuuuu

SEQ ID NO: 3905872 - RNA, 15 nt, Shigella flexneri 2a str. 301
cacuacccauauuua

SEQ ID NO: 3905873 - RNA, 16 nt, Shigella flexneri 2a str. 301
cacuaccguaauagug

SEQ ID NO: 3905874 - RNA, 20 nt, Shigella flexneri 2a str. 301
cacuacgcagggauauuuca

SEQ ID NO: 3905875 - RNA, 16 nt, Shigella flexneri 2a str. 301
cacuacggucacgcca

SEQ ID NO: 3905876 - RNA, 14 nt, Shigella flexneri 2a str. 301
cacuacgugaucgu

SEQ ID NO: 3905877 - RNA, 22 nt, Shigella flexneri 2a str. 301
cacuacugcgucgcgcguaaca

SEQ ID NO: 3905878 - RNA, 14 nt, Shigella flexneri 2a str. 301
cacuagguuuucgu

SEQ ID NO: 3905879 - RNA, 23 nt, Shigella flexneri 2a str. 301
cacuagguuuucgucguacugac

SEQ ID NO: 3905880 - RNA, 18 nt, Shigella flexneri 2a str. 301
cacuaguauuuauuugca

SEQ ID NO: 3905881 - RNA, 22 nt, Shigella flexneri 2a str. 301
cacuaguauuuauuugcaaagu

SEQ ID NO: 3905882 - RNA, 13 nt, Shigella flexneri 2a str. 301
cacuauaaaauaa

SEQ ID NO: 3905883 - RNA, 20 nt, Shigella flexneri 2a str. 301
cacuauacaaccagauaacc

SEQ ID NO: 3905884 - RNA, 18 nt, Shigella flexneri 2a str. 301
cacuauccgacaucccgc

SEQ ID NO: 3905885 - RNA, 18 nt, Shigella flexneri 2a str. 301
cacuaucgccaucaggca

SEQ ID NO: 3905886 - RNA, 10 nt, Shigella flexneri 2a str. 301
cacuauuucu

SEQ ID NO: 3905887 - RNA, 15 nt, Shigella flexneri 2a str. 301
cacucaaauaucuau

SEQ ID NO: 3905888 - RNA, 24 nt, Shigella flexneri 2a str. 301
cacucaaauaucuauauacaauca

SEQ ID NO: 3905889 - RNA, 14 nt, Shigella flexneri 2a str. 301
cacucacccgcuag

SEQ ID NO: 3905890 - RNA, 21 nt, Shigella flexneri 2a str. 301
cacucacgauagugacucauu

SEQ ID NO: 3905891 - RNA, 23 nt, Shigella flexneri 2a str. 301
cacucagguaacagggaacuuau

SEQ ID NO: 3905892 - RNA, 16 nt, Shigella flexneri 2a str. 301
cacucaucacuccccg

SEQ ID NO: 3905893 - RNA, 14 nt, Shigella flexneri 2a str. 301
cacuccauccagca

SEQ ID NO: 3905894 - RNA, 21 nt, Shigella flexneri 2a str. 301
cacuccgguaauaucgcgcag

SEQ ID NO: 3905895 - RNA, 21 nt, Shigella flexneri 2a str. 301
cacucgccagaccgcagaagc

SEQ ID NO: 3905896 - RNA, 22 nt, Shigella flexneri 2a str. 301
cacucgccagaccgcagaagcc

SEQ ID NO: 3905897 - RNA, 16 nt, Shigella flexneri 2a str. 301
cacucgccccgagaaa

SEQ ID NO: 3905898 - RNA, 22 nt, Shigella flexneri 2a str. 301
cacucgcugcagguauugcuuc

SEQ ID NO: 3905899 - RNA, 18 nt, Shigella flexneri 2a str. 301
cacucggcgcggaugcgu

SEQ ID NO: 3905900 - RNA, 17 nt, Shigella flexneri 2a str. 301
cacucgugcgucgcauc

SEQ ID NO: 3905901 - RNA, 21 nt, Shigella flexneri 2a str. 301
cacucucaaucgucaaacgca

SEQ ID NO: 3905902 - RNA, 22 nt, Shigella flexneri 2a str. 301
cacucucaccacgcuccaucau

SEQ ID NO: 3905903 - RNA, 15 nt, Shigella flexneri 2a str. 301
cacucugaaaacgcu

SEQ ID NO: 3905904 - RNA, 17 nt, Shigella flexneri 2a str. 301
cacucugaaaacgcugu

SEQ ID NO: 3905905 - RNA, 15 nt, Shigella flexneri 2a str. 301
cacucugacggcgca

SEQ ID NO: 3905906 - RNA, 15 nt, Shigella flexneri 2a str. 301
cacucuuucagcacc

SEQ ID NO: 3905907 - RNA, 14 nt, Shigella flexneri 2a str. 301
cacugaaaaucacc

SEQ ID NO: 3905908 - RNA, 20 nt, Shigella flexneri 2a str. 301
cacugaaccgaaauggcugc

SEQ ID NO: 3905909 - RNA, 21 nt, Shigella flexneri 2a str. 301
cacugaauagugccacaccag

SEQ ID NO: 3905910 - RNA, 15 nt, Shigella flexneri 2a str. 301
cacugaaugacgacg

SEQ ID NO: 3905911 - RNA, 14 nt, Shigella flexneri 2a str. 301
cacugacaccagca

SEQ ID NO: 3905912 - RNA, 21 nt, Shigella flexneri 2a str. 301
cacugaccaccaccaccugca

SEQ ID NO: 3905913 - RNA, 20 nt, Shigella flexneri 2a str. 301
cacugacgaggcgucagcgu

SEQ ID NO: 3905914 - RNA, 20 nt, Shigella flexneri 2a str. 301
cacugacgcgucuuaucugg

SEQ ID NO: 3905915 - RNA, 15 nt, Shigella flexneri 2a str. 301
cacugacgggaaacu

SEQ ID NO: 3905916 - RNA, 20 nt, Shigella flexneri 2a str. 301
cacugagucagcccaacaaa

SEQ ID NO: 3905917 - RNA, 22 nt, Shigella flexneri 2a str. 301
cacugauaagcugagcacaaaa

SEQ ID NO: 3905918 - RNA, 13 nt, Shigella flexneri 2a str. 301
cacugcaaaacag

SEQ ID NO: 3905919 - RNA, 22 nt, Shigella flexneri 2a str. 301
cacugcaaauacccaaaaaaua

SEQ ID NO: 3905920 - RNA, 16 nt, Shigella flexneri 2a str. 301
cacugcaaaucaccac

SEQ ID NO: 3905921 - RNA, 17 nt, Shigella flexneri 2a str. 301
cacugcaaaucaccaca

SEQ ID NO: 3905922 - RNA, 22 nt, Shigella flexneri 2a str. 301
cacugcaacagcuguugaaaag

SEQ ID NO: 3905923 - RNA, 15 nt, Shigella flexneri 2a str. 301
cacugcaggcugaug

SEQ ID NO: 3905924 - RNA, 15 nt, Shigella flexneri 2a str. 301
cacugcaucaaugcc

SEQ ID NO: 3905925 - RNA, 16 nt, Shigella flexneri 2a str. 301
cacugcauggcggcgu

SEQ ID NO: 3905926 - RNA, 20 nt, Shigella flexneri 2a str. 301
cacugccagauucuccaaca

SEQ ID NO: 3905927 - RNA, 20 nt, Shigella flexneri 2a str. 301
cacugccguacaggcagcuu

SEQ ID NO: 3905928 - RNA, 21 nt, Shigella flexneri 2a str. 301
cacugccugucacggcgcaug

SEQ ID NO: 3905929 - RNA, 18 nt, Shigella flexneri 2a str. 301
cacugccuuucagcgcau

SEQ ID NO: 3905930 - RNA, 13 nt, Shigella flexneri 2a str. 301
cacugcgagaaaa

SEQ ID NO: 3905931 - RNA, 18 nt, Shigella flexneri 2a str. 301
cacugcgagaaaaagccu

SEQ ID NO: 3905932 - RNA, 19 nt, Shigella flexneri 2a str. 301
cacugcgcauaauccacuu

SEQ ID NO: 3905933 - RNA, 13 nt, Shigella flexneri 2a str. 301
cacugcgcccgcc

SEQ ID NO: 3905934 - RNA, 18 nt, Shigella flexneri 2a str. 301
cacugcucgcagaaauac

SEQ ID NO: 3905935 - RNA, 19 nt, Shigella flexneri 2a str. 301
cacugcuuuccgcuggcgu

SEQ ID NO: 3905936 - RNA, 22 nt, Shigella flexneri 2a str. 301
cacugcuuuggcucuucgcucc

SEQ ID NO: 3905937 - RNA, 12 nt, Shigella flexneri 2a str. 301
cacuggcaauga

SEQ ID NO: 3905938 - RNA, 17 nt, Shigella flexneri 2a str. 301
cacuggcagccaggcgc

SEQ ID NO: 3905939 - RNA, 21 nt, Shigella flexneri 2a str. 301
cacuggcccaacaacggcuuu

SEQ ID NO: 3905940 - RNA, 18 nt, Shigella flexneri 2a str. 301
cacugggagaacgcugcu

SEQ ID NO: 3905941 - RNA, 22 nt, Shigella flexneri 2a str. 301
cacuggguucaaaaacuaauuc

SEQ ID NO: 3905942 - RNA, 23 nt, Shigella flexneri 2a str. 301
cacuggguuggguucacuuuccc

SEQ ID NO: 3905943 - RNA, 15 nt, Shigella flexneri 2a str. 301
cacuggucgcccugg

SEQ ID NO: 3905944 - RNA, 20 nt, Shigella flexneri 2a str. 301
cacuggucugacgcugaaua

SEQ ID NO: 3905945 - RNA, 18 nt, Shigella flexneri 2a str. 301
cacuggugccaugaauga

SEQ ID NO: 3905946 - RNA, 19 nt, Shigella flexneri 2a str. 301
cacuggugcuguaaaacca

SEQ ID NO: 3905947 - RNA, 17 nt, Shigella flexneri 2a str. 301
cacugguucccaacaac

SEQ ID NO: 3905948 - RNA, 21 nt, Shigella flexneri 2a str. 301
cacugguuccgguuuauccau

SEQ ID NO: 3905949 - RNA, 22 nt, Shigella flexneri 2a str. 301
cacugguuuccgccagcgggcc

SEQ ID NO: 3905950 - RNA, 18 nt, Shigella flexneri 2a str. 301
cacugucaaauccagacu

SEQ ID NO: 3905951 - RNA, 19 nt, Shigella flexneri 2a str. 301
cacugucuaacaacaugac

SEQ ID NO: 3905952 - RNA, 17 nt, Shigella flexneri 2a str. 301
cacugugggauugcuuc

SEQ ID NO: 3905953 - RNA, 15 nt, Shigella flexneri 2a str. 301
cacuguucacuuuug

SEQ ID NO: 3905954 - RNA, 13 nt, Shigella flexneri 2a str. 301
cacuguugaagcc

SEQ ID NO: 3905955 - RNA, 23 nt, Shigella flexneri 2a str. 301
cacuuaauaagaagaaaccgcua

SEQ ID NO: 3905956 - RNA, 13 nt, Shigella flexneri 2a str. 301
cacuuacuuuccu

SEQ ID NO: 3905957 - RNA, 17 nt, Shigella flexneri 2a str. 301
cacuucaaccacauuca

SEQ ID NO: 3905958 - RNA, 12 nt, Shigella flexneri 2a str. 301
cacuucacaguu

SEQ ID NO: 3905959 - RNA, 18 nt, Shigella flexneri 2a str. 301
cacuucacccaucgccag

SEQ ID NO: 3905960 - RNA, 17 nt, Shigella flexneri 2a str. 301
cagaauauacggaauga

SEQ ID NO: 3905961 - RNA, 14 nt, Shigella flexneri 2a str. 301
cagaauaugcgcca

SEQ ID NO: 3905962 - RNA, 19 nt, Shigella flexneri 2a str. 301
cagaauauucgaaaucugu

SEQ ID NO: 3905963 - RNA, 13 nt, Shigella flexneri 2a str. 301
cagaaucaagucu

SEQ ID NO: 3905964 - RNA, 15 nt, Shigella flexneri 2a str. 301
cagaaucaccucuuu

SEQ ID NO: 3905965 - RNA, 16 nt, Shigella flexneri 2a str. 301
cagaaucacgccaaca

SEQ ID NO: 3905966 - RNA, 18 nt, Shigella flexneri 2a str. 301
cagaaucacgccaacaaa

SEQ ID NO: 3905967 - RNA, 15 nt, Shigella flexneri 2a str. 301
cagaaucaggccauu

SEQ ID NO: 3905968 - RNA, 19 nt, Shigella flexneri 2a str. 301
cagaaucaggccauuacua

SEQ ID NO: 3905969 - RNA, 12 nt, Shigella flexneri 2a str. 301
cagaauccagga

SEQ ID NO: 3905970 - RNA, 14 nt, Shigella flexneri 2a str. 301
cagaauccaggaaa

SEQ ID NO: 3905971 - RNA, 15 nt, Shigella flexneri 2a str. 301
cagaaucgccagcau

SEQ ID NO: 3905972 - RNA, 15 nt, Shigella flexneri 2a str. 301
cagaaucgcgcccca

SEQ ID NO: 3905973 - RNA, 13 nt, Shigella flexneri 2a str. 301
cagaaucguaaag

SEQ ID NO: 3905974 - RNA, 17 nt, Shigella flexneri 2a str. 301
cagaaucuucuucucag

SEQ ID NO: 3905975 - RNA, 17 nt, Shigella flexneri 2a str. 301
cagaaugacaucaucgc

SEQ ID NO: 3905976 - RNA, 17 nt, Shigella flexneri 2a str. 301
cagaaugccgcaaaacu

SEQ ID NO: 3905977 - RNA, 18 nt, Shigella flexneri 2a str. 301
cagaaugccgcaaaacuu

SEQ ID NO: 3905978 - RNA, 15 nt, Shigella flexneri 2a str. 301
cagaaugcgggcgaa

SEQ ID NO: 3905979 - RNA, 20 nt, Shigella flexneri 2a str. 301
cagaaugcgggcgaaaacau

SEQ ID NO: 3905980 - RNA, 16 nt, Shigella flexneri 2a str. 301
cagaauggcaucugau

SEQ ID NO: 3905981 - RNA, 21 nt, Shigella flexneri 2a str. 301
cagaaugguguuaaccgguac

SEQ ID NO: 3905982 - RNA, 17 nt, Shigella flexneri 2a str. 301
cagaauuaacgcugaca

SEQ ID NO: 3905983 - RNA, 19 nt, Shigella flexneri 2a str. 301
cagaauuucgacuuuuuuc

SEQ ID NO: 3905984 - RNA, 20 nt, Shigella flexneri 2a str. 301
cagaauuugaggaagcugcc

SEQ ID NO: 3905985 - RNA, 13 nt, Shigella flexneri 2a str. 301
cagaauuuuucgc

SEQ ID NO: 3905986 - RNA, 17 nt, Shigella flexneri 2a str. 301
cagaauuuuucgcuaaa

SEQ ID NO: 3905987 - RNA, 22 nt, Shigella flexneri 2a str. 301
cagaauuuuucgcuaaaaaaug

SEQ ID NO: 3905988 - RNA, 20 nt, Shigella flexneri 2a str. 301
cagacaaaaagaauacgcaa

SEQ ID NO: 3905989 - RNA, 14 nt, Shigella flexneri 2a str. 301
cagacaaaugaaca

SEQ ID NO: 3905990 - RNA, 15 nt, Shigella flexneri 2a str. 301
cagacaacaugagaa

SEQ ID NO: 3905991 - RNA, 20 nt, Shigella flexneri 2a str. 301
cagacaaccauauuuaugca

SEQ ID NO: 3905992 - RNA, 15 nt, Shigella flexneri 2a str. 301
cagacaacccacaca

SEQ ID NO: 3905993 - RNA, 17 nt, Shigella flexneri 2a str. 301
cagacaaccgcucaaca

SEQ ID NO: 3905994 - RNA, 13 nt, Shigella flexneri 2a str. 301
cagacaacgcuuc

SEQ ID NO: 3905995 - RNA, 14 nt, Shigella flexneri 2a str. 301
cagacaacuucccu

SEQ ID NO: 3905996 - RNA, 19 nt, Shigella flexneri 2a str. 301
cagacaaucacaucacugc

SEQ ID NO: 3905997 - RNA, 17 nt, Shigella flexneri 2a str. 301
cagacaauuuguuggcg

SEQ ID NO: 3905998 - RNA, 21 nt, Shigella flexneri 2a str. 301
cagacacaguucuucaaaaau

SEQ ID NO: 3905999 - RNA, 16 nt, Shigella flexneri 2a str. 301
cagacaccagccaggu

SEQ ID NO: 3906000 - RNA, 17 nt, Shigella flexneri 2a str. 301
cagacacccaccauaag

SEQ ID NO: 3906001 - RNA, 17 nt, Shigella flexneri 2a str. 301
cagacaccgauugcccc

SEQ ID NO: 3906002 - RNA, 16 nt, Shigella flexneri 2a str. 301
cagacacgccgccaga

SEQ ID NO: 3906003 - RNA, 13 nt, Shigella flexneri 2a str. 301
cagacacugcuga

SEQ ID NO: 3906004 - RNA, 14 nt, Shigella flexneri 2a str. 301
cagacacugcugau

SEQ ID NO: 3906005 - RNA, 20 nt, Shigella flexneri 2a str. 301
cagacacugcugauaaucca

SEQ ID NO: 3906006 - RNA, 23 nt, Shigella flexneri 2a str. 301
cagaccaaaacgugcagcugccu

SEQ ID NO: 3906007 - RNA, 22 nt, Shigella flexneri 2a str. 301
cagaccaauaauccccaauacg

SEQ ID NO: 3906008 - RNA, 11 nt, Shigella flexneri 2a str. 301
cagaccaauag

SEQ ID NO: 3906009 - RNA, 15 nt, Shigella flexneri 2a str. 301
cagaccaaucaccac

SEQ ID NO: 3906010 - RNA, 17 nt, Shigella flexneri 2a str. 301
cagaccaauccagccgg

SEQ ID NO: 3906011 - RNA, 13 nt, Shigella flexneri 2a str. 301
cagaccaauguua

SEQ ID NO: 3906012 - RNA, 13 nt, Shigella flexneri 2a str. 301
cagaccacuuucc

SEQ ID NO: 3906013 - RNA, 14 nt, Shigella flexneri 2a str. 301
cagaccacuuuccu

SEQ ID NO: 3906014 - RNA, 20 nt, Shigella flexneri 2a str. 301
cagaccagaaacgccaccau

SEQ ID NO: 3906015 - RNA, 21 nt, Shigella flexneri 2a str. 301
cagaccagaaugcuccgcacc

SEQ ID NO: 3906016 - RNA, 19 nt, Shigella flexneri 2a str. 301
cagaccagcuaccacgccg

SEQ ID NO: 3906017 - RNA, 20 nt, Shigella flexneri 2a str. 301
cagaccagcuaccacgccga

SEQ ID NO: 3906018 - RNA, 23 nt, Shigella flexneri 2a str. 301
cagaccaguuuuuucaccagcgc

SEQ ID NO: 3906019 - RNA, 19 nt, Shigella flexneri 2a str. 301
cagaccauauuuucauuau

SEQ ID NO: 3906020 - RNA, 11 nt, Shigella flexneri 2a str. 301
cagacccaguu

SEQ ID NO: 3906021 - RNA, 22 nt, Shigella flexneri 2a str. 301
cagacccaguuucggcaucagc

SEQ ID NO: 3906022 - RNA, 16 nt, Shigella flexneri 2a str. 301
cagaccgcacaccgag

SEQ ID NO: 3906023 - RNA, 14 nt, Shigella flexneri 2a str. 301
cagaccgcagaagc

SEQ ID NO: 3906024 - RNA, 12 nt, Shigella flexneri 2a str. 301
cagaccggcaau

SEQ ID NO: 3906025 - RNA, 20 nt, Shigella flexneri 2a str. 301
cagaccuacaaaaccugcac

SEQ ID NO: 3906026 - RNA, 16 nt, Shigella flexneri 2a str. 301
cagaccuaccaucucc

SEQ ID NO: 3906027 - RNA, 18 nt, Shigella flexneri 2a str. 301
cagaccuccguuuuucug

SEQ ID NO: 3906028 - RNA, 12 nt, Shigella flexneri 2a str. 301
cagaccugaauu

SEQ ID NO: 3906029 - RNA, 17 nt, Shigella flexneri 2a str. 301
cagaccugaauuugcuc

SEQ ID NO: 3906030 - RNA, 13 nt, Shigella flexneri 2a str. 301
cagaccugcguca

SEQ ID NO: 3906031 - RNA, 17 nt, Shigella flexneri 2a str. 301
cagaccugcgucaccac

SEQ ID NO: 3906032 - RNA, 20 nt, Shigella flexneri 2a str. 301
cagaccuucgcuaucaaacu

SEQ ID NO: 3906033 - RNA, 21 nt, Shigella flexneri 2a str. 301
cagaccuucgcuaucaaacug

SEQ ID NO: 3906034 - RNA, 15 nt, Shigella flexneri 2a str. 301
cagaccuucugccag

SEQ ID NO: 3906035 - RNA, 13 nt, Shigella flexneri 2a str. 301
cagaccuuuuaau

SEQ ID NO: 3906036 - RNA, 20 nt, Shigella flexneri 2a str. 301
cagacgaaaucgaucgcuau

SEQ ID NO: 3906037 - RNA, 16 nt, Shigella flexneri 2a str. 301
cagacgaagucaacaa

SEQ ID NO: 3906038 - RNA, 22 nt, Shigella flexneri 2a str. 301
cagacgagaaguuccagggcag

SEQ ID NO: 3906039 - RNA, 18 nt, Shigella flexneri 2a str. 301
cagacgagggaaaauaaa

SEQ ID NO: 3906040 - RNA, 19 nt, Shigella flexneri 2a str. 301
cagacgauaccgcugucca

SEQ ID NO: 3906041 - RNA, 14 nt, Shigella flexneri 2a str. 301
cagacgcaacagaa

SEQ ID NO: 3906042 - RNA, 16 nt, Shigella flexneri 2a str. 301
cagacgcaggcgcgcu

SEQ ID NO: 3906043 - RNA, 17 nt, Shigella flexneri 2a str. 301
cagacgccagccacagg

SEQ ID NO: 3906044 - RNA, 16 nt, Shigella flexneri 2a str. 301
cagacgcgcagcuuca

SEQ ID NO: 3906045 - RNA, 18 nt, Shigella flexneri 2a str. 301
cagacgcgcagcuucacu

SEQ ID NO: 3906046 - RNA, 20 nt, Shigella flexneri 2a str. 301
cagacgcgcagcuucacuuc

SEQ ID NO: 3906047 - RNA, 23 nt, Shigella flexneri 2a str. 301
cagacgcgcagcuucacuucuua

SEQ ID NO: 3906048 - RNA, 22 nt, Shigella flexneri 2a str. 301
cagacgcuacuuuuuucaccca

SEQ ID NO: 3906049 - RNA, 19 nt, Shigella flexneri 2a str. 301
cagacgcucgccauuuuuc

SEQ ID NO: 3906050 - RNA, 13 nt, Shigella flexneri 2a str. 301
cagacgcucuuca

SEQ ID NO: 3906051 - RNA, 16 nt, Shigella flexneri 2a str. 301
cagacggagcugccag

SEQ ID NO: 3906052 - RNA, 17 nt, Shigella flexneri 2a str. 301
cagacggcucaucaccc

SEQ ID NO: 3906053 - RNA, 15 nt, Shigella flexneri 2a str. 301
cagacggcucaucuc

SEQ ID NO: 3906054 - RNA, 20 nt, Shigella flexneri 2a str. 301
cagacggcugucauccagca

SEQ ID NO: 3906055 - RNA, 16 nt, Shigella flexneri 2a str. 301
cagacggcugucuucc

SEQ ID NO: 3906056 - RNA, 17 nt, Shigella flexneri 2a str. 301
cagacggcugucuuccu

SEQ ID NO: 3906057 - RNA, 16 nt, Shigella flexneri 2a str. 301
cagacgguacccgcug

SEQ ID NO: 3906058 - RNA, 18 nt, Shigella flexneri 2a str. 301
cagacgguuuuucaaguc

SEQ ID NO: 3906059 - RNA, 18 nt, Shigella flexneri 2a str. 301
cagacguccggcgcugca

SEQ ID NO: 3906060 - RNA, 17 nt, Shigella flexneri 2a str. 301
cagaucacgcaucaccc

SEQ ID NO: 3906061 - RNA, 16 nt, Shigella flexneri 2a str. 301
cagaucagaccaaucc

SEQ ID NO: 3906062 - RNA, 17 nt, Shigella flexneri 2a str. 301
cagaucagccacuuccu

SEQ ID NO: 3906063 - RNA, 23 nt, Shigella flexneri 2a str. 301
cagaucagggaagggucuuuuaa

SEQ ID NO: 3906064 - RNA, 14 nt, Shigella flexneri 2a str. 301
cagaucauccaucg

SEQ ID NO: 3906065 - RNA, 16 nt, Shigella flexneri 2a str. 301
cagaucauccugcggc

SEQ ID NO: 3906066 - RNA, 17 nt, Shigella flexneri 2a str. 301
cagaucaucguuuccga

SEQ ID NO: 3906067 - RNA, 14 nt, Shigella flexneri 2a str. 301
cagauccagugcuc

SEQ ID NO: 3906068 - RNA, 23 nt, Shigella flexneri 2a str. 301
cagauccagugcucauccuucag

SEQ ID NO: 3906069 - RNA, 23 nt, Shigella flexneri 2a str. 301
cagauccauaagguccuccagcu

SEQ ID NO: 3906070 - RNA, 21 nt, Shigella flexneri 2a str. 301
cagaucccaauucauuccugg

SEQ ID NO: 3906071 - RNA, 22 nt, Shigella flexneri 2a str. 301
cagaucccaauucauuccugga

SEQ ID NO: 3906072 - RNA, 15 nt, Shigella flexneri 2a str. 301
cagaucccuucaccu

SEQ ID NO: 3906073 - RNA, 15 nt, Shigella flexneri 2a str. 301
cagauccgcacccgc

SEQ ID NO: 3906074 - RNA, 18 nt, Shigella flexneri 2a str. 301
cagauccgccauuucucc

SEQ ID NO: 3906075 - RNA, 24 nt, Shigella flexneri 2a str. 301
cagauccugaaauuccugagagga

SEQ ID NO: 3906076 - RNA, 21 nt, Shigella flexneri 2a str. 301
cagauccugauuuaacaucuc

SEQ ID NO: 3906077 - RNA, 18 nt, Shigella flexneri 2a str. 301
cagaucgaucauauuucc

SEQ ID NO: 3906078 - RNA, 20 nt, Shigella flexneri 2a str. 301
cagaucgccccggucaucaa

SEQ ID NO: 3906079 - RNA, 21 nt, Shigella flexneri 2a str. 301
cagaucgcucaucugcugcgu

SEQ ID NO: 3906080 - RNA, 16 nt, Shigella flexneri 2a str. 301
cagaucgcuuucccag

SEQ ID NO: 3906081 - RNA, 15 nt, Shigella flexneri 2a str. 301
cagaucggcaaucgc

SEQ ID NO: 3906082 - RNA, 18 nt, Shigella flexneri 2a str. 301
cagaucggucagugccag

SEQ ID NO: 3906083 - RNA, 16 nt, Shigella flexneri 2a str. 301
cagaucgguugccaua

SEQ ID NO: 3906084 - RNA, 19 nt, Shigella flexneri 2a str. 301
cagaucguugaacccggca

SEQ ID NO: 3906085 - RNA, 16 nt, Shigella flexneri 2a str. 301
cagaucguugaccuga

SEQ ID NO: 3906086 - RNA, 13 nt, Shigella flexneri 2a str. 301
cagaucguuuucc

SEQ ID NO: 3906087 - RNA, 22 nt, Shigella flexneri 2a str. 301
cagaucuaauguuggugugaca

SEQ ID NO: 3906088 - RNA, 22 nt, Shigella flexneri 2a str. 301
cagaucucaccacgauguggcg

SEQ ID NO: 3906089 - RNA, 23 nt, Shigella flexneri 2a str. 301
cagaucugaauauucggcuccag

SEQ ID NO: 3906090 - RNA, 21 nt, Shigella flexneri 2a str. 301
cagaucuggcgauuauuuucc

SEQ ID NO: 3906091 - RNA, 14 nt, Shigella flexneri 2a str. 301
cagaucuucaucac

SEQ ID NO: 3906092 - RNA, 22 nt, Shigella flexneri 2a str. 301
cagaucuuccgaggcguuuucu

SEQ ID NO: 3906093 - RNA, 22 nt, Shigella flexneri 2a str. 301
cagaucuuucacgaacacagug

SEQ ID NO: 3906094 - RNA, 16 nt, Shigella flexneri 2a str. 301
cagaugaaaacgcuga

SEQ ID NO: 3906095 - RNA, 23 nt, Shigella flexneri 2a str. 301
cagaugaacgagucaacgcuuca

SEQ ID NO: 3906096 - RNA, 19 nt, Shigella flexneri 2a str. 301
cagaugaagcuggcaaagu

SEQ ID NO: 3906097 - RNA, 22 nt, Shigella flexneri 2a str. 301
cagaugacuugccgcaaaaccc

SEQ ID NO: 3906098 - RNA, 20 nt, Shigella flexneri 2a str. 301
cagaugauuagucuuuaucu

SEQ ID NO: 3906099 - RNA, 22 nt, Shigella flexneri 2a str. 301
cagaugauuagucuuuaucugc

SEQ ID NO: 3906100 - RNA, 19 nt, Shigella flexneri 2a str. 301
cagaugccggaugcggcgu

SEQ ID NO: 3906101 - RNA, 23 nt, Shigella flexneri 2a str. 301
cagaugcgcgguugccugcugug

SEQ ID NO: 3906102 - RNA, 13 nt, Shigella flexneri 2a str. 301
cagaugcgcuuca

SEQ ID NO: 3906103 - RNA, 15 nt, Shigella flexneri 2a str. 301
cagaugcgcuucaag

SEQ ID NO: 3906104 - RNA, 19 nt, Shigella flexneri 2a str. 301
cagaugcggcuucgcuuca

SEQ ID NO: 3906105 - RNA, 18 nt, Shigella flexneri 2a str. 301
cagaugcgucuucugcag

SEQ ID NO: 3906106 - RNA, 15 nt, Shigella flexneri 2a str. 301
cagauggcuuuccac

SEQ ID NO: 3906107 - RNA, 18 nt, Shigella flexneri 2a str. 301
cagauguaaacuuuuucg

SEQ ID NO: 3906108 - RNA, 16 nt, Shigella flexneri 2a str. 301
cagauguuccgccauu

SEQ ID NO: 3906109 - RNA, 15 nt, Shigella flexneri 2a str. 301
cagauguugucucag

SEQ ID NO: 3906110 - RNA, 20 nt, Shigella flexneri 2a str. 301
cagauguugucucagcuuca

SEQ ID NO: 3906111 - RNA, 21 nt, Shigella flexneri 2a str. 301
cagauuauaagccaguaagac

SEQ ID NO: 3906112 - RNA, 17 nt, Shigella flexneri 2a str. 301
cagauucaaauuauguc

SEQ ID NO: 3906113 - RNA, 12 nt, Shigella flexneri 2a str. 301
cagauucaggcg

SEQ ID NO: 3906114 - RNA, 20 nt, Shigella flexneri 2a str. 301
cagauucaggcgcagcaagu

SEQ ID NO: 3906115 - RNA, 17 nt, Shigella flexneri 2a str. 301
cagauucggguucaugu

SEQ ID NO: 3906116 - RNA, 14 nt, Shigella flexneri 2a str. 301
cagauugccacagg

SEQ ID NO: 3906117 - RNA, 23 nt, Shigella flexneri 2a str. 301
cagauugugaaucgccuggacau

SEQ ID NO: 3906118 - RNA, 20 nt, Shigella flexneri 2a str. 301
cagauuguugauuaacaggc

SEQ ID NO: 3906119 - RNA, 20 nt, Shigella flexneri 2a str. 301
cagauuuaacggcagcaagg

SEQ ID NO: 3906120 - RNA, 20 nt, Shigella flexneri 2a str. 301
cagauuuacagucugcuccc

SEQ ID NO: 3906121 - RNA, 23 nt, Shigella flexneri 2a str. 301
cagauuuaccgccauggccugag

SEQ ID NO: 3906122 - RNA, 16 nt, Shigella flexneri 2a str. 301
cagauuuauaaaagaa

SEQ ID NO: 3906123 - RNA, 17 nt, Shigella flexneri 2a str. 301
cagauuuauaaaagaaa

SEQ ID NO: 3906124 - RNA, 19 nt, Shigella flexneri 2a str. 301
cagauuuauaaaagaaaaa

SEQ ID NO: 3906125 - RNA, 21 nt, Shigella flexneri 2a str. 301
cagauuucaaucuggccugag

SEQ ID NO: 3906126 - RNA, 15 nt, Shigella flexneri 2a str. 301
cagcaaaaucaccau

SEQ ID NO: 3906127 - RNA, 18 nt, Shigella flexneri 2a str. 301
cagcaaaaucaccaucac

SEQ ID NO: 3906128 - RNA, 18 nt, Shigella flexneri 2a str. 301
cagcaaacuaucccagcc

SEQ ID NO: 3906129 - RNA, 14 nt, Shigella flexneri 2a str. 301
cagcaaagcaaauu

SEQ ID NO: 3906130 - RNA, 11 nt, Shigella flexneri 2a str. 301
cagcaaaggaa

SEQ ID NO: 3906131 - RNA, 16 nt, Shigella flexneri 2a str. 301
cagcaaagugccccca

SEQ ID NO: 3906132 - RNA, 12 nt, Shigella flexneri 2a str. 301
cagcaaauacgu

SEQ ID NO: 3906133 - RNA, 17 nt, Shigella flexneri 2a str. 301
cagcaaauauugcauug

SEQ ID NO: 3906134 - RNA, 20 nt, Shigella flexneri 2a str. 301
cagcaaaucaugaaugcaag

SEQ ID NO: 3906135 - RNA, 16 nt, Shigella flexneri 2a str. 301
cagcaaauccagcggu

SEQ ID NO: 3906136 - RNA, 17 nt, Shigella flexneri 2a str. 301
cagcaaauccaucauau

SEQ ID NO: 3906137 - RNA, 21 nt, Shigella flexneri 2a str. 301
cagcaaauggcccauuuucuc

SEQ ID NO: 3906138 - RNA, 17 nt, Shigella flexneri 2a str. 301
cagcaacaaauaaccgc

SEQ ID NO: 3906139 - RNA, 13 nt, Shigella flexneri 2a str. 301
cagcaacaacagc

SEQ ID NO: 3906140 - RNA, 22 nt, Shigella flexneri 2a str. 301
cagcaacaagccaguccagaaa

SEQ ID NO: 3906141 - RNA, 19 nt, Shigella flexneri 2a str. 301
cagcaacaagcccaccguu

SEQ ID NO: 3906142 - RNA, 21 nt, Shigella flexneri 2a str. 301
cagcaacacaaucagacgcag

SEQ ID NO: 3906143 - RNA, 18 nt, Shigella flexneri 2a str. 301
cagcaacagcgccgagca

SEQ ID NO: 3906144 - RNA, 21 nt, Shigella flexneri 2a str. 301
cagcaacauuggcucaucaaa

SEQ ID NO: 3906145 - RNA, 14 nt, Shigella flexneri 2a str. 301
cagcaaccagguaa

SEQ ID NO: 3906146 - RNA, 14 nt, Shigella flexneri 2a str. 301
cagcaaccgcuucc

SEQ ID NO: 3906147 - RNA, 16 nt, Shigella flexneri 2a str. 301
cagcaaccgcuuccgg

SEQ ID NO: 3906148 - RNA, 18 nt, Shigella flexneri 2a str. 301
cagcaaccuuuugcgcuc

SEQ ID NO: 3906149 - RNA, 19 nt, Shigella flexneri 2a str. 301
cagcaacgaacuaaccgcg

SEQ ID NO: 3906150 - RNA, 16 nt, Shigella flexneri 2a str. 301
cagcaacuuaaucauc

SEQ ID NO: 3906151 - RNA, 16 nt, Shigella flexneri 2a str. 301
cagcaagcgauaauuu

SEQ ID NO: 3906152 - RNA, 19 nt, Shigella flexneri 2a str. 301
cagcaaggcgcuaaaagca

SEQ ID NO: 3906153 - RNA, 20 nt, Shigella flexneri 2a str. 301
cagcaagucggcaucgccac

SEQ ID NO: 3906154 - RNA, 16 nt, Shigella flexneri 2a str. 301
cagcaauaaucagaug

SEQ ID NO: 3906155 - RNA, 13 nt, Shigella flexneri 2a str. 301
cagcaaucacugc

SEQ ID NO: 3906156 - RNA, 16 nt, Shigella flexneri 2a str. 301
cagcaaucacugccag

SEQ ID NO: 3906157 - RNA, 17 nt, Shigella flexneri 2a str. 301
cagcaaucacugccaga

SEQ ID NO: 3906158 - RNA, 19 nt, Shigella flexneri 2a str. 301
cagcaaucacugccagaau

SEQ ID NO: 3906159 - RNA, 13 nt, Shigella flexneri 2a str. 301
cagcaguucacgc

SEQ ID NO: 3906160 - RNA, 17 nt, Shigella flexneri 2a str. 301
cagcaguucacgcagcu

SEQ ID NO: 3906161 - RNA, 20 nt, Shigella flexneri 2a str. 301
cagcaguucacgcagcuucu

SEQ ID NO: 3906162 - RNA, 17 nt, Shigella flexneri 2a str. 301
cagcaguucagcacgag

SEQ ID NO: 3906163 - RNA, 19 nt, Shigella flexneri 2a str. 301
cagcaguucgcccgcuuca

SEQ ID NO: 3906164 - RNA, 14 nt, Shigella flexneri 2a str. 301
cagcaguucugcca

SEQ ID NO: 3906165 - RNA, 18 nt, Shigella flexneri 2a str. 301
cagcaguugugugccagu

SEQ ID NO: 3906166 - RNA, 14 nt, Shigella flexneri 2a str. 301
cagcaguuuccgcg

SEQ ID NO: 3906167 - RNA, 19 nt, Shigella flexneri 2a str. 301
cagcaguuuccgcgccggc

SEQ ID NO: 3906168 - RNA, 13 nt, Shigella flexneri 2a str. 301
cagcauaaaaaua

SEQ ID NO: 3906169 - RNA, 20 nt, Shigella flexneri 2a str. 301
cagcauaaucaccaguaccg

SEQ ID NO: 3906170 - RNA, 16 nt, Shigella flexneri 2a str. 301
cagcauaaucaccauc

SEQ ID NO: 3906171 - RNA, 15 nt, Shigella flexneri 2a str. 301
cagcauaaugacucu

SEQ ID NO: 3906172 - RNA, 18 nt, Shigella flexneri 2a str. 301
cagcauaauuauuacuac

SEQ ID NO: 3906173 - RNA, 15 nt, Shigella flexneri 2a str. 301
cagcauaccuuccag

SEQ ID NO: 3906174 - RNA, 18 nt, Shigella flexneri 2a str. 301
cagcauaccuuccagcgc

SEQ ID NO: 3906175 - RNA, 21 nt, Shigella flexneri 2a str. 301
cagcauacgcugccagccauc

SEQ ID NO: 3906176 - RNA, 15 nt, Shigella flexneri 2a str. 301
cagcauacgucgaua

SEQ ID NO: 3906177 - RNA, 17 nt, Shigella flexneri 2a str. 301
cagcauaguacgggcaa

SEQ ID NO: 3906178 - RNA, 21 nt, Shigella flexneri 2a str. 301
cagcauauaguuuugcauggc

SEQ ID NO: 3906179 - RNA, 20 nt, Shigella flexneri 2a str. 301
cagcaucaagauaaaccccu

SEQ ID NO: 3906180 - RNA, 15 nt, Shigella flexneri 2a str. 301
cagcaucacgcccgc

SEQ ID NO: 3906181 - RNA, 22 nt, Shigella flexneri 2a str. 301
cagcaucauaccuccgcaauau

SEQ ID NO: 3906182 - RNA, 14 nt, Shigella flexneri 2a str. 301
cagcaucauagugg

SEQ ID NO: 3906183 - RNA, 15 nt, Shigella flexneri 2a str. 301
cagcaucaugccgcu

SEQ ID NO: 3906184 - RNA, 13 nt, Shigella flexneri 2a str. 301
cagcaucccaccu

SEQ ID NO: 3906185 - RNA, 14 nt, Shigella flexneri 2a str. 301
cagcaucgaccagg

SEQ ID NO: 3906186 - RNA, 18 nt, Shigella flexneri 2a str. 301
cagcaucgaccaggauuu

SEQ ID NO: 3906187 - RNA, 16 nt, Shigella flexneri 2a str. 301
cagcaucgcauccggc

SEQ ID NO: 3906188 - RNA, 22 nt, Shigella flexneri 2a str. 301
cagcaucggcagcgccagcgaa

SEQ ID NO: 3906189 - RNA, 15 nt, Shigella flexneri 2a str. 301
cagcaucgucaucag

SEQ ID NO: 3906190 - RNA, 16 nt, Shigella flexneri 2a str. 301
cagcaucgucaucagc

SEQ ID NO: 3906191 - RNA, 19 nt, Shigella flexneri 2a str. 301
cagcaucgucaucagcucc

SEQ ID NO: 3906192 - RNA, 15 nt, Shigella flexneri 2a str. 301
cagcaucguccgcca

SEQ ID NO: 3906193 - RNA, 16 nt, Shigella flexneri 2a str. 301
cagcaucucgcgcucu

SEQ ID NO: 3906194 - RNA, 22 nt, Shigella flexneri 2a str. 301
cagcaucugcauggugccgcca

SEQ ID NO: 3906195 - RNA, 14 nt, Shigella flexneri 2a str. 301
cagcaucuggauga

SEQ ID NO: 3906196 - RNA, 15 nt, Shigella flexneri 2a str. 301
cagcaugaaacgcca

SEQ ID NO: 3906197 - RNA, 16 nt, Shigella flexneri 2a str. 301
cagcaugaccaccggg

SEQ ID NO: 3906198 - RNA, 20 nt, Shigella flexneri 2a str. 301
cagcaugacguccuguacug

SEQ ID NO: 3906199 - RNA, 13 nt, Shigella flexneri 2a str. 301
cagcaugcacccu

SEQ ID NO: 3906200 - RNA, 16 nt, Shigella flexneri 2a str. 301
cagcaugcacccucaa

SEQ ID NO: 3906201 - RNA, 18 nt, Shigella flexneri 2a str. 301
cagcauguguaaccgcuu

SEQ ID NO: 3906202 - RNA, 15 nt, Shigella flexneri 2a str. 301
cagcauuagcaaugc

SEQ ID NO: 3906203 - RNA, 18 nt, Shigella flexneri 2a str. 301
cagcauuauuuuuaaaca

SEQ ID NO: 3906204 - RNA, 23 nt, Shigella flexneri 2a str. 301
cagcauuauuuuuaaacaucaaa

SEQ ID NO: 3906205 - RNA, 16 nt, Shigella flexneri 2a str. 301
cagcauuccagauacg

SEQ ID NO: 3906206 - RNA, 17 nt, Shigella flexneri 2a str. 301
cagcauucccgccagcg

SEQ ID NO: 3906207 - RNA, 20 nt, Shigella flexneri 2a str. 301
cagcauucccgccagcggcc

SEQ ID NO: 3906208 - RNA, 21 nt, Shigella flexneri 2a str. 301
cagcauucgccgcauugucua

SEQ ID NO: 3906209 - RNA, 19 nt, Shigella flexneri 2a str. 301
cagcauucucaucaccauu

SEQ ID NO: 3906210 - RNA, 15 nt, Shigella flexneri 2a str. 301
cagcauucucggccc

SEQ ID NO: 3906211 - RNA, 23 nt, Shigella flexneri 2a str. 301
cagcauuucucuacgcccucgau

SEQ ID NO: 3906212 - RNA, 14 nt, Shigella flexneri 2a str. 301
cagcauuucuucca

SEQ ID NO: 3906213 - RNA, 19 nt, Shigella flexneri 2a str. 301
cagcauuucuuccagcguu

SEQ ID NO: 3906214 - RNA, 14 nt, Shigella flexneri 2a str. 301
cagccaaaaaugac

SEQ ID NO: 3906215 - RNA, 15 nt, Shigella flexneri 2a str. 301
cagccaaauccagcg

SEQ ID NO: 3906216 - RNA, 21 nt, Shigella flexneri 2a str. 301
cagccaaaucccgugaugcgg

SEQ ID NO: 3906217 - RNA, 18 nt, Shigella flexneri 2a str. 301
cagccacacaccgcaaac

SEQ ID NO: 3906218 - RNA, 15 nt, Shigella flexneri 2a str. 301
cagccacaccaauca

SEQ ID NO: 3906219 - RNA, 12 nt, Shigella flexneri 2a str. 301
cagccacagggu

SEQ ID NO: 3906220 - RNA, 20 nt, Shigella flexneri 2a str. 301
cagccacagggugaucacca

SEQ ID NO: 3906221 - RNA, 23 nt, Shigella flexneri 2a str. 301
cagccacagggugaucaccagua

SEQ ID NO: 3906222 - RNA, 15 nt, Shigella flexneri 2a str. 301
cagccaccgccagcg

SEQ ID NO: 3906223 - RNA, 12 nt, Shigella flexneri 2a str. 301
cagccacugcgg

SEQ ID NO: 3906224 - RNA, 12 nt, Shigella flexneri 2a str. 301
cagccacuuccu

SEQ ID NO: 3906225 - RNA, 15 nt, Shigella flexneri 2a str. 301
cagccagacgccagc

SEQ ID NO: 3906226 - RNA, 23 nt, Shigella flexneri 2a str. 301
cagccagacgccagccacaggcu

SEQ ID NO: 3906227 - RNA, 15 nt, Shigella flexneri 2a str. 301
cagccagagccacca

SEQ ID NO: 3906228 - RNA, 20 nt, Shigella flexneri 2a str. 301
cagccagagccaccaacucu

SEQ ID NO: 3906229 - RNA, 15 nt, Shigella flexneri 2a str. 301
cagccagcaccaggc

SEQ ID NO: 3906230 - RNA, 12 nt, Shigella flexneri 2a str. 301
cagccagcacug

SEQ ID NO: 3906231 - RNA, 15 nt, Shigella flexneri 2a str. 301
cagccagcagaggga

SEQ ID NO: 3906232 - RNA, 12 nt, Shigella flexneri 2a str. 301
cagccagcagcg

SEQ ID NO: 3906233 - RNA, 15 nt, Shigella flexneri 2a str. 301
cagccagcagcgaau

SEQ ID NO: 3906234 - RNA, 18 nt, Shigella flexneri 2a str. 301
cagccagccgaacagcgc

SEQ ID NO: 3906235 - RNA, 22 nt, Shigella flexneri 2a str. 301
cagccagccgaacagcgccaga

SEQ ID NO: 3906236 - RNA, 11 nt, Shigella flexneri 2a str. 301
cagccagccgg

SEQ ID NO: 3906237 - RNA, 16 nt, Shigella flexneri 2a str. 301
cagccagcgcuggcaa

SEQ ID NO: 3906238 - RNA, 17 nt, Shigella flexneri 2a str. 301
cagccagcgcuggcaau

SEQ ID NO: 3906239 - RNA, 16 nt, Shigella flexneri 2a str. 301
cagccagcgucaccca

SEQ ID NO: 3906240 - RNA, 19 nt, Shigella flexneri 2a str. 301
cagccagcgucgcacccgg

SEQ ID NO: 3906241 - RNA, 22 nt, Shigella flexneri 2a str. 301
cagccaggccauuuuuucgaua

SEQ ID NO: 3906242 - RNA, 20 nt, Shigella flexneri 2a str. 301
cagccaggguuauauaaaac

SEQ ID NO: 3906243 - RNA, 20 nt, Shigella flexneri 2a str. 301
cagccagucggaaccggcga

SEQ ID NO: 3906244 - RNA, 17 nt, Shigella flexneri 2a str. 301
cagccagugauuaacgc

SEQ ID NO: 3906245 - RNA, 19 nt, Shigella flexneri 2a str. 301
cagccaguucgagaaaaau

SEQ ID NO: 3906246 - RNA, 14 nt, Shigella flexneri 2a str. 301
cagccaguugaucu

SEQ ID NO: 3906247 - RNA, 16 nt, Shigella flexneri 2a str. 301
cagccaguuuuucagc

SEQ ID NO: 3906248 - RNA, 19 nt, Shigella flexneri 2a str. 301
cagccaguuuuucagcgcc

SEQ ID NO: 3906249 - RNA, 22 nt, Shigella flexneri 2a str. 301
cagccauaaagaaaucaccugc

SEQ ID NO: 3906250 - RNA, 22 nt, Shigella flexneri 2a str. 301
cagccauaaauuuaccugaucc

SEQ ID NO: 3906251 - RNA, 12 nt, Shigella flexneri 2a str. 301
cagccauaaccc

SEQ ID NO: 3906252 - RNA, 18 nt, Shigella flexneri 2a str. 301
cagccauacguugcauaa

SEQ ID NO: 3906253 - RNA, 15 nt, Shigella flexneri 2a str. 301
cagccaucaccacgc

SEQ ID NO: 3906254 - RNA, 13 nt, Shigella flexneri 2a str. 301
cagccauccguca

SEQ ID NO: 3906255 - RNA, 19 nt, Shigella flexneri 2a str. 301
cagccaucuguuccggcgu

SEQ ID NO: 3906256 - RNA, 22 nt, Shigella flexneri 2a str. 301
cagccauucaaucuucgacagc

SEQ ID NO: 3906257 - RNA, 20 nt, Shigella flexneri 2a str. 301
cagccauucgaugguuuuau

SEQ ID NO: 3906258 - RNA, 13 nt, Shigella flexneri 2a str. 301
cagccauugccau

SEQ ID NO: 3906259 - RNA, 13 nt, Shigella flexneri 2a str. 301
cagcgccaaucgc

SEQ ID NO: 3906260 - RNA, 16 nt, Shigella flexneri 2a str. 301
cagcgccaccacaaaa

SEQ ID NO: 3906261 - RNA, 17 nt, Shigella flexneri 2a str. 301
cagcgccaccaccagca

SEQ ID NO: 3906262 - RNA, 18 nt, Shigella flexneri 2a str. 301
cagcgccaccagcgccgc

SEQ ID NO: 3906263 - RNA, 23 nt, Shigella flexneri 2a str. 301
cagcgccaccgguuuauuauuga

SEQ ID NO: 3906264 - RNA, 17 nt, Shigella flexneri 2a str. 301
cagcgccagacaaacca

SEQ ID NO: 3906265 - RNA, 23 nt, Shigella flexneri 2a str. 301
cagcgccagcgcgaugcaggcca

SEQ ID NO: 3906266 - RNA, 16 nt, Shigella flexneri 2a str. 301
cagcgccaucugcagg

SEQ ID NO: 3906267 - RNA, 14 nt, Shigella flexneri 2a str. 301
cagcgcccaacacu

SEQ ID NO: 3906268 - RNA, 15 nt, Shigella flexneri 2a str. 301
cagcgcccaacacuu

SEQ ID NO: 3906269 - RNA, 23 nt, Shigella flexneri 2a str. 301
cagcgcccgcuugcgagacggcg

SEQ ID NO: 3906270 - RNA, 19 nt, Shigella flexneri 2a str. 301
cagcgccgacagcagcccu

SEQ ID NO: 3906271 - RNA, 19 nt, Shigella flexneri 2a str. 301
cagcgccgagcaccgaccc

SEQ ID NO: 3906272 - RNA, 18 nt, Shigella flexneri 2a str. 301
cagcgccgcgccacuacu

SEQ ID NO: 3906273 - RNA, 14 nt, Shigella flexneri 2a str. 301
cagcgccgcggcgu

SEQ ID NO: 3906274 - RNA, 23 nt, Shigella flexneri 2a str. 301
cagcgccgcuuuccaggcugugu

SEQ ID NO: 3906275 - RNA, 18 nt, Shigella flexneri 2a str. 301
cagcgccugacgcggggu

SEQ ID NO: 3906276 - RNA, 13 nt, Shigella flexneri 2a str. 301
cagcgccugauac

SEQ ID NO: 3906277 - RNA, 14 nt, Shigella flexneri 2a str. 301
cagcgccugcugca

SEQ ID NO: 3906278 - RNA, 18 nt, Shigella flexneri 2a str. 301
cagcgccuggcugcaugg

SEQ ID NO: 3906279 - RNA, 19 nt, Shigella flexneri 2a str. 301
cagcgccuggcugcauggc

SEQ ID NO: 3906280 - RNA, 23 nt, Shigella flexneri 2a str. 301
cagcgcgacgcucggcuguuucu

SEQ ID NO: 3906281 - RNA, 22 nt, Shigella flexneri 2a str. 301
cagcgcgaggaucacgcaaucg

SEQ ID NO: 3906282 - RNA, 13 nt, Shigella flexneri 2a str. 301
cagcgcgcagaac

SEQ ID NO: 3906283 - RNA, 18 nt, Shigella flexneri 2a str. 301
cagcgcgccagccaccac

SEQ ID NO: 3906284 - RNA, 16 nt, Shigella flexneri 2a str. 301
cagcgcgccgucgaug

SEQ ID NO: 3906285 - RNA, 13 nt, Shigella flexneri 2a str. 301
cagcgcgcgcagc

SEQ ID NO: 3906286 - RNA, 14 nt, Shigella flexneri 2a str. 301
cagcgcgcucgcca

SEQ ID NO: 3906287 - RNA, 13 nt, Shigella flexneri 2a str. 301
cagcgcgcugaca

SEQ ID NO: 3906288 - RNA, 22 nt, Shigella flexneri 2a str. 301
cagcgcggaagggaugaaauag

SEQ ID NO: 3906289 - RNA, 17 nt, Shigella flexneri 2a str. 301
cagcgcggcgaacuuaa

SEQ ID NO: 3906290 - RNA, 17 nt, Shigella flexneri 2a str. 301
cagcgcgggcuggcgua

SEQ ID NO: 3906291 - RNA, 18 nt, Shigella flexneri 2a str. 301
cagcgcggugauaaccgu

SEQ ID NO: 3906292 - RNA, 20 nt, Shigella flexneri 2a str. 301
cagcgcggugauaaccguuu

SEQ ID NO: 3906293 - RNA, 18 nt, Shigella flexneri 2a str. 301
cagcgcguucugguaaac

SEQ ID NO: 3906294 - RNA, 13 nt, Shigella flexneri 2a str. 301
cagcgcuaaccgc

SEQ ID NO: 3906295 - RNA, 19 nt, Shigella flexneri 2a str. 301
cagcgcuaaccgccugaaa

SEQ ID NO: 3906296 - RNA, 15 nt, Shigella flexneri 2a str. 301
cagcgcuaauacgau

SEQ ID NO: 3906297 - RNA, 15 nt, Shigella flexneri 2a str. 301
cagcgcugacgugau

SEQ ID NO: 3906298 - RNA, 23 nt, Shigella flexneri 2a str. 301
cagcgcugcgaaaguaccauuaa

SEQ ID NO: 3906299 - RNA, 16 nt, Shigella flexneri 2a str. 301
cagcgcuuacccgucc

SEQ ID NO: 3906300 - RNA, 16 nt, Shigella flexneri 2a str. 301
cagcgcuucacuauga

SEQ ID NO: 3906301 - RNA, 13 nt, Shigella flexneri 2a str. 301
cagcgcuuucaug

SEQ ID NO: 3906302 - RNA, 21 nt, Shigella flexneri 2a str. 301
cagcgcuuuuggcgcguuccc

SEQ ID NO: 3906303 - RNA, 20 nt, Shigella flexneri 2a str. 301
cagcggaaaauaucgcccau

SEQ ID NO: 3906304 - RNA, 23 nt, Shigella flexneri 2a str. 301
cagcggaaccgcuguugucugaa

SEQ ID NO: 3906305 - RNA, 23 nt, Shigella flexneri 2a str. 301
cagcggaaugcagucacgccagu

SEQ ID NO: 3906306 - RNA, 14 nt, Shigella flexneri 2a str. 301
cagcggacgcugcu

SEQ ID NO: 3906307 - RNA, 21 nt, Shigella flexneri 2a str. 301
cagcggagaaacuucugccgg

SEQ ID NO: 3906308 - RNA, 20 nt, Shigella flexneri 2a str. 301
cagcggauaaagcagagcag

SEQ ID NO: 3906309 - RNA, 16 nt, Shigella flexneri 2a str. 301
cagcggauacaggaag

SEQ ID NO: 3906310 - RNA, 17 nt, Shigella flexneri 2a str. 301
cagcggauacaggaagc

SEQ ID NO: 3906311 - RNA, 16 nt, Shigella flexneri 2a str. 301
cagcggaucgaacucc

SEQ ID NO: 3906312 - RNA, 15 nt, Shigella flexneri 2a str. 301
cagcggaugacccag

SEQ ID NO: 3906313 - RNA, 12 nt, Shigella flexneri 2a str. 301
cagcggcaauuc

SEQ ID NO: 3906314 - RNA, 16 nt, Shigella flexneri 2a str. 301
cagcggcaguaaauau

SEQ ID NO: 3906315 - RNA, 18 nt, Shigella flexneri 2a str. 301
cagcggcauuacgcgccc

SEQ ID NO: 3906316 - RNA, 14 nt, Shigella flexneri 2a str. 301
cagcggccagccau

SEQ ID NO: 3906317 - RNA, 15 nt, Shigella flexneri 2a str. 301
cagcggccagcgcac

SEQ ID NO: 3906318 - RNA, 23 nt, Shigella flexneri 2a str. 301
cagcggcccggagacgccgaggg

SEQ ID NO: 3906319 - RNA, 12 nt, Shigella flexneri 2a str. 301
cagcggccggau

SEQ ID NO: 3906320 - RNA, 21 nt, Shigella flexneri 2a str. 301
cagcggcgaauguuccaucac

SEQ ID NO: 3906321 - RNA, 15 nt, Shigella flexneri 2a str. 301
cagcggcggcaaaau

SEQ ID NO: 3906322 - RNA, 15 nt, Shigella flexneri 2a str. 301
cagcggcggcacagc

SEQ ID NO: 3906323 - RNA, 16 nt, Shigella flexneri 2a str. 301
cagcggcugccagcau

SEQ ID NO: 3906324 - RNA, 16 nt, Shigella flexneri 2a str. 301
cagcggcuuccaccgc

SEQ ID NO: 3906325 - RNA, 17 nt, Shigella flexneri 2a str. 301
cagcgggaugccaguca

SEQ ID NO: 3906326 - RNA, 17 nt, Shigella flexneri 2a str. 301
cagcgggcagggcauca

SEQ ID NO: 3906327 - RNA, 17 nt, Shigella flexneri 2a str. 301
cagcgggccggagggca

SEQ ID NO: 3906328 - RNA, 11 nt, Shigella flexneri 2a str. 301
cagcgggcgaa

SEQ ID NO: 3906329 - RNA, 22 nt, Shigella flexneri 2a str. 301
cagcgggugcauuuucacuuca

SEQ ID NO: 3906330 - RNA, 18 nt, Shigella flexneri 2a str. 301
cagcgguaaagcggcgcu

SEQ ID NO: 3906331 - RNA, 21 nt, Shigella flexneri 2a str. 301
cagcgguaacuuaucuguaau

SEQ ID NO: 3906332 - RNA, 18 nt, Shigella flexneri 2a str. 301
cagcggugagccaggacg

SEQ ID NO: 3906333 - RNA, 22 nt, Shigella flexneri 2a str. 301
cagcggugcgaauugccaccau

SEQ ID NO: 3906334 - RNA, 15 nt, Shigella flexneri 2a str. 301
cagcgguugagagaa

SEQ ID NO: 3906335 - RNA, 18 nt, Shigella flexneri 2a str. 301
cagcgguuucacaggaaa

SEQ ID NO: 3906336 - RNA, 15 nt, Shigella flexneri 2a str. 301
cagcgguuugcgcau

SEQ ID NO: 3906337 - RNA, 12 nt, Shigella flexneri 2a str. 301
cagcgguuuugc

SEQ ID NO: 3906338 - RNA, 21 nt, Shigella flexneri 2a str. 301
cagcgguuuuugcgccauuca

SEQ ID NO: 3906339 - RNA, 22 nt, Shigella flexneri 2a str. 301
cagcguaaaggcggcagaacag

SEQ ID NO: 3906340 - RNA, 22 nt, Shigella flexneri 2a str. 301
cagcguaaaggucaauuccuuc

SEQ ID NO: 3906341 - RNA, 21 nt, Shigella flexneri 2a str. 301
cagcguaaauccugacgcugg

SEQ ID NO: 3906342 - RNA, 20 nt, Shigella flexneri 2a str. 301
cagcguaacgauggcaauuu

SEQ ID NO: 3906343 - RNA, 14 nt, Shigella flexneri 2a str. 301
cagcguaacggcuc

SEQ ID NO: 3906344 - RNA, 21 nt, Shigella flexneri 2a str. 301
cagcguaauaaccaacggcga

SEQ ID NO: 3906345 - RNA, 17 nt, Shigella flexneri 2a str. 301
cagcguacaauagccac

SEQ ID NO: 3906346 - RNA, 22 nt, Shigella flexneri 2a str. 301
cagcguacaauagccacauugc

SEQ ID NO: 3906347 - RNA, 21 nt, Shigella flexneri 2a str. 301
cagcguaccaugauccugcaa

SEQ ID NO: 3906348 - RNA, 15 nt, Shigella flexneri 2a str. 301
cagcguaccugccgc

SEQ ID NO: 3906349 - RNA, 16 nt, Shigella flexneri 2a str. 301
cagcguagucggcaga

SEQ ID NO: 3906350 - RNA, 17 nt, Shigella flexneri 2a str. 301
cagcguaucccagugcg

SEQ ID NO: 3906351 - RNA, 17 nt, Shigella flexneri 2a str. 301
cagcguaugcagccagg

SEQ ID NO: 3906352 - RNA, 14 nt, Shigella flexneri 2a str. 301
cagcgucacaucag

SEQ ID NO: 3906353 - RNA, 21 nt, Shigella flexneri 2a str. 301
cagcgucacaucaggccaucc

SEQ ID NO: 3906354 - RNA, 16 nt, Shigella flexneri 2a str. 301
cagcgucagccagaaa

SEQ ID NO: 3906355 - RNA, 13 nt, Shigella flexneri 2a str. 301
cagcgucagcgaa

SEQ ID NO: 3906356 - RNA, 13 nt, Shigella flexneri 2a str. 301
cagcgucaucaac

SEQ ID NO: 3906357 - RNA, 16 nt, Shigella flexneri 2a str. 301
cagcguccagcccucc

SEQ ID NO: 3906358 - RNA, 17 nt, Shigella flexneri 2a str. 301
cagcgucgcaucaggca

SEQ ID NO: 3906359 - RNA, 15 nt, Shigella flexneri 2a str. 301
caggaaauaaauaau

SEQ ID NO: 3906360 - RNA, 13 nt, Shigella flexneri 2a str. 301
caggaaaugggug

SEQ ID NO: 3906361 - RNA, 23 nt, Shigella flexneri 2a str. 301
caggaaauuaccgcaaagcccac

SEQ ID NO: 3906362 - RNA, 18 nt, Shigella flexneri 2a str. 301
caggaacaccgcacgcag

SEQ ID NO: 3906363 - RNA, 13 nt, Shigella flexneri 2a str. 301
caggaacagccac

SEQ ID NO: 3906364 - RNA, 22 nt, Shigella flexneri 2a str. 301
caggaaccccauaagccugaua

SEQ ID NO: 3906365 - RNA, 21 nt, Shigella flexneri 2a str. 301
caggaaccugugacagcagcg

SEQ ID NO: 3906366 - RNA, 15 nt, Shigella flexneri 2a str. 301
caggaacgccgcgcc

SEQ ID NO: 3906367 - RNA, 18 nt, Shigella flexneri 2a str. 301
caggaacgggauugccag

SEQ ID NO: 3906368 - RNA, 13 nt, Shigella flexneri 2a str. 301
caggaacugcuca

SEQ ID NO: 3906369 - RNA, 17 nt, Shigella flexneri 2a str. 301
caggaacuguugcaaaa

SEQ ID NO: 3906370 - RNA, 14 nt, Shigella flexneri 2a str. 301
caggaagccccagc

SEQ ID NO: 3906371 - RNA, 15 nt, Shigella flexneri 2a str. 301
caggaagccccagcu

SEQ ID NO: 3906372 - RNA, 18 nt, Shigella flexneri 2a str. 301
caggaauaaucagcaacg

SEQ ID NO: 3906373 - RNA, 18 nt, Shigella flexneri 2a str. 301
caggaaugcagucgcugu

SEQ ID NO: 3906374 - RNA, 12 nt, Shigella flexneri 2a str. 301
caggacagagac

SEQ ID NO: 3906375 - RNA, 16 nt, Shigella flexneri 2a str. 301
caggacagucagaccg

SEQ ID NO: 3906376 - RNA, 15 nt, Shigella flexneri 2a str. 301
caggaccguucgcua

SEQ ID NO: 3906377 - RNA, 16 nt, Shigella flexneri 2a str. 301
caggaccucacggaac

SEQ ID NO: 3906378 - RNA, 17 nt, Shigella flexneri 2a str. 301
caggaccugcucugcca

SEQ ID NO: 3906379 - RNA, 18 nt, Shigella flexneri 2a str. 301
caggaccugcucugccag

SEQ ID NO: 3906380 - RNA, 14 nt, Shigella flexneri 2a str. 301
caggacgcagucca

SEQ ID NO: 3906381 - RNA, 14 nt, Shigella flexneri 2a str. 301
caggagcagcaggu

SEQ ID NO: 3906382 - RNA, 13 nt, Shigella flexneri 2a str. 301
caggagcaggcug

SEQ ID NO: 3906383 - RNA, 14 nt, Shigella flexneri 2a str. 301
caggagcaggcugc

SEQ ID NO: 3906384 - RNA, 15 nt, Shigella flexneri 2a str. 301
caggagcaggcugca

SEQ ID NO: 3906385 - RNA, 19 nt, Shigella flexneri 2a str. 301
caggagcaggcugcacugg

SEQ ID NO: 3906386 - RNA, 19 nt, Shigella flexneri 2a str. 301
caggagcgauuaugaaaca

SEQ ID NO: 3906387 - RNA, 19 nt, Shigella flexneri 2a str. 301
caggagcgguguaggccug

SEQ ID NO: 3906388 - RNA, 22 nt, Shigella flexneri 2a str. 301
caggagcuccagguccuccugu

SEQ ID NO: 3906389 - RNA, 16 nt, Shigella flexneri 2a str. 301
caggaguagcucuggg

SEQ ID NO: 3906390 - RNA, 17 nt, Shigella flexneri 2a str. 301
caggaguagcucugggu

SEQ ID NO: 3906391 - RNA, 15 nt, Shigella flexneri 2a str. 301
caggagucaugucau

SEQ ID NO: 3906392 - RNA, 17 nt, Shigella flexneri 2a str. 301
caggauaaccuucaacu

SEQ ID NO: 3906393 - RNA, 16 nt, Shigella flexneri 2a str. 301
caggauaagcgccgcu

SEQ ID NO: 3906394 - RNA, 16 nt, Shigella flexneri 2a str. 301
caggauauagucgaac

SEQ ID NO: 3906395 - RNA, 18 nt, Shigella flexneri 2a str. 301
caggauauauuucaucaa

SEQ ID NO: 3906396 - RNA, 16 nt, Shigella flexneri 2a str. 301
caggauauuuauauuu

SEQ ID NO: 3906397 - RNA, 21 nt, Shigella flexneri 2a str. 301
caggaucuggcuugccagcag

SEQ ID NO: 3906398 - RNA, 17 nt, Shigella flexneri 2a str. 301
caggaucugguauuaaa

SEQ ID NO: 3906399 - RNA, 21 nt, Shigella flexneri 2a str. 301
caggauggcguucgcaacacc

SEQ ID NO: 3906400 - RNA, 17 nt, Shigella flexneri 2a str. 301
caggauguuccggcaaa

SEQ ID NO: 3906401 - RNA, 16 nt, Shigella flexneri 2a str. 301
caggauuaauaaauuu

SEQ ID NO: 3906402 - RNA, 13 nt, Shigella flexneri 2a str. 301
caggauucacaau

SEQ ID NO: 3906403 - RNA, 21 nt, Shigella flexneri 2a str. 301
caggauucacaauauuaauac

SEQ ID NO: 3906404 - RNA, 13 nt, Shigella flexneri 2a str. 301
caggauuuccagc

SEQ ID NO: 3906405 - RNA, 19 nt, Shigella flexneri 2a str. 301
caggauuuccagcucaaag

SEQ ID NO: 3906406 - RNA, 20 nt, Shigella flexneri 2a str. 301
caggauuugcgguagcgggc

SEQ ID NO: 3906407 - RNA, 18 nt, Shigella flexneri 2a str. 301
caggcaacuucaagguca

SEQ ID NO: 3906408 - RNA, 14 nt, Shigella flexneri 2a str. 301
caggcaagccgcua

SEQ ID NO: 3906409 - RNA, 21 nt, Shigella flexneri 2a str. 301
caggcaagccgcuaacagcag

SEQ ID NO: 3906410 - RNA, 20 nt, Shigella flexneri 2a str. 301
caggcaaguagcgccauacu

SEQ ID NO: 3906411 - RNA, 15 nt, Shigella flexneri 2a str. 301
caggcaauccauaac

SEQ ID NO: 3906412 - RNA, 20 nt, Shigella flexneri 2a str. 301
caggcaaucccacagccguc

SEQ ID NO: 3906413 - RNA, 15 nt, Shigella flexneri 2a str. 301
caggcacaccgccgc

SEQ ID NO: 3906414 - RNA, 14 nt, Shigella flexneri 2a str. 301
caggcaccagcccc

SEQ ID NO: 3906415 - RNA, 18 nt, Shigella flexneri 2a str. 301
caggcacuacguucucac

SEQ ID NO: 3906416 - RNA, 14 nt, Shigella flexneri 2a str. 301
caggcagauacaac

SEQ ID NO: 3906417 - RNA, 18 nt, Shigella flexneri 2a str. 301
caggcagauccaguuacc

SEQ ID NO: 3906418 - RNA, 19 nt, Shigella flexneri 2a str. 301
caggcagauuuuuuaacug

SEQ ID NO: 3906419 - RNA, 14 nt, Shigella flexneri 2a str. 301
caggcagcugccag

SEQ ID NO: 3906420 - RNA, 15 nt, Shigella flexneri 2a str. 301
caggcagcuuagaaa

SEQ ID NO: 3906421 - RNA, 20 nt, Shigella flexneri 2a str. 301
caggcagcuuagaaaucgac

SEQ ID NO: 3906422 - RNA, 14 nt, Shigella flexneri 2a str. 301
caggcaguaaaccg

SEQ ID NO: 3906423 - RNA, 15 nt, Shigella flexneri 2a str. 301
caggcaguaaaccgu

SEQ ID NO: 3906424 - RNA, 16 nt, Shigella flexneri 2a str. 301
caggcauauucgcgcu

SEQ ID NO: 3906425 - RNA, 18 nt, Shigella flexneri 2a str. 301
caggcaucacgucggcgu

SEQ ID NO: 3906426 - RNA, 13 nt, Shigella flexneri 2a str. 301
caggcaucgugca

SEQ ID NO: 3906427 - RNA, 18 nt, Shigella flexneri 2a str. 301
caggcaucgugcaccaau

SEQ ID NO: 3906428 - RNA, 21 nt, Shigella flexneri 2a str. 301
caggcaucguguugaugcucc

SEQ ID NO: 3906429 - RNA, 19 nt, Shigella flexneri 2a str. 301
caggcauuugcuccagacg

SEQ ID NO: 3906430 - RNA, 20 nt, Shigella flexneri 2a str. 301
caggccaaaaaacagccccu

SEQ ID NO: 3906431 - RNA, 14 nt, Shigella flexneri 2a str. 301
caggccaacagucu

SEQ ID NO: 3906432 - RNA, 14 nt, Shigella flexneri 2a str. 301
caggccaauagugc

SEQ ID NO: 3906433 - RNA, 17 nt, Shigella flexneri 2a str. 301
caggccaguucuucuuc

SEQ ID NO: 3906434 - RNA, 19 nt, Shigella flexneri 2a str. 301
caggccaucacauccugau

SEQ ID NO: 3906435 - RNA, 16 nt, Shigella flexneri 2a str. 301
caggccaucagcagcg

SEQ ID NO: 3906436 - RNA, 17 nt, Shigella flexneri 2a str. 301
caggcccaacuguugau

SEQ ID NO: 3906437 - RNA, 13 nt, Shigella flexneri 2a str. 301
caggccgcgcagu

SEQ ID NO: 3906438 - RNA, 18 nt, Shigella flexneri 2a str. 301
caggccgcguaccgcagc

SEQ ID NO: 3906439 - RNA, 14 nt, Shigella flexneri 2a str. 301
caggccuacaaaau

SEQ ID NO: 3906440 - RNA, 20 nt, Shigella flexneri 2a str. 301
caggccuacaaaaucuugca

SEQ ID NO: 3906441 - RNA, 19 nt, Shigella flexneri 2a str. 301
caggccuacaauguuucug

SEQ ID NO: 3906442 - RNA, 23 nt, Shigella flexneri 2a str. 301
caggccuacagcauauaaugcaa

SEQ ID NO: 3906443 - RNA, 16 nt, Shigella flexneri 2a str. 301
caggccuacauuuucu

SEQ ID NO: 3906444 - RNA, 19 nt, Shigella flexneri 2a str. 301
caggccugauaagcgcagc

SEQ ID NO: 3906445 - RNA, 18 nt, Shigella flexneri 2a str. 301
caggcgaaacccgcugcc

SEQ ID NO: 3906446 - RNA, 16 nt, Shigella flexneri 2a str. 301
caggcgaaggccucuc

SEQ ID NO: 3906447 - RNA, 18 nt, Shigella flexneri 2a str. 301
caggcgagucgagauccc

SEQ ID NO: 3906448 - RNA, 23 nt, Shigella flexneri 2a str. 301
caggcgaucucguuuuugucucu

SEQ ID NO: 3906449 - RNA, 15 nt, Shigella flexneri 2a str. 301
caggcgaucuucccg

SEQ ID NO: 3906450 - RNA, 15 nt, Shigella flexneri 2a str. 301
caggcgcgugaaugc

SEQ ID NO: 3906451 - RNA, 16 nt, Shigella flexneri 2a str. 301
caggcgcuguaugccu

SEQ ID NO: 3906452 - RNA, 16 nt, Shigella flexneri 2a str. 301
caggcggcuaugcugg

SEQ ID NO: 3906453 - RNA, 11 nt, Shigella flexneri 2a str. 301
caggcgugauu

SEQ ID NO: 3906454 - RNA, 22 nt, Shigella flexneri 2a str. 301
caggcguucuacauaaaacgcu

SEQ ID NO: 3906455 - RNA, 15 nt, Shigella flexneri 2a str. 301
caggcguuuacccuu

SEQ ID NO: 3906456 - RNA, 20 nt, Shigella flexneri 2a str. 301
caggcguuuacccuucgcac

SEQ ID NO: 3906457 - RNA, 17 nt, Shigella flexneri 2a str. 301
caggcuaccgcagugaa

SEQ ID NO: 3906458 - RNA, 22 nt, Shigella flexneri 2a str. 301
caggcuaccgcagugaaauuuc

SEQ ID NO: 3906459 - RNA, 17 nt, Shigella flexneri 2a str. 301
cagguuucaaugcacaa

SEQ ID NO: 3906460 - RNA, 21 nt, Shigella flexneri 2a str. 301
cagguuucaccuuuuuccaga

SEQ ID NO: 3906461 - RNA, 21 nt, Shigella flexneri 2a str. 301
cagguuugacauaaauuccgc

SEQ ID NO: 3906462 - RNA, 14 nt, Shigella flexneri 2a str. 301
cagguuuugaccag

SEQ ID NO: 3906463 - RNA, 16 nt, Shigella flexneri 2a str. 301
cagguuuuguuguuuc

SEQ ID NO: 3906464 - RNA, 22 nt, Shigella flexneri 2a str. 301
cagguuuuguuguuucagaaau

SEQ ID NO: 3906465 - RNA, 17 nt, Shigella flexneri 2a str. 301
cagguuuuucagcugcc

SEQ ID NO: 3906466 - RNA, 16 nt, Shigella flexneri 2a str. 301
caguaaacgcuuuuuu

SEQ ID NO: 3906467 - RNA, 17 nt, Shigella flexneri 2a str. 301
caguaaagaaaucccau

SEQ ID NO: 3906468 - RNA, 15 nt, Shigella flexneri 2a str. 301
caguaaagcagcgaa

SEQ ID NO: 3906469 - RNA, 23 nt, Shigella flexneri 2a str. 301
caguaaagcgcaaaauaccagca

SEQ ID NO: 3906470 - RNA, 19 nt, Shigella flexneri 2a str. 301
caguaaauggugauaucac

SEQ ID NO: 3906471 - RNA, 15 nt, Shigella flexneri 2a str. 301
caguaaauuuaucaa

SEQ ID NO: 3906472 - RNA, 22 nt, Shigella flexneri 2a str. 301
caguaacagaacgcauaacagc

SEQ ID NO: 3906473 - RNA, 15 nt, Shigella flexneri 2a str. 301
caguaaccaaaagcu

SEQ ID NO: 3906474 - RNA, 17 nt, Shigella flexneri 2a str. 301
caguaaccgcuuuuuca

SEQ ID NO: 3906475 - RNA, 18 nt, Shigella flexneri 2a str. 301
caguaaccgcuuuuucaa

SEQ ID NO: 3906476 - RNA, 17 nt, Shigella flexneri 2a str. 301
caguaacgccugguaac

SEQ ID NO: 3906477 - RNA, 14 nt, Shigella flexneri 2a str. 301
caguaacucauugc

SEQ ID NO: 3906478 - RNA, 17 nt, Shigella flexneri 2a str. 301
caguaacucauugccag

SEQ ID NO: 3906479 - RNA, 18 nt, Shigella flexneri 2a str. 301
caguaagcaguccagcgc

SEQ ID NO: 3906480 - RNA, 23 nt, Shigella flexneri 2a str. 301
caguaagcaguccagcgccugac

SEQ ID NO: 3906481 - RNA, 14 nt, Shigella flexneri 2a str. 301
caguaagcgacggg

SEQ ID NO: 3906482 - RNA, 21 nt, Shigella flexneri 2a str. 301
caguaagcugugcgauagcaa

SEQ ID NO: 3906483 - RNA, 19 nt, Shigella flexneri 2a str. 301
caguaagggaucacgcggu

SEQ ID NO: 3906484 - RNA, 21 nt, Shigella flexneri 2a str. 301
caguaaggucaucaaucauuu

SEQ ID NO: 3906485 - RNA, 16 nt, Shigella flexneri 2a str. 301
caguaauaccagaccu

SEQ ID NO: 3906486 - RNA, 20 nt, Shigella flexneri 2a str. 301
caguaaugaucggcgcgaaa

SEQ ID NO: 3906487 - RNA, 13 nt, Shigella flexneri 2a str. 301
caguaauucagcc

SEQ ID NO: 3906488 - RNA, 14 nt, Shigella flexneri 2a str. 301
caguacauagccau

SEQ ID NO: 3906489 - RNA, 22 nt, Shigella flexneri 2a str. 301
caguacauugagaauaucggca

SEQ ID NO: 3906490 - RNA, 13 nt, Shigella flexneri 2a str. 301
caguaccaccgcg

SEQ ID NO: 3906491 - RNA, 13 nt, Shigella flexneri 2a str. 301
caguaccagcaac

SEQ ID NO: 3906492 - RNA, 13 nt, Shigella flexneri 2a str. 301
caguaccagcagu

SEQ ID NO: 3906493 - RNA, 20 nt, Shigella flexneri 2a str. 301
caguaccauuuucgcuggca

SEQ ID NO: 3906494 - RNA, 19 nt, Shigella flexneri 2a str. 301
caguaccgccaccaccaga

SEQ ID NO: 3906495 - RNA, 21 nt, Shigella flexneri 2a str. 301
caguaccgccagugcagcgaa

SEQ ID NO: 3906496 - RNA, 23 nt, Shigella flexneri 2a str. 301
caguaccgccgccauaaacagca

SEQ ID NO: 3906497 - RNA, 21 nt, Shigella flexneri 2a str. 301
caguaccuccuucacaguggc

SEQ ID NO: 3906498 - RNA, 20 nt, Shigella flexneri 2a str. 301
caguacgaaauaacugaaua

SEQ ID NO: 3906499 - RNA, 19 nt, Shigella flexneri 2a str. 301
caguacgccaaucugcaaa

SEQ ID NO: 3906500 - RNA, 20 nt, Shigella flexneri 2a str. 301
caguacgcccacgccagccu

SEQ ID NO: 3906501 - RNA, 13 nt, Shigella flexneri 2a str. 301
caguacgccgccg

SEQ ID NO: 3906502 - RNA, 21 nt, Shigella flexneri 2a str. 301
caguacggcagcaaucgacca

SEQ ID NO: 3906503 - RNA, 20 nt, Shigella flexneri 2a str. 301
caguacgguaaagccgugcu

SEQ ID NO: 3906504 - RNA, 15 nt, Shigella flexneri 2a str. 301
caguacuggccucca

SEQ ID NO: 3906505 - RNA, 19 nt, Shigella flexneri 2a str. 301
caguagcgcaaucaccacc

SEQ ID NO: 3906506 - RNA, 20 nt, Shigella flexneri 2a str. 301
caguagcgcaaucaccacca

SEQ ID NO: 3906507 - RNA, 17 nt, Shigella flexneri 2a str. 301
caguagcgccucuucca

SEQ ID NO: 3906508 - RNA, 18 nt, Shigella flexneri 2a str. 301
caguagcgucgccagcag

SEQ ID NO: 3906509 - RNA, 22 nt, Shigella flexneri 2a str. 301
caguagcgucgccagcaguuuc

SEQ ID NO: 3906510 - RNA, 20 nt, Shigella flexneri 2a str. 301
caguagcuauaaaccugcug

SEQ ID NO: 3906511 - RNA, 21 nt, Shigella flexneri 2a str. 301
caguagggugauuucaccugc

SEQ ID NO: 3906512 - RNA, 16 nt, Shigella flexneri 2a str. 301
caguaguucauccagu

SEQ ID NO: 3906513 - RNA, 19 nt, Shigella flexneri 2a str. 301
caguaguucgagaaucgca

SEQ ID NO: 3906514 - RNA, 15 nt, Shigella flexneri 2a str. 301
caguaucugaaucaa

SEQ ID NO: 3906515 - RNA, 16 nt, Shigella flexneri 2a str. 301
caguaucugaaucaaa

SEQ ID NO: 3906516 - RNA, 15 nt, Shigella flexneri 2a str. 301
caguaugaucuugcc

SEQ ID NO: 3906517 - RNA, 17 nt, Shigella flexneri 2a str. 301
caguauguaacuggguu

SEQ ID NO: 3906518 - RNA, 22 nt, Shigella flexneri 2a str. 301
caguauuaacgccauaucauuc

SEQ ID NO: 3906519 - RNA, 19 nt, Shigella flexneri 2a str. 301
caguauuaccggcagagug

SEQ ID NO: 3906520 - RNA, 19 nt, Shigella flexneri 2a str. 301
caguauucaggucagcggc

SEQ ID NO: 3906521 - RNA, 15 nt, Shigella flexneri 2a str. 301
caguauugccaugca

SEQ ID NO: 3906522 - RNA, 18 nt, Shigella flexneri 2a str. 301
caguauugggaugccgaa

SEQ ID NO: 3906523 - RNA, 22 nt, Shigella flexneri 2a str. 301
cagucacaccagcgauguaacc

SEQ ID NO: 3906524 - RNA, 17 nt, Shigella flexneri 2a str. 301
cagucaccugcccuccg

SEQ ID NO: 3906525 - RNA, 20 nt, Shigella flexneri 2a str. 301
cagucaccugcggugcagcc

SEQ ID NO: 3906526 - RNA, 16 nt, Shigella flexneri 2a str. 301
cagucacuacgcgacc

SEQ ID NO: 3906527 - RNA, 14 nt, Shigella flexneri 2a str. 301
cagucacuucaaau

SEQ ID NO: 3906528 - RNA, 16 nt, Shigella flexneri 2a str. 301
cagucacuuuuuuccg

SEQ ID NO: 3906529 - RNA, 12 nt, Shigella flexneri 2a str. 301
cagucagucuca

SEQ ID NO: 3906530 - RNA, 17 nt, Shigella flexneri 2a str. 301
cagucagucucaaggga

SEQ ID NO: 3906531 - RNA, 17 nt, Shigella flexneri 2a str. 301
cagucaguggcagcaaa

SEQ ID NO: 3906532 - RNA, 17 nt, Shigella flexneri 2a str. 301
cagucaguuaagcaacu

SEQ ID NO: 3906533 - RNA, 13 nt, Shigella flexneri 2a str. 301
cagucaguugcuu

SEQ ID NO: 3906534 - RNA, 17 nt, Shigella flexneri 2a str. 301
cagucauaaccagucca

SEQ ID NO: 3906535 - RNA, 14 nt, Shigella flexneri 2a str. 301
cagucauauuucug

SEQ ID NO: 3906536 - RNA, 15 nt, Shigella flexneri 2a str. 301
cagucaugcgagaag

SEQ ID NO: 3906537 - RNA, 18 nt, Shigella flexneri 2a str. 301
cagucaugcgagaagcaa

SEQ ID NO: 3906538 - RNA, 16 nt, Shigella flexneri 2a str. 301
caguccaccugaccug

SEQ ID NO: 3906539 - RNA, 16 nt, Shigella flexneri 2a str. 301
caguccacgguugguu

SEQ ID NO: 3906540 - RNA, 18 nt, Shigella flexneri 2a str. 301
caguccagacuccgagaa

SEQ ID NO: 3906541 - RNA, 13 nt, Shigella flexneri 2a str. 301
caguccagcgccu

SEQ ID NO: 3906542 - RNA, 15 nt, Shigella flexneri 2a str. 301
caguccagcgccuga

SEQ ID NO: 3906543 - RNA, 14 nt, Shigella flexneri 2a str. 301
cagucccaguucau

SEQ ID NO: 3906544 - RNA, 16 nt, Shigella flexneri 2a str. 301
caguccccacaucacu

SEQ ID NO: 3906545 - RNA, 17 nt, Shigella flexneri 2a str. 301
caguccccucgccccuc

SEQ ID NO: 3906546 - RNA, 18 nt, Shigella flexneri 2a str. 301
caguccccucgccccucc

SEQ ID NO: 3906547 - RNA, 23 nt, Shigella flexneri 2a str. 301
cagucccguacccagcaagaccg

SEQ ID NO: 3906548 - RNA, 19 nt, Shigella flexneri 2a str. 301
cagucgaauggcaucuacg

SEQ ID NO: 3906549 - RNA, 17 nt, Shigella flexneri 2a str. 301
cagucgcaaaccuggca

SEQ ID NO: 3906550 - RNA, 16 nt, Shigella flexneri 2a str. 301
cagucgcacgccuggc

SEQ ID NO: 3906551 - RNA, 15 nt, Shigella flexneri 2a str. 301
cagucgccagcgcca

SEQ ID NO: 3906552 - RNA, 17 nt, Shigella flexneri 2a str. 301
cagucgcgcaauugcca

SEQ ID NO: 3906553 - RNA, 21 nt, Shigella flexneri 2a str. 301
cagucgcuauuacgcacacuu

SEQ ID NO: 3906554 - RNA, 23 nt, Shigella flexneri 2a str. 301
cagucgcuauuacgcacacuuuu

SEQ ID NO: 3906555 - RNA, 13 nt, Shigella flexneri 2a str. 301
cagucgcugacac

SEQ ID NO: 3906556 - RNA, 15 nt, Shigella flexneri 2a str. 301
cagucggcguaaucc

SEQ ID NO: 3906557 - RNA, 13 nt, Shigella flexneri 2a str. 301
cagucggcuuucu

SEQ ID NO: 3906558 - RNA, 21 nt, Shigella flexneri 2a str. 301
cagucggcuuucucauuuuuu

SEQ ID NO: 3906559 - RNA, 17 nt, Shigella flexneri 2a str. 301
caguucuucaaaaauaa

SEQ ID NO: 3906560 - RNA, 15 nt, Shigella flexneri 2a str. 301
caguucuuccuggcu

SEQ ID NO: 3906561 - RNA, 14 nt, Shigella flexneri 2a str. 301
caguucuucucaac

SEQ ID NO: 3906562 - RNA, 15 nt, Shigella flexneri 2a str. 301
caguucuucuucaau

SEQ ID NO: 3906563 - RNA, 13 nt, Shigella flexneri 2a str. 301
caguucuuuuauu

SEQ ID NO: 3906564 - RNA, 21 nt, Shigella flexneri 2a str. 301
caguugaccugcgaccggcgu

SEQ ID NO: 3906565 - RNA, 22 nt, Shigella flexneri 2a str. 301
caguugaucaccagugcggaua

SEQ ID NO: 3906566 - RNA, 21 nt, Shigella flexneri 2a str. 301
caguugaugaaucugcuucgc

SEQ ID NO: 3906567 - RNA, 19 nt, Shigella flexneri 2a str. 301
caguugcagcaagccaucg

SEQ ID NO: 3906568 - RNA, 21 nt, Shigella flexneri 2a str. 301
caguugcaucgucuguuuuau

SEQ ID NO: 3906569 - RNA, 14 nt, Shigella flexneri 2a str. 301
caguugcuucaucu

SEQ ID NO: 3906570 - RNA, 15 nt, Shigella flexneri 2a str. 301
caguugcuucaucuc

SEQ ID NO: 3906571 - RNA, 14 nt, Shigella flexneri 2a str. 301
caguuggcugacaa

SEQ ID NO: 3906572 - RNA, 14 nt, Shigella flexneri 2a str. 301
caguugguguccaa

SEQ ID NO: 3906573 - RNA, 13 nt, Shigella flexneri 2a str. 301
caguugguuaauc

SEQ ID NO: 3906574 - RNA, 20 nt, Shigella flexneri 2a str. 301
caguugguuagagcacauca

SEQ ID NO: 3906575 - RNA, 23 nt, Shigella flexneri 2a str. 301
caguugguuagagcacaucacuc

SEQ ID NO: 3906576 - RNA, 16 nt, Shigella flexneri 2a str. 301
caguugucgguaauug

SEQ ID NO: 3906577 - RNA, 20 nt, Shigella flexneri 2a str. 301
caguuguucagaaugcccac

SEQ ID NO: 3906578 - RNA, 13 nt, Shigella flexneri 2a str. 301
caguuguugcaua

SEQ ID NO: 3906579 - RNA, 22 nt, Shigella flexneri 2a str. 301
caguuguugcauaggaauuucu

SEQ ID NO: 3906580 - RNA, 13 nt, Shigella flexneri 2a str. 301
caguuguugcuga

SEQ ID NO: 3906581 - RNA, 17 nt, Shigella flexneri 2a str. 301
caguuguugcugccgac

SEQ ID NO: 3906582 - RNA, 16 nt, Shigella flexneri 2a str. 301
caguuuauccagccac

SEQ ID NO: 3906583 - RNA, 13 nt, Shigella flexneri 2a str. 301
caguuuauuuucu

SEQ ID NO: 3906584 - RNA, 14 nt, Shigella flexneri 2a str. 301
caguuuauuuucug

SEQ ID NO: 3906585 - RNA, 14 nt, Shigella flexneri 2a str. 301
caguuucaccagca

SEQ ID NO: 3906586 - RNA, 15 nt, Shigella flexneri 2a str. 301
caguuucaccugcug

SEQ ID NO: 3906587 - RNA, 14 nt, Shigella flexneri 2a str. 301
caguuucgccaggg

SEQ ID NO: 3906588 - RNA, 18 nt, Shigella flexneri 2a str. 301
caguuucggaccagccgc

SEQ ID NO: 3906589 - RNA, 18 nt, Shigella flexneri 2a str. 301
caguuucugauacugcuc

SEQ ID NO: 3906590 - RNA, 12 nt, Shigella flexneri 2a str. 301
caguuugccaug

SEQ ID NO: 3906591 - RNA, 20 nt, Shigella flexneri 2a str. 301
caguuugcgcgugcugggau

SEQ ID NO: 3906592 - RNA, 22 nt, Shigella flexneri 2a str. 301
caguuuggucuggcaaaaauaa

SEQ ID NO: 3906593 - RNA, 15 nt, Shigella flexneri 2a str. 301
caguuuguucagcug

SEQ ID NO: 3906594 - RNA, 21 nt, Shigella flexneri 2a str. 301
caguuuucauauaccgcauca

SEQ ID NO: 3906595 - RNA, 14 nt, Shigella flexneri 2a str. 301
caguuuugucuucg

SEQ ID NO: 3906596 - RNA, 22 nt, Shigella flexneri 2a str. 301
caguuuugucuucggccauuga

SEQ ID NO: 3906597 - RNA, 18 nt, Shigella flexneri 2a str. 301
caguuuuuccccugccag

SEQ ID NO: 3906598 - RNA, 21 nt, Shigella flexneri 2a str. 301
caguuuuucgucaacauacug

SEQ ID NO: 3906599 - RNA, 23 nt, Shigella flexneri 2a str. 301
caguuuuucgucaacauacugcu

SEQ ID NO: 3906600 - RNA, 15 nt, Shigella flexneri 2a str. 301
caguuuuuguuucug

SEQ ID NO: 3906601 - RNA, 12 nt, Shigella flexneri 2a str. 301
cauaaaaaaacg

SEQ ID NO: 3906602 - RNA, 12 nt, Shigella flexneri 2a str. 301
cauaaaaaccug

SEQ ID NO: 3906603 - RNA, 12 nt, Shigella flexneri 2a str. 301
cauaaaaccagc

SEQ ID NO: 3906604 - RNA, 14 nt, Shigella flexneri 2a str. 301
cauaaaaucacagg

SEQ ID NO: 3906605 - RNA, 13 nt, Shigella flexneri 2a str. 301
cauaaacaacgag

SEQ ID NO: 3906606 - RNA, 15 nt, Shigella flexneri 2a str. 301
cauaaacaccagcaa

SEQ ID NO: 3906607 - RNA, 15 nt, Shigella flexneri 2a str. 301
cauaaaccacagacc

SEQ ID NO: 3906608 - RNA, 17 nt, Shigella flexneri 2a str. 301
cauaaacgccgucauca

SEQ ID NO: 3906609 - RNA, 17 nt, Shigella flexneri 2a str. 301
cauaaacugagccaaac

SEQ ID NO: 3906610 - RNA, 15 nt, Shigella flexneri 2a str. 301
cauaaagccugcuuc

SEQ ID NO: 3906611 - RNA, 22 nt, Shigella flexneri 2a str. 301
cauaaagccugcuucaaacgcu

SEQ ID NO: 3906612 - RNA, 17 nt, Shigella flexneri 2a str. 301
cauaaagcgguuuucaa

SEQ ID NO: 3906613 - RNA, 18 nt, Shigella flexneri 2a str. 301
cauaaagcgguuuucaaa

SEQ ID NO: 3906614 - RNA, 22 nt, Shigella flexneri 2a str. 301
cauaaagcugcggauccugagc

SEQ ID NO: 3906615 - RNA, 17 nt, Shigella flexneri 2a str. 301
cauaaauacuccauaac

SEQ ID NO: 3906616 - RNA, 17 nt, Shigella flexneri 2a str. 301
cauaaauccaacaacac

SEQ ID NO: 3906617 - RNA, 15 nt, Shigella flexneri 2a str. 301
cauaaauugcagcga

SEQ ID NO: 3906618 - RNA, 16 nt, Shigella flexneri 2a str. 301
cauaaauugcuguaaa

SEQ ID NO: 3906619 - RNA, 22 nt, Shigella flexneri 2a str. 301
cauaaauuucugccauuuugcu

SEQ ID NO: 3906620 - RNA, 18 nt, Shigella flexneri 2a str. 301
cauaacacagguaacuua

SEQ ID NO: 3906621 - RNA, 21 nt, Shigella flexneri 2a str. 301
cauaacacagguaacuuaaau

SEQ ID NO: 3906622 - RNA, 12 nt, Shigella flexneri 2a str. 301
cauaacagagcg

SEQ ID NO: 3906623 - RNA, 16 nt, Shigella flexneri 2a str. 301
cauaaccaacaauugu

SEQ ID NO: 3906624 - RNA, 13 nt, Shigella flexneri 2a str. 301
cauaaccacucac

SEQ ID NO: 3906625 - RNA, 15 nt, Shigella flexneri 2a str. 301
cauaaccagagagcu

SEQ ID NO: 3906626 - RNA, 14 nt, Shigella flexneri 2a str. 301
cauaaccaguccau

SEQ ID NO: 3906627 - RNA, 18 nt, Shigella flexneri 2a str. 301
cauaaccugugcaccaga

SEQ ID NO: 3906628 - RNA, 22 nt, Shigella flexneri 2a str. 301
cauaacgcaucggcuaaaccau

SEQ ID NO: 3906629 - RNA, 22 nt, Shigella flexneri 2a str. 301
cauaacgccgguauuuuuauug

SEQ ID NO: 3906630 - RNA, 21 nt, Shigella flexneri 2a str. 301
cauaacgcuccuacaccgaac

SEQ ID NO: 3906631 - RNA, 19 nt, Shigella flexneri 2a str. 301
cauaacgcugauauuucgg

SEQ ID NO: 3906632 - RNA, 15 nt, Shigella flexneri 2a str. 301
cauaacggacgaucu

SEQ ID NO: 3906633 - RNA, 13 nt, Shigella flexneri 2a str. 301
cauaacucaccau

SEQ ID NO: 3906634 - RNA, 22 nt, Shigella flexneri 2a str. 301
cauaacuccccgagaaauacug

SEQ ID NO: 3906635 - RNA, 13 nt, Shigella flexneri 2a str. 301
cauaacugccgga

SEQ ID NO: 3906636 - RNA, 17 nt, Shigella flexneri 2a str. 301
cauaacuggucaucaaa

SEQ ID NO: 3906637 - RNA, 18 nt, Shigella flexneri 2a str. 301
cauaacuggucaucaaau

SEQ ID NO: 3906638 - RNA, 13 nt, Shigella flexneri 2a str. 301
cauaagagaugga

SEQ ID NO: 3906639 - RNA, 21 nt, Shigella flexneri 2a str. 301
cauaagagauggaaugagcau

SEQ ID NO: 3906640 - RNA, 17 nt, Shigella flexneri 2a str. 301
cauaagcaucccuuuaa

SEQ ID NO: 3906641 - RNA, 18 nt, Shigella flexneri 2a str. 301
cauaagcaucccuuuaau

SEQ ID NO: 3906642 - RNA, 18 nt, Shigella flexneri 2a str. 301
cauaaggaaacuccagcc

SEQ ID NO: 3906643 - RNA, 22 nt, Shigella flexneri 2a str. 301
cauaauaagcgccauaucggca

SEQ ID NO: 3906644 - RNA, 19 nt, Shigella flexneri 2a str. 301
cauaauaagcuuuuucugc

SEQ ID NO: 3906645 - RNA, 20 nt, Shigella flexneri 2a str. 301
cauaauauucauuacaccaa

SEQ ID NO: 3906646 - RNA, 23 nt, Shigella flexneri 2a str. 301
cauaauauucauuacaccaauac

SEQ ID NO: 3906647 - RNA, 20 nt, Shigella flexneri 2a str. 301
cauaaucaccaucagcagca

SEQ ID NO: 3906648 - RNA, 13 nt, Shigella flexneri 2a str. 301
cauaauccagguu

SEQ ID NO: 3906649 - RNA, 16 nt, Shigella flexneri 2a str. 301
cauaaucggcgcggcg

SEQ ID NO: 3906650 - RNA, 20 nt, Shigella flexneri 2a str. 301
cauaaucgggaugcguaaca

SEQ ID NO: 3906651 - RNA, 21 nt, Shigella flexneri 2a str. 301
cauaaucgggaugcguaacag

SEQ ID NO: 3906652 - RNA, 14 nt, Shigella flexneri 2a str. 301
cauaaucugcaaau

SEQ ID NO: 3906653 - RNA, 13 nt, Shigella flexneri 2a str. 301
cauaaugcagcca

SEQ ID NO: 3906654 - RNA, 16 nt, Shigella flexneri 2a str. 301
cauaaugcccagcguu

SEQ ID NO: 3906655 - RNA, 20 nt, Shigella flexneri 2a str. 301
cauaaugccugaugcgacgc

SEQ ID NO: 3906656 - RNA, 13 nt, Shigella flexneri 2a str. 301
cauaaugcugaca

SEQ ID NO: 3906657 - RNA, 13 nt, Shigella flexneri 2a str. 301
cauaauguccugc

SEQ ID NO: 3906658 - RNA, 20 nt, Shigella flexneri 2a str. 301
cauaauguccugcggacagu

SEQ ID NO: 3906659 - RNA, 14 nt, Shigella flexneri 2a str. 301
cauaugcaucagau

SEQ ID NO: 3906660 - RNA, 13 nt, Shigella flexneri 2a str. 301
cauaugccccugu

SEQ ID NO: 3906661 - RNA, 21 nt, Shigella flexneri 2a str. 301
cauaugcgccagacugaucau

SEQ ID NO: 3906662 - RNA, 15 nt, Shigella flexneri 2a str. 301
cauauguugaaaagc

SEQ ID NO: 3906663 - RNA, 13 nt, Shigella flexneri 2a str. 301
cauauguuuacgc

SEQ ID NO: 3906664 - RNA, 14 nt, Shigella flexneri 2a str. 301
cauauuaaauuuuu

SEQ ID NO: 3906665 - RNA, 18 nt, Shigella flexneri 2a str. 301
cauauuauucauaaugcc

SEQ ID NO: 3906666 - RNA, 16 nt, Shigella flexneri 2a str. 301
cauauucaauuugcaa

SEQ ID NO: 3906667 - RNA, 12 nt, Shigella flexneri 2a str. 301
cauauucaccac

SEQ ID NO: 3906668 - RNA, 21 nt, Shigella flexneri 2a str. 301
cauauucaccacgaaaccgac

SEQ ID NO: 3906669 - RNA, 23 nt, Shigella flexneri 2a str. 301
cauauucaccacgaaaccgacug

SEQ ID NO: 3906670 - RNA, 13 nt, Shigella flexneri 2a str. 301
cauauucagcagc

SEQ ID NO: 3906671 - RNA, 14 nt, Shigella flexneri 2a str. 301
cauauucagcagca

SEQ ID NO: 3906672 - RNA, 13 nt, Shigella flexneri 2a str. 301
cauauuccccugg

SEQ ID NO: 3906673 - RNA, 17 nt, Shigella flexneri 2a str. 301
cauauucccgcaacuua

SEQ ID NO: 3906674 - RNA, 15 nt, Shigella flexneri 2a str. 301
cauauuccugaccca

SEQ ID NO: 3906675 - RNA, 17 nt, Shigella flexneri 2a str. 301
cauauucgccaccgcgc

SEQ ID NO: 3906676 - RNA, 14 nt, Shigella flexneri 2a str. 301
cauauuuaaagaag

SEQ ID NO: 3906677 - RNA, 18 nt, Shigella flexneri 2a str. 301
cauauuuaaucaguucua

SEQ ID NO: 3906678 - RNA, 19 nt, Shigella flexneri 2a str. 301
cauauuuaaucaguucuac

SEQ ID NO: 3906679 - RNA, 20 nt, Shigella flexneri 2a str. 301
cauauuuccuuccuuggaua

SEQ ID NO: 3906680 - RNA, 21 nt, Shigella flexneri 2a str. 301
cauauuucuguuugcgucagc

SEQ ID NO: 3906681 - RNA, 22 nt, Shigella flexneri 2a str. 301
cauauuuuucauauuuuacauc

SEQ ID NO: 3906682 - RNA, 14 nt, Shigella flexneri 2a str. 301
caucaaacaacggc

SEQ ID NO: 3906683 - RNA, 17 nt, Shigella flexneri 2a str. 301
caucaaacaacggcacu

SEQ ID NO: 3906684 - RNA, 22 nt, Shigella flexneri 2a str. 301
caucaaacaacggcacuucaau

SEQ ID NO: 3906685 - RNA, 14 nt, Shigella flexneri 2a str. 301
caucaaacccuucc

SEQ ID NO: 3906686 - RNA, 16 nt, Shigella flexneri 2a str. 301
caucaaacggcauaug

SEQ ID NO: 3906687 - RNA, 13 nt, Shigella flexneri 2a str. 301
caucaaagucucc

SEQ ID NO: 3906688 - RNA, 14 nt, Shigella flexneri 2a str. 301
caucaaaucacuaa

SEQ ID NO: 3906689 - RNA, 14 nt, Shigella flexneri 2a str. 301
caucaaauccccac

SEQ ID NO: 3906690 - RNA, 20 nt, Shigella flexneri 2a str. 301
caucaaaugcgcagccagcg

SEQ ID NO: 3906691 - RNA, 23 nt, Shigella flexneri 2a str. 301
caucaaauguugcguucaucagu

SEQ ID NO: 3906692 - RNA, 19 nt, Shigella flexneri 2a str. 301
caucaaauuugucgccaac

SEQ ID NO: 3906693 - RNA, 20 nt, Shigella flexneri 2a str. 301
caucaacaacuggcguuucu

SEQ ID NO: 3906694 - RNA, 20 nt, Shigella flexneri 2a str. 301
caucaacaagcgaauuuccc

SEQ ID NO: 3906695 - RNA, 14 nt, Shigella flexneri 2a str. 301
caucaacacuuugg

SEQ ID NO: 3906696 - RNA, 21 nt, Shigella flexneri 2a str. 301
caucaaccaacaccuguucca

SEQ ID NO: 3906697 - RNA, 12 nt, Shigella flexneri 2a str. 301
caucaaccagca

SEQ ID NO: 3906698 - RNA, 17 nt, Shigella flexneri 2a str. 301
caucaaccagcacaaag

SEQ ID NO: 3906699 - RNA, 20 nt, Shigella flexneri 2a str. 301
caucaacccgcccagugccg

SEQ ID NO: 3906700 - RNA, 22 nt, Shigella flexneri 2a str. 301
caucaacccgcucauaauacag

SEQ ID NO: 3906701 - RNA, 15 nt, Shigella flexneri 2a str. 301
caucaacgccauacg

SEQ ID NO: 3906702 - RNA, 18 nt, Shigella flexneri 2a str. 301
caucaacgccaucgccag

SEQ ID NO: 3906703 - RNA, 15 nt, Shigella flexneri 2a str. 301
caucaacguuuuuuu

SEQ ID NO: 3906704 - RNA, 17 nt, Shigella flexneri 2a str. 301
caucaacugaccgauuu

SEQ ID NO: 3906705 - RNA, 13 nt, Shigella flexneri 2a str. 301
caucaacugacua

SEQ ID NO: 3906706 - RNA, 19 nt, Shigella flexneri 2a str. 301
caucaacugcgcuauaucg

SEQ ID NO: 3906707 - RNA, 22 nt, Shigella flexneri 2a str. 301
caucaagcuaacgaacgcagug

SEQ ID NO: 3906708 - RNA, 18 nt, Shigella flexneri 2a str. 301
caucaagcugugccugaa

SEQ ID NO: 3906709 - RNA, 15 nt, Shigella flexneri 2a str. 301
caucaaguaaccuuu

SEQ ID NO: 3906710 - RNA, 14 nt, Shigella flexneri 2a str. 301
caucaaguagcagg

SEQ ID NO: 3906711 - RNA, 22 nt, Shigella flexneri 2a str. 301
caucaaguagcagguaaucugc

SEQ ID NO: 3906712 - RNA, 15 nt, Shigella flexneri 2a str. 301
caucaagucagaugc

SEQ ID NO: 3906713 - RNA, 22 nt, Shigella flexneri 2a str. 301
caucaaguugauuuuucguuuu

SEQ ID NO: 3906714 - RNA, 13 nt, Shigella flexneri 2a str. 301
caucaauaaacaa

SEQ ID NO: 3906715 - RNA, 12 nt, Shigella flexneri 2a str. 301
caucaauaccau

SEQ ID NO: 3906716 - RNA, 13 nt, Shigella flexneri 2a str. 301
caucaaucacuuu

SEQ ID NO: 3906717 - RNA, 13 nt, Shigella flexneri 2a str. 301
caucaaucauuuu

SEQ ID NO: 3906718 - RNA, 12 nt, Shigella flexneri 2a str. 301
caucaaugccag

SEQ ID NO: 3906719 - RNA, 13 nt, Shigella flexneri 2a str. 301
caucaaugccagc

SEQ ID NO: 3906720 - RNA, 15 nt, Shigella flexneri 2a str. 301
caucaaugccagcau

SEQ ID NO: 3906721 - RNA, 22 nt, Shigella flexneri 2a str. 301
caucaaugccagcauaccgccg

SEQ ID NO: 3906722 - RNA, 14 nt, Shigella flexneri 2a str. 301
caucaauggaugaa

SEQ ID NO: 3906723 - RNA, 20 nt, Shigella flexneri 2a str. 301
caucaauggaugcaaucaca

SEQ ID NO: 3906724 - RNA, 17 nt, Shigella flexneri 2a str. 301
caucaauugcucacucc

SEQ ID NO: 3906725 - RNA, 20 nt, Shigella flexneri 2a str. 301
caucaauugcucacucccgg

SEQ ID NO: 3906726 - RNA, 13 nt, Shigella flexneri 2a str. 301
caucacaauggca

SEQ ID NO: 3906727 - RNA, 11 nt, Shigella flexneri 2a str. 301
caucacaccag

SEQ ID NO: 3906728 - RNA, 18 nt, Shigella flexneri 2a str. 301
caucacauagcgguaagc

SEQ ID NO: 3906729 - RNA, 14 nt, Shigella flexneri 2a str. 301
caucacaucccagc

SEQ ID NO: 3906730 - RNA, 17 nt, Shigella flexneri 2a str. 301
caucacaucccagcaga

SEQ ID NO: 3906731 - RNA, 19 nt, Shigella flexneri 2a str. 301
caucaccaaugaaagcccc

SEQ ID NO: 3906732 - RNA, 18 nt, Shigella flexneri 2a str. 301
caucaccauaaaucagau

SEQ ID NO: 3906733 - RNA, 14 nt, Shigella flexneri 2a str. 301
caucaccauccacg

SEQ ID NO: 3906734 - RNA, 17 nt, Shigella flexneri 2a str. 301
caucaccauugcaucga

SEQ ID NO: 3906735 - RNA, 16 nt, Shigella flexneri 2a str. 301
caucaccccgccgggc

SEQ ID NO: 3906736 - RNA, 15 nt, Shigella flexneri 2a str. 301
ccaucggcuuuggca

SEQ ID NO: 3906737 - RNA, 14 nt, Shigella flexneri 2a str. 301
ccaucgggcuauuu

SEQ ID NO: 3906738 - RNA, 23 nt, Shigella flexneri 2a str. 301
ccaucguccagcagcaaugcagg

SEQ ID NO: 3906739 - RNA, 12 nt, Shigella flexneri 2a str. 301
ccaucuccagcu

SEQ ID NO: 3906740 - RNA, 15 nt, Shigella flexneri 2a str. 301
ccaucuccagcugcu

SEQ ID NO: 3906741 - RNA, 20 nt, Shigella flexneri 2a str. 301
ccaucuccgcauguuucgac

SEQ ID NO: 3906742 - RNA, 15 nt, Shigella flexneri 2a str. 301
ccaucuccuuacugc

SEQ ID NO: 3906743 - RNA, 19 nt, Shigella flexneri 2a str. 301
ccaucuccuuacugccccc

SEQ ID NO: 3906744 - RNA, 16 nt, Shigella flexneri 2a str. 301
ccaucucuuccagcga

SEQ ID NO: 3906745 - RNA, 19 nt, Shigella flexneri 2a str. 301
ccaucugaugauauuuuuc

SEQ ID NO: 3906746 - RNA, 16 nt, Shigella flexneri 2a str. 301
ccaucugccgauacgc

SEQ ID NO: 3906747 - RNA, 14 nt, Shigella flexneri 2a str. 301
ccaucuggcugacg

SEQ ID NO: 3906748 - RNA, 15 nt, Shigella flexneri 2a str. 301
ccaucuguucugccg

SEQ ID NO: 3906749 - RNA, 19 nt, Shigella flexneri 2a str. 301
ccaucuucuucacuucuuc

SEQ ID NO: 3906750 - RNA, 18 nt, Shigella flexneri 2a str. 301
ccaucuucuugcagcuua

SEQ ID NO: 3906751 - RNA, 15 nt, Shigella flexneri 2a str. 301
ccaucuuuccucacu

SEQ ID NO: 3906752 - RNA, 13 nt, Shigella flexneri 2a str. 301
ccaucuuuuuaag

SEQ ID NO: 3906753 - RNA, 16 nt, Shigella flexneri 2a str. 301
ccaugacaaauaacgg

SEQ ID NO: 3906754 - RNA, 18 nt, Shigella flexneri 2a str. 301
ccaugaccgcuccgccau

SEQ ID NO: 3906755 - RNA, 13 nt, Shigella flexneri 2a str. 301
ccaugacgcacuu

SEQ ID NO: 3906756 - RNA, 14 nt, Shigella flexneri 2a str. 301
ccaugacuuucugg

SEQ ID NO: 3906757 - RNA, 18 nt, Shigella flexneri 2a str. 301
ccaugagaagcugaaauc

SEQ ID NO: 3906758 - RNA, 12 nt, Shigella flexneri 2a str. 301
ccaugagacaaa

SEQ ID NO: 3906759 - RNA, 17 nt, Shigella flexneri 2a str. 301
ccaugauaguguccauu

SEQ ID NO: 3906760 - RNA, 14 nt, Shigella flexneri 2a str. 301
ccaugauauuggca

SEQ ID NO: 3906761 - RNA, 22 nt, Shigella flexneri 2a str. 301
ccaugauccugcaauaccgccg

SEQ ID NO: 3906762 - RNA, 14 nt, Shigella flexneri 2a str. 301
ccaugaugacaaca

SEQ ID NO: 3906763 - RNA, 17 nt, Shigella flexneri 2a str. 301
ccaugaugacaacauag

SEQ ID NO: 3906764 - RNA, 20 nt, Shigella flexneri 2a str. 301
ccaugcaauauuguagcaac

SEQ ID NO: 3906765 - RNA, 15 nt, Shigella flexneri 2a str. 301
ccaugcacugcaacg

SEQ ID NO: 3906766 - RNA, 18 nt, Shigella flexneri 2a str. 301
ccaugcaggaucgcucca

SEQ ID NO: 3906767 - RNA, 19 nt, Shigella flexneri 2a str. 301
ccaugcaggaucgcuccau

SEQ ID NO: 3906768 - RNA, 11 nt, Shigella flexneri 2a str. 301
ccaugcauauc

SEQ ID NO: 3906769 - RNA, 18 nt, Shigella flexneri 2a str. 301
ccaugccaguuaucgcag

SEQ ID NO: 3906770 - RNA, 16 nt, Shigella flexneri 2a str. 301
ccaugccaucugccag

SEQ ID NO: 3906771 - RNA, 22 nt, Shigella flexneri 2a str. 301
ccaugccaucugccagcaagcg

SEQ ID NO: 3906772 - RNA, 19 nt, Shigella flexneri 2a str. 301
ccaugccggaugcgccagc

SEQ ID NO: 3906773 - RNA, 23 nt, Shigella flexneri 2a str. 301
ccaugccggaugcgccagcaucc

SEQ ID NO: 3906774 - RNA, 22 nt, Shigella flexneri 2a str. 301
ccaugccggugaugccgccaga

SEQ ID NO: 3906775 - RNA, 16 nt, Shigella flexneri 2a str. 301
ccaugccuuguuugau

SEQ ID NO: 3906776 - RNA, 21 nt, Shigella flexneri 2a str. 301
ccaugccuuguuugaucaucg

SEQ ID NO: 3906777 - RNA, 19 nt, Shigella flexneri 2a str. 301
ccaugcgaagaagggacua

SEQ ID NO: 3906778 - RNA, 23 nt, Shigella flexneri 2a str. 301
ccaugcgaagaccgcaucacgac

SEQ ID NO: 3906779 - RNA, 18 nt, Shigella flexneri 2a str. 301
ccaugcgaaugccaauuu

SEQ ID NO: 3906780 - RNA, 15 nt, Shigella flexneri 2a str. 301
ccaugcgcaucaucg

SEQ ID NO: 3906781 - RNA, 13 nt, Shigella flexneri 2a str. 301
ccaugcggcaucu

SEQ ID NO: 3906782 - RNA, 18 nt, Shigella flexneri 2a str. 301
ccaugcguugucgccauc

SEQ ID NO: 3906783 - RNA, 14 nt, Shigella flexneri 2a str. 301
ccaugcugagcuuc

SEQ ID NO: 3906784 - RNA, 15 nt, Shigella flexneri 2a str. 301
ccaugcugugcgcca

SEQ ID NO: 3906785 - RNA, 23 nt, Shigella flexneri 2a str. 301
ccaugcugugcgccacagacaua

SEQ ID NO: 3906786 - RNA, 18 nt, Shigella flexneri 2a str. 301
ccaugcuuugcaucccag

SEQ ID NO: 3906787 - RNA, 12 nt, Shigella flexneri 2a str. 301
ccauggacgaug

SEQ ID NO: 3906788 - RNA, 14 nt, Shigella flexneri 2a str. 301
ccauggacgcguca

SEQ ID NO: 3906789 - RNA, 16 nt, Shigella flexneri 2a str. 301
ccaugucgcauccgac

SEQ ID NO: 3906790 - RNA, 16 nt, Shigella flexneri 2a str. 301
ccauguguuuaucuau

SEQ ID NO: 3906791 - RNA, 15 nt, Shigella flexneri 2a str. 301
ccauguugacuucaa

SEQ ID NO: 3906792 - RNA, 12 nt, Shigella flexneri 2a str. 301
ccauguugccug

SEQ ID NO: 3906793 - RNA, 16 nt, Shigella flexneri 2a str. 301
ccauguugcuggaaga

SEQ ID NO: 3906794 - RNA, 23 nt, Shigella flexneri 2a str. 301
ccauguuuaauucacgcaggcga

SEQ ID NO: 3906795 - RNA, 19 nt, Shigella flexneri 2a str. 301
ccauuaaacgcaguaagcg

SEQ ID NO: 3906796 - RNA, 14 nt, Shigella flexneri 2a str. 301
ccauuaaccagcca

SEQ ID NO: 3906797 - RNA, 16 nt, Shigella flexneri 2a str. 301
ccauuaacuacaccgu

SEQ ID NO: 3906798 - RNA, 17 nt, Shigella flexneri 2a str. 301
ccauuacaagcccgcug

SEQ ID NO: 3906799 - RNA, 19 nt, Shigella flexneri 2a str. 301
ccauuagacaguuugccuu

SEQ ID NO: 3906800 - RNA, 19 nt, Shigella flexneri 2a str. 301
ccauuauccgucagccacu

SEQ ID NO: 3906801 - RNA, 22 nt, Shigella flexneri 2a str. 301
ccauuauuaaauuuaauaauaa

SEQ ID NO: 3906802 - RNA, 13 nt, Shigella flexneri 2a str. 301
ccauuauuucaau

SEQ ID NO: 3906803 - RNA, 16 nt, Shigella flexneri 2a str. 301
ccauucaccauuuuuu

SEQ ID NO: 3906804 - RNA, 17 nt, Shigella flexneri 2a str. 301
ccauucauaauugcgau

SEQ ID NO: 3906805 - RNA, 22 nt, Shigella flexneri 2a str. 301
ccauucauaauugcgaugccag

SEQ ID NO: 3906806 - RNA, 22 nt, Shigella flexneri 2a str. 301
ccauuccaguaauugacgcauc

SEQ ID NO: 3906807 - RNA, 19 nt, Shigella flexneri 2a str. 301
ccauucccccuuugaccag

SEQ ID NO: 3906808 - RNA, 12 nt, Shigella flexneri 2a str. 301
ccauucccugcu

SEQ ID NO: 3906809 - RNA, 17 nt, Shigella flexneri 2a str. 301
ccauuccguuucuccac

SEQ ID NO: 3906810 - RNA, 17 nt, Shigella flexneri 2a str. 301
ccauucgcaaagucgau

SEQ ID NO: 3906811 - RNA, 17 nt, Shigella flexneri 2a str. 301
ccauucguuauaaugcu

SEQ ID NO: 3906812 - RNA, 21 nt, Shigella flexneri 2a str. 301
ccauugaagcaauccauacca

SEQ ID NO: 3906813 - RNA, 14 nt, Shigella flexneri 2a str. 301
ccauugaccagcug

SEQ ID NO: 3906814 - RNA, 19 nt, Shigella flexneri 2a str. 301
ccauugagagcaacggcga

SEQ ID NO: 3906815 - RNA, 20 nt, Shigella flexneri 2a str. 301
ccauugagcuggucugaauc

SEQ ID NO: 3906816 - RNA, 15 nt, Shigella flexneri 2a str. 301
ccauuggaggacgcg

SEQ ID NO: 3906817 - RNA, 13 nt, Shigella flexneri 2a str. 301
ccauuggcaggcu

SEQ ID NO: 3906818 - RNA, 16 nt, Shigella flexneri 2a str. 301
ccauuggcauaaauaa

SEQ ID NO: 3906819 - RNA, 15 nt, Shigella flexneri 2a str. 301
ccauugggccacuca

SEQ ID NO: 3906820 - RNA, 20 nt, Shigella flexneri 2a str. 301
ccauugggccacucaacauc

SEQ ID NO: 3906821 - RNA, 16 nt, Shigella flexneri 2a str. 301
ccauuguuagcaacga

SEQ ID NO: 3906822 - RNA, 23 nt, Shigella flexneri 2a str. 301
ccauuguuguuggauccccugcc

SEQ ID NO: 3906823 - RNA, 18 nt, Shigella flexneri 2a str. 301
ccauuuaacguuaucuga

SEQ ID NO: 3906824 - RNA, 15 nt, Shigella flexneri 2a str. 301
ccauuucaucgccag

SEQ ID NO: 3906825 - RNA, 19 nt, Shigella flexneri 2a str. 301
ccauuuccagcgcuuucau

SEQ ID NO: 3906826 - RNA, 15 nt, Shigella flexneri 2a str. 301
ccauuuccuguaaca

SEQ ID NO: 3906827 - RNA, 23 nt, Shigella flexneri 2a str. 301
ccauuuggcggggauuuuuuuau

SEQ ID NO: 3906828 - RNA, 20 nt, Shigella flexneri 2a str. 301
ccauuugugcauagcacacu

SEQ ID NO: 3906829 - RNA, 21 nt, Shigella flexneri 2a str. 301
ccauuugugcauagcacacuu

SEQ ID NO: 3906830 - RNA, 16 nt, Shigella flexneri 2a str. 301
ccauuugugcuggcaa

SEQ ID NO: 3906831 - RNA, 16 nt, Shigella flexneri 2a str. 301
ccauuuuuaauaauac

SEQ ID NO: 3906832 - RNA, 18 nt, Shigella flexneri 2a str. 301
ccauuuuuaauaauacuc

SEQ ID NO: 3906833 - RNA, 22 nt, Shigella flexneri 2a str. 301
ccauuuuucagacguucuuccu

SEQ ID NO: 3906834 - RNA, 18 nt, Shigella flexneri 2a str. 301
ccauuuuuucgauaauca

SEQ ID NO: 3906835 - RNA, 23 nt, Shigella flexneri 2a str. 301
cccaaaaaaucaacgacaaaaau

SEQ ID NO: 3906836 - RNA, 16 nt, Shigella flexneri 2a str. 301
cccaaacagcagaacg

SEQ ID NO: 3906837 - RNA, 15 nt, Shigella flexneri 2a str. 301
cccaaacuuaacacu

SEQ ID NO: 3906838 - RNA, 21 nt, Shigella flexneri 2a str. 301
cccaacaaauugguuuugaau

SEQ ID NO: 3906839 - RNA, 19 nt, Shigella flexneri 2a str. 301
cccaaccauuucaucuucu

SEQ ID NO: 3906840 - RNA, 15 nt, Shigella flexneri 2a str. 301
cccaaccgcccugcg

SEQ ID NO: 3906841 - RNA, 15 nt, Shigella flexneri 2a str. 301
cccaacgccacucuc

SEQ ID NO: 3906842 - RNA, 17 nt, Shigella flexneri 2a str. 301
cccaacgcgccaccgac

SEQ ID NO: 3906843 - RNA, 20 nt, Shigella flexneri 2a str. 301
cccaacgcgccaccgaccag

SEQ ID NO: 3906844 - RNA, 17 nt, Shigella flexneri 2a str. 301
cccaacguaacaaaacu

SEQ ID NO: 3906845 - RNA, 16 nt, Shigella flexneri 2a str. 301
cccaacugccugaugc

SEQ ID NO: 3906846 - RNA, 13 nt, Shigella flexneri 2a str. 301
cccaacuggcgac

SEQ ID NO: 3906847 - RNA, 17 nt, Shigella flexneri 2a str. 301
cccaacuuugugcaauu

SEQ ID NO: 3906848 - RNA, 22 nt, Shigella flexneri 2a str. 301
cccaauauccugagccggaacu

SEQ ID NO: 3906849 - RNA, 20 nt, Shigella flexneri 2a str. 301
cccaauccaguacaugaagc

SEQ ID NO: 3906850 - RNA, 15 nt, Shigella flexneri 2a str. 301
cccaaucccccacuu

SEQ ID NO: 3906851 - RNA, 22 nt, Shigella flexneri 2a str. 301
cccaauguagccgcacgcuggc

SEQ ID NO: 3906852 - RNA, 19 nt, Shigella flexneri 2a str. 301
cccaauuaauugccagccg

SEQ ID NO: 3906853 - RNA, 18 nt, Shigella flexneri 2a str. 301
cccacaaacccgccagac

SEQ ID NO: 3906854 - RNA, 23 nt, Shigella flexneri 2a str. 301
cccacaacaguggcgacaucuuu

SEQ ID NO: 3906855 - RNA, 11 nt, Shigella flexneri 2a str. 301
cccacaaccgg

SEQ ID NO: 3906856 - RNA, 11 nt, Shigella flexneri 2a str. 301
cccacacauuu

SEQ ID NO: 3906857 - RNA, 14 nt, Shigella flexneri 2a str. 301
cccacaccaccaug

SEQ ID NO: 3906858 - RNA, 15 nt, Shigella flexneri 2a str. 301
cccacagaaacaaua

SEQ ID NO: 3906859 - RNA, 12 nt, Shigella flexneri 2a str. 301
cccacagacgac

SEQ ID NO: 3906860 - RNA, 17 nt, Shigella flexneri 2a str. 301
cccacagacgacgaacu

SEQ ID NO: 3906861 - RNA, 15 nt, Shigella flexneri 2a str. 301
cccacauccaugugg

SEQ ID NO: 3906862 - RNA, 21 nt, Shigella flexneri 2a str. 301
cccacauguugcgcuucacca

SEQ ID NO: 3906863 - RNA, 12 nt, Shigella flexneri 2a str. 301
cccaccaccagc

SEQ ID NO: 3906864 - RNA, 13 nt, Shigella flexneri 2a str. 301
cccaccccagcag

SEQ ID NO: 3906865 - RNA, 19 nt, Shigella flexneri 2a str. 301
cccaccccagcagcagccg

SEQ ID NO: 3906866 - RNA, 13 nt, Shigella flexneri 2a str. 301
cccaccgcagccc

SEQ ID NO: 3906867 - RNA, 13 nt, Shigella flexneri 2a str. 301
cccacgagcaaaa

SEQ ID NO: 3906868 - RNA, 19 nt, Shigella flexneri 2a str. 301
cccacgauguauccggcaa

SEQ ID NO: 3906869 - RNA, 19 nt, Shigella flexneri 2a str. 301
cccacgauugaucucguug

SEQ ID NO: 3906870 - RNA, 12 nt, Shigella flexneri 2a str. 301
cccacgccgccc

SEQ ID NO: 3906871 - RNA, 19 nt, Shigella flexneri 2a str. 301
cccacgccgcccagagaac

SEQ ID NO: 3906872 - RNA, 22 nt, Shigella flexneri 2a str. 301
cccacgcgguuugugcucugug

SEQ ID NO: 3906873 - RNA, 21 nt, Shigella flexneri 2a str. 301
cccacggcggugucgccagaa

SEQ ID NO: 3906874 - RNA, 19 nt, Shigella flexneri 2a str. 301
cccacgggugaucuucaua

SEQ ID NO: 3906875 - RNA, 20 nt, Shigella flexneri 2a str. 301
cccacgucagaccaaaacgc

SEQ ID NO: 3906876 - RNA, 22 nt, Shigella flexneri 2a str. 301
cccacgucaucugucauaacac

SEQ ID NO: 3906877 - RNA, 23 nt, Shigella flexneri 2a str. 301
cccacguuaguguggccaguucc

SEQ ID NO: 3906878 - RNA, 16 nt, Shigella flexneri 2a str. 301
cccacuaagcaccaaa

SEQ ID NO: 3906879 - RNA, 13 nt, Shigella flexneri 2a str. 301
cccacucgccccg

SEQ ID NO: 3906880 - RNA, 17 nt, Shigella flexneri 2a str. 301
cccacucgccccgagaa

SEQ ID NO: 3906881 - RNA, 12 nt, Shigella flexneri 2a str. 301
cccacugcaugg

SEQ ID NO: 3906882 - RNA, 13 nt, Shigella flexneri 2a str. 301
cccacugcucaau

SEQ ID NO: 3906883 - RNA, 18 nt, Shigella flexneri 2a str. 301
cccacuggaaguuauagc

SEQ ID NO: 3906884 - RNA, 18 nt, Shigella flexneri 2a str. 301
cccacuucuuucgcccag

SEQ ID NO: 3906885 - RNA, 17 nt, Shigella flexneri 2a str. 301
cccacuuucaggccagc

SEQ ID NO: 3906886 - RNA, 19 nt, Shigella flexneri 2a str. 301
cccacuuucaggccagcgg

SEQ ID NO: 3906887 - RNA, 16 nt, Shigella flexneri 2a str. 301
cccacuuucugcgcaa

SEQ ID NO: 3906888 - RNA, 17 nt, Shigella flexneri 2a str. 301
cccacuuucugcgcaau

SEQ ID NO: 3906889 - RNA, 16 nt, Shigella flexneri 2a str. 301
cccagaacuaucauac

SEQ ID NO: 3906890 - RNA, 20 nt, Shigella flexneri 2a str. 301
cccagaagguuucgccgcug

SEQ ID NO: 3906891 - RNA, 22 nt, Shigella flexneri 2a str. 301
cccagaaucucuuuuguuuccc

SEQ ID NO: 3906892 - RNA, 14 nt, Shigella flexneri 2a str. 301
cccagacgagagug

SEQ ID NO: 3906893 - RNA, 14 nt, Shigella flexneri 2a str. 301
cccagauagcaaca

SEQ ID NO: 3906894 - RNA, 15 nt, Shigella flexneri 2a str. 301
cccagauagcaacag

SEQ ID NO: 3906895 - RNA, 19 nt, Shigella flexneri 2a str. 301
cccagauagcaacagcagc

SEQ ID NO: 3906896 - RNA, 20 nt, Shigella flexneri 2a str. 301
cccagaugccagaaucccca

SEQ ID NO: 3906897 - RNA, 16 nt, Shigella flexneri 2a str. 301
cccagcaccgcagaga

SEQ ID NO: 3906898 - RNA, 13 nt, Shigella flexneri 2a str. 301
cccagcacuucgc

SEQ ID NO: 3906899 - RNA, 15 nt, Shigella flexneri 2a str. 301
cccagcagagaucuu

SEQ ID NO: 3906900 - RNA, 23 nt, Shigella flexneri 2a str. 301
cccagcagagaucuuucacgccc

SEQ ID NO: 3906901 - RNA, 13 nt, Shigella flexneri 2a str. 301
cccagcagcgccg

SEQ ID NO: 3906902 - RNA, 21 nt, Shigella flexneri 2a str. 301
cccagcaggauguuccggcaa

SEQ ID NO: 3906903 - RNA, 22 nt, Shigella flexneri 2a str. 301
cccagcaucacgcccgcuuuuu

SEQ ID NO: 3906904 - RNA, 12 nt, Shigella flexneri 2a str. 301
cccagcaucaga

SEQ ID NO: 3906905 - RNA, 19 nt, Shigella flexneri 2a str. 301
cccagcaucugcauggugc

SEQ ID NO: 3906906 - RNA, 16 nt, Shigella flexneri 2a str. 301
cccagcauggcaauaa

SEQ ID NO: 3906907 - RNA, 16 nt, Shigella flexneri 2a str. 301
cccagcccagcggaaa

SEQ ID NO: 3906908 - RNA, 12 nt, Shigella flexneri 2a str. 301
cccagccgcccu

SEQ ID NO: 3906909 - RNA, 23 nt, Shigella flexneri 2a str. 301
cccagccgcgucugaauaucauc

SEQ ID NO: 3906910 - RNA, 13 nt, Shigella flexneri 2a str. 301
cccagcgcaucag

SEQ ID NO: 3906911 - RNA, 14 nt, Shigella flexneri 2a str. 301
cccagcgcaucagg

SEQ ID NO: 3906912 - RNA, 16 nt, Shigella flexneri 2a str. 301
cccagcgcaucaggca

SEQ ID NO: 3906913 - RNA, 23 nt, Shigella flexneri 2a str. 301
cccagcgcccccacaacaguggc

SEQ ID NO: 3906914 - RNA, 12 nt, Shigella flexneri 2a str. 301
cccagcgcgccg

SEQ ID NO: 3906915 - RNA, 16 nt, Shigella flexneri 2a str. 301
cccagcgcgccgccaa

SEQ ID NO: 3906916 - RNA, 17 nt, Shigella flexneri 2a str. 301
cccagcgguaaaauggu

SEQ ID NO: 3906917 - RNA, 21 nt, Shigella flexneri 2a str. 301
cccagcgucagcauaaaaaua

SEQ ID NO: 3906918 - RNA, 23 nt, Shigella flexneri 2a str. 301
cccagcgucagcaucauaccucc

SEQ ID NO: 3906919 - RNA, 21 nt, Shigella flexneri 2a str. 301
cccagcgugcguuuuuuguac

SEQ ID NO: 3906920 - RNA, 19 nt, Shigella flexneri 2a str. 301
cccagcguggagagcagca

SEQ ID NO: 3906921 - RNA, 22 nt, Shigella flexneri 2a str. 301
cccagcguggagagcagcauca

SEQ ID NO: 3906922 - RNA, 17 nt, Shigella flexneri 2a str. 301
cccagcucaucagcauu

SEQ ID NO: 3906923 - RNA, 13 nt, Shigella flexneri 2a str. 301
cccaggcaccguc

SEQ ID NO: 3906924 - RNA, 20 nt, Shigella flexneri 2a str. 301
cccagggcaauguaacaccu

SEQ ID NO: 3906925 - RNA, 23 nt, Shigella flexneri 2a str. 301
cccagguaucguugaugcucuug

SEQ ID NO: 3906926 - RNA, 17 nt, Shigella flexneri 2a str. 301
cccaguaaccacgcagc

SEQ ID NO: 3906927 - RNA, 13 nt, Shigella flexneri 2a str. 301
cccaguaauucag

SEQ ID NO: 3906928 - RNA, 14 nt, Shigella flexneri 2a str. 301
cccagucauccggc

SEQ ID NO: 3906929 - RNA, 15 nt, Shigella flexneri 2a str. 301
cccagugcggcaucg

SEQ ID NO: 3906930 - RNA, 15 nt, Shigella flexneri 2a str. 301
cccaguggcagcaau

SEQ ID NO: 3906931 - RNA, 21 nt, Shigella flexneri 2a str. 301
cccagugguuucgccagcacc

SEQ ID NO: 3906932 - RNA, 20 nt, Shigella flexneri 2a str. 301
cccaguuacugccaucuucc

SEQ ID NO: 3906933 - RNA, 19 nt, Shigella flexneri 2a str. 301
cccaguugauucgcgcguu

SEQ ID NO: 3906934 - RNA, 23 nt, Shigella flexneri 2a str. 301
cccaguuuugcgcguuggcaaga

SEQ ID NO: 3906935 - RNA, 17 nt, Shigella flexneri 2a str. 301
cccauaucaggcacauu

SEQ ID NO: 3906936 - RNA, 16 nt, Shigella flexneri 2a str. 301
cccauccugauccaca

SEQ ID NO: 3906937 - RNA, 14 nt, Shigella flexneri 2a str. 301
cccauccuucugug

SEQ ID NO: 3906938 - RNA, 19 nt, Shigella flexneri 2a str. 301
cccaucgcgcccgccgcca

SEQ ID NO: 3906939 - RNA, 23 nt, Shigella flexneri 2a str. 301
cccaucgcguuugcgcuccggcg

SEQ ID NO: 3906940 - RNA, 15 nt, Shigella flexneri 2a str. 301
cccaucucaauauua

SEQ ID NO: 3906941 - RNA, 14 nt, Shigella flexneri 2a str. 301
cccaucucuucuuc

SEQ ID NO: 3906942 - RNA, 19 nt, Shigella flexneri 2a str. 301
cccaucuuuuuaaguuuau

SEQ ID NO: 3906943 - RNA, 19 nt, Shigella flexneri 2a str. 301
cccaugaugcgcggcucca

SEQ ID NO: 3906944 - RNA, 22 nt, Shigella flexneri 2a str. 301
cccaugaugcgcggcuccagaa

SEQ ID NO: 3906945 - RNA, 18 nt, Shigella flexneri 2a str. 301
cccaugccauuuccagcg

SEQ ID NO: 3906946 - RNA, 23 nt, Shigella flexneri 2a str. 301
cccauggacauacgcaccuuuac

SEQ ID NO: 3906947 - RNA, 17 nt, Shigella flexneri 2a str. 301
cccauugccccauguug

SEQ ID NO: 3906948 - RNA, 12 nt, Shigella flexneri 2a str. 301
cccauuucucca

SEQ ID NO: 3906949 - RNA, 15 nt, Shigella flexneri 2a str. 301
cccauuuuuaauaau

SEQ ID NO: 3906950 - RNA, 23 nt, Shigella flexneri 2a str. 301
ccccaaaaagauuaaaaaaacac

SEQ ID NO: 3906951 - RNA, 21 nt, Shigella flexneri 2a str. 301
ccccaacaugacuaaucugac

SEQ ID NO: 3906952 - RNA, 14 nt, Shigella flexneri 2a str. 301
ccccaaccgcccug

SEQ ID NO: 3906953 - RNA, 15 nt, Shigella flexneri 2a str. 301
ccccaaccgcccugc

SEQ ID NO: 3906954 - RNA, 20 nt, Shigella flexneri 2a str. 301
ccccaaggaucgucgcccga

SEQ ID NO: 3906955 - RNA, 22 nt, Shigella flexneri 2a str. 301
ccccaaggcgaggggaccgccc

SEQ ID NO: 3906956 - RNA, 21 nt, Shigella flexneri 2a str. 301
ccccacaaacccgccagacca

SEQ ID NO: 3906957 - RNA, 14 nt, Shigella flexneri 2a str. 301
ccccacaccaccau

SEQ ID NO: 3906958 - RNA, 21 nt, Shigella flexneri 2a str. 301
ccccacacuaccaucggcgcu

SEQ ID NO: 3906959 - RNA, 13 nt, Shigella flexneri 2a str. 301
ccccacagaccca

SEQ ID NO: 3906960 - RNA, 19 nt, Shigella flexneri 2a str. 301
ccccacagcgucauuguca

SEQ ID NO: 3906961 - RNA, 21 nt, Shigella flexneri 2a str. 301
ccccacagugcugauuuugca

SEQ ID NO: 3906962 - RNA, 13 nt, Shigella flexneri 2a str. 301
ccccaccagcaaa

SEQ ID NO: 3906963 - RNA, 21 nt, Shigella flexneri 2a str. 301
ccccaccccggcccucucccu

SEQ ID NO: 3906964 - RNA, 13 nt, Shigella flexneri 2a str. 301
ccccaccucauca

SEQ ID NO: 3906965 - RNA, 22 nt, Shigella flexneri 2a str. 301
ccccacucgccccgagaaaaau

SEQ ID NO: 3906966 - RNA, 20 nt, Shigella flexneri 2a str. 301
ccccagaagcuuuccaucgg

SEQ ID NO: 3906967 - RNA, 22 nt, Shigella flexneri 2a str. 301
ccccagacgacggcugccauca

SEQ ID NO: 3906968 - RNA, 17 nt, Shigella flexneri 2a str. 301
ccccagaucccauaacc

SEQ ID NO: 3906969 - RNA, 11 nt, Shigella flexneri 2a str. 301
ccccagaugcc

SEQ ID NO: 3906970 - RNA, 17 nt, Shigella flexneri 2a str. 301
ccccagcagaauccggu

SEQ ID NO: 3906971 - RNA, 21 nt, Shigella flexneri 2a str. 301
ccccagcaucacgcccgcuuu

SEQ ID NO: 3906972 - RNA, 12 nt, Shigella flexneri 2a str. 301
ccccagcgcaag

SEQ ID NO: 3906973 - RNA, 20 nt, Shigella flexneri 2a str. 301
ccccagcgcucgguagugcc

SEQ ID NO: 3906974 - RNA, 16 nt, Shigella flexneri 2a str. 301
ccccagcggaaaauau

SEQ ID NO: 3906975 - RNA, 15 nt, Shigella flexneri 2a str. 301
ccccagcgucagcau

SEQ ID NO: 3906976 - RNA, 12 nt, Shigella flexneri 2a str. 301
ccccaguaauuc

SEQ ID NO: 3906977 - RNA, 23 nt, Shigella flexneri 2a str. 301
ccccauaaacuaucccucagcca

SEQ ID NO: 3906978 - RNA, 21 nt, Shigella flexneri 2a str. 301
ccccaucaacgccaucgccag

SEQ ID NO: 3906979 - RNA, 13 nt, Shigella flexneri 2a str. 301
ccccauccacgca

SEQ ID NO: 3906980 - RNA, 21 nt, Shigella flexneri 2a str. 301
ccccaucuuccgucacaggca

SEQ ID NO: 3906981 - RNA, 23 nt, Shigella flexneri 2a str. 301
ccccauuaccugacagcagagca

SEQ ID NO: 3906982 - RNA, 17 nt, Shigella flexneri 2a str. 301
cccccaaauaaccccuc

SEQ ID NO: 3906983 - RNA, 13 nt, Shigella flexneri 2a str. 301
cccccaccccggc

SEQ ID NO: 3906984 - RNA, 14 nt, Shigella flexneri 2a str. 301
cccccaccccggcc

SEQ ID NO: 3906985 - RNA, 18 nt, Shigella flexneri 2a str. 301
cccccauugggccacuca

SEQ ID NO: 3906986 - RNA, 11 nt, Shigella flexneri 2a str. 301
cccccucugau

SEQ ID NO: 3906987 - RNA, 23 nt, Shigella flexneri 2a str. 301
cccccuuugaccagccagucagu

SEQ ID NO: 3906988 - RNA, 16 nt, Shigella flexneri 2a str. 301
ccccgaacucaucucu

SEQ ID NO: 3906989 - RNA, 18 nt, Shigella flexneri 2a str. 301
ccccgagaaauacuggcu

SEQ ID NO: 3906990 - RNA, 23 nt, Shigella flexneri 2a str. 301
ccccgcacaacggcuacuucuuc

SEQ ID NO: 3906991 - RNA, 13 nt, Shigella flexneri 2a str. 301
ccccgcucacgca

SEQ ID NO: 3906992 - RNA, 22 nt, Shigella flexneri 2a str. 301
ccccgcucacgcagcggcggca

SEQ ID NO: 3906993 - RNA, 12 nt, Shigella flexneri 2a str. 301
ccccgcuccggc

SEQ ID NO: 3906994 - RNA, 14 nt, Shigella flexneri 2a str. 301
ccccgcuuccugca

SEQ ID NO: 3906995 - RNA, 17 nt, Shigella flexneri 2a str. 301
ccccgcuucgcccgcca

SEQ ID NO: 3906996 - RNA, 16 nt, Shigella flexneri 2a str. 301
ccccggcaugauugag

SEQ ID NO: 3906997 - RNA, 17 nt, Shigella flexneri 2a str. 301
ccccggcccucucccua

SEQ ID NO: 3906998 - RNA, 21 nt, Shigella flexneri 2a str. 301
ccccggcgaucccagagcggg

SEQ ID NO: 3906999 - RNA, 22 nt, Shigella flexneri 2a str. 301
ccccgguuaauugcgccagcac

SEQ ID NO: 3907000 - RNA, 19 nt, Shigella flexneri 2a str. 301
ccccgugaugaacugcggu

SEQ ID NO: 3907001 - RNA, 21 nt, Shigella flexneri 2a str. 301
ccccgugaugaacugcgguaa

SEQ ID NO: 3907002 - RNA, 14 nt, Shigella flexneri 2a str. 301
ccccguucugccag

SEQ ID NO: 3907003 - RNA, 21 nt, Shigella flexneri 2a str. 301
ccccucacccuaacccucucc

SEQ ID NO: 3907004 - RNA, 17 nt, Shigella flexneri 2a str. 301
ccccugauaaccgcauc

SEQ ID NO: 3907005 - RNA, 14 nt, Shigella flexneri 2a str. 301
ccccugccagaucg

SEQ ID NO: 3907006 - RNA, 19 nt, Shigella flexneri 2a str. 301
ccccugccgcaaacgacac

SEQ ID NO: 3907007 - RNA, 20 nt, Shigella flexneri 2a str. 301
ccccugccgcaaacgacacu

SEQ ID NO: 3907008 - RNA, 22 nt, Shigella flexneri 2a str. 301
ccccugcgauugugacacgcgc

SEQ ID NO: 3907009 - RNA, 19 nt, Shigella flexneri 2a str. 301
ccccuguugugccagacca

SEQ ID NO: 3907010 - RNA, 13 nt, Shigella flexneri 2a str. 301
ccccuucugccgc

SEQ ID NO: 3907011 - RNA, 16 nt, Shigella flexneri 2a str. 301
ccccuucuucuacugc

SEQ ID NO: 3907012 - RNA, 17 nt, Shigella flexneri 2a str. 301
ccccuuucgaaaucauu

SEQ ID NO: 3907013 - RNA, 15 nt, Shigella flexneri 2a str. 301
ccccuuugaccagcc

SEQ ID NO: 3907014 - RNA, 22 nt, Shigella flexneri 2a str. 301
ccccuuugaccagccagucagu

SEQ ID NO: 3907015 - RNA, 22 nt, Shigella flexneri 2a str. 301
cccgaaaccgacuuacuuauuu

SEQ ID NO: 3907016 - RNA, 19 nt, Shigella flexneri 2a str. 301
cccgaaggaauuuuacagc

SEQ ID NO: 3907017 - RNA, 15 nt, Shigella flexneri 2a str. 301
cccgaaugaccgccc

SEQ ID NO: 3907018 - RNA, 16 nt, Shigella flexneri 2a str. 301
cccgaaugcagcucca

SEQ ID NO: 3907019 - RNA, 18 nt, Shigella flexneri 2a str. 301
cccgacaaccugaccuuu

SEQ ID NO: 3907020 - RNA, 13 nt, Shigella flexneri 2a str. 301
cccgacaccgccu

SEQ ID NO: 3907021 - RNA, 13 nt, Shigella flexneri 2a str. 301
cccgaccaaugca

SEQ ID NO: 3907022 - RNA, 14 nt, Shigella flexneri 2a str. 301
cccgaccaaugcau

SEQ ID NO: 3907023 - RNA, 16 nt, Shigella flexneri 2a str. 301
cccgacgaggcgcugg

SEQ ID NO: 3907024 - RNA, 18 nt, Shigella flexneri 2a str. 301
cccgacgauacaacgcuu

SEQ ID NO: 3907025 - RNA, 19 nt, Shigella flexneri 2a str. 301
cccgagauacaucaccgcc

SEQ ID NO: 3907026 - RNA, 14 nt, Shigella flexneri 2a str. 301
cccgagcacaugca

SEQ ID NO: 3907027 - RNA, 20 nt, Shigella flexneri 2a str. 301
cccgagcugcucgucagccg

SEQ ID NO: 3907028 - RNA, 13 nt, Shigella flexneri 2a str. 301
cccgaugaccuug

SEQ ID NO: 3907029 - RNA, 17 nt, Shigella flexneri 2a str. 301
cccgaugaugaugggcg

SEQ ID NO: 3907030 - RNA, 13 nt, Shigella flexneri 2a str. 301
cccgaugcaaaaa

SEQ ID NO: 3907031 - RNA, 22 nt, Shigella flexneri 2a str. 301
cccgaugccaucauggcgauga

SEQ ID NO: 3907032 - RNA, 20 nt, Shigella flexneri 2a str. 301
cccgauggucagcuucaccu

SEQ ID NO: 3907033 - RNA, 21 nt, Shigella flexneri 2a str. 301
cccgcacgcuuaauugaaccu

SEQ ID NO: 3907034 - RNA, 16 nt, Shigella flexneri 2a str. 301
cccgcacggccgcaag

SEQ ID NO: 3907035 - RNA, 18 nt, Shigella flexneri 2a str. 301
cccgcagccagcacugcc

SEQ ID NO: 3907036 - RNA, 14 nt, Shigella flexneri 2a str. 301
cccgcagcuccagc

SEQ ID NO: 3907037 - RNA, 15 nt, Shigella flexneri 2a str. 301
cccgcagcuccagcc

SEQ ID NO: 3907038 - RNA, 16 nt, Shigella flexneri 2a str. 301
cccgcauccgcugaug

SEQ ID NO: 3907039 - RNA, 18 nt, Shigella flexneri 2a str. 301
cccgcauccgcugaugca

SEQ ID NO: 3907040 - RNA, 16 nt, Shigella flexneri 2a str. 301
cccgcauuuacucuca

SEQ ID NO: 3907041 - RNA, 16 nt, Shigella flexneri 2a str. 301
cccgccaaccaccgcc

SEQ ID NO: 3907042 - RNA, 19 nt, Shigella flexneri 2a str. 301
cccgccaaccaccgccagu

SEQ ID NO: 3907043 - RNA, 12 nt, Shigella flexneri 2a str. 301
cccgccacccca

SEQ ID NO: 3907044 - RNA, 14 nt, Shigella flexneri 2a str. 301
cccgccaccggcuu

SEQ ID NO: 3907045 - RNA, 14 nt, Shigella flexneri 2a str. 301
cccgccagcagaau

SEQ ID NO: 3907046 - RNA, 11 nt, Shigella flexneri 2a str. 301
cccgccagcau

SEQ ID NO: 3907047 - RNA, 13 nt, Shigella flexneri 2a str. 301
cccgccagcgccu

SEQ ID NO: 3907048 - RNA, 20 nt, Shigella flexneri 2a str. 301
cccgccauaacggcugucca

SEQ ID NO: 3907049 - RNA, 18 nt, Shigella flexneri 2a str. 301
cccgccaucaucccuaca

SEQ ID NO: 3907050 - RNA, 14 nt, Shigella flexneri 2a str. 301
cccgccaucgccca

SEQ ID NO: 3907051 - RNA, 13 nt, Shigella flexneri 2a str. 301
cccgcccaaucga

SEQ ID NO: 3907052 - RNA, 15 nt, Shigella flexneri 2a str. 301
cccgccgccauccug

SEQ ID NO: 3907053 - RNA, 16 nt, Shigella flexneri 2a str. 301
cccgccggucaacgcg

SEQ ID NO: 3907054 - RNA, 17 nt, Shigella flexneri 2a str. 301
cccgccgugcugccagc

SEQ ID NO: 3907055 - RNA, 15 nt, Shigella flexneri 2a str. 301
cccgccugauagacc

SEQ ID NO: 3907056 - RNA, 20 nt, Shigella flexneri 2a str. 301
cccgcgaacggggcugccag

SEQ ID NO: 3907057 - RNA, 15 nt, Shigella flexneri 2a str. 301
cccgcgaccaccagc

SEQ ID NO: 3907058 - RNA, 13 nt, Shigella flexneri 2a str. 301
cccgcgacgcgcu

SEQ ID NO: 3907059 - RNA, 22 nt, Shigella flexneri 2a str. 301
cccgcgcaaaccaccuggcagu

SEQ ID NO: 3907060 - RNA, 17 nt, Shigella flexneri 2a str. 301
cccgcgccauauaauac

SEQ ID NO: 3907061 - RNA, 21 nt, Shigella flexneri 2a str. 301
cccgcgcgguaucaccaccca

SEQ ID NO: 3907062 - RNA, 19 nt, Shigella flexneri 2a str. 301
cccgcguuaagacacacua

SEQ ID NO: 3907063 - RNA, 12 nt, Shigella flexneri 2a str. 301
cccgcguucugg

SEQ ID NO: 3907064 - RNA, 22 nt, Shigella flexneri 2a str. 301
cccgcuaccugccgccaccaug

SEQ ID NO: 3907065 - RNA, 13 nt, Shigella flexneri 2a str. 301
cccgcucaaacac

SEQ ID NO: 3907066 - RNA, 20 nt, Shigella flexneri 2a str. 301
cccgcucaaacaccgucgca

SEQ ID NO: 3907067 - RNA, 13 nt, Shigella flexneri 2a str. 301
cccgcucauaaua

SEQ ID NO: 3907068 - RNA, 14 nt, Shigella flexneri 2a str. 301
cccgcucggcggcu

SEQ ID NO: 3907069 - RNA, 13 nt, Shigella flexneri 2a str. 301
cccgcugaaaagc

SEQ ID NO: 3907070 - RNA, 15 nt, Shigella flexneri 2a str. 301
cccgcugcugacuuu

SEQ ID NO: 3907071 - RNA, 17 nt, Shigella flexneri 2a str. 301
cccgcuguaaaugcugc

SEQ ID NO: 3907072 - RNA, 21 nt, Shigella flexneri 2a str. 301
cccgcuguuuguucaagcgca

SEQ ID NO: 3907073 - RNA, 15 nt, Shigella flexneri 2a str. 301
cccgcuucagccccg

SEQ ID NO: 3907074 - RNA, 11 nt, Shigella flexneri 2a str. 301
cccgcuuccag

SEQ ID NO: 3907075 - RNA, 18 nt, Shigella flexneri 2a str. 301
cccgcuuccugcagcgug

SEQ ID NO: 3907076 - RNA, 12 nt, Shigella flexneri 2a str. 301
cccgcuucgccc

SEQ ID NO: 3907077 - RNA, 15 nt, Shigella flexneri 2a str. 301
cccgcuucgcccgcc

SEQ ID NO: 3907078 - RNA, 20 nt, Shigella flexneri 2a str. 301
cccgcuucguuuucagcuuc

SEQ ID NO: 3907079 - RNA, 22 nt, Shigella flexneri 2a str. 301
cccgcuucuucugccgcuucca

SEQ ID NO: 3907080 - RNA, 23 nt, Shigella flexneri 2a str. 301
cccgcuuuggcgucuucugccgg

SEQ ID NO: 3907081 - RNA, 20 nt, Shigella flexneri 2a str. 301
cccgcuuuuuugucaccuuu

SEQ ID NO: 3907082 - RNA, 14 nt, Shigella flexneri 2a str. 301
cccggaacgggaga

SEQ ID NO: 3907083 - RNA, 13 nt, Shigella flexneri 2a str. 301
cccggaagccacc

SEQ ID NO: 3907084 - RNA, 23 nt, Shigella flexneri 2a str. 301
cccggaagccaccacgccaagaa

SEQ ID NO: 3907085 - RNA, 17 nt, Shigella flexneri 2a str. 301
cccggauauccacccgc

SEQ ID NO: 3907086 - RNA, 23 nt, Shigella flexneri 2a str. 301
cccggauuuggcaaaugcaucag

SEQ ID NO: 3907087 - RNA, 23 nt, Shigella flexneri 2a str. 301
cccggcaaaauagaguguuccuc

SEQ ID NO: 3907088 - RNA, 18 nt, Shigella flexneri 2a str. 301
cccggcaaaugucggggu

SEQ ID NO: 3907089 - RNA, 23 nt, Shigella flexneri 2a str. 301
cccggcaagaaauaccgaagagu

SEQ ID NO: 3907090 - RNA, 18 nt, Shigella flexneri 2a str. 301
cccggcaaucaccgccag

SEQ ID NO: 3907091 - RNA, 21 nt, Shigella flexneri 2a str. 301
cccggcaaucaccgccagcgg

SEQ ID NO: 3907092 - RNA, 18 nt, Shigella flexneri 2a str. 301
cccggcaauggguaacgg

SEQ ID NO: 3907093 - RNA, 20 nt, Shigella flexneri 2a str. 301
cccggcacguuuuggcagac

SEQ ID NO: 3907094 - RNA, 12 nt, Shigella flexneri 2a str. 301
cccggcagagaa

SEQ ID NO: 3907095 - RNA, 15 nt, Shigella flexneri 2a str. 301
cccggcagagaaaau

SEQ ID NO: 3907096 - RNA, 15 nt, Shigella flexneri 2a str. 301
cccggcaucgcauuc

SEQ ID NO: 3907097 - RNA, 17 nt, Shigella flexneri 2a str. 301
cccggcauucaccucug

SEQ ID NO: 3907098 - RNA, 20 nt, Shigella flexneri 2a str. 301
cccggcggcgcgccaggcgc

SEQ ID NO: 3907099 - RNA, 16 nt, Shigella flexneri 2a str. 301
cccggcgguauaccau

SEQ ID NO: 3907100 - RNA, 18 nt, Shigella flexneri 2a str. 301
cccggcgucgcauccgac

SEQ ID NO: 3907101 - RNA, 15 nt, Shigella flexneri 2a str. 301
cccgguaccuuugaa

SEQ ID NO: 3907102 - RNA, 14 nt, Shigella flexneri 2a str. 301
cccgguaucaaacc

SEQ ID NO: 3907103 - RNA, 14 nt, Shigella flexneri 2a str. 301
cccggucaugauac

SEQ ID NO: 3907104 - RNA, 13 nt, Shigella flexneri 2a str. 301
cccggucccuuca

SEQ ID NO: 3907105 - RNA, 17 nt, Shigella flexneri 2a str. 301
cccggucuuuucucauu

SEQ ID NO: 3907106 - RNA, 19 nt, Shigella flexneri 2a str. 301
cccgguguucccgcgccag

SEQ ID NO: 3907107 - RNA, 14 nt, Shigella flexneri 2a str. 301
cccgguugacugcu

SEQ ID NO: 3907108 - RNA, 21 nt, Shigella flexneri 2a str. 301
cccgguugcuuuucacaaccg

SEQ ID NO: 3907109 - RNA, 15 nt, Shigella flexneri 2a str. 301
cccgguuucucuucu

SEQ ID NO: 3907110 - RNA, 15 nt, Shigella flexneri 2a str. 301
cccgguuuucgcgcg

SEQ ID NO: 3907111 - RNA, 13 nt, Shigella flexneri 2a str. 301
cccguaacauggc

SEQ ID NO: 3907112 - RNA, 14 nt, Shigella flexneri 2a str. 301
cccguacgcugugg

SEQ ID NO: 3907113 - RNA, 15 nt, Shigella flexneri 2a str. 301
cccgucaccacuuca

SEQ ID NO: 3907114 - RNA, 21 nt, Shigella flexneri 2a str. 301
cccgucagagcaccaucgcug

SEQ ID NO: 3907115 - RNA, 17 nt, Shigella flexneri 2a str. 301
cccgucgaagacucuua

SEQ ID NO: 3907116 - RNA, 16 nt, Shigella flexneri 2a str. 301
cccgucguugcaauca

SEQ ID NO: 3907117 - RNA, 18 nt, Shigella flexneri 2a str. 301
cccgucugacgcgugccu

SEQ ID NO: 3907118 - RNA, 22 nt, Shigella flexneri 2a str. 301
cccgugacacacugaaccgcgc

SEQ ID NO: 3907119 - RNA, 17 nt, Shigella flexneri 2a str. 301
cccgugggcaggccugg

SEQ ID NO: 3907120 - RNA, 18 nt, Shigella flexneri 2a str. 301
cccguuacgauucucugc

SEQ ID NO: 3907121 - RNA, 19 nt, Shigella flexneri 2a str. 301
cccguucauccgcuucagg

SEQ ID NO: 3907122 - RNA, 19 nt, Shigella flexneri 2a str. 301
cccguuucagccccuugcu

SEQ ID NO: 3907123 - RNA, 13 nt, Shigella flexneri 2a str. 301
cccguuucccugu

SEQ ID NO: 3907124 - RNA, 14 nt, Shigella flexneri 2a str. 301
cccguuuucaccuu

SEQ ID NO: 3907125 - RNA, 14 nt, Shigella flexneri 2a str. 301
cccuaacucuuuca

SEQ ID NO: 3907126 - RNA, 20 nt, Shigella flexneri 2a str. 301
cccuaacugacgggcggcuu

SEQ ID NO: 3907127 - RNA, 16 nt, Shigella flexneri 2a str. 301
cccuaaucccgugccg

SEQ ID NO: 3907128 - RNA, 15 nt, Shigella flexneri 2a str. 301
cccucaaacaacaca

SEQ ID NO: 3907129 - RNA, 19 nt, Shigella flexneri 2a str. 301
cccucacccuaacccucuc

SEQ ID NO: 3907130 - RNA, 20 nt, Shigella flexneri 2a str. 301
cccucacccuaacccucucc

SEQ ID NO: 3907131 - RNA, 22 nt, Shigella flexneri 2a str. 301
cccucacccuaacccucucccc

SEQ ID NO: 3907132 - RNA, 18 nt, Shigella flexneri 2a str. 301
cccucagccagacagcau

SEQ ID NO: 3907133 - RNA, 18 nt, Shigella flexneri 2a str. 301
cccucauuccuccccgaa

SEQ ID NO: 3907134 - RNA, 19 nt, Shigella flexneri 2a str. 301
cccucccguuucccugucu

SEQ ID NO: 3907135 - RNA, 17 nt, Shigella flexneri 2a str. 301
cccuccugauaacacag

SEQ ID NO: 3907136 - RNA, 16 nt, Shigella flexneri 2a str. 301
cccucgaccaucuccu

SEQ ID NO: 3907137 - RNA, 19 nt, Shigella flexneri 2a str. 301
cccucgaucggcucuuccg

SEQ ID NO: 3907138 - RNA, 14 nt, Shigella flexneri 2a str. 301
cccucgcccccuug

SEQ ID NO: 3907139 - RNA, 14 nt, Shigella flexneri 2a str. 301
cccucgccccuccg

SEQ ID NO: 3907140 - RNA, 23 nt, Shigella flexneri 2a str. 301
cccucguuuugccgccaucaucg

SEQ ID NO: 3907141 - RNA, 14 nt, Shigella flexneri 2a str. 301
cccucuccccagaa

SEQ ID NO: 3907142 - RNA, 22 nt, Shigella flexneri 2a str. 301
cccucugaucaguuguuaguaa

SEQ ID NO: 3907143 - RNA, 22 nt, Shigella flexneri 2a str. 301
cccucugcggcucucagccgca

SEQ ID NO: 3907144 - RNA, 22 nt, Shigella flexneri 2a str. 301
cccugaauaacaccagccagaa

SEQ ID NO: 3907145 - RNA, 14 nt, Shigella flexneri 2a str. 301
cccugaaucaauca

SEQ ID NO: 3907146 - RNA, 14 nt, Shigella flexneri 2a str. 301
cccugacgaccacc

SEQ ID NO: 3907147 - RNA, 16 nt, Shigella flexneri 2a str. 301
cccugagcaucaauac

SEQ ID NO: 3907148 - RNA, 17 nt, Shigella flexneri 2a str. 301
cccugagcguuacccgc

SEQ ID NO: 3907149 - RNA, 10 nt, Shigella flexneri 2a str. 301
cccugaguga

SEQ ID NO: 3907150 - RNA, 14 nt, Shigella flexneri 2a str. 301
cccugauaaaucac

SEQ ID NO: 3907151 - RNA, 15 nt, Shigella flexneri 2a str. 301
cccugauaaccgcau

SEQ ID NO: 3907152 - RNA, 22 nt, Shigella flexneri 2a str. 301
cccugauaauggcguauuucac

SEQ ID NO: 3907153 - RNA, 20 nt, Shigella flexneri 2a str. 301
cccugcaaauuauuugcgua

SEQ ID NO: 3907154 - RNA, 18 nt, Shigella flexneri 2a str. 301
cccugcaauuauuaaccu

SEQ ID NO: 3907155 - RNA, 23 nt, Shigella flexneri 2a str. 301
cccugcacauuugugaacgccag

SEQ ID NO: 3907156 - RNA, 21 nt, Shigella flexneri 2a str. 301
cccugcacuuaacaggaucug

SEQ ID NO: 3907157 - RNA, 15 nt, Shigella flexneri 2a str. 301
cccugcagcuggucg

SEQ ID NO: 3907158 - RNA, 14 nt, Shigella flexneri 2a str. 301
cccugcagucaccu

SEQ ID NO: 3907159 - RNA, 18 nt, Shigella flexneri 2a str. 301
cccugcagucaccugccc

SEQ ID NO: 3907160 - RNA, 22 nt, Shigella flexneri 2a str. 301
cccugcagucaccugcccuccg

SEQ ID NO: 3907161 - RNA, 23 nt, Shigella flexneri 2a str. 301
cccugccaggucaucauugcagu

SEQ ID NO: 3907162 - RNA, 13 nt, Shigella flexneri 2a str. 301
cccugcccgcgau

SEQ ID NO: 3907163 - RNA, 15 nt, Shigella flexneri 2a str. 301
cccugcgauugugac

SEQ ID NO: 3907164 - RNA, 15 nt, Shigella flexneri 2a str. 301
cccugcgccagcggc

SEQ ID NO: 3907165 - RNA, 19 nt, Shigella flexneri 2a str. 301
cccugcgcggcgacuucca

SEQ ID NO: 3907166 - RNA, 19 nt, Shigella flexneri 2a str. 301
cccugcgcuaaacaggauc

SEQ ID NO: 3907167 - RNA, 20 nt, Shigella flexneri 2a str. 301
cccugcgcuaaacaggaucu

SEQ ID NO: 3907168 - RNA, 22 nt, Shigella flexneri 2a str. 301
cccugcgcuaaacaggaucugg

SEQ ID NO: 3907169 - RNA, 18 nt, Shigella flexneri 2a str. 301
cccugcgcuggugaaaac

SEQ ID NO: 3907170 - RNA, 15 nt, Shigella flexneri 2a str. 301
cccugcggcugacca

SEQ ID NO: 3907171 - RNA, 17 nt, Shigella flexneri 2a str. 301
cccugcggcugaccacc

SEQ ID NO: 3907172 - RNA, 15 nt, Shigella flexneri 2a str. 301
cccugcggcugcuga

SEQ ID NO: 3907173 - RNA, 20 nt, Shigella flexneri 2a str. 301
cccugcuaugcaagauguua

SEQ ID NO: 3907174 - RNA, 22 nt, Shigella flexneri 2a str. 301
cccugcucgucggcaaagcggg

SEQ ID NO: 3907175 - RNA, 14 nt, Shigella flexneri 2a str. 301
cccugcucuuucag

SEQ ID NO: 3907176 - RNA, 15 nt, Shigella flexneri 2a str. 301
cccugcucuuucagc

SEQ ID NO: 3907177 - RNA, 21 nt, Shigella flexneri 2a str. 301
cccugcucuuucagcaccgcg

SEQ ID NO: 3907178 - RNA, 20 nt, Shigella flexneri 2a str. 301
cccuggaagaaaaacuggcg

SEQ ID NO: 3907179 - RNA, 20 nt, Shigella flexneri 2a str. 301
cccuggcaauagcgcacgcc

SEQ ID NO: 3907180 - RNA, 21 nt, Shigella flexneri 2a str. 301
cccuggcgaugcccccagcag

SEQ ID NO: 3907181 - RNA, 15 nt, Shigella flexneri 2a str. 301
cccugggcuucaucc

SEQ ID NO: 3907182 - RNA, 21 nt, Shigella flexneri 2a str. 301
cccugggcuucauccagcagu

SEQ ID NO: 3907183 - RNA, 17 nt, Shigella flexneri 2a str. 301
cccugguaaaaaaugau

SEQ ID NO: 3907184 - RNA, 19 nt, Shigella flexneri 2a str. 301
cccuggucaguuucagcca

SEQ ID NO: 3907185 - RNA, 22 nt, Shigella flexneri 2a str. 301
cccugguggcauugguugcugg

SEQ ID NO: 3907186 - RNA, 13 nt, Shigella flexneri 2a str. 301
cccuguugccugc

SEQ ID NO: 3907187 - RNA, 22 nt, Shigella flexneri 2a str. 301
cccuguuuuauuucccgcccgc

SEQ ID NO: 3907188 - RNA, 14 nt, Shigella flexneri 2a str. 301
cccuuacccuuacu

SEQ ID NO: 3907189 - RNA, 22 nt, Shigella flexneri 2a str. 301
cccuuacgcguucauacuuuuc

SEQ ID NO: 3907190 - RNA, 17 nt, Shigella flexneri 2a str. 301
cccuuaucgggaagcgg

SEQ ID NO: 3907191 - RNA, 20 nt, Shigella flexneri 2a str. 301
cccuucacgacauaaacauu

SEQ ID NO: 3907192 - RNA, 18 nt, Shigella flexneri 2a str. 301
cccuucacucugcugcca

SEQ ID NO: 3907193 - RNA, 17 nt, Shigella flexneri 2a str. 301
cccuucagccaccaggu

SEQ ID NO: 3907194 - RNA, 13 nt, Shigella flexneri 2a str. 301
cccuucaucgcuc

SEQ ID NO: 3907195 - RNA, 19 nt, Shigella flexneri 2a str. 301
cccuucaucgcuccugccg

SEQ ID NO: 3907196 - RNA, 15 nt, Shigella flexneri 2a str. 301
cccuucauucaggug

SEQ ID NO: 3907197 - RNA, 14 nt, Shigella flexneri 2a str. 301
cccuuccagcacga

SEQ ID NO: 3907198 - RNA, 18 nt, Shigella flexneri 2a str. 301
cccuuccccguucugcca

SEQ ID NO: 3907199 - RNA, 14 nt, Shigella flexneri 2a str. 301
cccuucgccgccgc

SEQ ID NO: 3907200 - RNA, 17 nt, Shigella flexneri 2a str. 301
cccuucguaggcagcau

SEQ ID NO: 3907201 - RNA, 16 nt, Shigella flexneri 2a str. 301
cccuucguucucugca

SEQ ID NO: 3907202 - RNA, 15 nt, Shigella flexneri 2a str. 301
cccuucugcacgcca

SEQ ID NO: 3907203 - RNA, 22 nt, Shigella flexneri 2a str. 301
cccuucuggucaugaaccugcc

SEQ ID NO: 3907204 - RNA, 12 nt, Shigella flexneri 2a str. 301
cccuucuucaau

SEQ ID NO: 3907205 - RNA, 16 nt, Shigella flexneri 2a str. 301
cccuucuuucacuuca

SEQ ID NO: 3907206 - RNA, 18 nt, Shigella flexneri 2a str. 301
cccuugauaaacgccgcc

SEQ ID NO: 3907207 - RNA, 21 nt, Shigella flexneri 2a str. 301
cccuugauaaacgccgccagu

SEQ ID NO: 3907208 - RNA, 23 nt, Shigella flexneri 2a str. 301
cccuugaugcagauucggguuca

SEQ ID NO: 3907209 - RNA, 14 nt, Shigella flexneri 2a str. 301
cccuugcucaauga

SEQ ID NO: 3907210 - RNA, 21 nt, Shigella flexneri 2a str. 301
cccuugcucugguucaccauu

SEQ ID NO: 3907211 - RNA, 18 nt, Shigella flexneri 2a str. 301
cccuugcugacuccccga

SEQ ID NO: 3907212 - RNA, 19 nt, Shigella flexneri 2a str. 301
cccuugcuucgccaguucg

SEQ ID NO: 3907213 - RNA, 16 nt, Shigella flexneri 2a str. 301
cccuuggggagagggu

SEQ ID NO: 3907214 - RNA, 13 nt, Shigella flexneri 2a str. 301
cccuuucugcauc

SEQ ID NO: 3907215 - RNA, 14 nt, Shigella flexneri 2a str. 301
ccgaaaaaccugac

SEQ ID NO: 3907216 - RNA, 12 nt, Shigella flexneri 2a str. 301
ccgaaaaaggau

SEQ ID NO: 3907217 - RNA, 17 nt, Shigella flexneri 2a str. 301
ccgaacaacaagaagcg

SEQ ID NO: 3907218 - RNA, 19 nt, Shigella flexneri 2a str. 301
ccgaacaacaagaagcguu

SEQ ID NO: 3907219 - RNA, 15 nt, Shigella flexneri 2a str. 301
ccgaacagcacaacg

SEQ ID NO: 3907220 - RNA, 22 nt, Shigella flexneri 2a str. 301
ccgaacagcgccagacaaacca

SEQ ID NO: 3907221 - RNA, 14 nt, Shigella flexneri 2a str. 301
ccgaaccggacgau

SEQ ID NO: 3907222 - RNA, 16 nt, Shigella flexneri 2a str. 301
ccgaaccgggcgcgag

SEQ ID NO: 3907223 - RNA, 19 nt, Shigella flexneri 2a str. 301
ccgaacucaucucucguug

SEQ ID NO: 3907224 - RNA, 15 nt, Shigella flexneri 2a str. 301
ccgaacuuugcaccc

SEQ ID NO: 3907225 - RNA, 23 nt, Shigella flexneri 2a str. 301
ccgaagaaauagaaacuggcccu

SEQ ID NO: 3907226 - RNA, 12 nt, Shigella flexneri 2a str. 301
ccgaagacaucg

SEQ ID NO: 3907227 - RNA, 22 nt, Shigella flexneri 2a str. 301
ccgaagagggggcgauagaaua

SEQ ID NO: 3907228 - RNA, 21 nt, Shigella flexneri 2a str. 301
ccgaagcccaucaguacacca

SEQ ID NO: 3907229 - RNA, 22 nt, Shigella flexneri 2a str. 301
ccgaagcccaucaguacaccac

SEQ ID NO: 3907230 - RNA, 21 nt, Shigella flexneri 2a str. 301
ccgaagcggcguuccaccgcu

SEQ ID NO: 3907231 - RNA, 17 nt, Shigella flexneri 2a str. 301
ccgaaggugcacuagac

SEQ ID NO: 3907232 - RNA, 18 nt, Shigella flexneri 2a str. 301
ccgaaguuguagcuggcu

SEQ ID NO: 3907233 - RNA, 14 nt, Shigella flexneri 2a str. 301
ccgaauacggucuu

SEQ ID NO: 3907234 - RNA, 15 nt, Shigella flexneri 2a str. 301
ccgaauccaguaagc

SEQ ID NO: 3907235 - RNA, 13 nt, Shigella flexneri 2a str. 301
ccgaauccgggaa

SEQ ID NO: 3907236 - RNA, 16 nt, Shigella flexneri 2a str. 301
ccgaaugaccgccccu

SEQ ID NO: 3907237 - RNA, 19 nt, Shigella flexneri 2a str. 301
ccgaaugaccgccccugcg

SEQ ID NO: 3907238 - RNA, 16 nt, Shigella flexneri 2a str. 301
ccgaauuucauccugu

SEQ ID NO: 3907239 - RNA, 17 nt, Shigella flexneri 2a str. 301
ccgacaaauuucaucgc

SEQ ID NO: 3907240 - RNA, 15 nt, Shigella flexneri 2a str. 301
ccgacaccgccucca

SEQ ID NO: 3907241 - RNA, 12 nt, Shigella flexneri 2a str. 301
ccgacauugaag

SEQ ID NO: 3907242 - RNA, 21 nt, Shigella flexneri 2a str. 301
ccgacauugaaggauaagacg

SEQ ID NO: 3907243 - RNA, 14 nt, Shigella flexneri 2a str. 301
ccgacauugccagc

SEQ ID NO: 3907244 - RNA, 17 nt, Shigella flexneri 2a str. 301
ccgacauuucugcugcc

SEQ ID NO: 3907245 - RNA, 13 nt, Shigella flexneri 2a str. 301
ccgaccacuucca

SEQ ID NO: 3907246 - RNA, 15 nt, Shigella flexneri 2a str. 301
ccgaccgcaaggaag

SEQ ID NO: 3907247 - RNA, 22 nt, Shigella flexneri 2a str. 301
ccgaccgcaaggaagccugaca

SEQ ID NO: 3907248 - RNA, 12 nt, Shigella flexneri 2a str. 301
ccgaccgcuuca

SEQ ID NO: 3907249 - RNA, 20 nt, Shigella flexneri 2a str. 301
ccgaccuacaaaaccugcac

SEQ ID NO: 3907250 - RNA, 12 nt, Shigella flexneri 2a str. 301
ccgaccuucacg

SEQ ID NO: 3907251 - RNA, 19 nt, Shigella flexneri 2a str. 301
ccgaccuucacgcugcgca

SEQ ID NO: 3907252 - RNA, 23 nt, Shigella flexneri 2a str. 301
ccgacgagaaaugucggcccgca

SEQ ID NO: 3907253 - RNA, 18 nt, Shigella flexneri 2a str. 301
ccgacgauaccgccgcac

SEQ ID NO: 3907254 - RNA, 19 nt, Shigella flexneri 2a str. 301
ccgacgauguuagcggcga

SEQ ID NO: 3907255 - RNA, 13 nt, Shigella flexneri 2a str. 301
ccgacgugcagca

SEQ ID NO: 3907256 - RNA, 15 nt, Shigella flexneri 2a str. 301
ccgacgugcagcauc

SEQ ID NO: 3907257 - RNA, 16 nt, Shigella flexneri 2a str. 301
ccgacgugcagcaucg

SEQ ID NO: 3907258 - RNA, 23 nt, Shigella flexneri 2a str. 301
ccgacgugguuaacgaccagcgg

SEQ ID NO: 3907259 - RNA, 14 nt, Shigella flexneri 2a str. 301
ccgacguuugcgcc

SEQ ID NO: 3907260 - RNA, 17 nt, Shigella flexneri 2a str. 301
ccgacugcgccaauacc

SEQ ID NO: 3907261 - RNA, 13 nt, Shigella flexneri 2a str. 301
ccgacuuauucuu

SEQ ID NO: 3907262 - RNA, 22 nt, Shigella flexneri 2a str. 301
ccgagaaaaauagcauuaaugc

SEQ ID NO: 3907263 - RNA, 14 nt, Shigella flexneri 2a str. 301
ccgagaaccggcgc

SEQ ID NO: 3907264 - RNA, 21 nt, Shigella flexneri 2a str. 301
ccgagaagauuuuuugccagc

SEQ ID NO: 3907265 - RNA, 11 nt, Shigella flexneri 2a str. 301
ccgagcaaacc

SEQ ID NO: 3907266 - RNA, 19 nt, Shigella flexneri 2a str. 301
ccgagcaaaucgcggcagu

SEQ ID NO: 3907267 - RNA, 15 nt, Shigella flexneri 2a str. 301
ccgagcaccacguug

SEQ ID NO: 3907268 - RNA, 11 nt, Shigella flexneri 2a str. 301
ccgagcagcca

SEQ ID NO: 3907269 - RNA, 13 nt, Shigella flexneri 2a str. 301
ccgagcagccacu

SEQ ID NO: 3907270 - RNA, 14 nt, Shigella flexneri 2a str. 301
ccgagcagccacug

SEQ ID NO: 3907271 - RNA, 15 nt, Shigella flexneri 2a str. 301
ccgagccgguugccu

SEQ ID NO: 3907272 - RNA, 15 nt, Shigella flexneri 2a str. 301
ccgagcgccaccauc

SEQ ID NO: 3907273 - RNA, 13 nt, Shigella flexneri 2a str. 301
ccgagcuggaaca

SEQ ID NO: 3907274 - RNA, 17 nt, Shigella flexneri 2a str. 301
ccgagcuuaugcaauag

SEQ ID NO: 3907275 - RNA, 23 nt, Shigella flexneri 2a str. 301
ccgagcuuaugcaauagcgccug

SEQ ID NO: 3907276 - RNA, 18 nt, Shigella flexneri 2a str. 301
ccgaggaucacaaugcca

SEQ ID NO: 3907277 - RNA, 16 nt, Shigella flexneri 2a str. 301
ccgaggcauucagcca

SEQ ID NO: 3907278 - RNA, 20 nt, Shigella flexneri 2a str. 301
ccgaggcgcuggcagaaggc

SEQ ID NO: 3907279 - RNA, 23 nt, Shigella flexneri 2a str. 301
ccgaguggcauuucgccaaacca

SEQ ID NO: 3907280 - RNA, 20 nt, Shigella flexneri 2a str. 301
ccgaguuguugagguucgga

SEQ ID NO: 3907281 - RNA, 23 nt, Shigella flexneri 2a str. 301
ccgauaaaacgguuuauccccaa

SEQ ID NO: 3907282 - RNA, 18 nt, Shigella flexneri 2a str. 301
ccgauaaaggucgacagc

SEQ ID NO: 3907283 - RNA, 22 nt, Shigella flexneri 2a str. 301
ccgauaaaggucgacagcagcc

SEQ ID NO: 3907284 - RNA, 20 nt, Shigella flexneri 2a str. 301
ccgauaaucaacaaaccaaa

SEQ ID NO: 3907285 - RNA, 21 nt, Shigella flexneri 2a str. 301
ccgauaaucaacgcgccgcca

SEQ ID NO: 3907286 - RNA, 21 nt, Shigella flexneri 2a str. 301
ccgauaccaauguagccgcgg

SEQ ID NO: 3907287 - RNA, 13 nt, Shigella flexneri 2a str. 301
ccgauaccaucac

SEQ ID NO: 3907288 - RNA, 12 nt, Shigella flexneri 2a str. 301
ccgauauccgcc

SEQ ID NO: 3907289 - RNA, 13 nt, Shigella flexneri 2a str. 301
ccgaucaaggcau

SEQ ID NO: 3907290 - RNA, 16 nt, Shigella flexneri 2a str. 301
ccgaucaauuucacag

SEQ ID NO: 3907291 - RNA, 18 nt, Shigella flexneri 2a str. 301
ccgaucaucaaaaaacac

SEQ ID NO: 3907292 - RNA, 22 nt, Shigella flexneri 2a str. 301
ccgaucaucacgaucgcuucgg

SEQ ID NO: 3907293 - RNA, 14 nt, Shigella flexneri 2a str. 301
ccgaucaucaucca

SEQ ID NO: 3907294 - RNA, 20 nt, Shigella flexneri 2a str. 301
ccgaucggcuggcauuuuua

SEQ ID NO: 3907295 - RNA, 14 nt, Shigella flexneri 2a str. 301
ccgaucucaccgau

SEQ ID NO: 3907296 - RNA, 17 nt, Shigella flexneri 2a str. 301
ccgaugaccuugucaug

SEQ ID NO: 3907297 - RNA, 18 nt, Shigella flexneri 2a str. 301
ccgaugcgcaaacuuauc

SEQ ID NO: 3907298 - RNA, 13 nt, Shigella flexneri 2a str. 301
ccgaugcgcgaac

SEQ ID NO: 3907299 - RNA, 18 nt, Shigella flexneri 2a str. 301
ccgauggucacggacagg

SEQ ID NO: 3907300 - RNA, 18 nt, Shigella flexneri 2a str. 301
ccgauuaauugccgccag

SEQ ID NO: 3907301 - RNA, 17 nt, Shigella flexneri 2a str. 301
ccgauuacucagcaacu

SEQ ID NO: 3907302 - RNA, 19 nt, Shigella flexneri 2a str. 301
ccgauucccgggcacacuu

SEQ ID NO: 3907303 - RNA, 15 nt, Shigella flexneri 2a str. 301
ccgauugauucccaa

SEQ ID NO: 3907304 - RNA, 13 nt, Shigella flexneri 2a str. 301
ccgauugccggau

SEQ ID NO: 3907305 - RNA, 20 nt, Shigella flexneri 2a str. 301
ccgauuucaugaagcugaca

SEQ ID NO: 3907306 - RNA, 17 nt, Shigella flexneri 2a str. 301
ccgcaaaaccaacgccu

SEQ ID NO: 3907307 - RNA, 14 nt, Shigella flexneri 2a str. 301
ccgcaaagcccauc

SEQ ID NO: 3907308 - RNA, 14 nt, Shigella flexneri 2a str. 301
ccgcaacaaugccg

SEQ ID NO: 3907309 - RNA, 15 nt, Shigella flexneri 2a str. 301
ccgcaacagcaauac

SEQ ID NO: 3907310 - RNA, 21 nt, Shigella flexneri 2a str. 301
ccgcaacagcaauacguuuca

SEQ ID NO: 3907311 - RNA, 23 nt, Shigella flexneri 2a str. 301
ccgcaacauacugcccgagcgcc

SEQ ID NO: 3907312 - RNA, 23 nt, Shigella flexneri 2a str. 301
ccgcaaccggccguaagaaaguc

SEQ ID NO: 3907313 - RNA, 22 nt, Shigella flexneri 2a str. 301
ccgcaacgccuaucaccagaag

SEQ ID NO: 3907314 - RNA, 15 nt, Shigella flexneri 2a str. 301
ccgcaagcagacgcu

SEQ ID NO: 3907315 - RNA, 17 nt, Shigella flexneri 2a str. 301
ccgcaaggaagccugac

SEQ ID NO: 3907316 - RNA, 22 nt, Shigella flexneri 2a str. 301
ccgcaauacagccagccagcac

SEQ ID NO: 3907317 - RNA, 14 nt, Shigella flexneri 2a str. 301
ccgcaauuccggug

SEQ ID NO: 3907318 - RNA, 14 nt, Shigella flexneri 2a str. 301
ccgcaccaccagca

SEQ ID NO: 3907319 - RNA, 12 nt, Shigella flexneri 2a str. 301
ccgcaccagcgg

SEQ ID NO: 3907320 - RNA, 21 nt, Shigella flexneri 2a str. 301
ccgcaccccugauaaccgcau

SEQ ID NO: 3907321 - RNA, 16 nt, Shigella flexneri 2a str. 301
ccgcaccugccagcgc

SEQ ID NO: 3907322 - RNA, 22 nt, Shigella flexneri 2a str. 301
ccgcacgcagaaucucugcgcu

SEQ ID NO: 3907323 - RNA, 12 nt, Shigella flexneri 2a str. 301
ccgcacgcuuca

SEQ ID NO: 3907324 - RNA, 17 nt, Shigella flexneri 2a str. 301
ccgcacucaucuuauug

SEQ ID NO: 3907325 - RNA, 22 nt, Shigella flexneri 2a str. 301
ccgcacucguaucaccccgccc

SEQ ID NO: 3907326 - RNA, 16 nt, Shigella flexneri 2a str. 301
ccgcagaaaaagagca

SEQ ID NO: 3907327 - RNA, 23 nt, Shigella flexneri 2a str. 301
ccgcagaaaaagagcaucagcag

SEQ ID NO: 3907328 - RNA, 16 nt, Shigella flexneri 2a str. 301
ccgcagagauagaacu

SEQ ID NO: 3907329 - RNA, 21 nt, Shigella flexneri 2a str. 301
ccgcagagaucgccccggcaa

SEQ ID NO: 3907330 - RNA, 15 nt, Shigella flexneri 2a str. 301
ccgcagaucagacca

SEQ ID NO: 3907331 - RNA, 21 nt, Shigella flexneri 2a str. 301
ccgcagaucagaccaauccag

SEQ ID NO: 3907332 - RNA, 14 nt, Shigella flexneri 2a str. 301
ccgcagccaucaac

SEQ ID NO: 3907333 - RNA, 21 nt, Shigella flexneri 2a str. 301
ccgcagccaucacugacugcg

SEQ ID NO: 3907334 - RNA, 14 nt, Shigella flexneri 2a str. 301
ccgcagccaucagc

SEQ ID NO: 3907335 - RNA, 13 nt, Shigella flexneri 2a str. 301
ccgcagcuccagc

SEQ ID NO: 3907336 - RNA, 16 nt, Shigella flexneri 2a str. 301
ccgcaggcgcaauggc

SEQ ID NO: 3907337 - RNA, 17 nt, Shigella flexneri 2a str. 301
ccgcaguaaagcgcagg

SEQ ID NO: 3907338 - RNA, 18 nt, Shigella flexneri 2a str. 301
ccgcagugauuucaaccg

SEQ ID NO: 3907339 - RNA, 22 nt, Shigella flexneri 2a str. 301
ccgcaguuaaagcaauuccagc

SEQ ID NO: 3907340 - RNA, 23 nt, Shigella flexneri 2a str. 301
ccgcaguuaaagcaauuccagcg

SEQ ID NO: 3907341 - RNA, 23 nt, Shigella flexneri 2a str. 301
ccgcauaugcgggcguuuugcuu

SEQ ID NO: 3907342 - RNA, 14 nt, Shigella flexneri 2a str. 301
ccgcaucacgacag

SEQ ID NO: 3907343 - RNA, 15 nt, Shigella flexneri 2a str. 301
ccgcaucacgacagc

SEQ ID NO: 3907344 - RNA, 12 nt, Shigella flexneri 2a str. 301
ccgcauccggca

SEQ ID NO: 3907345 - RNA, 19 nt, Shigella flexneri 2a str. 301
ccgcauccggcaauaagca

SEQ ID NO: 3907346 - RNA, 15 nt, Shigella flexneri 2a str. 301
ccgcauccggcaauu

SEQ ID NO: 3907347 - RNA, 19 nt, Shigella flexneri 2a str. 301
ccgcauccggcauaaacaa

SEQ ID NO: 3907348 - RNA, 18 nt, Shigella flexneri 2a str. 301
ccgcauccgggccagcgg

SEQ ID NO: 3907349 - RNA, 19 nt, Shigella flexneri 2a str. 301
ccgcauccgggccagcggc

SEQ ID NO: 3907350 - RNA, 21 nt, Shigella flexneri 2a str. 301
ccgcauccggugauuuucauc

SEQ ID NO: 3907351 - RNA, 22 nt, Shigella flexneri 2a str. 301
ccgcaucuucccagguuucaau

SEQ ID NO: 3907352 - RNA, 15 nt, Shigella flexneri 2a str. 301
ccgcaugcucacaga

SEQ ID NO: 3907353 - RNA, 18 nt, Shigella flexneri 2a str. 301
ccgcauggaaccaguuca

SEQ ID NO: 3907354 - RNA, 18 nt, Shigella flexneri 2a str. 301
ccgcauuauuucccggcu

SEQ ID NO: 3907355 - RNA, 19 nt, Shigella flexneri 2a str. 301
ccgccaaaacgguccggca

SEQ ID NO: 3907356 - RNA, 14 nt, Shigella flexneri 2a str. 301
ccgccaaacgcggu

SEQ ID NO: 3907357 - RNA, 14 nt, Shigella flexneri 2a str. 301
ccgccaaccagcgc

SEQ ID NO: 3907358 - RNA, 19 nt, Shigella flexneri 2a str. 301
ccgccaauucguaaguaca

SEQ ID NO: 3907359 - RNA, 16 nt, Shigella flexneri 2a str. 301
ccgccaauuucaucac

SEQ ID NO: 3907360 - RNA, 12 nt, Shigella flexneri 2a str. 301
ccgccaauuucu

SEQ ID NO: 3907361 - RNA, 12 nt, Shigella flexneri 2a str. 301
ccgccacagcgc

SEQ ID NO: 3907362 - RNA, 14 nt, Shigella flexneri 2a str. 301
ccgccacagcgcca

SEQ ID NO: 3907363 - RNA, 17 nt, Shigella flexneri 2a str. 301
ccgccacgaccugcaga

SEQ ID NO: 3907364 - RNA, 15 nt, Shigella flexneri 2a str. 301
ccgccacgcccuccu

SEQ ID NO: 3907365 - RNA, 22 nt, Shigella flexneri 2a str. 301
ccgccacuugagccuccagcgg

SEQ ID NO: 3907366 - RNA, 23 nt, Shigella flexneri 2a str. 301
ccgccacuugagccuccagcgga

SEQ ID NO: 3907367 - RNA, 11 nt, Shigella flexneri 2a str. 301
ccgccagacca

SEQ ID NO: 3907368 - RNA, 15 nt, Shigella flexneri 2a str. 301
ccgccagaccacugc

SEQ ID NO: 3907369 - RNA, 17 nt, Shigella flexneri 2a str. 301
ccgccagacguccggcg

SEQ ID NO: 3907370 - RNA, 18 nt, Shigella flexneri 2a str. 301
ccgccagagcuucaaccg

SEQ ID NO: 3907371 - RNA, 13 nt, Shigella flexneri 2a str. 301
ccgccagauaguu

SEQ ID NO: 3907372 - RNA, 13 nt, Shigella flexneri 2a str. 301
ccgccagcaggaa

SEQ ID NO: 3907373 - RNA, 15 nt, Shigella flexneri 2a str. 301
ccgccagcgccuggg

SEQ ID NO: 3907374 - RNA, 12 nt, Shigella flexneri 2a str. 301
ccgccagcgggc

SEQ ID NO: 3907375 - RNA, 22 nt, Shigella flexneri 2a str. 301
ccgccagcucacgggcggcagg

SEQ ID NO: 3907376 - RNA, 19 nt, Shigella flexneri 2a str. 301
ccgccagcuucgcuuccca

SEQ ID NO: 3907377 - RNA, 12 nt, Shigella flexneri 2a str. 301
ccgccaggcuuc

SEQ ID NO: 3907378 - RNA, 17 nt, Shigella flexneri 2a str. 301
ccgccagugccaaagcc

SEQ ID NO: 3907379 - RNA, 15 nt, Shigella flexneri 2a str. 301
ccgccaguguggcgg

SEQ ID NO: 3907380 - RNA, 12 nt, Shigella flexneri 2a str. 301
ccgccaguucuu

SEQ ID NO: 3907381 - RNA, 21 nt, Shigella flexneri 2a str. 301
ccgccaguucuuccaguuccg

SEQ ID NO: 3907382 - RNA, 21 nt, Shigella flexneri 2a str. 301
ccgccaguuuacugucugcuu

SEQ ID NO: 3907383 - RNA, 20 nt, Shigella flexneri 2a str. 301
ccgccaguuugucuggcaau

SEQ ID NO: 3907384 - RNA, 17 nt, Shigella flexneri 2a str. 301
ccgccaguuuugugccc

SEQ ID NO: 3907385 - RNA, 18 nt, Shigella flexneri 2a str. 301
ccgccaguuuugugcccg

SEQ ID NO: 3907386 - RNA, 13 nt, Shigella flexneri 2a str. 301
ccgccauaaacag

SEQ ID NO: 3907387 - RNA, 15 nt, Shigella flexneri 2a str. 301
ccgccauagaaagga

SEQ ID NO: 3907388 - RNA, 11 nt, Shigella flexneri 2a str. 301
ccgccaucaga

SEQ ID NO: 3907389 - RNA, 11 nt, Shigella flexneri 2a str. 301
ccgccaucauc

SEQ ID NO: 3907390 - RNA, 14 nt, Shigella flexneri 2a str. 301
ccgccaucgacaac

SEQ ID NO: 3907391 - RNA, 19 nt, Shigella flexneri 2a str. 301
ccgccaucgaguaccccuu

SEQ ID NO: 3907392 - RNA, 13 nt, Shigella flexneri 2a str. 301
ccgccaucucuuc

SEQ ID NO: 3907393 - RNA, 17 nt, Shigella flexneri 2a str. 301
ccgccaucucuuccagc

SEQ ID NO: 3907394 - RNA, 18 nt, Shigella flexneri 2a str. 301
ccgccaucucuuccagcg

SEQ ID NO: 3907395 - RNA, 17 nt, Shigella flexneri 2a str. 301
ccgccauuucuccuccg

SEQ ID NO: 3907396 - RNA, 13 nt, Shigella flexneri 2a str. 301
ccgcccaccacca

SEQ ID NO: 3907397 - RNA, 17 nt, Shigella flexneri 2a str. 301
ccgcccaccaccagcga

SEQ ID NO: 3907398 - RNA, 12 nt, Shigella flexneri 2a str. 301
ccgcccagugcc

SEQ ID NO: 3907399 - RNA, 17 nt, Shigella flexneri 2a str. 301
ccgcccagugccagcac

SEQ ID NO: 3907400 - RNA, 13 nt, Shigella flexneri 2a str. 301
ccgccccggcgau

SEQ ID NO: 3907401 - RNA, 19 nt, Shigella flexneri 2a str. 301
ccgcccguuuucuccagcg

SEQ ID NO: 3907402 - RNA, 20 nt, Shigella flexneri 2a str. 301
ccgcccguuuucuccagcgc

SEQ ID NO: 3907403 - RNA, 23 nt, Shigella flexneri 2a str. 301
ccgcccuguuugguugccagcca

SEQ ID NO: 3907404 - RNA, 11 nt, Shigella flexneri 2a str. 301
ccgccgauacc

SEQ ID NO: 3907405 - RNA, 17 nt, Shigella flexneri 2a str. 301
ccgccgauguugcauga

SEQ ID NO: 3907406 - RNA, 21 nt, Shigella flexneri 2a str. 301
ccgccgcacaauacauagaaa

SEQ ID NO: 3907407 - RNA, 14 nt, Shigella flexneri 2a str. 301
ccgccgcagccgca

SEQ ID NO: 3907408 - RNA, 14 nt, Shigella flexneri 2a str. 301
ccgccgccacacgc

SEQ ID NO: 3907409 - RNA, 20 nt, Shigella flexneri 2a str. 301
ccgccgccauuugggcggcu

SEQ ID NO: 3907410 - RNA, 11 nt, Shigella flexneri 2a str. 301
ccgccgcccgg

SEQ ID NO: 3907411 - RNA, 13 nt, Shigella flexneri 2a str. 301
ccgccgccgccac

SEQ ID NO: 3907412 - RNA, 23 nt, Shigella flexneri 2a str. 301
ccgccgccgcuucuggcggcggc

SEQ ID NO: 3907413 - RNA, 12 nt, Shigella flexneri 2a str. 301
ccgccgcuccuc

SEQ ID NO: 3907414 - RNA, 14 nt, Shigella flexneri 2a str. 301
ccgccgcuucgccc

SEQ ID NO: 3907415 - RNA, 11 nt, Shigella flexneri 2a str. 301
ccgccgcuucu

SEQ ID NO: 3907416 - RNA, 19 nt, Shigella flexneri 2a str. 301
ccgccgguagucaccgccc

SEQ ID NO: 3907417 - RNA, 21 nt, Shigella flexneri 2a str. 301
ccgccgguagucaccgcccag

SEQ ID NO: 3907418 - RNA, 16 nt, Shigella flexneri 2a str. 301
ccgccggucaacgcgc

SEQ ID NO: 3907419 - RNA, 19 nt, Shigella flexneri 2a str. 301
ccgccggucaacgcgcggc

SEQ ID NO: 3907420 - RNA, 16 nt, Shigella flexneri 2a str. 301
ccgccgguugccccgc

SEQ ID NO: 3907421 - RNA, 19 nt, Shigella flexneri 2a str. 301
ccgccguuaccuucggccc

SEQ ID NO: 3907422 - RNA, 16 nt, Shigella flexneri 2a str. 301
ccgccguugccgcagc

SEQ ID NO: 3907423 - RNA, 21 nt, Shigella flexneri 2a str. 301
ccgccguugccgcagcgaugg

SEQ ID NO: 3907424 - RNA, 22 nt, Shigella flexneri 2a str. 301
ccgccguugccuuuaccgccac

SEQ ID NO: 3907425 - RNA, 13 nt, Shigella flexneri 2a str. 301
ccgccguugcucu

SEQ ID NO: 3907426 - RNA, 14 nt, Shigella flexneri 2a str. 301
ccgccguugcucuu

SEQ ID NO: 3907427 - RNA, 22 nt, Shigella flexneri 2a str. 301
ccgccucaccgccauuugcauc

SEQ ID NO: 3907428 - RNA, 13 nt, Shigella flexneri 2a str. 301
ccgccucagccag

SEQ ID NO: 3907429 - RNA, 15 nt, Shigella flexneri 2a str. 301
ccgccucccuucgcu

SEQ ID NO: 3907430 - RNA, 21 nt, Shigella flexneri 2a str. 301
ccgccucgcggcagcagagaa

SEQ ID NO: 3907431 - RNA, 17 nt, Shigella flexneri 2a str. 301
ccgccugagccagugcc

SEQ ID NO: 3907432 - RNA, 21 nt, Shigella flexneri 2a str. 301
ccgccugaugggcgaagagaa

SEQ ID NO: 3907433 - RNA, 23 nt, Shigella flexneri 2a str. 301
ccgccuggcgcugcucaggcgag

SEQ ID NO: 3907434 - RNA, 14 nt, Shigella flexneri 2a str. 301
ccgccuguuccagc

SEQ ID NO: 3907435 - RNA, 13 nt, Shigella flexneri 2a str. 301
ccgccuguugccc

SEQ ID NO: 3907436 - RNA, 15 nt, Shigella flexneri 2a str. 301
ccgccuguugcccuu

SEQ ID NO: 3907437 - RNA, 16 nt, Shigella flexneri 2a str. 301
ccgccuugauauaaau

SEQ ID NO: 3907438 - RNA, 19 nt, Shigella flexneri 2a str. 301
ccgccuuguuguaaugaca

SEQ ID NO: 3907439 - RNA, 19 nt, Shigella flexneri 2a str. 301
ccgcgaaccggaccagcaa

SEQ ID NO: 3907440 - RNA, 21 nt, Shigella flexneri 2a str. 301
ccgcgaaccggaccagcaaca

SEQ ID NO: 3907441 - RNA, 18 nt, Shigella flexneri 2a str. 301
ccgcgaauuaugcagccu

SEQ ID NO: 3907442 - RNA, 14 nt, Shigella flexneri 2a str. 301
ccgcgaccaccacc

SEQ ID NO: 3907443 - RNA, 23 nt, Shigella flexneri 2a str. 301
ccgcgaccucaaaggccgacagc

SEQ ID NO: 3907444 - RNA, 18 nt, Shigella flexneri 2a str. 301
ccgcgacgacgacaggca

SEQ ID NO: 3907445 - RNA, 20 nt, Shigella flexneri 2a str. 301
ccgcgacgacgacaggcaag

SEQ ID NO: 3907446 - RNA, 19 nt, Shigella flexneri 2a str. 301
ccgcgacugggaggacagc

SEQ ID NO: 3907447 - RNA, 18 nt, Shigella flexneri 2a str. 301
ccgcgaguaaucacauca

SEQ ID NO: 3907448 - RNA, 15 nt, Shigella flexneri 2a str. 301
ccgcgauagcaagcg

SEQ ID NO: 3907449 - RNA, 20 nt, Shigella flexneri 2a str. 301
ccgcgauccagcgcaauacc

SEQ ID NO: 3907450 - RNA, 18 nt, Shigella flexneri 2a str. 301
ccgcgcacgucagccucg

SEQ ID NO: 3907451 - RNA, 20 nt, Shigella flexneri 2a str. 301
ccgcgcagcgguuugcgcau

SEQ ID NO: 3907452 - RNA, 21 nt, Shigella flexneri 2a str. 301
ccgcgcauuacgcucacugca

SEQ ID NO: 3907453 - RNA, 15 nt, Shigella flexneri 2a str. 301
ccgcgccaaugccug

SEQ ID NO: 3907454 - RNA, 15 nt, Shigella flexneri 2a str. 301
ccgcgccgcagccgg

SEQ ID NO: 3907455 - RNA, 11 nt, Shigella flexneri 2a str. 301
ccgcgccgcgg

SEQ ID NO: 3907456 - RNA, 17 nt, Shigella flexneri 2a str. 301
ccgcgcggcgcaggcgc

SEQ ID NO: 3907457 - RNA, 20 nt, Shigella flexneri 2a str. 301
ccgcgcgguaucaccaccca

SEQ ID NO: 3907458 - RNA, 23 nt, Shigella flexneri 2a str. 301
ccgcgcucgaagcgggcgcgcag

SEQ ID NO: 3907459 - RNA, 17 nt, Shigella flexneri 2a str. 301
ccgcgcugucgggcagc

SEQ ID NO: 3907460 - RNA, 15 nt, Shigella flexneri 2a str. 301
ccgcgcuugccgccg

SEQ ID NO: 3907461 - RNA, 19 nt, Shigella flexneri 2a str. 301
ccgcgcuuucuggcgcaga

SEQ ID NO: 3907462 - RNA, 14 nt, Shigella flexneri 2a str. 301
ccgcggaucacgcg

SEQ ID NO: 3907463 - RNA, 22 nt, Shigella flexneri 2a str. 301
ccgcgggcgaauuaucggcagc

SEQ ID NO: 3907464 - RNA, 21 nt, Shigella flexneri 2a str. 301
ccgcguaaacgugcggcugug

SEQ ID NO: 3907465 - RNA, 15 nt, Shigella flexneri 2a str. 301
ccgcguacgccgcug

SEQ ID NO: 3907466 - RNA, 18 nt, Shigella flexneri 2a str. 301
ccgcgucauugacgcugg

SEQ ID NO: 3907467 - RNA, 20 nt, Shigella flexneri 2a str. 301
ccgcgucguugaaaugcggc

SEQ ID NO: 3907468 - RNA, 14 nt, Shigella flexneri 2a str. 301
ccgcgugcgcggca

SEQ ID NO: 3907469 - RNA, 18 nt, Shigella flexneri 2a str. 301
ccgcgugcgcuggacgcc

SEQ ID NO: 3907470 - RNA, 16 nt, Shigella flexneri 2a str. 301
ccgcguugcagcauau

SEQ ID NO: 3907471 - RNA, 14 nt, Shigella flexneri 2a str. 301
ccgcguuuuccagu

SEQ ID NO: 3907472 - RNA, 15 nt, Shigella flexneri 2a str. 301
ccgcuaacagcagca

SEQ ID NO: 3907473 - RNA, 19 nt, Shigella flexneri 2a str. 301
ccgcuaacagcagcagcgc

SEQ ID NO: 3907474 - RNA, 15 nt, Shigella flexneri 2a str. 301
ccgcuaccugccgcc

SEQ ID NO: 3907475 - RNA, 19 nt, Shigella flexneri 2a str. 301
ccgcuaccugccgccacca

SEQ ID NO: 3907476 - RNA, 13 nt, Shigella flexneri 2a str. 301
ccgcuacuggcaa

SEQ ID NO: 3907477 - RNA, 21 nt, Shigella flexneri 2a str. 301
ccgcuaucgaggcucugauug

SEQ ID NO: 3907478 - RNA, 14 nt, Shigella flexneri 2a str. 301
ccgcuaucggcaag

SEQ ID NO: 3907479 - RNA, 19 nt, Shigella flexneri 2a str. 301
ccgcuaucggcaaggaaac

SEQ ID NO: 3907480 - RNA, 23 nt, Shigella flexneri 2a str. 301
ccgcuaucguccacgucaucaaa

SEQ ID NO: 3907481 - RNA, 11 nt, Shigella flexneri 2a str. 301
ccgcucaaaca

SEQ ID NO: 3907482 - RNA, 20 nt, Shigella flexneri 2a str. 301
ccgcucacgaugccgccgag

SEQ ID NO: 3907483 - RNA, 12 nt, Shigella flexneri 2a str. 301
ccgcucagcucc

SEQ ID NO: 3907484 - RNA, 12 nt, Shigella flexneri 2a str. 301
ccgcucccagca

SEQ ID NO: 3907485 - RNA, 13 nt, Shigella flexneri 2a str. 301
ccgcucccagcau

SEQ ID NO: 3907486 - RNA, 11 nt, Shigella flexneri 2a str. 301
ccgcucccugg

SEQ ID NO: 3907487 - RNA, 23 nt, Shigella flexneri 2a str. 301
ccgcuccgccaucuucuugcagc

SEQ ID NO: 3907488 - RNA, 15 nt, Shigella flexneri 2a str. 301
ccgcucgaaguuuuc

SEQ ID NO: 3907489 - RNA, 15 nt, Shigella flexneri 2a str. 301
ccgcucgucacauca

SEQ ID NO: 3907490 - RNA, 22 nt, Shigella flexneri 2a str. 301
ccgcucucaaucucuuuuucca

SEQ ID NO: 3907491 - RNA, 22 nt, Shigella flexneri 2a str. 301
ccgcucugcgaucugcgcguca

SEQ ID NO: 3907492 - RNA, 21 nt, Shigella flexneri 2a str. 301
ccgcucuucauacgcggcaga

SEQ ID NO: 3907493 - RNA, 15 nt, Shigella flexneri 2a str. 301
ccgcucuuccaggca

SEQ ID NO: 3907494 - RNA, 20 nt, Shigella flexneri 2a str. 301
ccgcucuuuuguucgcggcg

SEQ ID NO: 3907495 - RNA, 14 nt, Shigella flexneri 2a str. 301
ccgcugagacgcgc

SEQ ID NO: 3907496 - RNA, 11 nt, Shigella flexneri 2a str. 301
ccgcugauuca

SEQ ID NO: 3907497 - RNA, 18 nt, Shigella flexneri 2a str. 301
ccgcugcacguuuucaac

SEQ ID NO: 3907498 - RNA, 22 nt, Shigella flexneri 2a str. 301
ccgcugcuggggccaauaccug

SEQ ID NO: 3907499 - RNA, 21 nt, Shigella flexneri 2a str. 301
ccgcuggagcggggaacaccu

SEQ ID NO: 3907500 - RNA, 20 nt, Shigella flexneri 2a str. 301
ccgcuggccauuucugccag

SEQ ID NO: 3907501 - RNA, 15 nt, Shigella flexneri 2a str. 301
ccgcugggccgucag

SEQ ID NO: 3907502 - RNA, 13 nt, Shigella flexneri 2a str. 301
ccgcuggugcguc

SEQ ID NO: 3907503 - RNA, 19 nt, Shigella flexneri 2a str. 301
ccgcuguaaaugcugcucc

SEQ ID NO: 3907504 - RNA, 20 nt, Shigella flexneri 2a str. 301
ccgcuguaauaccagccuuc

SEQ ID NO: 3907505 - RNA, 17 nt, Shigella flexneri 2a str. 301
ccgcuguaauugccgcu

SEQ ID NO: 3907506 - RNA, 16 nt, Shigella flexneri 2a str. 301
ccgcugucacccggca

SEQ ID NO: 3907507 - RNA, 16 nt, Shigella flexneri 2a str. 301
ccgcugugauuucagc

SEQ ID NO: 3907508 - RNA, 21 nt, Shigella flexneri 2a str. 301
ccgcuuacaucaacucucuuu

SEQ ID NO: 3907509 - RNA, 16 nt, Shigella flexneri 2a str. 301
ccgcuucaaaguucug

SEQ ID NO: 3907510 - RNA, 22 nt, Shigella flexneri 2a str. 301
ccgcuucaacgaccgcuuuugu

SEQ ID NO: 3907511 - RNA, 14 nt, Shigella flexneri 2a str. 301
ccgcuucaccaauc

SEQ ID NO: 3907512 - RNA, 14 nt, Shigella flexneri 2a str. 301
ccgcuucacucccu

SEQ ID NO: 3907513 - RNA, 22 nt, Shigella flexneri 2a str. 301
ccgcuucaucgguuaaccggca

SEQ ID NO: 3907514 - RNA, 17 nt, Shigella flexneri 2a str. 301
ccgcuuccagcgcaucu

SEQ ID NO: 3907515 - RNA, 14 nt, Shigella flexneri 2a str. 301
ccgcuuccagcucc

SEQ ID NO: 3907516 - RNA, 13 nt, Shigella flexneri 2a str. 301
ccgcuucgcccgc

SEQ ID NO: 3907517 - RNA, 16 nt, Shigella flexneri 2a str. 301
ccgcuucgcccgccag

SEQ ID NO: 3907518 - RNA, 13 nt, Shigella flexneri 2a str. 301
ccgcuucgcucac

SEQ ID NO: 3907519 - RNA, 15 nt, Shigella flexneri 2a str. 301
ccgcuucguuuucag

SEQ ID NO: 3907520 - RNA, 16 nt, Shigella flexneri 2a str. 301
ccgcuucugcagcuuu

SEQ ID NO: 3907521 - RNA, 16 nt, Shigella flexneri 2a str. 301
ccgcuucugcguucug

SEQ ID NO: 3907522 - RNA, 14 nt, Shigella flexneri 2a str. 301
ccgcuucugcuuug

SEQ ID NO: 3907523 - RNA, 22 nt, Shigella flexneri 2a str. 301
ccgcuugaguauuuaccagaau

SEQ ID NO: 3907524 - RNA, 15 nt, Shigella flexneri 2a str. 301
ccgcuuggcgauacc

SEQ ID NO: 3907525 - RNA, 17 nt, Shigella flexneri 2a str. 301
ccgcuuucaauuagcuu

SEQ ID NO: 3907526 - RNA, 16 nt, Shigella flexneri 2a str. 301
ccgcuuuccaggcauc

SEQ ID NO: 3907527 - RNA, 14 nt, Shigella flexneri 2a str. 301
ccgcuuucccagug

SEQ ID NO: 3907528 - RNA, 20 nt, Shigella flexneri 2a str. 301
ccgcuuucucugcaagaacu

SEQ ID NO: 3907529 - RNA, 14 nt, Shigella flexneri 2a str. 301
ccgcuuuggcgucu

SEQ ID NO: 3907530 - RNA, 14 nt, Shigella flexneri 2a str. 301
ccgcuuuugcgcgu

SEQ ID NO: 3907531 - RNA, 12 nt, Shigella flexneri 2a str. 301
ccgcuuuuucaa

SEQ ID NO: 3907532 - RNA, 22 nt, Shigella flexneri 2a str. 301
ccggaaaagguguucacgccgc

SEQ ID NO: 3907533 - RNA, 23 nt, Shigella flexneri 2a str. 301
ccggaacaggcagggccaccagc

SEQ ID NO: 3907534 - RNA, 14 nt, Shigella flexneri 2a str. 301
ccggaacccaccgc

SEQ ID NO: 3907535 - RNA, 22 nt, Shigella flexneri 2a str. 301
ccggaacgggagaaacccggcc

SEQ ID NO: 3907536 - RNA, 17 nt, Shigella flexneri 2a str. 301
ccggaagccaccacgcc

SEQ ID NO: 3907537 - RNA, 21 nt, Shigella flexneri 2a str. 301
ccggaauaaaugucacgucau

SEQ ID NO: 3907538 - RNA, 13 nt, Shigella flexneri 2a str. 301
ccggaauaaugau

SEQ ID NO: 3907539 - RNA, 19 nt, Shigella flexneri 2a str. 301
ccggaaucagaauccggug

SEQ ID NO: 3907540 - RNA, 13 nt, Shigella flexneri 2a str. 301
ccggacacugcuu

SEQ ID NO: 3907541 - RNA, 23 nt, Shigella flexneri 2a str. 301
ccggacacugcuuacaggcuggu

SEQ ID NO: 3907542 - RNA, 15 nt, Shigella flexneri 2a str. 301
ccggacauugcgccc

SEQ ID NO: 3907543 - RNA, 19 nt, Shigella flexneri 2a str. 301
ccggacauugcgccccggc

SEQ ID NO: 3907544 - RNA, 16 nt, Shigella flexneri 2a str. 301
ccggaccagacgaucg

SEQ ID NO: 3907545 - RNA, 13 nt, Shigella flexneri 2a str. 301
ccggacccacacc

SEQ ID NO: 3907546 - RNA, 20 nt, Shigella flexneri 2a str. 301
ccggacccuggucaguuuca

SEQ ID NO: 3907547 - RNA, 22 nt, Shigella flexneri 2a str. 301
ccggacccuggucaguuucagc

SEQ ID NO: 3907548 - RNA, 16 nt, Shigella flexneri 2a str. 301
ccggacgcaucgccgg

SEQ ID NO: 3907549 - RNA, 19 nt, Shigella flexneri 2a str. 301
ccggacggacuuccagcgg

SEQ ID NO: 3907550 - RNA, 18 nt, Shigella flexneri 2a str. 301
ccggacguguuuucaccg

SEQ ID NO: 3907551 - RNA, 15 nt, Shigella flexneri 2a str. 301
ccggacuccgcaccg

SEQ ID NO: 3907552 - RNA, 15 nt, Shigella flexneri 2a str. 301
ccggacugaaaguac

SEQ ID NO: 3907553 - RNA, 15 nt, Shigella flexneri 2a str. 301
ccggagaagcguagg

SEQ ID NO: 3907554 - RNA, 12 nt, Shigella flexneri 2a str. 301
ccggagacgacg

SEQ ID NO: 3907555 - RNA, 23 nt, Shigella flexneri 2a str. 301
ccggagcagcagucaggcgcgcg

SEQ ID NO: 3907556 - RNA, 20 nt, Shigella flexneri 2a str. 301
ccggagccaaacaugcaaac

SEQ ID NO: 3907557 - RNA, 13 nt, Shigella flexneri 2a str. 301
ccggagccagccg

SEQ ID NO: 3907558 - RNA, 16 nt, Shigella flexneri 2a str. 301
ccggagcgccaccacc

SEQ ID NO: 3907559 - RNA, 17 nt, Shigella flexneri 2a str. 301
ccggagcggacugcugc

SEQ ID NO: 3907560 - RNA, 17 nt, Shigella flexneri 2a str. 301
ccggaggcaaguuuccu

SEQ ID NO: 3907561 - RNA, 13 nt, Shigella flexneri 2a str. 301
ccggaggcgcugg

SEQ ID NO: 3907562 - RNA, 14 nt, Shigella flexneri 2a str. 301
ccggauaaacaaug

SEQ ID NO: 3907563 - RNA, 14 nt, Shigella flexneri 2a str. 301
ccggauaucccagc

SEQ ID NO: 3907564 - RNA, 15 nt, Shigella flexneri 2a str. 301
ccggaucccaccaga

SEQ ID NO: 3907565 - RNA, 18 nt, Shigella flexneri 2a str. 301
ccggaugaucauccggcu

SEQ ID NO: 3907566 - RNA, 19 nt, Shigella flexneri 2a str. 301
ccggaugauucacaucauc

SEQ ID NO: 3907567 - RNA, 13 nt, Shigella flexneri 2a str. 301
ccggaugcaucac

SEQ ID NO: 3907568 - RNA, 19 nt, Shigella flexneri 2a str. 301
ccggaugcaugauccggca

SEQ ID NO: 3907569 - RNA, 16 nt, Shigella flexneri 2a str. 301
ccggaugcgacgccgg

SEQ ID NO: 3907570 - RNA, 22 nt, Shigella flexneri 2a str. 301
ccggaugcggcguaaacgcuuu

SEQ ID NO: 3907571 - RNA, 22 nt, Shigella flexneri 2a str. 301
ccggaugcggcgugaacgccuu

SEQ ID NO: 3907572 - RNA, 17 nt, Shigella flexneri 2a str. 301
ccggauuuucaccaucg

SEQ ID NO: 3907573 - RNA, 19 nt, Shigella flexneri 2a str. 301
ccggcaaaaccaucaaucc

SEQ ID NO: 3907574 - RNA, 12 nt, Shigella flexneri 2a str. 301
ccggcaaagcca

SEQ ID NO: 3907575 - RNA, 23 nt, Shigella flexneri 2a str. 301
ccggcaaagugaauacagaacag

SEQ ID NO: 3907576 - RNA, 14 nt, Shigella flexneri 2a str. 301
ccggcaaauaacag

SEQ ID NO: 3907577 - RNA, 14 nt, Shigella flexneri 2a str. 301
ccggcaaauaacgc

SEQ ID NO: 3907578 - RNA, 11 nt, Shigella flexneri 2a str. 301
ccggcaaaugu

SEQ ID NO: 3907579 - RNA, 14 nt, Shigella flexneri 2a str. 301
ccggcaaccacacc

SEQ ID NO: 3907580 - RNA, 19 nt, Shigella flexneri 2a str. 301
ccggcaacguugcccguac

SEQ ID NO: 3907581 - RNA, 19 nt, Shigella flexneri 2a str. 301
ccggcaagauuccagugcc

SEQ ID NO: 3907582 - RNA, 19 nt, Shigella flexneri 2a str. 301
ccggcaauaaaacagggcg

SEQ ID NO: 3907583 - RNA, 23 nt, Shigella flexneri 2a str. 301
ccggcaauaaaacagggcggaac

SEQ ID NO: 3907584 - RNA, 14 nt, Shigella flexneri 2a str. 301
ccggcaauaagcaa

SEQ ID NO: 3907585 - RNA, 17 nt, Shigella flexneri 2a str. 301
ccggcaauaagcaacgc

SEQ ID NO: 3907586 - RNA, 21 nt, Shigella flexneri 2a str. 301
ccggcaaucaccgccagcggc

SEQ ID NO: 3907587 - RNA, 16 nt, Shigella flexneri 2a str. 301
ccggcaaucgccagau

SEQ ID NO: 3907588 - RNA, 23 nt, Shigella flexneri 2a str. 301
ccggcaaucggugcaaaugccag

SEQ ID NO: 3907589 - RNA, 20 nt, Shigella flexneri 2a str. 301
ccggcaaucugcuggcaaac

SEQ ID NO: 3907590 - RNA, 23 nt, Shigella flexneri 2a str. 301
ccggcaauguuaccgaucgccag

SEQ ID NO: 3907591 - RNA, 21 nt, Shigella flexneri 2a str. 301
ccggcaauucucucugauuac

SEQ ID NO: 3907592 - RNA, 22 nt, Shigella flexneri 2a str. 301
ccggcaauucucugcuccugau

SEQ ID NO: 3907593 - RNA, 22 nt, Shigella flexneri 2a str. 301
ccggcacaaagcuguaucccag

SEQ ID NO: 3907594 - RNA, 18 nt, Shigella flexneri 2a str. 301
ccggcacacguaggccaa

SEQ ID NO: 3907595 - RNA, 15 nt, Shigella flexneri 2a str. 301
ccggcacauuucacu

SEQ ID NO: 3907596 - RNA, 18 nt, Shigella flexneri 2a str. 301
ccggcacauuucacucac

SEQ ID NO: 3907597 - RNA, 16 nt, Shigella flexneri 2a str. 301
ccggcaccugucagac

SEQ ID NO: 3907598 - RNA, 11 nt, Shigella flexneri 2a str. 301
ccggcaccuuu

SEQ ID NO: 3907599 - RNA, 18 nt, Shigella flexneri 2a str. 301
ccggcaccuuuucaucag

SEQ ID NO: 3907600 - RNA, 20 nt, Shigella flexneri 2a str. 301
ccggcacguuuuggcagaca

SEQ ID NO: 3907601 - RNA, 11 nt, Shigella flexneri 2a str. 301
ccggcagagaa

SEQ ID NO: 3907602 - RNA, 17 nt, Shigella flexneri 2a str. 301
ccggcagccccaaacag

SEQ ID NO: 3907603 - RNA, 14 nt, Shigella flexneri 2a str. 301
ccggcagucggcgc

SEQ ID NO: 3907604 - RNA, 15 nt, Shigella flexneri 2a str. 301
ccggcauaaacaacg

SEQ ID NO: 3907605 - RNA, 19 nt, Shigella flexneri 2a str. 301
ccggcauaccacggucauu

SEQ ID NO: 3907606 - RNA, 15 nt, Shigella flexneri 2a str. 301
ccggcauacuuugau

SEQ ID NO: 3907607 - RNA, 17 nt, Shigella flexneri 2a str. 301
ccggcauauccaccacc

SEQ ID NO: 3907608 - RNA, 17 nt, Shigella flexneri 2a str. 301
ccggcaucaaccagcac

SEQ ID NO: 3907609 - RNA, 19 nt, Shigella flexneri 2a str. 301
ccggcauccagccaaacau

SEQ ID NO: 3907610 - RNA, 16 nt, Shigella flexneri 2a str. 301
ccggcauccagcguuc

SEQ ID NO: 3907611 - RNA, 17 nt, Shigella flexneri 2a str. 301
ccggcauggcauuuuua

SEQ ID NO: 3907612 - RNA, 15 nt, Shigella flexneri 2a str. 301
ccggcauuacggauu

SEQ ID NO: 3907613 - RNA, 22 nt, Shigella flexneri 2a str. 301
ccggcauuaucacaucagcgca

SEQ ID NO: 3907614 - RNA, 19 nt, Shigella flexneri 2a str. 301
ccggcauucagugcaaaug

SEQ ID NO: 3907615 - RNA, 15 nt, Shigella flexneri 2a str. 301
ccggccacagcgcca

SEQ ID NO: 3907616 - RNA, 12 nt, Shigella flexneri 2a str. 301
ccggccagagca

SEQ ID NO: 3907617 - RNA, 23 nt, Shigella flexneri 2a str. 301
ccggccagcgccaccaccagcac

SEQ ID NO: 3907618 - RNA, 13 nt, Shigella flexneri 2a str. 301
ccggccagcgccg

SEQ ID NO: 3907619 - RNA, 21 nt, Shigella flexneri 2a str. 301
ccggccaguaagcaguccagc

SEQ ID NO: 3907620 - RNA, 23 nt, Shigella flexneri 2a str. 301
ccggccaguaagcaguccagcgc

SEQ ID NO: 3907621 - RNA, 14 nt, Shigella flexneri 2a str. 301
ccggccauuccagc

SEQ ID NO: 3907622 - RNA, 20 nt, Shigella flexneri 2a str. 301
ccggcccuaaacucuuuacc

SEQ ID NO: 3907623 - RNA, 13 nt, Shigella flexneri 2a str. 301
ccggccuggaugg

SEQ ID NO: 3907624 - RNA, 18 nt, Shigella flexneri 2a str. 301
ccggcgaauuaccagcca

SEQ ID NO: 3907625 - RNA, 13 nt, Shigella flexneri 2a str. 301
ccggcgcauccau

SEQ ID NO: 3907626 - RNA, 15 nt, Shigella flexneri 2a str. 301
ccggcgcauccauga

SEQ ID NO: 3907627 - RNA, 11 nt, Shigella flexneri 2a str. 301
ccggcgcuaau

SEQ ID NO: 3907628 - RNA, 19 nt, Shigella flexneri 2a str. 301
ccggcgcuaauucaacgcc

SEQ ID NO: 3907629 - RNA, 14 nt, Shigella flexneri 2a str. 301
ccggcggcacagcc

SEQ ID NO: 3907630 - RNA, 22 nt, Shigella flexneri 2a str. 301
ccggcggcgcgccaggcgcuga

SEQ ID NO: 3907631 - RNA, 17 nt, Shigella flexneri 2a str. 301
ccggcgggucgcugccg

SEQ ID NO: 3907632 - RNA, 18 nt, Shigella flexneri 2a str. 301
ccggcgguaaaucgccgc

SEQ ID NO: 3907633 - RNA, 23 nt, Shigella flexneri 2a str. 301
ccggcguaugcccagggcaaugu

SEQ ID NO: 3907634 - RNA, 15 nt, Shigella flexneri 2a str. 301
ccggcguccaccugc

SEQ ID NO: 3907635 - RNA, 17 nt, Shigella flexneri 2a str. 301
ccggcgucccaucggca

SEQ ID NO: 3907636 - RNA, 18 nt, Shigella flexneri 2a str. 301
ccggcgucgcauccggca

SEQ ID NO: 3907637 - RNA, 11 nt, Shigella flexneri 2a str. 301
ccggcgugacg

SEQ ID NO: 3907638 - RNA, 18 nt, Shigella flexneri 2a str. 301
ccggcguuuucaaccagc

SEQ ID NO: 3907639 - RNA, 17 nt, Shigella flexneri 2a str. 301
ccggcuaccgggccuga

SEQ ID NO: 3907640 - RNA, 15 nt, Shigella flexneri 2a str. 301
ccggcugcaaccaga

SEQ ID NO: 3907641 - RNA, 14 nt, Shigella flexneri 2a str. 301
ccggcugggcguga

SEQ ID NO: 3907642 - RNA, 23 nt, Shigella flexneri 2a str. 301
ccggcuuaaugcauggcagauaa

SEQ ID NO: 3907643 - RNA, 19 nt, Shigella flexneri 2a str. 301
ccggcuuaccaaauaaacg

SEQ ID NO: 3907644 - RNA, 18 nt, Shigella flexneri 2a str. 301
ccggcuucaaagcagaaa

SEQ ID NO: 3907645 - RNA, 13 nt, Shigella flexneri 2a str. 301
ccggcuugaacca

SEQ ID NO: 3907646 - RNA, 20 nt, Shigella flexneri 2a str. 301
ccggcuuguucaucaccauu

SEQ ID NO: 3907647 - RNA, 15 nt, Shigella flexneri 2a str. 301
ccggcuuguugcccg

SEQ ID NO: 3907648 - RNA, 19 nt, Shigella flexneri 2a str. 301
ccgggaaauccucaaccgg

SEQ ID NO: 3907649 - RNA, 22 nt, Shigella flexneri 2a str. 301
ccgggaacuggcaacaauggca

SEQ ID NO: 3907650 - RNA, 21 nt, Shigella flexneri 2a str. 301
ccgggagggaaccuguucaac

SEQ ID NO: 3907651 - RNA, 20 nt, Shigella flexneri 2a str. 301
ccgggaugaaaggcaagcac

SEQ ID NO: 3907652 - RNA, 14 nt, Shigella flexneri 2a str. 301
ccgggcaaaaguca

SEQ ID NO: 3907653 - RNA, 14 nt, Shigella flexneri 2a str. 301
ccgggcacacuuag

SEQ ID NO: 3907654 - RNA, 14 nt, Shigella flexneri 2a str. 301
ccgggcauauuucc

SEQ ID NO: 3907655 - RNA, 18 nt, Shigella flexneri 2a str. 301
ccgggcaucagcagcacg

SEQ ID NO: 3907656 - RNA, 15 nt, Shigella flexneri 2a str. 301
ccgggcgauccggca

SEQ ID NO: 3907657 - RNA, 13 nt, Shigella flexneri 2a str. 301
ccgggcgcggcug

SEQ ID NO: 3907658 - RNA, 17 nt, Shigella flexneri 2a str. 301
ccgggcucccggcggua

SEQ ID NO: 3907659 - RNA, 17 nt, Shigella flexneri 2a str. 301
ccgggcugguuuucagc

SEQ ID NO: 3907660 - RNA, 21 nt, Shigella flexneri 2a str. 301
ccggggagauauuccccagac

SEQ ID NO: 3907661 - RNA, 17 nt, Shigella flexneri 2a str. 301
ccgggguagaccgcgcu

SEQ ID NO: 3907662 - RNA, 20 nt, Shigella flexneri 2a str. 301
ccgggguucgaauccccgcc

SEQ ID NO: 3907663 - RNA, 14 nt, Shigella flexneri 2a str. 301
ccggguaccacgca

SEQ ID NO: 3907664 - RNA, 16 nt, Shigella flexneri 2a str. 301
ccggguaccagaauca

SEQ ID NO: 3907665 - RNA, 14 nt, Shigella flexneri 2a str. 301
ccgggugaacugcc

SEQ ID NO: 3907666 - RNA, 23 nt, Shigella flexneri 2a str. 301
ccgggugaacugccacacaggcc

SEQ ID NO: 3907667 - RNA, 17 nt, Shigella flexneri 2a str. 301
ccggguuugccacauca

SEQ ID NO: 3907668 - RNA, 19 nt, Shigella flexneri 2a str. 301
ccggguuuucaaugauaaa

SEQ ID NO: 3907669 - RNA, 21 nt, Shigella flexneri 2a str. 301
ccgguaacguccaucacuucg

SEQ ID NO: 3907670 - RNA, 13 nt, Shigella flexneri 2a str. 301
ccgguaauaaugc

SEQ ID NO: 3907671 - RNA, 14 nt, Shigella flexneri 2a str. 301
ccgguaaucaggca

SEQ ID NO: 3907672 - RNA, 21 nt, Shigella flexneri 2a str. 301
ccgguacaaacaucauccagu

SEQ ID NO: 3907673 - RNA, 13 nt, Shigella flexneri 2a str. 301
ccgguacgccgcg

SEQ ID NO: 3907674 - RNA, 15 nt, Shigella flexneri 2a str. 301
ccgguagucaccgcc

SEQ ID NO: 3907675 - RNA, 18 nt, Shigella flexneri 2a str. 301
ccgguagucaccgcccag

SEQ ID NO: 3907676 - RNA, 21 nt, Shigella flexneri 2a str. 301
ccgguaugaauuugcagccau

SEQ ID NO: 3907677 - RNA, 22 nt, Shigella flexneri 2a str. 301
ccggucaagcgcagcgcccccg

SEQ ID NO: 3907678 - RNA, 19 nt, Shigella flexneri 2a str. 301
ccggucacgcccggaauuu

SEQ ID NO: 3907679 - RNA, 22 nt, Shigella flexneri 2a str. 301
ccggucagccauugcuaccgcu

SEQ ID NO: 3907680 - RNA, 13 nt, Shigella flexneri 2a str. 301
ccggucagguggu

SEQ ID NO: 3907681 - RNA, 14 nt, Shigella flexneri 2a str. 301
ccgguccuggcgau

SEQ ID NO: 3907682 - RNA, 15 nt, Shigella flexneri 2a str. 301
ccggucgcgcgggaa

SEQ ID NO: 3907683 - RNA, 21 nt, Shigella flexneri 2a str. 301
ccggucugguguaucugcugu

SEQ ID NO: 3907684 - RNA, 18 nt, Shigella flexneri 2a str. 301
ccggucuuuucucauuac

SEQ ID NO: 3907685 - RNA, 17 nt, Shigella flexneri 2a str. 301
ccggugaaucgcaauuu

SEQ ID NO: 3907686 - RNA, 14 nt, Shigella flexneri 2a str. 301
ccggugcaucaaca

SEQ ID NO: 3907687 - RNA, 13 nt, Shigella flexneri 2a str. 301
ccggugucgaugu

SEQ ID NO: 3907688 - RNA, 20 nt, Shigella flexneri 2a str. 301
ccgguuaaaucgacguucug

SEQ ID NO: 3907689 - RNA, 15 nt, Shigella flexneri 2a str. 301
ccgguuaaccuuuaa

SEQ ID NO: 3907690 - RNA, 15 nt, Shigella flexneri 2a str. 301
ccgguuaacgccgcg

SEQ ID NO: 3907691 - RNA, 17 nt, Shigella flexneri 2a str. 301
ccgguuacgccaccagc

SEQ ID NO: 3907692 - RNA, 22 nt, Shigella flexneri 2a str. 301
ccgguuacgccaccagcugaca

SEQ ID NO: 3907693 - RNA, 18 nt, Shigella flexneri 2a str. 301
ccgguuaucggcgcgcca

SEQ ID NO: 3907694 - RNA, 14 nt, Shigella flexneri 2a str. 301
ccgguucaucacga

SEQ ID NO: 3907695 - RNA, 15 nt, Shigella flexneri 2a str. 301
ccgguucccagaccu

SEQ ID NO: 3907696 - RNA, 21 nt, Shigella flexneri 2a str. 301
ccgguucggccauauccagcc

SEQ ID NO: 3907697 - RNA, 23 nt, Shigella flexneri 2a str. 301
ccgguucgggaaauugcagagcu

SEQ ID NO: 3907698 - RNA, 18 nt, Shigella flexneri 2a str. 301
ccgguucgucauacucca

SEQ ID NO: 3907699 - RNA, 19 nt, Shigella flexneri 2a str. 301
ccgguucgucauacuccag

SEQ ID NO: 3907700 - RNA, 19 nt, Shigella flexneri 2a str. 301
ccgguugcaguucugccau

SEQ ID NO: 3907701 - RNA, 21 nt, Shigella flexneri 2a str. 301
ccgguuggcgacugaugaagu

SEQ ID NO: 3907702 - RNA, 12 nt, Shigella flexneri 2a str. 301
ccgguuucgcca

SEQ ID NO: 3907703 - RNA, 18 nt, Shigella flexneri 2a str. 301
ccgguuuguaggccugau

SEQ ID NO: 3907704 - RNA, 18 nt, Shigella flexneri 2a str. 301
ccgguuuuacuuugccuu

SEQ ID NO: 3907705 - RNA, 16 nt, Shigella flexneri 2a str. 301
ccgguuuugcaggaaa

SEQ ID NO: 3907706 - RNA, 20 nt, Shigella flexneri 2a str. 301
ccguaaagcccauaccacag

SEQ ID NO: 3907707 - RNA, 19 nt, Shigella flexneri 2a str. 301
ccguaacgcccuucaggug

SEQ ID NO: 3907708 - RNA, 14 nt, Shigella flexneri 2a str. 301
ccguaagcgcggag

SEQ ID NO: 3907709 - RNA, 21 nt, Shigella flexneri 2a str. 301
ccguaaguaagauaaaagcaa

SEQ ID NO: 3907710 - RNA, 19 nt, Shigella flexneri 2a str. 301
ccguaauagauccuuuuuc

SEQ ID NO: 3907711 - RNA, 23 nt, Shigella flexneri 2a str. 301
ccguaaucaccacaugccgcgcg

SEQ ID NO: 3907712 - RNA, 19 nt, Shigella flexneri 2a str. 301
ccguaauccguggucuguu

SEQ ID NO: 3907713 - RNA, 16 nt, Shigella flexneri 2a str. 301
ccguaaugaucgcgau

SEQ ID NO: 3907714 - RNA, 13 nt, Shigella flexneri 2a str. 301
ccguaauuccgcu

SEQ ID NO: 3907715 - RNA, 23 nt, Shigella flexneri 2a str. 301
ccguaauuuuuacuccacuuccu

SEQ ID NO: 3907716 - RNA, 19 nt, Shigella flexneri 2a str. 301
ccguacaaagugccgccag

SEQ ID NO: 3907717 - RNA, 21 nt, Shigella flexneri 2a str. 301
ccguacaaagugccgccagcu

SEQ ID NO: 3907718 - RNA, 18 nt, Shigella flexneri 2a str. 301
ccguacauagcgucaaga

SEQ ID NO: 3907719 - RNA, 15 nt, Shigella flexneri 2a str. 301
ccguaccacgccacu

SEQ ID NO: 3907720 - RNA, 22 nt, Shigella flexneri 2a str. 301
ccguaccaucguaagcgccagg

SEQ ID NO: 3907721 - RNA, 13 nt, Shigella flexneri 2a str. 301
ccguacccagcaa

SEQ ID NO: 3907722 - RNA, 16 nt, Shigella flexneri 2a str. 301
ccguacgcaucaccag

SEQ ID NO: 3907723 - RNA, 17 nt, Shigella flexneri 2a str. 301
ccguacguuacguacuu

SEQ ID NO: 3907724 - RNA, 23 nt, Shigella flexneri 2a str. 301
ccguacugaaugaucacuuguuc

SEQ ID NO: 3907725 - RNA, 14 nt, Shigella flexneri 2a str. 301
ccguacugcauaau

SEQ ID NO: 3907726 - RNA, 18 nt, Shigella flexneri 2a str. 301
ccguagcuucaccgcauc

SEQ ID NO: 3907727 - RNA, 13 nt, Shigella flexneri 2a str. 301
ccguaggccggau

SEQ ID NO: 3907728 - RNA, 15 nt, Shigella flexneri 2a str. 301
ccguaguggccacag

SEQ ID NO: 3907729 - RNA, 14 nt, Shigella flexneri 2a str. 301
ccguaguuccacau

SEQ ID NO: 3907730 - RNA, 12 nt, Shigella flexneri 2a str. 301
ccguauccggca

SEQ ID NO: 3907731 - RNA, 17 nt, Shigella flexneri 2a str. 301
ccguauuacugagaugg

SEQ ID NO: 3907732 - RNA, 20 nt, Shigella flexneri 2a str. 301
ccgucaacguuaacuuucgu

SEQ ID NO: 3907733 - RNA, 19 nt, Shigella flexneri 2a str. 301
ccgucacaggcacaccgcc

SEQ ID NO: 3907734 - RNA, 23 nt, Shigella flexneri 2a str. 301
ccgucaccauugguugcgcuucu

SEQ ID NO: 3907735 - RNA, 16 nt, Shigella flexneri 2a str. 301
ccgucaccccugugga

SEQ ID NO: 3907736 - RNA, 18 nt, Shigella flexneri 2a str. 301
ccgucaccggaauaauga

SEQ ID NO: 3907737 - RNA, 17 nt, Shigella flexneri 2a str. 301
ccgucaccggcacaaag

SEQ ID NO: 3907738 - RNA, 19 nt, Shigella flexneri 2a str. 301
ccgucaccggcacaaagcu

SEQ ID NO: 3907739 - RNA, 23 nt, Shigella flexneri 2a str. 301
ccgucacgcguugcuaugcugaa

SEQ ID NO: 3907740 - RNA, 17 nt, Shigella flexneri 2a str. 301
ccgucacgguaauaaca

SEQ ID NO: 3907741 - RNA, 16 nt, Shigella flexneri 2a str. 301
ccgucagaccaccggu

SEQ ID NO: 3907742 - RNA, 18 nt, Shigella flexneri 2a str. 301
ccgucagagcaccaucgc

SEQ ID NO: 3907743 - RNA, 12 nt, Shigella flexneri 2a str. 301
ccgucagcagga

SEQ ID NO: 3907744 - RNA, 14 nt, Shigella flexneri 2a str. 301
ccgucagccacucc

SEQ ID NO: 3907745 - RNA, 16 nt, Shigella flexneri 2a str. 301
ccgucagcgcaugauu

SEQ ID NO: 3907746 - RNA, 19 nt, Shigella flexneri 2a str. 301
ccgucagcggcaauucuuu

SEQ ID NO: 3907747 - RNA, 21 nt, Shigella flexneri 2a str. 301
ccgucaguuuuucacccgcaa

SEQ ID NO: 3907748 - RNA, 17 nt, Shigella flexneri 2a str. 301
ccgucaucacgcaggcu

SEQ ID NO: 3907749 - RNA, 17 nt, Shigella flexneri 2a str. 301
ccgucauuguuaacgcc

SEQ ID NO: 3907750 - RNA, 14 nt, Shigella flexneri 2a str. 301
ccguccccucgccc

SEQ ID NO: 3907751 - RNA, 16 nt, Shigella flexneri 2a str. 301
ccgucccuaccgguaa

SEQ ID NO: 3907752 - RNA, 15 nt, Shigella flexneri 2a str. 301
ccguccggcgggcaa

SEQ ID NO: 3907753 - RNA, 23 nt, Shigella flexneri 2a str. 301
ccguccguuauaucgcgcugacg

SEQ ID NO: 3907754 - RNA, 23 nt, Shigella flexneri 2a str. 301
ccguccuucaucuucauccggcu

SEQ ID NO: 3907755 - RNA, 22 nt, Shigella flexneri 2a str. 301
ccgucgagcagagaaacgccag

SEQ ID NO: 3907756 - RNA, 21 nt, Shigella flexneri 2a str. 301
ccgucgcaauacccugaccca

SEQ ID NO: 3907757 - RNA, 17 nt, Shigella flexneri 2a str. 301
ccgucgcgcccuccugc

SEQ ID NO: 3907758 - RNA, 18 nt, Shigella flexneri 2a str. 301
ccgucgcgcccuccugca

SEQ ID NO: 3907759 - RNA, 16 nt, Shigella flexneri 2a str. 301
ccgucgggucagcucc

SEQ ID NO: 3907760 - RNA, 17 nt, Shigella flexneri 2a str. 301
ccgucguagccaccauc

SEQ ID NO: 3907761 - RNA, 14 nt, Shigella flexneri 2a str. 301
ccgucgugaaugcc

SEQ ID NO: 3907762 - RNA, 16 nt, Shigella flexneri 2a str. 301
ccgucguggucgugau

SEQ ID NO: 3907763 - RNA, 14 nt, Shigella flexneri 2a str. 301
ccgucuacaaaaac

SEQ ID NO: 3907764 - RNA, 16 nt, Shigella flexneri 2a str. 301
ccgucuucccgcagcc

SEQ ID NO: 3907765 - RNA, 17 nt, Shigella flexneri 2a str. 301
ccgugaacaauuucagc

SEQ ID NO: 3907766 - RNA, 18 nt, Shigella flexneri 2a str. 301
ccgugaacguggccauga

SEQ ID NO: 3907767 - RNA, 17 nt, Shigella flexneri 2a str. 301
ccgugaagguugcgccu

SEQ ID NO: 3907768 - RNA, 21 nt, Shigella flexneri 2a str. 301
ccgugaugcgcaagggucguc

SEQ ID NO: 3907769 - RNA, 13 nt, Shigella flexneri 2a str. 301
ccgugccagagca

SEQ ID NO: 3907770 - RNA, 16 nt, Shigella flexneri 2a str. 301
ccgugccggacggucg

SEQ ID NO: 3907771 - RNA, 13 nt, Shigella flexneri 2a str. 301
ccgugcgcuuuuu

SEQ ID NO: 3907772 - RNA, 18 nt, Shigella flexneri 2a str. 301
ccgugcugacucagcggc

SEQ ID NO: 3907773 - RNA, 21 nt, Shigella flexneri 2a str. 301
ccgugcugacucagcggcugc

SEQ ID NO: 3907774 - RNA, 18 nt, Shigella flexneri 2a str. 301
ccgugcugugugccgcga

SEQ ID NO: 3907775 - RNA, 20 nt, Shigella flexneri 2a str. 301
ccguggucuguuuaaccgcu

SEQ ID NO: 3907776 - RNA, 23 nt, Shigella flexneri 2a str. 301
ccguggucuguuuaaccgcuuca

SEQ ID NO: 3907777 - RNA, 23 nt, Shigella flexneri 2a str. 301
ccguggugaguuguggcgcgucg

SEQ ID NO: 3907778 - RNA, 16 nt, Shigella flexneri 2a str. 301
ccgugguucauaugau

SEQ ID NO: 3907779 - RNA, 16 nt, Shigella flexneri 2a str. 301
ccgugugccgacaucg

SEQ ID NO: 3907780 - RNA, 15 nt, Shigella flexneri 2a str. 301
ccguuaaccguggga

SEQ ID NO: 3907781 - RNA, 17 nt, Shigella flexneri 2a str. 301
ccguuaaguuuaacugc

SEQ ID NO: 3907782 - RNA, 17 nt, Shigella flexneri 2a str. 301
ccguuacgauucucugc

SEQ ID NO: 3907783 - RNA, 21 nt, Shigella flexneri 2a str. 301
ccguuauacaucgcuuuccag

SEQ ID NO: 3907784 - RNA, 13 nt, Shigella flexneri 2a str. 301
ccguuaucacagc

SEQ ID NO: 3907785 - RNA, 17 nt, Shigella flexneri 2a str. 301
ccguucaaaacagcccu

SEQ ID NO: 3907786 - RNA, 22 nt, Shigella flexneri 2a str. 301
ccguucauauggagcaaaagug

SEQ ID NO: 3907787 - RNA, 17 nt, Shigella flexneri 2a str. 301
ccguuccacccagcuca

SEQ ID NO: 3907788 - RNA, 23 nt, Shigella flexneri 2a str. 301
ccguucgccaggucagagagcca

SEQ ID NO: 3907789 - RNA, 17 nt, Shigella flexneri 2a str. 301
ccguucgcuaccuuuca

SEQ ID NO: 3907790 - RNA, 15 nt, Shigella flexneri 2a str. 301
ccguucgcuggaagc

SEQ ID NO: 3907791 - RNA, 19 nt, Shigella flexneri 2a str. 301
ccguucuuaagauauaaag

SEQ ID NO: 3907792 - RNA, 15 nt, Shigella flexneri 2a str. 301
ccguugaccagcauc

SEQ ID NO: 3907793 - RNA, 19 nt, Shigella flexneri 2a str. 301
ccguugcaauacuuccgcu

SEQ ID NO: 3907794 - RNA, 23 nt, Shigella flexneri 2a str. 301
ccguugccgaacguaggcuggau

SEQ ID NO: 3907795 - RNA, 14 nt, Shigella flexneri 2a str. 301
ccguugccgcagcg

SEQ ID NO: 3907796 - RNA, 15 nt, Shigella flexneri 2a str. 301
ccguugcgccaacca

SEQ ID NO: 3907797 - RNA, 18 nt, Shigella flexneri 2a str. 301
ccguugcgcccaucauca

SEQ ID NO: 3907798 - RNA, 16 nt, Shigella flexneri 2a str. 301
ccguugcuguuccauc

SEQ ID NO: 3907799 - RNA, 21 nt, Shigella flexneri 2a str. 301
ccguugcuugaugcacuggga

SEQ ID NO: 3907800 - RNA, 21 nt, Shigella flexneri 2a str. 301
ccguuggcagaccgccaacca

SEQ ID NO: 3907801 - RNA, 15 nt, Shigella flexneri 2a str. 301
ccguuggcggcguga

SEQ ID NO: 3907802 - RNA, 20 nt, Shigella flexneri 2a str. 301
ccguuggcguaaaucaaacc

SEQ ID NO: 3907803 - RNA, 23 nt, Shigella flexneri 2a str. 301
ccguugguuaauuuuucaaacuc

SEQ ID NO: 3907804 - RNA, 13 nt, Shigella flexneri 2a str. 301
ccguuuaauauua

SEQ ID NO: 3907805 - RNA, 18 nt, Shigella flexneri 2a str. 301
ccguuuacgcuuuccagc

SEQ ID NO: 3907806 - RNA, 16 nt, Shigella flexneri 2a str. 301
ccguuuacgucauuac

SEQ ID NO: 3907807 - RNA, 19 nt, Shigella flexneri 2a str. 301
ccguuuacgucauuaccgc

SEQ ID NO: 3907808 - RNA, 17 nt, Shigella flexneri 2a str. 301
ccguuucagccccuugc

SEQ ID NO: 3907809 - RNA, 17 nt, Shigella flexneri 2a str. 301
ccguuuccucaagcgga

SEQ ID NO: 3907810 - RNA, 12 nt, Shigella flexneri 2a str. 301
ccguuucuccac

SEQ ID NO: 3907811 - RNA, 23 nt, Shigella flexneri 2a str. 301
ccguuugccccggcugcgcgacg

SEQ ID NO: 3907812 - RNA, 12 nt, Shigella flexneri 2a str. 301
ccguuuuccagc

SEQ ID NO: 3907813 - RNA, 14 nt, Shigella flexneri 2a str. 301
ccguuuuccagccu

SEQ ID NO: 3907814 - RNA, 20 nt, Shigella flexneri 2a str. 301
ccguuuucuuuuacaucuac

SEQ ID NO: 3907815 - RNA, 23 nt, Shigella flexneri 2a str. 301
ccguuuugugguguuuuuuuaau

SEQ ID NO: 3907816 - RNA, 22 nt, Shigella flexneri 2a str. 301
ccguuuuuacccagcagcagcg

SEQ ID NO: 3907817 - RNA, 18 nt, Shigella flexneri 2a str. 301
ccguuuuuuaguuagcaa

SEQ ID NO: 3907818 - RNA, 17 nt, Shigella flexneri 2a str. 301
ccguuuuuugaaacagg

SEQ ID NO: 3907819 - RNA, 13 nt, Shigella flexneri 2a str. 301
ccguuuuuuuucu

SEQ ID NO: 3907820 - RNA, 11 nt, Shigella flexneri 2a str. 301
ccuaaaaaauu

SEQ ID NO: 3907821 - RNA, 18 nt, Shigella flexneri 2a str. 301
ccuaaaagcacgccagac

SEQ ID NO: 3907822 - RNA, 18 nt, Shigella flexneri 2a str. 301
ccuaaacguuuaaaaacu

SEQ ID NO: 3907823 - RNA, 22 nt, Shigella flexneri 2a str. 301
ccuaaaggcaaaaugccagccc

SEQ ID NO: 3907824 - RNA, 17 nt, Shigella flexneri 2a str. 301
ccuaacaaccaucccca

SEQ ID NO: 3907825 - RNA, 18 nt, Shigella flexneri 2a str. 301
ccuaacaaccauccccaa

SEQ ID NO: 3907826 - RNA, 15 nt, Shigella flexneri 2a str. 301
ccuaacaaggcuucg

SEQ ID NO: 3907827 - RNA, 13 nt, Shigella flexneri 2a str. 301
ccuaacaucaucc

SEQ ID NO: 3907828 - RNA, 15 nt, Shigella flexneri 2a str. 301
ccuaacauuuuacuu

SEQ ID NO: 3907829 - RNA, 23 nt, Shigella flexneri 2a str. 301
ccuaacccucuccccaagggggc

SEQ ID NO: 3907830 - RNA, 18 nt, Shigella flexneri 2a str. 301
ccuaagccauuuaacuca

SEQ ID NO: 3907831 - RNA, 12 nt, Shigella flexneri 2a str. 301
ccuaagcuuucg

SEQ ID NO: 3907832 - RNA, 13 nt, Shigella flexneri 2a str. 301
ccuaaggaaucca

SEQ ID NO: 3907833 - RNA, 15 nt, Shigella flexneri 2a str. 301
ccuaaggaauccagc

SEQ ID NO: 3907834 - RNA, 17 nt, Shigella flexneri 2a str. 301
ccuaauuacauaacacu

SEQ ID NO: 3907835 - RNA, 13 nt, Shigella flexneri 2a str. 301
ccuaauuuuuuga

SEQ ID NO: 3907836 - RNA, 13 nt, Shigella flexneri 2a str. 301
ccuacaaaaccug

SEQ ID NO: 3907837 - RNA, 13 nt, Shigella flexneri 2a str. 301
ccuacaaaaucua

SEQ ID NO: 3907838 - RNA, 19 nt, Shigella flexneri 2a str. 301
ccuacaaaaucuauugcaa

SEQ ID NO: 3907839 - RNA, 14 nt, Shigella flexneri 2a str. 301
ccuacaaaaucuug

SEQ ID NO: 3907840 - RNA, 17 nt, Shigella flexneri 2a str. 301
ccuacaaacguugcuga

SEQ ID NO: 3907841 - RNA, 13 nt, Shigella flexneri 2a str. 301
ccuacaaagggcu

SEQ ID NO: 3907842 - RNA, 19 nt, Shigella flexneri 2a str. 301
ccuacaacuccguugaaau

SEQ ID NO: 3907843 - RNA, 18 nt, Shigella flexneri 2a str. 301
ccuacacauuaucucaac

SEQ ID NO: 3907844 - RNA, 17 nt, Shigella flexneri 2a str. 301
ccuacaggaaacgauuc

SEQ ID NO: 3907845 - RNA, 18 nt, Shigella flexneri 2a str. 301
ccuacagguaagguaaug

SEQ ID NO: 3907846 - RNA, 20 nt, Shigella flexneri 2a str. 301
ccuacaugauuucugcaaua

SEQ ID NO: 3907847 - RNA, 12 nt, Shigella flexneri 2a str. 301
ccuaccaaaccu

SEQ ID NO: 3907848 - RNA, 14 nt, Shigella flexneri 2a str. 301
ccuaccauaaucag

SEQ ID NO: 3907849 - RNA, 19 nt, Shigella flexneri 2a str. 301
ccuaccgccagguuucaau

SEQ ID NO: 3907850 - RNA, 18 nt, Shigella flexneri 2a str. 301
ccuaccugcaguucauca

SEQ ID NO: 3907851 - RNA, 17 nt, Shigella flexneri 2a str. 301
ccuacgugcgcaauaac

SEQ ID NO: 3907852 - RNA, 21 nt, Shigella flexneri 2a str. 301
ccuacgugguuuaugcaauau

SEQ ID NO: 3907853 - RNA, 13 nt, Shigella flexneri 2a str. 301
ccuacugcuccua

SEQ ID NO: 3907854 - RNA, 21 nt, Shigella flexneri 2a str. 301
ccuacuuuuuaauucaggaaa

SEQ ID NO: 3907855 - RNA, 20 nt, Shigella flexneri 2a str. 301
ccuagaaggaacaacguauc

SEQ ID NO: 3907856 - RNA, 16 nt, Shigella flexneri 2a str. 301
ccuagcaaacuaucug

SEQ ID NO: 3907857 - RNA, 14 nt, Shigella flexneri 2a str. 301
ccuaggcauagaaa

SEQ ID NO: 3907858 - RNA, 18 nt, Shigella flexneri 2a str. 301
ccuauauuccuuuaucau

SEQ ID NO: 3907859 - RNA, 16 nt, Shigella flexneri 2a str. 301
ccuaugcauaauccug

SEQ ID NO: 3907860 - RNA, 23 nt, Shigella flexneri 2a str. 301
ccucaaacgagggguuuuuuguu

SEQ ID NO: 3907861 - RNA, 16 nt, Shigella flexneri 2a str. 301
ccucaaccccuuccug

SEQ ID NO: 3907862 - RNA, 17 nt, Shigella flexneri 2a str. 301
ccucaaccccuuccuga

SEQ ID NO: 3907863 - RNA, 15 nt, Shigella flexneri 2a str. 301
ccucaagcucgccac

SEQ ID NO: 3907864 - RNA, 20 nt, Shigella flexneri 2a str. 301
ccucacagcuaaucaucauc

SEQ ID NO: 3907865 - RNA, 16 nt, Shigella flexneri 2a str. 301
ccucacaugaguugcu

SEQ ID NO: 3907866 - RNA, 22 nt, Shigella flexneri 2a str. 301
ccucaccauuccguuucuccac

SEQ ID NO: 3907867 - RNA, 16 nt, Shigella flexneri 2a str. 301
ccucacgaucacagca

SEQ ID NO: 3907868 - RNA, 21 nt, Shigella flexneri 2a str. 301
ccucacgaucacagcagucca

SEQ ID NO: 3907869 - RNA, 22 nt, Shigella flexneri 2a str. 301
ccucacgaucacagcaguccag

SEQ ID NO: 3907870 - RNA, 19 nt, Shigella flexneri 2a str. 301
ccucacgcauucucuuuuc

SEQ ID NO: 3907871 - RNA, 16 nt, Shigella flexneri 2a str. 301
ccucacggcuuagcaa

SEQ ID NO: 3907872 - RNA, 15 nt, Shigella flexneri 2a str. 301
ccucauucaccaguu

SEQ ID NO: 3907873 - RNA, 18 nt, Shigella flexneri 2a str. 301
ccucauuucccuguugcc

SEQ ID NO: 3907874 - RNA, 18 nt, Shigella flexneri 2a str. 301
ccuccacauucagucccg

SEQ ID NO: 3907875 - RNA, 16 nt, Shigella flexneri 2a str. 301
ccuccacgcccagcgc

SEQ ID NO: 3907876 - RNA, 15 nt, Shigella flexneri 2a str. 301
ccuccagcuccgcca

SEQ ID NO: 3907877 - RNA, 16 nt, Shigella flexneri 2a str. 301
ccuccagcuccgccag

SEQ ID NO: 3907878 - RNA, 19 nt, Shigella flexneri 2a str. 301
ccuccagcuccgccagcgu

SEQ ID NO: 3907879 - RNA, 14 nt, Shigella flexneri 2a str. 301
ccuccagcuccucg

SEQ ID NO: 3907880 - RNA, 20 nt, Shigella flexneri 2a str. 301
ccuccauaagaguagcccga

SEQ ID NO: 3907881 - RNA, 15 nt, Shigella flexneri 2a str. 301
ccuccaugaaaauag

SEQ ID NO: 3907882 - RNA, 15 nt, Shigella flexneri 2a str. 301
ccuccccaacauaua

SEQ ID NO: 3907883 - RNA, 13 nt, Shigella flexneri 2a str. 301
ccucccccugagc

SEQ ID NO: 3907884 - RNA, 23 nt, Shigella flexneri 2a str. 301
ccucccgcuguuuguucaagcgc

SEQ ID NO: 3907885 - RNA, 16 nt, Shigella flexneri 2a str. 301
ccucccguuucccugu

SEQ ID NO: 3907886 - RNA, 12 nt, Shigella flexneri 2a str. 301
ccuccgcaauau

SEQ ID NO: 3907887 - RNA, 14 nt, Shigella flexneri 2a str. 301
ccuccggcguacag

SEQ ID NO: 3907888 - RNA, 11 nt, Shigella flexneri 2a str. 301
ccuccggcguu

SEQ ID NO: 3907889 - RNA, 12 nt, Shigella flexneri 2a str. 301
ccuccggcuggg

SEQ ID NO: 3907890 - RNA, 23 nt, Shigella flexneri 2a str. 301
ccuccgggaccuuucugaugcau

SEQ ID NO: 3907891 - RNA, 11 nt, Shigella flexneri 2a str. 301
ccuccugcagc

SEQ ID NO: 3907892 - RNA, 13 nt, Shigella flexneri 2a str. 301
ccuccugcagcgu

SEQ ID NO: 3907893 - RNA, 14 nt, Shigella flexneri 2a str. 301
ccuccugucuuccc

SEQ ID NO: 3907894 - RNA, 18 nt, Shigella flexneri 2a str. 301
ccuccugucuucccugcu

SEQ ID NO: 3907895 - RNA, 21 nt, Shigella flexneri 2a str. 301
ccuccugucuucccugcugaa

SEQ ID NO: 3907896 - RNA, 20 nt, Shigella flexneri 2a str. 301
ccuccuguucugcgcgccau

SEQ ID NO: 3907897 - RNA, 19 nt, Shigella flexneri 2a str. 301
ccuccuguucugugcgcca

SEQ ID NO: 3907898 - RNA, 17 nt, Shigella flexneri 2a str. 301
ccuccuuuuaucaucac

SEQ ID NO: 3907899 - RNA, 22 nt, Shigella flexneri 2a str. 301
ccucgagaaauuuuuauuauuu

SEQ ID NO: 3907900 - RNA, 16 nt, Shigella flexneri 2a str. 301
ccucgaguccuuccag

SEQ ID NO: 3907901 - RNA, 17 nt, Shigella flexneri 2a str. 301
ccucgaucggcucuucc

SEQ ID NO: 3907902 - RNA, 14 nt, Shigella flexneri 2a str. 301
ccucgccccuccgg

SEQ ID NO: 3907903 - RNA, 15 nt, Shigella flexneri 2a str. 301
ccucgccguuuucug

SEQ ID NO: 3907904 - RNA, 22 nt, Shigella flexneri 2a str. 301
ccucgcgcguccacggugcgac

SEQ ID NO: 3907905 - RNA, 14 nt, Shigella flexneri 2a str. 301
ccucgcuccauacu

SEQ ID NO: 3907906 - RNA, 19 nt, Shigella flexneri 2a str. 301
ccucgcuggucagcgccag

SEQ ID NO: 3907907 - RNA, 18 nt, Shigella flexneri 2a str. 301
ccucgggauccaugcacg

SEQ ID NO: 3907908 - RNA, 19 nt, Shigella flexneri 2a str. 301
ccucguaaugcuccggcuc

SEQ ID NO: 3907909 - RNA, 14 nt, Shigella flexneri 2a str. 301
ccucguucuucccu

SEQ ID NO: 3907910 - RNA, 18 nt, Shigella flexneri 2a str. 301
ccucguuucgcccugccu

SEQ ID NO: 3907911 - RNA, 15 nt, Shigella flexneri 2a str. 301
ccucguuuugccgcc

SEQ ID NO: 3907912 - RNA, 18 nt, Shigella flexneri 2a str. 301
ccucguuuugccgccauc

SEQ ID NO: 3907913 - RNA, 18 nt, Shigella flexneri 2a str. 301
ccucuaacagaucaucca

SEQ ID NO: 3907914 - RNA, 17 nt, Shigella flexneri 2a str. 301
ccucuaacucuucugaa

SEQ ID NO: 3907915 - RNA, 18 nt, Shigella flexneri 2a str. 301
ccucuaucuguuugccag

SEQ ID NO: 3907916 - RNA, 15 nt, Shigella flexneri 2a str. 301
ccucucagaaagggg

SEQ ID NO: 3907917 - RNA, 21 nt, Shigella flexneri 2a str. 301
ccucuccccgaaggggcgagg

SEQ ID NO: 3907918 - RNA, 16 nt, Shigella flexneri 2a str. 301
ccucuccuguucucac

SEQ ID NO: 3907919 - RNA, 12 nt, Shigella flexneri 2a str. 301
ccucucuucgcu

SEQ ID NO: 3907920 - RNA, 14 nt, Shigella flexneri 2a str. 301
ccucugcucccggc

SEQ ID NO: 3907921 - RNA, 15 nt, Shigella flexneri 2a str. 301
ccucuuacacuugac

SEQ ID NO: 3907922 - RNA, 14 nt, Shigella flexneri 2a str. 301
ccucuuacgccgcc

SEQ ID NO: 3907923 - RNA, 15 nt, Shigella flexneri 2a str. 301
ccucuuacgccgcca

SEQ ID NO: 3907924 - RNA, 15 nt, Shigella flexneri 2a str. 301
ccucuucaauuaaca

SEQ ID NO: 3907925 - RNA, 16 nt, Shigella flexneri 2a str. 301
ccucuucacguuuuuc

SEQ ID NO: 3907926 - RNA, 19 nt, Shigella flexneri 2a str. 301
ccucuucauacaucugcaa

SEQ ID NO: 3907927 - RNA, 16 nt, Shigella flexneri 2a str. 301
ccucuuccacauuuuc

SEQ ID NO: 3907928 - RNA, 15 nt, Shigella flexneri 2a str. 301
ccucuuccauaaucg

SEQ ID NO: 3907929 - RNA, 20 nt, Shigella flexneri 2a str. 301
ccucuuccauuucaucgcca

SEQ ID NO: 3907930 - RNA, 17 nt, Shigella flexneri 2a str. 301
ccucuucuaccacauga

SEQ ID NO: 3907931 - RNA, 11 nt, Shigella flexneri 2a str. 301
ccucuucuuuu

SEQ ID NO: 3907932 - RNA, 18 nt, Shigella flexneri 2a str. 301
ccucuuuacgcaaaauca

SEQ ID NO: 3907933 - RNA, 13 nt, Shigella flexneri 2a str. 301
ccucuuucuagac

SEQ ID NO: 3907934 - RNA, 14 nt, Shigella flexneri 2a str. 301
ccugaaaaaacaaa

SEQ ID NO: 3907935 - RNA, 13 nt, Shigella flexneri 2a str. 301
ccugaaaccauag

SEQ ID NO: 3907936 - RNA, 22 nt, Shigella flexneri 2a str. 301
ccugaaacggaaucgcccgcug

SEQ ID NO: 3907937 - RNA, 18 nt, Shigella flexneri 2a str. 301
ccugaaagcgugucaugu

SEQ ID NO: 3907938 - RNA, 20 nt, Shigella flexneri 2a str. 301
ccugaaauguuugcaauaaa

SEQ ID NO: 3907939 - RNA, 13 nt, Shigella flexneri 2a str. 301
ccugaacaagcaa

SEQ ID NO: 3907940 - RNA, 18 nt, Shigella flexneri 2a str. 301
ccugaaccgaacuuuuug

SEQ ID NO: 3907941 - RNA, 12 nt, Shigella flexneri 2a str. 301
ccugaauaaacg

SEQ ID NO: 3907942 - RNA, 15 nt, Shigella flexneri 2a str. 301
ccugaauaacaccag

SEQ ID NO: 3907943 - RNA, 19 nt, Shigella flexneri 2a str. 301
ccugaauaacaccagccag

SEQ ID NO: 3907944 - RNA, 22 nt, Shigella flexneri 2a str. 301
ccugaauaacaccagccagaau

SEQ ID NO: 3907945 - RNA, 11 nt, Shigella flexneri 2a str. 301
ccugaauaauc

SEQ ID NO: 3907946 - RNA, 20 nt, Shigella flexneri 2a str. 301
ccugaauaaucguaaucagc

SEQ ID NO: 3907947 - RNA, 22 nt, Shigella flexneri 2a str. 301
ccugaauaaucguaaucagcau

SEQ ID NO: 3907948 - RNA, 17 nt, Shigella flexneri 2a str. 301
ccugaauggugaccugc

SEQ ID NO: 3907949 - RNA, 19 nt, Shigella flexneri 2a str. 301
ccugaauggugaccugcag

SEQ ID NO: 3907950 - RNA, 18 nt, Shigella flexneri 2a str. 301
ccugaaugucuccauacu

SEQ ID NO: 3907951 - RNA, 16 nt, Shigella flexneri 2a str. 301
ccugaauuugcuccag

SEQ ID NO: 3907952 - RNA, 20 nt, Shigella flexneri 2a str. 301
ccugaauuugcuccagaaac

SEQ ID NO: 3907953 - RNA, 13 nt, Shigella flexneri 2a str. 301
ccugacaaaucau

SEQ ID NO: 3907954 - RNA, 21 nt, Shigella flexneri 2a str. 301
ccugacaacaaaacgggggcu

SEQ ID NO: 3907955 - RNA, 15 nt, Shigella flexneri 2a str. 301
ccugacagcagagca

SEQ ID NO: 3907956 - RNA, 22 nt, Shigella flexneri 2a str. 301
ccugacaggcgggaagaacggc

SEQ ID NO: 3907957 - RNA, 14 nt, Shigella flexneri 2a str. 301
ccugaccaaagccc

SEQ ID NO: 3907958 - RNA, 13 nt, Shigella flexneri 2a str. 301
ccugaccaccaua

SEQ ID NO: 3907959 - RNA, 14 nt, Shigella flexneri 2a str. 301
ccugaccaccauau

SEQ ID NO: 3907960 - RNA, 19 nt, Shigella flexneri 2a str. 301
ccugaccauuaucaaacag

SEQ ID NO: 3907961 - RNA, 23 nt, Shigella flexneri 2a str. 301
ccugacccagcaccaguaccauu

SEQ ID NO: 3907962 - RNA, 23 nt, Shigella flexneri 2a str. 301
ccugacgaccaaugacagccagc

SEQ ID NO: 3907963 - RNA, 16 nt, Shigella flexneri 2a str. 301
ccugacgcaauaacac

SEQ ID NO: 3907964 - RNA, 18 nt, Shigella flexneri 2a str. 301
ccugacgcccguuuucac

SEQ ID NO: 3907965 - RNA, 19 nt, Shigella flexneri 2a str. 301
ccugacguaacgaccacca

SEQ ID NO: 3907966 - RNA, 19 nt, Shigella flexneri 2a str. 301
ccugacucagcaucugcaa

SEQ ID NO: 3907967 - RNA, 20 nt, Shigella flexneri 2a str. 301
ccugacucggacgcguuuca

SEQ ID NO: 3907968 - RNA, 12 nt, Shigella flexneri 2a str. 301
ccugacugguua

SEQ ID NO: 3907969 - RNA, 17 nt, Shigella flexneri 2a str. 301
ccugacuuugccccagc

SEQ ID NO: 3907970 - RNA, 17 nt, Shigella flexneri 2a str. 301
ccugagacagacagccu

SEQ ID NO: 3907971 - RNA, 19 nt, Shigella flexneri 2a str. 301
ccugagacagacagccuca

SEQ ID NO: 3907972 - RNA, 13 nt, Shigella flexneri 2a str. 301
ccugagaggauga

SEQ ID NO: 3907973 - RNA, 23 nt, Shigella flexneri 2a str. 301
ccugagcuggcagaccugcuuug

SEQ ID NO: 3907974 - RNA, 12 nt, Shigella flexneri 2a str. 301
ccugaguaauua

SEQ ID NO: 3907975 - RNA, 16 nt, Shigella flexneri 2a str. 301
ccugagucagaaacug

SEQ ID NO: 3907976 - RNA, 17 nt, Shigella flexneri 2a str. 301
ccugagucagaaacugu

SEQ ID NO: 3907977 - RNA, 22 nt, Shigella flexneri 2a str. 301
ccugagugaauauuuaaccuga

SEQ ID NO: 3907978 - RNA, 21 nt, Shigella flexneri 2a str. 301
ccugauaaaaaccauucaggc

SEQ ID NO: 3907979 - RNA, 14 nt, Shigella flexneri 2a str. 301
ccugauaagcgcag

SEQ ID NO: 3907980 - RNA, 20 nt, Shigella flexneri 2a str. 301
ccugauaauggcguauuuca

SEQ ID NO: 3907981 - RNA, 17 nt, Shigella flexneri 2a str. 301
ccugauacaugaaugau

SEQ ID NO: 3907982 - RNA, 21 nt, Shigella flexneri 2a str. 301
ccugauacgcgccaaucggca

SEQ ID NO: 3907983 - RNA, 19 nt, Shigella flexneri 2a str. 301
ccugauagcuuacggcgcu

SEQ ID NO: 3907984 - RNA, 21 nt, Shigella flexneri 2a str. 301
ccugauagcuuacggcgcugu

SEQ ID NO: 3907985 - RNA, 12 nt, Shigella flexneri 2a str. 301
ccugaucaagca

SEQ ID NO: 3907986 - RNA, 16 nt, Shigella flexneri 2a str. 301
ccugaucaagcacaug

SEQ ID NO: 3907987 - RNA, 19 nt, Shigella flexneri 2a str. 301
ccugauccagcucuucuuc

SEQ ID NO: 3907988 - RNA, 22 nt, Shigella flexneri 2a str. 301
ccugauccagcucuucuucacu

SEQ ID NO: 3907989 - RNA, 13 nt, Shigella flexneri 2a str. 301
ccugauccauacu

SEQ ID NO: 3907990 - RNA, 21 nt, Shigella flexneri 2a str. 301
ccugaucgacaaaaucccggc

SEQ ID NO: 3907991 - RNA, 21 nt, Shigella flexneri 2a str. 301
ccugaucggcgagauaaugcg

SEQ ID NO: 3907992 - RNA, 16 nt, Shigella flexneri 2a str. 301
ccugaugagggcgcua

SEQ ID NO: 3907993 - RNA, 18 nt, Shigella flexneri 2a str. 301
ccugaugcgauauguuua

SEQ ID NO: 3907994 - RNA, 17 nt, Shigella flexneri 2a str. 301
ccugaugcgcugcgcuu

SEQ ID NO: 3907995 - RNA, 12 nt, Shigella flexneri 2a str. 301
ccugaugcguug

SEQ ID NO: 3907996 - RNA, 17 nt, Shigella flexneri 2a str. 301
ccugaugcguugcgcuu

SEQ ID NO: 3907997 - RNA, 14 nt, Shigella flexneri 2a str. 301
ccugauggcgcgcc

SEQ ID NO: 3907998 - RNA, 15 nt, Shigella flexneri 2a str. 301
ccugauguacaacca

SEQ ID NO: 3907999 - RNA, 20 nt, Shigella flexneri 2a str. 301
ccugaugugaaagauaaaac

SEQ ID NO: 3908000 - RNA, 19 nt, Shigella flexneri 2a str. 301
ccugauuaacgacacucuc

SEQ ID NO: 3908001 - RNA, 19 nt, Shigella flexneri 2a str. 301
ccugauuauugauauccac

SEQ ID NO: 3908002 - RNA, 14 nt, Shigella flexneri 2a str. 301
ccugauugaccgcc

SEQ ID NO: 3908003 - RNA, 16 nt, Shigella flexneri 2a str. 301
ccugcaaaauagucau

SEQ ID NO: 3908004 - RNA, 14 nt, Shigella flexneri 2a str. 301
ccugcaaauaaaua

SEQ ID NO: 3908005 - RNA, 15 nt, Shigella flexneri 2a str. 301
ccugcaaauaaauac

SEQ ID NO: 3908006 - RNA, 22 nt, Shigella flexneri 2a str. 301
ccugcaacgagugcaucuggua

SEQ ID NO: 3908007 - RNA, 12 nt, Shigella flexneri 2a str. 301
ccugcaacgcuu

SEQ ID NO: 3908008 - RNA, 17 nt, Shigella flexneri 2a str. 301
ccugcaagguggucaga

SEQ ID NO: 3908009 - RNA, 23 nt, Shigella flexneri 2a str. 301
ccugcaauagauugaauuagcaa

SEQ ID NO: 3908010 - RNA, 23 nt, Shigella flexneri 2a str. 301
ccugcaauuuauugauuuugcaa

SEQ ID NO: 3908011 - RNA, 23 nt, Shigella flexneri 2a str. 301
ccugcacaaauagccagcagagc

SEQ ID NO: 3908012 - RNA, 20 nt, Shigella flexneri 2a str. 301
ccugcacaaauuugccgucg

SEQ ID NO: 3908013 - RNA, 10 nt, Shigella flexneri 2a str. 301
ccugcacaug

SEQ ID NO: 3908014 - RNA, 16 nt, Shigella flexneri 2a str. 301
ccugcacgaccggguu

SEQ ID NO: 3908015 - RNA, 22 nt, Shigella flexneri 2a str. 301
ccugcacggagauauccagcgc

SEQ ID NO: 3908016 - RNA, 23 nt, Shigella flexneri 2a str. 301
ccugcacggagauauccagcgcc

SEQ ID NO: 3908017 - RNA, 17 nt, Shigella flexneri 2a str. 301
ccugcacuuaacaggau

SEQ ID NO: 3908018 - RNA, 14 nt, Shigella flexneri 2a str. 301
ccugcacuuucagc

SEQ ID NO: 3908019 - RNA, 12 nt, Shigella flexneri 2a str. 301
ccugcagcuuca

SEQ ID NO: 3908020 - RNA, 16 nt, Shigella flexneri 2a str. 301
ccugcagggcuuucac

SEQ ID NO: 3908021 - RNA, 17 nt, Shigella flexneri 2a str. 301
ccugcagugaaauuaaa

SEQ ID NO: 3908022 - RNA, 18 nt, Shigella flexneri 2a str. 301
ccugcauaaacgccguca

SEQ ID NO: 3908023 - RNA, 20 nt, Shigella flexneri 2a str. 301
ccugcauacgacgugccgca

SEQ ID NO: 3908024 - RNA, 11 nt, Shigella flexneri 2a str. 301
ccugcauaucg

SEQ ID NO: 3908025 - RNA, 22 nt, Shigella flexneri 2a str. 301
ccugcaugcgaaugcagggccg

SEQ ID NO: 3908026 - RNA, 17 nt, Shigella flexneri 2a str. 301
ccugcauugacucgccu

SEQ ID NO: 3908027 - RNA, 18 nt, Shigella flexneri 2a str. 301
ccugccagaacaaccaga

SEQ ID NO: 3908028 - RNA, 20 nt, Shigella flexneri 2a str. 301
ccugccagagcugaauauca

SEQ ID NO: 3908029 - RNA, 18 nt, Shigella flexneri 2a str. 301
ccugccagaugcagcggu

SEQ ID NO: 3908030 - RNA, 14 nt, Shigella flexneri 2a str. 301
ccugccagcaugca

SEQ ID NO: 3908031 - RNA, 12 nt, Shigella flexneri 2a str. 301
ccugccagcuug

SEQ ID NO: 3908032 - RNA, 13 nt, Shigella flexneri 2a str. 301
ccugccaguccug

SEQ ID NO: 3908033 - RNA, 21 nt, Shigella flexneri 2a str. 301
ccugccaguuauagcgcagac

SEQ ID NO: 3908034 - RNA, 18 nt, Shigella flexneri 2a str. 301
ccugccaucuggcaggcu

SEQ ID NO: 3908035 - RNA, 13 nt, Shigella flexneri 2a str. 301
ccugcccacucca

SEQ ID NO: 3908036 - RNA, 15 nt, Shigella flexneri 2a str. 301
ccugcccacuccagc

SEQ ID NO: 3908037 - RNA, 19 nt, Shigella flexneri 2a str. 301
ccugccgcaggacgggcaa

SEQ ID NO: 3908038 - RNA, 22 nt, Shigella flexneri 2a str. 301
ccugccgggcugaugccgcguu

SEQ ID NO: 3908039 - RNA, 22 nt, Shigella flexneri 2a str. 301
ccugccguuguugccuuauugc

SEQ ID NO: 3908040 - RNA, 12 nt, Shigella flexneri 2a str. 301
ccugccugcagc

SEQ ID NO: 3908041 - RNA, 17 nt, Shigella flexneri 2a str. 301
ccugcgaacuguaauga

SEQ ID NO: 3908042 - RNA, 17 nt, Shigella flexneri 2a str. 301
ccugcgauggugguugc

SEQ ID NO: 3908043 - RNA, 14 nt, Shigella flexneri 2a str. 301
ccugcgcaggaagc

SEQ ID NO: 3908044 - RNA, 15 nt, Shigella flexneri 2a str. 301
ccugcgccagccagc

SEQ ID NO: 3908045 - RNA, 15 nt, Shigella flexneri 2a str. 301
ccugcgccagcgcgc

SEQ ID NO: 3908046 - RNA, 22 nt, Shigella flexneri 2a str. 301
ccugcgccagcgcgcguugcug

SEQ ID NO: 3908047 - RNA, 21 nt, Shigella flexneri 2a str. 301
ccugcgcccgcguuaccggca

SEQ ID NO: 3908048 - RNA, 17 nt, Shigella flexneri 2a str. 301
ccugcgccugcaccauu

SEQ ID NO: 3908049 - RNA, 16 nt, Shigella flexneri 2a str. 301
ccugcgcgcccgccgc

SEQ ID NO: 3908050 - RNA, 18 nt, Shigella flexneri 2a str. 301
ccugcgcgcccgccgccu

SEQ ID NO: 3908051 - RNA, 18 nt, Shigella flexneri 2a str. 301
ccugcgcggcaaugcgcc

SEQ ID NO: 3908052 - RNA, 17 nt, Shigella flexneri 2a str. 301
ccugcgcuuccugcaac

SEQ ID NO: 3908053 - RNA, 15 nt, Shigella flexneri 2a str. 301
ccugcggcaacgcuc

SEQ ID NO: 3908054 - RNA, 17 nt, Shigella flexneri 2a str. 301
ccugcggcggcaucgcc

SEQ ID NO: 3908055 - RNA, 22 nt, Shigella flexneri 2a str. 301
ccugcggcuggcacaauuaccu

SEQ ID NO: 3908056 - RNA, 18 nt, Shigella flexneri 2a str. 301
ccugcggcuuccagagca

SEQ ID NO: 3908057 - RNA, 18 nt, Shigella flexneri 2a str. 301
ccugcgggagcgcuuuuu

SEQ ID NO: 3908058 - RNA, 18 nt, Shigella flexneri 2a str. 301
ccugcgguaagucccggc

SEQ ID NO: 3908059 - RNA, 14 nt, Shigella flexneri 2a str. 301
ccugcgugacuaaa

SEQ ID NO: 3908060 - RNA, 18 nt, Shigella flexneri 2a str. 301
ccugcguuuguccgccgg

SEQ ID NO: 3908061 - RNA, 23 nt, Shigella flexneri 2a str. 301
ccugcucaagcguuucaucuuca

SEQ ID NO: 3908062 - RNA, 21 nt, Shigella flexneri 2a str. 301
ccugcuccagugcauccagca

SEQ ID NO: 3908063 - RNA, 19 nt, Shigella flexneri 2a str. 301
ccugcucccgaaccuuuuc

SEQ ID NO: 3908064 - RNA, 18 nt, Shigella flexneri 2a str. 301
ccugcucgccacgucacu

SEQ ID NO: 3908065 - RNA, 16 nt, Shigella flexneri 2a str. 301
ccugcucgucauccgc

SEQ ID NO: 3908066 - RNA, 19 nt, Shigella flexneri 2a str. 301
ccugcucgucauccgccag

SEQ ID NO: 3908067 - RNA, 23 nt, Shigella flexneri 2a str. 301
ccugcucuaaccacugagcuaaa

SEQ ID NO: 3908068 - RNA, 12 nt, Shigella flexneri 2a str. 301
ccugcucugcca

SEQ ID NO: 3908069 - RNA, 17 nt, Shigella flexneri 2a str. 301
ccugcucugccagacgg

SEQ ID NO: 3908070 - RNA, 16 nt, Shigella flexneri 2a str. 301
ccugcucuuucagcac

SEQ ID NO: 3908071 - RNA, 16 nt, Shigella flexneri 2a str. 301
ccugcugaauccccuu

SEQ ID NO: 3908072 - RNA, 17 nt, Shigella flexneri 2a str. 301
ccugcugauuauccgca

SEQ ID NO: 3908073 - RNA, 16 nt, Shigella flexneri 2a str. 301
ccugcugcacgcccug

SEQ ID NO: 3908074 - RNA, 22 nt, Shigella flexneri 2a str. 301
ccugcugcgccuguaacuguuc

SEQ ID NO: 3908075 - RNA, 20 nt, Shigella flexneri 2a str. 301
ccugcuggaaaggccgcgaa

SEQ ID NO: 3908076 - RNA, 23 nt, Shigella flexneri 2a str. 301
ccugcuggaaaggccgcgaaccg

SEQ ID NO: 3908077 - RNA, 12 nt, Shigella flexneri 2a str. 301
ccugcuggcagu

SEQ ID NO: 3908078 - RNA, 12 nt, Shigella flexneri 2a str. 301
ccugcuggcccc

SEQ ID NO: 3908079 - RNA, 22 nt, Shigella flexneri 2a str. 301
ccugcuuauagcgcaucgcagc

SEQ ID NO: 3908080 - RNA, 21 nt, Shigella flexneri 2a str. 301
ccugcuuaucgcccugcucca

SEQ ID NO: 3908081 - RNA, 22 nt, Shigella flexneri 2a str. 301
ccugcuuugacaaagcucauug

SEQ ID NO: 3908082 - RNA, 18 nt, Shigella flexneri 2a str. 301
ccugcuuuugccagcgug

SEQ ID NO: 3908083 - RNA, 16 nt, Shigella flexneri 2a str. 301
ccugcuuuuucaucau

SEQ ID NO: 3908084 - RNA, 13 nt, Shigella flexneri 2a str. 301
ccuggacagcucg

SEQ ID NO: 3908085 - RNA, 21 nt, Shigella flexneri 2a str. 301
ccuggagaguguuuuaucugu

SEQ ID NO: 3908086 - RNA, 22 nt, Shigella flexneri 2a str. 301
ccuggcaacccgggcucccggc

SEQ ID NO: 3908087 - RNA, 19 nt, Shigella flexneri 2a str. 301
ccuggcaauagcgcacgcc

SEQ ID NO: 3908088 - RNA, 13 nt, Shigella flexneri 2a str. 301
ccuggcacagcag

SEQ ID NO: 3908089 - RNA, 13 nt, Shigella flexneri 2a str. 301
ccuggcagcaccg

SEQ ID NO: 3908090 - RNA, 16 nt, Shigella flexneri 2a str. 301
ccuggcauguggcggc

SEQ ID NO: 3908091 - RNA, 23 nt, Shigella flexneri 2a str. 301
ccuggccugggaucaucagcaaa

SEQ ID NO: 3908092 - RNA, 20 nt, Shigella flexneri 2a str. 301
ccuggcgaacccaaccguga

SEQ ID NO: 3908093 - RNA, 20 nt, Shigella flexneri 2a str. 301
ccuggcgaugcccccagcag

SEQ ID NO: 3908094 - RNA, 17 nt, Shigella flexneri 2a str. 301
ccuggcgcagcugcgcu

SEQ ID NO: 3908095 - RNA, 18 nt, Shigella flexneri 2a str. 301
ccuggcgcagcugcgcuu

SEQ ID NO: 3908096 - RNA, 12 nt, Shigella flexneri 2a str. 301
ccuggcgcgaaa

SEQ ID NO: 3908097 - RNA, 11 nt, Shigella flexneri 2a str. 301
ccuggcgcugg

SEQ ID NO: 3908098 - RNA, 14 nt, Shigella flexneri 2a str. 301
ccuggcgcuggcgu

SEQ ID NO: 3908099 - RNA, 16 nt, Shigella flexneri 2a str. 301
ccuggcgggaauaaaa

SEQ ID NO: 3908100 - RNA, 15 nt, Shigella flexneri 2a str. 301
ccuggcgucuggccc

SEQ ID NO: 3908101 - RNA, 16 nt, Shigella flexneri 2a str. 301
ccuggcgucuggccca

SEQ ID NO: 3908102 - RNA, 14 nt, Shigella flexneri 2a str. 301
ccuggcucaagcac

SEQ ID NO: 3908103 - RNA, 18 nt, Shigella flexneri 2a str. 301
ccuggcucaagcaccauc

SEQ ID NO: 3908104 - RNA, 14 nt, Shigella flexneri 2a str. 301
ccuggcugcagaau

SEQ ID NO: 3908105 - RNA, 14 nt, Shigella flexneri 2a str. 301
ccuggcuggugacg

SEQ ID NO: 3908106 - RNA, 15 nt, Shigella flexneri 2a str. 301
ccuggcuggugacgc

SEQ ID NO: 3908107 - RNA, 16 nt, Shigella flexneri 2a str. 301
ccuggcuugccagcca

SEQ ID NO: 3908108 - RNA, 23 nt, Shigella flexneri 2a str. 301
ccuggcuuggcuggcgugagccg

SEQ ID NO: 3908109 - RNA, 16 nt, Shigella flexneri 2a str. 301
ccugggcaauggugaa

SEQ ID NO: 3908110 - RNA, 15 nt, Shigella flexneri 2a str. 301
ccugggcauuugcgc

SEQ ID NO: 3908111 - RNA, 23 nt, Shigella flexneri 2a str. 301
ccugguaaaaaaugauuuccugc

SEQ ID NO: 3908112 - RNA, 15 nt, Shigella flexneri 2a str. 301
ccugguaccagcacc

SEQ ID NO: 3908113 - RNA, 21 nt, Shigella flexneri 2a str. 301
ccugguccuucaucuucaacu

SEQ ID NO: 3908114 - RNA, 17 nt, Shigella flexneri 2a str. 301
ccuggugaauauuccuu

SEQ ID NO: 3908115 - RNA, 13 nt, Shigella flexneri 2a str. 301
ccugguucucacu

SEQ ID NO: 3908116 - RNA, 18 nt, Shigella flexneri 2a str. 301
ccugguuucuggucauug

SEQ ID NO: 3908117 - RNA, 22 nt, Shigella flexneri 2a str. 301
ccuguaaaaaaguaaugccugc

SEQ ID NO: 3908118 - RNA, 15 nt, Shigella flexneri 2a str. 301
ccuguaaacgaaaac

SEQ ID NO: 3908119 - RNA, 14 nt, Shigella flexneri 2a str. 301
ccuguaccagcccg

SEQ ID NO: 3908120 - RNA, 17 nt, Shigella flexneri 2a str. 301
ccuguaccuucagcggc

SEQ ID NO: 3908121 - RNA, 16 nt, Shigella flexneri 2a str. 301
ccuguacggcagugaa

SEQ ID NO: 3908122 - RNA, 20 nt, Shigella flexneri 2a str. 301
ccuguacgucgagaauaucg

SEQ ID NO: 3908123 - RNA, 15 nt, Shigella flexneri 2a str. 301
ccuguacuguuucac

SEQ ID NO: 3908124 - RNA, 17 nt, Shigella flexneri 2a str. 301
ccuguaguguguugcaa

SEQ ID NO: 3908125 - RNA, 22 nt, Shigella flexneri 2a str. 301
ccuguaguguguugcaauacac

SEQ ID NO: 3908126 - RNA, 13 nt, Shigella flexneri 2a str. 301
ccuguaucccaga

SEQ ID NO: 3908127 - RNA, 19 nt, Shigella flexneri 2a str. 301
ccuguaucccaguucgauu

SEQ ID NO: 3908128 - RNA, 21 nt, Shigella flexneri 2a str. 301
ccuguauuguuccacucuuuc

SEQ ID NO: 3908129 - RNA, 17 nt, Shigella flexneri 2a str. 301
ccugucagacuuaagcc

SEQ ID NO: 3908130 - RNA, 14 nt, Shigella flexneri 2a str. 301
ccuguccacaccca

SEQ ID NO: 3908131 - RNA, 22 nt, Shigella flexneri 2a str. 301
ccuguccagacggagcugccag

SEQ ID NO: 3908132 - RNA, 14 nt, Shigella flexneri 2a str. 301
ccugucgaggccaa

SEQ ID NO: 3908133 - RNA, 20 nt, Shigella flexneri 2a str. 301
ccugucgcuuugacugcuuu

SEQ ID NO: 3908134 - RNA, 23 nt, Shigella flexneri 2a str. 301
ccugucgggugcuuuuuucaauu

SEQ ID NO: 3908135 - RNA, 14 nt, Shigella flexneri 2a str. 301
ccugucuucccugc

SEQ ID NO: 3908136 - RNA, 16 nt, Shigella flexneri 2a str. 301
ccugugcaaccuuuuc

SEQ ID NO: 3908137 - RNA, 19 nt, Shigella flexneri 2a str. 301
ccugugcaaccuuuuccau

SEQ ID NO: 3908138 - RNA, 12 nt, Shigella flexneri 2a str. 301
ccugugcagcga

SEQ ID NO: 3908139 - RNA, 23 nt, Shigella flexneri 2a str. 301
ccuguggugcaggcgcagauaca

SEQ ID NO: 3908140 - RNA, 16 nt, Shigella flexneri 2a str. 301
ccugugucacuuugac

SEQ ID NO: 3908141 - RNA, 15 nt, Shigella flexneri 2a str. 301
ccuguguccuguuga

SEQ ID NO: 3908142 - RNA, 23 nt, Shigella flexneri 2a str. 301
ccuguuaaucagcuaauggcugc

SEQ ID NO: 3908143 - RNA, 17 nt, Shigella flexneri 2a str. 301
ccuguuccagacgcugc

SEQ ID NO: 3908144 - RNA, 21 nt, Shigella flexneri 2a str. 301
ccuguucgucccgauucagca

SEQ ID NO: 3908145 - RNA, 22 nt, Shigella flexneri 2a str. 301
ccuguucgucccgauucagcac

SEQ ID NO: 3908146 - RNA, 16 nt, Shigella flexneri 2a str. 301
ccuguugaaauuauug

SEQ ID NO: 3908147 - RNA, 21 nt, Shigella flexneri 2a str. 301
ccuguugauggggguccugag

SEQ ID NO: 3908148 - RNA, 15 nt, Shigella flexneri 2a str. 301
ccuguugcccuuugc

SEQ ID NO: 3908149 - RNA, 15 nt, Shigella flexneri 2a str. 301
ccuguugccugcacu

SEQ ID NO: 3908150 - RNA, 21 nt, Shigella flexneri 2a str. 301
ccuguugcgcuccgcgaccca

SEQ ID NO: 3908151 - RNA, 24 nt, Shigella flexneri 2a str. 301
ccuguugcgucgccgccuguucca

SEQ ID NO: 3908152 - RNA, 21 nt, Shigella flexneri 2a str. 301
ccuguugucuuuccagacuca

SEQ ID NO: 3908153 - RNA, 21 nt, Shigella flexneri 2a str. 301
caucagaaacacacuuuccag

SEQ ID NO: 3908154 - RNA, 15 nt, Shigella flexneri 2a str. 301
caucagaaaugccag

SEQ ID NO: 3908155 - RNA, 21 nt, Shigella flexneri 2a str. 301
caucagaagauggugaauggu

SEQ ID NO: 3908156 - RNA, 21 nt, Shigella flexneri 2a str. 301
caucagacaaaugucacugcu

SEQ ID NO: 3908157 - RNA, 14 nt, Shigella flexneri 2a str. 301
caucagacauuauu

SEQ ID NO: 3908158 - RNA, 18 nt, Shigella flexneri 2a str. 301
caucagacuuugcgccau

SEQ ID NO: 3908159 - RNA, 22 nt, Shigella flexneri 2a str. 301
caucagaucguugaacccggca

SEQ ID NO: 3908160 - RNA, 14 nt, Shigella flexneri 2a str. 301
caucagcaacacgc

SEQ ID NO: 3908161 - RNA, 20 nt, Shigella flexneri 2a str. 301
caucagcacaaaucggcaac

SEQ ID NO: 3908162 - RNA, 23 nt, Shigella flexneri 2a str. 301
caucagcaguuuuuccccugcca

SEQ ID NO: 3908163 - RNA, 19 nt, Shigella flexneri 2a str. 301
caucagcauaaucaccagu

SEQ ID NO: 3908164 - RNA, 16 nt, Shigella flexneri 2a str. 301
caucagcaucccaccu

SEQ ID NO: 3908165 - RNA, 14 nt, Shigella flexneri 2a str. 301
caucagccagaugc

SEQ ID NO: 3908166 - RNA, 17 nt, Shigella flexneri 2a str. 301
caucagccagaugcacc

SEQ ID NO: 3908167 - RNA, 20 nt, Shigella flexneri 2a str. 301
caucagcgauucauugagua

SEQ ID NO: 3908168 - RNA, 21 nt, Shigella flexneri 2a str. 301
caucagcgauucauugaguaa

SEQ ID NO: 3908169 - RNA, 13 nt, Shigella flexneri 2a str. 301
caucagcgccacc

SEQ ID NO: 3908170 - RNA, 15 nt, Shigella flexneri 2a str. 301
caucagcgccaccag

SEQ ID NO: 3908171 - RNA, 16 nt, Shigella flexneri 2a str. 301
caucagcgccaccagc

SEQ ID NO: 3908172 - RNA, 20 nt, Shigella flexneri 2a str. 301
caucagcgccugauggacau

SEQ ID NO: 3908173 - RNA, 14 nt, Shigella flexneri 2a str. 301
caucagcgccuuac

SEQ ID NO: 3908174 - RNA, 18 nt, Shigella flexneri 2a str. 301
caucagcgguacucgcgc

SEQ ID NO: 3908175 - RNA, 18 nt, Shigella flexneri 2a str. 301
caucagcuggaucgagau

SEQ ID NO: 3908176 - RNA, 18 nt, Shigella flexneri 2a str. 301
caucaggaccugcucugc

SEQ ID NO: 3908177 - RNA, 21 nt, Shigella flexneri 2a str. 301
caucaggcaacccagaagaaa

SEQ ID NO: 3908178 - RNA, 21 nt, Shigella flexneri 2a str. 301
caucaggcaaugggcaaacgc

SEQ ID NO: 3908179 - RNA, 21 nt, Shigella flexneri 2a str. 301
caucaggcagauacaaccaau

SEQ ID NO: 3908180 - RNA, 13 nt, Shigella flexneri 2a str. 301
caucaggcaucug

SEQ ID NO: 3908181 - RNA, 21 nt, Shigella flexneri 2a str. 301
caucaggcguucgcggcggca

SEQ ID NO: 3908182 - RNA, 23 nt, Shigella flexneri 2a str. 301
caucaggcguucgcggcggcacu

SEQ ID NO: 3908183 - RNA, 12 nt, Shigella flexneri 2a str. 301
caucaggggcag

SEQ ID NO: 3908184 - RNA, 18 nt, Shigella flexneri 2a str. 301
caucaguacgcauucgcg

SEQ ID NO: 3908185 - RNA, 15 nt, Shigella flexneri 2a str. 301
caucagucucaaacc

SEQ ID NO: 3908186 - RNA, 15 nt, Shigella flexneri 2a str. 301
caucagugaacccau

SEQ ID NO: 3908187 - RNA, 16 nt, Shigella flexneri 2a str. 301
caucagugaacccaua

SEQ ID NO: 3908188 - RNA, 14 nt, Shigella flexneri 2a str. 301
caucagugccagua

SEQ ID NO: 3908189 - RNA, 22 nt, Shigella flexneri 2a str. 301
caucaguugcaccugauccagc

SEQ ID NO: 3908190 - RNA, 12 nt, Shigella flexneri 2a str. 301
caucaguuucaa

SEQ ID NO: 3908191 - RNA, 14 nt, Shigella flexneri 2a str. 301
caucauaaauaaga

SEQ ID NO: 3908192 - RNA, 21 nt, Shigella flexneri 2a str. 301
caucauacgggucauugccag

SEQ ID NO: 3908193 - RNA, 19 nt, Shigella flexneri 2a str. 301
caucauaguggguuucugc

SEQ ID NO: 3908194 - RNA, 15 nt, Shigella flexneri 2a str. 301
caucaucacugccag

SEQ ID NO: 3908195 - RNA, 12 nt, Shigella flexneri 2a str. 301
caucaucagaaa

SEQ ID NO: 3908196 - RNA, 22 nt, Shigella flexneri 2a str. 301
caucaucagaaaugccaguaac

SEQ ID NO: 3908197 - RNA, 16 nt, Shigella flexneri 2a str. 301
caucauccucuucagc

SEQ ID NO: 3908198 - RNA, 15 nt, Shigella flexneri 2a str. 301
caucaucgauaccaa

SEQ ID NO: 3908199 - RNA, 17 nt, Shigella flexneri 2a str. 301
caucaucgcaaugauuu

SEQ ID NO: 3908200 - RNA, 18 nt, Shigella flexneri 2a str. 301
caucaucgccccgcucac

SEQ ID NO: 3908201 - RNA, 13 nt, Shigella flexneri 2a str. 301
caucaucgcuuuc

SEQ ID NO: 3908202 - RNA, 14 nt, Shigella flexneri 2a str. 301
caucaucgcuuuca

SEQ ID NO: 3908203 - RNA, 13 nt, Shigella flexneri 2a str. 301
caucaucucccac

SEQ ID NO: 3908204 - RNA, 19 nt, Shigella flexneri 2a str. 301
caucaucucugucgcugaa

SEQ ID NO: 3908205 - RNA, 20 nt, Shigella flexneri 2a str. 301
caucaucucugucgcugaaa

SEQ ID NO: 3908206 - RNA, 22 nt, Shigella flexneri 2a str. 301
caucaucuggcugugauccauu

SEQ ID NO: 3908207 - RNA, 18 nt, Shigella flexneri 2a str. 301
caucaucuuuauauauug

SEQ ID NO: 3908208 - RNA, 17 nt, Shigella flexneri 2a str. 301
caucaugcacuccgcug

SEQ ID NO: 3908209 - RNA, 13 nt, Shigella flexneri 2a str. 301
caucauggaagca

SEQ ID NO: 3908210 - RNA, 14 nt, Shigella flexneri 2a str. 301
caucauggcauuuc

SEQ ID NO: 3908211 - RNA, 18 nt, Shigella flexneri 2a str. 301
caucaugguuugcaucca

SEQ ID NO: 3908212 - RNA, 20 nt, Shigella flexneri 2a str. 301
caucaugguuugcauccaca

SEQ ID NO: 3908213 - RNA, 22 nt, Shigella flexneri 2a str. 301
caucauucccuacgcgauaaaa

SEQ ID NO: 3908214 - RNA, 17 nt, Shigella flexneri 2a str. 301
cauccaccagcaugaaa

SEQ ID NO: 3908215 - RNA, 17 nt, Shigella flexneri 2a str. 301
cauccaccgccacgccg

SEQ ID NO: 3908216 - RNA, 23 nt, Shigella flexneri 2a str. 301
cauccaccuuaaaacaauauaac

SEQ ID NO: 3908217 - RNA, 13 nt, Shigella flexneri 2a str. 301
cauccacugccug

SEQ ID NO: 3908218 - RNA, 20 nt, Shigella flexneri 2a str. 301
cauccagaccgcucagcucc

SEQ ID NO: 3908219 - RNA, 20 nt, Shigella flexneri 2a str. 301
cauccagcaacaacagcgcg

SEQ ID NO: 3908220 - RNA, 12 nt, Shigella flexneri 2a str. 301
cauccagcacuu

SEQ ID NO: 3908221 - RNA, 14 nt, Shigella flexneri 2a str. 301
cauccagcagacgc

SEQ ID NO: 3908222 - RNA, 14 nt, Shigella flexneri 2a str. 301
cauccagcagcaau

SEQ ID NO: 3908223 - RNA, 20 nt, Shigella flexneri 2a str. 301
cauccagcagcccuugcuuc

SEQ ID NO: 3908224 - RNA, 22 nt, Shigella flexneri 2a str. 301
cauccagcagcggaucgaacuc

SEQ ID NO: 3908225 - RNA, 11 nt, Shigella flexneri 2a str. 301
cauccagcagu

SEQ ID NO: 3908226 - RNA, 20 nt, Shigella flexneri 2a str. 301
cauccagcguuaccggcuuc

SEQ ID NO: 3908227 - RNA, 21 nt, Shigella flexneri 2a str. 301
cauccagcuuuuuaaucgcca

SEQ ID NO: 3908228 - RNA, 23 nt, Shigella flexneri 2a str. 301
cauccagcuuuuuaaucgccauc

SEQ ID NO: 3908229 - RNA, 17 nt, Shigella flexneri 2a str. 301
cauccaggaacuccaga

SEQ ID NO: 3908230 - RNA, 21 nt, Shigella flexneri 2a str. 301
cauccaggaacuccagaucca

SEQ ID NO: 3908231 - RNA, 12 nt, Shigella flexneri 2a str. 301
cauccaggccaa

SEQ ID NO: 3908232 - RNA, 16 nt, Shigella flexneri 2a str. 301
cauccagugccgccug

SEQ ID NO: 3908233 - RNA, 12 nt, Shigella flexneri 2a str. 301
cauccagugcuu

SEQ ID NO: 3908234 - RNA, 21 nt, Shigella flexneri 2a str. 301
cauccaguggcagaguaauug

SEQ ID NO: 3908235 - RNA, 17 nt, Shigella flexneri 2a str. 301
cauccauaccacgaccu

SEQ ID NO: 3908236 - RNA, 16 nt, Shigella flexneri 2a str. 301
cauccauuacaucacg

SEQ ID NO: 3908237 - RNA, 14 nt, Shigella flexneri 2a str. 301
cauccauucagugc

SEQ ID NO: 3908238 - RNA, 22 nt, Shigella flexneri 2a str. 301
cauccauucuugcgcggauggc

SEQ ID NO: 3908239 - RNA, 15 nt, Shigella flexneri 2a str. 301
caucccagacaccgc

SEQ ID NO: 3908240 - RNA, 18 nt, Shigella flexneri 2a str. 301
caucccagacaccgccca

SEQ ID NO: 3908241 - RNA, 15 nt, Shigella flexneri 2a str. 301
caucccagcagagau

SEQ ID NO: 3908242 - RNA, 20 nt, Shigella flexneri 2a str. 301
caucccauuucuccagcagu

SEQ ID NO: 3908243 - RNA, 20 nt, Shigella flexneri 2a str. 301
cauccccaaaaaaucaacga

SEQ ID NO: 3908244 - RNA, 17 nt, Shigella flexneri 2a str. 301
cauccccgcccuuccag

SEQ ID NO: 3908245 - RNA, 19 nt, Shigella flexneri 2a str. 301
cauccccggcaaccacacc

SEQ ID NO: 3908246 - RNA, 20 nt, Shigella flexneri 2a str. 301
cauccccggcaaccacaccc

SEQ ID NO: 3908247 - RNA, 13 nt, Shigella flexneri 2a str. 301
cauccccucuucc

SEQ ID NO: 3908248 - RNA, 17 nt, Shigella flexneri 2a str. 301
caucccgaccaaugcau

SEQ ID NO: 3908249 - RNA, 18 nt, Shigella flexneri 2a str. 301
caucccgagucgcugagc

SEQ ID NO: 3908250 - RNA, 16 nt, Shigella flexneri 2a str. 301
caucccggcagagaaa

SEQ ID NO: 3908251 - RNA, 18 nt, Shigella flexneri 2a str. 301
caucccggcagagaaaau

SEQ ID NO: 3908252 - RNA, 22 nt, Shigella flexneri 2a str. 301
caucccgguaucaaagcgccag

SEQ ID NO: 3908253 - RNA, 15 nt, Shigella flexneri 2a str. 301
caucccgguuauuaa

SEQ ID NO: 3908254 - RNA, 21 nt, Shigella flexneri 2a str. 301
caucccguuaugguuauccac

SEQ ID NO: 3908255 - RNA, 18 nt, Shigella flexneri 2a str. 301
caucccugucguccagac

SEQ ID NO: 3908256 - RNA, 18 nt, Shigella flexneri 2a str. 301
cauccgacaaggcaucag

SEQ ID NO: 3908257 - RNA, 13 nt, Shigella flexneri 2a str. 301
cauccgacacugg

SEQ ID NO: 3908258 - RNA, 15 nt, Shigella flexneri 2a str. 301
cauccgacacuggca

SEQ ID NO: 3908259 - RNA, 15 nt, Shigella flexneri 2a str. 301
cauccgacaucaacc

SEQ ID NO: 3908260 - RNA, 17 nt, Shigella flexneri 2a str. 301
cauccgacauuugcaca

SEQ ID NO: 3908261 - RNA, 13 nt, Shigella flexneri 2a str. 301
cauccgcgcaaua

SEQ ID NO: 3908262 - RNA, 17 nt, Shigella flexneri 2a str. 301
cauccgcgcgcguaagc

SEQ ID NO: 3908263 - RNA, 21 nt, Shigella flexneri 2a str. 301
cauccgcgucggcaaguaccc

SEQ ID NO: 3908264 - RNA, 16 nt, Shigella flexneri 2a str. 301
cauccgcgugacgcug

SEQ ID NO: 3908265 - RNA, 18 nt, Shigella flexneri 2a str. 301
cauccgcgugacgcuggc

SEQ ID NO: 3908266 - RNA, 14 nt, Shigella flexneri 2a str. 301
cauccgcucccugg

SEQ ID NO: 3908267 - RNA, 20 nt, Shigella flexneri 2a str. 301
cauccgcugaugcaacguca

SEQ ID NO: 3908268 - RNA, 22 nt, Shigella flexneri 2a str. 301
cauccgcuugcguaucgacggc

SEQ ID NO: 3908269 - RNA, 22 nt, Shigella flexneri 2a str. 301
cauccggaucgagaauauucac

SEQ ID NO: 3908270 - RNA, 16 nt, Shigella flexneri 2a str. 301
cauccggcaaaaacaa

SEQ ID NO: 3908271 - RNA, 16 nt, Shigella flexneri 2a str. 301
cauccggcaaccaccg

SEQ ID NO: 3908272 - RNA, 15 nt, Shigella flexneri 2a str. 301
cauccggcaauaagc

SEQ ID NO: 3908273 - RNA, 14 nt, Shigella flexneri 2a str. 301
cauccggcaauauu

SEQ ID NO: 3908274 - RNA, 21 nt, Shigella flexneri 2a str. 301
cauccggcaauuaaaaaagcg

SEQ ID NO: 3908275 - RNA, 19 nt, Shigella flexneri 2a str. 301
cauccggcaauucucugcu

SEQ ID NO: 3908276 - RNA, 13 nt, Shigella flexneri 2a str. 301
cauccggcaccuu

SEQ ID NO: 3908277 - RNA, 17 nt, Shigella flexneri 2a str. 301
cauccggcagccgugcc

SEQ ID NO: 3908278 - RNA, 21 nt, Shigella flexneri 2a str. 301
cauccggcauucagugcaaau

SEQ ID NO: 3908279 - RNA, 16 nt, Shigella flexneri 2a str. 301
cauccggcauuuugug

SEQ ID NO: 3908280 - RNA, 14 nt, Shigella flexneri 2a str. 301
cauccgggccagcg

SEQ ID NO: 3908281 - RNA, 22 nt, Shigella flexneri 2a str. 301
cauccggucagacaacuucccu

SEQ ID NO: 3908282 - RNA, 22 nt, Shigella flexneri 2a str. 301
cauccgguuaucgucugcgcca

SEQ ID NO: 3908283 - RNA, 23 nt, Shigella flexneri 2a str. 301
cauccgguuuacgcaaugccagu

SEQ ID NO: 3908284 - RNA, 19 nt, Shigella flexneri 2a str. 301
cauccguccuccguaucuu

SEQ ID NO: 3908285 - RNA, 23 nt, Shigella flexneri 2a str. 301
cauccgugaauaaugcaaaaagg

SEQ ID NO: 3908286 - RNA, 23 nt, Shigella flexneri 2a str. 301
cauccgugguggcagccagccau

SEQ ID NO: 3908287 - RNA, 22 nt, Shigella flexneri 2a str. 301
cauccguuucccuguucagccu

SEQ ID NO: 3908288 - RNA, 16 nt, Shigella flexneri 2a str. 301
cauccuaaaggcaaaa

SEQ ID NO: 3908289 - RNA, 16 nt, Shigella flexneri 2a str. 301
cauccucuauauuuca

SEQ ID NO: 3908290 - RNA, 18 nt, Shigella flexneri 2a str. 301
cauccugcggcagcucca

SEQ ID NO: 3908291 - RNA, 19 nt, Shigella flexneri 2a str. 301
cauccugcggcagcuccag

SEQ ID NO: 3908292 - RNA, 14 nt, Shigella flexneri 2a str. 301
cauccugcucaagu

SEQ ID NO: 3908293 - RNA, 11 nt, Shigella flexneri 2a str. 301
cauccugcugg

SEQ ID NO: 3908294 - RNA, 12 nt, Shigella flexneri 2a str. 301
cauccugcuggu

SEQ ID NO: 3908295 - RNA, 15 nt, Shigella flexneri 2a str. 301
cauccugcuggugcc

SEQ ID NO: 3908296 - RNA, 21 nt, Shigella flexneri 2a str. 301
cauccuggggguucaucacca

SEQ ID NO: 3908297 - RNA, 22 nt, Shigella flexneri 2a str. 301
cauccuggggguucaucaccac

SEQ ID NO: 3908298 - RNA, 21 nt, Shigella flexneri 2a str. 301
cauccugguaguccaggaugu

SEQ ID NO: 3908299 - RNA, 17 nt, Shigella flexneri 2a str. 301
cauccuucacacugccu

SEQ ID NO: 3908300 - RNA, 18 nt, Shigella flexneri 2a str. 301
cauccuucacacugccuc

SEQ ID NO: 3908301 - RNA, 15 nt, Shigella flexneri 2a str. 301
cauccuugcuaacca

SEQ ID NO: 3908302 - RNA, 19 nt, Shigella flexneri 2a str. 301
cauccuuugggcauuugca

SEQ ID NO: 3908303 - RNA, 18 nt, Shigella flexneri 2a str. 301
caucgaaccaucggcuuu

SEQ ID NO: 3908304 - RNA, 13 nt, Shigella flexneri 2a str. 301
caucgacagcaaa

SEQ ID NO: 3908305 - RNA, 13 nt, Shigella flexneri 2a str. 301
caucgacccagaa

SEQ ID NO: 3908306 - RNA, 16 nt, Shigella flexneri 2a str. 301
caucgacgccaucauu

SEQ ID NO: 3908307 - RNA, 23 nt, Shigella flexneri 2a str. 301
caucgacggcggagucauucucc

SEQ ID NO: 3908308 - RNA, 23 nt, Shigella flexneri 2a str. 301
caucgacguagugaaaucgccaa

SEQ ID NO: 3908309 - RNA, 14 nt, Shigella flexneri 2a str. 301
caucgacucaagcg

SEQ ID NO: 3908310 - RNA, 13 nt, Shigella flexneri 2a str. 301
caucgacuccagc

SEQ ID NO: 3908311 - RNA, 15 nt, Shigella flexneri 2a str. 301
caucgagaaucagcg

SEQ ID NO: 3908312 - RNA, 16 nt, Shigella flexneri 2a str. 301
caucgauaaucaccga

SEQ ID NO: 3908313 - RNA, 16 nt, Shigella flexneri 2a str. 301
caucgauaucaaccag

SEQ ID NO: 3908314 - RNA, 17 nt, Shigella flexneri 2a str. 301
caucgauaucaaccagu

SEQ ID NO: 3908315 - RNA, 15 nt, Shigella flexneri 2a str. 301
caucgaugagaugac

SEQ ID NO: 3908316 - RNA, 16 nt, Shigella flexneri 2a str. 301
caucgauuuugcaaua

SEQ ID NO: 3908317 - RNA, 16 nt, Shigella flexneri 2a str. 301
caucgcaaaccagacg

SEQ ID NO: 3908318 - RNA, 19 nt, Shigella flexneri 2a str. 301
caucgcaaaccagacgcgc

SEQ ID NO: 3908319 - RNA, 18 nt, Shigella flexneri 2a str. 301
caucgcaggccaguugcg

SEQ ID NO: 3908320 - RNA, 21 nt, Shigella flexneri 2a str. 301
caucgcaggccaguugcgccg

SEQ ID NO: 3908321 - RNA, 15 nt, Shigella flexneri 2a str. 301
caucgcauaaaacaa

SEQ ID NO: 3908322 - RNA, 17 nt, Shigella flexneri 2a str. 301
caucgcauaacagagcg

SEQ ID NO: 3908323 - RNA, 18 nt, Shigella flexneri 2a str. 301
caucgcauaacagagcga

SEQ ID NO: 3908324 - RNA, 22 nt, Shigella flexneri 2a str. 301
caucgcauguugauuaccuguc

SEQ ID NO: 3908325 - RNA, 14 nt, Shigella flexneri 2a str. 301
caucgccagaaauc

SEQ ID NO: 3908326 - RNA, 18 nt, Shigella flexneri 2a str. 301
caucgccagagaagaaca

SEQ ID NO: 3908327 - RNA, 16 nt, Shigella flexneri 2a str. 301
caucgccagcagccau

SEQ ID NO: 3908328 - RNA, 18 nt, Shigella flexneri 2a str. 301
caucgccagugccgccca

SEQ ID NO: 3908329 - RNA, 17 nt, Shigella flexneri 2a str. 301
caucgccaguuuugcca

SEQ ID NO: 3908330 - RNA, 12 nt, Shigella flexneri 2a str. 301
caucgcccacau

SEQ ID NO: 3908331 - RNA, 22 nt, Shigella flexneri 2a str. 301
caucgcccaguugaucaccagu

SEQ ID NO: 3908332 - RNA, 16 nt, Shigella flexneri 2a str. 301
caucgcccugauggcg

SEQ ID NO: 3908333 - RNA, 21 nt, Shigella flexneri 2a str. 301
caucgccgccguugcgggaag

SEQ ID NO: 3908334 - RNA, 13 nt, Shigella flexneri 2a str. 301
caucgccgggaac

SEQ ID NO: 3908335 - RNA, 15 nt, Shigella flexneri 2a str. 301
caucgccuguggcgu

SEQ ID NO: 3908336 - RNA, 15 nt, Shigella flexneri 2a str. 301
caucgccuuccagcg

SEQ ID NO: 3908337 - RNA, 19 nt, Shigella flexneri 2a str. 301
caucgcgauuaugccgccg

SEQ ID NO: 3908338 - RNA, 16 nt, Shigella flexneri 2a str. 301
caucgcgcccaaacca

SEQ ID NO: 3908339 - RNA, 17 nt, Shigella flexneri 2a str. 301
caucgcgcccaaaccac

SEQ ID NO: 3908340 - RNA, 18 nt, Shigella flexneri 2a str. 301
caucgcgcuuaucgccag

SEQ ID NO: 3908341 - RNA, 19 nt, Shigella flexneri 2a str. 301
caucgcggucaaccaucgc

SEQ ID NO: 3908342 - RNA, 14 nt, Shigella flexneri 2a str. 301
caucgcuacaccaa

SEQ ID NO: 3908343 - RNA, 15 nt, Shigella flexneri 2a str. 301
caucgcugugcugcu

SEQ ID NO: 3908344 - RNA, 14 nt, Shigella flexneri 2a str. 301
caucgcuuuccagg

SEQ ID NO: 3908345 - RNA, 15 nt, Shigella flexneri 2a str. 301
caucgcuuuccaggu

SEQ ID NO: 3908346 - RNA, 17 nt, Shigella flexneri 2a str. 301
caucggcaaucacauca

SEQ ID NO: 3908347 - RNA, 20 nt, Shigella flexneri 2a str. 301
caucggcaaucacaucacca

SEQ ID NO: 3908348 - RNA, 20 nt, Shigella flexneri 2a str. 301
caucggcaaucauucccaga

SEQ ID NO: 3908349 - RNA, 16 nt, Shigella flexneri 2a str. 301
caucggcagcgccaau

SEQ ID NO: 3908350 - RNA, 15 nt, Shigella flexneri 2a str. 301
caucggcagcgccag

SEQ ID NO: 3908351 - RNA, 16 nt, Shigella flexneri 2a str. 301
caucggcagcgccagc

SEQ ID NO: 3908352 - RNA, 14 nt, Shigella flexneri 2a str. 301
caucggccagauaa

SEQ ID NO: 3908353 - RNA, 22 nt, Shigella flexneri 2a str. 301
caucggcuuauucauaucaaac

SEQ ID NO: 3908354 - RNA, 21 nt, Shigella flexneri 2a str. 301
caucgggaagaggaucugcuc

SEQ ID NO: 3908355 - RNA, 22 nt, Shigella flexneri 2a str. 301
caucgggaagaggaucugcucu

SEQ ID NO: 3908356 - RNA, 15 nt, Shigella flexneri 2a str. 301
caucgggacaugaua

SEQ ID NO: 3908357 - RNA, 13 nt, Shigella flexneri 2a str. 301
caucgggaugcug

SEQ ID NO: 3908358 - RNA, 14 nt, Shigella flexneri 2a str. 301
caucgggaugcugg

SEQ ID NO: 3908359 - RNA, 19 nt, Shigella flexneri 2a str. 301
caucgggcagcaucgccag

SEQ ID NO: 3908360 - RNA, 13 nt, Shigella flexneri 2a str. 301
caucggguaacgg

SEQ ID NO: 3908361 - RNA, 19 nt, Shigella flexneri 2a str. 301
caucgguauaaccaaauga

SEQ ID NO: 3908362 - RNA, 16 nt, Shigella flexneri 2a str. 301
caucgguaucuuccca

SEQ ID NO: 3908363 - RNA, 22 nt, Shigella flexneri 2a str. 301
caucgguaucuucccagccaau

SEQ ID NO: 3908364 - RNA, 12 nt, Shigella flexneri 2a str. 301
caucggugcgcu

SEQ ID NO: 3908365 - RNA, 21 nt, Shigella flexneri 2a str. 301
caucguaguuuuugcccauca

SEQ ID NO: 3908366 - RNA, 24 nt, Shigella flexneri 2a str. 301
caucguaguuuuugcccaucaugc

SEQ ID NO: 3908367 - RNA, 17 nt, Shigella flexneri 2a str. 301
caucgucaggggcauuu

SEQ ID NO: 3908368 - RNA, 12 nt, Shigella flexneri 2a str. 301
caucgucaucag

SEQ ID NO: 3908369 - RNA, 13 nt, Shigella flexneri 2a str. 301
caucguccagcuu

SEQ ID NO: 3908370 - RNA, 13 nt, Shigella flexneri 2a str. 301
caucgucggccuu

SEQ ID NO: 3908371 - RNA, 20 nt, Shigella flexneri 2a str. 301
caucgucggccuuaaugccc

SEQ ID NO: 3908372 - RNA, 13 nt, Shigella flexneri 2a str. 301
caucgugauaaac

SEQ ID NO: 3908373 - RNA, 13 nt, Shigella flexneri 2a str. 301
caucgugcaccaa

SEQ ID NO: 3908374 - RNA, 14 nt, Shigella flexneri 2a str. 301
caucgugcaccaau

SEQ ID NO: 3908375 - RNA, 13 nt, Shigella flexneri 2a str. 301
caucgugccggaa

SEQ ID NO: 3908376 - RNA, 21 nt, Shigella flexneri 2a str. 301
caucguguugaugcuccuggc

SEQ ID NO: 3908377 - RNA, 15 nt, Shigella flexneri 2a str. 301
caucguuacgauugg

SEQ ID NO: 3908378 - RNA, 18 nt, Shigella flexneri 2a str. 301
caucguuugcugccuuca

SEQ ID NO: 3908379 - RNA, 22 nt, Shigella flexneri 2a str. 301
caucuaaccauuauuaaauuua

SEQ ID NO: 3908380 - RNA, 12 nt, Shigella flexneri 2a str. 301
caucuacaaaaa

SEQ ID NO: 3908381 - RNA, 16 nt, Shigella flexneri 2a str. 301
caucuacaaaaaacug

SEQ ID NO: 3908382 - RNA, 16 nt, Shigella flexneri 2a str. 301
caucuauagcacccgc

SEQ ID NO: 3908383 - RNA, 21 nt, Shigella flexneri 2a str. 301
caucuauagugaggcuauucc

SEQ ID NO: 3908384 - RNA, 12 nt, Shigella flexneri 2a str. 301
caucuauuauug

SEQ ID NO: 3908385 - RNA, 13 nt, Shigella flexneri 2a str. 301
caucucaaacacg

SEQ ID NO: 3908386 - RNA, 17 nt, Shigella flexneri 2a str. 301
caucucaccguugccaa

SEQ ID NO: 3908387 - RNA, 22 nt, Shigella flexneri 2a str. 301
caucucaggcaguacgcggcgg

SEQ ID NO: 3908388 - RNA, 16 nt, Shigella flexneri 2a str. 301
caucucauagcgcccu

SEQ ID NO: 3908389 - RNA, 24 nt, Shigella flexneri 2a str. 301
caucucccacgcggcaacggcuuc

SEQ ID NO: 3908390 - RNA, 15 nt, Shigella flexneri 2a str. 301
caucucgcucaaaaa

SEQ ID NO: 3908391 - RNA, 18 nt, Shigella flexneri 2a str. 301
caucucucguugccuugc

SEQ ID NO: 3908392 - RNA, 20 nt, Shigella flexneri 2a str. 301
caucucugcaacgucuuccc

SEQ ID NO: 3908393 - RNA, 12 nt, Shigella flexneri 2a str. 301
caucucuuccca

SEQ ID NO: 3908394 - RNA, 13 nt, Shigella flexneri 2a str. 301
caucucuucccau

SEQ ID NO: 3908395 - RNA, 19 nt, Shigella flexneri 2a str. 301
caucucuuccggcaccaca

SEQ ID NO: 3908396 - RNA, 13 nt, Shigella flexneri 2a str. 301
caucucuucuucc

SEQ ID NO: 3908397 - RNA, 14 nt, Shigella flexneri 2a str. 301
caucucuucuuccg

SEQ ID NO: 3908398 - RNA, 22 nt, Shigella flexneri 2a str. 301
caucucuucuuccggcaccauu

SEQ ID NO: 3908399 - RNA, 20 nt, Shigella flexneri 2a str. 301
caucugaccacggccacagc

SEQ ID NO: 3908400 - RNA, 21 nt, Shigella flexneri 2a str. 301
caucugaccacggccacagcc

SEQ ID NO: 3908401 - RNA, 13 nt, Shigella flexneri 2a str. 301
caucugaccagau

SEQ ID NO: 3908402 - RNA, 20 nt, Shigella flexneri 2a str. 301
caucugagcaugaugccuga

SEQ ID NO: 3908403 - RNA, 13 nt, Shigella flexneri 2a str. 301
caucugcauggug

SEQ ID NO: 3908404 - RNA, 19 nt, Shigella flexneri 2a str. 301
caucugcauggugccgcca

SEQ ID NO: 3908405 - RNA, 19 nt, Shigella flexneri 2a str. 301
caucugcauuccgguguaa

SEQ ID NO: 3908406 - RNA, 14 nt, Shigella flexneri 2a str. 301
caucugccacuucu

SEQ ID NO: 3908407 - RNA, 15 nt, Shigella flexneri 2a str. 301
caucugccuuauuga

SEQ ID NO: 3908408 - RNA, 15 nt, Shigella flexneri 2a str. 301
caucugcgacagcca

SEQ ID NO: 3908409 - RNA, 13 nt, Shigella flexneri 2a str. 301
caucuggaugaaa

SEQ ID NO: 3908410 - RNA, 15 nt, Shigella flexneri 2a str. 301
caucuggcauucaga

SEQ ID NO: 3908411 - RNA, 21 nt, Shigella flexneri 2a str. 301
caucuggcugugauccauucc

SEQ ID NO: 3908412 - RNA, 23 nt, Shigella flexneri 2a str. 301
caucuguauggcccggaaacccu

SEQ ID NO: 3908413 - RNA, 23 nt, Shigella flexneri 2a str. 301
caucuguucuuuuaacgcaugca

SEQ ID NO: 3908414 - RNA, 20 nt, Shigella flexneri 2a str. 301
caucuguuucgaucagcaau

SEQ ID NO: 3908415 - RNA, 19 nt, Shigella flexneri 2a str. 301
caucuuaacuucgcagcuu

SEQ ID NO: 3908416 - RNA, 19 nt, Shigella flexneri 2a str. 301
caucuuauccagcaaccag

SEQ ID NO: 3908417 - RNA, 14 nt, Shigella flexneri 2a str. 301
caucuuauccggcc

SEQ ID NO: 3908418 - RNA, 18 nt, Shigella flexneri 2a str. 301
caucuuauuccuuucggc

SEQ ID NO: 3908419 - RNA, 17 nt, Shigella flexneri 2a str. 301
caucuucaacugccaug

SEQ ID NO: 3908420 - RNA, 13 nt, Shigella flexneri 2a str. 301
caucuucacuuca

SEQ ID NO: 3908421 - RNA, 14 nt, Shigella flexneri 2a str. 301
caucuucaucaucc

SEQ ID NO: 3908422 - RNA, 13 nt, Shigella flexneri 2a str. 301
caucuuccaccac

SEQ ID NO: 3908423 - RNA, 12 nt, Shigella flexneri 2a str. 301
caucuuccagca

SEQ ID NO: 3908424 - RNA, 13 nt, Shigella flexneri 2a str. 301
caucuuccagcgu

SEQ ID NO: 3908425 - RNA, 15 nt, Shigella flexneri 2a str. 301
caucuuccaguugca

SEQ ID NO: 3908426 - RNA, 20 nt, Shigella flexneri 2a str. 301
caucuuccaguugcacgcca

SEQ ID NO: 3908427 - RNA, 21 nt, Shigella flexneri 2a str. 301
caucuuccaguugcacgccac

SEQ ID NO: 3908428 - RNA, 22 nt, Shigella flexneri 2a str. 301
caucuucggcguuguaagguua

SEQ ID NO: 3908429 - RNA, 12 nt, Shigella flexneri 2a str. 301
caucuucuccac

SEQ ID NO: 3908430 - RNA, 16 nt, Shigella flexneri 2a str. 301
caucuucuccacgcca

SEQ ID NO: 3908431 - RNA, 15 nt, Shigella flexneri 2a str. 301
caucuucuccagcga

SEQ ID NO: 3908432 - RNA, 18 nt, Shigella flexneri 2a str. 301
caucuucuucaauuuccg

SEQ ID NO: 3908433 - RNA, 23 nt, Shigella flexneri 2a str. 301
caucuucuugcagcuuaaucaua

SEQ ID NO: 3908434 - RNA, 16 nt, Shigella flexneri 2a str. 301
caucuugaacgcaaau

SEQ ID NO: 3908435 - RNA, 21 nt, Shigella flexneri 2a str. 301
caucuuguucauagugccuga

SEQ ID NO: 3908436 - RNA, 21 nt, Shigella flexneri 2a str. 301
caucuuuauauauugggauca

SEQ ID NO: 3908437 - RNA, 15 nt, Shigella flexneri 2a str. 301
caucuuucagaauca

SEQ ID NO: 3908438 - RNA, 18 nt, Shigella flexneri 2a str. 301
caucuuucagaaucaggu

SEQ ID NO: 3908439 - RNA, 18 nt, Shigella flexneri 2a str. 301
caucuuugaaaucacgca

SEQ ID NO: 3908440 - RNA, 17 nt, Shigella flexneri 2a str. 301
caugaaaaaacuggcua

SEQ ID NO: 3908441 - RNA, 14 nt, Shigella flexneri 2a str. 301
caugaaacagaaaa

SEQ ID NO: 3908442 - RNA, 13 nt, Shigella flexneri 2a str. 301
caugaaacgcguu

SEQ ID NO: 3908443 - RNA, 22 nt, Shigella flexneri 2a str. 301
caugaaacgcguucaggcgaac

SEQ ID NO: 3908444 - RNA, 15 nt, Shigella flexneri 2a str. 301
caugaaauaaaaaua

SEQ ID NO: 3908445 - RNA, 20 nt, Shigella flexneri 2a str. 301
caugaaauaaaaauaagaaa

SEQ ID NO: 3908446 - RNA, 13 nt, Shigella flexneri 2a str. 301
caugaaaugaaaa

SEQ ID NO: 3908447 - RNA, 20 nt, Shigella flexneri 2a str. 301
caugaaaugaaaaucaccau

SEQ ID NO: 3908448 - RNA, 18 nt, Shigella flexneri 2a str. 301
caugaacaaagcgcaccu

SEQ ID NO: 3908449 - RNA, 20 nt, Shigella flexneri 2a str. 301
caugaacaccuucucaggcc

SEQ ID NO: 3908450 - RNA, 21 nt, Shigella flexneri 2a str. 301
caugaaccauuauccgucagc

SEQ ID NO: 3908451 - RNA, 18 nt, Shigella flexneri 2a str. 301
caugaaccgugucgccau

SEQ ID NO: 3908452 - RNA, 15 nt, Shigella flexneri 2a str. 301
caugaaccugccgcc

SEQ ID NO: 3908453 - RNA, 24 nt, Shigella flexneri 2a str. 301
caugaagauggucuguaccaccag

SEQ ID NO: 3908454 - RNA, 22 nt, Shigella flexneri 2a str. 301
caugaagcugacaggcgcugau

SEQ ID NO: 3908455 - RNA, 13 nt, Shigella flexneri 2a str. 301
caugaauaucaag

SEQ ID NO: 3908456 - RNA, 17 nt, Shigella flexneri 2a str. 301
caugaaucagcaaggaa

SEQ ID NO: 3908457 - RNA, 18 nt, Shigella flexneri 2a str. 301
caugaauucgacuuucuc

SEQ ID NO: 3908458 - RNA, 23 nt, Shigella flexneri 2a str. 301
caugaccagugaggaugcggguc

SEQ ID NO: 3908459 - RNA, 21 nt, Shigella flexneri 2a str. 301
caugacccgugacacacugaa

SEQ ID NO: 3908460 - RNA, 16 nt, Shigella flexneri 2a str. 301
caugaccgaucaaggc

SEQ ID NO: 3908461 - RNA, 16 nt, Shigella flexneri 2a str. 301
caugaccgcuccgcca

SEQ ID NO: 3908462 - RNA, 15 nt, Shigella flexneri 2a str. 301
caugaccgugaucgu

SEQ ID NO: 3908463 - RNA, 23 nt, Shigella flexneri 2a str. 301
caugaccgugaucguggccauga

SEQ ID NO: 3908464 - RNA, 11 nt, Shigella flexneri 2a str. 301
caugaccugcc

SEQ ID NO: 3908465 - RNA, 18 nt, Shigella flexneri 2a str. 301
caugaccuuccagcgccg

SEQ ID NO: 3908466 - RNA, 18 nt, Shigella flexneri 2a str. 301
caugacgaucaacccagu

SEQ ID NO: 3908467 - RNA, 20 nt, Shigella flexneri 2a str. 301
caugacgaucaacccaguug

SEQ ID NO: 3908468 - RNA, 20 nt, Shigella flexneri 2a str. 301
caugacgcacuuucgcuuua

SEQ ID NO: 3908469 - RNA, 13 nt, Shigella flexneri 2a str. 301
caugacgccacca

SEQ ID NO: 3908470 - RNA, 15 nt, Shigella flexneri 2a str. 301
caugacgccaccagc

SEQ ID NO: 3908471 - RNA, 19 nt, Shigella flexneri 2a str. 301
caugacgggcaagaauauc

SEQ ID NO: 3908472 - RNA, 16 nt, Shigella flexneri 2a str. 301
caugacuacacuaaac

SEQ ID NO: 3908473 - RNA, 19 nt, Shigella flexneri 2a str. 301
caugacuuuguaggccgga

SEQ ID NO: 3908474 - RNA, 22 nt, Shigella flexneri 2a str. 301
caugagagaaaaucacacuacc

SEQ ID NO: 3908475 - RNA, 20 nt, Shigella flexneri 2a str. 301
caugaguaacagucaguuau

SEQ ID NO: 3908476 - RNA, 16 nt, Shigella flexneri 2a str. 301
caugaguuccacuggu

SEQ ID NO: 3908477 - RNA, 12 nt, Shigella flexneri 2a str. 301
caugaguugcug

SEQ ID NO: 3908478 - RNA, 14 nt, Shigella flexneri 2a str. 301
caugaguugcugga

SEQ ID NO: 3908479 - RNA, 19 nt, Shigella flexneri 2a str. 301
caugauaagacgcgccagc

SEQ ID NO: 3908480 - RNA, 20 nt, Shigella flexneri 2a str. 301
caugauaauuccgccgccca

SEQ ID NO: 3908481 - RNA, 15 nt, Shigella flexneri 2a str. 301
caugauagcccggau

SEQ ID NO: 3908482 - RNA, 21 nt, Shigella flexneri 2a str. 301
caugauagcucgggcgauaau

SEQ ID NO: 3908483 - RNA, 17 nt, Shigella flexneri 2a str. 301
caugauaucaaaacgcu

SEQ ID NO: 3908484 - RNA, 18 nt, Shigella flexneri 2a str. 301
caugaucauucaccagcc

SEQ ID NO: 3908485 - RNA, 14 nt, Shigella flexneri 2a str. 301
caugaucuuuuuug

SEQ ID NO: 3908486 - RNA, 14 nt, Shigella flexneri 2a str. 301
caugaugacaacau

SEQ ID NO: 3908487 - RNA, 18 nt, Shigella flexneri 2a str. 301
caugaugacaacauagcu

SEQ ID NO: 3908488 - RNA, 19 nt, Shigella flexneri 2a str. 301
caugaugacuugccuccag

SEQ ID NO: 3908489 - RNA, 18 nt, Shigella flexneri 2a str. 301
caugaugauaucacuggu

SEQ ID NO: 3908490 - RNA, 23 nt, Shigella flexneri 2a str. 301
caugaugaucuuaugauguaaau

SEQ ID NO: 3908491 - RNA, 23 nt, Shigella flexneri 2a str. 301
caugaugcgcggcuccagaauau

SEQ ID NO: 3908492 - RNA, 18 nt, Shigella flexneri 2a str. 301
caugaugugcuucaucag

SEQ ID NO: 3908493 - RNA, 19 nt, Shigella flexneri 2a str. 301
caugaugugcuucaucaga

SEQ ID NO: 3908494 - RNA, 14 nt, Shigella flexneri 2a str. 301
caugauguggugca

SEQ ID NO: 3908495 - RNA, 22 nt, Shigella flexneri 2a str. 301
caugauucggcgguaguuaagc

SEQ ID NO: 3908496 - RNA, 16 nt, Shigella flexneri 2a str. 301
caugauucugagaaac

SEQ ID NO: 3908497 - RNA, 14 nt, Shigella flexneri 2a str. 301
caugauuucgucau

SEQ ID NO: 3908498 - RNA, 12 nt, Shigella flexneri 2a str. 301
caugauuucugc

SEQ ID NO: 3908499 - RNA, 20 nt, Shigella flexneri 2a str. 301
caugauuuuguaggccggau

SEQ ID NO: 3908500 - RNA, 10 nt, Shigella flexneri 2a str. 301
caugcaauaa

SEQ ID NO: 3908501 - RNA, 19 nt, Shigella flexneri 2a str. 301
caugcaauuaccgccacca

SEQ ID NO: 3908502 - RNA, 20 nt, Shigella flexneri 2a str. 301
caugcacccucaacaacagc

SEQ ID NO: 3908503 - RNA, 22 nt, Shigella flexneri 2a str. 301
caugcaccugcuuccugaacuc

SEQ ID NO: 3908504 - RNA, 20 nt, Shigella flexneri 2a str. 301
caugcacgauauaccgugcu

SEQ ID NO: 3908505 - RNA, 20 nt, Shigella flexneri 2a str. 301
caugcacgggcgcuuguuau

SEQ ID NO: 3908506 - RNA, 15 nt, Shigella flexneri 2a str. 301
caugcacuccgcugu

SEQ ID NO: 3908507 - RNA, 13 nt, Shigella flexneri 2a str. 301
caugcagcauggu

SEQ ID NO: 3908508 - RNA, 14 nt, Shigella flexneri 2a str. 301
caugcagcccagca

SEQ ID NO: 3908509 - RNA, 21 nt, Shigella flexneri 2a str. 301
caugcagcccagcaucagacu

SEQ ID NO: 3908510 - RNA, 13 nt, Shigella flexneri 2a str. 301
caugcagcuccac

SEQ ID NO: 3908511 - RNA, 15 nt, Shigella flexneri 2a str. 301
caugcagcuccaccg

SEQ ID NO: 3908512 - RNA, 22 nt, Shigella flexneri 2a str. 301
caugcaggcggugcaauuccau

SEQ ID NO: 3908513 - RNA, 15 nt, Shigella flexneri 2a str. 301
caugcaggcuggcac

SEQ ID NO: 3908514 - RNA, 16 nt, Shigella flexneri 2a str. 301
caugcaguaccagaua

SEQ ID NO: 3908515 - RNA, 21 nt, Shigella flexneri 2a str. 301
caugcaguugauuacacaaau

SEQ ID NO: 3908516 - RNA, 14 nt, Shigella flexneri 2a str. 301
caugccaaaaggga

SEQ ID NO: 3908517 - RNA, 15 nt, Shigella flexneri 2a str. 301
caugccaaaucaaug

SEQ ID NO: 3908518 - RNA, 22 nt, Shigella flexneri 2a str. 301
caugccaacgcggaugaggcgu

SEQ ID NO: 3908519 - RNA, 14 nt, Shigella flexneri 2a str. 301
caugccauauuguu

SEQ ID NO: 3908520 - RNA, 13 nt, Shigella flexneri 2a str. 301
caugccauccgca

SEQ ID NO: 3908521 - RNA, 15 nt, Shigella flexneri 2a str. 301
caugccauccgcauc

SEQ ID NO: 3908522 - RNA, 16 nt, Shigella flexneri 2a str. 301
caugccaucugccagc

SEQ ID NO: 3908523 - RNA, 23 nt, Shigella flexneri 2a str. 301
caugcccgcgcaaaccaccuggc

SEQ ID NO: 3908524 - RNA, 17 nt, Shigella flexneri 2a str. 301
caugcccggcauccggg

SEQ ID NO: 3908525 - RNA, 16 nt, Shigella flexneri 2a str. 301
caugcccgugcugaca

SEQ ID NO: 3908526 - RNA, 17 nt, Shigella flexneri 2a str. 301
caugccgaucgucuggg

SEQ ID NO: 3908527 - RNA, 16 nt, Shigella flexneri 2a str. 301
caugccgaugccgacg

SEQ ID NO: 3908528 - RNA, 18 nt, Shigella flexneri 2a str. 301
caugccgaugccgacgau

SEQ ID NO: 3908529 - RNA, 17 nt, Shigella flexneri 2a str. 301
caugccggccagcgcca

SEQ ID NO: 3908530 - RNA, 20 nt, Shigella flexneri 2a str. 301
caugccggccagcgccacca

SEQ ID NO: 3908531 - RNA, 17 nt, Shigella flexneri 2a str. 301
caugccggugaugccgc

SEQ ID NO: 3908532 - RNA, 15 nt, Shigella flexneri 2a str. 301
caugcgaagaccgca

SEQ ID NO: 3908533 - RNA, 16 nt, Shigella flexneri 2a str. 301
caugcgaauacacccu

SEQ ID NO: 3908534 - RNA, 23 nt, Shigella flexneri 2a str. 301
caugcgaauacacccugaacuga

SEQ ID NO: 3908535 - RNA, 15 nt, Shigella flexneri 2a str. 301
caugcgagaagcaac

SEQ ID NO: 3908536 - RNA, 13 nt, Shigella flexneri 2a str. 301
caugcgauggagu

SEQ ID NO: 3908537 - RNA, 15 nt, Shigella flexneri 2a str. 301
caugcgcucucccau

SEQ ID NO: 3908538 - RNA, 17 nt, Shigella flexneri 2a str. 301
caugcgcucucccaugg

SEQ ID NO: 3908539 - RNA, 14 nt, Shigella flexneri 2a str. 301
caugcggauaaauc

SEQ ID NO: 3908540 - RNA, 20 nt, Shigella flexneri 2a str. 301
caugcguugucgccauccag

SEQ ID NO: 3908541 - RNA, 14 nt, Shigella flexneri 2a str. 301
caugcguuuguagg

SEQ ID NO: 3908542 - RNA, 15 nt, Shigella flexneri 2a str. 301
caugcucacagagua

SEQ ID NO: 3908543 - RNA, 18 nt, Shigella flexneri 2a str. 301
caugcucagaugccugau

SEQ ID NO: 3908544 - RNA, 21 nt, Shigella flexneri 2a str. 301
caugcuccagcagauggcagu

SEQ ID NO: 3908545 - RNA, 14 nt, Shigella flexneri 2a str. 301
caugcucugccagc

SEQ ID NO: 3908546 - RNA, 22 nt, Shigella flexneri 2a str. 301
caugcugccggaaaucaucauu

SEQ ID NO: 3908547 - RNA, 14 nt, Shigella flexneri 2a str. 301
caugcugccgggca

SEQ ID NO: 3908548 - RNA, 14 nt, Shigella flexneri 2a str. 301
caugcuggcugcgc

SEQ ID NO: 3908549 - RNA, 22 nt, Shigella flexneri 2a str. 301
caugcuguccagcaggcgauga

SEQ ID NO: 3908550 - RNA, 20 nt, Shigella flexneri 2a str. 301
caugcuuaccaaaaugcugc

SEQ ID NO: 3908551 - RNA, 12 nt, Shigella flexneri 2a str. 301
caugcuucugca

SEQ ID NO: 3908552 - RNA, 23 nt, Shigella flexneri 2a str. 301
caugcuucugcacgcuugccugu

SEQ ID NO: 3908553 - RNA, 14 nt, Shigella flexneri 2a str. 301
cauggaaaccauca

SEQ ID NO: 3908554 - RNA, 16 nt, Shigella flexneri 2a str. 301
cauggaaaccaucauc

SEQ ID NO: 3908555 - RNA, 17 nt, Shigella flexneri 2a str. 301
cauggacauacgcaccu

SEQ ID NO: 3908556 - RNA, 15 nt, Shigella flexneri 2a str. 301
cauggacgcgucagu

SEQ ID NO: 3908557 - RNA, 22 nt, Shigella flexneri 2a str. 301
cauggagaacgccuguguccug

SEQ ID NO: 3908558 - RNA, 16 nt, Shigella flexneri 2a str. 301
cauggauacauuccac

SEQ ID NO: 3908559 - RNA, 22 nt, Shigella flexneri 2a str. 301
cauggcaacuaacugacuuccg

SEQ ID NO: 3908560 - RNA, 16 nt, Shigella flexneri 2a str. 301
cauggcagauaaacaa

SEQ ID NO: 3908561 - RNA, 19 nt, Shigella flexneri 2a str. 301
cauggcagauaaacaaccc

SEQ ID NO: 3908562 - RNA, 12 nt, Shigella flexneri 2a str. 301
cauggcguccgu

SEQ ID NO: 3908563 - RNA, 14 nt, Shigella flexneri 2a str. 301
cauggcucaccagc

SEQ ID NO: 3908564 - RNA, 16 nt, Shigella flexneri 2a str. 301
cauggcucaccagcag

SEQ ID NO: 3908565 - RNA, 14 nt, Shigella flexneri 2a str. 301
caugggguuuuucg

SEQ ID NO: 3908566 - RNA, 16 nt, Shigella flexneri 2a str. 301
caugggguuuuucgag

SEQ ID NO: 3908567 - RNA, 22 nt, Shigella flexneri 2a str. 301
caugggucugcggaucauggua

SEQ ID NO: 3908568 - RNA, 16 nt, Shigella flexneri 2a str. 301
caugggugaacugcuu

SEQ ID NO: 3908569 - RNA, 20 nt, Shigella flexneri 2a str. 301
cauggguggcagauccaaua

SEQ ID NO: 3908570 - RNA, 20 nt, Shigella flexneri 2a str. 301
caugguaaaaccgacuuaaa

SEQ ID NO: 3908571 - RNA, 20 nt, Shigella flexneri 2a str. 301
caugguaacgccccacaaac

SEQ ID NO: 3908572 - RNA, 15 nt, Shigella flexneri 2a str. 301
caugguaaugaucgc

SEQ ID NO: 3908573 - RNA, 23 nt, Shigella flexneri 2a str. 301
cauggugaauaucaguuauuaca

SEQ ID NO: 3908574 - RNA, 17 nt, Shigella flexneri 2a str. 301
cauggugagccugcugu

SEQ ID NO: 3908575 - RNA, 23 nt, Shigella flexneri 2a str. 301
caugguggaaaucgaacuucccg

SEQ ID NO: 3908576 - RNA, 17 nt, Shigella flexneri 2a str. 301
cauggugucugaugagg

SEQ ID NO: 3908577 - RNA, 19 nt, Shigella flexneri 2a str. 301
cauggugucugaugaggca

SEQ ID NO: 3908578 - RNA, 21 nt, Shigella flexneri 2a str. 301
caugguguucagauggccaau

SEQ ID NO: 3908579 - RNA, 18 nt, Shigella flexneri 2a str. 301
caugguuuauuucccaga

SEQ ID NO: 3908580 - RNA, 18 nt, Shigella flexneri 2a str. 301
caugguuugcauccacaa

SEQ ID NO: 3908581 - RNA, 22 nt, Shigella flexneri 2a str. 301
cauguaaaaggcgcuaaaaaua

SEQ ID NO: 3908582 - RNA, 14 nt, Shigella flexneri 2a str. 301
cauguaacgaugca

SEQ ID NO: 3908583 - RNA, 15 nt, Shigella flexneri 2a str. 301
cauguaacgaugcau

SEQ ID NO: 3908584 - RNA, 17 nt, Shigella flexneri 2a str. 301
cauguaacgaugcauga

SEQ ID NO: 3908585 - RNA, 19 nt, Shigella flexneri 2a str. 301
cauguaacgaugcaugaca

SEQ ID NO: 3908586 - RNA, 20 nt, Shigella flexneri 2a str. 301
cauguagccgcuuuuucugc

SEQ ID NO: 3908587 - RNA, 17 nt, Shigella flexneri 2a str. 301
cauguccuucuucugcc

SEQ ID NO: 3908588 - RNA, 19 nt, Shigella flexneri 2a str. 301
caugugauuuaaaucaaac

SEQ ID NO: 3908589 - RNA, 20 nt, Shigella flexneri 2a str. 301
caugugcaggauuaauaaau

SEQ ID NO: 3908590 - RNA, 17 nt, Shigella flexneri 2a str. 301
caugugcgacgggccaa

SEQ ID NO: 3908591 - RNA, 16 nt, Shigella flexneri 2a str. 301
caugugcuuuuguuau

SEQ ID NO: 3908592 - RNA, 19 nt, Shigella flexneri 2a str. 301
cauguucauuuauuaccuu

SEQ ID NO: 3908593 - RNA, 20 nt, Shigella flexneri 2a str. 301
cauguucuaugaagaacugg

SEQ ID NO: 3908594 - RNA, 15 nt, Shigella flexneri 2a str. 301
cauguugaucauaaa

SEQ ID NO: 3908595 - RNA, 16 nt, Shigella flexneri 2a str. 301
cauguugaucccggcu

SEQ ID NO: 3908596 - RNA, 19 nt, Shigella flexneri 2a str. 301
cauguugauuaccugucgc

SEQ ID NO: 3908597 - RNA, 22 nt, Shigella flexneri 2a str. 301
cauguugcgcagaguuuccagg

SEQ ID NO: 3908598 - RNA, 12 nt, Shigella flexneri 2a str. 301
cauguugcugac

SEQ ID NO: 3908599 - RNA, 17 nt, Shigella flexneri 2a str. 301
cauguuguacaugcugc

SEQ ID NO: 3908600 - RNA, 19 nt, Shigella flexneri 2a str. 301
cauguuucaacggaccaau

SEQ ID NO: 3908601 - RNA, 15 nt, Shigella flexneri 2a str. 301
cauguuugaaucaac

SEQ ID NO: 3908602 - RNA, 22 nt, Shigella flexneri 2a str. 301
cauguuuuccagcacauauuca

SEQ ID NO: 3908603 - RNA, 13 nt, Shigella flexneri 2a str. 301
cauuaaaaacccg

SEQ ID NO: 3908604 - RNA, 12 nt, Shigella flexneri 2a str. 301
cauuaaaauucu

SEQ ID NO: 3908605 - RNA, 14 nt, Shigella flexneri 2a str. 301
cauuaaaccagugc

SEQ ID NO: 3908606 - RNA, 15 nt, Shigella flexneri 2a str. 301
cauuaacuccagcuc

SEQ ID NO: 3908607 - RNA, 19 nt, Shigella flexneri 2a str. 301
cauuaagauuaccuuccuc

SEQ ID NO: 3908608 - RNA, 17 nt, Shigella flexneri 2a str. 301
cauuaaggcaagaaaau

SEQ ID NO: 3908609 - RNA, 23 nt, Shigella flexneri 2a str. 301
cauuaaugccguuauacaucgcu

SEQ ID NO: 3908610 - RNA, 22 nt, Shigella flexneri 2a str. 301
cauuaaugcgcccagcgucagc

SEQ ID NO: 3908611 - RNA, 18 nt, Shigella flexneri 2a str. 301
cauuaauuuccugauggc

SEQ ID NO: 3908612 - RNA, 14 nt, Shigella flexneri 2a str. 301
cauuacaaccgcug

SEQ ID NO: 3908613 - RNA, 18 nt, Shigella flexneri 2a str. 301
cauuacaagaaucaugcc

SEQ ID NO: 3908614 - RNA, 13 nt, Shigella flexneri 2a str. 301
cauuacaagcccg

SEQ ID NO: 3908615 - RNA, 18 nt, Shigella flexneri 2a str. 301
cauuaccacgauuuugac

SEQ ID NO: 3908616 - RNA, 16 nt, Shigella flexneri 2a str. 301
cauuaccgaacaacaa

SEQ ID NO: 3908617 - RNA, 11 nt, Shigella flexneri 2a str. 301
cauuaccgcga

SEQ ID NO: 3908618 - RNA, 16 nt, Shigella flexneri 2a str. 301
cauuaccugaaaaaac

SEQ ID NO: 3908619 - RNA, 19 nt, Shigella flexneri 2a str. 301
cauuaccugaaaaaacaaa

SEQ ID NO: 3908620 - RNA, 14 nt, Shigella flexneri 2a str. 301
cauuaccugacagc

SEQ ID NO: 3908621 - RNA, 19 nt, Shigella flexneri 2a str. 301
cauuaccuucaacacuggc

SEQ ID NO: 3908622 - RNA, 23 nt, Shigella flexneri 2a str. 301
cauuacgcucacugcaaaacagg

SEQ ID NO: 3908623 - RNA, 18 nt, Shigella flexneri 2a str. 301
cauuacggcauaacgccg

SEQ ID NO: 3908624 - RNA, 20 nt, Shigella flexneri 2a str. 301
cauuacguccaucacaauca

SEQ ID NO: 3908625 - RNA, 14 nt, Shigella flexneri 2a str. 301
cauuacucguccuu

SEQ ID NO: 3908626 - RNA, 19 nt, Shigella flexneri 2a str. 301
cauuacuguauacgggcuu

SEQ ID NO: 3908627 - RNA, 15 nt, Shigella flexneri 2a str. 301
cauuagauaaaaaug

SEQ ID NO: 3908628 - RNA, 15 nt, Shigella flexneri 2a str. 301
cauuagccauugaga

SEQ ID NO: 3908629 - RNA, 18 nt, Shigella flexneri 2a str. 301
cauuagugauuaacgcuu

SEQ ID NO: 3908630 - RNA, 19 nt, Shigella flexneri 2a str. 301
cauuagugauuaacgcuug

SEQ ID NO: 3908631 - RNA, 20 nt, Shigella flexneri 2a str. 301
cauuauaaauucuggccacu

SEQ ID NO: 3908632 - RNA, 17 nt, Shigella flexneri 2a str. 301
cauuauauaaugccagg

SEQ ID NO: 3908633 - RNA, 14 nt, Shigella flexneri 2a str. 301
cauuaucaaagaug

SEQ ID NO: 3908634 - RNA, 13 nt, Shigella flexneri 2a str. 301
cauuaucaccaaa

SEQ ID NO: 3908635 - RNA, 14 nt, Shigella flexneri 2a str. 301
cauuaucagagauu

SEQ ID NO: 3908636 - RNA, 20 nt, Shigella flexneri 2a str. 301
cauuaucagagauucuuuuc

SEQ ID NO: 3908637 - RNA, 17 nt, Shigella flexneri 2a str. 301
cauuaucaugacgccac

SEQ ID NO: 3908638 - RNA, 13 nt, Shigella flexneri 2a str. 301
cauuauccagcga

SEQ ID NO: 3908639 - RNA, 19 nt, Shigella flexneri 2a str. 301
cauuaugagauugagcgau

SEQ ID NO: 3908640 - RNA, 14 nt, Shigella flexneri 2a str. 301
cauuaugcuggaau

SEQ ID NO: 3908641 - RNA, 23 nt, Shigella flexneri 2a str. 301
cauuaugcuggaaucaauaauua

SEQ ID NO: 3908642 - RNA, 18 nt, Shigella flexneri 2a str. 301
cauuauucauuguucucc

SEQ ID NO: 3908643 - RNA, 15 nt, Shigella flexneri 2a str. 301
cauuauucucagcgg

SEQ ID NO: 3908644 - RNA, 22 nt, Shigella flexneri 2a str. 301
cauuauucucagcgguugcaag

SEQ ID NO: 3908645 - RNA, 19 nt, Shigella flexneri 2a str. 301
cauuauugcgcacaucaau

SEQ ID NO: 3908646 - RNA, 22 nt, Shigella flexneri 2a str. 301
cauuauugucgguggcgggcaa

SEQ ID NO: 3908647 - RNA, 21 nt, Shigella flexneri 2a str. 301
cauuauuucccggcugauaaa

SEQ ID NO: 3908648 - RNA, 20 nt, Shigella flexneri 2a str. 301
cauucacaaacagcgccugu

SEQ ID NO: 3908649 - RNA, 14 nt, Shigella flexneri 2a str. 301
cauucaccaagcaa

SEQ ID NO: 3908650 - RNA, 15 nt, Shigella flexneri 2a str. 301
cauucaccagcccac

SEQ ID NO: 3908651 - RNA, 19 nt, Shigella flexneri 2a str. 301
cauucaccagcccacaugc

SEQ ID NO: 3908652 - RNA, 12 nt, Shigella flexneri 2a str. 301
cauucaccaguu

SEQ ID NO: 3908653 - RNA, 15 nt, Shigella flexneri 2a str. 301
cauucaccauuuuuu

SEQ ID NO: 3908654 - RNA, 18 nt, Shigella flexneri 2a str. 301
cauucaccgacgugauga

SEQ ID NO: 3908655 - RNA, 12 nt, Shigella flexneri 2a str. 301
cauucaccuugg

SEQ ID NO: 3908656 - RNA, 14 nt, Shigella flexneri 2a str. 301
cauucagacaggcg

SEQ ID NO: 3908657 - RNA, 16 nt, Shigella flexneri 2a str. 301
cauucagccaguucuu

SEQ ID NO: 3908658 - RNA, 20 nt, Shigella flexneri 2a str. 301
cauucagugcaaaugccaga

SEQ ID NO: 3908659 - RNA, 16 nt, Shigella flexneri 2a str. 301
cauucaguuaccugaa

SEQ ID NO: 3908660 - RNA, 21 nt, Shigella flexneri 2a str. 301
cauucaguuaccugaaugcuc

SEQ ID NO: 3908661 - RNA, 15 nt, Shigella flexneri 2a str. 301
cauucauacccugaa

SEQ ID NO: 3908662 - RNA, 19 nt, Shigella flexneri 2a str. 301
cauucauacccugaaucaa

SEQ ID NO: 3908663 - RNA, 21 nt, Shigella flexneri 2a str. 301
cauucauagaggaauggcaga

SEQ ID NO: 3908664 - RNA, 18 nt, Shigella flexneri 2a str. 301
cauucaugaacacacccg

SEQ ID NO: 3908665 - RNA, 13 nt, Shigella flexneri 2a str. 301
cauuccacuuuca

SEQ ID NO: 3908666 - RNA, 22 nt, Shigella flexneri 2a str. 301
cauuccagaugugccaguugca

SEQ ID NO: 3908667 - RNA, 13 nt, Shigella flexneri 2a str. 301
cauuccaguaauu

SEQ ID NO: 3908668 - RNA, 21 nt, Shigella flexneri 2a str. 301
cauuccaguccacaucaacca

SEQ ID NO: 3908669 - RNA, 19 nt, Shigella flexneri 2a str. 301
cauucccucuacauucaua

SEQ ID NO: 3908670 - RNA, 23 nt, Shigella flexneri 2a str. 301
cauucccugcagucaccugcccu

SEQ ID NO: 3908671 - RNA, 19 nt, Shigella flexneri 2a str. 301
cauuccgcaugauucugag

SEQ ID NO: 3908672 - RNA, 22 nt, Shigella flexneri 2a str. 301
cauuccggaguuuaugaggcac

SEQ ID NO: 3908673 - RNA, 17 nt, Shigella flexneri 2a str. 301
cauuccggccaucgccu

SEQ ID NO: 3908674 - RNA, 19 nt, Shigella flexneri 2a str. 301
cauuccguuugcuguaucg

SEQ ID NO: 3908675 - RNA, 16 nt, Shigella flexneri 2a str. 301
cauuccugcugacggc

SEQ ID NO: 3908676 - RNA, 16 nt, Shigella flexneri 2a str. 301
cauucgacaacugcug

SEQ ID NO: 3908677 - RNA, 21 nt, Shigella flexneri 2a str. 301
cauucgcaguugcaguaccag

SEQ ID NO: 3908678 - RNA, 13 nt, Shigella flexneri 2a str. 301
cauucgccagucc

SEQ ID NO: 3908679 - RNA, 15 nt, Shigella flexneri 2a str. 301
cauucgccaguccuu

SEQ ID NO: 3908680 - RNA, 22 nt, Shigella flexneri 2a str. 301
cauucgccgccgaagacaaauu

SEQ ID NO: 3908681 - RNA, 20 nt, Shigella flexneri 2a str. 301
cauucgccgguuccagcuuc

SEQ ID NO: 3908682 - RNA, 16 nt, Shigella flexneri 2a str. 301
cauucgcgguuuuaca

SEQ ID NO: 3908683 - RNA, 22 nt, Shigella flexneri 2a str. 301
cauucgcuguguaaacccagcc

SEQ ID NO: 3908684 - RNA, 19 nt, Shigella flexneri 2a str. 301
cauucggcgcagguuuaau

SEQ ID NO: 3908685 - RNA, 13 nt, Shigella flexneri 2a str. 301
cauucggugcuca

SEQ ID NO: 3908686 - RNA, 16 nt, Shigella flexneri 2a str. 301
cauucgguugccagcg

SEQ ID NO: 3908687 - RNA, 23 nt, Shigella flexneri 2a str. 301
cauucgucguauagaucacuuug

SEQ ID NO: 3908688 - RNA, 15 nt, Shigella flexneri 2a str. 301
cauucgucuccuggc

SEQ ID NO: 3908689 - RNA, 22 nt, Shigella flexneri 2a str. 301
cauucuacuuugcgagucugcu

SEQ ID NO: 3908690 - RNA, 12 nt, Shigella flexneri 2a str. 301
cauucucacucc

SEQ ID NO: 3908691 - RNA, 13 nt, Shigella flexneri 2a str. 301
cauucucacucca

SEQ ID NO: 3908692 - RNA, 18 nt, Shigella flexneri 2a str. 301
cauucucaucaccauucc

SEQ ID NO: 3908693 - RNA, 18 nt, Shigella flexneri 2a str. 301
cauucucgcgacccauga

SEQ ID NO: 3908694 - RNA, 22 nt, Shigella flexneri 2a str. 301
cauucucggcccggcccaacgc

SEQ ID NO: 3908695 - RNA, 15 nt, Shigella flexneri 2a str. 301
cauucugacuggguc

SEQ ID NO: 3908696 - RNA, 22 nt, Shigella flexneri 2a str. 301
cauucugcgcugacucuacuga

SEQ ID NO: 3908697 - RNA, 18 nt, Shigella flexneri 2a str. 301
cauucugcuggccuggcu

SEQ ID NO: 3908698 - RNA, 16 nt, Shigella flexneri 2a str. 301
cauucuuccuccagcg

SEQ ID NO: 3908699 - RNA, 20 nt, Shigella flexneri 2a str. 301
cauucuugcgcggauggccu

SEQ ID NO: 3908700 - RNA, 23 nt, Shigella flexneri 2a str. 301
cauugaacgggugauuuccccua

SEQ ID NO: 3908701 - RNA, 17 nt, Shigella flexneri 2a str. 301
cauugaagaauuuuugc

SEQ ID NO: 3908702 - RNA, 16 nt, Shigella flexneri 2a str. 301
cauugaccagaucagu

SEQ ID NO: 3908703 - RNA, 15 nt, Shigella flexneri 2a str. 301
cauugaccagcugcc

SEQ ID NO: 3908704 - RNA, 19 nt, Shigella flexneri 2a str. 301
cauugacgauagcgccgcc

SEQ ID NO: 3908705 - RNA, 14 nt, Shigella flexneri 2a str. 301
cauugacgcaucgc

SEQ ID NO: 3908706 - RNA, 14 nt, Shigella flexneri 2a str. 301
cauugacgcuggcu

SEQ ID NO: 3908707 - RNA, 14 nt, Shigella flexneri 2a str. 301
cauugacguuccuu

SEQ ID NO: 3908708 - RNA, 14 nt, Shigella flexneri 2a str. 301
cauugagauagcau

SEQ ID NO: 3908709 - RNA, 18 nt, Shigella flexneri 2a str. 301
cauugagcuggucugaau

SEQ ID NO: 3908710 - RNA, 19 nt, Shigella flexneri 2a str. 301
cauugagcuggucugaauc

SEQ ID NO: 3908711 - RNA, 23 nt, Shigella flexneri 2a str. 301
cauugagcuugcguguuuuauau

SEQ ID NO: 3908712 - RNA, 14 nt, Shigella flexneri 2a str. 301
cauugauaauguua

SEQ ID NO: 3908713 - RNA, 16 nt, Shigella flexneri 2a str. 301
cauugauauacagccc

SEQ ID NO: 3908714 - RNA, 18 nt, Shigella flexneri 2a str. 301
cauugauguuuucagacc

SEQ ID NO: 3908715 - RNA, 20 nt, Shigella flexneri 2a str. 301
cauugauguuuucagaccag

SEQ ID NO: 3908716 - RNA, 18 nt, Shigella flexneri 2a str. 301
cauugcaaccacacaggc

SEQ ID NO: 3908717 - RNA, 14 nt, Shigella flexneri 2a str. 301
cauugcaacguggu

SEQ ID NO: 3908718 - RNA, 15 nt, Shigella flexneri 2a str. 301
cauugcaguuaucug

SEQ ID NO: 3908719 - RNA, 17 nt, Shigella flexneri 2a str. 301
cauugcaucaucgacau

SEQ ID NO: 3908720 - RNA, 14 nt, Shigella flexneri 2a str. 301
cauugccauguuga

SEQ ID NO: 3908721 - RNA, 15 nt, Shigella flexneri 2a str. 301
cauugccgccucugc

SEQ ID NO: 3908722 - RNA, 22 nt, Shigella flexneri 2a str. 301
cauugccggaugacgcgucagg

SEQ ID NO: 3908723 - RNA, 20 nt, Shigella flexneri 2a str. 301
cauugccggugauugcaaag

SEQ ID NO: 3908724 - RNA, 21 nt, Shigella flexneri 2a str. 301
cauugccugaucgcgcaaaca

SEQ ID NO: 3908725 - RNA, 12 nt, Shigella flexneri 2a str. 301
cauugccugaug

SEQ ID NO: 3908726 - RNA, 21 nt, Shigella flexneri 2a str. 301
cauugcguuuaguuacaccac

SEQ ID NO: 3908727 - RNA, 16 nt, Shigella flexneri 2a str. 301
cauugcuauuuccacc

SEQ ID NO: 3908728 - RNA, 16 nt, Shigella flexneri 2a str. 301
cauugcucacuuccuu

SEQ ID NO: 3908729 - RNA, 16 nt, Shigella flexneri 2a str. 301
cauugcucucuucucc

SEQ ID NO: 3908730 - RNA, 15 nt, Shigella flexneri 2a str. 301
cauugcugccgccag

SEQ ID NO: 3908731 - RNA, 20 nt, Shigella flexneri 2a str. 301
cauugcugccgccaguucuu

SEQ ID NO: 3908732 - RNA, 21 nt, Shigella flexneri 2a str. 301
cauugcugcugaagcaacagu

SEQ ID NO: 3908733 - RNA, 23 nt, Shigella flexneri 2a str. 301
cauugcuguaucacuaugaaaau

SEQ ID NO: 3908734 - RNA, 14 nt, Shigella flexneri 2a str. 301
cauugcuuugguaa

SEQ ID NO: 3908735 - RNA, 20 nt, Shigella flexneri 2a str. 301
cauugcuuuuuugauuacag

SEQ ID NO: 3908736 - RNA, 14 nt, Shigella flexneri 2a str. 301
cauuggcaggcucu

SEQ ID NO: 3908737 - RNA, 16 nt, Shigella flexneri 2a str. 301
cauuggcauaaauaau

SEQ ID NO: 3908738 - RNA, 22 nt, Shigella flexneri 2a str. 301
cauuggccggaauaccacuuuc

SEQ ID NO: 3908739 - RNA, 16 nt, Shigella flexneri 2a str. 301
cauuggccguugccau

SEQ ID NO: 3908740 - RNA, 23 nt, Shigella flexneri 2a str. 301
cauuggcgcgcguaugcgucagc

SEQ ID NO: 3908741 - RNA, 19 nt, Shigella flexneri 2a str. 301
cauugggccacucaacauc

SEQ ID NO: 3908742 - RNA, 17 nt, Shigella flexneri 2a str. 301
cauuggggauuaucuga

SEQ ID NO: 3908743 - RNA, 23 nt, Shigella flexneri 2a str. 301
cauuggggauuaucugaaucagc

SEQ ID NO: 3908744 - RNA, 19 nt, Shigella flexneri 2a str. 301
cauuguccaguugcccggu

SEQ ID NO: 3908745 - RNA, 20 nt, Shigella flexneri 2a str. 301
cauugugguucucaauuaca

SEQ ID NO: 3908746 - RNA, 14 nt, Shigella flexneri 2a str. 301
cauugugugaaauc

SEQ ID NO: 3908747 - RNA, 17 nt, Shigella flexneri 2a str. 301
cauuguguuaucccgau

SEQ ID NO: 3908748 - RNA, 15 nt, Shigella flexneri 2a str. 301
cauuguuucucugac

SEQ ID NO: 3908749 - RNA, 20 nt, Shigella flexneri 2a str. 301
cauuguuugcaaaaucaaau

SEQ ID NO: 3908750 - RNA, 14 nt, Shigella flexneri 2a str. 301
cauuguuuuccaga

SEQ ID NO: 3908751 - RNA, 19 nt, Shigella flexneri 2a str. 301
cauuguuuuuuuacgcaac

SEQ ID NO: 3908752 - RNA, 20 nt, Shigella flexneri 2a str. 301
cauuuaaacaauuucagaau

SEQ ID NO: 3908753 - RNA, 17 nt, Shigella flexneri 2a str. 301
cauuuaacccuucaaga

SEQ ID NO: 3908754 - RNA, 13 nt, Shigella flexneri 2a str. 301
cauuuaauuuaac

SEQ ID NO: 3908755 - RNA, 13 nt, Shigella flexneri 2a str. 301
cauuuacagaaac

SEQ ID NO: 3908756 - RNA, 15 nt, Shigella flexneri 2a str. 301
cauuuacgccgcauc

SEQ ID NO: 3908757 - RNA, 17 nt, Shigella flexneri 2a str. 301
cauuuacgccgcauccg

SEQ ID NO: 3908758 - RNA, 23 nt, Shigella flexneri 2a str. 301
cauuuaugcuguccuaaaaaauu

SEQ ID NO: 3908759 - RNA, 13 nt, Shigella flexneri 2a str. 301
cauuuauuaccuu

SEQ ID NO: 3908760 - RNA, 14 nt, Shigella flexneri 2a str. 301
cauuuauuucucac

SEQ ID NO: 3908761 - RNA, 20 nt, Shigella flexneri 2a str. 301
cauuuauuuuuccuccauug

SEQ ID NO: 3908762 - RNA, 22 nt, Shigella flexneri 2a str. 301
cauuucaccgucaucgacaaaa

SEQ ID NO: 3908763 - RNA, 16 nt, Shigella flexneri 2a str. 301
cauuucacguucacgu

SEQ ID NO: 3908764 - RNA, 21 nt, Shigella flexneri 2a str. 301
cauuucagaaaguauauaaaa

SEQ ID NO: 3908765 - RNA, 22 nt, Shigella flexneri 2a str. 301
cauuucagaaaguauauaaaaa

SEQ ID NO: 3908766 - RNA, 15 nt, Shigella flexneri 2a str. 301
cauuucagggaugaa

SEQ ID NO: 3908767 - RNA, 12 nt, Shigella flexneri 2a str. 301
cauuuccauaaa

SEQ ID NO: 3908768 - RNA, 15 nt, Shigella flexneri 2a str. 301
cauuuccauaaauug

SEQ ID NO: 3908769 - RNA, 19 nt, Shigella flexneri 2a str. 301
cauuucccagcaagaacca

SEQ ID NO: 3908770 - RNA, 13 nt, Shigella flexneri 2a str. 301
cauuuccccaauc

SEQ ID NO: 3908771 - RNA, 18 nt, Shigella flexneri 2a str. 301
cauuuccccaaucuucuc

SEQ ID NO: 3908772 - RNA, 14 nt, Shigella flexneri 2a str. 301
cauuucgaagaaac

SEQ ID NO: 3908773 - RNA, 19 nt, Shigella flexneri 2a str. 301
cauuucugcugccuacaca

SEQ ID NO: 3908774 - RNA, 14 nt, Shigella flexneri 2a str. 301
cauuucuggcguca

SEQ ID NO: 3908775 - RNA, 19 nt, Shigella flexneri 2a str. 301
cauuucuggcgucaaagcu

SEQ ID NO: 3908776 - RNA, 23 nt, Shigella flexneri 2a str. 301
cauuucuuacuguagugcuccca

SEQ ID NO: 3908777 - RNA, 14 nt, Shigella flexneri 2a str. 301
cauuugaaacguua

SEQ ID NO: 3908778 - RNA, 19 nt, Shigella flexneri 2a str. 301
cauuugacacgaacuuuau

SEQ ID NO: 3908779 - RNA, 20 nt, Shigella flexneri 2a str. 301
cauuugagcaggaugccuga

SEQ ID NO: 3908780 - RNA, 12 nt, Shigella flexneri 2a str. 301
cauuugcacaag

SEQ ID NO: 3908781 - RNA, 16 nt, Shigella flexneri 2a str. 301
cauuugcacaagaugc

SEQ ID NO: 3908782 - RNA, 18 nt, Shigella flexneri 2a str. 301
cauuugcauacccagaac

SEQ ID NO: 3908783 - RNA, 21 nt, Shigella flexneri 2a str. 301
cauuuggauugauaauuguua

SEQ ID NO: 3908784 - RNA, 19 nt, Shigella flexneri 2a str. 301
cauuuggcggggauuuuuu

SEQ ID NO: 3908785 - RNA, 16 nt, Shigella flexneri 2a str. 301
cauuugugacauuaac

SEQ ID NO: 3908786 - RNA, 16 nt, Shigella flexneri 2a str. 301
cauuugugcauagcac

SEQ ID NO: 3908787 - RNA, 18 nt, Shigella flexneri 2a str. 301
cauuuguggguucagcgg

SEQ ID NO: 3908788 - RNA, 16 nt, Shigella flexneri 2a str. 301
cauuuuaaucaucuga

SEQ ID NO: 3908789 - RNA, 14 nt, Shigella flexneri 2a str. 301
cauuuuacguugca

SEQ ID NO: 3908790 - RNA, 14 nt, Shigella flexneri 2a str. 301
cauuuucauccauu

SEQ ID NO: 3908791 - RNA, 19 nt, Shigella flexneri 2a str. 301
cauuuucauccauuaccag

SEQ ID NO: 3908792 - RNA, 22 nt, Shigella flexneri 2a str. 301
cauuuuccaucacgaucagcgg

SEQ ID NO: 3908793 - RNA, 12 nt, Shigella flexneri 2a str. 301
cauuuucgcugg

SEQ ID NO: 3908794 - RNA, 16 nt, Shigella flexneri 2a str. 301
cauuuucgucaaccac

SEQ ID NO: 3908795 - RNA, 21 nt, Shigella flexneri 2a str. 301
cauuuucucgcggacugccug

SEQ ID NO: 3908796 - RNA, 15 nt, Shigella flexneri 2a str. 301
cauuuucuucagcag

SEQ ID NO: 3908797 - RNA, 14 nt, Shigella flexneri 2a str. 301
cauuuugacccggu

SEQ ID NO: 3908798 - RNA, 20 nt, Shigella flexneri 2a str. 301
cauuuugacuuuuacagcuu

SEQ ID NO: 3908799 - RNA, 18 nt, Shigella flexneri 2a str. 301
cauuuugccgguucccaa

SEQ ID NO: 3908800 - RNA, 14 nt, Shigella flexneri 2a str. 301
cauuuugcgcggca

SEQ ID NO: 3908801 - RNA, 16 nt, Shigella flexneri 2a str. 301
cauuuuguaggccuga

SEQ ID NO: 3908802 - RNA, 19 nt, Shigella flexneri 2a str. 301
cauuuuucagcguucccca

SEQ ID NO: 3908803 - RNA, 14 nt, Shigella flexneri 2a str. 301
cauuuuucaugauc

SEQ ID NO: 3908804 - RNA, 20 nt, Shigella flexneri 2a str. 301
cauuuuucggcgucagaacu

SEQ ID NO: 3908805 - RNA, 22 nt, Shigella flexneri 2a str. 301
cauuuuuggugcuuuaaucgcc

SEQ ID NO: 3908806 - RNA, 20 nt, Shigella flexneri 2a str. 301
cauuuuuucacauguucauu

SEQ ID NO: 3908807 - RNA, 20 nt, Shigella flexneri 2a str. 301
cauuuuuuccagguacuuuu

SEQ ID NO: 3908808 - RNA, 22 nt, Shigella flexneri 2a str. 301
cauuuuuuugcauuacugcuau

SEQ ID NO: 3908809 - RNA, 18 nt, Shigella flexneri 2a str. 301
cauuuuuuugucugcuau

SEQ ID NO: 3908810 - RNA, 23 nt, Shigella flexneri 2a str. 301
ccaaaaaagcgaaucuuuaucgg

SEQ ID NO: 3908811 - RNA, 11 nt, Shigella flexneri 2a str. 301
ccaaaaacauu

SEQ ID NO: 3908812 - RNA, 13 nt, Shigella flexneri 2a str. 301
ccaaaaacgccau

SEQ ID NO: 3908813 - RNA, 15 nt, Shigella flexneri 2a str. 301
ccaaaaagauuaaaa

SEQ ID NO: 3908814 - RNA, 17 nt, Shigella flexneri 2a str. 301
ccaaaaagauuaaaaaa

SEQ ID NO: 3908815 - RNA, 13 nt, Shigella flexneri 2a str. 301
ccaaaacaccagc

SEQ ID NO: 3908816 - RNA, 16 nt, Shigella flexneri 2a str. 301
ccaaaacagcgacacc

SEQ ID NO: 3908817 - RNA, 20 nt, Shigella flexneri 2a str. 301
ccaaaacagcgacaccagcc

SEQ ID NO: 3908818 - RNA, 14 nt, Shigella flexneri 2a str. 301
ccaaaacguaacca

SEQ ID NO: 3908819 - RNA, 11 nt, Shigella flexneri 2a str. 301
ccaaaacugga

SEQ ID NO: 3908820 - RNA, 16 nt, Shigella flexneri 2a str. 301
ccaaaagcuaacagag

SEQ ID NO: 3908821 - RNA, 15 nt, Shigella flexneri 2a str. 301
ccaaaagcugggaug

SEQ ID NO: 3908822 - RNA, 20 nt, Shigella flexneri 2a str. 301
ccaaaauaacuuaaugucau

SEQ ID NO: 3908823 - RNA, 18 nt, Shigella flexneri 2a str. 301
ccaaaauaauaaauuaac

SEQ ID NO: 3908824 - RNA, 21 nt, Shigella flexneri 2a str. 301
ccaaaauaauaaauuaacugc

SEQ ID NO: 3908825 - RNA, 17 nt, Shigella flexneri 2a str. 301
ccaaaaugacuuaauaa

SEQ ID NO: 3908826 - RNA, 11 nt, Shigella flexneri 2a str. 301
ccaaaaugccu

SEQ ID NO: 3908827 - RNA, 14 nt, Shigella flexneri 2a str. 301
ccaaaaugccugau

SEQ ID NO: 3908828 - RNA, 16 nt, Shigella flexneri 2a str. 301
ccaaaaugccugaugc

SEQ ID NO: 3908829 - RNA, 14 nt, Shigella flexneri 2a str. 301
ccaaacagaccaau

SEQ ID NO: 3908830 - RNA, 14 nt, Shigella flexneri 2a str. 301
ccaaacagcagaac

SEQ ID NO: 3908831 - RNA, 14 nt, Shigella flexneri 2a str. 301
ccaaacagcgccag

SEQ ID NO: 3908832 - RNA, 16 nt, Shigella flexneri 2a str. 301
ccaaacagcgccagau

SEQ ID NO: 3908833 - RNA, 18 nt, Shigella flexneri 2a str. 301
ccaaacaugcaaaccauc

SEQ ID NO: 3908834 - RNA, 15 nt, Shigella flexneri 2a str. 301
ccaaaccucagaguu

SEQ ID NO: 3908835 - RNA, 15 nt, Shigella flexneri 2a str. 301
ccaaacgccuagaug

SEQ ID NO: 3908836 - RNA, 17 nt, Shigella flexneri 2a str. 301
ccaaagaaaucaguaaa

SEQ ID NO: 3908837 - RNA, 15 nt, Shigella flexneri 2a str. 301
ccaaagcaccacucc

SEQ ID NO: 3908838 - RNA, 18 nt, Shigella flexneri 2a str. 301
ccaaagcaccacuccuca

SEQ ID NO: 3908839 - RNA, 19 nt, Shigella flexneri 2a str. 301
ccaaagcaccacuccucaa

SEQ ID NO: 3908840 - RNA, 17 nt, Shigella flexneri 2a str. 301
ccaaagcugauuucugg

SEQ ID NO: 3908841 - RNA, 13 nt, Shigella flexneri 2a str. 301
ccaaagguuuccu

SEQ ID NO: 3908842 - RNA, 14 nt, Shigella flexneri 2a str. 301
ccaaagguuuccuc

SEQ ID NO: 3908843 - RNA, 20 nt, Shigella flexneri 2a str. 301
ccaaauaaacgaaucugcaa

SEQ ID NO: 3908844 - RNA, 20 nt, Shigella flexneri 2a str. 301
ccaaauaucuuauagacuaa

SEQ ID NO: 3908845 - RNA, 12 nt, Shigella flexneri 2a str. 301
ccaaauauuucu

SEQ ID NO: 3908846 - RNA, 20 nt, Shigella flexneri 2a str. 301
ccaaaucauccagacugcuc

SEQ ID NO: 3908847 - RNA, 21 nt, Shigella flexneri 2a str. 301
ccaaaucauccagacugcuca

SEQ ID NO: 3908848 - RNA, 15 nt, Shigella flexneri 2a str. 301
ccaaauccagcgcca

SEQ ID NO: 3908849 - RNA, 18 nt, Shigella flexneri 2a str. 301
ccaaauccagcgccacau

SEQ ID NO: 3908850 - RNA, 17 nt, Shigella flexneri 2a str. 301
ccaaauccggcaaauaa

SEQ ID NO: 3908851 - RNA, 17 nt, Shigella flexneri 2a str. 301
ccaaaucgcccagcaaa

SEQ ID NO: 3908852 - RNA, 18 nt, Shigella flexneri 2a str. 301
ccaaaucgcccagcaaau

SEQ ID NO: 3908853 - RNA, 23 nt, Shigella flexneri 2a str. 301
ccaaaucgcccagcaaauacgua

SEQ ID NO: 3908854 - RNA, 17 nt, Shigella flexneri 2a str. 301
ccaaaucggaacaacag

SEQ ID NO: 3908855 - RNA, 18 nt, Shigella flexneri 2a str. 301
ccaaaucugauuaauauu

SEQ ID NO: 3908856 - RNA, 15 nt, Shigella flexneri 2a str. 301
ccaaaucuuuucugc

SEQ ID NO: 3908857 - RNA, 15 nt, Shigella flexneri 2a str. 301
ccaaaugaaacaggg

SEQ ID NO: 3908858 - RNA, 18 nt, Shigella flexneri 2a str. 301
ccaaauguugucucagau

SEQ ID NO: 3908859 - RNA, 20 nt, Shigella flexneri 2a str. 301
ccaaauuuaaacgacaauac

SEQ ID NO: 3908860 - RNA, 17 nt, Shigella flexneri 2a str. 301
ccaacaaaagcaacaaa

SEQ ID NO: 3908861 - RNA, 13 nt, Shigella flexneri 2a str. 301
ccaacaaacagua

SEQ ID NO: 3908862 - RNA, 20 nt, Shigella flexneri 2a str. 301
ccaacaaacaguacacagac

SEQ ID NO: 3908863 - RNA, 19 nt, Shigella flexneri 2a str. 301
ccaacaacacauucaauaa

SEQ ID NO: 3908864 - RNA, 22 nt, Shigella flexneri 2a str. 301
ccaacaacacauucaauaacac

SEQ ID NO: 3908865 - RNA, 14 nt, Shigella flexneri 2a str. 301
ccaacaacagcgcg

SEQ ID NO: 3908866 - RNA, 15 nt, Shigella flexneri 2a str. 301
ccaacaaucucuucc

SEQ ID NO: 3908867 - RNA, 16 nt, Shigella flexneri 2a str. 301
ccaacaaucucuucca

SEQ ID NO: 3908868 - RNA, 19 nt, Shigella flexneri 2a str. 301
ccaacacuuccccggacgc

SEQ ID NO: 3908869 - RNA, 13 nt, Shigella flexneri 2a str. 301
ccaacagcagcca

SEQ ID NO: 3908870 - RNA, 15 nt, Shigella flexneri 2a str. 301
ccaacagcagccaca

SEQ ID NO: 3908871 - RNA, 16 nt, Shigella flexneri 2a str. 301
ccaacagcagccacac

SEQ ID NO: 3908872 - RNA, 12 nt, Shigella flexneri 2a str. 301
ccaacaggcgag

SEQ ID NO: 3908873 - RNA, 13 nt, Shigella flexneri 2a str. 301
ccaacagguuuug

SEQ ID NO: 3908874 - RNA, 16 nt, Shigella flexneri 2a str. 301
ccaacaguaucugaau

SEQ ID NO: 3908875 - RNA, 13 nt, Shigella flexneri 2a str. 301
ccaacauauaagu

SEQ ID NO: 3908876 - RNA, 21 nt, Shigella flexneri 2a str. 301
ccaacauauaaguggcgcucu

SEQ ID NO: 3908877 - RNA, 15 nt, Shigella flexneri 2a str. 301
ccaacaucaugccag

SEQ ID NO: 3908878 - RNA, 20 nt, Shigella flexneri 2a str. 301
ccaacaucgaaaacgccacc

SEQ ID NO: 3908879 - RNA, 14 nt, Shigella flexneri 2a str. 301
ccaacaugacuaau

SEQ ID NO: 3908880 - RNA, 13 nt, Shigella flexneri 2a str. 301
ccaaccaaggaag

SEQ ID NO: 3908881 - RNA, 14 nt, Shigella flexneri 2a str. 301
ccaaccaccgccag

SEQ ID NO: 3908882 - RNA, 21 nt, Shigella flexneri 2a str. 301
ccaaccacggaguugaccagc

SEQ ID NO: 3908883 - RNA, 21 nt, Shigella flexneri 2a str. 301
ccaaccaugccgcccagaagc

SEQ ID NO: 3908884 - RNA, 20 nt, Shigella flexneri 2a str. 301
ccaacccuucugcacgccag

SEQ ID NO: 3908885 - RNA, 21 nt, Shigella flexneri 2a str. 301
ccaaccgauaucuuuccggca

SEQ ID NO: 3908886 - RNA, 13 nt, Shigella flexneri 2a str. 301
ccaacgauaauuc

SEQ ID NO: 3908887 - RNA, 15 nt, Shigella flexneri 2a str. 301
ccaacgauaauucag

SEQ ID NO: 3908888 - RNA, 17 nt, Shigella flexneri 2a str. 301
ccaacgauaauucagca

SEQ ID NO: 3908889 - RNA, 19 nt, Shigella flexneri 2a str. 301
ccaacgauaauucagcaau

SEQ ID NO: 3908890 - RNA, 12 nt, Shigella flexneri 2a str. 301
ccaacgcagcaa

SEQ ID NO: 3908891 - RNA, 15 nt, Shigella flexneri 2a str. 301
ccaacgcagcaacau

SEQ ID NO: 3908892 - RNA, 19 nt, Shigella flexneri 2a str. 301
ccaacgcccuuaccgccag

SEQ ID NO: 3908893 - RNA, 16 nt, Shigella flexneri 2a str. 301
ccaacgccuuucgcug

SEQ ID NO: 3908894 - RNA, 14 nt, Shigella flexneri 2a str. 301
ccaacgcgccaccg

SEQ ID NO: 3908895 - RNA, 19 nt, Shigella flexneri 2a str. 301
ccaacgcgccaccgaccag

SEQ ID NO: 3908896 - RNA, 12 nt, Shigella flexneri 2a str. 301
ccaacgcugcca

SEQ ID NO: 3908897 - RNA, 18 nt, Shigella flexneri 2a str. 301
ccaacggcauuucuuacu

SEQ ID NO: 3908898 - RNA, 15 nt, Shigella flexneri 2a str. 301
ccaacggccuugcgg

SEQ ID NO: 3908899 - RNA, 20 nt, Shigella flexneri 2a str. 301
ccaacggcgaaagcuggcac

SEQ ID NO: 3908900 - RNA, 13 nt, Shigella flexneri 2a str. 301
ccaacggcgagcc

SEQ ID NO: 3908901 - RNA, 17 nt, Shigella flexneri 2a str. 301
ccaacggugaaaaacca

SEQ ID NO: 3908902 - RNA, 18 nt, Shigella flexneri 2a str. 301
ccaacggugaaaaaccaa

SEQ ID NO: 3908903 - RNA, 15 nt, Shigella flexneri 2a str. 301
ccaacguuaucgccg

SEQ ID NO: 3908904 - RNA, 21 nt, Shigella flexneri 2a str. 301
ccaacguuucuggaaguaauc

SEQ ID NO: 3908905 - RNA, 21 nt, Shigella flexneri 2a str. 301
ccaacucaucgccgcuggcca

SEQ ID NO: 3908906 - RNA, 15 nt, Shigella flexneri 2a str. 301
ccaacugauccugac

SEQ ID NO: 3908907 - RNA, 13 nt, Shigella flexneri 2a str. 301
ccaacugccugau

SEQ ID NO: 3908908 - RNA, 15 nt, Shigella flexneri 2a str. 301
ccaacugccugaugc

SEQ ID NO: 3908909 - RNA, 14 nt, Shigella flexneri 2a str. 301
ccaacuguaccagc

SEQ ID NO: 3908910 - RNA, 18 nt, Shigella flexneri 2a str. 301
ccaacugugccgccgcca

SEQ ID NO: 3908911 - RNA, 18 nt, Shigella flexneri 2a str. 301
ccaacuguugauccagga

SEQ ID NO: 3908912 - RNA, 19 nt, Shigella flexneri 2a str. 301
ccaacuguugauccaggag

SEQ ID NO: 3908913 - RNA, 23 nt, Shigella flexneri 2a str. 301
ccaacuuaccgccggugcaugau

SEQ ID NO: 3908914 - RNA, 22 nt, Shigella flexneri 2a str. 301
ccaacuuacugauaguguuuua

SEQ ID NO: 3908915 - RNA, 15 nt, Shigella flexneri 2a str. 301
ccaacuucagcaaca

SEQ ID NO: 3908916 - RNA, 20 nt, Shigella flexneri 2a str. 301
ccaacuuuuggggugcaguu

SEQ ID NO: 3908917 - RNA, 14 nt, Shigella flexneri 2a str. 301
ccaagaaacaccag

SEQ ID NO: 3908918 - RNA, 15 nt, Shigella flexneri 2a str. 301
ccaagaaacaccaga

SEQ ID NO: 3908919 - RNA, 18 nt, Shigella flexneri 2a str. 301
ccaagaccaauccgccag

SEQ ID NO: 3908920 - RNA, 12 nt, Shigella flexneri 2a str. 301
ccaagccugaua

SEQ ID NO: 3908921 - RNA, 17 nt, Shigella flexneri 2a str. 301
ccaagcgcggcaggcau

SEQ ID NO: 3908922 - RNA, 15 nt, Shigella flexneri 2a str. 301
ccaagcuccagcauc

SEQ ID NO: 3908923 - RNA, 15 nt, Shigella flexneri 2a str. 301
ccaagggcggcgaga

SEQ ID NO: 3908924 - RNA, 18 nt, Shigella flexneri 2a str. 301
ccaaggucuccgcccagc

SEQ ID NO: 3908925 - RNA, 19 nt, Shigella flexneri 2a str. 301
ccaagucaacgucauuauc

SEQ ID NO: 3908926 - RNA, 14 nt, Shigella flexneri 2a str. 301
ccaagugauuuuua

SEQ ID NO: 3908927 - RNA, 15 nt, Shigella flexneri 2a str. 301
ccaagugauuuuuaa

SEQ ID NO: 3908928 - RNA, 13 nt, Shigella flexneri 2a str. 301
ccaauaaaaauac

SEQ ID NO: 3908929 - RNA, 16 nt, Shigella flexneri 2a str. 301
ccaauacaaaauuuaa

SEQ ID NO: 3908930 - RNA, 14 nt, Shigella flexneri 2a str. 301
ccaauaccaaaauc

SEQ ID NO: 3908931 - RNA, 17 nt, Shigella flexneri 2a str. 301
ccaauagguugaguaug

SEQ ID NO: 3908932 - RNA, 20 nt, Shigella flexneri 2a str. 301
ccaauagucaucgucgcggu

SEQ ID NO: 3908933 - RNA, 21 nt, Shigella flexneri 2a str. 301
ccaauauaauuccauucacca

SEQ ID NO: 3908934 - RNA, 14 nt, Shigella flexneri 2a str. 301
ccaauaucaaauaa

SEQ ID NO: 3908935 - RNA, 13 nt, Shigella flexneri 2a str. 301
ccaauauccugag

SEQ ID NO: 3908936 - RNA, 19 nt, Shigella flexneri 2a str. 301
ccaaucaccgccagcaagg

SEQ ID NO: 3908937 - RNA, 22 nt, Shigella flexneri 2a str. 301
ccaaucacgcccauugagcugg

SEQ ID NO: 3908938 - RNA, 15 nt, Shigella flexneri 2a str. 301
ccaaucaucgcggca

SEQ ID NO: 3908939 - RNA, 22 nt, Shigella flexneri 2a str. 301
ccaauccagaacaccauaauga

SEQ ID NO: 3908940 - RNA, 15 nt, Shigella flexneri 2a str. 301
ccaauccccagaccu

SEQ ID NO: 3908941 - RNA, 17 nt, Shigella flexneri 2a str. 301
ccaauccccagaccugc

SEQ ID NO: 3908942 - RNA, 19 nt, Shigella flexneri 2a str. 301
ccaauccccagaccugcug

SEQ ID NO: 3908943 - RNA, 20 nt, Shigella flexneri 2a str. 301
ccaaucccccacuuuuaaau

SEQ ID NO: 3908944 - RNA, 15 nt, Shigella flexneri 2a str. 301
ccaauccgccagcca

SEQ ID NO: 3908945 - RNA, 18 nt, Shigella flexneri 2a str. 301
ccaaucgcaauaccggca

SEQ ID NO: 3908946 - RNA, 15 nt, Shigella flexneri 2a str. 301
ccaaucucccagccg

SEQ ID NO: 3908947 - RNA, 15 nt, Shigella flexneri 2a str. 301
ccaaucugugccgcu

SEQ ID NO: 3908948 - RNA, 22 nt, Shigella flexneri 2a str. 301
ccaaucuuauaggucacaucau

SEQ ID NO: 3908949 - RNA, 11 nt, Shigella flexneri 2a str. 301
ccaaugaaauu

SEQ ID NO: 3908950 - RNA, 15 nt, Shigella flexneri 2a str. 301
ccaaugaccacuccg

SEQ ID NO: 3908951 - RNA, 15 nt, Shigella flexneri 2a str. 301
ccaaugaccgcgcca

SEQ ID NO: 3908952 - RNA, 16 nt, Shigella flexneri 2a str. 301
ccaaugacuauuugcg

SEQ ID NO: 3908953 - RNA, 19 nt, Shigella flexneri 2a str. 301
ccaaugcaggcaucgguga

SEQ ID NO: 3908954 - RNA, 22 nt, Shigella flexneri 2a str. 301
ccaaugccaccagggauaaagc

SEQ ID NO: 3908955 - RNA, 16 nt, Shigella flexneri 2a str. 301
ccaaugccguucucug

SEQ ID NO: 3908956 - RNA, 17 nt, Shigella flexneri 2a str. 301
ccaauguggguagccaa

SEQ ID NO: 3908957 - RNA, 22 nt, Shigella flexneri 2a str. 301
ccaauuaaugcaccaacaaaua

SEQ ID NO: 3908958 - RNA, 13 nt, Shigella flexneri 2a str. 301
ccaauugaacucu

SEQ ID NO: 3908959 - RNA, 18 nt, Shigella flexneri 2a str. 301
ccaauugcacauauuuuu

SEQ ID NO: 3908960 - RNA, 11 nt, Shigella flexneri 2a str. 301
ccaauugcugu

SEQ ID NO: 3908961 - RNA, 21 nt, Shigella flexneri 2a str. 301
ccacaaacccgccagaccagc

SEQ ID NO: 3908962 - RNA, 20 nt, Shigella flexneri 2a str. 301
ccacaaagcagacaacccac

SEQ ID NO: 3908963 - RNA, 15 nt, Shigella flexneri 2a str. 301
ccacaaagcagggcu

SEQ ID NO: 3908964 - RNA, 14 nt, Shigella flexneri 2a str. 301
ccacaacaguggcg

SEQ ID NO: 3908965 - RNA, 20 nt, Shigella flexneri 2a str. 301
ccacaaccgccguugccuuu

SEQ ID NO: 3908966 - RNA, 20 nt, Shigella flexneri 2a str. 301
ccacaaccggcgggaaaaau

SEQ ID NO: 3908967 - RNA, 14 nt, Shigella flexneri 2a str. 301
ccacaaucagccag

SEQ ID NO: 3908968 - RNA, 23 nt, Shigella flexneri 2a str. 301
ccacaccaacugugccgccgcca

SEQ ID NO: 3908969 - RNA, 23 nt, Shigella flexneri 2a str. 301
ccacaccaaucaacaauugcggg

SEQ ID NO: 3908970 - RNA, 15 nt, Shigella flexneri 2a str. 301
ccacaccacugcgca

SEQ ID NO: 3908971 - RNA, 14 nt, Shigella flexneri 2a str. 301
ccacaccagugacg

SEQ ID NO: 3908972 - RNA, 14 nt, Shigella flexneri 2a str. 301
ccacacccgcaaga

SEQ ID NO: 3908973 - RNA, 16 nt, Shigella flexneri 2a str. 301
ccacaccuggugcagc

SEQ ID NO: 3908974 - RNA, 15 nt, Shigella flexneri 2a str. 301
ccacacgaauuccaa

SEQ ID NO: 3908975 - RNA, 18 nt, Shigella flexneri 2a str. 301
ccacacgcguaaaacgau

SEQ ID NO: 3908976 - RNA, 22 nt, Shigella flexneri 2a str. 301
ccacacggagaguaaugccagu

SEQ ID NO: 3908977 - RNA, 18 nt, Shigella flexneri 2a str. 301
ccacacucucgcgcagcg

SEQ ID NO: 3908978 - RNA, 22 nt, Shigella flexneri 2a str. 301
ccacagacauaaagccugcuuc

SEQ ID NO: 3908979 - RNA, 13 nt, Shigella flexneri 2a str. 301
ccacagacccagg

SEQ ID NO: 3908980 - RNA, 17 nt, Shigella flexneri 2a str. 301
ccacagaccggacugac

SEQ ID NO: 3908981 - RNA, 15 nt, Shigella flexneri 2a str. 301
ccacagcaaugcauu

SEQ ID NO: 3908982 - RNA, 18 nt, Shigella flexneri 2a str. 301
ccacagcagccuucgcca

SEQ ID NO: 3908983 - RNA, 19 nt, Shigella flexneri 2a str. 301
ccacagcagccuucgccac

SEQ ID NO: 3908984 - RNA, 22 nt, Shigella flexneri 2a str. 301
ccacagcauucucggcccggcc

SEQ ID NO: 3908985 - RNA, 14 nt, Shigella flexneri 2a str. 301
ccacagccaacaca

SEQ ID NO: 3908986 - RNA, 13 nt, Shigella flexneri 2a str. 301
ccacagccagcca

SEQ ID NO: 3908987 - RNA, 17 nt, Shigella flexneri 2a str. 301
ccacagcucacggcccu

SEQ ID NO: 3908988 - RNA, 16 nt, Shigella flexneri 2a str. 301
ccacagggugaucacc

SEQ ID NO: 3908989 - RNA, 18 nt, Shigella flexneri 2a str. 301
ccacagggugaucaccag

SEQ ID NO: 3908990 - RNA, 15 nt, Shigella flexneri 2a str. 301
ccacaguaacgccug

SEQ ID NO: 3908991 - RNA, 23 nt, Shigella flexneri 2a str. 301
ccacagugacccgcagccagcac

SEQ ID NO: 3908992 - RNA, 21 nt, Shigella flexneri 2a str. 301
ccacaguuucauaucugccag

SEQ ID NO: 3908993 - RNA, 20 nt, Shigella flexneri 2a str. 301
ccacaguuuuacugcagcca

SEQ ID NO: 3908994 - RNA, 12 nt, Shigella flexneri 2a str. 301
ccacauccggca

SEQ ID NO: 3908995 - RNA, 19 nt, Shigella flexneri 2a str. 301
ccacauccggcaaaaacaa

SEQ ID NO: 3908996 - RNA, 17 nt, Shigella flexneri 2a str. 301
ccacaucgcaaaaugau

SEQ ID NO: 3908997 - RNA, 19 nt, Shigella flexneri 2a str. 301
ccacaucggcaucaggcca

SEQ ID NO: 3908998 - RNA, 21 nt, Shigella flexneri 2a str. 301
ccacaucgguuugcgcagcuu

SEQ ID NO: 3908999 - RNA, 16 nt, Shigella flexneri 2a str. 301
ccacaucuaccgccag

SEQ ID NO: 3909000 - RNA, 22 nt, Shigella flexneri 2a str. 301
ccacaucuaccgccagccaggu

SEQ ID NO: 3909001 - RNA, 21 nt, Shigella flexneri 2a str. 301
ccacaugaucauucaccagcc

SEQ ID NO: 3909002 - RNA, 23 nt, Shigella flexneri 2a str. 301
ccacaugaucauucaccagccca

SEQ ID NO: 3909003 - RNA, 20 nt, Shigella flexneri 2a str. 301
ccacaugccugcauaaagga

SEQ ID NO: 3909004 - RNA, 17 nt, Shigella flexneri 2a str. 301
ccacauuagauaaaaau

SEQ ID NO: 3909005 - RNA, 21 nt, Shigella flexneri 2a str. 301
ccacauugugggauuccagcg

SEQ ID NO: 3909006 - RNA, 14 nt, Shigella flexneri 2a str. 301
ccacauuuuccauc

SEQ ID NO: 3909007 - RNA, 16 nt, Shigella flexneri 2a str. 301
ccaccaaacugcgccc

SEQ ID NO: 3909008 - RNA, 18 nt, Shigella flexneri 2a str. 301
ccaccaauggcuggccug

SEQ ID NO: 3909009 - RNA, 12 nt, Shigella flexneri 2a str. 301
ccaccacaaaag

SEQ ID NO: 3909010 - RNA, 19 nt, Shigella flexneri 2a str. 301
ccaccacaacauucccauc

SEQ ID NO: 3909011 - RNA, 20 nt, Shigella flexneri 2a str. 301
ccaccacagacaaucgccag

SEQ ID NO: 3909012 - RNA, 18 nt, Shigella flexneri 2a str. 301
ccaccaccgcaaaauagg

SEQ ID NO: 3909013 - RNA, 17 nt, Shigella flexneri 2a str. 301
ccaccacguccagagug

SEQ ID NO: 3909014 - RNA, 14 nt, Shigella flexneri 2a str. 301
ccaccagacgugau

SEQ ID NO: 3909015 - RNA, 13 nt, Shigella flexneri 2a str. 301
ccaccagauggcu

SEQ ID NO: 3909016 - RNA, 12 nt, Shigella flexneri 2a str. 301
ccaccagcagcu

SEQ ID NO: 3909017 - RNA, 16 nt, Shigella flexneri 2a str. 301
ccaccagcgucagaaa

SEQ ID NO: 3909018 - RNA, 19 nt, Shigella flexneri 2a str. 301
ccaccaggaacgcgccaag

SEQ ID NO: 3909019 - RNA, 20 nt, Shigella flexneri 2a str. 301
ccaccaggaacgcgccaaga

SEQ ID NO: 3909020 - RNA, 15 nt, Shigella flexneri 2a str. 301
ccaccaggccacggc

SEQ ID NO: 3909021 - RNA, 20 nt, Shigella flexneri 2a str. 301
ccaccagggauaaagccccc

SEQ ID NO: 3909022 - RNA, 19 nt, Shigella flexneri 2a str. 301
ccaccaguaccucuucgcu

SEQ ID NO: 3909023 - RNA, 12 nt, Shigella flexneri 2a str. 301
ccaccagugcca

SEQ ID NO: 3909024 - RNA, 13 nt, Shigella flexneri 2a str. 301
ccaccauaagccc

SEQ ID NO: 3909025 - RNA, 22 nt, Shigella flexneri 2a str. 301
ccaccauucaccaagcaaaacg

SEQ ID NO: 3909026 - RNA, 21 nt, Shigella flexneri 2a str. 301
ccaccauuuuacguccgcgca

SEQ ID NO: 3909027 - RNA, 14 nt, Shigella flexneri 2a str. 301
ccacccaccagcgc

SEQ ID NO: 3909028 - RNA, 16 nt, Shigella flexneri 2a str. 301
ccacccaccagcgccg

SEQ ID NO: 3909029 - RNA, 15 nt, Shigella flexneri 2a str. 301
ccacccaccgcagcc

SEQ ID NO: 3909030 - RNA, 18 nt, Shigella flexneri 2a str. 301
ccacccaccgcagcccag

SEQ ID NO: 3909031 - RNA, 13 nt, Shigella flexneri 2a str. 301
ccacccagcagcg

SEQ ID NO: 3909032 - RNA, 22 nt, Shigella flexneri 2a str. 301
ccacccagucccguacccagca

SEQ ID NO: 3909033 - RNA, 18 nt, Shigella flexneri 2a str. 301
ccacccgaucgcucauau

SEQ ID NO: 3909034 - RNA, 13 nt, Shigella flexneri 2a str. 301
ccacccgcagcca

SEQ ID NO: 3909035 - RNA, 14 nt, Shigella flexneri 2a str. 301
ccacccgcagccau

SEQ ID NO: 3909036 - RNA, 14 nt, Shigella flexneri 2a str. 301
ccacccgucgggca

SEQ ID NO: 3909037 - RNA, 13 nt, Shigella flexneri 2a str. 301
ccacccuggcaac

SEQ ID NO: 3909038 - RNA, 22 nt, Shigella flexneri 2a str. 301
ccacccuggcaacccgggcucc

SEQ ID NO: 3909039 - RNA, 16 nt, Shigella flexneri 2a str. 301
ccaccgaugcacagca

SEQ ID NO: 3909040 - RNA, 20 nt, Shigella flexneri 2a str. 301
ccaccgaugcacagcacgcu

SEQ ID NO: 3909041 - RNA, 23 nt, Shigella flexneri 2a str. 301
ccaccgauuuucagccaucaucc

SEQ ID NO: 3909042 - RNA, 14 nt, Shigella flexneri 2a str. 301
ccaccgcaaaaggc

SEQ ID NO: 3909043 - RNA, 15 nt, Shigella flexneri 2a str. 301
ccaccgcaaaguggg

SEQ ID NO: 3909044 - RNA, 14 nt, Shigella flexneri 2a str. 301
ccaccgcaaucgcc

SEQ ID NO: 3909045 - RNA, 17 nt, Shigella flexneri 2a str. 301
ccaccgcaaucgccagu

SEQ ID NO: 3909046 - RNA, 14 nt, Shigella flexneri 2a str. 301
ccaccgcagcccag

SEQ ID NO: 3909047 - RNA, 16 nt, Shigella flexneri 2a str. 301
ccaccgcccagagaau

SEQ ID NO: 3909048 - RNA, 19 nt, Shigella flexneri 2a str. 301
ccaccggacggacuuccag

SEQ ID NO: 3909049 - RNA, 16 nt, Shigella flexneri 2a str. 301
ccaccgguacaaacau

SEQ ID NO: 3909050 - RNA, 21 nt, Shigella flexneri 2a str. 301
ccaccgucgggcugacguuaa

SEQ ID NO: 3909051 - RNA, 14 nt, Shigella flexneri 2a str. 301
ccaccguuauccug

SEQ ID NO: 3909052 - RNA, 14 nt, Shigella flexneri 2a str. 301
ccaccguuucuuuu

SEQ ID NO: 3909053 - RNA, 19 nt, Shigella flexneri 2a str. 301
ccaccucauuaagaugcau

SEQ ID NO: 3909054 - RNA, 14 nt, Shigella flexneri 2a str. 301
ccaccuccacgccc

SEQ ID NO: 3909055 - RNA, 12 nt, Shigella flexneri 2a str. 301
ccaccuccagcu

SEQ ID NO: 3909056 - RNA, 16 nt, Shigella flexneri 2a str. 301
ccaccugauugcugcu

SEQ ID NO: 3909057 - RNA, 22 nt, Shigella flexneri 2a str. 301
ccaccugccggagcgccaccac

SEQ ID NO: 3909058 - RNA, 20 nt, Shigella flexneri 2a str. 301
ccaccugcgaacuguaauga

SEQ ID NO: 3909059 - RNA, 22 nt, Shigella flexneri 2a str. 301
ccaccugcucgucauccgccag

SEQ ID NO: 3909060 - RNA, 16 nt, Shigella flexneri 2a str. 301
ccaccuggaaccaggc

SEQ ID NO: 3909061 - RNA, 15 nt, Shigella flexneri 2a str. 301
ccaccuuaaaacaau

SEQ ID NO: 3909062 - RNA, 14 nt, Shigella flexneri 2a str. 301
ccaccuuauaaccc

SEQ ID NO: 3909063 - RNA, 14 nt, Shigella flexneri 2a str. 301
ccaccuucaacguu

SEQ ID NO: 3909064 - RNA, 21 nt, Shigella flexneri 2a str. 301
ccaccuugcggaaacugucaa

SEQ ID NO: 3909065 - RNA, 20 nt, Shigella flexneri 2a str. 301
ccacgaaaccgacugccaug

SEQ ID NO: 3909066 - RNA, 23 nt, Shigella flexneri 2a str. 301
ccacgaccucaaaggccgacagc

SEQ ID NO: 3909067 - RNA, 13 nt, Shigella flexneri 2a str. 301
ccacgacuucugu

SEQ ID NO: 3909068 - RNA, 15 nt, Shigella flexneri 2a str. 301
ccacgauacgcugca

SEQ ID NO: 3909069 - RNA, 21 nt, Shigella flexneri 2a str. 301
ccacgauagagagcagucagg

SEQ ID NO: 3909070 - RNA, 19 nt, Shigella flexneri 2a str. 301
ccacgauauguucaggaua

SEQ ID NO: 3909071 - RNA, 17 nt, Shigella flexneri 2a str. 301
ccacgcaaaggcguuau

SEQ ID NO: 3909072 - RNA, 15 nt, Shigella flexneri 2a str. 301
ccacgcaacagacca

SEQ ID NO: 3909073 - RNA, 18 nt, Shigella flexneri 2a str. 301
ccacgcacagaacaaaau

SEQ ID NO: 3909074 - RNA, 18 nt, Shigella flexneri 2a str. 301
ccacgcagcagccaagca

SEQ ID NO: 3909075 - RNA, 13 nt, Shigella flexneri 2a str. 301
ccacgcaggcauu

SEQ ID NO: 3909076 - RNA, 16 nt, Shigella flexneri 2a str. 301
ccacgccacaauacug

SEQ ID NO: 3909077 - RNA, 15 nt, Shigella flexneri 2a str. 301
ccacgccacgcugcc

SEQ ID NO: 3909078 - RNA, 22 nt, Shigella flexneri 2a str. 301
ccacgccgaaccaugucaucaa

SEQ ID NO: 3909079 - RNA, 15 nt, Shigella flexneri 2a str. 301
ccacgccggaugaaa

SEQ ID NO: 3909080 - RNA, 20 nt, Shigella flexneri 2a str. 301
ccacgccguuuuuacccagc

SEQ ID NO: 3909081 - RNA, 18 nt, Shigella flexneri 2a str. 301
ccacgccugcauccgcca

SEQ ID NO: 3909082 - RNA, 18 nt, Shigella flexneri 2a str. 301
ccacgccugccgccagca

SEQ ID NO: 3909083 - RNA, 21 nt, Shigella flexneri 2a str. 301
ccacgccuuaugccacgugag

SEQ ID NO: 3909084 - RNA, 17 nt, Shigella flexneri 2a str. 301
ccacgcgauacuuuuuc

SEQ ID NO: 3909085 - RNA, 17 nt, Shigella flexneri 2a str. 301
ccacgcgggaagucacu

SEQ ID NO: 3909086 - RNA, 15 nt, Shigella flexneri 2a str. 301
ccacgcuccaucaug

SEQ ID NO: 3909087 - RNA, 16 nt, Shigella flexneri 2a str. 301
ccacgcugagagaagc

SEQ ID NO: 3909088 - RNA, 19 nt, Shigella flexneri 2a str. 301
ccacgcugcaucgccaauc

SEQ ID NO: 3909089 - RNA, 16 nt, Shigella flexneri 2a str. 301
ccacgcuuaacaaccc

SEQ ID NO: 3909090 - RNA, 15 nt, Shigella flexneri 2a str. 301
ccacgcuuuuuugcu

SEQ ID NO: 3909091 - RNA, 15 nt, Shigella flexneri 2a str. 301
ccacggcaugaaagc

SEQ ID NO: 3909092 - RNA, 16 nt, Shigella flexneri 2a str. 301
ccacggcaugaaagcg

SEQ ID NO: 3909093 - RNA, 15 nt, Shigella flexneri 2a str. 301
ccacggccacagcca

SEQ ID NO: 3909094 - RNA, 13 nt, Shigella flexneri 2a str. 301
ccacggcuccagc

SEQ ID NO: 3909095 - RNA, 14 nt, Shigella flexneri 2a str. 301
ccacggcuccagca

SEQ ID NO: 3909096 - RNA, 15 nt, Shigella flexneri 2a str. 301
ccacgguauuugcca

SEQ ID NO: 3909097 - RNA, 21 nt, Shigella flexneri 2a str. 301
ccacgguucuccacucugcca

SEQ ID NO: 3909098 - RNA, 18 nt, Shigella flexneri 2a str. 301
ccacgucaucagcaauuu

SEQ ID NO: 3909099 - RNA, 13 nt, Shigella flexneri 2a str. 301
ccacguucauuuc

SEQ ID NO: 3909100 - RNA, 14 nt, Shigella flexneri 2a str. 301
ccacguucugaucu

SEQ ID NO: 3909101 - RNA, 23 nt, Shigella flexneri 2a str. 301
ccacguucugaucuuucuucagc

SEQ ID NO: 3909102 - RNA, 17 nt, Shigella flexneri 2a str. 301
ccacguugacaaacugc

SEQ ID NO: 3909103 - RNA, 13 nt, Shigella flexneri 2a str. 301
ccacuacccauau

SEQ ID NO: 3909104 - RNA, 23 nt, Shigella flexneri 2a str. 301
ccacucggcacaucgacggugac

SEQ ID NO: 3909105 - RNA, 14 nt, Shigella flexneri 2a str. 301
ccacucugaccuga

SEQ ID NO: 3909106 - RNA, 11 nt, Shigella flexneri 2a str. 301
ccacucugccu

SEQ ID NO: 3909107 - RNA, 23 nt, Shigella flexneri 2a str. 301
ccacugaauaacauuaugucugu

SEQ ID NO: 3909108 - RNA, 22 nt, Shigella flexneri 2a str. 301
ccacugaauagugccacaccag

SEQ ID NO: 3909109 - RNA, 23 nt, Shigella flexneri 2a str. 301
ccacugacgggaaacucugcugg

SEQ ID NO: 3909110 - RNA, 15 nt, Shigella flexneri 2a str. 301
ccacugcaaaucacc

SEQ ID NO: 3909111 - RNA, 17 nt, Shigella flexneri 2a str. 301
ccacugcaacagcuguu

SEQ ID NO: 3909112 - RNA, 12 nt, Shigella flexneri 2a str. 301
ccacugcaauga

SEQ ID NO: 3909113 - RNA, 17 nt, Shigella flexneri 2a str. 301
ccacugccaaucaccug

SEQ ID NO: 3909114 - RNA, 15 nt, Shigella flexneri 2a str. 301
ccacugcgccaucaa

SEQ ID NO: 3909115 - RNA, 14 nt, Shigella flexneri 2a str. 301
ccacugcgccgcuc

SEQ ID NO: 3909116 - RNA, 20 nt, Shigella flexneri 2a str. 301
ccacuggcgcgaauagcuuc

SEQ ID NO: 3909117 - RNA, 16 nt, Shigella flexneri 2a str. 301
ccacuggucgcccugg

SEQ ID NO: 3909118 - RNA, 21 nt, Shigella flexneri 2a str. 301
ccacugguuccgguuuaucca

SEQ ID NO: 3909119 - RNA, 16 nt, Shigella flexneri 2a str. 301
ccacugugcgcgccag

SEQ ID NO: 3909120 - RNA, 18 nt, Shigella flexneri 2a str. 301
ccacuucacgaugcagcg

SEQ ID NO: 3909121 - RNA, 21 nt, Shigella flexneri 2a str. 301
ccacuucacggcugcuaauau

SEQ ID NO: 3909122 - RNA, 15 nt, Shigella flexneri 2a str. 301
ccacuucaucaagca

SEQ ID NO: 3909123 - RNA, 14 nt, Shigella flexneri 2a str. 301
ccacuucauccgga

SEQ ID NO: 3909124 - RNA, 21 nt, Shigella flexneri 2a str. 301
ccacuuccaccacuuccugcu

SEQ ID NO: 3909125 - RNA, 16 nt, Shigella flexneri 2a str. 301
ccacuuccaccagcgg

SEQ ID NO: 3909126 - RNA, 14 nt, Shigella flexneri 2a str. 301
ccacuuccccucau

SEQ ID NO: 3909127 - RNA, 22 nt, Shigella flexneri 2a str. 301
ccacuuccugccaguuuuuccg

SEQ ID NO: 3909128 - RNA, 16 nt, Shigella flexneri 2a str. 301
ccacuuccugcucggu

SEQ ID NO: 3909129 - RNA, 20 nt, Shigella flexneri 2a str. 301
ccacuucuuccagcggcagg

SEQ ID NO: 3909130 - RNA, 22 nt, Shigella flexneri 2a str. 301
ccacuuuacgggcaaucuccug

SEQ ID NO: 3909131 - RNA, 17 nt, Shigella flexneri 2a str. 301
ccacuuucacgcccaua

SEQ ID NO: 3909132 - RNA, 13 nt, Shigella flexneri 2a str. 301
ccacuuuccucau

SEQ ID NO: 3909133 - RNA, 12 nt, Shigella flexneri 2a str. 301
ccacuuugcgcu

SEQ ID NO: 3909134 - RNA, 13 nt, Shigella flexneri 2a str. 301
ccacuuugcgcuc

SEQ ID NO: 3909135 - RNA, 22 nt, Shigella flexneri 2a str. 301
ccacuuuuuucaccgagucguc

SEQ ID NO: 3909136 - RNA, 13 nt, Shigella flexneri 2a str. 301
ccagaaaaccugg

SEQ ID NO: 3909137 - RNA, 18 nt, Shigella flexneri 2a str. 301
ccagaaaaccuggcgcag

SEQ ID NO: 3909138 - RNA, 12 nt, Shigella flexneri 2a str. 301
ccagaaacaaua

SEQ ID NO: 3909139 - RNA, 18 nt, Shigella flexneri 2a str. 301
ccagaaacgccaccauuu

SEQ ID NO: 3909140 - RNA, 22 nt, Shigella flexneri 2a str. 301
ccagaaacgcguugucuuucca

SEQ ID NO: 3909141 - RNA, 23 nt, Shigella flexneri 2a str. 301
ccagaaagcguauccaucacuaa

SEQ ID NO: 3909142 - RNA, 16 nt, Shigella flexneri 2a str. 301
ccagaaaucagcagcu

SEQ ID NO: 3909143 - RNA, 17 nt, Shigella flexneri 2a str. 301
ccagaaaucggccuucc

SEQ ID NO: 3909144 - RNA, 19 nt, Shigella flexneri 2a str. 301
ccagaaauggcccaaaagg

SEQ ID NO: 3909145 - RNA, 12 nt, Shigella flexneri 2a str. 301
ccagaacaaccc

SEQ ID NO: 3909146 - RNA, 17 nt, Shigella flexneri 2a str. 301
ccagaacaccauaauga

SEQ ID NO: 3909147 - RNA, 23 nt, Shigella flexneri 2a str. 301
ccagaacacuguuaccgcugcug

SEQ ID NO: 3909148 - RNA, 22 nt, Shigella flexneri 2a str. 301
ccagaacuacccgguucgucau

SEQ ID NO: 3909149 - RNA, 23 nt, Shigella flexneri 2a str. 301
ccagaacugauaacgcauuucau

SEQ ID NO: 3909150 - RNA, 19 nt, Shigella flexneri 2a str. 301
ccagaagaaagccggauga

SEQ ID NO: 3909151 - RNA, 17 nt, Shigella flexneri 2a str. 301
ccagaagaugcguucac

SEQ ID NO: 3909152 - RNA, 15 nt, Shigella flexneri 2a str. 301
ccagaauaaacaacu

SEQ ID NO: 3909153 - RNA, 18 nt, Shigella flexneri 2a str. 301
ccagaauaaacaacugug

SEQ ID NO: 3909154 - RNA, 19 nt, Shigella flexneri 2a str. 301
ccagaauaccuugcugcuc

SEQ ID NO: 3909155 - RNA, 18 nt, Shigella flexneri 2a str. 301
ccagaauagccgcagcca

SEQ ID NO: 3909156 - RNA, 19 nt, Shigella flexneri 2a str. 301
ccagaauaugcgccagcgu

SEQ ID NO: 3909157 - RNA, 13 nt, Shigella flexneri 2a str. 301
ccagaaugcccca

SEQ ID NO: 3909158 - RNA, 16 nt, Shigella flexneri 2a str. 301
ccagacaaaugaacac

SEQ ID NO: 3909159 - RNA, 19 nt, Shigella flexneri 2a str. 301
ccagacaauggcccgccgc

SEQ ID NO: 3909160 - RNA, 21 nt, Shigella flexneri 2a str. 301
ccagacaauugccgccagcuc

SEQ ID NO: 3909161 - RNA, 14 nt, Shigella flexneri 2a str. 301
ccagacaccccuuc

SEQ ID NO: 3909162 - RNA, 23 nt, Shigella flexneri 2a str. 301
ccagacaucaccaguaccgccac

SEQ ID NO: 3909163 - RNA, 16 nt, Shigella flexneri 2a str. 301
ccagacaucccagugc

SEQ ID NO: 3909164 - RNA, 14 nt, Shigella flexneri 2a str. 301
ccagaccgcacacc

SEQ ID NO: 3909165 - RNA, 17 nt, Shigella flexneri 2a str. 301
ccagaccgcagaagccg

SEQ ID NO: 3909166 - RNA, 19 nt, Shigella flexneri 2a str. 301
ccagaccguggucagaaaa

SEQ ID NO: 3909167 - RNA, 22 nt, Shigella flexneri 2a str. 301
ccagaccuaacuuggcaaagcu

SEQ ID NO: 3909168 - RNA, 18 nt, Shigella flexneri 2a str. 301
ccagaccugaaaccgccu

SEQ ID NO: 3909169 - RNA, 20 nt, Shigella flexneri 2a str. 301
ccagaccugaauuugcucca

SEQ ID NO: 3909170 - RNA, 17 nt, Shigella flexneri 2a str. 301
ccagacgaauaaaacag

SEQ ID NO: 3909171 - RNA, 15 nt, Shigella flexneri 2a str. 301
ccagacgacggcugc

SEQ ID NO: 3909172 - RNA, 19 nt, Shigella flexneri 2a str. 301
ccagacgcgcguccccugc

SEQ ID NO: 3909173 - RNA, 23 nt, Shigella flexneri 2a str. 301
ccagacgcucuucaauggucagc

SEQ ID NO: 3909174 - RNA, 20 nt, Shigella flexneri 2a str. 301
ccagacgugauaaacaucca

SEQ ID NO: 3909175 - RNA, 15 nt, Shigella flexneri 2a str. 301
ccagacucaacaggc

SEQ ID NO: 3909176 - RNA, 18 nt, Shigella flexneri 2a str. 301
ccagacuccaggcguuuu

SEQ ID NO: 3909177 - RNA, 21 nt, Shigella flexneri 2a str. 301
ccagacuccgagaaucauaaa

SEQ ID NO: 3909178 - RNA, 20 nt, Shigella flexneri 2a str. 301
ccagacugaucaucgcccag

SEQ ID NO: 3909179 - RNA, 23 nt, Shigella flexneri 2a str. 301
ccagacugaugugauccaucagg

SEQ ID NO: 3909180 - RNA, 15 nt, Shigella flexneri 2a str. 301
ccagacugcuccugu

SEQ ID NO: 3909181 - RNA, 20 nt, Shigella flexneri 2a str. 301
ccagacuggagcacugcgcc

SEQ ID NO: 3909182 - RNA, 14 nt, Shigella flexneri 2a str. 301
ccagagcagcaaca

SEQ ID NO: 3909183 - RNA, 21 nt, Shigella flexneri 2a str. 301
ccagagcagcgaauuucucau

SEQ ID NO: 3909184 - RNA, 16 nt, Shigella flexneri 2a str. 301
ccagagcaucuacugg

SEQ ID NO: 3909185 - RNA, 16 nt, Shigella flexneri 2a str. 301
ccagaggagccaucac

SEQ ID NO: 3909186 - RNA, 19 nt, Shigella flexneri 2a str. 301
ccagaggagccaucaccau

SEQ ID NO: 3909187 - RNA, 20 nt, Shigella flexneri 2a str. 301
ccagaggaugcacucgcauc

SEQ ID NO: 3909188 - RNA, 14 nt, Shigella flexneri 2a str. 301
ccagagugaccgcc

SEQ ID NO: 3909189 - RNA, 20 nt, Shigella flexneri 2a str. 301
ccagagugaugcguccgcua

SEQ ID NO: 3909190 - RNA, 21 nt, Shigella flexneri 2a str. 301
ccagaguggauuaucuucacc

SEQ ID NO: 3909191 - RNA, 14 nt, Shigella flexneri 2a str. 301
ccagauaagacacu

SEQ ID NO: 3909192 - RNA, 15 nt, Shigella flexneri 2a str. 301
ccagauaagacacua

SEQ ID NO: 3909193 - RNA, 15 nt, Shigella flexneri 2a str. 301
ccagauaagacacug

SEQ ID NO: 3909194 - RNA, 12 nt, Shigella flexneri 2a str. 301
ccagauaagacg

SEQ ID NO: 3909195 - RNA, 22 nt, Shigella flexneri 2a str. 301
ccagauaauagcguuucagcgg

SEQ ID NO: 3909196 - RNA, 16 nt, Shigella flexneri 2a str. 301
ccagauaauggcuguu

SEQ ID NO: 3909197 - RNA, 23 nt, Shigella flexneri 2a str. 301
ccagauaauggcuguugaaugcc

SEQ ID NO: 3909198 - RNA, 18 nt, Shigella flexneri 2a str. 301
ccagauacaaaaaaggcc

SEQ ID NO: 3909199 - RNA, 18 nt, Shigella flexneri 2a str. 301
ccagauacaucagcgaca

SEQ ID NO: 3909200 - RNA, 19 nt, Shigella flexneri 2a str. 301
ccagauagcaacagcagcc

SEQ ID NO: 3909201 - RNA, 23 nt, Shigella flexneri 2a str. 301
ccagauagccaauuacgcaggca

SEQ ID NO: 3909202 - RNA, 13 nt, Shigella flexneri 2a str. 301
ccagauagccagg

SEQ ID NO: 3909203 - RNA, 16 nt, Shigella flexneri 2a str. 301
ccagauaugaucgaaa

SEQ ID NO: 3909204 - RNA, 21 nt, Shigella flexneri 2a str. 301
ccagauauuuuucaauccgca

SEQ ID NO: 3909205 - RNA, 14 nt, Shigella flexneri 2a str. 301
ccagaucacgcagc

SEQ ID NO: 3909206 - RNA, 18 nt, Shigella flexneri 2a str. 301
ccagaucacgcagcaagc

SEQ ID NO: 3909207 - RNA, 17 nt, Shigella flexneri 2a str. 301
ccagaucgaucauauuu

SEQ ID NO: 3909208 - RNA, 18 nt, Shigella flexneri 2a str. 301
ccagaucggucagugcca

SEQ ID NO: 3909209 - RNA, 14 nt, Shigella flexneri 2a str. 301
ccagaucuucauca

SEQ ID NO: 3909210 - RNA, 17 nt, Shigella flexneri 2a str. 301
ccagauggcuuuccacc

SEQ ID NO: 3909211 - RNA, 21 nt, Shigella flexneri 2a str. 301
ccagauggcuuuccaccauca

SEQ ID NO: 3909212 - RNA, 16 nt, Shigella flexneri 2a str. 301
ccagaugucuuuaccc

SEQ ID NO: 3909213 - RNA, 15 nt, Shigella flexneri 2a str. 301
ccagauuaauuauug

SEQ ID NO: 3909214 - RNA, 17 nt, Shigella flexneri 2a str. 301
ccagauuaccagcgaca

SEQ ID NO: 3909215 - RNA, 17 nt, Shigella flexneri 2a str. 301
ccagauucuccaacauc

SEQ ID NO: 3909216 - RNA, 21 nt, Shigella flexneri 2a str. 301
ccagauugaucucuaaggcau

SEQ ID NO: 3909217 - RNA, 18 nt, Shigella flexneri 2a str. 301
ccagauugccgauauaaa

SEQ ID NO: 3909218 - RNA, 23 nt, Shigella flexneri 2a str. 301
ccagauuggguuuuugaugcugu

SEQ ID NO: 3909219 - RNA, 23 nt, Shigella flexneri 2a str. 301
ccagauugugaaucgccuggaca

SEQ ID NO: 3909220 - RNA, 22 nt, Shigella flexneri 2a str. 301
ccagauugugugauacuucuuc

SEQ ID NO: 3909221 - RNA, 23 nt, Shigella flexneri 2a str. 301
ccagauugugugauacuucuucg

SEQ ID NO: 3909222 - RNA, 17 nt, Shigella flexneri 2a str. 301
ccagauuuaacggcagc

SEQ ID NO: 3909223 - RNA, 23 nt, Shigella flexneri 2a str. 301
ccagauuuaccgccauggccuga

SEQ ID NO: 3909224 - RNA, 20 nt, Shigella flexneri 2a str. 301
ccagauuuauuuacuucugc

SEQ ID NO: 3909225 - RNA, 22 nt, Shigella flexneri 2a str. 301
ccagauuuuuauccaguuguuc

SEQ ID NO: 3909226 - RNA, 14 nt, Shigella flexneri 2a str. 301
ccagcaaaaucacc

SEQ ID NO: 3909227 - RNA, 15 nt, Shigella flexneri 2a str. 301
ccagcaaaaucacca

SEQ ID NO: 3909228 - RNA, 17 nt, Shigella flexneri 2a str. 301
ccagcaaaaucaccauc

SEQ ID NO: 3909229 - RNA, 16 nt, Shigella flexneri 2a str. 301
ccagcaacaaauaacc

SEQ ID NO: 3909230 - RNA, 13 nt, Shigella flexneri 2a str. 301
ccagcaacaacag

SEQ ID NO: 3909231 - RNA, 23 nt, Shigella flexneri 2a str. 301
ccagcaacaagccaguccagaaa

SEQ ID NO: 3909232 - RNA, 20 nt, Shigella flexneri 2a str. 301
ccagcaacauuggcucauca

SEQ ID NO: 3909233 - RNA, 17 nt, Shigella flexneri 2a str. 301
ccagcaaccaacgccag

SEQ ID NO: 3909234 - RNA, 23 nt, Shigella flexneri 2a str. 301
ccagcaaccaacgccagcagcag

SEQ ID NO: 3909235 - RNA, 15 nt, Shigella flexneri 2a str. 301
ccagcaagaaccaug

SEQ ID NO: 3909236 - RNA, 20 nt, Shigella flexneri 2a str. 301
ccagcaagagcaaauaaaac

SEQ ID NO: 3909237 - RNA, 13 nt, Shigella flexneri 2a str. 301
ccagcaagccacu

SEQ ID NO: 3909238 - RNA, 13 nt, Shigella flexneri 2a str. 301
ccagcaagcgcac

SEQ ID NO: 3909239 - RNA, 19 nt, Shigella flexneri 2a str. 301
ccagcaaggcgcuaaaagc

SEQ ID NO: 3909240 - RNA, 23 nt, Shigella flexneri 2a str. 301
ccagcaaggcgcuaaaagcauag

SEQ ID NO: 3909241 - RNA, 21 nt, Shigella flexneri 2a str. 301
ccagcaaggguucaccgguga

SEQ ID NO: 3909242 - RNA, 15 nt, Shigella flexneri 2a str. 301
ccagcaagucuucac

SEQ ID NO: 3909243 - RNA, 15 nt, Shigella flexneri 2a str. 301
ccagcaauccccaga

SEQ ID NO: 3909244 - RNA, 20 nt, Shigella flexneri 2a str. 301
ccagcaauccccagacaaaa

SEQ ID NO: 3909245 - RNA, 15 nt, Shigella flexneri 2a str. 301
ccagcacaaaguggc

SEQ ID NO: 3909246 - RNA, 22 nt, Shigella flexneri 2a str. 301
ccagcacacugguucccaacaa

SEQ ID NO: 3909247 - RNA, 20 nt, Shigella flexneri 2a str. 301
ccagcacauaacucauacug

SEQ ID NO: 3909248 - RNA, 12 nt, Shigella flexneri 2a str. 301
ccagcaccagca

SEQ ID NO: 3909249 - RNA, 15 nt, Shigella flexneri 2a str. 301
ccagcaccagcaacg

SEQ ID NO: 3909250 - RNA, 18 nt, Shigella flexneri 2a str. 301
ccagcaccagcuccggca

SEQ ID NO: 3909251 - RNA, 16 nt, Shigella flexneri 2a str. 301
ccagcaccaggcuugc

SEQ ID NO: 3909252 - RNA, 11 nt, Shigella flexneri 2a str. 301
ccagcaccgca

SEQ ID NO: 3909253 - RNA, 23 nt, Shigella flexneri 2a str. 301
ccagcaccgcagagaucgccccg

SEQ ID NO: 3909254 - RNA, 19 nt, Shigella flexneri 2a str. 301
ccagcaccgucaaacacag

SEQ ID NO: 3909255 - RNA, 20 nt, Shigella flexneri 2a str. 301
ccagcacggauaccgcacgc

SEQ ID NO: 3909256 - RNA, 15 nt, Shigella flexneri 2a str. 301
ccagcacggugaaga

SEQ ID NO: 3909257 - RNA, 15 nt, Shigella flexneri 2a str. 301
ccagcacuaccgccc

SEQ ID NO: 3909258 - RNA, 23 nt, Shigella flexneri 2a str. 301
ccagcacuuuucgcacugcaggc

SEQ ID NO: 3909259 - RNA, 13 nt, Shigella flexneri 2a str. 301
ccagcagagauac

SEQ ID NO: 3909260 - RNA, 18 nt, Shigella flexneri 2a str. 301
ccagcagagaucuuucac

SEQ ID NO: 3909261 - RNA, 12 nt, Shigella flexneri 2a str. 301
ccagcagauggc

SEQ ID NO: 3909262 - RNA, 16 nt, Shigella flexneri 2a str. 301
ccagcagauggcagug

SEQ ID NO: 3909263 - RNA, 11 nt, Shigella flexneri 2a str. 301
ccagcagcaca

SEQ ID NO: 3909264 - RNA, 14 nt, Shigella flexneri 2a str. 301
ccagcagcagccgg

SEQ ID NO: 3909265 - RNA, 13 nt, Shigella flexneri 2a str. 301
ccagcagcagcgg

SEQ ID NO: 3909266 - RNA, 16 nt, Shigella flexneri 2a str. 301
ccagcagcgccgcgcc

SEQ ID NO: 3909267 - RNA, 14 nt, Shigella flexneri 2a str. 301
ccagcagcggcaga

SEQ ID NO: 3909268 - RNA, 17 nt, Shigella flexneri 2a str. 301
ccagcagcggucggcuu

SEQ ID NO: 3909269 - RNA, 18 nt, Shigella flexneri 2a str. 301
ccagcagcugcguggcgc

SEQ ID NO: 3909270 - RNA, 18 nt, Shigella flexneri 2a str. 301
ccagcagcugcucccagc

SEQ ID NO: 3909271 - RNA, 19 nt, Shigella flexneri 2a str. 301
ccagcaggauguuccggca

SEQ ID NO: 3909272 - RNA, 17 nt, Shigella flexneri 2a str. 301
ccagcaggccgucgcgc

SEQ ID NO: 3909273 - RNA, 23 nt, Shigella flexneri 2a str. 301
ccagcagguuuaaccaucaggca

SEQ ID NO: 3909274 - RNA, 18 nt, Shigella flexneri 2a str. 301
ccagcaguaaaccaccca

SEQ ID NO: 3909275 - RNA, 18 nt, Shigella flexneri 2a str. 301
ccagcagugacucacgaa

SEQ ID NO: 3909276 - RNA, 17 nt, Shigella flexneri 2a str. 301
ccagcaguuccagcaua

SEQ ID NO: 3909277 - RNA, 14 nt, Shigella flexneri 2a str. 301
ccagcaguucgccc

SEQ ID NO: 3909278 - RNA, 14 nt, Shigella flexneri 2a str. 301
ccagcaguuuccgc

SEQ ID NO: 3909279 - RNA, 12 nt, Shigella flexneri 2a str. 301
ccagcaguuucu

SEQ ID NO: 3909280 - RNA, 13 nt, Shigella flexneri 2a str. 301
ccagcauaaucac

SEQ ID NO: 3909281 - RNA, 15 nt, Shigella flexneri 2a str. 301
ccagcauaaucacca

SEQ ID NO: 3909282 - RNA, 17 nt, Shigella flexneri 2a str. 301
ccagcauaaucaccauc

SEQ ID NO: 3909283 - RNA, 17 nt, Shigella flexneri 2a str. 301
ccagcauacgcugccag

SEQ ID NO: 3909284 - RNA, 21 nt, Shigella flexneri 2a str. 301
ccagcauacgcugccagccau

SEQ ID NO: 3909285 - RNA, 22 nt, Shigella flexneri 2a str. 301
ccagcauacgcugccagccauc

SEQ ID NO: 3909286 - RNA, 21 nt, Shigella flexneri 2a str. 301
ccagcauaguacgggcaauuu

SEQ ID NO: 3909287 - RNA, 13 nt, Shigella flexneri 2a str. 301
ccagcaucaacaa

SEQ ID NO: 3909288 - RNA, 18 nt, Shigella flexneri 2a str. 301
ccagcaucacgcccgcuu

SEQ ID NO: 3909289 - RNA, 13 nt, Shigella flexneri 2a str. 301
ccagcaucagcag

SEQ ID NO: 3909290 - RNA, 14 nt, Shigella flexneri 2a str. 301
ccagcaucccggca

SEQ ID NO: 3909291 - RNA, 17 nt, Shigella flexneri 2a str. 301
ccagcaucccggcagcc

SEQ ID NO: 3909292 - RNA, 13 nt, Shigella flexneri 2a str. 301
ccagcauccggca

SEQ ID NO: 3909293 - RNA, 12 nt, Shigella flexneri 2a str. 301
ccagcaucggca

SEQ ID NO: 3909294 - RNA, 17 nt, Shigella flexneri 2a str. 301
ccagcaucggcagcgcc

SEQ ID NO: 3909295 - RNA, 15 nt, Shigella flexneri 2a str. 301
ccagcaucugcaugg

SEQ ID NO: 3909296 - RNA, 23 nt, Shigella flexneri 2a str. 301
ccagcaucugcauggugccgcca

SEQ ID NO: 3909297 - RNA, 22 nt, Shigella flexneri 2a str. 301
ccagcaugaugcucucccaaau

SEQ ID NO: 3909298 - RNA, 13 nt, Shigella flexneri 2a str. 301
ccagcaugcauaa

SEQ ID NO: 3909299 - RNA, 17 nt, Shigella flexneri 2a str. 301
ccagcaugcauaacaga

SEQ ID NO: 3909300 - RNA, 16 nt, Shigella flexneri 2a str. 301
ccagcauggcaauaac

SEQ ID NO: 3909301 - RNA, 15 nt, Shigella flexneri 2a str. 301
ccagcauucccgcca

SEQ ID NO: 3909302 - RNA, 14 nt, Shigella flexneri 2a str. 301
ccagcauuucuucc

SEQ ID NO: 3909303 - RNA, 14 nt, Shigella flexneri 2a str. 301
ccagccaacgcccu

SEQ ID NO: 3909304 - RNA, 14 nt, Shigella flexneri 2a str. 301
ccagccacugcgcc

SEQ ID NO: 3909305 - RNA, 15 nt, Shigella flexneri 2a str. 301
ccagccacugcgcca

SEQ ID NO: 3909306 - RNA, 16 nt, Shigella flexneri 2a str. 301
ccagccagaaucauug

SEQ ID NO: 3909307 - RNA, 12 nt, Shigella flexneri 2a str. 301
ccagccagcaga

SEQ ID NO: 3909308 - RNA, 22 nt, Shigella flexneri 2a str. 301
ccagccagguguugauccacgg

SEQ ID NO: 3909309 - RNA, 23 nt, Shigella flexneri 2a str. 301
ccagccaguauugccaugcacgc

SEQ ID NO: 3909310 - RNA, 18 nt, Shigella flexneri 2a str. 301
ccagccaucuuucgcaga

SEQ ID NO: 3909311 - RNA, 18 nt, Shigella flexneri 2a str. 301
ccagccauuaaccagcca

SEQ ID NO: 3909312 - RNA, 19 nt, Shigella flexneri 2a str. 301
ccagcccaugaaucagcaa

SEQ ID NO: 3909313 - RNA, 22 nt, Shigella flexneri 2a str. 301
ccagcccgaucggcuggcauuu

SEQ ID NO: 3909314 - RNA, 17 nt, Shigella flexneri 2a str. 301
ccagccgaacagcgcca

SEQ ID NO: 3909315 - RNA, 11 nt, Shigella flexneri 2a str. 301
ccagccgagcc

SEQ ID NO: 3909316 - RNA, 21 nt, Shigella flexneri 2a str. 301
ccagccgauuuuaaugcggca

SEQ ID NO: 3909317 - RNA, 23 nt, Shigella flexneri 2a str. 301
ccagccgauuuuaaugcggcagu

SEQ ID NO: 3909318 - RNA, 17 nt, Shigella flexneri 2a str. 301
ccagccgcuaacuuccu

SEQ ID NO: 3909319 - RNA, 16 nt, Shigella flexneri 2a str. 301
ccagccuacaggaaac

SEQ ID NO: 3909320 - RNA, 22 nt, Shigella flexneri 2a str. 301
ccagccugaacgagaaaagcca

SEQ ID NO: 3909321 - RNA, 14 nt, Shigella flexneri 2a str. 301
ccagccugcaaacg

SEQ ID NO: 3909322 - RNA, 16 nt, Shigella flexneri 2a str. 301
ccagccuuuuucucug

SEQ ID NO: 3909323 - RNA, 22 nt, Shigella flexneri 2a str. 301
ccagcgaaaucaccgccaccag

SEQ ID NO: 3909324 - RNA, 15 nt, Shigella flexneri 2a str. 301
ccagcgaagccagcu

SEQ ID NO: 3909325 - RNA, 15 nt, Shigella flexneri 2a str. 301
ccagcgaauccagca

SEQ ID NO: 3909326 - RNA, 17 nt, Shigella flexneri 2a str. 301
ccagcgaccaagcgauu

SEQ ID NO: 3909327 - RNA, 22 nt, Shigella flexneri 2a str. 301
ccagcgauuacuguacagaucc

SEQ ID NO: 3909328 - RNA, 21 nt, Shigella flexneri 2a str. 301
ccagcgauuuaucggcaauuu

SEQ ID NO: 3909329 - RNA, 20 nt, Shigella flexneri 2a str. 301
ccagcgcacaguuauaaaau

SEQ ID NO: 3909330 - RNA, 16 nt, Shigella flexneri 2a str. 301
ccagcgcagacggcgc

SEQ ID NO: 3909331 - RNA, 15 nt, Shigella flexneri 2a str. 301
ccagcgcaucaggca

SEQ ID NO: 3909332 - RNA, 18 nt, Shigella flexneri 2a str. 301
ccagcgcauggcggcagc

SEQ ID NO: 3909333 - RNA, 19 nt, Shigella flexneri 2a str. 301
ccagcgcauggcggcagcg

SEQ ID NO: 3909334 - RNA, 18 nt, Shigella flexneri 2a str. 301
ccagcgccaccaccagca

SEQ ID NO: 3909335 - RNA, 16 nt, Shigella flexneri 2a str. 301
ccagcgccaguaauuc

SEQ ID NO: 3909336 - RNA, 20 nt, Shigella flexneri 2a str. 301
ccagcgccaucucuucggca

SEQ ID NO: 3909337 - RNA, 18 nt, Shigella flexneri 2a str. 301
ccagcgccgacagcagcc

SEQ ID NO: 3909338 - RNA, 13 nt, Shigella flexneri 2a str. 301
ccagcgccgccag

SEQ ID NO: 3909339 - RNA, 14 nt, Shigella flexneri 2a str. 301
ccagcgccugcgcg

SEQ ID NO: 3909340 - RNA, 18 nt, Shigella flexneri 2a str. 301
ccagcgcgaugcaggcca

SEQ ID NO: 3909341 - RNA, 20 nt, Shigella flexneri 2a str. 301
ccagcgcgaugcaggccacc

SEQ ID NO: 3909342 - RNA, 22 nt, Shigella flexneri 2a str. 301
ccagcgcgccuucauucaggcc

SEQ ID NO: 3909343 - RNA, 19 nt, Shigella flexneri 2a str. 301
ccagcgcgcguauccggca

SEQ ID NO: 3909344 - RNA, 18 nt, Shigella flexneri 2a str. 301
ccagcgcguaaauaccuu

SEQ ID NO: 3909345 - RNA, 22 nt, Shigella flexneri 2a str. 301
ccagcgcguuauguaacaacug

SEQ ID NO: 3909346 - RNA, 13 nt, Shigella flexneri 2a str. 301
ccagcgcuucacu

SEQ ID NO: 3909347 - RNA, 15 nt, Shigella flexneri 2a str. 301
ccagcggaauaacgc

SEQ ID NO: 3909348 - RNA, 20 nt, Shigella flexneri 2a str. 301
ccagcggaauucccgcuucu

SEQ ID NO: 3909349 - RNA, 17 nt, Shigella flexneri 2a str. 301
ccagcggauaaagcaga

SEQ ID NO: 3909350 - RNA, 20 nt, Shigella flexneri 2a str. 301
ccagcggauaaagcagagca

SEQ ID NO: 3909351 - RNA, 15 nt, Shigella flexneri 2a str. 301
ccagcggaugaccca

SEQ ID NO: 3909352 - RNA, 13 nt, Shigella flexneri 2a str. 301
ccagcggcagcuc

SEQ ID NO: 3909353 - RNA, 16 nt, Shigella flexneri 2a str. 301
ccagcggcggcacagc

SEQ ID NO: 3909354 - RNA, 23 nt, Shigella flexneri 2a str. 301
ccagcggcugcugauguucgcca

SEQ ID NO: 3909355 - RNA, 21 nt, Shigella flexneri 2a str. 301
ccagcgggcgucaaaaucauc

SEQ ID NO: 3909356 - RNA, 18 nt, Shigella flexneri 2a str. 301
ccagcggguugcugagau

SEQ ID NO: 3909357 - RNA, 16 nt, Shigella flexneri 2a str. 301
ccagcgguucacucca

SEQ ID NO: 3909358 - RNA, 18 nt, Shigella flexneri 2a str. 301
ccagcgguuuuugcgcca

SEQ ID NO: 3909359 - RNA, 12 nt, Shigella flexneri 2a str. 301
ccagcguaaauc

SEQ ID NO: 3909360 - RNA, 15 nt, Shigella flexneri 2a str. 301
ccagcguaaauccug

SEQ ID NO: 3909361 - RNA, 15 nt, Shigella flexneri 2a str. 301
ccagcguacguaacu

SEQ ID NO: 3909362 - RNA, 20 nt, Shigella flexneri 2a str. 301
ccagcguacguaacuucuua

SEQ ID NO: 3909363 - RNA, 16 nt, Shigella flexneri 2a str. 301
ccagcguagucggcag

SEQ ID NO: 3909364 - RNA, 17 nt, Shigella flexneri 2a str. 301
ccagcgucacccagaca

SEQ ID NO: 3909365 - RNA, 19 nt, Shigella flexneri 2a str. 301
ccagcgucacccagacaaa

SEQ ID NO: 3909366 - RNA, 13 nt, Shigella flexneri 2a str. 301
ccagcgucagcau

SEQ ID NO: 3909367 - RNA, 18 nt, Shigella flexneri 2a str. 301
ccagcgucagcauaaaaa

SEQ ID NO: 3909368 - RNA, 22 nt, Shigella flexneri 2a str. 301
ccagcgucaucauagacuuccc

SEQ ID NO: 3909369 - RNA, 17 nt, Shigella flexneri 2a str. 301
ccagcgucgcacccggc

SEQ ID NO: 3909370 - RNA, 21 nt, Shigella flexneri 2a str. 301
ccagcgucgcacccggcauuu

SEQ ID NO: 3909371 - RNA, 20 nt, Shigella flexneri 2a str. 301
ccagcgucgcaucaggcauc

SEQ ID NO: 3909372 - RNA, 20 nt, Shigella flexneri 2a str. 301
ccagcgucuucugguuuuuc

SEQ ID NO: 3909373 - RNA, 21 nt, Shigella flexneri 2a str. 301
ccagcguggcgaacggauagc

SEQ ID NO: 3909374 - RNA, 17 nt, Shigella flexneri 2a str. 301
ccagcguggucauggca

SEQ ID NO: 3909375 - RNA, 14 nt, Shigella flexneri 2a str. 301
ccagcguguugccg

SEQ ID NO: 3909376 - RNA, 15 nt, Shigella flexneri 2a str. 301
ccagcguuaccggcu

SEQ ID NO: 3909377 - RNA, 23 nt, Shigella flexneri 2a str. 301
ccagcguuagauccccgcucucc

SEQ ID NO: 3909378 - RNA, 14 nt, Shigella flexneri 2a str. 301
ccagcguugagccc

SEQ ID NO: 3909379 - RNA, 17 nt, Shigella flexneri 2a str. 301
ccagcguuuccagcacc

SEQ ID NO: 3909380 - RNA, 19 nt, Shigella flexneri 2a str. 301
ccagcguuuccagcaccag

SEQ ID NO: 3909381 - RNA, 21 nt, Shigella flexneri 2a str. 301
ccagcguuuccagcaccaguu

SEQ ID NO: 3909382 - RNA, 14 nt, Shigella flexneri 2a str. 301
ccagcucaaacgaa

SEQ ID NO: 3909383 - RNA, 15 nt, Shigella flexneri 2a str. 301
ccagcucaaacgaau

SEQ ID NO: 3909384 - RNA, 16 nt, Shigella flexneri 2a str. 301
ccagcuccauccacca

SEQ ID NO: 3909385 - RNA, 12 nt, Shigella flexneri 2a str. 301
ccagcuccgcca

SEQ ID NO: 3909386 - RNA, 15 nt, Shigella flexneri 2a str. 301
ccagcuccggcaccu

SEQ ID NO: 3909387 - RNA, 17 nt, Shigella flexneri 2a str. 301
ccagcuccguccagcca

SEQ ID NO: 3909388 - RNA, 18 nt, Shigella flexneri 2a str. 301
ccagcucggcaaucuguu

SEQ ID NO: 3909389 - RNA, 15 nt, Shigella flexneri 2a str. 301
ccagcucuucuucac

SEQ ID NO: 3909390 - RNA, 18 nt, Shigella flexneri 2a str. 301
ccagcucuucuucacucu

SEQ ID NO: 3909391 - RNA, 19 nt, Shigella flexneri 2a str. 301
ccagcucuucuucacucuc

SEQ ID NO: 3909392 - RNA, 19 nt, Shigella flexneri 2a str. 301
ccagcugccgaaccacuga

SEQ ID NO: 3909393 - RNA, 17 nt, Shigella flexneri 2a str. 301
ccagcugccgacgccag

SEQ ID NO: 3909394 - RNA, 21 nt, Shigella flexneri 2a str. 301
ccagcugcuguggauucagca

SEQ ID NO: 3909395 - RNA, 18 nt, Shigella flexneri 2a str. 301
ccagcuggcuaccgccgc

SEQ ID NO: 3909396 - RNA, 15 nt, Shigella flexneri 2a str. 301
ccagcuguccgauuu

SEQ ID NO: 3909397 - RNA, 16 nt, Shigella flexneri 2a str. 301
ccagcuguccgauuug

SEQ ID NO: 3909398 - RNA, 22 nt, Shigella flexneri 2a str. 301
ccagcuguggucuuuaaugaca

SEQ ID NO: 3909399 - RNA, 18 nt, Shigella flexneri 2a str. 301
ccagcuucaacgauucaa

SEQ ID NO: 3909400 - RNA, 21 nt, Shigella flexneri 2a str. 301
ccagcuucccaaagaucuccu

SEQ ID NO: 3909401 - RNA, 22 nt, Shigella flexneri 2a str. 301
ccagcuugaaggguuuuauaau

SEQ ID NO: 3909402 - RNA, 17 nt, Shigella flexneri 2a str. 301
ccagcuugcgacaugcg

SEQ ID NO: 3909403 - RNA, 19 nt, Shigella flexneri 2a str. 301
ccagcuugucauacggauu

SEQ ID NO: 3909404 - RNA, 23 nt, Shigella flexneri 2a str. 301
ccagcuuucgcuuaacgcccaug

SEQ ID NO: 3909405 - RNA, 20 nt, Shigella flexneri 2a str. 301
ccagcuuuuuaaucgccauc

SEQ ID NO: 3909406 - RNA, 13 nt, Shigella flexneri 2a str. 301
ccaggaaacccaa

SEQ ID NO: 3909407 - RNA, 13 nt, Shigella flexneri 2a str. 301
ccaggaacagaag

SEQ ID NO: 3909408 - RNA, 21 nt, Shigella flexneri 2a str. 301
ccaggaaccugugacagcagc

SEQ ID NO: 3909409 - RNA, 22 nt, Shigella flexneri 2a str. 301
ccaggaaccugugacagcagcg

SEQ ID NO: 3909410 - RNA, 23 nt, Shigella flexneri 2a str. 301
ccaggaaccugugacagcagcgg

SEQ ID NO: 3909411 - RNA, 21 nt, Shigella flexneri 2a str. 301
ccaggaacgcgccaagauaga

SEQ ID NO: 3909412 - RNA, 23 nt, Shigella flexneri 2a str. 301
ccaggaacuccagauccauaagg

SEQ ID NO: 3909413 - RNA, 23 nt, Shigella flexneri 2a str. 301
ccaggaagggcauaucagcaacu

SEQ ID NO: 3909414 - RNA, 15 nt, Shigella flexneri 2a str. 301
ccaggacgauaaacc

SEQ ID NO: 3909415 - RNA, 14 nt, Shigella flexneri 2a str. 301
ccaggagauuaacg

SEQ ID NO: 3909416 - RNA, 18 nt, Shigella flexneri 2a str. 301
ccaggagcguauucagca

SEQ ID NO: 3909417 - RNA, 15 nt, Shigella flexneri 2a str. 301
ccaggaucagaaugc

SEQ ID NO: 3909418 - RNA, 18 nt, Shigella flexneri 2a str. 301
ccaggaucggugcugcca

SEQ ID NO: 3909419 - RNA, 23 nt, Shigella flexneri 2a str. 301
ccaggaucuggcuugccagcagg

SEQ ID NO: 3909420 - RNA, 14 nt, Shigella flexneri 2a str. 301
ccaggcaaaccagu

SEQ ID NO: 3909421 - RNA, 22 nt, Shigella flexneri 2a str. 301
ccaggcaacgaaaggugaagug

SEQ ID NO: 3909422 - RNA, 17 nt, Shigella flexneri 2a str. 301
ccaggcaaucagcaauc

SEQ ID NO: 3909423 - RNA, 13 nt, Shigella flexneri 2a str. 301
ccaggcaccguca

SEQ ID NO: 3909424 - RNA, 13 nt, Shigella flexneri 2a str. 301
ccaggcagaagcg

SEQ ID NO: 3909425 - RNA, 20 nt, Shigella flexneri 2a str. 301
ccaggcaguuuauccagcca

SEQ ID NO: 3909426 - RNA, 18 nt, Shigella flexneri 2a str. 301
ccaggcaucagcaacacg

SEQ ID NO: 3909427 - RNA, 17 nt, Shigella flexneri 2a str. 301
ccaggcaucguguugau

SEQ ID NO: 3909428 - RNA, 17 nt, Shigella flexneri 2a str. 301
ccaggcauuaaauccug

SEQ ID NO: 3909429 - RNA, 20 nt, Shigella flexneri 2a str. 301
ccaggccaaauccuuccagc

SEQ ID NO: 3909430 - RNA, 12 nt, Shigella flexneri 2a str. 301
ccaggccagcgc

SEQ ID NO: 3909431 - RNA, 13 nt, Shigella flexneri 2a str. 301
ccaggccaucagc

SEQ ID NO: 3909432 - RNA, 17 nt, Shigella flexneri 2a str. 301
ccaggccaucagcagcg

SEQ ID NO: 3909433 - RNA, 19 nt, Shigella flexneri 2a str. 301
ccaggccgcguaccgcagc

SEQ ID NO: 3909434 - RNA, 18 nt, Shigella flexneri 2a str. 301
ccaggccgguaacgcuuu

SEQ ID NO: 3909435 - RNA, 18 nt, Shigella flexneri 2a str. 301
ccaggccggugaugaugc

SEQ ID NO: 3909436 - RNA, 15 nt, Shigella flexneri 2a str. 301
ccaggcucgccgccg

SEQ ID NO: 3909437 - RNA, 19 nt, Shigella flexneri 2a str. 301
ccaggcugcaaagucuggg

SEQ ID NO: 3909438 - RNA, 21 nt, Shigella flexneri 2a str. 301
ccaggcugcgaacgguuuuca

SEQ ID NO: 3909439 - RNA, 16 nt, Shigella flexneri 2a str. 301
ccaggcuggucgcgcg

SEQ ID NO: 3909440 - RNA, 13 nt, Shigella flexneri 2a str. 301
ccagggcagcagu

SEQ ID NO: 3909441 - RNA, 20 nt, Shigella flexneri 2a str. 301
ccagggcagcaguucaugca

SEQ ID NO: 3909442 - RNA, 19 nt, Shigella flexneri 2a str. 301
ccagggccuccugcagcgu

SEQ ID NO: 3909443 - RNA, 14 nt, Shigella flexneri 2a str. 301
ccagggccucuccu

SEQ ID NO: 3909444 - RNA, 16 nt, Shigella flexneri 2a str. 301
ccagggcuuuauucac

SEQ ID NO: 3909445 - RNA, 20 nt, Shigella flexneri 2a str. 301
ccagggcuuuuuuauuucau

SEQ ID NO: 3909446 - RNA, 23 nt, Shigella flexneri 2a str. 301
ccagguaaacaccuucauccagc

SEQ ID NO: 3909447 - RNA, 13 nt, Shigella flexneri 2a str. 301
ccagguaauuuga

SEQ ID NO: 3909448 - RNA, 15 nt, Shigella flexneri 2a str. 301
ccaggucaccagaca

SEQ ID NO: 3909449 - RNA, 19 nt, Shigella flexneri 2a str. 301
ccaggucagagagccagcc

SEQ ID NO: 3909450 - RNA, 20 nt, Shigella flexneri 2a str. 301
ccaggucagagagccagccc

SEQ ID NO: 3909451 - RNA, 16 nt, Shigella flexneri 2a str. 301
ccaggugaaaaauaaa

SEQ ID NO: 3909452 - RNA, 17 nt, Shigella flexneri 2a str. 301
ccagguuaacgcaggcg

SEQ ID NO: 3909453 - RNA, 21 nt, Shigella flexneri 2a str. 301
ccagguuguacuuuccagcca

SEQ ID NO: 3909454 - RNA, 17 nt, Shigella flexneri 2a str. 301
ccagguuguucacggca

SEQ ID NO: 3909455 - RNA, 17 nt, Shigella flexneri 2a str. 301
ccagguuuaccagcagc

SEQ ID NO: 3909456 - RNA, 22 nt, Shigella flexneri 2a str. 301
ccagguuuuaguuucgccguuu

SEQ ID NO: 3909457 - RNA, 20 nt, Shigella flexneri 2a str. 301
ccagguuuucuuucaccucu

SEQ ID NO: 3909458 - RNA, 19 nt, Shigella flexneri 2a str. 301
ccaguaaaccaauuucugu

SEQ ID NO: 3909459 - RNA, 23 nt, Shigella flexneri 2a str. 301
ccaguaaccacgcagcguuggca

SEQ ID NO: 3909460 - RNA, 17 nt, Shigella flexneri 2a str. 301
ccaguaaccuuucagau

SEQ ID NO: 3909461 - RNA, 22 nt, Shigella flexneri 2a str. 301
ccaguaacgucccccagauccc

SEQ ID NO: 3909462 - RNA, 23 nt, Shigella flexneri 2a str. 301
ccaguaacucauugccaguccua

SEQ ID NO: 3909463 - RNA, 21 nt, Shigella flexneri 2a str. 301
ccaguaagcaguccagcgccu

SEQ ID NO: 3909464 - RNA, 21 nt, Shigella flexneri 2a str. 301
ccaguaagcugugcgauagca

SEQ ID NO: 3909465 - RNA, 19 nt, Shigella flexneri 2a str. 301
ccaguaaggcaucuucuuc

SEQ ID NO: 3909466 - RNA, 22 nt, Shigella flexneri 2a str. 301
ccaguaaucacgaucucgccag

SEQ ID NO: 3909467 - RNA, 14 nt, Shigella flexneri 2a str. 301
ccaguaaucgggca

SEQ ID NO: 3909468 - RNA, 21 nt, Shigella flexneri 2a str. 301
ccaguaaucgggcaacugcug

SEQ ID NO: 3909469 - RNA, 14 nt, Shigella flexneri 2a str. 301
ccaguaaucuggcc

SEQ ID NO: 3909470 - RNA, 13 nt, Shigella flexneri 2a str. 301
ccaguaauucagc

SEQ ID NO: 3909471 - RNA, 21 nt, Shigella flexneri 2a str. 301
ccaguaauugacgcauccgau

SEQ ID NO: 3909472 - RNA, 16 nt, Shigella flexneri 2a str. 301
ccaguacaugaagcac

SEQ ID NO: 3909473 - RNA, 14 nt, Shigella flexneri 2a str. 301
ccaguaccagcagc

SEQ ID NO: 3909474 - RNA, 11 nt, Shigella flexneri 2a str. 301
ccaguaccgau

SEQ ID NO: 3909475 - RNA, 13 nt, Shigella flexneri 2a str. 301
ccaguaccgccag

SEQ ID NO: 3909476 - RNA, 15 nt, Shigella flexneri 2a str. 301
ccaguacgccaaucu

SEQ ID NO: 3909477 - RNA, 18 nt, Shigella flexneri 2a str. 301
ccaguacgcccacgccag

SEQ ID NO: 3909478 - RNA, 15 nt, Shigella flexneri 2a str. 301
ccaguacgccuucac

SEQ ID NO: 3909479 - RNA, 22 nt, Shigella flexneri 2a str. 301
ccaguacgcguacacuuuccug

SEQ ID NO: 3909480 - RNA, 23 nt, Shigella flexneri 2a str. 301
ccaguacggcuucgaucaggaac

SEQ ID NO: 3909481 - RNA, 22 nt, Shigella flexneri 2a str. 301
ccaguacucggaauaaccgguu

SEQ ID NO: 3909482 - RNA, 13 nt, Shigella flexneri 2a str. 301
ccaguagacagca

SEQ ID NO: 3909483 - RNA, 21 nt, Shigella flexneri 2a str. 301
ccaguagacgagccguuccua

SEQ ID NO: 3909484 - RNA, 23 nt, Shigella flexneri 2a str. 301
ccaguaugcauguaaaucaagcg

SEQ ID NO: 3909485 - RNA, 19 nt, Shigella flexneri 2a str. 301
ccaguauuaccggcagagu

SEQ ID NO: 3909486 - RNA, 23 nt, Shigella flexneri 2a str. 301
ccaguauugccaugcacgcaaga

SEQ ID NO: 3909487 - RNA, 17 nt, Shigella flexneri 2a str. 301
ccaguauuucauagauu

SEQ ID NO: 3909488 - RNA, 21 nt, Shigella flexneri 2a str. 301
ccagucacuucacaguuuuga

SEQ ID NO: 3909489 - RNA, 17 nt, Shigella flexneri 2a str. 301
ccagucagaaagugcca

SEQ ID NO: 3909490 - RNA, 14 nt, Shigella flexneri 2a str. 301
ccagucaggcauga

SEQ ID NO: 3909491 - RNA, 14 nt, Shigella flexneri 2a str. 301
ccagucaguuaagc

SEQ ID NO: 3909492 - RNA, 22 nt, Shigella flexneri 2a str. 301
ccaguccagcgccugacguaac

SEQ ID NO: 3909493 - RNA, 15 nt, Shigella flexneri 2a str. 301
ccaguccauuaccga

SEQ ID NO: 3909494 - RNA, 13 nt, Shigella flexneri 2a str. 301
ccagucccuuuca

SEQ ID NO: 3909495 - RNA, 19 nt, Shigella flexneri 2a str. 301
ccaguccugugacucaaug

SEQ ID NO: 3909496 - RNA, 22 nt, Shigella flexneri 2a str. 301
ccagucguaguggaucagcaaa

SEQ ID NO: 3909497 - RNA, 20 nt, Shigella flexneri 2a str. 301
ccagucguucaaccacuuca

SEQ ID NO: 3909498 - RNA, 13 nt, Shigella flexneri 2a str. 301
ccagugaauacug

SEQ ID NO: 3909499 - RNA, 21 nt, Shigella flexneri 2a str. 301
ccagugaugcgcaggguaacg

SEQ ID NO: 3909500 - RNA, 15 nt, Shigella flexneri 2a str. 301
ccagugcagcgaagu

SEQ ID NO: 3909501 - RNA, 13 nt, Shigella flexneri 2a str. 301
ccagugcagcgcc

SEQ ID NO: 3909502 - RNA, 21 nt, Shigella flexneri 2a str. 301
ccagugcaggcaccagccccu

SEQ ID NO: 3909503 - RNA, 16 nt, Shigella flexneri 2a str. 301
ccagugcauccagcac

SEQ ID NO: 3909504 - RNA, 21 nt, Shigella flexneri 2a str. 301
ccagugccacacgcucuucca

SEQ ID NO: 3909505 - RNA, 22 nt, Shigella flexneri 2a str. 301
ccagugccacacgcucuuccag

SEQ ID NO: 3909506 - RNA, 22 nt, Shigella flexneri 2a str. 301
ccagugcccgaccacuucaugc

SEQ ID NO: 3909507 - RNA, 16 nt, Shigella flexneri 2a str. 301
ccagugccgcccacca

SEQ ID NO: 3909508 - RNA, 18 nt, Shigella flexneri 2a str. 301
ccagugccgcccaccacu

SEQ ID NO: 3909509 - RNA, 19 nt, Shigella flexneri 2a str. 301
ccagugccguuccagccag

SEQ ID NO: 3909510 - RNA, 21 nt, Shigella flexneri 2a str. 301
ccagugccguuccagccagug

SEQ ID NO: 3909511 - RNA, 15 nt, Shigella flexneri 2a str. 301
ccagugccucaagaa

SEQ ID NO: 3909512 - RNA, 14 nt, Shigella flexneri 2a str. 301
ccagugccuggcga

SEQ ID NO: 3909513 - RNA, 16 nt, Shigella flexneri 2a str. 301
ccaguggcagcaauuu

SEQ ID NO: 3909514 - RNA, 22 nt, Shigella flexneri 2a str. 301
ccagugguuucgccagcaccgg

SEQ ID NO: 3909515 - RNA, 14 nt, Shigella flexneri 2a str. 301
ccaguuacugccac

SEQ ID NO: 3909516 - RNA, 15 nt, Shigella flexneri 2a str. 301
ccaguuaucaagcca

SEQ ID NO: 3909517 - RNA, 21 nt, Shigella flexneri 2a str. 301
ccaguucaagugcuacccacu

SEQ ID NO: 3909518 - RNA, 16 nt, Shigella flexneri 2a str. 301
ccaguucacgaauauu

SEQ ID NO: 3909519 - RNA, 15 nt, Shigella flexneri 2a str. 301
ccaguucagcggcug

SEQ ID NO: 3909520 - RNA, 21 nt, Shigella flexneri 2a str. 301
ccaguucauguucgacaugcu

SEQ ID NO: 3909521 - RNA, 14 nt, Shigella flexneri 2a str. 301
ccaguucauuugaa

SEQ ID NO: 3909522 - RNA, 17 nt, Shigella flexneri 2a str. 301
ccaguuccacuucugca

SEQ ID NO: 3909523 - RNA, 12 nt, Shigella flexneri 2a str. 301
ccaguucccccu

SEQ ID NO: 3909524 - RNA, 15 nt, Shigella flexneri 2a str. 301
ccaguuccggacugc

SEQ ID NO: 3909525 - RNA, 18 nt, Shigella flexneri 2a str. 301
ccaguuccggacugcuca

SEQ ID NO: 3909526 - RNA, 13 nt, Shigella flexneri 2a str. 301
ccaguucgcgcac

SEQ ID NO: 3909527 - RNA, 14 nt, Shigella flexneri 2a str. 301
ccaguucgcgcacg

SEQ ID NO: 3909528 - RNA, 21 nt, Shigella flexneri 2a str. 301
ccaguucgcgcacguuucccg

SEQ ID NO: 3909529 - RNA, 15 nt, Shigella flexneri 2a str. 301
ccaguucguuguagu

SEQ ID NO: 3909530 - RNA, 13 nt, Shigella flexneri 2a str. 301
ccaguucuacaau

SEQ ID NO: 3909531 - RNA, 21 nt, Shigella flexneri 2a str. 301
ccaguucuuccaguuccggca

SEQ ID NO: 3909532 - RNA, 14 nt, Shigella flexneri 2a str. 301
ccaguugaccugcg

SEQ ID NO: 3909533 - RNA, 18 nt, Shigella flexneri 2a str. 301
ccaguugcuccagcaaua

SEQ ID NO: 3909534 - RNA, 22 nt, Shigella flexneri 2a str. 301
ccaguugucgguaauugcgccg

SEQ ID NO: 3909535 - RNA, 23 nt, Shigella flexneri 2a str. 301
ccaguugugaugauuuugugcca

SEQ ID NO: 3909536 - RNA, 20 nt, Shigella flexneri 2a str. 301
ccaguugugucagugcgcga

SEQ ID NO: 3909537 - RNA, 15 nt, Shigella flexneri 2a str. 301
ccaguuguucgcgca

SEQ ID NO: 3909538 - RNA, 16 nt, Shigella flexneri 2a str. 301
ccaguuguucgcgcac

SEQ ID NO: 3909539 - RNA, 21 nt, Shigella flexneri 2a str. 301
ccaguuuacugauaacuucac

SEQ ID NO: 3909540 - RNA, 16 nt, Shigella flexneri 2a str. 301
ccaguuuacugucugc

SEQ ID NO: 3909541 - RNA, 18 nt, Shigella flexneri 2a str. 301
ccaguuuacugucugcuu

SEQ ID NO: 3909542 - RNA, 12 nt, Shigella flexneri 2a str. 301
ccaguuucacag

SEQ ID NO: 3909543 - RNA, 14 nt, Shigella flexneri 2a str. 301
ccaguuucggacgc

SEQ ID NO: 3909544 - RNA, 20 nt, Shigella flexneri 2a str. 301
ccaguuucggcaucagcaga

SEQ ID NO: 3909545 - RNA, 22 nt, Shigella flexneri 2a str. 301
ccaguuuguucagcugcgugcc

SEQ ID NO: 3909546 - RNA, 13 nt, Shigella flexneri 2a str. 301
ccaguuuucgcca

SEQ ID NO: 3909547 - RNA, 15 nt, Shigella flexneri 2a str. 301
ccaguuuucggauuu

SEQ ID NO: 3909548 - RNA, 15 nt, Shigella flexneri 2a str. 301
ccaguuuuuguuucu

SEQ ID NO: 3909549 - RNA, 14 nt, Shigella flexneri 2a str. 301
ccauaaacagggcu

SEQ ID NO: 3909550 - RNA, 21 nt, Shigella flexneri 2a str. 301
ccauaaacagggcuuuaccug

SEQ ID NO: 3909551 - RNA, 15 nt, Shigella flexneri 2a str. 301
ccauaaacuaucccu

SEQ ID NO: 3909552 - RNA, 18 nt, Shigella flexneri 2a str. 301
ccauaaccccaccagcau

SEQ ID NO: 3909553 - RNA, 19 nt, Shigella flexneri 2a str. 301
ccauaacgccugcuccagu

SEQ ID NO: 3909554 - RNA, 22 nt, Shigella flexneri 2a str. 301
ccauaagauugcauagcggcga

SEQ ID NO: 3909555 - RNA, 15 nt, Shigella flexneri 2a str. 301
ccauaagcccagaac

SEQ ID NO: 3909556 - RNA, 21 nt, Shigella flexneri 2a str. 301
ccauaagcccagaacaaauaa

SEQ ID NO: 3909557 - RNA, 20 nt, Shigella flexneri 2a str. 301
ccauaagccugauaagcguu

SEQ ID NO: 3909558 - RNA, 13 nt, Shigella flexneri 2a str. 301
ccauaauaaucau

SEQ ID NO: 3909559 - RNA, 14 nt, Shigella flexneri 2a str. 301
ccauaauaaucauc

SEQ ID NO: 3909560 - RNA, 13 nt, Shigella flexneri 2a str. 301
ccauacagacacc

SEQ ID NO: 3909561 - RNA, 19 nt, Shigella flexneri 2a str. 301
ccauacaucuucaucaucc

SEQ ID NO: 3909562 - RNA, 20 nt, Shigella flexneri 2a str. 301
ccauacggcagagaucgccg

SEQ ID NO: 3909563 - RNA, 18 nt, Shigella flexneri 2a str. 301
ccauacggcucagcucug

SEQ ID NO: 3909564 - RNA, 13 nt, Shigella flexneri 2a str. 301
ccauacugacgga

SEQ ID NO: 3909565 - RNA, 17 nt, Shigella flexneri 2a str. 301
ccauagcaucccaauac

SEQ ID NO: 3909566 - RNA, 20 nt, Shigella flexneri 2a str. 301
ccauagcaucccaauacccg

SEQ ID NO: 3909567 - RNA, 20 nt, Shigella flexneri 2a str. 301
ccauaggaugagguuucccg

SEQ ID NO: 3909568 - RNA, 13 nt, Shigella flexneri 2a str. 301
ccauauagcgcac

SEQ ID NO: 3909569 - RNA, 13 nt, Shigella flexneri 2a str. 301
ccauaucaagcau

SEQ ID NO: 3909570 - RNA, 15 nt, Shigella flexneri 2a str. 301
ccauaucaggcacau

SEQ ID NO: 3909571 - RNA, 18 nt, Shigella flexneri 2a str. 301
ccauaucaggcacauuac

SEQ ID NO: 3909572 - RNA, 19 nt, Shigella flexneri 2a str. 301
ccauaucgccauugccggu

SEQ ID NO: 3909573 - RNA, 14 nt, Shigella flexneri 2a str. 301
ccauaugaauauau

SEQ ID NO: 3909574 - RNA, 19 nt, Shigella flexneri 2a str. 301
ccauauggcugcauucaga

SEQ ID NO: 3909575 - RNA, 18 nt, Shigella flexneri 2a str. 301
ccauauguugaaaagcca

SEQ ID NO: 3909576 - RNA, 22 nt, Shigella flexneri 2a str. 301
ccauauuagccgccagcucuuu

SEQ ID NO: 3909577 - RNA, 15 nt, Shigella flexneri 2a str. 301
ccauauucagcagca

SEQ ID NO: 3909578 - RNA, 19 nt, Shigella flexneri 2a str. 301
ccauauucugaucgugcuc

SEQ ID NO: 3909579 - RNA, 15 nt, Shigella flexneri 2a str. 301
ccaucaaaucacuaa

SEQ ID NO: 3909580 - RNA, 12 nt, Shigella flexneri 2a str. 301
ccaucaaaucug

SEQ ID NO: 3909581 - RNA, 19 nt, Shigella flexneri 2a str. 301
ccaucaacaaacgccagau

SEQ ID NO: 3909582 - RNA, 15 nt, Shigella flexneri 2a str. 301
ccaucaacaagcgaa

SEQ ID NO: 3909583 - RNA, 20 nt, Shigella flexneri 2a str. 301
ccaucaacgccaucgccagg

SEQ ID NO: 3909584 - RNA, 22 nt, Shigella flexneri 2a str. 301
ccaucaaguagcagguaaucug

SEQ ID NO: 3909585 - RNA, 20 nt, Shigella flexneri 2a str. 301
ccaucaaucacuuugcgcuc

SEQ ID NO: 3909586 - RNA, 20 nt, Shigella flexneri 2a str. 301
ccaucaauccacuucgccag

SEQ ID NO: 3909587 - RNA, 13 nt, Shigella flexneri 2a str. 301
ccaucaaugccgc

SEQ ID NO: 3909588 - RNA, 18 nt, Shigella flexneri 2a str. 301
ccaucaauggcugcaaag

SEQ ID NO: 3909589 - RNA, 18 nt, Shigella flexneri 2a str. 301
ccaucaauugcucacucc

SEQ ID NO: 3909590 - RNA, 22 nt, Shigella flexneri 2a str. 301
ccaucacaauggcacaaauggc

SEQ ID NO: 3909591 - RNA, 12 nt, Shigella flexneri 2a str. 301
ccaucacaccuc

SEQ ID NO: 3909592 - RNA, 22 nt, Shigella flexneri 2a str. 301
ccaucaccaacgauuuuuuccg

SEQ ID NO: 3909593 - RNA, 18 nt, Shigella flexneri 2a str. 301
ccaucaccaucguugcua

SEQ ID NO: 3909594 - RNA, 20 nt, Shigella flexneri 2a str. 301
ccaucaccucuucagcgucc

SEQ ID NO: 3909595 - RNA, 18 nt, Shigella flexneri 2a str. 301
ccaucagacuuugcgcca

SEQ ID NO: 3909596 - RNA, 19 nt, Shigella flexneri 2a str. 301
ccaucagacuuugcgccau

SEQ ID NO: 3909597 - RNA, 17 nt, Shigella flexneri 2a str. 301
ccaucagcgccugaugg

SEQ ID NO: 3909598 - RNA, 18 nt, Shigella flexneri 2a str. 301
ccaucagcgccugaugga

SEQ ID NO: 3909599 - RNA, 15 nt, Shigella flexneri 2a str. 301
ccaucaggcagucug

SEQ ID NO: 3909600 - RNA, 19 nt, Shigella flexneri 2a str. 301
ccaucaggcagucugcgcc

SEQ ID NO: 3909601 - RNA, 21 nt, Shigella flexneri 2a str. 301
ccaucaggcagucugcgcccu

SEQ ID NO: 3909602 - RNA, 16 nt, Shigella flexneri 2a str. 301
ccaucaggcauuacug

SEQ ID NO: 3909603 - RNA, 18 nt, Shigella flexneri 2a str. 301
ccaucagggcggccgcca

SEQ ID NO: 3909604 - RNA, 14 nt, Shigella flexneri 2a str. 301
ccaucagugccagu

SEQ ID NO: 3909605 - RNA, 17 nt, Shigella flexneri 2a str. 301
ccaucagugccaguacg

SEQ ID NO: 3909606 - RNA, 14 nt, Shigella flexneri 2a str. 301
ccaucauacccaac

SEQ ID NO: 3909607 - RNA, 14 nt, Shigella flexneri 2a str. 301
ccaucauauuuucc

SEQ ID NO: 3909608 - RNA, 20 nt, Shigella flexneri 2a str. 301
ccaucauauuuuccaucauu

SEQ ID NO: 3909609 - RNA, 21 nt, Shigella flexneri 2a str. 301
ccaucaucaucgguaccgcca

SEQ ID NO: 3909610 - RNA, 14 nt, Shigella flexneri 2a str. 301
ccaucaucggcaaa

SEQ ID NO: 3909611 - RNA, 13 nt, Shigella flexneri 2a str. 301
ccaucaugcgcca

SEQ ID NO: 3909612 - RNA, 15 nt, Shigella flexneri 2a str. 301
ccaucaugcgccagg

SEQ ID NO: 3909613 - RNA, 19 nt, Shigella flexneri 2a str. 301
ccaucauuaugagugaugu

SEQ ID NO: 3909614 - RNA, 13 nt, Shigella flexneri 2a str. 301
ccauccagcaaca

SEQ ID NO: 3909615 - RNA, 23 nt, Shigella flexneri 2a str. 301
ccauccagcuuuuagaucacuca

SEQ ID NO: 3909616 - RNA, 10 nt, Shigella flexneri 2a str. 301
ccauccauac

SEQ ID NO: 3909617 - RNA, 16 nt, Shigella flexneri 2a str. 301
ccaucccaccaccagc

SEQ ID NO: 3909618 - RNA, 20 nt, Shigella flexneri 2a str. 301
ccaucccaccaccagcaaua

SEQ ID NO: 3909619 - RNA, 21 nt, Shigella flexneri 2a str. 301
ccauccccaaaaaaucaacga

SEQ ID NO: 3909620 - RNA, 13 nt, Shigella flexneri 2a str. 301
ccaucccuccugu

SEQ ID NO: 3909621 - RNA, 13 nt, Shigella flexneri 2a str. 301
ccaucccuucacc

SEQ ID NO: 3909622 - RNA, 17 nt, Shigella flexneri 2a str. 301
ccauccgaauucacuua

SEQ ID NO: 3909623 - RNA, 14 nt, Shigella flexneri 2a str. 301
ccauccgcccacac

SEQ ID NO: 3909624 - RNA, 20 nt, Shigella flexneri 2a str. 301
ccauccgcgugacgcuggca

SEQ ID NO: 3909625 - RNA, 14 nt, Shigella flexneri 2a str. 301
ccauccggcaacau

SEQ ID NO: 3909626 - RNA, 18 nt, Shigella flexneri 2a str. 301
ccauccggccgccacaca

SEQ ID NO: 3909627 - RNA, 17 nt, Shigella flexneri 2a str. 301
ccauccgucauccauac

SEQ ID NO: 3909628 - RNA, 18 nt, Shigella flexneri 2a str. 301
ccauccugacggauagcc

SEQ ID NO: 3909629 - RNA, 16 nt, Shigella flexneri 2a str. 301
ccauccuucuguggac

SEQ ID NO: 3909630 - RNA, 13 nt, Shigella flexneri 2a str. 301
ccaucgcauacug

SEQ ID NO: 3909631 - RNA, 15 nt, Shigella flexneri 2a str. 301
ccaucgccagcagcc

SEQ ID NO: 3909632 - RNA, 14 nt, Shigella flexneri 2a str. 301
ccaucgccagugcc

SEQ ID NO: 3909633 - RNA, 15 nt, Shigella flexneri 2a str. 301
ccaucgccagugccg

SEQ ID NO: 3909634 - RNA, 18 nt, Shigella flexneri 2a str. 301
ccaucgccauuuaacgca

SEQ ID NO: 3909635 - RNA, 18 nt, Shigella flexneri 2a str. 301
ccaucgccuggugaccgc

SEQ ID NO: 3909636 - RNA, 20 nt, Shigella flexneri 2a str. 301
ccaucgcgguuaaucggcag

SEQ ID NO: 3909637 - RNA, 18 nt, Shigella flexneri 2a str. 301
ccaucgcuacauaacgca

SEQ ID NO: 3909638 - RNA, 20 nt, Shigella flexneri 2a str. 301
ccaucgcuacauaacgcagc

SEQ ID NO: 3909639 - RNA, 15 nt, Shigella flexneri 2a str. 301
ccaucgcugauugcu

SEQ ID NO: 3909640 - RNA, 22 nt, Shigella flexneri 2a str. 301
ccaucgcuuuuaccagcauacg

SEQ ID NO: 3909641 - RNA, 23 nt, Shigella flexneri 2a str. 301
ccaucggagcguugucguaacag

SEQ ID NO: 3909642 - RNA, 21 nt, Shigella flexneri 2a str. 301
ccaucggcaaucauucccaga

SEQ ID NO: 3909643 - RNA, 17 nt, Shigella flexneri 2a str. 301
ccaucggcaccaccaaa

SEQ ID NO: 3909644 - RNA, 16 nt, Shigella flexneri 2a str. 301
gcagcagcgcgcccgg

SEQ ID NO: 3909645 - RNA, 13 nt, Shigella flexneri 2a str. 301
gcagcagcgguug

SEQ ID NO: 3909646 - RNA, 22 nt, Shigella flexneri 2a str. 301
gcagcagcguuucgaacaggcc

SEQ ID NO: 3909647 - RNA, 21 nt, Shigella flexneri 2a str. 301
gcagcaggaucuccagcuccc

SEQ ID NO: 3909648 - RNA, 19 nt, Shigella flexneri 2a str. 301
gcagcaggugcgccagcga

SEQ ID NO: 3909649 - RNA, 14 nt, Shigella flexneri 2a str. 301
gcagcagucgcaac

SEQ ID NO: 3909650 - RNA, 13 nt, Shigella flexneri 2a str. 301
gcagcaguugcca

SEQ ID NO: 3909651 - RNA, 22 nt, Shigella flexneri 2a str. 301
gcagcaucaucauaauggcugc

SEQ ID NO: 3909652 - RNA, 15 nt, Shigella flexneri 2a str. 301
gcagcaucgucauca

SEQ ID NO: 3909653 - RNA, 11 nt, Shigella flexneri 2a str. 301
gcagcaugcac

SEQ ID NO: 3909654 - RNA, 15 nt, Shigella flexneri 2a str. 301
gcagcaugcacccuc

SEQ ID NO: 3909655 - RNA, 18 nt, Shigella flexneri 2a str. 301
gcagcaugcaucccgccg

SEQ ID NO: 3909656 - RNA, 14 nt, Shigella flexneri 2a str. 301
gcagcauggucagg

SEQ ID NO: 3909657 - RNA, 22 nt, Shigella flexneri 2a str. 301
gcagccaccacuugcagcucau

SEQ ID NO: 3909658 - RNA, 15 nt, Shigella flexneri 2a str. 301
gcagccaccgccagc

SEQ ID NO: 3909659 - RNA, 18 nt, Shigella flexneri 2a str. 301
gcagccagcacugccgca

SEQ ID NO: 3909660 - RNA, 16 nt, Shigella flexneri 2a str. 301
gcagccagcgcgccuu

SEQ ID NO: 3909661 - RNA, 12 nt, Shigella flexneri 2a str. 301
gcagccagcguu

SEQ ID NO: 3909662 - RNA, 21 nt, Shigella flexneri 2a str. 301
gcagccaggcaaucccacagc

SEQ ID NO: 3909663 - RNA, 13 nt, Shigella flexneri 2a str. 301
gcagccaggccau

SEQ ID NO: 3909664 - RNA, 19 nt, Shigella flexneri 2a str. 301
gcagccagggucaacauaa

SEQ ID NO: 3909665 - RNA, 18 nt, Shigella flexneri 2a str. 301
gcagccaguuaaccugcu

SEQ ID NO: 3909666 - RNA, 19 nt, Shigella flexneri 2a str. 301
gcagccaucaccacgcuga

SEQ ID NO: 3909667 - RNA, 16 nt, Shigella flexneri 2a str. 301
gcagccaucacugacu

SEQ ID NO: 3909668 - RNA, 19 nt, Shigella flexneri 2a str. 301
gcagccaucugaugauauu

SEQ ID NO: 3909669 - RNA, 18 nt, Shigella flexneri 2a str. 301
gcagcccguaagcaaaag

SEQ ID NO: 3909670 - RNA, 15 nt, Shigella flexneri 2a str. 301
gcagccgccagaaau

SEQ ID NO: 3909671 - RNA, 16 nt, Shigella flexneri 2a str. 301
gcagccgguauccagc

SEQ ID NO: 3909672 - RNA, 15 nt, Shigella flexneri 2a str. 301
gcagccgucauugaa

SEQ ID NO: 3909673 - RNA, 19 nt, Shigella flexneri 2a str. 301
gcagccgugcccaacugcc

SEQ ID NO: 3909674 - RNA, 20 nt, Shigella flexneri 2a str. 301
gcagccuucauucaggcauu

SEQ ID NO: 3909675 - RNA, 18 nt, Shigella flexneri 2a str. 301
gcagcgaaggguauacgc

SEQ ID NO: 3909676 - RNA, 20 nt, Shigella flexneri 2a str. 301
gcagcgauucaacaguagcc

SEQ ID NO: 3909677 - RNA, 17 nt, Shigella flexneri 2a str. 301
gcagcgcaaucgccucc

SEQ ID NO: 3909678 - RNA, 16 nt, Shigella flexneri 2a str. 301
gcagcgcauuguuucu

SEQ ID NO: 3909679 - RNA, 14 nt, Shigella flexneri 2a str. 301
gcagcgccagcgaa

SEQ ID NO: 3909680 - RNA, 12 nt, Shigella flexneri 2a str. 301
gcagcgccgcgc

SEQ ID NO: 3909681 - RNA, 17 nt, Shigella flexneri 2a str. 301
gcagcgccgcguacgcc

SEQ ID NO: 3909682 - RNA, 22 nt, Shigella flexneri 2a str. 301
gcagcgccuuuuguuuguucuu

SEQ ID NO: 3909683 - RNA, 19 nt, Shigella flexneri 2a str. 301
gcagcggaucgccgccgga

SEQ ID NO: 3909684 - RNA, 15 nt, Shigella flexneri 2a str. 301
gcagcggcggcaccg

SEQ ID NO: 3909685 - RNA, 16 nt, Shigella flexneri 2a str. 301
gcagcggcggcaccga

SEQ ID NO: 3909686 - RNA, 20 nt, Shigella flexneri 2a str. 301
gcagcggucggcuucccugc

SEQ ID NO: 3909687 - RNA, 17 nt, Shigella flexneri 2a str. 301
gcagcggugagccagga

SEQ ID NO: 3909688 - RNA, 19 nt, Shigella flexneri 2a str. 301
gcagcguacguuggcaaag

SEQ ID NO: 3909689 - RNA, 23 nt, Shigella flexneri 2a str. 301
gcagcgucgcauccgacauugaa

SEQ ID NO: 3909690 - RNA, 13 nt, Shigella flexneri 2a str. 301
gcagcgucuucug

SEQ ID NO: 3909691 - RNA, 20 nt, Shigella flexneri 2a str. 301
gcagcgugaguaugauacgu

SEQ ID NO: 3909692 - RNA, 16 nt, Shigella flexneri 2a str. 301
gcagcgugccaggcgc

SEQ ID NO: 3909693 - RNA, 18 nt, Shigella flexneri 2a str. 301
gcagcgugcucucaaaua

SEQ ID NO: 3909694 - RNA, 19 nt, Shigella flexneri 2a str. 301
gcagcgugcucucaaauau

SEQ ID NO: 3909695 - RNA, 23 nt, Shigella flexneri 2a str. 301
gcagcguucauaaauacagagca

SEQ ID NO: 3909696 - RNA, 15 nt, Shigella flexneri 2a str. 301
gcagcguuuccagcc

SEQ ID NO: 3909697 - RNA, 16 nt, Shigella flexneri 2a str. 301
gcagcguuuccagcca

SEQ ID NO: 3909698 - RNA, 20 nt, Shigella flexneri 2a str. 301
gcagcguuucgcgcgcgccu

SEQ ID NO: 3909699 - RNA, 15 nt, Shigella flexneri 2a str. 301
gcagcucacgcacga

SEQ ID NO: 3909700 - RNA, 13 nt, Shigella flexneri 2a str. 301
gcagcucaucaac

SEQ ID NO: 3909701 - RNA, 21 nt, Shigella flexneri 2a str. 301
gcagcuccaccgauuuugaga

SEQ ID NO: 3909702 - RNA, 12 nt, Shigella flexneri 2a str. 301
gcagcuccagcc

SEQ ID NO: 3909703 - RNA, 23 nt, Shigella flexneri 2a str. 301
gcagcuccaguuucuuuugcgcc

SEQ ID NO: 3909704 - RNA, 23 nt, Shigella flexneri 2a str. 301
gcagcucuggcauaacgccacgc

SEQ ID NO: 3909705 - RNA, 14 nt, Shigella flexneri 2a str. 301
gcagcugacuucca

SEQ ID NO: 3909706 - RNA, 18 nt, Shigella flexneri 2a str. 301
gcagcugcgcuucaauac

SEQ ID NO: 3909707 - RNA, 22 nt, Shigella flexneri 2a str. 301
gcagcugggcgagggcaaaccu

SEQ ID NO: 3909708 - RNA, 20 nt, Shigella flexneri 2a str. 301
gcagcugguguaacugcgcc

SEQ ID NO: 3909709 - RNA, 20 nt, Shigella flexneri 2a str. 301
gcagcuuaaucauaauguug

SEQ ID NO: 3909710 - RNA, 15 nt, Shigella flexneri 2a str. 301
gcagcuuaucuuuuu

SEQ ID NO: 3909711 - RNA, 18 nt, Shigella flexneri 2a str. 301
gcagcuuaucuuuuucgg

SEQ ID NO: 3909712 - RNA, 13 nt, Shigella flexneri 2a str. 301
gcagcuucacaaa

SEQ ID NO: 3909713 - RNA, 18 nt, Shigella flexneri 2a str. 301
gcagcuucacaaaggcuu

SEQ ID NO: 3909714 - RNA, 23 nt, Shigella flexneri 2a str. 301
gcagcuucacaaaggcuugcugc

SEQ ID NO: 3909715 - RNA, 22 nt, Shigella flexneri 2a str. 301
gcagcuucucgugaaacucacg

SEQ ID NO: 3909716 - RNA, 23 nt, Shigella flexneri 2a str. 301
gcagcuucucgugaaacucacgc

SEQ ID NO: 3909717 - RNA, 17 nt, Shigella flexneri 2a str. 301
gcagcuucuuauccagc

SEQ ID NO: 3909718 - RNA, 20 nt, Shigella flexneri 2a str. 301
gcagcuuucccuucaggcgu

SEQ ID NO: 3909719 - RNA, 14 nt, Shigella flexneri 2a str. 301
gcaggaaaaaagcg

SEQ ID NO: 3909720 - RNA, 20 nt, Shigella flexneri 2a str. 301
gcaggaaaacaauguucauc

SEQ ID NO: 3909721 - RNA, 20 nt, Shigella flexneri 2a str. 301
gcaggaaaagguaggccuga

SEQ ID NO: 3909722 - RNA, 18 nt, Shigella flexneri 2a str. 301
gcaggaaaaucagcauca

SEQ ID NO: 3909723 - RNA, 20 nt, Shigella flexneri 2a str. 301
gcaggaaauacguaggccug

SEQ ID NO: 3909724 - RNA, 21 nt, Shigella flexneri 2a str. 301
gcaggaaauuauggaucacca

SEQ ID NO: 3909725 - RNA, 20 nt, Shigella flexneri 2a str. 301
gcaggaacgauguaggccug

SEQ ID NO: 3909726 - RNA, 22 nt, Shigella flexneri 2a str. 301
gcaggaacugcucauaaacgcg

SEQ ID NO: 3909727 - RNA, 17 nt, Shigella flexneri 2a str. 301
gcaggaauaaucagcaa

SEQ ID NO: 3909728 - RNA, 15 nt, Shigella flexneri 2a str. 301
gcaggagcagcaggu

SEQ ID NO: 3909729 - RNA, 21 nt, Shigella flexneri 2a str. 301
gcaggagcagccccugcgcca

SEQ ID NO: 3909730 - RNA, 15 nt, Shigella flexneri 2a str. 301
gcaggagcgccgaau

SEQ ID NO: 3909731 - RNA, 20 nt, Shigella flexneri 2a str. 301
gcaggagcgguguaggccug

SEQ ID NO: 3909732 - RNA, 21 nt, Shigella flexneri 2a str. 301
gcaggagcgguguaggccuga

SEQ ID NO: 3909733 - RNA, 22 nt, Shigella flexneri 2a str. 301
gcaggaucgacugcaaaccaug

SEQ ID NO: 3909734 - RNA, 18 nt, Shigella flexneri 2a str. 301
gcaggaucuccagcuccc

SEQ ID NO: 3909735 - RNA, 21 nt, Shigella flexneri 2a str. 301
gcaggaucugacuggcgagau

SEQ ID NO: 3909736 - RNA, 16 nt, Shigella flexneri 2a str. 301
gcaggaugcagaaacc

SEQ ID NO: 3909737 - RNA, 18 nt, Shigella flexneri 2a str. 301
gcaggaugcagaaaccaa

SEQ ID NO: 3909738 - RNA, 20 nt, Shigella flexneri 2a str. 301
gcaggaugggcaacgcgcau

SEQ ID NO: 3909739 - RNA, 16 nt, Shigella flexneri 2a str. 301
gcaggauguuccggca

SEQ ID NO: 3909740 - RNA, 12 nt, Shigella flexneri 2a str. 301
gcaggauuaaua

SEQ ID NO: 3909741 - RNA, 15 nt, Shigella flexneri 2a str. 301
gcaggauuaauaaau

SEQ ID NO: 3909742 - RNA, 21 nt, Shigella flexneri 2a str. 301
gcaggcaggccuauugacgcu

SEQ ID NO: 3909743 - RNA, 15 nt, Shigella flexneri 2a str. 301
gcauacggguuuucc

SEQ ID NO: 3909744 - RNA, 16 nt, Shigella flexneri 2a str. 301
gcauacguuucaccag

SEQ ID NO: 3909745 - RNA, 18 nt, Shigella flexneri 2a str. 301
gcauacuuucaucaaacg

SEQ ID NO: 3909746 - RNA, 22 nt, Shigella flexneri 2a str. 301
gcauagagacuuuuccagccga

SEQ ID NO: 3909747 - RNA, 12 nt, Shigella flexneri 2a str. 301
gcauagcuggcg

SEQ ID NO: 3909748 - RNA, 17 nt, Shigella flexneri 2a str. 301
gcauagguugaaauaaa

SEQ ID NO: 3909749 - RNA, 14 nt, Shigella flexneri 2a str. 301
gcauauaaugcaac

SEQ ID NO: 3909750 - RNA, 19 nt, Shigella flexneri 2a str. 301
gcauauagccaaagcacca

SEQ ID NO: 3909751 - RNA, 17 nt, Shigella flexneri 2a str. 301
gcauauaggcgaacggc

SEQ ID NO: 3909752 - RNA, 16 nt, Shigella flexneri 2a str. 301
gcauauaguuuugcau

SEQ ID NO: 3909753 - RNA, 19 nt, Shigella flexneri 2a str. 301
gcauauccaccacccagcg

SEQ ID NO: 3909754 - RNA, 13 nt, Shigella flexneri 2a str. 301
gcauauccaggcu

SEQ ID NO: 3909755 - RNA, 12 nt, Shigella flexneri 2a str. 301
gcauauccucau

SEQ ID NO: 3909756 - RNA, 19 nt, Shigella flexneri 2a str. 301
gcauaucgguaaaugcuuu

SEQ ID NO: 3909757 - RNA, 16 nt, Shigella flexneri 2a str. 301
gcauaugacgaaagcg

SEQ ID NO: 3909758 - RNA, 14 nt, Shigella flexneri 2a str. 301
gcauaugcggugcg

SEQ ID NO: 3909759 - RNA, 16 nt, Shigella flexneri 2a str. 301
gcauaugcuuugccgu

SEQ ID NO: 3909760 - RNA, 21 nt, Shigella flexneri 2a str. 301
gcauauguuuacgcuggcgga

SEQ ID NO: 3909761 - RNA, 19 nt, Shigella flexneri 2a str. 301
gcaucaaccaacaccuguu

SEQ ID NO: 3909762 - RNA, 16 nt, Shigella flexneri 2a str. 301
gcaucaauaacccugg

SEQ ID NO: 3909763 - RNA, 14 nt, Shigella flexneri 2a str. 301
gcaucaauaaucaa

SEQ ID NO: 3909764 - RNA, 17 nt, Shigella flexneri 2a str. 301
gcaucaauaaucaacgc

SEQ ID NO: 3909765 - RNA, 12 nt, Shigella flexneri 2a str. 301
gcaucaaucuuu

SEQ ID NO: 3909766 - RNA, 15 nt, Shigella flexneri 2a str. 301
gcaucaaugccggac

SEQ ID NO: 3909767 - RNA, 22 nt, Shigella flexneri 2a str. 301
gcaucacauccggcaauauuca

SEQ ID NO: 3909768 - RNA, 17 nt, Shigella flexneri 2a str. 301
gcaucacaucgcuggug

SEQ ID NO: 3909769 - RNA, 12 nt, Shigella flexneri 2a str. 301
gcaucaccagac

SEQ ID NO: 3909770 - RNA, 17 nt, Shigella flexneri 2a str. 301
gcaucacgaauccgcac

SEQ ID NO: 3909771 - RNA, 19 nt, Shigella flexneri 2a str. 301
gcaucacuacaaccgggau

SEQ ID NO: 3909772 - RNA, 15 nt, Shigella flexneri 2a str. 301
gcaucacuuccagua

SEQ ID NO: 3909773 - RNA, 17 nt, Shigella flexneri 2a str. 301
gcaucagacauuauugc

SEQ ID NO: 3909774 - RNA, 16 nt, Shigella flexneri 2a str. 301
gcaucagcaacacgcu

SEQ ID NO: 3909775 - RNA, 22 nt, Shigella flexneri 2a str. 301
gcaucagcagaaucgcaaccag

SEQ ID NO: 3909776 - RNA, 16 nt, Shigella flexneri 2a str. 301
gcaucagccaacggcu

SEQ ID NO: 3909777 - RNA, 17 nt, Shigella flexneri 2a str. 301
gcaucagcccaaagcag

SEQ ID NO: 3909778 - RNA, 19 nt, Shigella flexneri 2a str. 301
gcaucagcccaaagcagag

SEQ ID NO: 3909779 - RNA, 14 nt, Shigella flexneri 2a str. 301
gcaucagcgccacc

SEQ ID NO: 3909780 - RNA, 17 nt, Shigella flexneri 2a str. 301
gcaucagcgccaccagc

SEQ ID NO: 3909781 - RNA, 20 nt, Shigella flexneri 2a str. 301
gcaucagcgccaccagcgcc

SEQ ID NO: 3909782 - RNA, 13 nt, Shigella flexneri 2a str. 301
gcaucaggcaaug

SEQ ID NO: 3909783 - RNA, 14 nt, Shigella flexneri 2a str. 301
gcaucaggcaaugg

SEQ ID NO: 3909784 - RNA, 18 nt, Shigella flexneri 2a str. 301
gcaucaggcaugaugcgc

SEQ ID NO: 3909785 - RNA, 23 nt, Shigella flexneri 2a str. 301
gcaucaggcguucgcggcggcac

SEQ ID NO: 3909786 - RNA, 16 nt, Shigella flexneri 2a str. 301
gcaucagggcgcuggc

SEQ ID NO: 3909787 - RNA, 22 nt, Shigella flexneri 2a str. 301
gcaucaguucggaaacagugcu

SEQ ID NO: 3909788 - RNA, 21 nt, Shigella flexneri 2a str. 301
gcaucaugcucagaugccuga

SEQ ID NO: 3909789 - RNA, 20 nt, Shigella flexneri 2a str. 301
gcaucauuacgcgggccugu

SEQ ID NO: 3909790 - RNA, 18 nt, Shigella flexneri 2a str. 301
gcauccaggccaaaagcu

SEQ ID NO: 3909791 - RNA, 15 nt, Shigella flexneri 2a str. 301
gcaucccaacucauu

SEQ ID NO: 3909792 - RNA, 15 nt, Shigella flexneri 2a str. 301
gcaucccagaaaaaa

SEQ ID NO: 3909793 - RNA, 21 nt, Shigella flexneri 2a str. 301
gcaucccauuucuccagcagu

SEQ ID NO: 3909794 - RNA, 16 nt, Shigella flexneri 2a str. 301
gcauccccgcccuucc

SEQ ID NO: 3909795 - RNA, 16 nt, Shigella flexneri 2a str. 301
gcaucccggcagcccc

SEQ ID NO: 3909796 - RNA, 22 nt, Shigella flexneri 2a str. 301
gcaucccggcagccccaaacag

SEQ ID NO: 3909797 - RNA, 19 nt, Shigella flexneri 2a str. 301
gcaucccgguaucaaagcg

SEQ ID NO: 3909798 - RNA, 21 nt, Shigella flexneri 2a str. 301
gcaucccgguaucaaagcgcc

SEQ ID NO: 3909799 - RNA, 14 nt, Shigella flexneri 2a str. 301
gcauccgacaucaa

SEQ ID NO: 3909800 - RNA, 15 nt, Shigella flexneri 2a str. 301
gcauccgacauugaa

SEQ ID NO: 3909801 - RNA, 18 nt, Shigella flexneri 2a str. 301
gcauccggcaaucggugc

SEQ ID NO: 3909802 - RNA, 19 nt, Shigella flexneri 2a str. 301
gcauccggcaaucggugca

SEQ ID NO: 3909803 - RNA, 21 nt, Shigella flexneri 2a str. 301
gcauccggcaauucucucuga

SEQ ID NO: 3909804 - RNA, 21 nt, Shigella flexneri 2a str. 301
gcauccggcaauugugauggu

SEQ ID NO: 3909805 - RNA, 13 nt, Shigella flexneri 2a str. 301
gcauccggcagga

SEQ ID NO: 3909806 - RNA, 20 nt, Shigella flexneri 2a str. 301
gcauccggcauaaacaaagc

SEQ ID NO: 3909807 - RNA, 14 nt, Shigella flexneri 2a str. 301
gcauccggcaucaa

SEQ ID NO: 3909808 - RNA, 14 nt, Shigella flexneri 2a str. 301
gcauccggcaugaa

SEQ ID NO: 3909809 - RNA, 20 nt, Shigella flexneri 2a str. 301
gcauccgggauggucagcgg

SEQ ID NO: 3909810 - RNA, 19 nt, Shigella flexneri 2a str. 301
gcauccggguacacgauaa

SEQ ID NO: 3909811 - RNA, 16 nt, Shigella flexneri 2a str. 301
gcauccgucgccgcuu

SEQ ID NO: 3909812 - RNA, 21 nt, Shigella flexneri 2a str. 301
gcauccgugguggcagccagc

SEQ ID NO: 3909813 - RNA, 18 nt, Shigella flexneri 2a str. 301
gcauccugaucguccugc

SEQ ID NO: 3909814 - RNA, 21 nt, Shigella flexneri 2a str. 301
gcauccuggcuguuacucaac

SEQ ID NO: 3909815 - RNA, 20 nt, Shigella flexneri 2a str. 301
gcauccuggggguucaucac

SEQ ID NO: 3909816 - RNA, 18 nt, Shigella flexneri 2a str. 301
gcaucgacaguuucaccu

SEQ ID NO: 3909817 - RNA, 13 nt, Shigella flexneri 2a str. 301
gcaucgaccagga

SEQ ID NO: 3909818 - RNA, 21 nt, Shigella flexneri 2a str. 301
gcaucgaugguugcccugcug

SEQ ID NO: 3909819 - RNA, 20 nt, Shigella flexneri 2a str. 301
gcaucgcaacaugcuggccu

SEQ ID NO: 3909820 - RNA, 14 nt, Shigella flexneri 2a str. 301
gcaucgcagcauca

SEQ ID NO: 3909821 - RNA, 16 nt, Shigella flexneri 2a str. 301
gcaucgcaucaggcaa

SEQ ID NO: 3909822 - RNA, 15 nt, Shigella flexneri 2a str. 301
gcaucgccaccguua

SEQ ID NO: 3909823 - RNA, 18 nt, Shigella flexneri 2a str. 301
gcaucgccaguuuugcca

SEQ ID NO: 3909824 - RNA, 20 nt, Shigella flexneri 2a str. 301
gcaucgccauaauaagcgcc

SEQ ID NO: 3909825 - RNA, 12 nt, Shigella flexneri 2a str. 301
gcaucgccgcua

SEQ ID NO: 3909826 - RNA, 20 nt, Shigella flexneri 2a str. 301
gcaucgccgggcuaaccgcu

SEQ ID NO: 3909827 - RNA, 23 nt, Shigella flexneri 2a str. 301
gcaucgcgacagugcauaaauac

SEQ ID NO: 3909828 - RNA, 18 nt, Shigella flexneri 2a str. 301
gcaucgcgaccaaucaca

SEQ ID NO: 3909829 - RNA, 23 nt, Shigella flexneri 2a str. 301
gcaucggcaaaacgguaguugaa

SEQ ID NO: 3909830 - RNA, 16 nt, Shigella flexneri 2a str. 301
gcaucggcaaaucgcu

SEQ ID NO: 3909831 - RNA, 23 nt, Shigella flexneri 2a str. 301
gcaucggcaaucacaucaccaua

SEQ ID NO: 3909832 - RNA, 15 nt, Shigella flexneri 2a str. 301
gcaucggcauggcga

SEQ ID NO: 3909833 - RNA, 17 nt, Shigella flexneri 2a str. 301
gcaucgggcagcaucgc

SEQ ID NO: 3909834 - RNA, 18 nt, Shigella flexneri 2a str. 301
gcaucguaguuuuugccc

SEQ ID NO: 3909835 - RNA, 22 nt, Shigella flexneri 2a str. 301
gcaucguauugguacauaacac

SEQ ID NO: 3909836 - RNA, 23 nt, Shigella flexneri 2a str. 301
gcaucguauugguacauaacaca

SEQ ID NO: 3909837 - RNA, 21 nt, Shigella flexneri 2a str. 301
gcaucguccgucgaaagccca

SEQ ID NO: 3909838 - RNA, 15 nt, Shigella flexneri 2a str. 301
gcaucgugaauuuua

SEQ ID NO: 3909839 - RNA, 15 nt, Shigella flexneri 2a str. 301
gcaucucaaucgcac

SEQ ID NO: 3909840 - RNA, 14 nt, Shigella flexneri 2a str. 301
gcaucucaccguug

SEQ ID NO: 3909841 - RNA, 16 nt, Shigella flexneri 2a str. 301
gcaucucauccaucaa

SEQ ID NO: 3909842 - RNA, 14 nt, Shigella flexneri 2a str. 301
gcaucuccugcaac

SEQ ID NO: 3909843 - RNA, 15 nt, Shigella flexneri 2a str. 301
gcauuuuuaucacgu

SEQ ID NO: 3909844 - RNA, 23 nt, Shigella flexneri 2a str. 301
gcauuuuuuccagguacuuuuga

SEQ ID NO: 3909845 - RNA, 13 nt, Shigella flexneri 2a str. 301
gccaaaaaaauaa

SEQ ID NO: 3909846 - RNA, 16 nt, Shigella flexneri 2a str. 301
gccaaaaaucgcaaau

SEQ ID NO: 3909847 - RNA, 20 nt, Shigella flexneri 2a str. 301
gccaaaauaacuuaauguca

SEQ ID NO: 3909848 - RNA, 11 nt, Shigella flexneri 2a str. 301
gccaaaaugcc

SEQ ID NO: 3909849 - RNA, 22 nt, Shigella flexneri 2a str. 301
gccaaaauugguuucagccgga

SEQ ID NO: 3909850 - RNA, 22 nt, Shigella flexneri 2a str. 301
gccaaacagaugaugcgucuca

SEQ ID NO: 3909851 - RNA, 12 nt, Shigella flexneri 2a str. 301
gccaaaccacgg

SEQ ID NO: 3909852 - RNA, 21 nt, Shigella flexneri 2a str. 301
gccaaacccaccagcugauga

SEQ ID NO: 3909853 - RNA, 22 nt, Shigella flexneri 2a str. 301
gccaaacuggaacugaaaggcg

SEQ ID NO: 3909854 - RNA, 17 nt, Shigella flexneri 2a str. 301
gccaaagaccaggaaac

SEQ ID NO: 3909855 - RNA, 13 nt, Shigella flexneri 2a str. 301
gccaaagcguuca

SEQ ID NO: 3909856 - RNA, 14 nt, Shigella flexneri 2a str. 301
gccaaauaaaaucc

SEQ ID NO: 3909857 - RNA, 21 nt, Shigella flexneri 2a str. 301
gccaaauauuucuuuaucacc

SEQ ID NO: 3909858 - RNA, 14 nt, Shigella flexneri 2a str. 301
gccaaaucauccag

SEQ ID NO: 3909859 - RNA, 19 nt, Shigella flexneri 2a str. 301
gccaaaucauccagaccgc

SEQ ID NO: 3909860 - RNA, 15 nt, Shigella flexneri 2a str. 301
gccaaauccagcgcc

SEQ ID NO: 3909861 - RNA, 17 nt, Shigella flexneri 2a str. 301
gccaaauccuuccagcu

SEQ ID NO: 3909862 - RNA, 23 nt, Shigella flexneri 2a str. 301
gccaaauccuuccagcuccagcc

SEQ ID NO: 3909863 - RNA, 18 nt, Shigella flexneri 2a str. 301
gccaaaugucaccagccg

SEQ ID NO: 3909864 - RNA, 18 nt, Shigella flexneri 2a str. 301
gccaaaugucagcugcca

SEQ ID NO: 3909865 - RNA, 14 nt, Shigella flexneri 2a str. 301
gccaacaaucucuu

SEQ ID NO: 3909866 - RNA, 15 nt, Shigella flexneri 2a str. 301
gccaacaaucucuuc

SEQ ID NO: 3909867 - RNA, 20 nt, Shigella flexneri 2a str. 301
gccaacagcgacaucaaauu

SEQ ID NO: 3909868 - RNA, 17 nt, Shigella flexneri 2a str. 301
gccaacccuucugcacg

SEQ ID NO: 3909869 - RNA, 19 nt, Shigella flexneri 2a str. 301
gccaacccuucugcacgcc

SEQ ID NO: 3909870 - RNA, 13 nt, Shigella flexneri 2a str. 301
gccaaccgcggca

SEQ ID NO: 3909871 - RNA, 16 nt, Shigella flexneri 2a str. 301
gccaaccugcugguca

SEQ ID NO: 3909872 - RNA, 15 nt, Shigella flexneri 2a str. 301
gccaacgauaauuca

SEQ ID NO: 3909873 - RNA, 13 nt, Shigella flexneri 2a str. 301
gccaacggcucaa

SEQ ID NO: 3909874 - RNA, 14 nt, Shigella flexneri 2a str. 301
gccaacguuucugg

SEQ ID NO: 3909875 - RNA, 12 nt, Shigella flexneri 2a str. 301
gccaacuggcau

SEQ ID NO: 3909876 - RNA, 13 nt, Shigella flexneri 2a str. 301
gccaagaaacacc

SEQ ID NO: 3909877 - RNA, 15 nt, Shigella flexneri 2a str. 301
gccaagaaacaccag

SEQ ID NO: 3909878 - RNA, 14 nt, Shigella flexneri 2a str. 301
gccaagaaagagcg

SEQ ID NO: 3909879 - RNA, 23 nt, Shigella flexneri 2a str. 301
gccaagaaagagcgucuggaaga

SEQ ID NO: 3909880 - RNA, 17 nt, Shigella flexneri 2a str. 301
gccaagcaccgcauuga

SEQ ID NO: 3909881 - RNA, 20 nt, Shigella flexneri 2a str. 301
gccaagcgccgccucagcca

SEQ ID NO: 3909882 - RNA, 16 nt, Shigella flexneri 2a str. 301
gccaauaaaugccacc

SEQ ID NO: 3909883 - RNA, 17 nt, Shigella flexneri 2a str. 301
gccaauaaaugccacca

SEQ ID NO: 3909884 - RNA, 18 nt, Shigella flexneri 2a str. 301
gccaauaaucgcgcuaau

SEQ ID NO: 3909885 - RNA, 20 nt, Shigella flexneri 2a str. 301
gccaauacccguccacacgg

SEQ ID NO: 3909886 - RNA, 19 nt, Shigella flexneri 2a str. 301
gccaauaucaaucuucucu

SEQ ID NO: 3909887 - RNA, 17 nt, Shigella flexneri 2a str. 301
gccaaucacucaccugc

SEQ ID NO: 3909888 - RNA, 18 nt, Shigella flexneri 2a str. 301
gccaaucagcagaaccgc

SEQ ID NO: 3909889 - RNA, 18 nt, Shigella flexneri 2a str. 301
gccaauccccagaccugc

SEQ ID NO: 3909890 - RNA, 18 nt, Shigella flexneri 2a str. 301
gccaaugcaggcaucggu

SEQ ID NO: 3909891 - RNA, 23 nt, Shigella flexneri 2a str. 301
gccaauguguuuauaagccaugu

SEQ ID NO: 3909892 - RNA, 13 nt, Shigella flexneri 2a str. 301
gccaauucccagc

SEQ ID NO: 3909893 - RNA, 13 nt, Shigella flexneri 2a str. 301
gccaauuuggcug

SEQ ID NO: 3909894 - RNA, 23 nt, Shigella flexneri 2a str. 301
gccacaaaccuuaaauggcccuu

SEQ ID NO: 3909895 - RNA, 17 nt, Shigella flexneri 2a str. 301
gccacaaagcagggcug

SEQ ID NO: 3909896 - RNA, 13 nt, Shigella flexneri 2a str. 301
gccacaacuucaa

SEQ ID NO: 3909897 - RNA, 14 nt, Shigella flexneri 2a str. 301
gccacaacuucaac

SEQ ID NO: 3909898 - RNA, 15 nt, Shigella flexneri 2a str. 301
gccacaauaaacgcg

SEQ ID NO: 3909899 - RNA, 19 nt, Shigella flexneri 2a str. 301
gccacaauacugaucauca

SEQ ID NO: 3909900 - RNA, 21 nt, Shigella flexneri 2a str. 301
gccacaccgaggcauucagcc

SEQ ID NO: 3909901 - RNA, 22 nt, Shigella flexneri 2a str. 301
gccacacgagucauuccggccc

SEQ ID NO: 3909902 - RNA, 21 nt, Shigella flexneri 2a str. 301
gccacagauaauaauguguuc

SEQ ID NO: 3909903 - RNA, 14 nt, Shigella flexneri 2a str. 301
gccacagccgagcg

SEQ ID NO: 3909904 - RNA, 19 nt, Shigella flexneri 2a str. 301
gccacagccgagcgccacc

SEQ ID NO: 3909905 - RNA, 16 nt, Shigella flexneri 2a str. 301
gccacagcgccagaca

SEQ ID NO: 3909906 - RNA, 20 nt, Shigella flexneri 2a str. 301
gccacagcgccagacacugg

SEQ ID NO: 3909907 - RNA, 17 nt, Shigella flexneri 2a str. 301
gccacaggcuuuccuga

SEQ ID NO: 3909908 - RNA, 19 nt, Shigella flexneri 2a str. 301
gccacagggugaucaccag

SEQ ID NO: 3909909 - RNA, 14 nt, Shigella flexneri 2a str. 301
gccacaggucagca

SEQ ID NO: 3909910 - RNA, 15 nt, Shigella flexneri 2a str. 301
gccacaggucagcag

SEQ ID NO: 3909911 - RNA, 22 nt, Shigella flexneri 2a str. 301
gccacaguucgaggaucgcggg

SEQ ID NO: 3909912 - RNA, 20 nt, Shigella flexneri 2a str. 301
gccacaguuuuacugcagcc

SEQ ID NO: 3909913 - RNA, 18 nt, Shigella flexneri 2a str. 301
gccacauaugaucggaag

SEQ ID NO: 3909914 - RNA, 21 nt, Shigella flexneri 2a str. 301
gccacauccgcgguaucgccg

SEQ ID NO: 3909915 - RNA, 12 nt, Shigella flexneri 2a str. 301
gccacauccggc

SEQ ID NO: 3909916 - RNA, 13 nt, Shigella flexneri 2a str. 301
gccacauccggcu

SEQ ID NO: 3909917 - RNA, 18 nt, Shigella flexneri 2a str. 301
gccacauuagauaaaaau

SEQ ID NO: 3909918 - RNA, 22 nt, Shigella flexneri 2a str. 301
gccaccaauaaugaacgccacc

SEQ ID NO: 3909919 - RNA, 22 nt, Shigella flexneri 2a str. 301
gccaccacaauugaccaguaau

SEQ ID NO: 3909920 - RNA, 13 nt, Shigella flexneri 2a str. 301
gccaccacaccgg

SEQ ID NO: 3909921 - RNA, 22 nt, Shigella flexneri 2a str. 301
gccaccacaccggaccagacga

SEQ ID NO: 3909922 - RNA, 13 nt, Shigella flexneri 2a str. 301
gccaccaccagcg

SEQ ID NO: 3909923 - RNA, 15 nt, Shigella flexneri 2a str. 301
gccaccacuugcagc

SEQ ID NO: 3909924 - RNA, 23 nt, Shigella flexneri 2a str. 301
gccaccagcgguuuuugcgccau

SEQ ID NO: 3909925 - RNA, 18 nt, Shigella flexneri 2a str. 301
gccaccagcgucagaaac

SEQ ID NO: 3909926 - RNA, 16 nt, Shigella flexneri 2a str. 301
gccaccagggauaaag

SEQ ID NO: 3909927 - RNA, 17 nt, Shigella flexneri 2a str. 301
gccaccagguucaacag

SEQ ID NO: 3909928 - RNA, 17 nt, Shigella flexneri 2a str. 301
gccaccagugcaggcac

SEQ ID NO: 3909929 - RNA, 18 nt, Shigella flexneri 2a str. 301
gccaccagugcaggcacc

SEQ ID NO: 3909930 - RNA, 15 nt, Shigella flexneri 2a str. 301
gccaccccacaccag

SEQ ID NO: 3909931 - RNA, 15 nt, Shigella flexneri 2a str. 301
gccacccgaucgcuc

SEQ ID NO: 3909932 - RNA, 13 nt, Shigella flexneri 2a str. 301
gccacccugcggc

SEQ ID NO: 3909933 - RNA, 18 nt, Shigella flexneri 2a str. 301
gccaccgaccaggcaaac

SEQ ID NO: 3909934 - RNA, 17 nt, Shigella flexneri 2a str. 301
gccaccgcacgcaggcc

SEQ ID NO: 3909935 - RNA, 15 nt, Shigella flexneri 2a str. 301
gccaccgcccagaga

SEQ ID NO: 3909936 - RNA, 17 nt, Shigella flexneri 2a str. 301
gccaccgcccagagaau

SEQ ID NO: 3909937 - RNA, 12 nt, Shigella flexneri 2a str. 301
gccaccgcgcca

SEQ ID NO: 3909938 - RNA, 14 nt, Shigella flexneri 2a str. 301
gccaccgcgcguuu

SEQ ID NO: 3909939 - RNA, 23 nt, Shigella flexneri 2a str. 301
gccaccgcgcguuugaucgacag

SEQ ID NO: 3909940 - RNA, 18 nt, Shigella flexneri 2a str. 301
gccaccggcaaucugcug

SEQ ID NO: 3909941 - RNA, 13 nt, Shigella flexneri 2a str. 301
gccaccugaucca

SEQ ID NO: 3909942 - RNA, 14 nt, Shigella flexneri 2a str. 301
gccaccugccggag

SEQ ID NO: 3909943 - RNA, 16 nt, Shigella flexneri 2a str. 301
gccagccauucaaucu

SEQ ID NO: 3909944 - RNA, 16 nt, Shigella flexneri 2a str. 301
gccagccccagcguca

SEQ ID NO: 3909945 - RNA, 19 nt, Shigella flexneri 2a str. 301
gccagcccuuuggcuguca

SEQ ID NO: 3909946 - RNA, 17 nt, Shigella flexneri 2a str. 301
gccagccgaacagcgcc

SEQ ID NO: 3909947 - RNA, 20 nt, Shigella flexneri 2a str. 301
gccagccgccgcuaucggca

SEQ ID NO: 3909948 - RNA, 22 nt, Shigella flexneri 2a str. 301
gccagccgcuaacuuccugcug

SEQ ID NO: 3909949 - RNA, 14 nt, Shigella flexneri 2a str. 301
gccagccucaucca

SEQ ID NO: 3909950 - RNA, 15 nt, Shigella flexneri 2a str. 301
gccagccucauccau

SEQ ID NO: 3909951 - RNA, 11 nt, Shigella flexneri 2a str. 301
gccagccuccc

SEQ ID NO: 3909952 - RNA, 15 nt, Shigella flexneri 2a str. 301
gccagccucccagcc

SEQ ID NO: 3909953 - RNA, 13 nt, Shigella flexneri 2a str. 301
gccagccuucacg

SEQ ID NO: 3909954 - RNA, 15 nt, Shigella flexneri 2a str. 301
gccagcgaagccagc

SEQ ID NO: 3909955 - RNA, 16 nt, Shigella flexneri 2a str. 301
gccagcgaagccagcu

SEQ ID NO: 3909956 - RNA, 21 nt, Shigella flexneri 2a str. 301
gccagcgauuuugccagccgc

SEQ ID NO: 3909957 - RNA, 14 nt, Shigella flexneri 2a str. 301
gccagcgcaccagc

SEQ ID NO: 3909958 - RNA, 20 nt, Shigella flexneri 2a str. 301
gccagcgccaguuuuuguuu

SEQ ID NO: 3909959 - RNA, 17 nt, Shigella flexneri 2a str. 301
gccagcgccgacagcag

SEQ ID NO: 3909960 - RNA, 18 nt, Shigella flexneri 2a str. 301
gccagcgcgaugcaggcc

SEQ ID NO: 3909961 - RNA, 10 nt, Shigella flexneri 2a str. 301
gccagcggcg

SEQ ID NO: 3909962 - RNA, 19 nt, Shigella flexneri 2a str. 301
gccagcggcguucgcguaa

SEQ ID NO: 3909963 - RNA, 16 nt, Shigella flexneri 2a str. 301
gccagcggguucccgg

SEQ ID NO: 3909964 - RNA, 18 nt, Shigella flexneri 2a str. 301
gccagcguaaauccugac

SEQ ID NO: 3909965 - RNA, 22 nt, Shigella flexneri 2a str. 301
gccagcguaccaugauccugca

SEQ ID NO: 3909966 - RNA, 15 nt, Shigella flexneri 2a str. 301
gccagcgucacccag

SEQ ID NO: 3909967 - RNA, 17 nt, Shigella flexneri 2a str. 301
gccagcgucaucauaga

SEQ ID NO: 3909968 - RNA, 22 nt, Shigella flexneri 2a str. 301
gccagcgucaucauagacuucc

SEQ ID NO: 3909969 - RNA, 18 nt, Shigella flexneri 2a str. 301
gccagcgucgcacccggc

SEQ ID NO: 3909970 - RNA, 15 nt, Shigella flexneri 2a str. 301
gccagcgucugagca

SEQ ID NO: 3909971 - RNA, 20 nt, Shigella flexneri 2a str. 301
gccagcucaaccuguggugc

SEQ ID NO: 3909972 - RNA, 17 nt, Shigella flexneri 2a str. 301
gccagcucuuuaaacac

SEQ ID NO: 3909973 - RNA, 11 nt, Shigella flexneri 2a str. 301
gccagcuuagu

SEQ ID NO: 3909974 - RNA, 22 nt, Shigella flexneri 2a str. 301
gccagcuucgcuucccaacgca

SEQ ID NO: 3909975 - RNA, 15 nt, Shigella flexneri 2a str. 301
gccagcuugccgcgc

SEQ ID NO: 3909976 - RNA, 21 nt, Shigella flexneri 2a str. 301
gccagcuugcgauccugcaga

SEQ ID NO: 3909977 - RNA, 23 nt, Shigella flexneri 2a str. 301
gccaggaaccaccgaugcacagc

SEQ ID NO: 3909978 - RNA, 22 nt, Shigella flexneri 2a str. 301
gccaggaaccugugacagcagc

SEQ ID NO: 3909979 - RNA, 17 nt, Shigella flexneri 2a str. 301
gccaggacgcaguccag

SEQ ID NO: 3909980 - RNA, 24 nt, Shigella flexneri 2a str. 301
gccaggauucauuugcaucaacga

SEQ ID NO: 3909981 - RNA, 23 nt, Shigella flexneri 2a str. 301
gccaggcaacgaaaggugaagug

SEQ ID NO: 3909982 - RNA, 16 nt, Shigella flexneri 2a str. 301
gccaggcacgccgcgc

SEQ ID NO: 3909983 - RNA, 19 nt, Shigella flexneri 2a str. 301
gccaggcagagcucaacca

SEQ ID NO: 3909984 - RNA, 16 nt, Shigella flexneri 2a str. 301
gccaggcaucgaugga

SEQ ID NO: 3909985 - RNA, 20 nt, Shigella flexneri 2a str. 301
gccaggcuuuccgucagcgg

SEQ ID NO: 3909986 - RNA, 21 nt, Shigella flexneri 2a str. 301
gccaggcuuuccgucagcggc

SEQ ID NO: 3909987 - RNA, 23 nt, Shigella flexneri 2a str. 301
gccagguauucaugcccgcgcaa

SEQ ID NO: 3909988 - RNA, 17 nt, Shigella flexneri 2a str. 301
gccaggucgugccagaa

SEQ ID NO: 3909989 - RNA, 19 nt, Shigella flexneri 2a str. 301
gccaggugauacguccacc

SEQ ID NO: 3909990 - RNA, 14 nt, Shigella flexneri 2a str. 301
gccaggugcagccc

SEQ ID NO: 3909991 - RNA, 19 nt, Shigella flexneri 2a str. 301
gccagguguugauccacgg

SEQ ID NO: 3909992 - RNA, 17 nt, Shigella flexneri 2a str. 301
gccagguuuaccagcag

SEQ ID NO: 3909993 - RNA, 20 nt, Shigella flexneri 2a str. 301
gccagguuucauagcguccc

SEQ ID NO: 3909994 - RNA, 20 nt, Shigella flexneri 2a str. 301
gccagguuuucuuucaccuc

SEQ ID NO: 3909995 - RNA, 16 nt, Shigella flexneri 2a str. 301
gccaguaaauuuauca

SEQ ID NO: 3909996 - RNA, 21 nt, Shigella flexneri 2a str. 301
gccaguaaauuuaucaaugca

SEQ ID NO: 3909997 - RNA, 23 nt, Shigella flexneri 2a str. 301
gccaguaacagaacgcauaacag

SEQ ID NO: 3909998 - RNA, 14 nt, Shigella flexneri 2a str. 301
gccaguaacucauu

SEQ ID NO: 3909999 - RNA, 20 nt, Shigella flexneri 2a str. 301
gccaguaagacaccccacag

SEQ ID NO: 3910000 - RNA, 22 nt, Shigella flexneri 2a str. 301
gccaguaagacaccccacagcu

SEQ ID NO: 3910001 - RNA, 12 nt, Shigella flexneri 2a str. 301
gccaguaagcag

SEQ ID NO: 3910002 - RNA, 15 nt, Shigella flexneri 2a str. 301
gccaguaagcagucc

SEQ ID NO: 3910003 - RNA, 16 nt, Shigella flexneri 2a str. 301
gccaguaagcagucca

SEQ ID NO: 3910004 - RNA, 20 nt, Shigella flexneri 2a str. 301
gccaguaaucggcugaacgu

SEQ ID NO: 3910005 - RNA, 16 nt, Shigella flexneri 2a str. 301
gccaguaaucuggcca

SEQ ID NO: 3910006 - RNA, 20 nt, Shigella flexneri 2a str. 301
gccaguaaucuggccaaugc

SEQ ID NO: 3910007 - RNA, 14 nt, Shigella flexneri 2a str. 301
gccaguaccagcag

SEQ ID NO: 3910008 - RNA, 15 nt, Shigella flexneri 2a str. 301
gccaguaccagcagc

SEQ ID NO: 3910009 - RNA, 16 nt, Shigella flexneri 2a str. 301
gccaguacgcgcccgu

SEQ ID NO: 3910010 - RNA, 17 nt, Shigella flexneri 2a str. 301
gccagucaguuaagcaa

SEQ ID NO: 3910011 - RNA, 20 nt, Shigella flexneri 2a str. 301
gccagucgcacacaacagac

SEQ ID NO: 3910012 - RNA, 23 nt, Shigella flexneri 2a str. 301
gccagugaccaccgucccaguaa

SEQ ID NO: 3910013 - RNA, 22 nt, Shigella flexneri 2a str. 301
gccagugagugaaauuuugggc

SEQ ID NO: 3910014 - RNA, 21 nt, Shigella flexneri 2a str. 301
gccagugauugcuugccccuu

SEQ ID NO: 3910015 - RNA, 15 nt, Shigella flexneri 2a str. 301
gccagugccaaagcc

SEQ ID NO: 3910016 - RNA, 16 nt, Shigella flexneri 2a str. 301
gccagugccaaagcca

SEQ ID NO: 3910017 - RNA, 17 nt, Shigella flexneri 2a str. 301
gccagugccacacgcuc

SEQ ID NO: 3910018 - RNA, 17 nt, Shigella flexneri 2a str. 301
gccagugccgcccacca

SEQ ID NO: 3910019 - RNA, 16 nt, Shigella flexneri 2a str. 301
gccaguguuaaccaga

SEQ ID NO: 3910020 - RNA, 22 nt, Shigella flexneri 2a str. 301
gccaguguuaaccagauaagcc

SEQ ID NO: 3910021 - RNA, 20 nt, Shigella flexneri 2a str. 301
gccaguguuucgacaauaau

SEQ ID NO: 3910022 - RNA, 15 nt, Shigella flexneri 2a str. 301
gccaguuacugccac

SEQ ID NO: 3910023 - RNA, 14 nt, Shigella flexneri 2a str. 301
gccaguuacugcug

SEQ ID NO: 3910024 - RNA, 19 nt, Shigella flexneri 2a str. 301
gccaguuacugcugacgcu

SEQ ID NO: 3910025 - RNA, 12 nt, Shigella flexneri 2a str. 301
gccaguuauugg

SEQ ID NO: 3910026 - RNA, 14 nt, Shigella flexneri 2a str. 301
gccaguucccccug

SEQ ID NO: 3910027 - RNA, 14 nt, Shigella flexneri 2a str. 301
gccaguuccgccgg

SEQ ID NO: 3910028 - RNA, 22 nt, Shigella flexneri 2a str. 301
gccaguucggaugugaaccuca

SEQ ID NO: 3910029 - RNA, 14 nt, Shigella flexneri 2a str. 301
gccaguucucacca

SEQ ID NO: 3910030 - RNA, 23 nt, Shigella flexneri 2a str. 301
gccaguuguugauaagccccagu

SEQ ID NO: 3910031 - RNA, 22 nt, Shigella flexneri 2a str. 301
gccaguuuacugucugcuucug

SEQ ID NO: 3910032 - RNA, 20 nt, Shigella flexneri 2a str. 301
gccaguuugacaucgucagg

SEQ ID NO: 3910033 - RNA, 17 nt, Shigella flexneri 2a str. 301
gccaguuugcgcgugcu

SEQ ID NO: 3910034 - RNA, 22 nt, Shigella flexneri 2a str. 301
gccaguuuuucagcgccagcgc

SEQ ID NO: 3910035 - RNA, 19 nt, Shigella flexneri 2a str. 301
gccauaaagaaaucaccug

SEQ ID NO: 3910036 - RNA, 21 nt, Shigella flexneri 2a str. 301
gccauaaccccaccagcauga

SEQ ID NO: 3910037 - RNA, 16 nt, Shigella flexneri 2a str. 301
gccauaacgcgucuca

SEQ ID NO: 3910038 - RNA, 19 nt, Shigella flexneri 2a str. 301
gccauaauaaucaucacgc

SEQ ID NO: 3910039 - RNA, 19 nt, Shigella flexneri 2a str. 301
gccauaccaugcaccaacc

SEQ ID NO: 3910040 - RNA, 13 nt, Shigella flexneri 2a str. 301
gccauauaaauuu

SEQ ID NO: 3910041 - RNA, 19 nt, Shigella flexneri 2a str. 301
gccauaucguucugccaga

SEQ ID NO: 3910042 - RNA, 16 nt, Shigella flexneri 2a str. 301
gcccagccuuuccugc

SEQ ID NO: 3910043 - RNA, 17 nt, Shigella flexneri 2a str. 301
gcccagccuuuccugca

SEQ ID NO: 3910044 - RNA, 13 nt, Shigella flexneri 2a str. 301
gcccagcgcagga

SEQ ID NO: 3910045 - RNA, 17 nt, Shigella flexneri 2a str. 301
gcccagcgcaucaggca

SEQ ID NO: 3910046 - RNA, 19 nt, Shigella flexneri 2a str. 301
gcccagcgcaucaggcaau

SEQ ID NO: 3910047 - RNA, 16 nt, Shigella flexneri 2a str. 301
gcccagcgcgccgcca

SEQ ID NO: 3910048 - RNA, 22 nt, Shigella flexneri 2a str. 301
gcccagcgcguaaauaucggca

SEQ ID NO: 3910049 - RNA, 13 nt, Shigella flexneri 2a str. 301
gcccagcgcuuca

SEQ ID NO: 3910050 - RNA, 22 nt, Shigella flexneri 2a str. 301
gcccagcgucagcauaaaaaua

SEQ ID NO: 3910051 - RNA, 15 nt, Shigella flexneri 2a str. 301
gcccagucacggcuu

SEQ ID NO: 3910052 - RNA, 14 nt, Shigella flexneri 2a str. 301
gcccagugccagca

SEQ ID NO: 3910053 - RNA, 15 nt, Shigella flexneri 2a str. 301
gcccagugccagcac

SEQ ID NO: 3910054 - RNA, 15 nt, Shigella flexneri 2a str. 301
gcccagugccgagag

SEQ ID NO: 3910055 - RNA, 21 nt, Shigella flexneri 2a str. 301
gcccaguuagacgugcgaaug

SEQ ID NO: 3910056 - RNA, 14 nt, Shigella flexneri 2a str. 301
gcccauaccacagc

SEQ ID NO: 3910057 - RNA, 21 nt, Shigella flexneri 2a str. 301
gcccaucacaauggcacaaau

SEQ ID NO: 3910058 - RNA, 14 nt, Shigella flexneri 2a str. 301
gcccaucagcaucc

SEQ ID NO: 3910059 - RNA, 19 nt, Shigella flexneri 2a str. 301
gcccaucagcaucccaccu

SEQ ID NO: 3910060 - RNA, 14 nt, Shigella flexneri 2a str. 301
gcccaucaucaucg

SEQ ID NO: 3910061 - RNA, 15 nt, Shigella flexneri 2a str. 301
gcccaucaucuggcu

SEQ ID NO: 3910062 - RNA, 14 nt, Shigella flexneri 2a str. 301
gcccaucaugcgcc

SEQ ID NO: 3910063 - RNA, 18 nt, Shigella flexneri 2a str. 301
gcccaucaugcgccaggu

SEQ ID NO: 3910064 - RNA, 17 nt, Shigella flexneri 2a str. 301
gcccauccuucugugga

SEQ ID NO: 3910065 - RNA, 21 nt, Shigella flexneri 2a str. 301
gcccaucgccacgccuguacc

SEQ ID NO: 3910066 - RNA, 18 nt, Shigella flexneri 2a str. 301
gcccaucgcgcccgccgc

SEQ ID NO: 3910067 - RNA, 20 nt, Shigella flexneri 2a str. 301
gcccaucgcgcccgccgcca

SEQ ID NO: 3910068 - RNA, 16 nt, Shigella flexneri 2a str. 301
gcccaugaaucagcaa

SEQ ID NO: 3910069 - RNA, 22 nt, Shigella flexneri 2a str. 301
gcccaugcguugucgccaucca

SEQ ID NO: 3910070 - RNA, 19 nt, Shigella flexneri 2a str. 301
gcccauuauugacagaccg

SEQ ID NO: 3910071 - RNA, 16 nt, Shigella flexneri 2a str. 301
gcccauuccaguaauu

SEQ ID NO: 3910072 - RNA, 13 nt, Shigella flexneri 2a str. 301
gcccauuuugcca

SEQ ID NO: 3910073 - RNA, 23 nt, Shigella flexneri 2a str. 301
gccccaaugcguuccagcauguu

SEQ ID NO: 3910074 - RNA, 14 nt, Shigella flexneri 2a str. 301
gccccacagaccca

SEQ ID NO: 3910075 - RNA, 16 nt, Shigella flexneri 2a str. 301
gccccacagacccagg

SEQ ID NO: 3910076 - RNA, 14 nt, Shigella flexneri 2a str. 301
gccccaccagcaaa

SEQ ID NO: 3910077 - RNA, 16 nt, Shigella flexneri 2a str. 301
gccccaccagcaaaua

SEQ ID NO: 3910078 - RNA, 17 nt, Shigella flexneri 2a str. 301
gccccagaauuuucucu

SEQ ID NO: 3910079 - RNA, 13 nt, Shigella flexneri 2a str. 301
gccccagacacag

SEQ ID NO: 3910080 - RNA, 16 nt, Shigella flexneri 2a str. 301
gccccagauugccgau

SEQ ID NO: 3910081 - RNA, 15 nt, Shigella flexneri 2a str. 301
gccccagcaggaugu

SEQ ID NO: 3910082 - RNA, 22 nt, Shigella flexneri 2a str. 301
gccccagcaggauguuccggca

SEQ ID NO: 3910083 - RNA, 14 nt, Shigella flexneri 2a str. 301
gccccagccuacag

SEQ ID NO: 3910084 - RNA, 19 nt, Shigella flexneri 2a str. 301
gccccagcgucagcaucau

SEQ ID NO: 3910085 - RNA, 20 nt, Shigella flexneri 2a str. 301
gccccagcuugucauacgga

SEQ ID NO: 3910086 - RNA, 16 nt, Shigella flexneri 2a str. 301
gccccaucaacgccau

SEQ ID NO: 3910087 - RNA, 20 nt, Shigella flexneri 2a str. 301
gccccaucgaaccaucggcu

SEQ ID NO: 3910088 - RNA, 15 nt, Shigella flexneri 2a str. 301
gcccccgggccuccc

SEQ ID NO: 3910089 - RNA, 21 nt, Shigella flexneri 2a str. 301
gcccccucacaugaguugcug

SEQ ID NO: 3910090 - RNA, 15 nt, Shigella flexneri 2a str. 301
gccccgagaaaaaua

SEQ ID NO: 3910091 - RNA, 21 nt, Shigella flexneri 2a str. 301
gccccgaugccaucauggcga

SEQ ID NO: 3910092 - RNA, 17 nt, Shigella flexneri 2a str. 301
gccccgcucgcuggugc

SEQ ID NO: 3910093 - RNA, 23 nt, Shigella flexneri 2a str. 301
gccccgcuguuugaaauugugau

SEQ ID NO: 3910094 - RNA, 18 nt, Shigella flexneri 2a str. 301
gccccggcaaaugacgau

SEQ ID NO: 3910095 - RNA, 15 nt, Shigella flexneri 2a str. 301
gccccggcacuuaau

SEQ ID NO: 3910096 - RNA, 16 nt, Shigella flexneri 2a str. 301
gccccgguuucucuuc

SEQ ID NO: 3910097 - RNA, 20 nt, Shigella flexneri 2a str. 301
gccccugaucggccaugaua

SEQ ID NO: 3910098 - RNA, 21 nt, Shigella flexneri 2a str. 301
gccccuggaaaaagugcccca

SEQ ID NO: 3910099 - RNA, 21 nt, Shigella flexneri 2a str. 301
gccccuguugaaaucgggcag

SEQ ID NO: 3910100 - RNA, 17 nt, Shigella flexneri 2a str. 301
gcccgaaugcagcucca

SEQ ID NO: 3910101 - RNA, 16 nt, Shigella flexneri 2a str. 301
gcccgacaaagcauga

SEQ ID NO: 3910102 - RNA, 14 nt, Shigella flexneri 2a str. 301
gcccgacgaggcgc

SEQ ID NO: 3910103 - RNA, 21 nt, Shigella flexneri 2a str. 301
gcccgacgaggcgcuggcgca

SEQ ID NO: 3910104 - RNA, 18 nt, Shigella flexneri 2a str. 301
gcccgacgauaccgccgc

SEQ ID NO: 3910105 - RNA, 18 nt, Shigella flexneri 2a str. 301
gcccgacuugagcgcagu

SEQ ID NO: 3910106 - RNA, 17 nt, Shigella flexneri 2a str. 301
gcccgagauacaucacc

SEQ ID NO: 3910107 - RNA, 12 nt, Shigella flexneri 2a str. 301
gcccgagcgcca

SEQ ID NO: 3910108 - RNA, 21 nt, Shigella flexneri 2a str. 301
gcccgauacgcuugcgcaucg

SEQ ID NO: 3910109 - RNA, 20 nt, Shigella flexneri 2a str. 301
gcccgauagaaaccaugucc

SEQ ID NO: 3910110 - RNA, 14 nt, Shigella flexneri 2a str. 301
gcccgaugaccuug

SEQ ID NO: 3910111 - RNA, 20 nt, Shigella flexneri 2a str. 301
gcccgauggcaucaccaucg

SEQ ID NO: 3910112 - RNA, 18 nt, Shigella flexneri 2a str. 301
gcccgauuaacuggggca

SEQ ID NO: 3910113 - RNA, 13 nt, Shigella flexneri 2a str. 301
gcccgauucacau

SEQ ID NO: 3910114 - RNA, 19 nt, Shigella flexneri 2a str. 301
gcccgcacaaagcacgcug

SEQ ID NO: 3910115 - RNA, 19 nt, Shigella flexneri 2a str. 301
gcccgcagccaucacugac

SEQ ID NO: 3910116 - RNA, 16 nt, Shigella flexneri 2a str. 301
gcccgcauagagaaaa

SEQ ID NO: 3910117 - RNA, 18 nt, Shigella flexneri 2a str. 301
gcccgccaaccaccgcca

SEQ ID NO: 3910118 - RNA, 13 nt, Shigella flexneri 2a str. 301
gcccgccagcacc

SEQ ID NO: 3910119 - RNA, 14 nt, Shigella flexneri 2a str. 301
gcccgccagcaccg

SEQ ID NO: 3910120 - RNA, 15 nt, Shigella flexneri 2a str. 301
gcccgccagcaccgg

SEQ ID NO: 3910121 - RNA, 13 nt, Shigella flexneri 2a str. 301
gcccgccagcauc

SEQ ID NO: 3910122 - RNA, 14 nt, Shigella flexneri 2a str. 301
gcccgcccccgggc

SEQ ID NO: 3910123 - RNA, 17 nt, Shigella flexneri 2a str. 301
gcccgcccccgggccuc

SEQ ID NO: 3910124 - RNA, 13 nt, Shigella flexneri 2a str. 301
gcccgccgccauu

SEQ ID NO: 3910125 - RNA, 14 nt, Shigella flexneri 2a str. 301
gcccgccgcugguu

SEQ ID NO: 3910126 - RNA, 13 nt, Shigella flexneri 2a str. 301
gcccgcgcguuaa

SEQ ID NO: 3910127 - RNA, 17 nt, Shigella flexneri 2a str. 301
gcccgcgcugucgggca

SEQ ID NO: 3910128 - RNA, 22 nt, Shigella flexneri 2a str. 301
gcccgcgggcgaauuaucggca

SEQ ID NO: 3910129 - RNA, 20 nt, Shigella flexneri 2a str. 301
gcccgcgucguucaucgcaa

SEQ ID NO: 3910130 - RNA, 16 nt, Shigella flexneri 2a str. 301
gcccgcguuaccggca

SEQ ID NO: 3910131 - RNA, 15 nt, Shigella flexneri 2a str. 301
gcccgcugccgcaga

SEQ ID NO: 3910132 - RNA, 17 nt, Shigella flexneri 2a str. 301
gcccgcuucaucgugcu

SEQ ID NO: 3910133 - RNA, 17 nt, Shigella flexneri 2a str. 301
gcccgcuuucaccaucg

SEQ ID NO: 3910134 - RNA, 15 nt, Shigella flexneri 2a str. 301
gcccggaauggugcu

SEQ ID NO: 3910135 - RNA, 18 nt, Shigella flexneri 2a str. 301
gcccggaauggugcuggu

SEQ ID NO: 3910136 - RNA, 15 nt, Shigella flexneri 2a str. 301
gcccggacuagcgcu

SEQ ID NO: 3910137 - RNA, 16 nt, Shigella flexneri 2a str. 301
gcccggagcagcaguc

SEQ ID NO: 3910138 - RNA, 13 nt, Shigella flexneri 2a str. 301
gcccggaggaugc

SEQ ID NO: 3910139 - RNA, 21 nt, Shigella flexneri 2a str. 301
gcccggauauccacccgcagc

SEQ ID NO: 3910140 - RNA, 20 nt, Shigella flexneri 2a str. 301
gcccggaucguucacaugag

SEQ ID NO: 3910141 - RNA, 16 nt, Shigella flexneri 2a str. 301
gcccggcaauggguaa

SEQ ID NO: 3910142 - RNA, 14 nt, Shigella flexneri 2a str. 301
gccgauguugcaug

SEQ ID NO: 3910143 - RNA, 17 nt, Shigella flexneri 2a str. 301
gccgauguugcaugauu

SEQ ID NO: 3910144 - RNA, 20 nt, Shigella flexneri 2a str. 301
gccgauuaaaaucagaaucg

SEQ ID NO: 3910145 - RNA, 13 nt, Shigella flexneri 2a str. 301
gccgauuguauac

SEQ ID NO: 3910146 - RNA, 14 nt, Shigella flexneri 2a str. 301
gccgcaaaacccag

SEQ ID NO: 3910147 - RNA, 15 nt, Shigella flexneri 2a str. 301
gccgcaaaacccagg

SEQ ID NO: 3910148 - RNA, 15 nt, Shigella flexneri 2a str. 301
gccgcaaaacuucca

SEQ ID NO: 3910149 - RNA, 19 nt, Shigella flexneri 2a str. 301
gccgcaacuuuagccgguu

SEQ ID NO: 3910150 - RNA, 18 nt, Shigella flexneri 2a str. 301
gccgcaaucaucgacccc

SEQ ID NO: 3910151 - RNA, 20 nt, Shigella flexneri 2a str. 301
gccgcacaauacauagaaac

SEQ ID NO: 3910152 - RNA, 21 nt, Shigella flexneri 2a str. 301
gccgcacauuucccggccacg

SEQ ID NO: 3910153 - RNA, 18 nt, Shigella flexneri 2a str. 301
gccgcacuuugagcagcu

SEQ ID NO: 3910154 - RNA, 20 nt, Shigella flexneri 2a str. 301
gccgcagaaaaagagcauca

SEQ ID NO: 3910155 - RNA, 15 nt, Shigella flexneri 2a str. 301
gccgcagcaguugcc

SEQ ID NO: 3910156 - RNA, 13 nt, Shigella flexneri 2a str. 301
gccgcagccauca

SEQ ID NO: 3910157 - RNA, 14 nt, Shigella flexneri 2a str. 301
gccgcagcgauggu

SEQ ID NO: 3910158 - RNA, 23 nt, Shigella flexneri 2a str. 301
gccgcagcggcgauuucuuuauc

SEQ ID NO: 3910159 - RNA, 16 nt, Shigella flexneri 2a str. 301
gccgcaguaaagcgca

SEQ ID NO: 3910160 - RNA, 17 nt, Shigella flexneri 2a str. 301
gccgcaguaaagcgcag

SEQ ID NO: 3910161 - RNA, 23 nt, Shigella flexneri 2a str. 301
gccgcaguuuuugcacgcuuucu

SEQ ID NO: 3910162 - RNA, 15 nt, Shigella flexneri 2a str. 301
gccgcauccgacacu

SEQ ID NO: 3910163 - RNA, 14 nt, Shigella flexneri 2a str. 301
gccgcauccggcaa

SEQ ID NO: 3910164 - RNA, 22 nt, Shigella flexneri 2a str. 301
gccgcauccggcaauucucucu

SEQ ID NO: 3910165 - RNA, 20 nt, Shigella flexneri 2a str. 301
gccgcauccggcagccgugc

SEQ ID NO: 3910166 - RNA, 16 nt, Shigella flexneri 2a str. 301
gccgcauccggcaguu

SEQ ID NO: 3910167 - RNA, 13 nt, Shigella flexneri 2a str. 301
gccgcaucuggca

SEQ ID NO: 3910168 - RNA, 19 nt, Shigella flexneri 2a str. 301
gccgcauggaaccaguuca

SEQ ID NO: 3910169 - RNA, 11 nt, Shigella flexneri 2a str. 301
gccgcauugac

SEQ ID NO: 3910170 - RNA, 18 nt, Shigella flexneri 2a str. 301
gccgcauugguaaagccg

SEQ ID NO: 3910171 - RNA, 18 nt, Shigella flexneri 2a str. 301
gccgccaacccuucugca

SEQ ID NO: 3910172 - RNA, 23 nt, Shigella flexneri 2a str. 301
gccgccacacgcguaaaacgauc

SEQ ID NO: 3910173 - RNA, 14 nt, Shigella flexneri 2a str. 301
gccgccaccgauug

SEQ ID NO: 3910174 - RNA, 19 nt, Shigella flexneri 2a str. 301
gccgccaccgauuguaauc

SEQ ID NO: 3910175 - RNA, 16 nt, Shigella flexneri 2a str. 301
gccgccacugccacca

SEQ ID NO: 3910176 - RNA, 18 nt, Shigella flexneri 2a str. 301
gccgccagacugcgagaa

SEQ ID NO: 3910177 - RNA, 14 nt, Shigella flexneri 2a str. 301
gccgccagcaacau

SEQ ID NO: 3910178 - RNA, 13 nt, Shigella flexneri 2a str. 301
gccgccagcaucu

SEQ ID NO: 3910179 - RNA, 15 nt, Shigella flexneri 2a str. 301
gccgccagcaucuca

SEQ ID NO: 3910180 - RNA, 19 nt, Shigella flexneri 2a str. 301
gccgccagcucuuuaaaca

SEQ ID NO: 3910181 - RNA, 18 nt, Shigella flexneri 2a str. 301
gccgccaguacgcgcccg

SEQ ID NO: 3910182 - RNA, 16 nt, Shigella flexneri 2a str. 301
gccgccaguucuucca

SEQ ID NO: 3910183 - RNA, 13 nt, Shigella flexneri 2a str. 301
gccgccaucaucg

SEQ ID NO: 3910184 - RNA, 21 nt, Shigella flexneri 2a str. 301
gccgccauccugaaucaccug

SEQ ID NO: 3910185 - RNA, 18 nt, Shigella flexneri 2a str. 301
gccgccaucucuuccagc

SEQ ID NO: 3910186 - RNA, 21 nt, Shigella flexneri 2a str. 301
gccgccaucucuuccagcgau

SEQ ID NO: 3910187 - RNA, 19 nt, Shigella flexneri 2a str. 301
gccgccauugaaucguuau

SEQ ID NO: 3910188 - RNA, 17 nt, Shigella flexneri 2a str. 301
gccgccccagucaguaa

SEQ ID NO: 3910189 - RNA, 17 nt, Shigella flexneri 2a str. 301
gccgcccguuuucucca

SEQ ID NO: 3910190 - RNA, 19 nt, Shigella flexneri 2a str. 301
gccgcccuguuugguugcc

SEQ ID NO: 3910191 - RNA, 21 nt, Shigella flexneri 2a str. 301
gccgccgcuucuggcggcggc

SEQ ID NO: 3910192 - RNA, 22 nt, Shigella flexneri 2a str. 301
gccgccggauagacaugcccgg

SEQ ID NO: 3910193 - RNA, 16 nt, Shigella flexneri 2a str. 301
gccgccguuagcuuca

SEQ ID NO: 3910194 - RNA, 13 nt, Shigella flexneri 2a str. 301
gccgccucccuuc

SEQ ID NO: 3910195 - RNA, 20 nt, Shigella flexneri 2a str. 301
gccgccucccuucgcugcug

SEQ ID NO: 3910196 - RNA, 22 nt, Shigella flexneri 2a str. 301
gccgcgacuauucacugcgccu

SEQ ID NO: 3910197 - RNA, 12 nt, Shigella flexneri 2a str. 301
gccgcgagaaua

SEQ ID NO: 3910198 - RNA, 14 nt, Shigella flexneri 2a str. 301
gccgcgaggcaaau

SEQ ID NO: 3910199 - RNA, 13 nt, Shigella flexneri 2a str. 301
gccgcgauagcaa

SEQ ID NO: 3910200 - RNA, 21 nt, Shigella flexneri 2a str. 301
gccgcgcaaauccacguucca

SEQ ID NO: 3910201 - RNA, 14 nt, Shigella flexneri 2a str. 301
gccgcgcagcgugc

SEQ ID NO: 3910202 - RNA, 14 nt, Shigella flexneri 2a str. 301
gccgcgcaguuucu

SEQ ID NO: 3910203 - RNA, 16 nt, Shigella flexneri 2a str. 301
gccgcgcggguggugc

SEQ ID NO: 3910204 - RNA, 15 nt, Shigella flexneri 2a str. 301
gccgcgcuuucuucu

SEQ ID NO: 3910205 - RNA, 20 nt, Shigella flexneri 2a str. 301
gccgcggcucaggcgcacgc

SEQ ID NO: 3910206 - RNA, 15 nt, Shigella flexneri 2a str. 301
gccgcguagagaaaa

SEQ ID NO: 3910207 - RNA, 20 nt, Shigella flexneri 2a str. 301
gccgcgucugaauaucaucc

SEQ ID NO: 3910208 - RNA, 16 nt, Shigella flexneri 2a str. 301
gccgcguuugcgcagc

SEQ ID NO: 3910209 - RNA, 14 nt, Shigella flexneri 2a str. 301
gccgcuaacagcag

SEQ ID NO: 3910210 - RNA, 15 nt, Shigella flexneri 2a str. 301
gccgcuaacagcagc

SEQ ID NO: 3910211 - RNA, 16 nt, Shigella flexneri 2a str. 301
gccgcuaacagcagca

SEQ ID NO: 3910212 - RNA, 16 nt, Shigella flexneri 2a str. 301
gccgcuaacuuccugc

SEQ ID NO: 3910213 - RNA, 20 nt, Shigella flexneri 2a str. 301
gccgcuaauggugcgcgcac

SEQ ID NO: 3910214 - RNA, 15 nt, Shigella flexneri 2a str. 301
gccgcuaccagcgcg

SEQ ID NO: 3910215 - RNA, 14 nt, Shigella flexneri 2a str. 301
gccgcuaccgcccu

SEQ ID NO: 3910216 - RNA, 13 nt, Shigella flexneri 2a str. 301
gccgcuaucggca

SEQ ID NO: 3910217 - RNA, 22 nt, Shigella flexneri 2a str. 301
gccgcuccaaggucuccgccca

SEQ ID NO: 3910218 - RNA, 14 nt, Shigella flexneri 2a str. 301
gccgcuccagaauc

SEQ ID NO: 3910219 - RNA, 17 nt, Shigella flexneri 2a str. 301
gccgcucuuuuguucgc

SEQ ID NO: 3910220 - RNA, 23 nt, Shigella flexneri 2a str. 301
gccgcugaacugauugccacccu

SEQ ID NO: 3910221 - RNA, 18 nt, Shigella flexneri 2a str. 301
gccgcugaacuggcgaag

SEQ ID NO: 3910222 - RNA, 12 nt, Shigella flexneri 2a str. 301
gccgcugcgcgu

SEQ ID NO: 3910223 - RNA, 21 nt, Shigella flexneri 2a str. 301
gccgcugucuaccagcaccug

SEQ ID NO: 3910224 - RNA, 20 nt, Shigella flexneri 2a str. 301
gccgcuguguguaggccagc

SEQ ID NO: 3910225 - RNA, 13 nt, Shigella flexneri 2a str. 301
gccgcuuaaauuu

SEQ ID NO: 3910226 - RNA, 15 nt, Shigella flexneri 2a str. 301
gccgcuucaguugcg

SEQ ID NO: 3910227 - RNA, 17 nt, Shigella flexneri 2a str. 301
gccgcuuccagcagacc

SEQ ID NO: 3910228 - RNA, 18 nt, Shigella flexneri 2a str. 301
gccgcuucuggcggcggc

SEQ ID NO: 3910229 - RNA, 21 nt, Shigella flexneri 2a str. 301
gccgcuuuaugugcuucuacc

SEQ ID NO: 3910230 - RNA, 15 nt, Shigella flexneri 2a str. 301
gccgcuuuccaggca

SEQ ID NO: 3910231 - RNA, 20 nt, Shigella flexneri 2a str. 301
gccgcuuuuucugcgcacac

SEQ ID NO: 3910232 - RNA, 20 nt, Shigella flexneri 2a str. 301
gccggaaauaucaaccggcu

SEQ ID NO: 3910233 - RNA, 18 nt, Shigella flexneri 2a str. 301
gccggaacuauuggucug

SEQ ID NO: 3910234 - RNA, 19 nt, Shigella flexneri 2a str. 301
gccggaaggaagacgcagc

SEQ ID NO: 3910235 - RNA, 12 nt, Shigella flexneri 2a str. 301
gccggaauaauc

SEQ ID NO: 3910236 - RNA, 13 nt, Shigella flexneri 2a str. 301
gccggaauaauca

SEQ ID NO: 3910237 - RNA, 18 nt, Shigella flexneri 2a str. 301
gccggaauaccacuuuca

SEQ ID NO: 3910238 - RNA, 17 nt, Shigella flexneri 2a str. 301
gccggaaucaacggcaa

SEQ ID NO: 3910239 - RNA, 18 nt, Shigella flexneri 2a str. 301
gccggaaucaacggcaac

SEQ ID NO: 3910240 - RNA, 13 nt, Shigella flexneri 2a str. 301
gccggaaucagaa

SEQ ID NO: 3910241 - RNA, 15 nt, Shigella flexneri 2a str. 301
gccggaaucagaauc

SEQ ID NO: 3910242 - RNA, 20 nt, Shigella flexneri 2a str. 301
gccucaagaaucacuucauc

SEQ ID NO: 3910243 - RNA, 18 nt, Shigella flexneri 2a str. 301
gccucaagaaugacgcca

SEQ ID NO: 3910244 - RNA, 14 nt, Shigella flexneri 2a str. 301
gccucaagcacccg

SEQ ID NO: 3910245 - RNA, 20 nt, Shigella flexneri 2a str. 301
gccucaagcacccgccgcua

SEQ ID NO: 3910246 - RNA, 17 nt, Shigella flexneri 2a str. 301
gccucacgaucacagca

SEQ ID NO: 3910247 - RNA, 23 nt, Shigella flexneri 2a str. 301
gccucaguggcugcguuucaugu

SEQ ID NO: 3910248 - RNA, 21 nt, Shigella flexneri 2a str. 301
gccucauccauacggcagaga

SEQ ID NO: 3910249 - RNA, 12 nt, Shigella flexneri 2a str. 301
gccuccaugaaa

SEQ ID NO: 3910250 - RNA, 15 nt, Shigella flexneri 2a str. 301
gccucccauuuccug

SEQ ID NO: 3910251 - RNA, 15 nt, Shigella flexneri 2a str. 301
gccucccuucgcugc

SEQ ID NO: 3910252 - RNA, 18 nt, Shigella flexneri 2a str. 301
gccucgcguccgcguccg

SEQ ID NO: 3910253 - RNA, 16 nt, Shigella flexneri 2a str. 301
gccucgcuacgccagc

SEQ ID NO: 3910254 - RNA, 19 nt, Shigella flexneri 2a str. 301
gccucgcuggucagcgcca

SEQ ID NO: 3910255 - RNA, 18 nt, Shigella flexneri 2a str. 301
gccucgggcuuugcuaca

SEQ ID NO: 3910256 - RNA, 15 nt, Shigella flexneri 2a str. 301
gccucguucuucccu

SEQ ID NO: 3910257 - RNA, 17 nt, Shigella flexneri 2a str. 301
gccucguucuucccucc

SEQ ID NO: 3910258 - RNA, 19 nt, Shigella flexneri 2a str. 301
gccucucaaaccccgccac

SEQ ID NO: 3910259 - RNA, 22 nt, Shigella flexneri 2a str. 301
gccucuccuuuaccacucucgg

SEQ ID NO: 3910260 - RNA, 20 nt, Shigella flexneri 2a str. 301
gccucucggaucgguggcgc

SEQ ID NO: 3910261 - RNA, 15 nt, Shigella flexneri 2a str. 301
gccucucuucgcugc

SEQ ID NO: 3910262 - RNA, 13 nt, Shigella flexneri 2a str. 301
gccucugccagcu

SEQ ID NO: 3910263 - RNA, 19 nt, Shigella flexneri 2a str. 301
gccucuuacgccgccacag

SEQ ID NO: 3910264 - RNA, 17 nt, Shigella flexneri 2a str. 301
gccucuuuuaaccucag

SEQ ID NO: 3910265 - RNA, 22 nt, Shigella flexneri 2a str. 301
gccucuuuuaaccucagcgaac

SEQ ID NO: 3910266 - RNA, 20 nt, Shigella flexneri 2a str. 301
gccucuuuuuucagugcacc

SEQ ID NO: 3910267 - RNA, 21 nt, Shigella flexneri 2a str. 301
gccugaaaacgaaaucguugu

SEQ ID NO: 3910268 - RNA, 17 nt, Shigella flexneri 2a str. 301
gccugaaauaaugcagc

SEQ ID NO: 3910269 - RNA, 18 nt, Shigella flexneri 2a str. 301
gccugaaauaaugcagcg

SEQ ID NO: 3910270 - RNA, 17 nt, Shigella flexneri 2a str. 301
gccugaauauccagaua

SEQ ID NO: 3910271 - RNA, 16 nt, Shigella flexneri 2a str. 301
gccugaccauuaucaa

SEQ ID NO: 3910272 - RNA, 17 nt, Shigella flexneri 2a str. 301
gccugaccgcacacccc

SEQ ID NO: 3910273 - RNA, 20 nt, Shigella flexneri 2a str. 301
gccugaccgcacaccccggc

SEQ ID NO: 3910274 - RNA, 15 nt, Shigella flexneri 2a str. 301
gccugacggacgcgc

SEQ ID NO: 3910275 - RNA, 23 nt, Shigella flexneri 2a str. 301
gccugagaagcgcaacgcaucag

SEQ ID NO: 3910276 - RNA, 16 nt, Shigella flexneri 2a str. 301
gccugagcggcaaugc

SEQ ID NO: 3910277 - RNA, 18 nt, Shigella flexneri 2a str. 301
gccugaguccaugucggu

SEQ ID NO: 3910278 - RNA, 23 nt, Shigella flexneri 2a str. 301
gccugauaaacauagcgcaucag

SEQ ID NO: 3910279 - RNA, 15 nt, Shigella flexneri 2a str. 301
gccugauaagacgcg

SEQ ID NO: 3910280 - RNA, 15 nt, Shigella flexneri 2a str. 301
gccugauaagcgcag

SEQ ID NO: 3910281 - RNA, 20 nt, Shigella flexneri 2a str. 301
gccugauaagcguagcgcau

SEQ ID NO: 3910282 - RNA, 23 nt, Shigella flexneri 2a str. 301
gccugauaaguguagcgcaucag

SEQ ID NO: 3910283 - RNA, 22 nt, Shigella flexneri 2a str. 301
gccugauacagccaaaucauca

SEQ ID NO: 3910284 - RNA, 24 nt, Shigella flexneri 2a str. 301
gccugaugcgacgcugcgcgucuu

SEQ ID NO: 3910285 - RNA, 19 nt, Shigella flexneri 2a str. 301
gccugaugcgacgcuggcg

SEQ ID NO: 3910286 - RNA, 23 nt, Shigella flexneri 2a str. 301
gccugaugcgacgcuugcagcgu

SEQ ID NO: 3910287 - RNA, 23 nt, Shigella flexneri 2a str. 301
gccugaugcgacgcuugccgcgu

SEQ ID NO: 3910288 - RNA, 22 nt, Shigella flexneri 2a str. 301
gccugaugcgacgcuugcgcgu

SEQ ID NO: 3910289 - RNA, 16 nt, Shigella flexneri 2a str. 301
gccugaugcgcuacgc

SEQ ID NO: 3910290 - RNA, 22 nt, Shigella flexneri 2a str. 301
gccugaugcgcuacgcuuauca

SEQ ID NO: 3910291 - RNA, 19 nt, Shigella flexneri 2a str. 301
gccugaugcgcuaugcuua

SEQ ID NO: 3910292 - RNA, 13 nt, Shigella flexneri 2a str. 301
gccugaugcgcug

SEQ ID NO: 3910293 - RNA, 22 nt, Shigella flexneri 2a str. 301
gccugaugcgcugcgcuuauca

SEQ ID NO: 3910294 - RNA, 20 nt, Shigella flexneri 2a str. 301
gccugaugugacgcuuguca

SEQ ID NO: 3910295 - RNA, 16 nt, Shigella flexneri 2a str. 301
gccugcaacgcuuuca

SEQ ID NO: 3910296 - RNA, 15 nt, Shigella flexneri 2a str. 301
gccugcaccauugcu

SEQ ID NO: 3910297 - RNA, 16 nt, Shigella flexneri 2a str. 301
gccugcaccauugcug

SEQ ID NO: 3910298 - RNA, 21 nt, Shigella flexneri 2a str. 301
gccugcacggagauauccagc

SEQ ID NO: 3910299 - RNA, 16 nt, Shigella flexneri 2a str. 301
gccugcagggcuuuca

SEQ ID NO: 3910300 - RNA, 15 nt, Shigella flexneri 2a str. 301
gccugcauaaacgcc

SEQ ID NO: 3910301 - RNA, 11 nt, Shigella flexneri 2a str. 301
gccugccagag

SEQ ID NO: 3910302 - RNA, 13 nt, Shigella flexneri 2a str. 301
gccugccagcaug

SEQ ID NO: 3910303 - RNA, 15 nt, Shigella flexneri 2a str. 301
gccugccagucaauc

SEQ ID NO: 3910304 - RNA, 18 nt, Shigella flexneri 2a str. 301
gccugccagucaaucauc

SEQ ID NO: 3910305 - RNA, 12 nt, Shigella flexneri 2a str. 301
gccugccaucug

SEQ ID NO: 3910306 - RNA, 19 nt, Shigella flexneri 2a str. 301
gccugccaucuggcaggcu

SEQ ID NO: 3910307 - RNA, 22 nt, Shigella flexneri 2a str. 301
gccugccauuggcaggcucugg

SEQ ID NO: 3910308 - RNA, 13 nt, Shigella flexneri 2a str. 301
gccugccgccagc

SEQ ID NO: 3910309 - RNA, 13 nt, Shigella flexneri 2a str. 301
gccugccugcagc

SEQ ID NO: 3910310 - RNA, 17 nt, Shigella flexneri 2a str. 301
gccugccugcagcugcu

SEQ ID NO: 3910311 - RNA, 18 nt, Shigella flexneri 2a str. 301
gccugcuaaaccagcccu

SEQ ID NO: 3910312 - RNA, 10 nt, Shigella flexneri 2a str. 301
gccugcucca

SEQ ID NO: 3910313 - RNA, 13 nt, Shigella flexneri 2a str. 301
gccugcucuuauu

SEQ ID NO: 3910314 - RNA, 22 nt, Shigella flexneri 2a str. 301
gccugcugauaagacgcaucca

SEQ ID NO: 3910315 - RNA, 15 nt, Shigella flexneri 2a str. 301
gccugcuggccccau

SEQ ID NO: 3910316 - RNA, 22 nt, Shigella flexneri 2a str. 301
gccugcuggcuagccucccugc

SEQ ID NO: 3910317 - RNA, 22 nt, Shigella flexneri 2a str. 301
gccugcuuccgguuguucaacc

SEQ ID NO: 3910318 - RNA, 16 nt, Shigella flexneri 2a str. 301
gccuggauggcuugcu

SEQ ID NO: 3910319 - RNA, 14 nt, Shigella flexneri 2a str. 301
gccuggauuuucuc

SEQ ID NO: 3910320 - RNA, 22 nt, Shigella flexneri 2a str. 301
gccuggauuuuuauuccgcugg

SEQ ID NO: 3910321 - RNA, 14 nt, Shigella flexneri 2a str. 301
gccuggcucaagca

SEQ ID NO: 3910322 - RNA, 17 nt, Shigella flexneri 2a str. 301
gccuggcugcauggcaa

SEQ ID NO: 3910323 - RNA, 15 nt, Shigella flexneri 2a str. 301
gccugggaucaucag

SEQ ID NO: 3910324 - RNA, 13 nt, Shigella flexneri 2a str. 301
gccugggcgaggu

SEQ ID NO: 3910325 - RNA, 15 nt, Shigella flexneri 2a str. 301
gccuggggagauguu

SEQ ID NO: 3910326 - RNA, 15 nt, Shigella flexneri 2a str. 301
gccuggguuuucaca

SEQ ID NO: 3910327 - RNA, 18 nt, Shigella flexneri 2a str. 301
gccugguaccagcaccgu

SEQ ID NO: 3910328 - RNA, 12 nt, Shigella flexneri 2a str. 301
gccuggugaccg

SEQ ID NO: 3910329 - RNA, 22 nt, Shigella flexneri 2a str. 301
gccugguggucgaaaaucugcc

SEQ ID NO: 3910330 - RNA, 13 nt, Shigella flexneri 2a str. 301
gccuguacggcag

SEQ ID NO: 3910331 - RNA, 18 nt, Shigella flexneri 2a str. 301
gccuguacggcagugaac

SEQ ID NO: 3910332 - RNA, 17 nt, Shigella flexneri 2a str. 301
gccuguauuacgccuuc

SEQ ID NO: 3910333 - RNA, 16 nt, Shigella flexneri 2a str. 301
gccuguccacacccag

SEQ ID NO: 3910334 - RNA, 19 nt, Shigella flexneri 2a str. 301
gccuguccaccacgcugca

SEQ ID NO: 3910335 - RNA, 16 nt, Shigella flexneri 2a str. 301
gccuguccggaauacu

SEQ ID NO: 3910336 - RNA, 13 nt, Shigella flexneri 2a str. 301
gccugugcaaccu

SEQ ID NO: 3910337 - RNA, 15 nt, Shigella flexneri 2a str. 301
gccugugcaaccuuu

SEQ ID NO: 3910338 - RNA, 15 nt, Shigella flexneri 2a str. 301
gccugugcagcgacg

SEQ ID NO: 3910339 - RNA, 16 nt, Shigella flexneri 2a str. 301
gccugugccugagccg

SEQ ID NO: 3910340 - RNA, 12 nt, Shigella flexneri 2a str. 301
gccugugcgcgu

SEQ ID NO: 3910341 - RNA, 16 nt, Shigella flexneri 2a str. 301
gccuguggugauucau

SEQ ID NO: 3910342 - RNA, 15 nt, Shigella flexneri 2a str. 301
gcgacaccagccauc

SEQ ID NO: 3910343 - RNA, 22 nt, Shigella flexneri 2a str. 301
gcgacaccucccagcgcgguga

SEQ ID NO: 3910344 - RNA, 21 nt, Shigella flexneri 2a str. 301
gcgacacuguucgcgucuuau

SEQ ID NO: 3910345 - RNA, 19 nt, Shigella flexneri 2a str. 301
gcgacagacgacgacgcgc

SEQ ID NO: 3910346 - RNA, 19 nt, Shigella flexneri 2a str. 301
gcgacagauucaggcgcag

SEQ ID NO: 3910347 - RNA, 18 nt, Shigella flexneri 2a str. 301
gcgacagauuuugccagc

SEQ ID NO: 3910348 - RNA, 19 nt, Shigella flexneri 2a str. 301
gcgacagauuuugccagca

SEQ ID NO: 3910349 - RNA, 14 nt, Shigella flexneri 2a str. 301
gcgacaggagccgc

SEQ ID NO: 3910350 - RNA, 16 nt, Shigella flexneri 2a str. 301
gcgacaguaucaucau

SEQ ID NO: 3910351 - RNA, 17 nt, Shigella flexneri 2a str. 301
gcgacaucaccgccgga

SEQ ID NO: 3910352 - RNA, 17 nt, Shigella flexneri 2a str. 301
gcgacauugaccagcca

SEQ ID NO: 3910353 - RNA, 15 nt, Shigella flexneri 2a str. 301
gcgaccaaacugcuc

SEQ ID NO: 3910354 - RNA, 13 nt, Shigella flexneri 2a str. 301
gcgaccaaucaaa

SEQ ID NO: 3910355 - RNA, 15 nt, Shigella flexneri 2a str. 301
gcgaccaaucaaaua

SEQ ID NO: 3910356 - RNA, 19 nt, Shigella flexneri 2a str. 301
gcgaccaccggguuaacgu

SEQ ID NO: 3910357 - RNA, 18 nt, Shigella flexneri 2a str. 301
gcgaccauacagcagcaa

SEQ ID NO: 3910358 - RNA, 20 nt, Shigella flexneri 2a str. 301
gcgacccguuuacggcuaaa

SEQ ID NO: 3910359 - RNA, 14 nt, Shigella flexneri 2a str. 301
gcgaccgaacagau

SEQ ID NO: 3910360 - RNA, 13 nt, Shigella flexneri 2a str. 301
gcgaccgccgcca

SEQ ID NO: 3910361 - RNA, 18 nt, Shigella flexneri 2a str. 301
gcgaccggaauguuccau

SEQ ID NO: 3910362 - RNA, 21 nt, Shigella flexneri 2a str. 301
gcgaccggcgucgcauccggc

SEQ ID NO: 3910363 - RNA, 15 nt, Shigella flexneri 2a str. 301
gcgaccguuuucacc

SEQ ID NO: 3910364 - RNA, 19 nt, Shigella flexneri 2a str. 301
gcgaccguuuucaccaguu

SEQ ID NO: 3910365 - RNA, 15 nt, Shigella flexneri 2a str. 301
gcgacgaacagcuca

SEQ ID NO: 3910366 - RNA, 19 nt, Shigella flexneri 2a str. 301
gcgacgaacguuuacaggg

SEQ ID NO: 3910367 - RNA, 22 nt, Shigella flexneri 2a str. 301
gcgacgaccacccaccgcagcc

SEQ ID NO: 3910368 - RNA, 12 nt, Shigella flexneri 2a str. 301
gcgacgauaacc

SEQ ID NO: 3910369 - RNA, 15 nt, Shigella flexneri 2a str. 301
gcgacgcucggcugu

SEQ ID NO: 3910370 - RNA, 20 nt, Shigella flexneri 2a str. 301
gcgacgcugacgcgucuuau

SEQ ID NO: 3910371 - RNA, 21 nt, Shigella flexneri 2a str. 301
gcgacgcugauagcgucuuau

SEQ ID NO: 3910372 - RNA, 21 nt, Shigella flexneri 2a str. 301
gcgacgcuggccgcgucuuau

SEQ ID NO: 3910373 - RNA, 21 nt, Shigella flexneri 2a str. 301
gcgacgcuuaacgcgucuuau

SEQ ID NO: 3910374 - RNA, 17 nt, Shigella flexneri 2a str. 301
gcgacgcuuaccgcguc

SEQ ID NO: 3910375 - RNA, 20 nt, Shigella flexneri 2a str. 301
gcgacgcuuacgcgucuuau

SEQ ID NO: 3910376 - RNA, 20 nt, Shigella flexneri 2a str. 301
gcgacgcuugcgcgucuuau

SEQ ID NO: 3910377 - RNA, 24 nt, Shigella flexneri 2a str. 301
gcgacggaacuucauaugcgccag

SEQ ID NO: 3910378 - RNA, 22 nt, Shigella flexneri 2a str. 301
gcgacggcgaaucaaccgcgcc

SEQ ID NO: 3910379 - RNA, 15 nt, Shigella flexneri 2a str. 301
gcgacggcuggcaaa

SEQ ID NO: 3910380 - RNA, 18 nt, Shigella flexneri 2a str. 301
gcgacgggcgacaaacgc

SEQ ID NO: 3910381 - RNA, 12 nt, Shigella flexneri 2a str. 301
gcgacgguucau

SEQ ID NO: 3910382 - RNA, 20 nt, Shigella flexneri 2a str. 301
gcgacgucaguuuccagcau

SEQ ID NO: 3910383 - RNA, 15 nt, Shigella flexneri 2a str. 301
gcgacgucugccggu

SEQ ID NO: 3910384 - RNA, 16 nt, Shigella flexneri 2a str. 301
gcgacgugaggauuca

SEQ ID NO: 3910385 - RNA, 17 nt, Shigella flexneri 2a str. 301
gcgacuaauacaccauc

SEQ ID NO: 3910386 - RNA, 20 nt, Shigella flexneri 2a str. 301
gcgacuauucacugcgccuc

SEQ ID NO: 3910387 - RNA, 16 nt, Shigella flexneri 2a str. 301
gcgacucucugagcca

SEQ ID NO: 3910388 - RNA, 17 nt, Shigella flexneri 2a str. 301
gcgacugaggcugucau

SEQ ID NO: 3910389 - RNA, 19 nt, Shigella flexneri 2a str. 301
gcgacugcaaaaagcaggu

SEQ ID NO: 3910390 - RNA, 20 nt, Shigella flexneri 2a str. 301
gcgacuugucgcccgucagu

SEQ ID NO: 3910391 - RNA, 21 nt, Shigella flexneri 2a str. 301
gcgacuugucgcccgucaguu

SEQ ID NO: 3910392 - RNA, 22 nt, Shigella flexneri 2a str. 301
gcgagaaacuucacaucaccau

SEQ ID NO: 3910393 - RNA, 23 nt, Shigella flexneri 2a str. 301
gcgagacggcggaaagggccgca

SEQ ID NO: 3910394 - RNA, 19 nt, Shigella flexneri 2a str. 301
gcgagauuccgccgccauu

SEQ ID NO: 3910395 - RNA, 20 nt, Shigella flexneri 2a str. 301
gcgagcaaaaucguaagcag

SEQ ID NO: 3910396 - RNA, 23 nt, Shigella flexneri 2a str. 301
gcgagcaaaaucguaagcaggag

SEQ ID NO: 3910397 - RNA, 21 nt, Shigella flexneri 2a str. 301
gcgagcauaggcauuaaacau

SEQ ID NO: 3910398 - RNA, 20 nt, Shigella flexneri 2a str. 301
gcgagccauaaacugagcca

SEQ ID NO: 3910399 - RNA, 23 nt, Shigella flexneri 2a str. 301
gcgagccuguaccacaaccugca

SEQ ID NO: 3910400 - RNA, 20 nt, Shigella flexneri 2a str. 301
gcgagcgauaacccagcgca

SEQ ID NO: 3910401 - RNA, 17 nt, Shigella flexneri 2a str. 301
gcgagcuuucgaccagc

SEQ ID NO: 3910402 - RNA, 12 nt, Shigella flexneri 2a str. 301
gcgaggaugcgu

SEQ ID NO: 3910403 - RNA, 20 nt, Shigella flexneri 2a str. 301
gcgaggcaaaauuaucacaa

SEQ ID NO: 3910404 - RNA, 19 nt, Shigella flexneri 2a str. 301
gcgaggcggggccaauugc

SEQ ID NO: 3910405 - RNA, 12 nt, Shigella flexneri 2a str. 301
gcgagggagaaa

SEQ ID NO: 3910406 - RNA, 19 nt, Shigella flexneri 2a str. 301
gcgagggagaaaacccggc

SEQ ID NO: 3910407 - RNA, 19 nt, Shigella flexneri 2a str. 301
gcgaggggaccgccccugc

SEQ ID NO: 3910408 - RNA, 17 nt, Shigella flexneri 2a str. 301
gcgagguacgcccagcg

SEQ ID NO: 3910409 - RNA, 16 nt, Shigella flexneri 2a str. 301
gcgagguaggcaguca

SEQ ID NO: 3910410 - RNA, 15 nt, Shigella flexneri 2a str. 301
gcgagguuaaaaagu

SEQ ID NO: 3910411 - RNA, 18 nt, Shigella flexneri 2a str. 301
gcgagguuauccgccagc

SEQ ID NO: 3910412 - RNA, 19 nt, Shigella flexneri 2a str. 301
gcgagguuauccgccagcg

SEQ ID NO: 3910413 - RNA, 15 nt, Shigella flexneri 2a str. 301
gcgagucgagauccc

SEQ ID NO: 3910414 - RNA, 23 nt, Shigella flexneri 2a str. 301
gcgagucgagaucccuuccggug

SEQ ID NO: 3910415 - RNA, 15 nt, Shigella flexneri 2a str. 301
gcgagucgcuccugc

SEQ ID NO: 3910416 - RNA, 13 nt, Shigella flexneri 2a str. 301
gcgagucgucagu

SEQ ID NO: 3910417 - RNA, 14 nt, Shigella flexneri 2a str. 301
gcgagucgucaguu

SEQ ID NO: 3910418 - RNA, 15 nt, Shigella flexneri 2a str. 301
gcgaguggucuccug

SEQ ID NO: 3910419 - RNA, 13 nt, Shigella flexneri 2a str. 301
gcgauaaaucuca

SEQ ID NO: 3910420 - RNA, 13 nt, Shigella flexneri 2a str. 301
gcgauaaccgcac

SEQ ID NO: 3910421 - RNA, 15 nt, Shigella flexneri 2a str. 301
gcgauaaccgcaccu

SEQ ID NO: 3910422 - RNA, 22 nt, Shigella flexneri 2a str. 301
gcgauaaccuucaccgugaaug

SEQ ID NO: 3910423 - RNA, 16 nt, Shigella flexneri 2a str. 301
gcgauaacgccccaau

SEQ ID NO: 3910424 - RNA, 22 nt, Shigella flexneri 2a str. 301
gcgauaacgccccaauccacgc

SEQ ID NO: 3910425 - RNA, 11 nt, Shigella flexneri 2a str. 301
gcgauaauauu

SEQ ID NO: 3910426 - RNA, 14 nt, Shigella flexneri 2a str. 301
gcgauaaucagcgc

SEQ ID NO: 3910427 - RNA, 16 nt, Shigella flexneri 2a str. 301
gcgauaaugcccagca

SEQ ID NO: 3910428 - RNA, 17 nt, Shigella flexneri 2a str. 301
gcgauaaugcccagcaa

SEQ ID NO: 3910429 - RNA, 13 nt, Shigella flexneri 2a str. 301
gcgauacacugaa

SEQ ID NO: 3910430 - RNA, 19 nt, Shigella flexneri 2a str. 301
gcgauacccccaguaaaug

SEQ ID NO: 3910431 - RNA, 15 nt, Shigella flexneri 2a str. 301
gcgauacuuuuucaa

SEQ ID NO: 3910432 - RNA, 18 nt, Shigella flexneri 2a str. 301
gcgauagauuagcuggcc

SEQ ID NO: 3910433 - RNA, 22 nt, Shigella flexneri 2a str. 301
gcgauauccagcgauaccggug

SEQ ID NO: 3910434 - RNA, 17 nt, Shigella flexneri 2a str. 301
gcgauauccugaaacgc

SEQ ID NO: 3910435 - RNA, 21 nt, Shigella flexneri 2a str. 301
gcgauaucgcgguacuucuca

SEQ ID NO: 3910436 - RNA, 21 nt, Shigella flexneri 2a str. 301
gcgaucccacgccgaaugccg

SEQ ID NO: 3910437 - RNA, 21 nt, Shigella flexneri 2a str. 301
gcgauccgguacuggcguggg

SEQ ID NO: 3910438 - RNA, 17 nt, Shigella flexneri 2a str. 301
gcgauccugauacagac

SEQ ID NO: 3910439 - RNA, 20 nt, Shigella flexneri 2a str. 301
gcgaucgucgcuccaugaga

SEQ ID NO: 3910440 - RNA, 16 nt, Shigella flexneri 2a str. 301
gcgaucucgucagcau

SEQ ID NO: 3910441 - RNA, 19 nt, Shigella flexneri 2a str. 301
gcgcauuacgcucacugca

SEQ ID NO: 3910442 - RNA, 17 nt, Shigella flexneri 2a str. 301
gcgcauuucccagcaag

SEQ ID NO: 3910443 - RNA, 19 nt, Shigella flexneri 2a str. 301
gcgcauuucccagcaagaa

SEQ ID NO: 3910444 - RNA, 22 nt, Shigella flexneri 2a str. 301
gcgcauuucccagcaagaacca

SEQ ID NO: 3910445 - RNA, 20 nt, Shigella flexneri 2a str. 301
gcgcauuugcggcagggcaa

SEQ ID NO: 3910446 - RNA, 17 nt, Shigella flexneri 2a str. 301
gcgccaagauagaacca

SEQ ID NO: 3910447 - RNA, 19 nt, Shigella flexneri 2a str. 301
gcgccaagcagcgcgcaga

SEQ ID NO: 3910448 - RNA, 17 nt, Shigella flexneri 2a str. 301
gcgccaaucagcgcagc

SEQ ID NO: 3910449 - RNA, 21 nt, Shigella flexneri 2a str. 301
gcgccaaucagcgcagcaccc

SEQ ID NO: 3910450 - RNA, 20 nt, Shigella flexneri 2a str. 301
gcgccaaucggcaauucagu

SEQ ID NO: 3910451 - RNA, 16 nt, Shigella flexneri 2a str. 301
gcgccacauccggcau

SEQ ID NO: 3910452 - RNA, 14 nt, Shigella flexneri 2a str. 301
gcgccaccagcgcc

SEQ ID NO: 3910453 - RNA, 16 nt, Shigella flexneri 2a str. 301
gcgccacgcaacagac

SEQ ID NO: 3910454 - RNA, 17 nt, Shigella flexneri 2a str. 301
gcgccacgguguuguug

SEQ ID NO: 3910455 - RNA, 24 nt, Shigella flexneri 2a str. 301
gcgccagacccagacgcucagggu

SEQ ID NO: 3910456 - RNA, 19 nt, Shigella flexneri 2a str. 301
gcgccagagcgcggcguga

SEQ ID NO: 3910457 - RNA, 13 nt, Shigella flexneri 2a str. 301
gcgccagauggca

SEQ ID NO: 3910458 - RNA, 15 nt, Shigella flexneri 2a str. 301
gcgccagauggcaaa

SEQ ID NO: 3910459 - RNA, 11 nt, Shigella flexneri 2a str. 301
gcgccagcaag

SEQ ID NO: 3910460 - RNA, 22 nt, Shigella flexneri 2a str. 301
gcgccagcaucgcauccggcaa

SEQ ID NO: 3910461 - RNA, 13 nt, Shigella flexneri 2a str. 301
gcgccagccagau

SEQ ID NO: 3910462 - RNA, 14 nt, Shigella flexneri 2a str. 301
gcgccagccagcca

SEQ ID NO: 3910463 - RNA, 20 nt, Shigella flexneri 2a str. 301
gcgccagcgaagccagcucc

SEQ ID NO: 3910464 - RNA, 20 nt, Shigella flexneri 2a str. 301
gcgccagcgcuuccgucaga

SEQ ID NO: 3910465 - RNA, 13 nt, Shigella flexneri 2a str. 301
gcgccagcggcag

SEQ ID NO: 3910466 - RNA, 21 nt, Shigella flexneri 2a str. 301
gcgccagcgggcuccacggaa

SEQ ID NO: 3910467 - RNA, 17 nt, Shigella flexneri 2a str. 301
gcgccagcugcauuuca

SEQ ID NO: 3910468 - RNA, 13 nt, Shigella flexneri 2a str. 301
gcgccaggcgcug

SEQ ID NO: 3910469 - RNA, 22 nt, Shigella flexneri 2a str. 301
gcgccaguugcuuauccagcac

SEQ ID NO: 3910470 - RNA, 18 nt, Shigella flexneri 2a str. 301
gcgccaguuuuuguuucu

SEQ ID NO: 3910471 - RNA, 18 nt, Shigella flexneri 2a str. 301
gcgccauaccaugcacca

SEQ ID NO: 3910472 - RNA, 14 nt, Shigella flexneri 2a str. 301
gcgccaucugcagg

SEQ ID NO: 3910473 - RNA, 19 nt, Shigella flexneri 2a str. 301
gcgccauugccauaagcgg

SEQ ID NO: 3910474 - RNA, 14 nt, Shigella flexneri 2a str. 301
gcgcccaacaguag

SEQ ID NO: 3910475 - RNA, 13 nt, Shigella flexneri 2a str. 301
gcgcccaucggcg

SEQ ID NO: 3910476 - RNA, 13 nt, Shigella flexneri 2a str. 301
gcgccccacugga

SEQ ID NO: 3910477 - RNA, 23 nt, Shigella flexneri 2a str. 301
gcgccccuggucauaggccgcug

SEQ ID NO: 3910478 - RNA, 19 nt, Shigella flexneri 2a str. 301
gcgcccgcuuuucgccagc

SEQ ID NO: 3910479 - RNA, 21 nt, Shigella flexneri 2a str. 301
gcgcccggaaacgggcgcuga

SEQ ID NO: 3910480 - RNA, 12 nt, Shigella flexneri 2a str. 301
gcgcccuguucu

SEQ ID NO: 3910481 - RNA, 13 nt, Shigella flexneri 2a str. 301
gcgcccuuucagc

SEQ ID NO: 3910482 - RNA, 14 nt, Shigella flexneri 2a str. 301
gcgccgacagcagc

SEQ ID NO: 3910483 - RNA, 15 nt, Shigella flexneri 2a str. 301
gcgccgacccugcgu

SEQ ID NO: 3910484 - RNA, 23 nt, Shigella flexneri 2a str. 301
gcgccgagcaauaaaaacuccgc

SEQ ID NO: 3910485 - RNA, 16 nt, Shigella flexneri 2a str. 301
gcgccgaguaaaaaaa

SEQ ID NO: 3910486 - RNA, 20 nt, Shigella flexneri 2a str. 301
gcgccgcaacuaccagcagu

SEQ ID NO: 3910487 - RNA, 16 nt, Shigella flexneri 2a str. 301
gcgccgcauccggcau

SEQ ID NO: 3910488 - RNA, 20 nt, Shigella flexneri 2a str. 301
gcgccgcaucguccugcgca

SEQ ID NO: 3910489 - RNA, 14 nt, Shigella flexneri 2a str. 301
gcgccgccaaacgc

SEQ ID NO: 3910490 - RNA, 13 nt, Shigella flexneri 2a str. 301
gcgccgccaaccc

SEQ ID NO: 3910491 - RNA, 14 nt, Shigella flexneri 2a str. 301
gcgccgccacugcc

SEQ ID NO: 3910492 - RNA, 14 nt, Shigella flexneri 2a str. 301
gcgccgccagucga

SEQ ID NO: 3910493 - RNA, 15 nt, Shigella flexneri 2a str. 301
gcgccgccgcugaac

SEQ ID NO: 3910494 - RNA, 16 nt, Shigella flexneri 2a str. 301
gcgccgccucagccag

SEQ ID NO: 3910495 - RNA, 17 nt, Shigella flexneri 2a str. 301
gcgccgcucaguacgag

SEQ ID NO: 3910496 - RNA, 14 nt, Shigella flexneri 2a str. 301
gcgccgcuuucucu

SEQ ID NO: 3910497 - RNA, 22 nt, Shigella flexneri 2a str. 301
gcgccggcucauacucugucug

SEQ ID NO: 3910498 - RNA, 18 nt, Shigella flexneri 2a str. 301
gcgccggucacaucuucc

SEQ ID NO: 3910499 - RNA, 17 nt, Shigella flexneri 2a str. 301
gcgccguccacaaaccg

SEQ ID NO: 3910500 - RNA, 20 nt, Shigella flexneri 2a str. 301
gcgccgugcaacugcggcgc

SEQ ID NO: 3910501 - RNA, 22 nt, Shigella flexneri 2a str. 301
gcgccgugucggugcucaucag

SEQ ID NO: 3910502 - RNA, 17 nt, Shigella flexneri 2a str. 301
gcgccguuuuuuuucug

SEQ ID NO: 3910503 - RNA, 21 nt, Shigella flexneri 2a str. 301
gcgccucaacgccuaaugcca

SEQ ID NO: 3910504 - RNA, 22 nt, Shigella flexneri 2a str. 301
gcgccucaacgccuaaugccag

SEQ ID NO: 3910505 - RNA, 13 nt, Shigella flexneri 2a str. 301
gcgccugauaauc

SEQ ID NO: 3910506 - RNA, 18 nt, Shigella flexneri 2a str. 301
gcgccugcggccagcagc

SEQ ID NO: 3910507 - RNA, 22 nt, Shigella flexneri 2a str. 301
gcgccugcggccagcagcugua

SEQ ID NO: 3910508 - RNA, 12 nt, Shigella flexneri 2a str. 301
gcgccugggccg

SEQ ID NO: 3910509 - RNA, 17 nt, Shigella flexneri 2a str. 301
gcgccuuauccugccug

SEQ ID NO: 3910510 - RNA, 21 nt, Shigella flexneri 2a str. 301
gcgccuucagauugcuacgag

SEQ ID NO: 3910511 - RNA, 14 nt, Shigella flexneri 2a str. 301
gcgccuucauucag

SEQ ID NO: 3910512 - RNA, 19 nt, Shigella flexneri 2a str. 301
gcgccuucauucaggccaa

SEQ ID NO: 3910513 - RNA, 19 nt, Shigella flexneri 2a str. 301
gcgccuucgugcggcugca

SEQ ID NO: 3910514 - RNA, 18 nt, Shigella flexneri 2a str. 301
gcgccuucuacagcuuca

SEQ ID NO: 3910515 - RNA, 22 nt, Shigella flexneri 2a str. 301
gcgccuuuaauauuaacgccag

SEQ ID NO: 3910516 - RNA, 23 nt, Shigella flexneri 2a str. 301
gcgccuuuuguuuguucuucucg

SEQ ID NO: 3910517 - RNA, 20 nt, Shigella flexneri 2a str. 301
gcgccuuuuuucgccgcagc

SEQ ID NO: 3910518 - RNA, 18 nt, Shigella flexneri 2a str. 301
gcgcgaaaacaacuggca

SEQ ID NO: 3910519 - RNA, 15 nt, Shigella flexneri 2a str. 301
gcgcgaacagcacau

SEQ ID NO: 3910520 - RNA, 20 nt, Shigella flexneri 2a str. 301
gcgcgaacuggaugaaaaaa

SEQ ID NO: 3910521 - RNA, 15 nt, Shigella flexneri 2a str. 301
gcgcgaacugucggu

SEQ ID NO: 3910522 - RNA, 20 nt, Shigella flexneri 2a str. 301
gcgcgaacugucgguuugua

SEQ ID NO: 3910523 - RNA, 14 nt, Shigella flexneri 2a str. 301
gcgcgaagcccuca

SEQ ID NO: 3910524 - RNA, 19 nt, Shigella flexneri 2a str. 301
gcgcgaauauggcggcggc

SEQ ID NO: 3910525 - RNA, 20 nt, Shigella flexneri 2a str. 301
gcgcgaauggaaagcccgcc

SEQ ID NO: 3910526 - RNA, 22 nt, Shigella flexneri 2a str. 301
gcgcgaauggaaagcccgcccc

SEQ ID NO: 3910527 - RNA, 13 nt, Shigella flexneri 2a str. 301
gcgcgaccaaugu

SEQ ID NO: 3910528 - RNA, 19 nt, Shigella flexneri 2a str. 301
gcgcgaccaaugucagggc

SEQ ID NO: 3910529 - RNA, 15 nt, Shigella flexneri 2a str. 301
gcgcgacgcucggcu

SEQ ID NO: 3910530 - RNA, 12 nt, Shigella flexneri 2a str. 301
gcgcgagccaua

SEQ ID NO: 3910531 - RNA, 18 nt, Shigella flexneri 2a str. 301
gcgcgagguuaaaaagug

SEQ ID NO: 3910532 - RNA, 20 nt, Shigella flexneri 2a str. 301
gcgcgaucgcaccaccauug

SEQ ID NO: 3910533 - RNA, 22 nt, Shigella flexneri 2a str. 301
gcgcgaucgggaaccggcuggc

SEQ ID NO: 3910534 - RNA, 17 nt, Shigella flexneri 2a str. 301
gcgcgcaaucagcaccg

SEQ ID NO: 3910535 - RNA, 23 nt, Shigella flexneri 2a str. 301
gcgcgcagugccgguggaagggc

SEQ ID NO: 3910536 - RNA, 13 nt, Shigella flexneri 2a str. 301
gcgcgccagcgau

SEQ ID NO: 3910537 - RNA, 13 nt, Shigella flexneri 2a str. 301
gcgcgccaggaga

SEQ ID NO: 3910538 - RNA, 12 nt, Shigella flexneri 2a str. 301
gcgcgccaggcg

SEQ ID NO: 3910539 - RNA, 14 nt, Shigella flexneri 2a str. 301
gcgcgccaggcgcu

SEQ ID NO: 3910540 - RNA, 21 nt, Shigella flexneri 2a str. 301
gcgcgcccgauuaacuggggc

SEQ ID NO: 3910541 - RNA, 15 nt, Shigella flexneri 2a str. 301
gcggaggggcggcuc

SEQ ID NO: 3910542 - RNA, 19 nt, Shigella flexneri 2a str. 301
gcggauacaggaagcgaau

SEQ ID NO: 3910543 - RNA, 21 nt, Shigella flexneri 2a str. 301
gcggauaggaaucagcaguuc

SEQ ID NO: 3910544 - RNA, 14 nt, Shigella flexneri 2a str. 301
gcggauauaaaauu

SEQ ID NO: 3910545 - RNA, 19 nt, Shigella flexneri 2a str. 301
gcggaucaguuccagcagc

SEQ ID NO: 3910546 - RNA, 20 nt, Shigella flexneri 2a str. 301
gcggaucucuucguuuucaa

SEQ ID NO: 3910547 - RNA, 13 nt, Shigella flexneri 2a str. 301
gcggaucugcucc

SEQ ID NO: 3910548 - RNA, 21 nt, Shigella flexneri 2a str. 301
gcggaugaggcguuaacagcg

SEQ ID NO: 3910549 - RNA, 18 nt, Shigella flexneri 2a str. 301
gcggaugcggcguaaacg

SEQ ID NO: 3910550 - RNA, 16 nt, Shigella flexneri 2a str. 301
gcggauggccucugcc

SEQ ID NO: 3910551 - RNA, 19 nt, Shigella flexneri 2a str. 301
gcggauggccucugccagc

SEQ ID NO: 3910552 - RNA, 23 nt, Shigella flexneri 2a str. 301
gcggauggccucugccagcugcu

SEQ ID NO: 3910553 - RNA, 18 nt, Shigella flexneri 2a str. 301
gcggauucgaugcccagc

SEQ ID NO: 3910554 - RNA, 11 nt, Shigella flexneri 2a str. 301
gcggauuucac

SEQ ID NO: 3910555 - RNA, 14 nt, Shigella flexneri 2a str. 301
gcggauuuccccac

SEQ ID NO: 3910556 - RNA, 21 nt, Shigella flexneri 2a str. 301
gcggauuuguaauuucagcgg

SEQ ID NO: 3910557 - RNA, 20 nt, Shigella flexneri 2a str. 301
gcggcaaaaucgccggugau

SEQ ID NO: 3910558 - RNA, 16 nt, Shigella flexneri 2a str. 301
gcggcaaacaguuucu

SEQ ID NO: 3910559 - RNA, 16 nt, Shigella flexneri 2a str. 301
gcggcaacauggcaac

SEQ ID NO: 3910560 - RNA, 13 nt, Shigella flexneri 2a str. 301
gcggcaagaucgc

SEQ ID NO: 3910561 - RNA, 19 nt, Shigella flexneri 2a str. 301
gcggcaauccccgccagca

SEQ ID NO: 3910562 - RNA, 13 nt, Shigella flexneri 2a str. 301
gcggcaaucgcca

SEQ ID NO: 3910563 - RNA, 17 nt, Shigella flexneri 2a str. 301
gcggcaaucgccagaau

SEQ ID NO: 3910564 - RNA, 12 nt, Shigella flexneri 2a str. 301
gcggcaauggcu

SEQ ID NO: 3910565 - RNA, 19 nt, Shigella flexneri 2a str. 301
gcggcaauuagcggcuggc

SEQ ID NO: 3910566 - RNA, 19 nt, Shigella flexneri 2a str. 301
gcggcaauucuuucucgcu

SEQ ID NO: 3910567 - RNA, 21 nt, Shigella flexneri 2a str. 301
gcggcaauucuuucucgcuca

SEQ ID NO: 3910568 - RNA, 21 nt, Shigella flexneri 2a str. 301
gcggcacacagcacggcagca

SEQ ID NO: 3910569 - RNA, 16 nt, Shigella flexneri 2a str. 301
gcggcacagaaacgcc

SEQ ID NO: 3910570 - RNA, 14 nt, Shigella flexneri 2a str. 301
gcggcacagccagc

SEQ ID NO: 3910571 - RNA, 24 nt, Shigella flexneri 2a str. 301
gcggcacugcucuuuaacaauuua

SEQ ID NO: 3910572 - RNA, 22 nt, Shigella flexneri 2a str. 301
gcggcacugguacucaaccgcc

SEQ ID NO: 3910573 - RNA, 14 nt, Shigella flexneri 2a str. 301
gcggcagaaugguu

SEQ ID NO: 3910574 - RNA, 12 nt, Shigella flexneri 2a str. 301
gcggcagcggcu

SEQ ID NO: 3910575 - RNA, 23 nt, Shigella flexneri 2a str. 301
gcggcagcgugccaggcgcgcuu

SEQ ID NO: 3910576 - RNA, 14 nt, Shigella flexneri 2a str. 301
gcggcagcuccagc

SEQ ID NO: 3910577 - RNA, 15 nt, Shigella flexneri 2a str. 301
gcggcagcuccagca

SEQ ID NO: 3910578 - RNA, 17 nt, Shigella flexneri 2a str. 301
gcggcagcucgcguucg

SEQ ID NO: 3910579 - RNA, 18 nt, Shigella flexneri 2a str. 301
gcggcaggcagcgccacg

SEQ ID NO: 3910580 - RNA, 20 nt, Shigella flexneri 2a str. 301
gcggcaggcagcgccacgua

SEQ ID NO: 3910581 - RNA, 15 nt, Shigella flexneri 2a str. 301
gcggcaggccgugga

SEQ ID NO: 3910582 - RNA, 17 nt, Shigella flexneri 2a str. 301
gcggcaggguuugcgcc

SEQ ID NO: 3910583 - RNA, 14 nt, Shigella flexneri 2a str. 301
gcggcagguugaug

SEQ ID NO: 3910584 - RNA, 18 nt, Shigella flexneri 2a str. 301
gcggcaguaagcgcggcu

SEQ ID NO: 3910585 - RNA, 19 nt, Shigella flexneri 2a str. 301
gcggcaguauagcggcaug

SEQ ID NO: 3910586 - RNA, 18 nt, Shigella flexneri 2a str. 301
gcggcaguggcuaagcag

SEQ ID NO: 3910587 - RNA, 12 nt, Shigella flexneri 2a str. 301
gcggcaguucgu

SEQ ID NO: 3910588 - RNA, 21 nt, Shigella flexneri 2a str. 301
gcggcauccagguuucuucca

SEQ ID NO: 3910589 - RNA, 14 nt, Shigella flexneri 2a str. 301
gcggcaucuucucc

SEQ ID NO: 3910590 - RNA, 16 nt, Shigella flexneri 2a str. 301
gcggcaucuucuccac

SEQ ID NO: 3910591 - RNA, 22 nt, Shigella flexneri 2a str. 301
gcggccaaccauccgucaucca

SEQ ID NO: 3910592 - RNA, 20 nt, Shigella flexneri 2a str. 301
gcggccccauuuauuucuca

SEQ ID NO: 3910593 - RNA, 22 nt, Shigella flexneri 2a str. 301
gcggccccauuuauuucucacu

SEQ ID NO: 3910594 - RNA, 22 nt, Shigella flexneri 2a str. 301
gcggccgccagaaacagugacc

SEQ ID NO: 3910595 - RNA, 19 nt, Shigella flexneri 2a str. 301
gcggccggaugcgccgcca

SEQ ID NO: 3910596 - RNA, 17 nt, Shigella flexneri 2a str. 301
gcggcgaaccagccguu

SEQ ID NO: 3910597 - RNA, 19 nt, Shigella flexneri 2a str. 301
gcggcgaagauacccgcga

SEQ ID NO: 3910598 - RNA, 20 nt, Shigella flexneri 2a str. 301
gcggcgacaaauguugcauc

SEQ ID NO: 3910599 - RNA, 14 nt, Shigella flexneri 2a str. 301
gcggcgacaauaau

SEQ ID NO: 3910600 - RNA, 21 nt, Shigella flexneri 2a str. 301
gcggcgauaauauugaugcac

SEQ ID NO: 3910601 - RNA, 16 nt, Shigella flexneri 2a str. 301
gcggcgauauccagcg

SEQ ID NO: 3910602 - RNA, 18 nt, Shigella flexneri 2a str. 301
gcggcgaucuuuuaauaa

SEQ ID NO: 3910603 - RNA, 16 nt, Shigella flexneri 2a str. 301
gcggcgaugaccgcca

SEQ ID NO: 3910604 - RNA, 18 nt, Shigella flexneri 2a str. 301
gcggcgcaacccccacac

SEQ ID NO: 3910605 - RNA, 16 nt, Shigella flexneri 2a str. 301
gcggcgcaggcaauag

SEQ ID NO: 3910606 - RNA, 16 nt, Shigella flexneri 2a str. 301
gcggcgcuaauggcac

SEQ ID NO: 3910607 - RNA, 18 nt, Shigella flexneri 2a str. 301
gcggcggacgugcaccgu

SEQ ID NO: 3910608 - RNA, 21 nt, Shigella flexneri 2a str. 301
gcggcggcagauugagcguca

SEQ ID NO: 3910609 - RNA, 15 nt, Shigella flexneri 2a str. 301
gcggcggugauauaa

SEQ ID NO: 3910610 - RNA, 23 nt, Shigella flexneri 2a str. 301
gcggcgugaacgccuaauccagc

SEQ ID NO: 3910611 - RNA, 21 nt, Shigella flexneri 2a str. 301
gcggcuaagcugggcgguggc

SEQ ID NO: 3910612 - RNA, 14 nt, Shigella flexneri 2a str. 301
gcggcucaccugca

SEQ ID NO: 3910613 - RNA, 13 nt, Shigella flexneri 2a str. 301
gcggcuccagaau

SEQ ID NO: 3910614 - RNA, 23 nt, Shigella flexneri 2a str. 301
gcggcucguuagacggcgcugcc

SEQ ID NO: 3910615 - RNA, 12 nt, Shigella flexneri 2a str. 301
gcggcucucagc

SEQ ID NO: 3910616 - RNA, 12 nt, Shigella flexneri 2a str. 301
gcggcucuccug

SEQ ID NO: 3910617 - RNA, 21 nt, Shigella flexneri 2a str. 301
gcggcugcccaucaucgucgu

SEQ ID NO: 3910618 - RNA, 12 nt, Shigella flexneri 2a str. 301
gcggcugcgcag

SEQ ID NO: 3910619 - RNA, 22 nt, Shigella flexneri 2a str. 301
gcggcuggcgaagcccagaaug

SEQ ID NO: 3910620 - RNA, 15 nt, Shigella flexneri 2a str. 301
gcggcuggcugaccu

SEQ ID NO: 3910621 - RNA, 12 nt, Shigella flexneri 2a str. 301
gcggcuggcugg

SEQ ID NO: 3910622 - RNA, 14 nt, Shigella flexneri 2a str. 301
gcggcuuauauauu

SEQ ID NO: 3910623 - RNA, 13 nt, Shigella flexneri 2a str. 301
gcggcuuaucgcg

SEQ ID NO: 3910624 - RNA, 18 nt, Shigella flexneri 2a str. 301
gcggcuuauucauuacuc

SEQ ID NO: 3910625 - RNA, 20 nt, Shigella flexneri 2a str. 301
gcggcuuguacgccgccgca

SEQ ID NO: 3910626 - RNA, 13 nt, Shigella flexneri 2a str. 301
gcgggaggaacaa

SEQ ID NO: 3910627 - RNA, 13 nt, Shigella flexneri 2a str. 301
gcgggcaagcggc

SEQ ID NO: 3910628 - RNA, 17 nt, Shigella flexneri 2a str. 301
gcgggcaaucggcugca

SEQ ID NO: 3910629 - RNA, 17 nt, Shigella flexneri 2a str. 301
gcgggcaucaucuuccg

SEQ ID NO: 3910630 - RNA, 14 nt, Shigella flexneri 2a str. 301
gcgggcggcauugg

SEQ ID NO: 3910631 - RNA, 23 nt, Shigella flexneri 2a str. 301
gcgggcgguaagccggagcuggc

SEQ ID NO: 3910632 - RNA, 20 nt, Shigella flexneri 2a str. 301
gcgggcguagugcccgcagu

SEQ ID NO: 3910633 - RNA, 17 nt, Shigella flexneri 2a str. 301
gcgggcugaccgcccgc

SEQ ID NO: 3910634 - RNA, 21 nt, Shigella flexneri 2a str. 301
gcggggaucacuccccgccgu

SEQ ID NO: 3910635 - RNA, 20 nt, Shigella flexneri 2a str. 301
gcggggcuaccgccagacca

SEQ ID NO: 3910636 - RNA, 14 nt, Shigella flexneri 2a str. 301
gcggguaaccagcc

SEQ ID NO: 3910637 - RNA, 21 nt, Shigella flexneri 2a str. 301
gcgggucaccgcgguguauac

SEQ ID NO: 3910638 - RNA, 20 nt, Shigella flexneri 2a str. 301
gcggguggcucucgccagca

SEQ ID NO: 3910639 - RNA, 13 nt, Shigella flexneri 2a str. 301
gcggguuagucug

SEQ ID NO: 3910640 - RNA, 17 nt, Shigella flexneri 2a str. 301
gcggguucuuaccggug

SEQ ID NO: 3910641 - RNA, 21 nt, Shigella flexneri 2a str. 301
gcgugaccgccuuauccggcc

SEQ ID NO: 3910642 - RNA, 21 nt, Shigella flexneri 2a str. 301
gcgugacgcuggcagaaaguu

SEQ ID NO: 3910643 - RNA, 15 nt, Shigella flexneri 2a str. 301
gcgugacuaaaaccc

SEQ ID NO: 3910644 - RNA, 17 nt, Shigella flexneri 2a str. 301
gcgugagaacaccaccu

SEQ ID NO: 3910645 - RNA, 18 nt, Shigella flexneri 2a str. 301
gcgugagaacaccaccug

SEQ ID NO: 3910646 - RNA, 21 nt, Shigella flexneri 2a str. 301
gcgugagaucgcgcgggagca

SEQ ID NO: 3910647 - RNA, 22 nt, Shigella flexneri 2a str. 301
gcgugaucuaaaaucgcuucag

SEQ ID NO: 3910648 - RNA, 17 nt, Shigella flexneri 2a str. 301
gcgugauucauacagcg

SEQ ID NO: 3910649 - RNA, 12 nt, Shigella flexneri 2a str. 301
gcgugauuccag

SEQ ID NO: 3910650 - RNA, 16 nt, Shigella flexneri 2a str. 301
gcgugauuccagacgg

SEQ ID NO: 3910651 - RNA, 20 nt, Shigella flexneri 2a str. 301
gcgugccacguaccaaaaca

SEQ ID NO: 3910652 - RNA, 20 nt, Shigella flexneri 2a str. 301
gcgugcccgggucagcgcca

SEQ ID NO: 3910653 - RNA, 19 nt, Shigella flexneri 2a str. 301
gcgugccgugaauauggaa

SEQ ID NO: 3910654 - RNA, 15 nt, Shigella flexneri 2a str. 301
gcgugcggcggugga

SEQ ID NO: 3910655 - RNA, 23 nt, Shigella flexneri 2a str. 301
gcguggcgauaaucagcgccagc

SEQ ID NO: 3910656 - RNA, 14 nt, Shigella flexneri 2a str. 301
gcgugguccagcug

SEQ ID NO: 3910657 - RNA, 13 nt, Shigella flexneri 2a str. 301
gcgugucccacug

SEQ ID NO: 3910658 - RNA, 13 nt, Shigella flexneri 2a str. 301
gcguguuccagag

SEQ ID NO: 3910659 - RNA, 23 nt, Shigella flexneri 2a str. 301
gcguguuccagagaacgaccauc

SEQ ID NO: 3910660 - RNA, 13 nt, Shigella flexneri 2a str. 301
gcguguucgguaa

SEQ ID NO: 3910661 - RNA, 13 nt, Shigella flexneri 2a str. 301
gcguuaaaacagg

SEQ ID NO: 3910662 - RNA, 21 nt, Shigella flexneri 2a str. 301
gcguuaacuguacaggcuccu

SEQ ID NO: 3910663 - RNA, 14 nt, Shigella flexneri 2a str. 301
gcguuaccagcaaa

SEQ ID NO: 3910664 - RNA, 15 nt, Shigella flexneri 2a str. 301
gcguuacccauucaa

SEQ ID NO: 3910665 - RNA, 16 nt, Shigella flexneri 2a str. 301
gcguuacgacuguuga

SEQ ID NO: 3910666 - RNA, 18 nt, Shigella flexneri 2a str. 301
gcguuagacgcguuuaca

SEQ ID NO: 3910667 - RNA, 22 nt, Shigella flexneri 2a str. 301
gcguuagauagcggcugacggu

SEQ ID NO: 3910668 - RNA, 18 nt, Shigella flexneri 2a str. 301
gcguuagcaucgcaucag

SEQ ID NO: 3910669 - RNA, 21 nt, Shigella flexneri 2a str. 301
gcguuaugucccgcuggugcg

SEQ ID NO: 3910670 - RNA, 23 nt, Shigella flexneri 2a str. 301
gcguucacuguaguuauccgcaa

SEQ ID NO: 3910671 - RNA, 19 nt, Shigella flexneri 2a str. 301
gcguucagcaguucugcca

SEQ ID NO: 3910672 - RNA, 19 nt, Shigella flexneri 2a str. 301
gcguucauccaacaauagu

SEQ ID NO: 3910673 - RNA, 14 nt, Shigella flexneri 2a str. 301
gcguuccacgugcg

SEQ ID NO: 3910674 - RNA, 19 nt, Shigella flexneri 2a str. 301
gcguuccagcaucuccugc

SEQ ID NO: 3910675 - RNA, 23 nt, Shigella flexneri 2a str. 301
gcguuccaucagauucagcagcg

SEQ ID NO: 3910676 - RNA, 13 nt, Shigella flexneri 2a str. 301
gcguuccccagaa

SEQ ID NO: 3910677 - RNA, 23 nt, Shigella flexneri 2a str. 301
gcguucccguccgcacgcuggag

SEQ ID NO: 3910678 - RNA, 18 nt, Shigella flexneri 2a str. 301
gcguuccugcucuuccgg

SEQ ID NO: 3910679 - RNA, 16 nt, Shigella flexneri 2a str. 301
gcguucgccaaaccca

SEQ ID NO: 3910680 - RNA, 22 nt, Shigella flexneri 2a str. 301
gcguucgcgccgcauccggcau

SEQ ID NO: 3910681 - RNA, 23 nt, Shigella flexneri 2a str. 301
gcguucugguaaaccuuccacac

SEQ ID NO: 3910682 - RNA, 15 nt, Shigella flexneri 2a str. 301
gcguucugucgauaa

SEQ ID NO: 3910683 - RNA, 22 nt, Shigella flexneri 2a str. 301
gcguucugucgauaaacucaug

SEQ ID NO: 3910684 - RNA, 14 nt, Shigella flexneri 2a str. 301
gcguugagaaacgc

SEQ ID NO: 3910685 - RNA, 22 nt, Shigella flexneri 2a str. 301
gcguugagcaaucgacgccguu

SEQ ID NO: 3910686 - RNA, 15 nt, Shigella flexneri 2a str. 301
gcguugaugccggau

SEQ ID NO: 3910687 - RNA, 23 nt, Shigella flexneri 2a str. 301
gcguugcaauaugcuggcagugg

SEQ ID NO: 3910688 - RNA, 22 nt, Shigella flexneri 2a str. 301
gcguugcacgcagacacugcug

SEQ ID NO: 3910689 - RNA, 13 nt, Shigella flexneri 2a str. 301
gcguugcagcagg

SEQ ID NO: 3910690 - RNA, 23 nt, Shigella flexneri 2a str. 301
gcguugccaguaguucauccagu

SEQ ID NO: 3910691 - RNA, 16 nt, Shigella flexneri 2a str. 301
gcguugcuaugcugaa

SEQ ID NO: 3910692 - RNA, 13 nt, Shigella flexneri 2a str. 301
gcguuggcaaugu

SEQ ID NO: 3910693 - RNA, 21 nt, Shigella flexneri 2a str. 301
gcguuggcgugacuucgccga

SEQ ID NO: 3910694 - RNA, 19 nt, Shigella flexneri 2a str. 301
gcguuguaacaauccgaua

SEQ ID NO: 3910695 - RNA, 16 nt, Shigella flexneri 2a str. 301
gcguugucgccaucca

SEQ ID NO: 3910696 - RNA, 14 nt, Shigella flexneri 2a str. 301
gcguuuaaucacac

SEQ ID NO: 3910697 - RNA, 15 nt, Shigella flexneri 2a str. 301
gcguuuaccugccug

SEQ ID NO: 3910698 - RNA, 18 nt, Shigella flexneri 2a str. 301
gcguuuaucgacagacgc

SEQ ID NO: 3910699 - RNA, 17 nt, Shigella flexneri 2a str. 301
gcguuuaugaguauuua

SEQ ID NO: 3910700 - RNA, 16 nt, Shigella flexneri 2a str. 301
gcguuucaacaaacga

SEQ ID NO: 3910701 - RNA, 21 nt, Shigella flexneri 2a str. 301
gcguuucacauucgccgccga

SEQ ID NO: 3910702 - RNA, 22 nt, Shigella flexneri 2a str. 301
gcguuucgauacaacccgaagg

SEQ ID NO: 3910703 - RNA, 19 nt, Shigella flexneri 2a str. 301
gcguuugaaaaagccaaaa

SEQ ID NO: 3910704 - RNA, 16 nt, Shigella flexneri 2a str. 301
gcguuugcuccugcuu

SEQ ID NO: 3910705 - RNA, 19 nt, Shigella flexneri 2a str. 301
gcguuugcuguuccacgag

SEQ ID NO: 3910706 - RNA, 15 nt, Shigella flexneri 2a str. 301
gcguuuguccgccgg

SEQ ID NO: 3910707 - RNA, 12 nt, Shigella flexneri 2a str. 301
gcguuuguugcg

SEQ ID NO: 3910708 - RNA, 17 nt, Shigella flexneri 2a str. 301
gcguuuuaccaguuuca

SEQ ID NO: 3910709 - RNA, 19 nt, Shigella flexneri 2a str. 301
gcguuuuauaccaacaaaa

SEQ ID NO: 3910710 - RNA, 16 nt, Shigella flexneri 2a str. 301
gcguuuucaaccagcc

SEQ ID NO: 3910711 - RNA, 18 nt, Shigella flexneri 2a str. 301
gcguuuuccggcacgcag

SEQ ID NO: 3910712 - RNA, 13 nt, Shigella flexneri 2a str. 301
gcguuuugcagau

SEQ ID NO: 3910713 - RNA, 17 nt, Shigella flexneri 2a str. 301
gcguuuuuaucuucaca

SEQ ID NO: 3910714 - RNA, 13 nt, Shigella flexneri 2a str. 301
gcguuuuucuuca

SEQ ID NO: 3910715 - RNA, 23 nt, Shigella flexneri 2a str. 301
gcguuuuucuucagccccuccac

SEQ ID NO: 3910716 - RNA, 12 nt, Shigella flexneri 2a str. 301
gcguuuuuucau

SEQ ID NO: 3910717 - RNA, 23 nt, Shigella flexneri 2a str. 301
gcguuuuuucgauaucaagccau

SEQ ID NO: 3910718 - RNA, 14 nt, Shigella flexneri 2a str. 301
gcuaaaaacaucau

SEQ ID NO: 3910719 - RNA, 20 nt, Shigella flexneri 2a str. 301
gcuaaaaauagcgacuuggg

SEQ ID NO: 3910720 - RNA, 17 nt, Shigella flexneri 2a str. 301
gcuaaaaguuuuagcau

SEQ ID NO: 3910721 - RNA, 19 nt, Shigella flexneri 2a str. 301
gcuaaaguacguaaaacaa

SEQ ID NO: 3910722 - RNA, 17 nt, Shigella flexneri 2a str. 301
gcuaaauaaccagcaua

SEQ ID NO: 3910723 - RNA, 21 nt, Shigella flexneri 2a str. 301
gcuaaauguuuaguauuguua

SEQ ID NO: 3910724 - RNA, 16 nt, Shigella flexneri 2a str. 301
gcuaaccacgccgcuu

SEQ ID NO: 3910725 - RNA, 21 nt, Shigella flexneri 2a str. 301
gcuaaccgcuuuuccagcaua

SEQ ID NO: 3910726 - RNA, 15 nt, Shigella flexneri 2a str. 301
gcuaacugguggcag

SEQ ID NO: 3910727 - RNA, 21 nt, Shigella flexneri 2a str. 301
gcuaacugguggcaggaaaac

SEQ ID NO: 3910728 - RNA, 20 nt, Shigella flexneri 2a str. 301
gcuaacuuccugcuggcugu

SEQ ID NO: 3910729 - RNA, 15 nt, Shigella flexneri 2a str. 301
gcuaagauaccccag

SEQ ID NO: 3910730 - RNA, 20 nt, Shigella flexneri 2a str. 301
gcuaagauaccccagcgcaa

SEQ ID NO: 3910731 - RNA, 14 nt, Shigella flexneri 2a str. 301
gcuaagccguuccg

SEQ ID NO: 3910732 - RNA, 17 nt, Shigella flexneri 2a str. 301
gcuaagcugggcggugg

SEQ ID NO: 3910733 - RNA, 19 nt, Shigella flexneri 2a str. 301
gcuaaguacguaacgaccc

SEQ ID NO: 3910734 - RNA, 13 nt, Shigella flexneri 2a str. 301
gcuaaguugaauc

SEQ ID NO: 3910735 - RNA, 13 nt, Shigella flexneri 2a str. 301
gcuaauaaucagc

SEQ ID NO: 3910736 - RNA, 16 nt, Shigella flexneri 2a str. 301
gcuaauaccaaucgca

SEQ ID NO: 3910737 - RNA, 20 nt, Shigella flexneri 2a str. 301
gcuaauaccaaucgcaauac

SEQ ID NO: 3910738 - RNA, 18 nt, Shigella flexneri 2a str. 301
gcuaauaccguuucgcag

SEQ ID NO: 3910739 - RNA, 13 nt, Shigella flexneri 2a str. 301
gcuaaucagugcc

SEQ ID NO: 3910740 - RNA, 13 nt, Shigella flexneri 2a str. 301
gcuaauucaacgc

SEQ ID NO: 3910741 - RNA, 21 nt, Shigella flexneri 2a str. 301
gcucaucagcggcgaagccua

SEQ ID NO: 3910742 - RNA, 19 nt, Shigella flexneri 2a str. 301
gcucaucaggccuacaaaa

SEQ ID NO: 3910743 - RNA, 13 nt, Shigella flexneri 2a str. 301
gcucauccagcgu

SEQ ID NO: 3910744 - RNA, 20 nt, Shigella flexneri 2a str. 301
gcucaucgccuuccagcgau

SEQ ID NO: 3910745 - RNA, 16 nt, Shigella flexneri 2a str. 301
gcucaucggcauacag

SEQ ID NO: 3910746 - RNA, 13 nt, Shigella flexneri 2a str. 301
gcucauuauuugc

SEQ ID NO: 3910747 - RNA, 14 nt, Shigella flexneri 2a str. 301
gcucauucuuccuc

SEQ ID NO: 3910748 - RNA, 19 nt, Shigella flexneri 2a str. 301
gcucauucuuccuccagcg

SEQ ID NO: 3910749 - RNA, 20 nt, Shigella flexneri 2a str. 301
gcucauugguccaucuuuuu

SEQ ID NO: 3910750 - RNA, 16 nt, Shigella flexneri 2a str. 301
gcuccacaagcuccgg

SEQ ID NO: 3910751 - RNA, 14 nt, Shigella flexneri 2a str. 301
gcuccacgccauau

SEQ ID NO: 3910752 - RNA, 13 nt, Shigella flexneri 2a str. 301
gcuccagaaacca

SEQ ID NO: 3910753 - RNA, 15 nt, Shigella flexneri 2a str. 301
gcuccagacgccaga

SEQ ID NO: 3910754 - RNA, 20 nt, Shigella flexneri 2a str. 301
gcuccagauuaccagcgaca

SEQ ID NO: 3910755 - RNA, 16 nt, Shigella flexneri 2a str. 301
gcuccagcagguuuaa

SEQ ID NO: 3910756 - RNA, 16 nt, Shigella flexneri 2a str. 301
gcuccagcguaccugc

SEQ ID NO: 3910757 - RNA, 20 nt, Shigella flexneri 2a str. 301
gcuccaguaccugcaaaccg

SEQ ID NO: 3910758 - RNA, 16 nt, Shigella flexneri 2a str. 301
gcuccagugcgcuuua

SEQ ID NO: 3910759 - RNA, 12 nt, Shigella flexneri 2a str. 301
gcuccccagaau

SEQ ID NO: 3910760 - RNA, 13 nt, Shigella flexneri 2a str. 301
gcucccgcagcca

SEQ ID NO: 3910761 - RNA, 17 nt, Shigella flexneri 2a str. 301
gcucccgcagccacucc

SEQ ID NO: 3910762 - RNA, 19 nt, Shigella flexneri 2a str. 301
gcucccgcaggagcgccga

SEQ ID NO: 3910763 - RNA, 22 nt, Shigella flexneri 2a str. 301
gcucccugccaguccugcucaa

SEQ ID NO: 3910764 - RNA, 18 nt, Shigella flexneri 2a str. 301
gcucccuggcccaucgcc

SEQ ID NO: 3910765 - RNA, 16 nt, Shigella flexneri 2a str. 301
gcucccuuaucgggaa

SEQ ID NO: 3910766 - RNA, 17 nt, Shigella flexneri 2a str. 301
gcucccuucggggcggc

SEQ ID NO: 3910767 - RNA, 22 nt, Shigella flexneri 2a str. 301
gcucccuuuggccgcucgggaa

SEQ ID NO: 3910768 - RNA, 15 nt, Shigella flexneri 2a str. 301
gcuccgcaagcgaau

SEQ ID NO: 3910769 - RNA, 24 nt, Shigella flexneri 2a str. 301
gcuccggcaccucccccugagcag

SEQ ID NO: 3910770 - RNA, 21 nt, Shigella flexneri 2a str. 301
gcuccggcggcacagccagcg

SEQ ID NO: 3910771 - RNA, 22 nt, Shigella flexneri 2a str. 301
gcuccgggugugacaacaacau

SEQ ID NO: 3910772 - RNA, 17 nt, Shigella flexneri 2a str. 301
gcuccgguuaacgccgc

SEQ ID NO: 3910773 - RNA, 16 nt, Shigella flexneri 2a str. 301
gcuccugcauugacuc

SEQ ID NO: 3910774 - RNA, 22 nt, Shigella flexneri 2a str. 301
gcuccugcauugacucgccuuc

SEQ ID NO: 3910775 - RNA, 19 nt, Shigella flexneri 2a str. 301
gcuccuguaugacccggua

SEQ ID NO: 3910776 - RNA, 18 nt, Shigella flexneri 2a str. 301
gcuccuuaauaaaauacu

SEQ ID NO: 3910777 - RNA, 16 nt, Shigella flexneri 2a str. 301
gcucgacaccaaacag

SEQ ID NO: 3910778 - RNA, 13 nt, Shigella flexneri 2a str. 301
gcucgacagcgcu

SEQ ID NO: 3910779 - RNA, 20 nt, Shigella flexneri 2a str. 301
gcucgacgucacaggccauc

SEQ ID NO: 3910780 - RNA, 16 nt, Shigella flexneri 2a str. 301
gcucgagagagaaaau

SEQ ID NO: 3910781 - RNA, 12 nt, Shigella flexneri 2a str. 301
gcucgcacuuuc

SEQ ID NO: 3910782 - RNA, 15 nt, Shigella flexneri 2a str. 301
gcucgccgcagagau

SEQ ID NO: 3910783 - RNA, 23 nt, Shigella flexneri 2a str. 301
gcucgccgcagagaucagauaau

SEQ ID NO: 3910784 - RNA, 12 nt, Shigella flexneri 2a str. 301
gcucgccgccgc

SEQ ID NO: 3910785 - RNA, 14 nt, Shigella flexneri 2a str. 301
gcucgccgccgcug

SEQ ID NO: 3910786 - RNA, 23 nt, Shigella flexneri 2a str. 301
gcucgccuuucggcugcagcagu

SEQ ID NO: 3910787 - RNA, 19 nt, Shigella flexneri 2a str. 301
gcucgcgccgcauccgaca

SEQ ID NO: 3910788 - RNA, 22 nt, Shigella flexneri 2a str. 301
gcucgcgcuugcggaagcaacc

SEQ ID NO: 3910789 - RNA, 24 nt, Shigella flexneri 2a str. 301
gcucgcgcuugcggaagcaaccgg

SEQ ID NO: 3910790 - RNA, 21 nt, Shigella flexneri 2a str. 301
gcucgcgguuagcggcuucgu

SEQ ID NO: 3910791 - RNA, 12 nt, Shigella flexneri 2a str. 301
gcucgcuggaag

SEQ ID NO: 3910792 - RNA, 15 nt, Shigella flexneri 2a str. 301
gcucgcuggcaggcc

SEQ ID NO: 3910793 - RNA, 16 nt, Shigella flexneri 2a str. 301
gcucgcuucaucugcc

SEQ ID NO: 3910794 - RNA, 17 nt, Shigella flexneri 2a str. 301
gcucggcuccgggcgca

SEQ ID NO: 3910795 - RNA, 15 nt, Shigella flexneri 2a str. 301
gcucggucacugaca

SEQ ID NO: 3910796 - RNA, 22 nt, Shigella flexneri 2a str. 301
gcucguauaaugacugcccuga

SEQ ID NO: 3910797 - RNA, 16 nt, Shigella flexneri 2a str. 301
gcucgugggauugccg

SEQ ID NO: 3910798 - RNA, 20 nt, Shigella flexneri 2a str. 301
gcucguuacuuuccuucagc

SEQ ID NO: 3910799 - RNA, 17 nt, Shigella flexneri 2a str. 301
gcucguucagcggcccg

SEQ ID NO: 3910800 - RNA, 20 nt, Shigella flexneri 2a str. 301
gcucguucagcggcccguug

SEQ ID NO: 3910801 - RNA, 23 nt, Shigella flexneri 2a str. 301
gcucguugcagaaugauggcuga

SEQ ID NO: 3910802 - RNA, 23 nt, Shigella flexneri 2a str. 301
gcucguugccugcgaagcucuuu

SEQ ID NO: 3910803 - RNA, 17 nt, Shigella flexneri 2a str. 301
gcucuacaauauccuca

SEQ ID NO: 3910804 - RNA, 15 nt, Shigella flexneri 2a str. 301
gcucucaaauaucug

SEQ ID NO: 3910805 - RNA, 22 nt, Shigella flexneri 2a str. 301
gcucucacuuauuuguuauuac

SEQ ID NO: 3910806 - RNA, 14 nt, Shigella flexneri 2a str. 301
gcucucauuuuuca

SEQ ID NO: 3910807 - RNA, 13 nt, Shigella flexneri 2a str. 301
gcucucccauggc

SEQ ID NO: 3910808 - RNA, 19 nt, Shigella flexneri 2a str. 301
gcucuccugaacuuucucc

SEQ ID NO: 3910809 - RNA, 20 nt, Shigella flexneri 2a str. 301
gcucucgcagcucaucaaca

SEQ ID NO: 3910810 - RNA, 14 nt, Shigella flexneri 2a str. 301
gcucucgccagcac

SEQ ID NO: 3910811 - RNA, 13 nt, Shigella flexneri 2a str. 301
gcucucuuccagu

SEQ ID NO: 3910812 - RNA, 19 nt, Shigella flexneri 2a str. 301
gcucucuuucaccagcgcg

SEQ ID NO: 3910813 - RNA, 14 nt, Shigella flexneri 2a str. 301
gcucucuuucucca

SEQ ID NO: 3910814 - RNA, 19 nt, Shigella flexneri 2a str. 301
gcucugacaccaucaccca

SEQ ID NO: 3910815 - RNA, 12 nt, Shigella flexneri 2a str. 301
gcucugccagac

SEQ ID NO: 3910816 - RNA, 15 nt, Shigella flexneri 2a str. 301
gcucugccagcaaau

SEQ ID NO: 3910817 - RNA, 17 nt, Shigella flexneri 2a str. 301
gcucugccagcaaauag

SEQ ID NO: 3910818 - RNA, 19 nt, Shigella flexneri 2a str. 301
gcucugccagcaaauagau

SEQ ID NO: 3910819 - RNA, 15 nt, Shigella flexneri 2a str. 301
gcucugcgccgccuu

SEQ ID NO: 3910820 - RNA, 19 nt, Shigella flexneri 2a str. 301
gcucugcgcgugcaguggu

SEQ ID NO: 3910821 - RNA, 19 nt, Shigella flexneri 2a str. 301
gcucugcugucaccgaagc

SEQ ID NO: 3910822 - RNA, 17 nt, Shigella flexneri 2a str. 301
gcucugcuuucucagca

SEQ ID NO: 3910823 - RNA, 18 nt, Shigella flexneri 2a str. 301
gcucugcuuucucagcaa

SEQ ID NO: 3910824 - RNA, 21 nt, Shigella flexneri 2a str. 301
gcucuggauaaucacaauggu

SEQ ID NO: 3910825 - RNA, 23 nt, Shigella flexneri 2a str. 301
gcucuggcaggcuucaauuuuuu

SEQ ID NO: 3910826 - RNA, 19 nt, Shigella flexneri 2a str. 301
gcucuggcggagcucccag

SEQ ID NO: 3910827 - RNA, 19 nt, Shigella flexneri 2a str. 301
gcucugguucaccauucug

SEQ ID NO: 3910828 - RNA, 17 nt, Shigella flexneri 2a str. 301
gcucugguugugguggg

SEQ ID NO: 3910829 - RNA, 15 nt, Shigella flexneri 2a str. 301
gcucuucaaugguca

SEQ ID NO: 3910830 - RNA, 19 nt, Shigella flexneri 2a str. 301
gcucuucaauggucagcca

SEQ ID NO: 3910831 - RNA, 14 nt, Shigella flexneri 2a str. 301
gcucuucaugcagc

SEQ ID NO: 3910832 - RNA, 21 nt, Shigella flexneri 2a str. 301
gcucuucaugcagcaugguca

SEQ ID NO: 3910833 - RNA, 22 nt, Shigella flexneri 2a str. 301
gcucuuccaggcauuaaauccu

SEQ ID NO: 3910834 - RNA, 15 nt, Shigella flexneri 2a str. 301
gcucuuccuucagcu

SEQ ID NO: 3910835 - RNA, 17 nt, Shigella flexneri 2a str. 301
gcucuucuggcaccagu

SEQ ID NO: 3910836 - RNA, 22 nt, Shigella flexneri 2a str. 301
gcucuucuucacucucaccacg

SEQ ID NO: 3910837 - RNA, 23 nt, Shigella flexneri 2a str. 301
gcucuucuucgcgauaaaucaga

SEQ ID NO: 3910838 - RNA, 16 nt, Shigella flexneri 2a str. 301
gcucuucuuucaucau

SEQ ID NO: 3910839 - RNA, 21 nt, Shigella flexneri 2a str. 301
gcucuuguucgaagacaucca

SEQ ID NO: 3910840 - RNA, 15 nt, Shigella flexneri 2a str. 301
gcucuuucagcaccg

SEQ ID NO: 3910841 - RNA, 14 nt, Shigella flexneri 2a str. 301
gcugccgucaauuu

SEQ ID NO: 3910842 - RNA, 14 nt, Shigella flexneri 2a str. 301
gcugccguuuucaa

SEQ ID NO: 3910843 - RNA, 18 nt, Shigella flexneri 2a str. 301
gcugccguuuucaaaggu

SEQ ID NO: 3910844 - RNA, 14 nt, Shigella flexneri 2a str. 301
gcugccuacacaau

SEQ ID NO: 3910845 - RNA, 12 nt, Shigella flexneri 2a str. 301
gcugccucgcug

SEQ ID NO: 3910846 - RNA, 23 nt, Shigella flexneri 2a str. 301
gcugccuggcccauagacagggu

SEQ ID NO: 3910847 - RNA, 15 nt, Shigella flexneri 2a str. 301
gcugccuuucgcucc

SEQ ID NO: 3910848 - RNA, 16 nt, Shigella flexneri 2a str. 301
gcugcgaaucgcuuca

SEQ ID NO: 3910849 - RNA, 22 nt, Shigella flexneri 2a str. 301
gcugcgauaguggaacaaagaa

SEQ ID NO: 3910850 - RNA, 13 nt, Shigella flexneri 2a str. 301
gcugcgccccaca

SEQ ID NO: 3910851 - RNA, 18 nt, Shigella flexneri 2a str. 301
gcugcgccccacaccacc

SEQ ID NO: 3910852 - RNA, 11 nt, Shigella flexneri 2a str. 301
gcugcgcccgc

SEQ ID NO: 3910853 - RNA, 15 nt, Shigella flexneri 2a str. 301
gcugcgcgacggcga

SEQ ID NO: 3910854 - RNA, 17 nt, Shigella flexneri 2a str. 301
gcugcggaauugccggu

SEQ ID NO: 3910855 - RNA, 15 nt, Shigella flexneri 2a str. 301
gcugcggcgcgcauc

SEQ ID NO: 3910856 - RNA, 19 nt, Shigella flexneri 2a str. 301
gcugcggcguuccccaguu

SEQ ID NO: 3910857 - RNA, 12 nt, Shigella flexneri 2a str. 301
gcugcgucaguu

SEQ ID NO: 3910858 - RNA, 14 nt, Shigella flexneri 2a str. 301
gcugcgugccuaau

SEQ ID NO: 3910859 - RNA, 16 nt, Shigella flexneri 2a str. 301
gcugcguuccggcaug

SEQ ID NO: 3910860 - RNA, 20 nt, Shigella flexneri 2a str. 301
gcugcguuugcccuaaagcg

SEQ ID NO: 3910861 - RNA, 18 nt, Shigella flexneri 2a str. 301
gcugcuacgccgucauua

SEQ ID NO: 3910862 - RNA, 12 nt, Shigella flexneri 2a str. 301
gcugcuauccag

SEQ ID NO: 3910863 - RNA, 12 nt, Shigella flexneri 2a str. 301
gcugcuccagcg

SEQ ID NO: 3910864 - RNA, 16 nt, Shigella flexneri 2a str. 301
gcugcuccugcggcug

SEQ ID NO: 3910865 - RNA, 23 nt, Shigella flexneri 2a str. 301
gcugcugacuuugauccagccau

SEQ ID NO: 3910866 - RNA, 14 nt, Shigella flexneri 2a str. 301
gcugcugauccagc

SEQ ID NO: 3910867 - RNA, 16 nt, Shigella flexneri 2a str. 301
gcugcugauccagcuu

SEQ ID NO: 3910868 - RNA, 18 nt, Shigella flexneri 2a str. 301
gcugcugcguuccggcau

SEQ ID NO: 3910869 - RNA, 18 nt, Shigella flexneri 2a str. 301
gcugcuguagcaguucca

SEQ ID NO: 3910870 - RNA, 22 nt, Shigella flexneri 2a str. 301
gcugcuguggauucagcaccgu

SEQ ID NO: 3910871 - RNA, 15 nt, Shigella flexneri 2a str. 301
gcugcuucauugcuc

SEQ ID NO: 3910872 - RNA, 13 nt, Shigella flexneri 2a str. 301
gcugcuuuauauu

SEQ ID NO: 3910873 - RNA, 20 nt, Shigella flexneri 2a str. 301
gcugcuuuuccggucagcaa

SEQ ID NO: 3910874 - RNA, 19 nt, Shigella flexneri 2a str. 301
gcuggaaagcguaaacggu

SEQ ID NO: 3910875 - RNA, 23 nt, Shigella flexneri 2a str. 301
gcuggaaaugaccauaaaaggca

SEQ ID NO: 3910876 - RNA, 17 nt, Shigella flexneri 2a str. 301
gcuggaaauguccgcga

SEQ ID NO: 3910877 - RNA, 20 nt, Shigella flexneri 2a str. 301
gcuggaacgcuucugucgcu

SEQ ID NO: 3910878 - RNA, 22 nt, Shigella flexneri 2a str. 301
gcuggacgcgccaacaaaugga

SEQ ID NO: 3910879 - RNA, 21 nt, Shigella flexneri 2a str. 301
gcuggacguugcguugcagca

SEQ ID NO: 3910880 - RNA, 23 nt, Shigella flexneri 2a str. 301
gcuggacucccagaacaacccgg

SEQ ID NO: 3910881 - RNA, 20 nt, Shigella flexneri 2a str. 301
gcuggagcacccgcgcuggc

SEQ ID NO: 3910882 - RNA, 13 nt, Shigella flexneri 2a str. 301
gcuggagcgggga

SEQ ID NO: 3910883 - RNA, 21 nt, Shigella flexneri 2a str. 301
gcuggaguggugaaacaggga

SEQ ID NO: 3910884 - RNA, 17 nt, Shigella flexneri 2a str. 301
gcuggauaaggcguuua

SEQ ID NO: 3910885 - RNA, 19 nt, Shigella flexneri 2a str. 301
gcuggaucagacgcagcca

SEQ ID NO: 3910886 - RNA, 17 nt, Shigella flexneri 2a str. 301
gcuggaucugcggguua

SEQ ID NO: 3910887 - RNA, 23 nt, Shigella flexneri 2a str. 301
gcuggaucugcggguuagucugc

SEQ ID NO: 3910888 - RNA, 19 nt, Shigella flexneri 2a str. 301
gcuggauggcgcaaugcca

SEQ ID NO: 3910889 - RNA, 19 nt, Shigella flexneri 2a str. 301
gcuggauuaacgcugggga

SEQ ID NO: 3910890 - RNA, 18 nt, Shigella flexneri 2a str. 301
gcuggcaaauucaggagc

SEQ ID NO: 3910891 - RNA, 19 nt, Shigella flexneri 2a str. 301
gcuggcaauaaagugaucc

SEQ ID NO: 3910892 - RNA, 22 nt, Shigella flexneri 2a str. 301
gcuggcaauacuggcagcaguc

SEQ ID NO: 3910893 - RNA, 13 nt, Shigella flexneri 2a str. 301
gcuggcaaugacc

SEQ ID NO: 3910894 - RNA, 16 nt, Shigella flexneri 2a str. 301
gcuggcacgcucuuca

SEQ ID NO: 3910895 - RNA, 15 nt, Shigella flexneri 2a str. 301
gcuggcagaccugcu

SEQ ID NO: 3910896 - RNA, 20 nt, Shigella flexneri 2a str. 301
gcuggcagaugcgucuucug

SEQ ID NO: 3910897 - RNA, 17 nt, Shigella flexneri 2a str. 301
gcuggcagcugcuacgc

SEQ ID NO: 3910898 - RNA, 20 nt, Shigella flexneri 2a str. 301
gcuggcauuacaagaaucau

SEQ ID NO: 3910899 - RNA, 18 nt, Shigella flexneri 2a str. 301
gcuggccacaaaccuuaa

SEQ ID NO: 3910900 - RNA, 15 nt, Shigella flexneri 2a str. 301
gcuggcccaucagaa

SEQ ID NO: 3910901 - RNA, 20 nt, Shigella flexneri 2a str. 301
gcuggccccgucagcaaaau

SEQ ID NO: 3910902 - RNA, 18 nt, Shigella flexneri 2a str. 301
gcuggccgcgucuuaucc

SEQ ID NO: 3910903 - RNA, 14 nt, Shigella flexneri 2a str. 301
gcuggccuccagua

SEQ ID NO: 3910904 - RNA, 15 nt, Shigella flexneri 2a str. 301
gcuggccuggcuggu

SEQ ID NO: 3910905 - RNA, 16 nt, Shigella flexneri 2a str. 301
gcuggccuggcuggug

SEQ ID NO: 3910906 - RNA, 18 nt, Shigella flexneri 2a str. 301
gcuggccuggcuggugac

SEQ ID NO: 3910907 - RNA, 17 nt, Shigella flexneri 2a str. 301
gcuggcgaacgugcagg

SEQ ID NO: 3910908 - RNA, 15 nt, Shigella flexneri 2a str. 301
gcuggcgauuccacu

SEQ ID NO: 3910909 - RNA, 22 nt, Shigella flexneri 2a str. 301
gcuggcgcauguuggcgcggug

SEQ ID NO: 3910910 - RNA, 21 nt, Shigella flexneri 2a str. 301
gcuggcgcucaagucgaaccu

SEQ ID NO: 3910911 - RNA, 17 nt, Shigella flexneri 2a str. 301
gcuggcggaaacggguu

SEQ ID NO: 3910912 - RNA, 16 nt, Shigella flexneri 2a str. 301
gcuggcguacccauca

SEQ ID NO: 3910913 - RNA, 17 nt, Shigella flexneri 2a str. 301
gcuggcguacccaucaa

SEQ ID NO: 3910914 - RNA, 18 nt, Shigella flexneri 2a str. 301
gcuggcgucacgccgacc

SEQ ID NO: 3910915 - RNA, 11 nt, Shigella flexneri 2a str. 301
gcuggcugacc

SEQ ID NO: 3910916 - RNA, 15 nt, Shigella flexneri 2a str. 301
gcuggcuggcacgcu

SEQ ID NO: 3910917 - RNA, 20 nt, Shigella flexneri 2a str. 301
gcuggcuuugcccuggcgcg

SEQ ID NO: 3910918 - RNA, 14 nt, Shigella flexneri 2a str. 301
gcugggaaaucacc

SEQ ID NO: 3910919 - RNA, 20 nt, Shigella flexneri 2a str. 301
gcugggaaaucaccaccagc

SEQ ID NO: 3910920 - RNA, 15 nt, Shigella flexneri 2a str. 301
gcugggauggcaaaa

SEQ ID NO: 3910921 - RNA, 17 nt, Shigella flexneri 2a str. 301
gcugggccgucagguga

SEQ ID NO: 3910922 - RNA, 18 nt, Shigella flexneri 2a str. 301
gcugggcgaucgccugaa

SEQ ID NO: 3910923 - RNA, 14 nt, Shigella flexneri 2a str. 301
gcugggcgucaucc

SEQ ID NO: 3910924 - RNA, 14 nt, Shigella flexneri 2a str. 301
gcuggggccaauac

SEQ ID NO: 3910925 - RNA, 16 nt, Shigella flexneri 2a str. 301
gcuggggcugagcgau

SEQ ID NO: 3910926 - RNA, 19 nt, Shigella flexneri 2a str. 301
gcuggguaaagacaucgcc

SEQ ID NO: 3910927 - RNA, 11 nt, Shigella flexneri 2a str. 301
gcuggguaaau

SEQ ID NO: 3910928 - RNA, 22 nt, Shigella flexneri 2a str. 301
gcuggguuucgccugccagaug

SEQ ID NO: 3910929 - RNA, 20 nt, Shigella flexneri 2a str. 301
gcugguaauccgagaaucgu

SEQ ID NO: 3910930 - RNA, 13 nt, Shigella flexneri 2a str. 301
gcugguagaagcu

SEQ ID NO: 3910931 - RNA, 14 nt, Shigella flexneri 2a str. 301
gcuggucagcaacu

SEQ ID NO: 3910932 - RNA, 14 nt, Shigella flexneri 2a str. 301
gcuggucagcaucg

SEQ ID NO: 3910933 - RNA, 16 nt, Shigella flexneri 2a str. 301
gcuggugaguaacgcg

SEQ ID NO: 3910934 - RNA, 19 nt, Shigella flexneri 2a str. 301
gcuggugccaagcuccagc

SEQ ID NO: 3910935 - RNA, 20 nt, Shigella flexneri 2a str. 301
gcuggugccaagcuccagca

SEQ ID NO: 3910936 - RNA, 18 nt, Shigella flexneri 2a str. 301
gcugguuuuguaggccgg

SEQ ID NO: 3910937 - RNA, 23 nt, Shigella flexneri 2a str. 301
gcuguaaaaggcgccauuuucau

SEQ ID NO: 3910938 - RNA, 15 nt, Shigella flexneri 2a str. 301
gcuguaaccagcgca

SEQ ID NO: 3910939 - RNA, 20 nt, Shigella flexneri 2a str. 301
gcuguaauuucacaccauca

SEQ ID NO: 3910940 - RNA, 14 nt, Shigella flexneri 2a str. 301
gcuguacagcagua

SEQ ID NO: 3910941 - RNA, 14 nt, Shigella flexneri 2a str. 301
gcuucagcgcgucg

SEQ ID NO: 3910942 - RNA, 17 nt, Shigella flexneri 2a str. 301
gcuucagcguaucccag

SEQ ID NO: 3910943 - RNA, 18 nt, Shigella flexneri 2a str. 301
gcuucagucgccagcgcc

SEQ ID NO: 3910944 - RNA, 15 nt, Shigella flexneri 2a str. 301
gcuucauaaagauaa

SEQ ID NO: 3910945 - RNA, 18 nt, Shigella flexneri 2a str. 301
gcuucauaaagauaaugu

SEQ ID NO: 3910946 - RNA, 18 nt, Shigella flexneri 2a str. 301
gcuucauaggcuuccacu

SEQ ID NO: 3910947 - RNA, 15 nt, Shigella flexneri 2a str. 301
gcuucauauagaucu

SEQ ID NO: 3910948 - RNA, 19 nt, Shigella flexneri 2a str. 301
gcuucauccagcagugacu

SEQ ID NO: 3910949 - RNA, 21 nt, Shigella flexneri 2a str. 301
gcuucaucgguuaaccggcaa

SEQ ID NO: 3910950 - RNA, 21 nt, Shigella flexneri 2a str. 301
gcuucaucgugcucgcuuucc

SEQ ID NO: 3910951 - RNA, 18 nt, Shigella flexneri 2a str. 301
gcuucaugcaucgguuuu

SEQ ID NO: 3910952 - RNA, 14 nt, Shigella flexneri 2a str. 301
gcuucaugcuuaau

SEQ ID NO: 3910953 - RNA, 13 nt, Shigella flexneri 2a str. 301
gcuucauuuacau

SEQ ID NO: 3910954 - RNA, 15 nt, Shigella flexneri 2a str. 301
gcuuccaccgccgga

SEQ ID NO: 3910955 - RNA, 19 nt, Shigella flexneri 2a str. 301
gcuuccaccguuucuuuuu

SEQ ID NO: 3910956 - RNA, 12 nt, Shigella flexneri 2a str. 301
gcuuccagcucc

SEQ ID NO: 3910957 - RNA, 15 nt, Shigella flexneri 2a str. 301
gcuucccaaagaucu

SEQ ID NO: 3910958 - RNA, 22 nt, Shigella flexneri 2a str. 301
gcuucccggcaaucgccagauc

SEQ ID NO: 3910959 - RNA, 15 nt, Shigella flexneri 2a str. 301
gcuuccgccagcggc

SEQ ID NO: 3910960 - RNA, 16 nt, Shigella flexneri 2a str. 301
gcuuccgccagcggcg

SEQ ID NO: 3910961 - RNA, 15 nt, Shigella flexneri 2a str. 301
gcuuccggcaauggc

SEQ ID NO: 3910962 - RNA, 16 nt, Shigella flexneri 2a str. 301
gcuuccggcaauggcu

SEQ ID NO: 3910963 - RNA, 19 nt, Shigella flexneri 2a str. 301
gcuuccgguuguucaacca

SEQ ID NO: 3910964 - RNA, 19 nt, Shigella flexneri 2a str. 301
gcuuccugaacucgccagc

SEQ ID NO: 3910965 - RNA, 18 nt, Shigella flexneri 2a str. 301
gcuuccugaguaauaacu

SEQ ID NO: 3910966 - RNA, 16 nt, Shigella flexneri 2a str. 301
gcuucgccugagcggc

SEQ ID NO: 3910967 - RNA, 21 nt, Shigella flexneri 2a str. 301
gcuucgccuuuuaccagcgcc

SEQ ID NO: 3910968 - RNA, 19 nt, Shigella flexneri 2a str. 301
gcuucgcgaaucgccacaa

SEQ ID NO: 3910969 - RNA, 22 nt, Shigella flexneri 2a str. 301
gcuucgcggacaucguccagcu

SEQ ID NO: 3910970 - RNA, 21 nt, Shigella flexneri 2a str. 301
gcuucgcucucuuucaccagc

SEQ ID NO: 3910971 - RNA, 17 nt, Shigella flexneri 2a str. 301
gcuucgcuuaucaggcc

SEQ ID NO: 3910972 - RNA, 13 nt, Shigella flexneri 2a str. 301
gcuucgcuuccca

SEQ ID NO: 3910973 - RNA, 14 nt, Shigella flexneri 2a str. 301
gcuucgcuucccaa

SEQ ID NO: 3910974 - RNA, 12 nt, Shigella flexneri 2a str. 301
gcuucguccaug

SEQ ID NO: 3910975 - RNA, 20 nt, Shigella flexneri 2a str. 301
gcuucgucgucaccugcguc

SEQ ID NO: 3910976 - RNA, 13 nt, Shigella flexneri 2a str. 301
gcuucguuuucag

SEQ ID NO: 3910977 - RNA, 20 nt, Shigella flexneri 2a str. 301
gcuucucaggccuacccggu

SEQ ID NO: 3910978 - RNA, 19 nt, Shigella flexneri 2a str. 301
gcuucucccagccgcccug

SEQ ID NO: 3910979 - RNA, 18 nt, Shigella flexneri 2a str. 301
gcuucucgugaaacucac

SEQ ID NO: 3910980 - RNA, 21 nt, Shigella flexneri 2a str. 301
gcuucucgugaaacucacgca

SEQ ID NO: 3910981 - RNA, 20 nt, Shigella flexneri 2a str. 301
gcuucucuucagccaacgca

SEQ ID NO: 3910982 - RNA, 22 nt, Shigella flexneri 2a str. 301
gcuucugacauaaccacucacc

SEQ ID NO: 3910983 - RNA, 12 nt, Shigella flexneri 2a str. 301
gcuucugcagcu

SEQ ID NO: 3910984 - RNA, 14 nt, Shigella flexneri 2a str. 301
gcuucugcagcuuu

SEQ ID NO: 3910985 - RNA, 19 nt, Shigella flexneri 2a str. 301
gcuucugccaguuguugcu

SEQ ID NO: 3910986 - RNA, 18 nt, Shigella flexneri 2a str. 301
gcuucugccuuauccagc

SEQ ID NO: 3910987 - RNA, 21 nt, Shigella flexneri 2a str. 301
gcuucugccuuauccagcaga

SEQ ID NO: 3910988 - RNA, 17 nt, Shigella flexneri 2a str. 301
gcuucugcguucugauu

SEQ ID NO: 3910989 - RNA, 23 nt, Shigella flexneri 2a str. 301
gcuucugcguucugauuuaaucu

SEQ ID NO: 3910990 - RNA, 15 nt, Shigella flexneri 2a str. 301
gcuucuggcggcggc

SEQ ID NO: 3910991 - RNA, 16 nt, Shigella flexneri 2a str. 301
gcuucuggcggcggca

SEQ ID NO: 3910992 - RNA, 15 nt, Shigella flexneri 2a str. 301
gcuucuuccggcgau

SEQ ID NO: 3910993 - RNA, 11 nt, Shigella flexneri 2a str. 301
gcuucuuucuc

SEQ ID NO: 3910994 - RNA, 23 nt, Shigella flexneri 2a str. 301
gcuucuuuuuaccuucauuugcc

SEQ ID NO: 3910995 - RNA, 20 nt, Shigella flexneri 2a str. 301
gcuucuuuuuuauggcuggc

SEQ ID NO: 3910996 - RNA, 18 nt, Shigella flexneri 2a str. 301
gcuugacgcgucuuauca

SEQ ID NO: 3910997 - RNA, 22 nt, Shigella flexneri 2a str. 301
gcuugacgcgucuuaucaggcc

SEQ ID NO: 3910998 - RNA, 20 nt, Shigella flexneri 2a str. 301
gcuugagcaggagcagcagg

SEQ ID NO: 3910999 - RNA, 19 nt, Shigella flexneri 2a str. 301
gcuugaggaucaacugaaa

SEQ ID NO: 3911000 - RNA, 18 nt, Shigella flexneri 2a str. 301
gcuugaugcacugggaga

SEQ ID NO: 3911001 - RNA, 22 nt, Shigella flexneri 2a str. 301
gcuugcaccggcgacaucccag

SEQ ID NO: 3911002 - RNA, 19 nt, Shigella flexneri 2a str. 301
gcuugcaggaucagcuccg

SEQ ID NO: 3911003 - RNA, 15 nt, Shigella flexneri 2a str. 301
gcuugccagagcagc

SEQ ID NO: 3911004 - RNA, 19 nt, Shigella flexneri 2a str. 301
gcuugccagauggcaucca

SEQ ID NO: 3911005 - RNA, 18 nt, Shigella flexneri 2a str. 301
gcuugcgauauucuucag

SEQ ID NO: 3911006 - RNA, 17 nt, Shigella flexneri 2a str. 301
gcuugcgauccugcaga

SEQ ID NO: 3911007 - RNA, 23 nt, Shigella flexneri 2a str. 301
gcuugcgcaguaaaucguccguu

SEQ ID NO: 3911008 - RNA, 18 nt, Shigella flexneri 2a str. 301
gcuugcgcgcaaucagca

SEQ ID NO: 3911009 - RNA, 16 nt, Shigella flexneri 2a str. 301
gcuugcgucauccagc

SEQ ID NO: 3911010 - RNA, 17 nt, Shigella flexneri 2a str. 301
gcuugcgucauccagca

SEQ ID NO: 3911011 - RNA, 20 nt, Shigella flexneri 2a str. 301
gcuugcgucauccagcacuu

SEQ ID NO: 3911012 - RNA, 14 nt, Shigella flexneri 2a str. 301
gcuugcucaaguug

SEQ ID NO: 3911013 - RNA, 23 nt, Shigella flexneri 2a str. 301
gcuugcugauaacgugcagcuuu

SEQ ID NO: 3911014 - RNA, 15 nt, Shigella flexneri 2a str. 301
gcuugcuuuccagcu

SEQ ID NO: 3911015 - RNA, 15 nt, Shigella flexneri 2a str. 301
gcuuggcaagcccag

SEQ ID NO: 3911016 - RNA, 19 nt, Shigella flexneri 2a str. 301
gcuuggcaagcccagcacc

SEQ ID NO: 3911017 - RNA, 12 nt, Shigella flexneri 2a str. 301
gcuuggcagagc

SEQ ID NO: 3911018 - RNA, 11 nt, Shigella flexneri 2a str. 301
gcuugggcaga

SEQ ID NO: 3911019 - RNA, 13 nt, Shigella flexneri 2a str. 301
gcuugggcagaau

SEQ ID NO: 3911020 - RNA, 20 nt, Shigella flexneri 2a str. 301
gcuugguucuccaaauacau

SEQ ID NO: 3911021 - RNA, 15 nt, Shigella flexneri 2a str. 301
gcuugguuuugccau

SEQ ID NO: 3911022 - RNA, 18 nt, Shigella flexneri 2a str. 301
gcuugguuuugccaugca

SEQ ID NO: 3911023 - RNA, 22 nt, Shigella flexneri 2a str. 301
gcuuguaaaugaacucaacgcc

SEQ ID NO: 3911024 - RNA, 16 nt, Shigella flexneri 2a str. 301
gcuuguggugaaacua

SEQ ID NO: 3911025 - RNA, 16 nt, Shigella flexneri 2a str. 301
gcuuguucaucaccau

SEQ ID NO: 3911026 - RNA, 13 nt, Shigella flexneri 2a str. 301
gcuuuaaacgauu

SEQ ID NO: 3911027 - RNA, 15 nt, Shigella flexneri 2a str. 301
gcuuuacgcuuaucc

SEQ ID NO: 3911028 - RNA, 15 nt, Shigella flexneri 2a str. 301
gcuuuauacaaauga

SEQ ID NO: 3911029 - RNA, 12 nt, Shigella flexneri 2a str. 301
gcuuuauauucu

SEQ ID NO: 3911030 - RNA, 21 nt, Shigella flexneri 2a str. 301
gcuuucaccugcgcgugaccg

SEQ ID NO: 3911031 - RNA, 21 nt, Shigella flexneri 2a str. 301
gcuuucacgccgccguuagcu

SEQ ID NO: 3911032 - RNA, 21 nt, Shigella flexneri 2a str. 301
gcuuucacucugaaaacgcug

SEQ ID NO: 3911033 - RNA, 18 nt, Shigella flexneri 2a str. 301
gcuuucagagaagcaccg

SEQ ID NO: 3911034 - RNA, 15 nt, Shigella flexneri 2a str. 301
gcuuucagcacgaca

SEQ ID NO: 3911035 - RNA, 17 nt, Shigella flexneri 2a str. 301
gcuuucagcagcggcuc

SEQ ID NO: 3911036 - RNA, 20 nt, Shigella flexneri 2a str. 301
gcuuucaguucuagaacuaa

SEQ ID NO: 3911037 - RNA, 17 nt, Shigella flexneri 2a str. 301
gcuuucauauuccagcc

SEQ ID NO: 3911038 - RNA, 17 nt, Shigella flexneri 2a str. 301
gcuuuccaacuguacca

SEQ ID NO: 3911039 - RNA, 15 nt, Shigella flexneri 2a str. 301
gcuuuccaccaucac

SEQ ID NO: 3911040 - RNA, 23 nt, Shigella flexneri 2a str. 301
gcuuuccaccaucacgccaauaa

SEQ ID NO: 3911041 - RNA, 21 nt, Shigella flexneri 2a str. 301
ggaagagcgacaaucccugca

SEQ ID NO: 3911042 - RNA, 12 nt, Shigella flexneri 2a str. 301
ggaagaguuugu

SEQ ID NO: 3911043 - RNA, 20 nt, Shigella flexneri 2a str. 301
ggaagauguacgccagugcu

SEQ ID NO: 3911044 - RNA, 15 nt, Shigella flexneri 2a str. 301
ggaagccaccacgcc

SEQ ID NO: 3911045 - RNA, 20 nt, Shigella flexneri 2a str. 301
ggaagccggaauuuuccuuc

SEQ ID NO: 3911046 - RNA, 16 nt, Shigella flexneri 2a str. 301
ggaagccuaucgucau

SEQ ID NO: 3911047 - RNA, 18 nt, Shigella flexneri 2a str. 301
ggaagcuuucgcaguaga

SEQ ID NO: 3911048 - RNA, 17 nt, Shigella flexneri 2a str. 301
ggaaggaagacgcagca

SEQ ID NO: 3911049 - RNA, 20 nt, Shigella flexneri 2a str. 301
ggaaggauuacucagcgcug

SEQ ID NO: 3911050 - RNA, 16 nt, Shigella flexneri 2a str. 301
ggaaggcccuuucccu

SEQ ID NO: 3911051 - RNA, 19 nt, Shigella flexneri 2a str. 301
ggaaggguguucauccugg

SEQ ID NO: 3911052 - RNA, 18 nt, Shigella flexneri 2a str. 301
ggaaguaccaauggcaau

SEQ ID NO: 3911053 - RNA, 21 nt, Shigella flexneri 2a str. 301
ggaaguauuucaauauggaag

SEQ ID NO: 3911054 - RNA, 22 nt, Shigella flexneri 2a str. 301
ggaaguuaauuucgacgggcug

SEQ ID NO: 3911055 - RNA, 13 nt, Shigella flexneri 2a str. 301
ggaaguuacucaa

SEQ ID NO: 3911056 - RNA, 15 nt, Shigella flexneri 2a str. 301
ggaauaaaagccagg

SEQ ID NO: 3911057 - RNA, 18 nt, Shigella flexneri 2a str. 301
ggaauaagacuggcaaau

SEQ ID NO: 3911058 - RNA, 19 nt, Shigella flexneri 2a str. 301
ggaauagcggcaagcccag

SEQ ID NO: 3911059 - RNA, 20 nt, Shigella flexneri 2a str. 301
ggaauagcuuuacccaaauc

SEQ ID NO: 3911060 - RNA, 16 nt, Shigella flexneri 2a str. 301
ggaauccgggucugua

SEQ ID NO: 3911061 - RNA, 19 nt, Shigella flexneri 2a str. 301
ggaaucgcaaagccgauac

SEQ ID NO: 3911062 - RNA, 21 nt, Shigella flexneri 2a str. 301
ggaaugcauuguuacaccguc

SEQ ID NO: 3911063 - RNA, 19 nt, Shigella flexneri 2a str. 301
ggaauuaacgauacuucug

SEQ ID NO: 3911064 - RNA, 13 nt, Shigella flexneri 2a str. 301
ggaauuuuacagc

SEQ ID NO: 3911065 - RNA, 18 nt, Shigella flexneri 2a str. 301
ggaauuuuacagcccugg

SEQ ID NO: 3911066 - RNA, 13 nt, Shigella flexneri 2a str. 301
ggacacacuucau

SEQ ID NO: 3911067 - RNA, 13 nt, Shigella flexneri 2a str. 301
ggacaccucacca

SEQ ID NO: 3911068 - RNA, 20 nt, Shigella flexneri 2a str. 301
ggacacugcuuacaggcugg

SEQ ID NO: 3911069 - RNA, 16 nt, Shigella flexneri 2a str. 301
ggacagacuggcuauu

SEQ ID NO: 3911070 - RNA, 18 nt, Shigella flexneri 2a str. 301
ggacagacuggcuauuaa

SEQ ID NO: 3911071 - RNA, 16 nt, Shigella flexneri 2a str. 301
ggacagcguugccagc

SEQ ID NO: 3911072 - RNA, 13 nt, Shigella flexneri 2a str. 301
ggacaggcggccc

SEQ ID NO: 3911073 - RNA, 20 nt, Shigella flexneri 2a str. 301
ggacaguaaaguuuuauccc

SEQ ID NO: 3911074 - RNA, 17 nt, Shigella flexneri 2a str. 301
ggacagugggauuaaaa

SEQ ID NO: 3911075 - RNA, 22 nt, Shigella flexneri 2a str. 301
ggacaugauuacugcaaacuca

SEQ ID NO: 3911076 - RNA, 21 nt, Shigella flexneri 2a str. 301
ggacauuccguuugcuguauc

SEQ ID NO: 3911077 - RNA, 18 nt, Shigella flexneri 2a str. 301
ggaccaaagaaugacacu

SEQ ID NO: 3911078 - RNA, 17 nt, Shigella flexneri 2a str. 301
ggacccgcgaucgccug

SEQ ID NO: 3911079 - RNA, 19 nt, Shigella flexneri 2a str. 301
ggacccuuaaagggucagg

SEQ ID NO: 3911080 - RNA, 23 nt, Shigella flexneri 2a str. 301
ggaccgauggguucagaaucaag

SEQ ID NO: 3911081 - RNA, 15 nt, Shigella flexneri 2a str. 301
ggaccugcucugcca

SEQ ID NO: 3911082 - RNA, 18 nt, Shigella flexneri 2a str. 301
ggaccuuucugaugcaua

SEQ ID NO: 3911083 - RNA, 18 nt, Shigella flexneri 2a str. 301
ggacgaacaguucaacgc

SEQ ID NO: 3911084 - RNA, 20 nt, Shigella flexneri 2a str. 301
ggacgaauuagcauggcuga

SEQ ID NO: 3911085 - RNA, 19 nt, Shigella flexneri 2a str. 301
ggacgauaaaccaggccaa

SEQ ID NO: 3911086 - RNA, 18 nt, Shigella flexneri 2a str. 301
ggacgccaguuacugcug

SEQ ID NO: 3911087 - RNA, 16 nt, Shigella flexneri 2a str. 301
ggacgcugagcacguu

SEQ ID NO: 3911088 - RNA, 14 nt, Shigella flexneri 2a str. 301
ggacgugcaccguc

SEQ ID NO: 3911089 - RNA, 22 nt, Shigella flexneri 2a str. 301
ggacgugcaccgucacuucuuc

SEQ ID NO: 3911090 - RNA, 15 nt, Shigella flexneri 2a str. 301
ggacguuuucagcca

SEQ ID NO: 3911091 - RNA, 20 nt, Shigella flexneri 2a str. 301
ggacugaaauuacaggcagu

SEQ ID NO: 3911092 - RNA, 18 nt, Shigella flexneri 2a str. 301
ggacuggcugcguaagcg

SEQ ID NO: 3911093 - RNA, 19 nt, Shigella flexneri 2a str. 301
ggacuuaaggucacagaag

SEQ ID NO: 3911094 - RNA, 15 nt, Shigella flexneri 2a str. 301
ggacuucaucacgau

SEQ ID NO: 3911095 - RNA, 17 nt, Shigella flexneri 2a str. 301
ggacuucaugcgcagca

SEQ ID NO: 3911096 - RNA, 18 nt, Shigella flexneri 2a str. 301
ggacuuguuuuugaucuc

SEQ ID NO: 3911097 - RNA, 21 nt, Shigella flexneri 2a str. 301
ggacuuuaugaaccugaacca

SEQ ID NO: 3911098 - RNA, 14 nt, Shigella flexneri 2a str. 301
ggagacagcuuaga

SEQ ID NO: 3911099 - RNA, 20 nt, Shigella flexneri 2a str. 301
ggagacagcuuagacagcgc

SEQ ID NO: 3911100 - RNA, 16 nt, Shigella flexneri 2a str. 301
ggagacauuacgucca

SEQ ID NO: 3911101 - RNA, 13 nt, Shigella flexneri 2a str. 301
ggagagggccggg

SEQ ID NO: 3911102 - RNA, 19 nt, Shigella flexneri 2a str. 301
ggagaguugcaccagcaac

SEQ ID NO: 3911103 - RNA, 19 nt, Shigella flexneri 2a str. 301
ggagauaucgccaggccag

SEQ ID NO: 3911104 - RNA, 19 nt, Shigella flexneri 2a str. 301
ggagaucgagcgcgagcag

SEQ ID NO: 3911105 - RNA, 14 nt, Shigella flexneri 2a str. 301
ggagcagccagcca

SEQ ID NO: 3911106 - RNA, 21 nt, Shigella flexneri 2a str. 301
ggagcagccccugcgccagcg

SEQ ID NO: 3911107 - RNA, 14 nt, Shigella flexneri 2a str. 301
ggagcaggccgggu

SEQ ID NO: 3911108 - RNA, 20 nt, Shigella flexneri 2a str. 301
ggagccaaacaugcaaacca

SEQ ID NO: 3911109 - RNA, 19 nt, Shigella flexneri 2a str. 301
ggagccacauagacgguuu

SEQ ID NO: 3911110 - RNA, 17 nt, Shigella flexneri 2a str. 301
ggagcgaauacuccccu

SEQ ID NO: 3911111 - RNA, 17 nt, Shigella flexneri 2a str. 301
ggagcgauuaugaaaca

SEQ ID NO: 3911112 - RNA, 13 nt, Shigella flexneri 2a str. 301
ggagcgauuauua

SEQ ID NO: 3911113 - RNA, 20 nt, Shigella flexneri 2a str. 301
ggagcgcuuuuuuccugccg

SEQ ID NO: 3911114 - RNA, 22 nt, Shigella flexneri 2a str. 301
ggaggauuucuccccccucuga

SEQ ID NO: 3911115 - RNA, 14 nt, Shigella flexneri 2a str. 301
ggagguguucauaa

SEQ ID NO: 3911116 - RNA, 12 nt, Shigella flexneri 2a str. 301
ggaguaauaauu

SEQ ID NO: 3911117 - RNA, 11 nt, Shigella flexneri 2a str. 301
ggagugcagca

SEQ ID NO: 3911118 - RNA, 13 nt, Shigella flexneri 2a str. 301
ggagugcagcaug

SEQ ID NO: 3911119 - RNA, 16 nt, Shigella flexneri 2a str. 301
ggaguggcgaaauugg

SEQ ID NO: 3911120 - RNA, 15 nt, Shigella flexneri 2a str. 301
ggaguugaucgccaa

SEQ ID NO: 3911121 - RNA, 14 nt, Shigella flexneri 2a str. 301
ggaguuuaauaaau

SEQ ID NO: 3911122 - RNA, 13 nt, Shigella flexneri 2a str. 301
ggauaaagccccc

SEQ ID NO: 3911123 - RNA, 16 nt, Shigella flexneri 2a str. 301
ggauaccaccagugcc

SEQ ID NO: 3911124 - RNA, 15 nt, Shigella flexneri 2a str. 301
ggauagcgcugcugc

SEQ ID NO: 3911125 - RNA, 22 nt, Shigella flexneri 2a str. 301
ggauaggcuucuauaccaauga

SEQ ID NO: 3911126 - RNA, 20 nt, Shigella flexneri 2a str. 301
ggauauccacugucaaaucc

SEQ ID NO: 3911127 - RNA, 21 nt, Shigella flexneri 2a str. 301
ggauaucuucaaucagaugug

SEQ ID NO: 3911128 - RNA, 16 nt, Shigella flexneri 2a str. 301
ggauaugugaaauuua

SEQ ID NO: 3911129 - RNA, 18 nt, Shigella flexneri 2a str. 301
ggauauucaucuccagca

SEQ ID NO: 3911130 - RNA, 15 nt, Shigella flexneri 2a str. 301
ggaucacaagaccua

SEQ ID NO: 3911131 - RNA, 19 nt, Shigella flexneri 2a str. 301
ggaucaccugcacaugcaa

SEQ ID NO: 3911132 - RNA, 22 nt, Shigella flexneri 2a str. 301
ggaucagaaugcgcucuuccgg

SEQ ID NO: 3911133 - RNA, 16 nt, Shigella flexneri 2a str. 301
ggaucaggcaaacgaa

SEQ ID NO: 3911134 - RNA, 17 nt, Shigella flexneri 2a str. 301
ggauccugagcaaacag

SEQ ID NO: 3911135 - RNA, 12 nt, Shigella flexneri 2a str. 301
ggaucggaggca

SEQ ID NO: 3911136 - RNA, 14 nt, Shigella flexneri 2a str. 301
ggaucgugauagua

SEQ ID NO: 3911137 - RNA, 14 nt, Shigella flexneri 2a str. 301
ggaucugaugggau

SEQ ID NO: 3911138 - RNA, 23 nt, Shigella flexneri 2a str. 301
ggaucugcggguuagucugcauu

SEQ ID NO: 3911139 - RNA, 18 nt, Shigella flexneri 2a str. 301
ggaucuggcuugccagca

SEQ ID NO: 3911140 - RNA, 16 nt, Shigella flexneri 2a str. 301
ggaucuuugacugaaa

SEQ ID NO: 3911141 - RNA, 15 nt, Shigella flexneri 2a str. 301
ggccagccagcagag

SEQ ID NO: 3911142 - RNA, 12 nt, Shigella flexneri 2a str. 301
ggccagccgccg

SEQ ID NO: 3911143 - RNA, 21 nt, Shigella flexneri 2a str. 301
ggccagguuuucuuucaccuc

SEQ ID NO: 3911144 - RNA, 22 nt, Shigella flexneri 2a str. 301
ggccaguaagcaguccagcgcc

SEQ ID NO: 3911145 - RNA, 23 nt, Shigella flexneri 2a str. 301
ggccaguaagcaguccagcgccu

SEQ ID NO: 3911146 - RNA, 22 nt, Shigella flexneri 2a str. 301
ggccagucguaguggaucagca

SEQ ID NO: 3911147 - RNA, 19 nt, Shigella flexneri 2a str. 301
ggccaguuccacuucugca

SEQ ID NO: 3911148 - RNA, 17 nt, Shigella flexneri 2a str. 301
ggccaguugcgccguca

SEQ ID NO: 3911149 - RNA, 19 nt, Shigella flexneri 2a str. 301
ggccaguuucauagugcaa

SEQ ID NO: 3911150 - RNA, 17 nt, Shigella flexneri 2a str. 301
ggccauaaccacgcagc

SEQ ID NO: 3911151 - RNA, 22 nt, Shigella flexneri 2a str. 301
ggccauaaccacgcagcgccgc

SEQ ID NO: 3911152 - RNA, 18 nt, Shigella flexneri 2a str. 301
ggccauacccgccagugc

SEQ ID NO: 3911153 - RNA, 20 nt, Shigella flexneri 2a str. 301
ggccaucagcagcggagaaa

SEQ ID NO: 3911154 - RNA, 20 nt, Shigella flexneri 2a str. 301
ggccauccgcgugacgcugg

SEQ ID NO: 3911155 - RNA, 15 nt, Shigella flexneri 2a str. 301
ggccaugcggcgagg

SEQ ID NO: 3911156 - RNA, 14 nt, Shigella flexneri 2a str. 301
ggccauguuuacca

SEQ ID NO: 3911157 - RNA, 15 nt, Shigella flexneri 2a str. 301
ggccauuacuacccu

SEQ ID NO: 3911158 - RNA, 20 nt, Shigella flexneri 2a str. 301
ggccauuuuuucgauaauca

SEQ ID NO: 3911159 - RNA, 14 nt, Shigella flexneri 2a str. 301
ggcccagccgugaa

SEQ ID NO: 3911160 - RNA, 14 nt, Shigella flexneri 2a str. 301
ggcccaucgccagu

SEQ ID NO: 3911161 - RNA, 21 nt, Shigella flexneri 2a str. 301
ggcccgcucggcggcuggcug

SEQ ID NO: 3911162 - RNA, 23 nt, Shigella flexneri 2a str. 301
ggcccgguuaucggcgcgccagc

SEQ ID NO: 3911163 - RNA, 21 nt, Shigella flexneri 2a str. 301
ggcccuucuggucaugaaccu

SEQ ID NO: 3911164 - RNA, 18 nt, Shigella flexneri 2a str. 301
ggccgaauaccggcgucc

SEQ ID NO: 3911165 - RNA, 14 nt, Shigella flexneri 2a str. 301
ggccgagaggcuga

SEQ ID NO: 3911166 - RNA, 23 nt, Shigella flexneri 2a str. 301
ggccgauaauaaagccuauccag

SEQ ID NO: 3911167 - RNA, 21 nt, Shigella flexneri 2a str. 301
ggccgauuaaagacagcgagg

SEQ ID NO: 3911168 - RNA, 17 nt, Shigella flexneri 2a str. 301
ggccgcaaaccagcgca

SEQ ID NO: 3911169 - RNA, 18 nt, Shigella flexneri 2a str. 301
ggccgcaaaccagcgcau

SEQ ID NO: 3911170 - RNA, 21 nt, Shigella flexneri 2a str. 301
ggccgcaaaccagcgcauggc

SEQ ID NO: 3911171 - RNA, 15 nt, Shigella flexneri 2a str. 301
ggccgcaguaaagcg

SEQ ID NO: 3911172 - RNA, 16 nt, Shigella flexneri 2a str. 301
ggccgcaucguacugg

SEQ ID NO: 3911173 - RNA, 19 nt, Shigella flexneri 2a str. 301
ggccgccacacagcacgca

SEQ ID NO: 3911174 - RNA, 13 nt, Shigella flexneri 2a str. 301
ggccgccagaaac

SEQ ID NO: 3911175 - RNA, 16 nt, Shigella flexneri 2a str. 301
ggccgcguaccgcagc

SEQ ID NO: 3911176 - RNA, 19 nt, Shigella flexneri 2a str. 301
ggccgcuuucugagcggcc

SEQ ID NO: 3911177 - RNA, 20 nt, Shigella flexneri 2a str. 301
ggccgcuuucugagcggccu

SEQ ID NO: 3911178 - RNA, 16 nt, Shigella flexneri 2a str. 301
ggccggauguggcguu

SEQ ID NO: 3911179 - RNA, 18 nt, Shigella flexneri 2a str. 301
ggccgggcaaacaaggca

SEQ ID NO: 3911180 - RNA, 20 nt, Shigella flexneri 2a str. 301
ggccggguuuucucccucgc

SEQ ID NO: 3911181 - RNA, 14 nt, Shigella flexneri 2a str. 301
ggccgguaacgcuu

SEQ ID NO: 3911182 - RNA, 22 nt, Shigella flexneri 2a str. 301
ggccgguaacgcuuucucacca

SEQ ID NO: 3911183 - RNA, 15 nt, Shigella flexneri 2a str. 301
ggccguacccagcug

SEQ ID NO: 3911184 - RNA, 14 nt, Shigella flexneri 2a str. 301
ggccguauccggca

SEQ ID NO: 3911185 - RNA, 13 nt, Shigella flexneri 2a str. 301
ggccgugaagaag

SEQ ID NO: 3911186 - RNA, 18 nt, Shigella flexneri 2a str. 301
ggccgugcagaccgcuga

SEQ ID NO: 3911187 - RNA, 18 nt, Shigella flexneri 2a str. 301
ggccguuccauucaaacg

SEQ ID NO: 3911188 - RNA, 13 nt, Shigella flexneri 2a str. 301
ggccguuccggca

SEQ ID NO: 3911189 - RNA, 23 nt, Shigella flexneri 2a str. 301
ggccuacaaaaucuauugcaaca

SEQ ID NO: 3911190 - RNA, 20 nt, Shigella flexneri 2a str. 301
ggccuacaacuccguugaaa

SEQ ID NO: 3911191 - RNA, 19 nt, Shigella flexneri 2a str. 301
ggccuacaauguuucugca

SEQ ID NO: 3911192 - RNA, 20 nt, Shigella flexneri 2a str. 301
ggccuacauagucccugcaa

SEQ ID NO: 3911193 - RNA, 20 nt, Shigella flexneri 2a str. 301
ggccuaccguucaggcacaa

SEQ ID NO: 3911194 - RNA, 19 nt, Shigella flexneri 2a str. 301
ggccuacgcguccccugca

SEQ ID NO: 3911195 - RNA, 22 nt, Shigella flexneri 2a str. 301
ggccuaguccguaggcaggacu

SEQ ID NO: 3911196 - RNA, 15 nt, Shigella flexneri 2a str. 301
ggccuaucaacgucg

SEQ ID NO: 3911197 - RNA, 18 nt, Shigella flexneri 2a str. 301
ggccucaugugaugguaa

SEQ ID NO: 3911198 - RNA, 20 nt, Shigella flexneri 2a str. 301
ggccucugccagcugcucau

SEQ ID NO: 3911199 - RNA, 17 nt, Shigella flexneri 2a str. 301
ggccucuuacgccgcca

SEQ ID NO: 3911200 - RNA, 12 nt, Shigella flexneri 2a str. 301
ggccugaaagcu

SEQ ID NO: 3911201 - RNA, 13 nt, Shigella flexneri 2a str. 301
ggccugaacaagc

SEQ ID NO: 3911202 - RNA, 15 nt, Shigella flexneri 2a str. 301
ggccugaacaagcaa

SEQ ID NO: 3911203 - RNA, 15 nt, Shigella flexneri 2a str. 301
ggccugaguccaugu

SEQ ID NO: 3911204 - RNA, 20 nt, Shigella flexneri 2a str. 301
ggccugauaagcguagcgca

SEQ ID NO: 3911205 - RNA, 11 nt, Shigella flexneri 2a str. 301
ggccugccgcu

SEQ ID NO: 3911206 - RNA, 22 nt, Shigella flexneri 2a str. 301
ggccuggaauuacugauugcuc

SEQ ID NO: 3911207 - RNA, 13 nt, Shigella flexneri 2a str. 301
ggccuugccguug

SEQ ID NO: 3911208 - RNA, 18 nt, Shigella flexneri 2a str. 301
ggccuuuuuggcaagcag

SEQ ID NO: 3911209 - RNA, 14 nt, Shigella flexneri 2a str. 301
ggcgaaaagcuucu

SEQ ID NO: 3911210 - RNA, 13 nt, Shigella flexneri 2a str. 301
ggcgaaagaaaag

SEQ ID NO: 3911211 - RNA, 13 nt, Shigella flexneri 2a str. 301
ggcgaaaggcugg

SEQ ID NO: 3911212 - RNA, 14 nt, Shigella flexneri 2a str. 301
ggcgaaaggcuggc

SEQ ID NO: 3911213 - RNA, 15 nt, Shigella flexneri 2a str. 301
ggcgaacauuccggu

SEQ ID NO: 3911214 - RNA, 19 nt, Shigella flexneri 2a str. 301
ggcgaaccgcugucacccg

SEQ ID NO: 3911215 - RNA, 19 nt, Shigella flexneri 2a str. 301
ggcgaacucuuccggcagg

SEQ ID NO: 3911216 - RNA, 16 nt, Shigella flexneri 2a str. 301
ggcgaacuggucugca

SEQ ID NO: 3911217 - RNA, 16 nt, Shigella flexneri 2a str. 301
ggcgaagagagcgcca

SEQ ID NO: 3911218 - RNA, 23 nt, Shigella flexneri 2a str. 301
ggcgaagauacccgcgaggcgca

SEQ ID NO: 3911219 - RNA, 21 nt, Shigella flexneri 2a str. 301
ggcgaaggcgcacugauucau

SEQ ID NO: 3911220 - RNA, 21 nt, Shigella flexneri 2a str. 301
ggcgaauagaaagcaagccag

SEQ ID NO: 3911221 - RNA, 22 nt, Shigella flexneri 2a str. 301
ggcgaauggcacguugcugcgg

SEQ ID NO: 3911222 - RNA, 22 nt, Shigella flexneri 2a str. 301
ggcgacaaggcguugauuggcg

SEQ ID NO: 3911223 - RNA, 18 nt, Shigella flexneri 2a str. 301
ggcgaccguucgccaggu

SEQ ID NO: 3911224 - RNA, 15 nt, Shigella flexneri 2a str. 301
ggcgagaaacgcuuu

SEQ ID NO: 3911225 - RNA, 14 nt, Shigella flexneri 2a str. 301
ggcgagaagagagg

SEQ ID NO: 3911226 - RNA, 22 nt, Shigella flexneri 2a str. 301
ggcgagacgccgauugacugga

SEQ ID NO: 3911227 - RNA, 21 nt, Shigella flexneri 2a str. 301
ggcgagacugcgcgccgccgc

SEQ ID NO: 3911228 - RNA, 14 nt, Shigella flexneri 2a str. 301
ggcgagagacgcuu

SEQ ID NO: 3911229 - RNA, 12 nt, Shigella flexneri 2a str. 301
ggcgagagcuuu

SEQ ID NO: 3911230 - RNA, 14 nt, Shigella flexneri 2a str. 301
ggcgagauaaugcg

SEQ ID NO: 3911231 - RNA, 21 nt, Shigella flexneri 2a str. 301
ggcgagauccggaucccacca

SEQ ID NO: 3911232 - RNA, 19 nt, Shigella flexneri 2a str. 301
ggcgagcaacgcagcggcg

SEQ ID NO: 3911233 - RNA, 14 nt, Shigella flexneri 2a str. 301
ggcgagccagcgca

SEQ ID NO: 3911234 - RNA, 15 nt, Shigella flexneri 2a str. 301
ggcgagccagcgcau

SEQ ID NO: 3911235 - RNA, 11 nt, Shigella flexneri 2a str. 301
ggcgagcgcca

SEQ ID NO: 3911236 - RNA, 16 nt, Shigella flexneri 2a str. 301
ggcgagcgccagcaug

SEQ ID NO: 3911237 - RNA, 13 nt, Shigella flexneri 2a str. 301
ggcgaggcggggc

SEQ ID NO: 3911238 - RNA, 18 nt, Shigella flexneri 2a str. 301
ggcgagggaaccguccgc

SEQ ID NO: 3911239 - RNA, 14 nt, Shigella flexneri 2a str. 301
ggcgagggcaaacc

SEQ ID NO: 3911240 - RNA, 18 nt, Shigella flexneri 2a str. 301
ggcgaggggaccgccccu

SEQ ID NO: 3911241 - RNA, 16 nt, Shigella flexneri 2a str. 301
ggcuaaugccagucag

SEQ ID NO: 3911242 - RNA, 23 nt, Shigella flexneri 2a str. 301
ggcuaauucuguuuuaucagacc

SEQ ID NO: 3911243 - RNA, 14 nt, Shigella flexneri 2a str. 301
ggcuaccgcaguga

SEQ ID NO: 3911244 - RNA, 19 nt, Shigella flexneri 2a str. 301
ggcuacuacggcgugcagg

SEQ ID NO: 3911245 - RNA, 15 nt, Shigella flexneri 2a str. 301
ggcuagccucccugc

SEQ ID NO: 3911246 - RNA, 12 nt, Shigella flexneri 2a str. 301
ggcuauauugca

SEQ ID NO: 3911247 - RNA, 13 nt, Shigella flexneri 2a str. 301
ggcuaucuggaga

SEQ ID NO: 3911248 - RNA, 12 nt, Shigella flexneri 2a str. 301
ggcuaugcugga

SEQ ID NO: 3911249 - RNA, 14 nt, Shigella flexneri 2a str. 301
ggcucagccgauga

SEQ ID NO: 3911250 - RNA, 12 nt, Shigella flexneri 2a str. 301
ggcucagcucug

SEQ ID NO: 3911251 - RNA, 15 nt, Shigella flexneri 2a str. 301
ggcucauaccuucca

SEQ ID NO: 3911252 - RNA, 16 nt, Shigella flexneri 2a str. 301
ggcucauaccuuccac

SEQ ID NO: 3911253 - RNA, 23 nt, Shigella flexneri 2a str. 301
ggcucaucaccccgcgcucacac

SEQ ID NO: 3911254 - RNA, 20 nt, Shigella flexneri 2a str. 301
ggcucauccccugaugcugu

SEQ ID NO: 3911255 - RNA, 21 nt, Shigella flexneri 2a str. 301
ggcucauugccauucgccagu

SEQ ID NO: 3911256 - RNA, 15 nt, Shigella flexneri 2a str. 301
ggcuccacuucguuc

SEQ ID NO: 3911257 - RNA, 22 nt, Shigella flexneri 2a str. 301
ggcucccggcgguaaaucgccg

SEQ ID NO: 3911258 - RNA, 18 nt, Shigella flexneri 2a str. 301
ggcuccgcugacgccugc

SEQ ID NO: 3911259 - RNA, 21 nt, Shigella flexneri 2a str. 301
ggcuccgggaaaacgcuggca

SEQ ID NO: 3911260 - RNA, 18 nt, Shigella flexneri 2a str. 301
ggcuccgggcgcaccagu

SEQ ID NO: 3911261 - RNA, 16 nt, Shigella flexneri 2a str. 301
ggcuccucugacugga

SEQ ID NO: 3911262 - RNA, 18 nt, Shigella flexneri 2a str. 301
ggcucgacaaaaugagca

SEQ ID NO: 3911263 - RNA, 14 nt, Shigella flexneri 2a str. 301
ggcucgaucuggug

SEQ ID NO: 3911264 - RNA, 18 nt, Shigella flexneri 2a str. 301
ggcucgccauccagugaa

SEQ ID NO: 3911265 - RNA, 21 nt, Shigella flexneri 2a str. 301
ggcucggagagaaaagcaaaa

SEQ ID NO: 3911266 - RNA, 12 nt, Shigella flexneri 2a str. 301
ggcucucagccg

SEQ ID NO: 3911267 - RNA, 19 nt, Shigella flexneri 2a str. 301
ggcucugguguucuuuuac

SEQ ID NO: 3911268 - RNA, 18 nt, Shigella flexneri 2a str. 301
ggcucuucgcuccaguca

SEQ ID NO: 3911269 - RNA, 14 nt, Shigella flexneri 2a str. 301
ggcucuuuaaacag

SEQ ID NO: 3911270 - RNA, 14 nt, Shigella flexneri 2a str. 301
ggcugaacgugcuc

SEQ ID NO: 3911271 - RNA, 18 nt, Shigella flexneri 2a str. 301
ggcugacauuaucagaca

SEQ ID NO: 3911272 - RNA, 20 nt, Shigella flexneri 2a str. 301
ggcugacggucgaugcgcaa

SEQ ID NO: 3911273 - RNA, 10 nt, Shigella flexneri 2a str. 301
ggcugacugu

SEQ ID NO: 3911274 - RNA, 23 nt, Shigella flexneri 2a str. 301
ggcugagauuuaugacaaacgca

SEQ ID NO: 3911275 - RNA, 22 nt, Shigella flexneri 2a str. 301
ggcugauaugccagacuucauc

SEQ ID NO: 3911276 - RNA, 23 nt, Shigella flexneri 2a str. 301
ggcugaugccgguuuuacagaau

SEQ ID NO: 3911277 - RNA, 17 nt, Shigella flexneri 2a str. 301
ggcugcagaauacggau

SEQ ID NO: 3911278 - RNA, 24 nt, Shigella flexneri 2a str. 301
ggcugccagaucaucguuuccgau

SEQ ID NO: 3911279 - RNA, 14 nt, Shigella flexneri 2a str. 301
ggcugccagcucuc

SEQ ID NO: 3911280 - RNA, 13 nt, Shigella flexneri 2a str. 301
ggcugccaugguu

SEQ ID NO: 3911281 - RNA, 13 nt, Shigella flexneri 2a str. 301
ggcugcccaugcc

SEQ ID NO: 3911282 - RNA, 15 nt, Shigella flexneri 2a str. 301
ggcugcuauccaguu

SEQ ID NO: 3911283 - RNA, 17 nt, Shigella flexneri 2a str. 301
ggcuggcaagcugcugu

SEQ ID NO: 3911284 - RNA, 16 nt, Shigella flexneri 2a str. 301
ggcuggcacgcucuuc

SEQ ID NO: 3911285 - RNA, 19 nt, Shigella flexneri 2a str. 301
ggcuggccccgucagcaaa

SEQ ID NO: 3911286 - RNA, 20 nt, Shigella flexneri 2a str. 301
ggcuggccccgucagcaaaa

SEQ ID NO: 3911287 - RNA, 20 nt, Shigella flexneri 2a str. 301
ggcuggcgaagcccagaaug

SEQ ID NO: 3911288 - RNA, 15 nt, Shigella flexneri 2a str. 301
ggcuggcgcauacca

SEQ ID NO: 3911289 - RNA, 20 nt, Shigella flexneri 2a str. 301
ggcuggcggcaaucgccaga

SEQ ID NO: 3911290 - RNA, 20 nt, Shigella flexneri 2a str. 301
ggcuggcucguugcgccggg

SEQ ID NO: 3911291 - RNA, 18 nt, Shigella flexneri 2a str. 301
ggcugguuacucaccagc

SEQ ID NO: 3911292 - RNA, 21 nt, Shigella flexneri 2a str. 301
ggcuguagaagcugacgacga

SEQ ID NO: 3911293 - RNA, 18 nt, Shigella flexneri 2a str. 301
ggcugugggguauuucca

SEQ ID NO: 3911294 - RNA, 20 nt, Shigella flexneri 2a str. 301
ggcugugggucaccguacug

SEQ ID NO: 3911295 - RNA, 18 nt, Shigella flexneri 2a str. 301
ggcuguuaucccagcagu

SEQ ID NO: 3911296 - RNA, 19 nt, Shigella flexneri 2a str. 301
ggcuguucaccacugaaua

SEQ ID NO: 3911297 - RNA, 20 nt, Shigella flexneri 2a str. 301
ggcuguucccacgcacagaa

SEQ ID NO: 3911298 - RNA, 23 nt, Shigella flexneri 2a str. 301
ggcuguuuuccagcaccacuucc

SEQ ID NO: 3911299 - RNA, 16 nt, Shigella flexneri 2a str. 301
ggcuuaccaaauaaac

SEQ ID NO: 3911300 - RNA, 16 nt, Shigella flexneri 2a str. 301
ggcuuauccggcaugc

SEQ ID NO: 3911301 - RNA, 22 nt, Shigella flexneri 2a str. 301
ggcuucaaucaauaacagcgca

SEQ ID NO: 3911302 - RNA, 23 nt, Shigella flexneri 2a str. 301
ggcuucaucccgguuauuaaaac

SEQ ID NO: 3911303 - RNA, 18 nt, Shigella flexneri 2a str. 301
ggcuucgacgauugcuuu

SEQ ID NO: 3911304 - RNA, 13 nt, Shigella flexneri 2a str. 301
ggcuucgaucagg

SEQ ID NO: 3911305 - RNA, 16 nt, Shigella flexneri 2a str. 301
ggcuucggcguccagu

SEQ ID NO: 3911306 - RNA, 12 nt, Shigella flexneri 2a str. 301
ggcuucucgccu

SEQ ID NO: 3911307 - RNA, 16 nt, Shigella flexneri 2a str. 301
ggcuucugccuuaucc

SEQ ID NO: 3911308 - RNA, 21 nt, Shigella flexneri 2a str. 301
ggcuucugccuuauccagcag

SEQ ID NO: 3911309 - RNA, 20 nt, Shigella flexneri 2a str. 301
ggcuuguacgccgccgcaac

SEQ ID NO: 3911310 - RNA, 16 nt, Shigella flexneri 2a str. 301
ggcuugugcgcccggc

SEQ ID NO: 3911311 - RNA, 20 nt, Shigella flexneri 2a str. 301
ggcuuuaauaccugccuggu

SEQ ID NO: 3911312 - RNA, 17 nt, Shigella flexneri 2a str. 301
ggcuuucacgucaggau

SEQ ID NO: 3911313 - RNA, 17 nt, Shigella flexneri 2a str. 301
ggcuuucgcaauaauca

SEQ ID NO: 3911314 - RNA, 22 nt, Shigella flexneri 2a str. 301
ggcuuugccuccccaacauaua

SEQ ID NO: 3911315 - RNA, 19 nt, Shigella flexneri 2a str. 301
ggcuuugcuacagccuggu

SEQ ID NO: 3911316 - RNA, 17 nt, Shigella flexneri 2a str. 301
ggcuuugcuguuuccag

SEQ ID NO: 3911317 - RNA, 14 nt, Shigella flexneri 2a str. 301
ggcuuuggcaaacu

SEQ ID NO: 3911318 - RNA, 14 nt, Shigella flexneri 2a str. 301
ggcuuuucgacaga

SEQ ID NO: 3911319 - RNA, 12 nt, Shigella flexneri 2a str. 301
ggcuuuuuaauu

SEQ ID NO: 3911320 - RNA, 18 nt, Shigella flexneri 2a str. 301
ggcuuuuuaugacgcugg

SEQ ID NO: 3911321 - RNA, 18 nt, Shigella flexneri 2a str. 301
ggcuuuuuuacaucauca

SEQ ID NO: 3911322 - RNA, 23 nt, Shigella flexneri 2a str. 301
gggaaaacagcgcaccagaaaca

SEQ ID NO: 3911323 - RNA, 16 nt, Shigella flexneri 2a str. 301
gggaaaacgcuggcag

SEQ ID NO: 3911324 - RNA, 19 nt, Shigella flexneri 2a str. 301
gggaaaacgcuggcagcau

SEQ ID NO: 3911325 - RNA, 14 nt, Shigella flexneri 2a str. 301
gggaaaguggcguu

SEQ ID NO: 3911326 - RNA, 15 nt, Shigella flexneri 2a str. 301
gggaaaucaccacca

SEQ ID NO: 3911327 - RNA, 13 nt, Shigella flexneri 2a str. 301
gggaacagaccag

SEQ ID NO: 3911328 - RNA, 18 nt, Shigella flexneri 2a str. 301
gggaagcgcaccaauuca

SEQ ID NO: 3911329 - RNA, 12 nt, Shigella flexneri 2a str. 301
gggaagcggggc

SEQ ID NO: 3911330 - RNA, 15 nt, Shigella flexneri 2a str. 301
gggaagggagcgccg

SEQ ID NO: 3911331 - RNA, 19 nt, Shigella flexneri 2a str. 301
gggaagggucuuuuaaauc

SEQ ID NO: 3911332 - RNA, 13 nt, Shigella flexneri 2a str. 301
gggaaggucaggu

SEQ ID NO: 3911333 - RNA, 22 nt, Shigella flexneri 2a str. 301
gggaauagcguuaauggcagau

SEQ ID NO: 3911334 - RNA, 18 nt, Shigella flexneri 2a str. 301
gggaauucgaagcuguag

SEQ ID NO: 3911335 - RNA, 17 nt, Shigella flexneri 2a str. 301
gggaauugugcuuucag

SEQ ID NO: 3911336 - RNA, 17 nt, Shigella flexneri 2a str. 301
gggacuuuucaggcuag

SEQ ID NO: 3911337 - RNA, 17 nt, Shigella flexneri 2a str. 301
gggagaccucacugaaa

SEQ ID NO: 3911338 - RNA, 14 nt, Shigella flexneri 2a str. 301
gggagagggccggg

SEQ ID NO: 3911339 - RNA, 23 nt, Shigella flexneri 2a str. 301
gggagcagauacggcgcaucugu

SEQ ID NO: 3911340 - RNA, 14 nt, Shigella flexneri 2a str. 301
gggagcaggccggg

SEQ ID NO: 3911341 - RNA, 17 nt, Shigella flexneri 2a str. 301
gguaacauacuccaccc

SEQ ID NO: 3911342 - RNA, 15 nt, Shigella flexneri 2a str. 301
gguaacccauccagc

SEQ ID NO: 3911343 - RNA, 23 nt, Shigella flexneri 2a str. 301
gguaaccgaccuucacgcugcgc

SEQ ID NO: 3911344 - RNA, 14 nt, Shigella flexneri 2a str. 301
gguaaccgccagua

SEQ ID NO: 3911345 - RNA, 15 nt, Shigella flexneri 2a str. 301
gguaaccgccaguaa

SEQ ID NO: 3911346 - RNA, 21 nt, Shigella flexneri 2a str. 301
gguaacgauacggcccagacc

SEQ ID NO: 3911347 - RNA, 23 nt, Shigella flexneri 2a str. 301
gguaagcgccacaaucgcuucau

SEQ ID NO: 3911348 - RNA, 12 nt, Shigella flexneri 2a str. 301
gguaagugccac

SEQ ID NO: 3911349 - RNA, 16 nt, Shigella flexneri 2a str. 301
gguaagugcuggccaa

SEQ ID NO: 3911350 - RNA, 21 nt, Shigella flexneri 2a str. 301
gguaaguucacgcagguuaga

SEQ ID NO: 3911351 - RNA, 17 nt, Shigella flexneri 2a str. 301
gguaauaaugcagaucu

SEQ ID NO: 3911352 - RNA, 15 nt, Shigella flexneri 2a str. 301
gguaauaggcaggca

SEQ ID NO: 3911353 - RNA, 22 nt, Shigella flexneri 2a str. 301
gguaaugaauggacuccaccgg

SEQ ID NO: 3911354 - RNA, 16 nt, Shigella flexneri 2a str. 301
gguaauggcaauacug

SEQ ID NO: 3911355 - RNA, 12 nt, Shigella flexneri 2a str. 301
gguaauggucag

SEQ ID NO: 3911356 - RNA, 17 nt, Shigella flexneri 2a str. 301
gguaauuaagauucagc

SEQ ID NO: 3911357 - RNA, 11 nt, Shigella flexneri 2a str. 301
gguaauucccu

SEQ ID NO: 3911358 - RNA, 17 nt, Shigella flexneri 2a str. 301
gguaauuugaucaaaua

SEQ ID NO: 3911359 - RNA, 17 nt, Shigella flexneri 2a str. 301
gguacaaacaucaucca

SEQ ID NO: 3911360 - RNA, 13 nt, Shigella flexneri 2a str. 301
gguacaaagccaa

SEQ ID NO: 3911361 - RNA, 16 nt, Shigella flexneri 2a str. 301
gguacaaagccaacag

SEQ ID NO: 3911362 - RNA, 12 nt, Shigella flexneri 2a str. 301
gguacaaccgca

SEQ ID NO: 3911363 - RNA, 13 nt, Shigella flexneri 2a str. 301
gguacacgauaau

SEQ ID NO: 3911364 - RNA, 13 nt, Shigella flexneri 2a str. 301
gguaccagcaccg

SEQ ID NO: 3911365 - RNA, 22 nt, Shigella flexneri 2a str. 301
gguaccguugaccaguccggcu

SEQ ID NO: 3911366 - RNA, 19 nt, Shigella flexneri 2a str. 301
gguaccuuugaacugcuga

SEQ ID NO: 3911367 - RNA, 18 nt, Shigella flexneri 2a str. 301
gguacgaaaagggcugga

SEQ ID NO: 3911368 - RNA, 15 nt, Shigella flexneri 2a str. 301
gguacgaauacggau

SEQ ID NO: 3911369 - RNA, 23 nt, Shigella flexneri 2a str. 301
gguacgaauacggauauguuuac

SEQ ID NO: 3911370 - RNA, 17 nt, Shigella flexneri 2a str. 301
gguacgacuuccuggcu

SEQ ID NO: 3911371 - RNA, 22 nt, Shigella flexneri 2a str. 301
gguacgcaauuccagcaagcca

SEQ ID NO: 3911372 - RNA, 19 nt, Shigella flexneri 2a str. 301
gguacgccuuaguuauaaa

SEQ ID NO: 3911373 - RNA, 14 nt, Shigella flexneri 2a str. 301
gguacuggcaggga

SEQ ID NO: 3911374 - RNA, 16 nt, Shigella flexneri 2a str. 301
gguacuuucacaggga

SEQ ID NO: 3911375 - RNA, 22 nt, Shigella flexneri 2a str. 301
gguagacgcgcuagccucaggu

SEQ ID NO: 3911376 - RNA, 22 nt, Shigella flexneri 2a str. 301
gguagacgcgcuagcuucaggu

SEQ ID NO: 3911377 - RNA, 15 nt, Shigella flexneri 2a str. 301
gguagagguuauaaa

SEQ ID NO: 3911378 - RNA, 23 nt, Shigella flexneri 2a str. 301
gguagagguuauaaauaaaaauu

SEQ ID NO: 3911379 - RNA, 20 nt, Shigella flexneri 2a str. 301
gguagauuauuucgcugcgg

SEQ ID NO: 3911380 - RNA, 20 nt, Shigella flexneri 2a str. 301
gguagcaaaacaauuuggug

SEQ ID NO: 3911381 - RNA, 12 nt, Shigella flexneri 2a str. 301
gguagcggguga

SEQ ID NO: 3911382 - RNA, 22 nt, Shigella flexneri 2a str. 301
gguagcugcccccgcucuucca

SEQ ID NO: 3911383 - RNA, 15 nt, Shigella flexneri 2a str. 301
gguagggauaucuuc

SEQ ID NO: 3911384 - RNA, 16 nt, Shigella flexneri 2a str. 301
gguagucgcgguccgg

SEQ ID NO: 3911385 - RNA, 18 nt, Shigella flexneri 2a str. 301
gguagugccgucagcagg

SEQ ID NO: 3911386 - RNA, 13 nt, Shigella flexneri 2a str. 301
gguaguuucuccc

SEQ ID NO: 3911387 - RNA, 17 nt, Shigella flexneri 2a str. 301
gguauacgucccgguga

SEQ ID NO: 3911388 - RNA, 18 nt, Shigella flexneri 2a str. 301
gguauagaagccauccag

SEQ ID NO: 3911389 - RNA, 20 nt, Shigella flexneri 2a str. 301
gguauauuucaggccaacgg

SEQ ID NO: 3911390 - RNA, 17 nt, Shigella flexneri 2a str. 301
gguaucgcacagaugcg

SEQ ID NO: 3911391 - RNA, 16 nt, Shigella flexneri 2a str. 301
gguaugcgaagguggc

SEQ ID NO: 3911392 - RNA, 18 nt, Shigella flexneri 2a str. 301
gguauggucacggugagg

SEQ ID NO: 3911393 - RNA, 16 nt, Shigella flexneri 2a str. 301
gguauuaaucugccag

SEQ ID NO: 3911394 - RNA, 15 nt, Shigella flexneri 2a str. 301
gguauuaguggcaac

SEQ ID NO: 3911395 - RNA, 15 nt, Shigella flexneri 2a str. 301
gguauugcuucucag

SEQ ID NO: 3911396 - RNA, 14 nt, Shigella flexneri 2a str. 301
ggucaaaagcugca

SEQ ID NO: 3911397 - RNA, 21 nt, Shigella flexneri 2a str. 301
ggucaaaauccauuuucuauu

SEQ ID NO: 3911398 - RNA, 22 nt, Shigella flexneri 2a str. 301
ggucaacauucccugcaccggu

SEQ ID NO: 3911399 - RNA, 23 nt, Shigella flexneri 2a str. 301
ggucaaguaauuaucuuuacuga

SEQ ID NO: 3911400 - RNA, 22 nt, Shigella flexneri 2a str. 301
ggucaccugccagggugcuggc

SEQ ID NO: 3911401 - RNA, 20 nt, Shigella flexneri 2a str. 301
ggucacgauggaaccguaca

SEQ ID NO: 3911402 - RNA, 20 nt, Shigella flexneri 2a str. 301
ggucacgcaaaacgcugcaa

SEQ ID NO: 3911403 - RNA, 12 nt, Shigella flexneri 2a str. 301
ggucacggcugu

SEQ ID NO: 3911404 - RNA, 22 nt, Shigella flexneri 2a str. 301
ggucacggcuguagccagcucg

SEQ ID NO: 3911405 - RNA, 17 nt, Shigella flexneri 2a str. 301
ggucacugacaccagca

SEQ ID NO: 3911406 - RNA, 16 nt, Shigella flexneri 2a str. 301
ggucagacaacuuccc

SEQ ID NO: 3911407 - RNA, 10 nt, Shigella flexneri 2a str. 301
ggucagagaa

SEQ ID NO: 3911408 - RNA, 13 nt, Shigella flexneri 2a str. 301
ggucagagaaucg

SEQ ID NO: 3911409 - RNA, 14 nt, Shigella flexneri 2a str. 301
ggucagagaaucga

SEQ ID NO: 3911410 - RNA, 16 nt, Shigella flexneri 2a str. 301
ggucagauuucaaucu

SEQ ID NO: 3911411 - RNA, 23 nt, Shigella flexneri 2a str. 301
ggucagcagcuuucuuuauaucu

SEQ ID NO: 3911412 - RNA, 21 nt, Shigella flexneri 2a str. 301
ggucagcaggagcagccccug

SEQ ID NO: 3911413 - RNA, 20 nt, Shigella flexneri 2a str. 301
ggucagccacaguugaucag

SEQ ID NO: 3911414 - RNA, 23 nt, Shigella flexneri 2a str. 301
ggucagccacaguugaucagcca

SEQ ID NO: 3911415 - RNA, 18 nt, Shigella flexneri 2a str. 301
ggucagcgccuggcugca

SEQ ID NO: 3911416 - RNA, 14 nt, Shigella flexneri 2a str. 301
ggucagcggccagu

SEQ ID NO: 3911417 - RNA, 21 nt, Shigella flexneri 2a str. 301
ggucagcuucaccuuccagua

SEQ ID NO: 3911418 - RNA, 16 nt, Shigella flexneri 2a str. 301
ggucaggaaacuugcg

SEQ ID NO: 3911419 - RNA, 19 nt, Shigella flexneri 2a str. 301
ggucagguauuuugucagc

SEQ ID NO: 3911420 - RNA, 17 nt, Shigella flexneri 2a str. 301
ggucaguugccagacgg

SEQ ID NO: 3911421 - RNA, 12 nt, Shigella flexneri 2a str. 301
ggucauccaaau

SEQ ID NO: 3911422 - RNA, 19 nt, Shigella flexneri 2a str. 301
ggucauggcauuaauaugc

SEQ ID NO: 3911423 - RNA, 14 nt, Shigella flexneri 2a str. 301
ggucauuuucuuca

SEQ ID NO: 3911424 - RNA, 20 nt, Shigella flexneri 2a str. 301
ggucauuuucuucagcaguu

SEQ ID NO: 3911425 - RNA, 17 nt, Shigella flexneri 2a str. 301
gguccagccgccagggc

SEQ ID NO: 3911426 - RNA, 18 nt, Shigella flexneri 2a str. 301
gguccccucgcuccucug

SEQ ID NO: 3911427 - RNA, 15 nt, Shigella flexneri 2a str. 301
ggucccugaugcauc

SEQ ID NO: 3911428 - RNA, 20 nt, Shigella flexneri 2a str. 301
ggucccugaugcaucaguca

SEQ ID NO: 3911429 - RNA, 14 nt, Shigella flexneri 2a str. 301
ggucccuucaaucu

SEQ ID NO: 3911430 - RNA, 23 nt, Shigella flexneri 2a str. 301
gguccggauggcaaacugauuau

SEQ ID NO: 3911431 - RNA, 16 nt, Shigella flexneri 2a str. 301
gguccgggcaucagca

SEQ ID NO: 3911432 - RNA, 18 nt, Shigella flexneri 2a str. 301
gguccuggucugaugaau

SEQ ID NO: 3911433 - RNA, 12 nt, Shigella flexneri 2a str. 301
gguccuuuugcc

SEQ ID NO: 3911434 - RNA, 22 nt, Shigella flexneri 2a str. 301
ggucgacgaugggucacuguga

SEQ ID NO: 3911435 - RNA, 20 nt, Shigella flexneri 2a str. 301
ggucgagcgacaggucagcg

SEQ ID NO: 3911436 - RNA, 17 nt, Shigella flexneri 2a str. 301
ggucgauguacuucaac

SEQ ID NO: 3911437 - RNA, 18 nt, Shigella flexneri 2a str. 301
ggucgcacugcucuuuuu

SEQ ID NO: 3911438 - RNA, 16 nt, Shigella flexneri 2a str. 301
ggucgcaucauuuaaa

SEQ ID NO: 3911439 - RNA, 22 nt, Shigella flexneri 2a str. 301
ggucgccccggaacgggagaaa

SEQ ID NO: 3911440 - RNA, 22 nt, Shigella flexneri 2a str. 301
ggucgcgcaaauucggcggcgu

SEQ ID NO: 3911441 - RNA, 23 nt, Shigella flexneri 2a str. 301
ggucgcucgcgccgcauccgaca

SEQ ID NO: 3911442 - RNA, 11 nt, Shigella flexneri 2a str. 301
ggucgcuucgc

SEQ ID NO: 3911443 - RNA, 15 nt, Shigella flexneri 2a str. 301
ggucgcuuuguggcg

SEQ ID NO: 3911444 - RNA, 20 nt, Shigella flexneri 2a str. 301
ggucgcuuuguggcggcaaa

SEQ ID NO: 3911445 - RNA, 14 nt, Shigella flexneri 2a str. 301
ggucugauauggau

SEQ ID NO: 3911446 - RNA, 17 nt, Shigella flexneri 2a str. 301
ggucugccaacuuugcc

SEQ ID NO: 3911447 - RNA, 18 nt, Shigella flexneri 2a str. 301
ggucugguguaucugcug

SEQ ID NO: 3911448 - RNA, 21 nt, Shigella flexneri 2a str. 301
ggucuuacuggggaaguggcg

SEQ ID NO: 3911449 - RNA, 12 nt, Shigella flexneri 2a str. 301
ggugaaaaaaac

SEQ ID NO: 3911450 - RNA, 14 nt, Shigella flexneri 2a str. 301
ggugaaaaaauuaa

SEQ ID NO: 3911451 - RNA, 13 nt, Shigella flexneri 2a str. 301
ggugaaaaaccaa

SEQ ID NO: 3911452 - RNA, 18 nt, Shigella flexneri 2a str. 301
ggugaaaguaaaaaagaa

SEQ ID NO: 3911453 - RNA, 19 nt, Shigella flexneri 2a str. 301
ggugaaaguaaaaaagaag

SEQ ID NO: 3911454 - RNA, 18 nt, Shigella flexneri 2a str. 301
ggugaaaguaacaaagcc

SEQ ID NO: 3911455 - RNA, 23 nt, Shigella flexneri 2a str. 301
ggugaacagcauuaccauacggu

SEQ ID NO: 3911456 - RNA, 20 nt, Shigella flexneri 2a str. 301
ggugaacucacacagcgagu

SEQ ID NO: 3911457 - RNA, 22 nt, Shigella flexneri 2a str. 301
ggugaagguaaguuguugauaa

SEQ ID NO: 3911458 - RNA, 17 nt, Shigella flexneri 2a str. 301
ggugacaaagugccugu

SEQ ID NO: 3911459 - RNA, 21 nt, Shigella flexneri 2a str. 301
ggugacaaucaccaggucacc

SEQ ID NO: 3911460 - RNA, 14 nt, Shigella flexneri 2a str. 301
ggugacaucgcccu

SEQ ID NO: 3911461 - RNA, 18 nt, Shigella flexneri 2a str. 301
ggugaccuguaacguugc

SEQ ID NO: 3911462 - RNA, 13 nt, Shigella flexneri 2a str. 301
ggugacgcgcuuu

SEQ ID NO: 3911463 - RNA, 15 nt, Shigella flexneri 2a str. 301
ggugagcgaugcugc

SEQ ID NO: 3911464 - RNA, 14 nt, Shigella flexneri 2a str. 301
ggugagcgugcggu

SEQ ID NO: 3911465 - RNA, 17 nt, Shigella flexneri 2a str. 301
ggugagcuaaugcaaau

SEQ ID NO: 3911466 - RNA, 13 nt, Shigella flexneri 2a str. 301
ggugagggaggau

SEQ ID NO: 3911467 - RNA, 20 nt, Shigella flexneri 2a str. 301
ggugauaaucaucccacaug

SEQ ID NO: 3911468 - RNA, 19 nt, Shigella flexneri 2a str. 301
ggugauaccagaccauaca

SEQ ID NO: 3911469 - RNA, 17 nt, Shigella flexneri 2a str. 301
ggugauacugaucguca

SEQ ID NO: 3911470 - RNA, 14 nt, Shigella flexneri 2a str. 301
ggugaugaucgcgc

SEQ ID NO: 3911471 - RNA, 22 nt, Shigella flexneri 2a str. 301
ggugaugguauuguccugcaag

SEQ ID NO: 3911472 - RNA, 15 nt, Shigella flexneri 2a str. 301
ggugauguauaucgg

SEQ ID NO: 3911473 - RNA, 15 nt, Shigella flexneri 2a str. 301
ggugauuaucggcau

SEQ ID NO: 3911474 - RNA, 16 nt, Shigella flexneri 2a str. 301
ggugauucaucggaua

SEQ ID NO: 3911475 - RNA, 22 nt, Shigella flexneri 2a str. 301
ggugauuucaccugcauuugcu

SEQ ID NO: 3911476 - RNA, 16 nt, Shigella flexneri 2a str. 301
ggugcaagcauuagca

SEQ ID NO: 3911477 - RNA, 12 nt, Shigella flexneri 2a str. 301
ggugcaaucaaa

SEQ ID NO: 3911478 - RNA, 14 nt, Shigella flexneri 2a str. 301
ggugcagccggagc

SEQ ID NO: 3911479 - RNA, 15 nt, Shigella flexneri 2a str. 301
ggugcagcggcuccu

SEQ ID NO: 3911480 - RNA, 20 nt, Shigella flexneri 2a str. 301
ggugccgccacgaaacugcu

SEQ ID NO: 3911481 - RNA, 13 nt, Shigella flexneri 2a str. 301
ggugccgcgcagc

SEQ ID NO: 3911482 - RNA, 22 nt, Shigella flexneri 2a str. 301
ggugccggaucgguagaccgga

SEQ ID NO: 3911483 - RNA, 20 nt, Shigella flexneri 2a str. 301
ggugcgacaaacauugcugc

SEQ ID NO: 3911484 - RNA, 17 nt, Shigella flexneri 2a str. 301
ggugcgaccaaacugcu

SEQ ID NO: 3911485 - RNA, 18 nt, Shigella flexneri 2a str. 301
ggugcgaccaaacugcuc

SEQ ID NO: 3911486 - RNA, 18 nt, Shigella flexneri 2a str. 301
ggugcgaugccuggcaau

SEQ ID NO: 3911487 - RNA, 14 nt, Shigella flexneri 2a str. 301
ggugcggcaaaaac

SEQ ID NO: 3911488 - RNA, 19 nt, Shigella flexneri 2a str. 301
ggugcguaccaggcgugga

SEQ ID NO: 3911489 - RNA, 22 nt, Shigella flexneri 2a str. 301
ggugcucaucagcccggcaaug

SEQ ID NO: 3911490 - RNA, 13 nt, Shigella flexneri 2a str. 301
ggugcuuuugcug

SEQ ID NO: 3911491 - RNA, 13 nt, Shigella flexneri 2a str. 301
gguggcgagagcc

SEQ ID NO: 3911492 - RNA, 22 nt, Shigella flexneri 2a str. 301
ggugguagugcccaauagggcu

SEQ ID NO: 3911493 - RNA, 18 nt, Shigella flexneri 2a str. 301
gguguacugcaacucgcg

SEQ ID NO: 3911494 - RNA, 18 nt, Shigella flexneri 2a str. 301
gguguaucuucagcugca

SEQ ID NO: 3911495 - RNA, 16 nt, Shigella flexneri 2a str. 301
ggugucaaccagccag

SEQ ID NO: 3911496 - RNA, 17 nt, Shigella flexneri 2a str. 301
ggugucaaccagccagc

SEQ ID NO: 3911497 - RNA, 15 nt, Shigella flexneri 2a str. 301
ggugucacaugcagc

SEQ ID NO: 3911498 - RNA, 18 nt, Shigella flexneri 2a str. 301
ggugucacaugcagcgcc

SEQ ID NO: 3911499 - RNA, 13 nt, Shigella flexneri 2a str. 301
ggugucacggugu

SEQ ID NO: 3911500 - RNA, 21 nt, Shigella flexneri 2a str. 301
ggugucgccuuccacuucugc

SEQ ID NO: 3911501 - RNA, 19 nt, Shigella flexneri 2a str. 301
ggugucguuacgccgcaga

SEQ ID NO: 3911502 - RNA, 17 nt, Shigella flexneri 2a str. 301
gguguggcauggcgaau

SEQ ID NO: 3911503 - RNA, 21 nt, Shigella flexneri 2a str. 301
gguguuacccgcuaacuggug

SEQ ID NO: 3911504 - RNA, 20 nt, Shigella flexneri 2a str. 301
gguguucagauggccaauaa

SEQ ID NO: 3911505 - RNA, 22 nt, Shigella flexneri 2a str. 301
gguguucauccuggcacagcag

SEQ ID NO: 3911506 - RNA, 15 nt, Shigella flexneri 2a str. 301
gguguugaaaccgcu

SEQ ID NO: 3911507 - RNA, 13 nt, Shigella flexneri 2a str. 301
gguguugaagaaa

SEQ ID NO: 3911508 - RNA, 16 nt, Shigella flexneri 2a str. 301
gguguuuaaccaacac

SEQ ID NO: 3911509 - RNA, 15 nt, Shigella flexneri 2a str. 301
gguguuuaguuucgu

SEQ ID NO: 3911510 - RNA, 13 nt, Shigella flexneri 2a str. 301
gguuaaaaacagc

SEQ ID NO: 3911511 - RNA, 16 nt, Shigella flexneri 2a str. 301
gguuaaaaacauuuuc

SEQ ID NO: 3911512 - RNA, 12 nt, Shigella flexneri 2a str. 301
gguuaaccagca

SEQ ID NO: 3911513 - RNA, 20 nt, Shigella flexneri 2a str. 301
gguuaagccucacgguucau

SEQ ID NO: 3911514 - RNA, 19 nt, Shigella flexneri 2a str. 301
gguuaauaccgagcguuca

SEQ ID NO: 3911515 - RNA, 18 nt, Shigella flexneri 2a str. 301
gguuaccgacugcggccu

SEQ ID NO: 3911516 - RNA, 13 nt, Shigella flexneri 2a str. 301
gguuacggaucuc

SEQ ID NO: 3911517 - RNA, 19 nt, Shigella flexneri 2a str. 301
gguuagaauaccugccugu

SEQ ID NO: 3911518 - RNA, 12 nt, Shigella flexneri 2a str. 301
gguuagcguuug

SEQ ID NO: 3911519 - RNA, 13 nt, Shigella flexneri 2a str. 301
gguuauauuuccc

SEQ ID NO: 3911520 - RNA, 11 nt, Shigella flexneri 2a str. 301
gguuauugguu

SEQ ID NO: 3911521 - RNA, 21 nt, Shigella flexneri 2a str. 301
gguuauuucauuauuaauuuc

SEQ ID NO: 3911522 - RNA, 14 nt, Shigella flexneri 2a str. 301
gguucaaaguaaua

SEQ ID NO: 3911523 - RNA, 18 nt, Shigella flexneri 2a str. 301
gguucaacagcgugaacu

SEQ ID NO: 3911524 - RNA, 19 nt, Shigella flexneri 2a str. 301
gguucaaguccccccccuc

SEQ ID NO: 3911525 - RNA, 16 nt, Shigella flexneri 2a str. 301
gguucaauaucuuccu

SEQ ID NO: 3911526 - RNA, 19 nt, Shigella flexneri 2a str. 301
gguucauugagcgcaaaug

SEQ ID NO: 3911527 - RNA, 11 nt, Shigella flexneri 2a str. 301
gguuccagcuu

SEQ ID NO: 3911528 - RNA, 21 nt, Shigella flexneri 2a str. 301
gguuccccccacaaucagcca

SEQ ID NO: 3911529 - RNA, 16 nt, Shigella flexneri 2a str. 301
gguucgcacuaaguuc

SEQ ID NO: 3911530 - RNA, 22 nt, Shigella flexneri 2a str. 301
gguucgggaaauugcagagcug

SEQ ID NO: 3911531 - RNA, 21 nt, Shigella flexneri 2a str. 301
gguucguaagcgauaaccgca

SEQ ID NO: 3911532 - RNA, 21 nt, Shigella flexneri 2a str. 301
gguucguugaucacuuucacc

SEQ ID NO: 3911533 - RNA, 20 nt, Shigella flexneri 2a str. 301
gguucucuuuuauuucugcu

SEQ ID NO: 3911534 - RNA, 20 nt, Shigella flexneri 2a str. 301
gguucugcggguuagucugc

SEQ ID NO: 3911535 - RNA, 21 nt, Shigella flexneri 2a str. 301
gguucuuuggucaggcgcuga

SEQ ID NO: 3911536 - RNA, 13 nt, Shigella flexneri 2a str. 301
gguugaacccuuu

SEQ ID NO: 3911537 - RNA, 14 nt, Shigella flexneri 2a str. 301
gguugacgccccug

SEQ ID NO: 3911538 - RNA, 16 nt, Shigella flexneri 2a str. 301
gguugauauuccaucu

SEQ ID NO: 3911539 - RNA, 20 nt, Shigella flexneri 2a str. 301
gguugaucccaccgggcaac

SEQ ID NO: 3911540 - RNA, 23 nt, Shigella flexneri 2a str. 301
gguugccagcgccaacgcaccug

SEQ ID NO: 3911541 - RNA, 14 nt, Shigella flexneri 2a str. 301
guaaccacggcagc

SEQ ID NO: 3911542 - RNA, 17 nt, Shigella flexneri 2a str. 301
guaaccgcggcuaagcu

SEQ ID NO: 3911543 - RNA, 18 nt, Shigella flexneri 2a str. 301
guaaccguugaccagcau

SEQ ID NO: 3911544 - RNA, 12 nt, Shigella flexneri 2a str. 301
guaaccuucacc

SEQ ID NO: 3911545 - RNA, 22 nt, Shigella flexneri 2a str. 301
guaaccuuuaucgcgcagcaga

SEQ ID NO: 3911546 - RNA, 17 nt, Shigella flexneri 2a str. 301
guaacgacugacuuucg

SEQ ID NO: 3911547 - RNA, 18 nt, Shigella flexneri 2a str. 301
guaacgagacaaugcaaa

SEQ ID NO: 3911548 - RNA, 16 nt, Shigella flexneri 2a str. 301
guaacgaugcaugaca

SEQ ID NO: 3911549 - RNA, 15 nt, Shigella flexneri 2a str. 301
guaacgcacacaucc

SEQ ID NO: 3911550 - RNA, 22 nt, Shigella flexneri 2a str. 301
guaacgccagcggucauaacgc

SEQ ID NO: 3911551 - RNA, 18 nt, Shigella flexneri 2a str. 301
guaacgcuugcugauaac

SEQ ID NO: 3911552 - RNA, 14 nt, Shigella flexneri 2a str. 301
guaacggcagauga

SEQ ID NO: 3911553 - RNA, 22 nt, Shigella flexneri 2a str. 301
guaacguaaccguugaccagca

SEQ ID NO: 3911554 - RNA, 16 nt, Shigella flexneri 2a str. 301
guaacguaaucuucau

SEQ ID NO: 3911555 - RNA, 22 nt, Shigella flexneri 2a str. 301
guaacguuugauuaacgccaga

SEQ ID NO: 3911556 - RNA, 18 nt, Shigella flexneri 2a str. 301
guaacucacugaugccgu

SEQ ID NO: 3911557 - RNA, 20 nt, Shigella flexneri 2a str. 301
guaacucacugaugccguuu

SEQ ID NO: 3911558 - RNA, 15 nt, Shigella flexneri 2a str. 301
guaacucauugccag

SEQ ID NO: 3911559 - RNA, 15 nt, Shigella flexneri 2a str. 301
guaacugaagcauug

SEQ ID NO: 3911560 - RNA, 16 nt, Shigella flexneri 2a str. 301
guaacugagcggccag

SEQ ID NO: 3911561 - RNA, 22 nt, Shigella flexneri 2a str. 301
guaacugcugcucaaucugcgc

SEQ ID NO: 3911562 - RNA, 21 nt, Shigella flexneri 2a str. 301
guaacugucuucaccauaguu

SEQ ID NO: 3911563 - RNA, 17 nt, Shigella flexneri 2a str. 301
guaacuuaucuguaauu

SEQ ID NO: 3911564 - RNA, 17 nt, Shigella flexneri 2a str. 301
guaagaacaagcaaacc

SEQ ID NO: 3911565 - RNA, 16 nt, Shigella flexneri 2a str. 301
guaagagaacagauag

SEQ ID NO: 3911566 - RNA, 20 nt, Shigella flexneri 2a str. 301
guaagcagaaaagccaauga

SEQ ID NO: 3911567 - RNA, 15 nt, Shigella flexneri 2a str. 301
guaagcaggguugca

SEQ ID NO: 3911568 - RNA, 14 nt, Shigella flexneri 2a str. 301
guaagcgauaacgc

SEQ ID NO: 3911569 - RNA, 21 nt, Shigella flexneri 2a str. 301
guaagcgcggauuuuauucag

SEQ ID NO: 3911570 - RNA, 17 nt, Shigella flexneri 2a str. 301
guaaggcaucuucuuca

SEQ ID NO: 3911571 - RNA, 15 nt, Shigella flexneri 2a str. 301
guaaggccgaauacc

SEQ ID NO: 3911572 - RNA, 16 nt, Shigella flexneri 2a str. 301
guaaggcuucaaucaa

SEQ ID NO: 3911573 - RNA, 18 nt, Shigella flexneri 2a str. 301
guaagggaggauuucucc

SEQ ID NO: 3911574 - RNA, 19 nt, Shigella flexneri 2a str. 301
guaagggaggauuucuccc

SEQ ID NO: 3911575 - RNA, 13 nt, Shigella flexneri 2a str. 301
guaaggucaucaa

SEQ ID NO: 3911576 - RNA, 17 nt, Shigella flexneri 2a str. 301
guaagguugucgauacc

SEQ ID NO: 3911577 - RNA, 12 nt, Shigella flexneri 2a str. 301
guaaguaaugac

SEQ ID NO: 3911578 - RNA, 18 nt, Shigella flexneri 2a str. 301
guaaguacgccaucacgc

SEQ ID NO: 3911579 - RNA, 15 nt, Shigella flexneri 2a str. 301
guaaguccauacugu

SEQ ID NO: 3911580 - RNA, 18 nt, Shigella flexneri 2a str. 301
guaauaaugcccaucgug

SEQ ID NO: 3911581 - RNA, 17 nt, Shigella flexneri 2a str. 301
guaauaauuacuuacau

SEQ ID NO: 3911582 - RNA, 18 nt, Shigella flexneri 2a str. 301
guaauacaaccugcugga

SEQ ID NO: 3911583 - RNA, 16 nt, Shigella flexneri 2a str. 301
guaauacggcucucac

SEQ ID NO: 3911584 - RNA, 22 nt, Shigella flexneri 2a str. 301
guaauaugugcgccacgcagcg

SEQ ID NO: 3911585 - RNA, 22 nt, Shigella flexneri 2a str. 301
guaauauuucucggcaaauuca

SEQ ID NO: 3911586 - RNA, 13 nt, Shigella flexneri 2a str. 301
guaaucaccaccc

SEQ ID NO: 3911587 - RNA, 22 nt, Shigella flexneri 2a str. 301
guaaucacgaucucgccaguga

SEQ ID NO: 3911588 - RNA, 14 nt, Shigella flexneri 2a str. 301
guaaucauauuaaa

SEQ ID NO: 3911589 - RNA, 15 nt, Shigella flexneri 2a str. 301
guaaucauauuaaau

SEQ ID NO: 3911590 - RNA, 16 nt, Shigella flexneri 2a str. 301
guaaucauauugcucu

SEQ ID NO: 3911591 - RNA, 21 nt, Shigella flexneri 2a str. 301
guaauccucuuugcuuccuga

SEQ ID NO: 3911592 - RNA, 23 nt, Shigella flexneri 2a str. 301
guaauccucuuugcuuccugagu

SEQ ID NO: 3911593 - RNA, 17 nt, Shigella flexneri 2a str. 301
guaaucggcgaaaccgc

SEQ ID NO: 3911594 - RNA, 16 nt, Shigella flexneri 2a str. 301
guaaugacaacaucuu

SEQ ID NO: 3911595 - RNA, 14 nt, Shigella flexneri 2a str. 301
guaaugauguaaaa

SEQ ID NO: 3911596 - RNA, 13 nt, Shigella flexneri 2a str. 301
guaaugauuuaau

SEQ ID NO: 3911597 - RNA, 22 nt, Shigella flexneri 2a str. 301
guaaugccguuuuggguguaca

SEQ ID NO: 3911598 - RNA, 15 nt, Shigella flexneri 2a str. 301
guaaugcucaauucc

SEQ ID NO: 3911599 - RNA, 22 nt, Shigella flexneri 2a str. 301
guaaugcucgacgagaauuucc

SEQ ID NO: 3911600 - RNA, 17 nt, Shigella flexneri 2a str. 301
guaaugcuuauuucacc

SEQ ID NO: 3911601 - RNA, 15 nt, Shigella flexneri 2a str. 301
guaaugggaucgaaa

SEQ ID NO: 3911602 - RNA, 21 nt, Shigella flexneri 2a str. 301
guaauuauaugccagccccag

SEQ ID NO: 3911603 - RNA, 19 nt, Shigella flexneri 2a str. 301
guaauugcuuuuaccauac

SEQ ID NO: 3911604 - RNA, 18 nt, Shigella flexneri 2a str. 301
guaauuggccugacaggu

SEQ ID NO: 3911605 - RNA, 18 nt, Shigella flexneri 2a str. 301
guacaaacgcuuuacuca

SEQ ID NO: 3911606 - RNA, 20 nt, Shigella flexneri 2a str. 301
guacaaauuuuaggcguuaa

SEQ ID NO: 3911607 - RNA, 17 nt, Shigella flexneri 2a str. 301
guacacaacaugcagcc

SEQ ID NO: 3911608 - RNA, 20 nt, Shigella flexneri 2a str. 301
guacacaacaugcagcccag

SEQ ID NO: 3911609 - RNA, 11 nt, Shigella flexneri 2a str. 301
guacaccaaca

SEQ ID NO: 3911610 - RNA, 14 nt, Shigella flexneri 2a str. 301
guacaccaacauca

SEQ ID NO: 3911611 - RNA, 17 nt, Shigella flexneri 2a str. 301
guacaccaacaucacgc

SEQ ID NO: 3911612 - RNA, 12 nt, Shigella flexneri 2a str. 301
guacaccaccua

SEQ ID NO: 3911613 - RNA, 15 nt, Shigella flexneri 2a str. 301
guacacuuuccuggu

SEQ ID NO: 3911614 - RNA, 16 nt, Shigella flexneri 2a str. 301
guacagagcaauaaaa

SEQ ID NO: 3911615 - RNA, 15 nt, Shigella flexneri 2a str. 301
guacagauccgccau

SEQ ID NO: 3911616 - RNA, 16 nt, Shigella flexneri 2a str. 301
guacagauccgccauu

SEQ ID NO: 3911617 - RNA, 18 nt, Shigella flexneri 2a str. 301
guacagcauaaggcacac

SEQ ID NO: 3911618 - RNA, 12 nt, Shigella flexneri 2a str. 301
guacaggcacau

SEQ ID NO: 3911619 - RNA, 15 nt, Shigella flexneri 2a str. 301
guacaucaauaccau

SEQ ID NO: 3911620 - RNA, 19 nt, Shigella flexneri 2a str. 301
guacaucguagugaugcca

SEQ ID NO: 3911621 - RNA, 12 nt, Shigella flexneri 2a str. 301
guacaugaagca

SEQ ID NO: 3911622 - RNA, 15 nt, Shigella flexneri 2a str. 301
guacauuaaaauugg

SEQ ID NO: 3911623 - RNA, 15 nt, Shigella flexneri 2a str. 301
guacauuaagcgcau

SEQ ID NO: 3911624 - RNA, 15 nt, Shigella flexneri 2a str. 301
guacauuguuuucca

SEQ ID NO: 3911625 - RNA, 23 nt, Shigella flexneri 2a str. 301
guaccaccgcgaaaacaauuacg

SEQ ID NO: 3911626 - RNA, 11 nt, Shigella flexneri 2a str. 301
guaccaccgga

SEQ ID NO: 3911627 - RNA, 12 nt, Shigella flexneri 2a str. 301
guaccacgccac

SEQ ID NO: 3911628 - RNA, 12 nt, Shigella flexneri 2a str. 301
guaccagcagcg

SEQ ID NO: 3911629 - RNA, 13 nt, Shigella flexneri 2a str. 301
guaccaucgccag

SEQ ID NO: 3911630 - RNA, 16 nt, Shigella flexneri 2a str. 301
guaccaugauccugca

SEQ ID NO: 3911631 - RNA, 18 nt, Shigella flexneri 2a str. 301
guaccaugcgcaucaucg

SEQ ID NO: 3911632 - RNA, 14 nt, Shigella flexneri 2a str. 301
guacccaucaacaa

SEQ ID NO: 3911633 - RNA, 12 nt, Shigella flexneri 2a str. 301
guacccgcuggc

SEQ ID NO: 3911634 - RNA, 18 nt, Shigella flexneri 2a str. 301
guacccggccuguuuauc

SEQ ID NO: 3911635 - RNA, 17 nt, Shigella flexneri 2a str. 301
guaccgccagcaggaac

SEQ ID NO: 3911636 - RNA, 22 nt, Shigella flexneri 2a str. 301
guaccgccgccauaaacagcag

SEQ ID NO: 3911637 - RNA, 21 nt, Shigella flexneri 2a str. 301
guaccggacaugauuacugca

SEQ ID NO: 3911638 - RNA, 23 nt, Shigella flexneri 2a str. 301
guaccgucaaucuucacgcgcag

SEQ ID NO: 3911639 - RNA, 15 nt, Shigella flexneri 2a str. 301
guaccgugcagcgca

SEQ ID NO: 3911640 - RNA, 22 nt, Shigella flexneri 2a str. 301
guaccguugcugccagugcggu

SEQ ID NO: 3911641 - RNA, 19 nt, Shigella flexneri 2a str. 301
guaucagcgucauuaccca

SEQ ID NO: 3911642 - RNA, 16 nt, Shigella flexneri 2a str. 301
guaucaucauuauuaa

SEQ ID NO: 3911643 - RNA, 22 nt, Shigella flexneri 2a str. 301
guaucaugcaguaccagauaau

SEQ ID NO: 3911644 - RNA, 21 nt, Shigella flexneri 2a str. 301
guauccggcauggacgacagc

SEQ ID NO: 3911645 - RNA, 17 nt, Shigella flexneri 2a str. 301
guauccugucauacgcg

SEQ ID NO: 3911646 - RNA, 14 nt, Shigella flexneri 2a str. 301
guauccuguuuuua

SEQ ID NO: 3911647 - RNA, 21 nt, Shigella flexneri 2a str. 301
guauccuguuuuuaagugaug

SEQ ID NO: 3911648 - RNA, 19 nt, Shigella flexneri 2a str. 301
guaucgcgaaaaaaaagau

SEQ ID NO: 3911649 - RNA, 16 nt, Shigella flexneri 2a str. 301
guaucguaaucagcac

SEQ ID NO: 3911650 - RNA, 15 nt, Shigella flexneri 2a str. 301
guaucguggcgcagc

SEQ ID NO: 3911651 - RNA, 15 nt, Shigella flexneri 2a str. 301
guaucucguccaguu

SEQ ID NO: 3911652 - RNA, 14 nt, Shigella flexneri 2a str. 301
guaucugaaucaaa

SEQ ID NO: 3911653 - RNA, 18 nt, Shigella flexneri 2a str. 301
guaucugaaucaaaauca

SEQ ID NO: 3911654 - RNA, 20 nt, Shigella flexneri 2a str. 301
guaucugaaucaaaaucauc

SEQ ID NO: 3911655 - RNA, 16 nt, Shigella flexneri 2a str. 301
guaucuggcaagcagg

SEQ ID NO: 3911656 - RNA, 20 nt, Shigella flexneri 2a str. 301
guaucuguggcgcuaugcug

SEQ ID NO: 3911657 - RNA, 17 nt, Shigella flexneri 2a str. 301
guaucuucaugcuccag

SEQ ID NO: 3911658 - RNA, 19 nt, Shigella flexneri 2a str. 301
guaucuucaugcuccagca

SEQ ID NO: 3911659 - RNA, 13 nt, Shigella flexneri 2a str. 301
guaucuuugacua

SEQ ID NO: 3911660 - RNA, 15 nt, Shigella flexneri 2a str. 301
guaugaaauuuagcg

SEQ ID NO: 3911661 - RNA, 13 nt, Shigella flexneri 2a str. 301
guaugaauuugca

SEQ ID NO: 3911662 - RNA, 14 nt, Shigella flexneri 2a str. 301
guaugccucuuuca

SEQ ID NO: 3911663 - RNA, 12 nt, Shigella flexneri 2a str. 301
guaugccuggca

SEQ ID NO: 3911664 - RNA, 14 nt, Shigella flexneri 2a str. 301
guaugccuggcauu

SEQ ID NO: 3911665 - RNA, 20 nt, Shigella flexneri 2a str. 301
guaugcgccacaggucagca

SEQ ID NO: 3911666 - RNA, 18 nt, Shigella flexneri 2a str. 301
guauggaucccucuuucu

SEQ ID NO: 3911667 - RNA, 17 nt, Shigella flexneri 2a str. 301
guauguucucuggcgaa

SEQ ID NO: 3911668 - RNA, 16 nt, Shigella flexneri 2a str. 301
guauuacaacgugcuc

SEQ ID NO: 3911669 - RNA, 16 nt, Shigella flexneri 2a str. 301
guauuaccggcagagu

SEQ ID NO: 3911670 - RNA, 15 nt, Shigella flexneri 2a str. 301
guauuacuccagaua

SEQ ID NO: 3911671 - RNA, 18 nt, Shigella flexneri 2a str. 301
guauuagaugcuaguuau

SEQ ID NO: 3911672 - RNA, 23 nt, Shigella flexneri 2a str. 301
guauuaguggcaaccacaaccgc

SEQ ID NO: 3911673 - RNA, 14 nt, Shigella flexneri 2a str. 301
guauuauauauaau

SEQ ID NO: 3911674 - RNA, 19 nt, Shigella flexneri 2a str. 301
guauucaaccguuuccagu

SEQ ID NO: 3911675 - RNA, 17 nt, Shigella flexneri 2a str. 301
guauucaugcccugccc

SEQ ID NO: 3911676 - RNA, 14 nt, Shigella flexneri 2a str. 301
guauucauugccug

SEQ ID NO: 3911677 - RNA, 19 nt, Shigella flexneri 2a str. 301
guauugccgaugaacggcg

SEQ ID NO: 3911678 - RNA, 22 nt, Shigella flexneri 2a str. 301
guauuggaagguuaauaaauau

SEQ ID NO: 3911679 - RNA, 14 nt, Shigella flexneri 2a str. 301
guauuguccugcaa

SEQ ID NO: 3911680 - RNA, 15 nt, Shigella flexneri 2a str. 301
guauuguuaaauauu

SEQ ID NO: 3911681 - RNA, 21 nt, Shigella flexneri 2a str. 301
guauuuauuuuccaaaauaaa

SEQ ID NO: 3911682 - RNA, 22 nt, Shigella flexneri 2a str. 301
guauuuauuuuccaaaauaaaa

SEQ ID NO: 3911683 - RNA, 11 nt, Shigella flexneri 2a str. 301
guauuuccagg

SEQ ID NO: 3911684 - RNA, 12 nt, Shigella flexneri 2a str. 301
guauuuccaggg

SEQ ID NO: 3911685 - RNA, 13 nt, Shigella flexneri 2a str. 301
guauuuccagggc

SEQ ID NO: 3911686 - RNA, 17 nt, Shigella flexneri 2a str. 301
guauuuccaguccagcu

SEQ ID NO: 3911687 - RNA, 16 nt, Shigella flexneri 2a str. 301
guauuugauauuuauu

SEQ ID NO: 3911688 - RNA, 23 nt, Shigella flexneri 2a str. 301
guauuuugucagcccuuuuggca

SEQ ID NO: 3911689 - RNA, 12 nt, Shigella flexneri 2a str. 301
guauuuuuauug

SEQ ID NO: 3911690 - RNA, 19 nt, Shigella flexneri 2a str. 301
gucaaaacgcgacugcaaa

SEQ ID NO: 3911691 - RNA, 20 nt, Shigella flexneri 2a str. 301
gucaaaauccauuuucuauu

SEQ ID NO: 3911692 - RNA, 18 nt, Shigella flexneri 2a str. 301
gucaaacgggcuucuaau

SEQ ID NO: 3911693 - RNA, 21 nt, Shigella flexneri 2a str. 301
gucaaaguaaccuuugaacaa

SEQ ID NO: 3911694 - RNA, 14 nt, Shigella flexneri 2a str. 301
gucaacagggcaga

SEQ ID NO: 3911695 - RNA, 16 nt, Shigella flexneri 2a str. 301
gucaacagggcagaca

SEQ ID NO: 3911696 - RNA, 19 nt, Shigella flexneri 2a str. 301
gucaacaucgcauucgaca

SEQ ID NO: 3911697 - RNA, 16 nt, Shigella flexneri 2a str. 301
gucaaccagccagcgc

SEQ ID NO: 3911698 - RNA, 22 nt, Shigella flexneri 2a str. 301
gucaacggugccauugaccagc

SEQ ID NO: 3911699 - RNA, 17 nt, Shigella flexneri 2a str. 301
gucaacgucauuaucug

SEQ ID NO: 3911700 - RNA, 14 nt, Shigella flexneri 2a str. 301
gucaagaucggcga

SEQ ID NO: 3911701 - RNA, 19 nt, Shigella flexneri 2a str. 301
gucaauaagugcuuuagcc

SEQ ID NO: 3911702 - RNA, 23 nt, Shigella flexneri 2a str. 301
gucaauauuaucgauuuucugcu

SEQ ID NO: 3911703 - RNA, 15 nt, Shigella flexneri 2a str. 301
gucaaucauccauau

SEQ ID NO: 3911704 - RNA, 11 nt, Shigella flexneri 2a str. 301
gucaaucugac

SEQ ID NO: 3911705 - RNA, 12 nt, Shigella flexneri 2a str. 301
gucaaucugcuc

SEQ ID NO: 3911706 - RNA, 15 nt, Shigella flexneri 2a str. 301
gucaaugauuucugc

SEQ ID NO: 3911707 - RNA, 20 nt, Shigella flexneri 2a str. 301
gucaaugccgucaccagcau

SEQ ID NO: 3911708 - RNA, 22 nt, Shigella flexneri 2a str. 301
gucacaaauagagcgccggaaa

SEQ ID NO: 3911709 - RNA, 16 nt, Shigella flexneri 2a str. 301
gucacaaaucucccuu

SEQ ID NO: 3911710 - RNA, 14 nt, Shigella flexneri 2a str. 301
gucacagaagagag

SEQ ID NO: 3911711 - RNA, 16 nt, Shigella flexneri 2a str. 301
gucacagccgcaggcc

SEQ ID NO: 3911712 - RNA, 16 nt, Shigella flexneri 2a str. 301
gucacaggccaucaca

SEQ ID NO: 3911713 - RNA, 17 nt, Shigella flexneri 2a str. 301
gucacaucaccaacacc

SEQ ID NO: 3911714 - RNA, 16 nt, Shigella flexneri 2a str. 301
gucaccacauccagcu

SEQ ID NO: 3911715 - RNA, 15 nt, Shigella flexneri 2a str. 301
gucaccacccugccc

SEQ ID NO: 3911716 - RNA, 22 nt, Shigella flexneri 2a str. 301
gucaccacggccagguuaacca

SEQ ID NO: 3911717 - RNA, 16 nt, Shigella flexneri 2a str. 301
gucaccuucuggcgac

SEQ ID NO: 3911718 - RNA, 17 nt, Shigella flexneri 2a str. 301
gucaccuucuggcgacc

SEQ ID NO: 3911719 - RNA, 15 nt, Shigella flexneri 2a str. 301
gucacgaucgcgcca

SEQ ID NO: 3911720 - RNA, 18 nt, Shigella flexneri 2a str. 301
gucacgcauucagcaaau

SEQ ID NO: 3911721 - RNA, 16 nt, Shigella flexneri 2a str. 301
gucacgccaauaaucg

SEQ ID NO: 3911722 - RNA, 15 nt, Shigella flexneri 2a str. 301
gucacggaaucccgu

SEQ ID NO: 3911723 - RNA, 20 nt, Shigella flexneri 2a str. 301
gucacggcgacggcuggcaa

SEQ ID NO: 3911724 - RNA, 21 nt, Shigella flexneri 2a str. 301
gucacguagcggcggcagauu

SEQ ID NO: 3911725 - RNA, 15 nt, Shigella flexneri 2a str. 301
gucacgucauccccc

SEQ ID NO: 3911726 - RNA, 17 nt, Shigella flexneri 2a str. 301
gucacucgacagcaccg

SEQ ID NO: 3911727 - RNA, 22 nt, Shigella flexneri 2a str. 301
gucacucucgacccgacagaug

SEQ ID NO: 3911728 - RNA, 14 nt, Shigella flexneri 2a str. 301
gucacugacuauuu

SEQ ID NO: 3911729 - RNA, 18 nt, Shigella flexneri 2a str. 301
gucacugauagugcugcc

SEQ ID NO: 3911730 - RNA, 18 nt, Shigella flexneri 2a str. 301
gucacugcgcccuacucc

SEQ ID NO: 3911731 - RNA, 17 nt, Shigella flexneri 2a str. 301
gucacuuaauccggagc

SEQ ID NO: 3911732 - RNA, 13 nt, Shigella flexneri 2a str. 301
gucacuucaucgu

SEQ ID NO: 3911733 - RNA, 13 nt, Shigella flexneri 2a str. 301
gucacuuugcccu

SEQ ID NO: 3911734 - RNA, 22 nt, Shigella flexneri 2a str. 301
gucagaaacaguuguaaaguac

SEQ ID NO: 3911735 - RNA, 18 nt, Shigella flexneri 2a str. 301
gucagaaaucugauauac

SEQ ID NO: 3911736 - RNA, 13 nt, Shigella flexneri 2a str. 301
gucagacagcgau

SEQ ID NO: 3911737 - RNA, 14 nt, Shigella flexneri 2a str. 301
gucagacuuaagcc

SEQ ID NO: 3911738 - RNA, 18 nt, Shigella flexneri 2a str. 301
gucagagagccagcccca

SEQ ID NO: 3911739 - RNA, 13 nt, Shigella flexneri 2a str. 301
gucagauccgcca

SEQ ID NO: 3911740 - RNA, 22 nt, Shigella flexneri 2a str. 301
gucagaucgccccggucaucaa

SEQ ID NO: 3911741 - RNA, 21 nt, Shigella flexneri 2a str. 301
guccagacggagcugccaggc

SEQ ID NO: 3911742 - RNA, 16 nt, Shigella flexneri 2a str. 301
guccagauaauaauca

SEQ ID NO: 3911743 - RNA, 12 nt, Shigella flexneri 2a str. 301
guccagcaggcg

SEQ ID NO: 3911744 - RNA, 12 nt, Shigella flexneri 2a str. 301
guccagccgcca

SEQ ID NO: 3911745 - RNA, 23 nt, Shigella flexneri 2a str. 301
guccagcuuuucgauaacccggc

SEQ ID NO: 3911746 - RNA, 22 nt, Shigella flexneri 2a str. 301
guccaggcugcaaagucugggc

SEQ ID NO: 3911747 - RNA, 18 nt, Shigella flexneri 2a str. 301
guccaguucccaaccauu

SEQ ID NO: 3911748 - RNA, 23 nt, Shigella flexneri 2a str. 301
guccaguugcccgguaauuaacu

SEQ ID NO: 3911749 - RNA, 16 nt, Shigella flexneri 2a str. 301
guccaguuugccuuca

SEQ ID NO: 3911750 - RNA, 14 nt, Shigella flexneri 2a str. 301
guccauaaaaugca

SEQ ID NO: 3911751 - RNA, 19 nt, Shigella flexneri 2a str. 301
guccauacccagcaucagu

SEQ ID NO: 3911752 - RNA, 14 nt, Shigella flexneri 2a str. 301
guccauacugucuc

SEQ ID NO: 3911753 - RNA, 21 nt, Shigella flexneri 2a str. 301
guccauagcgauguauuucau

SEQ ID NO: 3911754 - RNA, 21 nt, Shigella flexneri 2a str. 301
guccaucacaaucauccuacc

SEQ ID NO: 3911755 - RNA, 17 nt, Shigella flexneri 2a str. 301
guccaucacuucgccga

SEQ ID NO: 3911756 - RNA, 13 nt, Shigella flexneri 2a str. 301
guccaucggcggc

SEQ ID NO: 3911757 - RNA, 15 nt, Shigella flexneri 2a str. 301
guccauggugucuga

SEQ ID NO: 3911758 - RNA, 21 nt, Shigella flexneri 2a str. 301
gucccaaccuuguuucugagc

SEQ ID NO: 3911759 - RNA, 14 nt, Shigella flexneri 2a str. 301
gucccaguucaugu

SEQ ID NO: 3911760 - RNA, 18 nt, Shigella flexneri 2a str. 301
gucccauuuuaaacguca

SEQ ID NO: 3911761 - RNA, 13 nt, Shigella flexneri 2a str. 301
guccccgagcaca

SEQ ID NO: 3911762 - RNA, 19 nt, Shigella flexneri 2a str. 301
guccccgagcacaugcagu

SEQ ID NO: 3911763 - RNA, 21 nt, Shigella flexneri 2a str. 301
gucccggaacaggcagggcca

SEQ ID NO: 3911764 - RNA, 18 nt, Shigella flexneri 2a str. 301
gucccuuccgcaauacag

SEQ ID NO: 3911765 - RNA, 20 nt, Shigella flexneri 2a str. 301
guccgcaauacaucaaagcg

SEQ ID NO: 3911766 - RNA, 12 nt, Shigella flexneri 2a str. 301
guccgccagccu

SEQ ID NO: 3911767 - RNA, 14 nt, Shigella flexneri 2a str. 301
guccgccguagccg

SEQ ID NO: 3911768 - RNA, 15 nt, Shigella flexneri 2a str. 301
guccgcguccagcuu

SEQ ID NO: 3911769 - RNA, 16 nt, Shigella flexneri 2a str. 301
guccgcguccgcugga

SEQ ID NO: 3911770 - RNA, 22 nt, Shigella flexneri 2a str. 301
guccgcgucuuaucaggccuac

SEQ ID NO: 3911771 - RNA, 23 nt, Shigella flexneri 2a str. 301
guccgcuauuucuugugcauggc

SEQ ID NO: 3911772 - RNA, 21 nt, Shigella flexneri 2a str. 301
guccgcucaaacgacgauaau

SEQ ID NO: 3911773 - RNA, 14 nt, Shigella flexneri 2a str. 301
guccgcuucaccac

SEQ ID NO: 3911774 - RNA, 14 nt, Shigella flexneri 2a str. 301
guccggcgcugcaa

SEQ ID NO: 3911775 - RNA, 15 nt, Shigella flexneri 2a str. 301
guccgguacgacaau

SEQ ID NO: 3911776 - RNA, 15 nt, Shigella flexneri 2a str. 301
guccgguuuacuucc

SEQ ID NO: 3911777 - RNA, 22 nt, Shigella flexneri 2a str. 301
guccguacccgguugacugcug

SEQ ID NO: 3911778 - RNA, 14 nt, Shigella flexneri 2a str. 301
guccguaggcagga

SEQ ID NO: 3911779 - RNA, 22 nt, Shigella flexneri 2a str. 301
guccguaggcaggacuuuucaa

SEQ ID NO: 3911780 - RNA, 13 nt, Shigella flexneri 2a str. 301
guccgugaagaaa

SEQ ID NO: 3911781 - RNA, 15 nt, Shigella flexneri 2a str. 301
guccguuauggcgug

SEQ ID NO: 3911782 - RNA, 12 nt, Shigella flexneri 2a str. 301
guccguugaaaa

SEQ ID NO: 3911783 - RNA, 16 nt, Shigella flexneri 2a str. 301
guccguugaaaaugcu

SEQ ID NO: 3911784 - RNA, 17 nt, Shigella flexneri 2a str. 301
guccuacacacgccagu

SEQ ID NO: 3911785 - RNA, 15 nt, Shigella flexneri 2a str. 301
guccucuucccagac

SEQ ID NO: 3911786 - RNA, 18 nt, Shigella flexneri 2a str. 301
guccugacgcccgaaggc

SEQ ID NO: 3911787 - RNA, 18 nt, Shigella flexneri 2a str. 301
guccugagcacuuuucug

SEQ ID NO: 3911788 - RNA, 14 nt, Shigella flexneri 2a str. 301
guccugcaaggugg

SEQ ID NO: 3911789 - RNA, 16 nt, Shigella flexneri 2a str. 301
guccugcaaggugguc

SEQ ID NO: 3911790 - RNA, 22 nt, Shigella flexneri 2a str. 301
guccugcucaaacuucgucaca

SEQ ID NO: 3911791 - RNA, 16 nt, Shigella flexneri 2a str. 301
guccuggcggcacggc

SEQ ID NO: 3911792 - RNA, 16 nt, Shigella flexneri 2a str. 301
guccuguaaugagaau

SEQ ID NO: 3911793 - RNA, 21 nt, Shigella flexneri 2a str. 301
guccuguaaugagaauaauca

SEQ ID NO: 3911794 - RNA, 14 nt, Shigella flexneri 2a str. 301
guccugugacucaa

SEQ ID NO: 3911795 - RNA, 18 nt, Shigella flexneri 2a str. 301
guccuguugaaaaaccag

SEQ ID NO: 3911796 - RNA, 13 nt, Shigella flexneri 2a str. 301
guccuuaccaugc

SEQ ID NO: 3911797 - RNA, 13 nt, Shigella flexneri 2a str. 301
guccuucaggccc

SEQ ID NO: 3911798 - RNA, 21 nt, Shigella flexneri 2a str. 301
guccuucaucuucauccggcu

SEQ ID NO: 3911799 - RNA, 12 nt, Shigella flexneri 2a str. 301
guccuuccaggu

SEQ ID NO: 3911800 - RNA, 21 nt, Shigella flexneri 2a str. 301
guccuuuugccgcccagucac

SEQ ID NO: 3911801 - RNA, 18 nt, Shigella flexneri 2a str. 301
gucgaacagguuauugac

SEQ ID NO: 3911802 - RNA, 16 nt, Shigella flexneri 2a str. 301
gucgaacgcuaugacg

SEQ ID NO: 3911803 - RNA, 12 nt, Shigella flexneri 2a str. 301
gucgacacagau

SEQ ID NO: 3911804 - RNA, 17 nt, Shigella flexneri 2a str. 301
gucgacuucagauaaau

SEQ ID NO: 3911805 - RNA, 18 nt, Shigella flexneri 2a str. 301
gucgagaacaacggcgag

SEQ ID NO: 3911806 - RNA, 18 nt, Shigella flexneri 2a str. 301
gucgagaauaucgauauc

SEQ ID NO: 3911807 - RNA, 21 nt, Shigella flexneri 2a str. 301
gucgagauacacggugcucca

SEQ ID NO: 3911808 - RNA, 15 nt, Shigella flexneri 2a str. 301
gucgagaucgcggca

SEQ ID NO: 3911809 - RNA, 17 nt, Shigella flexneri 2a str. 301
gucgagaucgcggcaau

SEQ ID NO: 3911810 - RNA, 14 nt, Shigella flexneri 2a str. 301
gucgaggcaaccag

SEQ ID NO: 3911811 - RNA, 21 nt, Shigella flexneri 2a str. 301
gucgagguacgcuccagcagg

SEQ ID NO: 3911812 - RNA, 14 nt, Shigella flexneri 2a str. 301
gucgauauaauuga

SEQ ID NO: 3911813 - RNA, 19 nt, Shigella flexneri 2a str. 301
gucgauaucgcugucgcca

SEQ ID NO: 3911814 - RNA, 20 nt, Shigella flexneri 2a str. 301
gucgcaauacccugacccag

SEQ ID NO: 3911815 - RNA, 13 nt, Shigella flexneri 2a str. 301
gucgcagccagcg

SEQ ID NO: 3911816 - RNA, 15 nt, Shigella flexneri 2a str. 301
gucgcagcugccugc

SEQ ID NO: 3911817 - RNA, 15 nt, Shigella flexneri 2a str. 301
gucgcaucaggcauu

SEQ ID NO: 3911818 - RNA, 20 nt, Shigella flexneri 2a str. 301
gucgcaucaggcauugugcu

SEQ ID NO: 3911819 - RNA, 14 nt, Shigella flexneri 2a str. 301
gucgcauccggcaa

SEQ ID NO: 3911820 - RNA, 18 nt, Shigella flexneri 2a str. 301
gucgcauccggcaauuac

SEQ ID NO: 3911821 - RNA, 20 nt, Shigella flexneri 2a str. 301
gucgcauccggcaugaacaa

SEQ ID NO: 3911822 - RNA, 15 nt, Shigella flexneri 2a str. 301
gucgccagcgccagc

SEQ ID NO: 3911823 - RNA, 16 nt, Shigella flexneri 2a str. 301
gucgcccauuuugcca

SEQ ID NO: 3911824 - RNA, 21 nt, Shigella flexneri 2a str. 301
gucgcccccgcgccagcgggc

SEQ ID NO: 3911825 - RNA, 20 nt, Shigella flexneri 2a str. 301
gucgcccgaccaucgccagc

SEQ ID NO: 3911826 - RNA, 23 nt, Shigella flexneri 2a str. 301
gucgcccgaccaucgccagcuca

SEQ ID NO: 3911827 - RNA, 15 nt, Shigella flexneri 2a str. 301
gucgccgcugguggu

SEQ ID NO: 3911828 - RNA, 19 nt, Shigella flexneri 2a str. 301
gucgccgggaugcuggggc

SEQ ID NO: 3911829 - RNA, 16 nt, Shigella flexneri 2a str. 301
gucgccguaccgggug

SEQ ID NO: 3911830 - RNA, 19 nt, Shigella flexneri 2a str. 301
gucgccuguacuuccuguu

SEQ ID NO: 3911831 - RNA, 15 nt, Shigella flexneri 2a str. 301
gucgcgaauggccug

SEQ ID NO: 3911832 - RNA, 18 nt, Shigella flexneri 2a str. 301
gucgcgcaauugccagac

SEQ ID NO: 3911833 - RNA, 15 nt, Shigella flexneri 2a str. 301
gucgcgcccuccugc

SEQ ID NO: 3911834 - RNA, 22 nt, Shigella flexneri 2a str. 301
gucgcgguugcugucggcggcg

SEQ ID NO: 3911835 - RNA, 20 nt, Shigella flexneri 2a str. 301
gucgcuauuacgcacacuuu

SEQ ID NO: 3911836 - RNA, 22 nt, Shigella flexneri 2a str. 301
gucgcugaaaggauuucgcaac

SEQ ID NO: 3911837 - RNA, 16 nt, Shigella flexneri 2a str. 301
gucgcuucacgcaggu

SEQ ID NO: 3911838 - RNA, 22 nt, Shigella flexneri 2a str. 301
gucgcuucgcgaaucgccacaa

SEQ ID NO: 3911839 - RNA, 20 nt, Shigella flexneri 2a str. 301
gucgcuugcaggaucagcuc

SEQ ID NO: 3911840 - RNA, 22 nt, Shigella flexneri 2a str. 301
gucgcuugugguacuaucagcg

SEQ ID NO: 3911841 - RNA, 19 nt, Shigella flexneri 2a str. 301
gugaacgcguuauccggcu

SEQ ID NO: 3911842 - RNA, 19 nt, Shigella flexneri 2a str. 301
gugaacguguaggccugau

SEQ ID NO: 3911843 - RNA, 18 nt, Shigella flexneri 2a str. 301
gugaagagauccaccagc

SEQ ID NO: 3911844 - RNA, 21 nt, Shigella flexneri 2a str. 301
gugaagaugccaacuggcaua

SEQ ID NO: 3911845 - RNA, 18 nt, Shigella flexneri 2a str. 301
gugaagcacguaaaucuu

SEQ ID NO: 3911846 - RNA, 15 nt, Shigella flexneri 2a str. 301
gugaagcagagcaga

SEQ ID NO: 3911847 - RNA, 22 nt, Shigella flexneri 2a str. 301
gugaaggcaaacuucucgccau

SEQ ID NO: 3911848 - RNA, 17 nt, Shigella flexneri 2a str. 301
gugaagguugucaucaa

SEQ ID NO: 3911849 - RNA, 23 nt, Shigella flexneri 2a str. 301
gugaagugagaauuuuucacucc

SEQ ID NO: 3911850 - RNA, 21 nt, Shigella flexneri 2a str. 301
gugaaguugccggauguguug

SEQ ID NO: 3911851 - RNA, 15 nt, Shigella flexneri 2a str. 301
gugaaucacuccauc

SEQ ID NO: 3911852 - RNA, 20 nt, Shigella flexneri 2a str. 301
gugaaucgggcgugauucca

SEQ ID NO: 3911853 - RNA, 13 nt, Shigella flexneri 2a str. 301
gugaaugccuuau

SEQ ID NO: 3911854 - RNA, 17 nt, Shigella flexneri 2a str. 301
gugaaugguggcgauga

SEQ ID NO: 3911855 - RNA, 12 nt, Shigella flexneri 2a str. 301
gugaauuacugc

SEQ ID NO: 3911856 - RNA, 13 nt, Shigella flexneri 2a str. 301
gugaauucacaau

SEQ ID NO: 3911857 - RNA, 17 nt, Shigella flexneri 2a str. 301
gugacaaucaccagguc

SEQ ID NO: 3911858 - RNA, 12 nt, Shigella flexneri 2a str. 301
gugacacaauca

SEQ ID NO: 3911859 - RNA, 16 nt, Shigella flexneri 2a str. 301
gugacaccaaccgcgg

SEQ ID NO: 3911860 - RNA, 18 nt, Shigella flexneri 2a str. 301
gugacacgcgcgcauggu

SEQ ID NO: 3911861 - RNA, 20 nt, Shigella flexneri 2a str. 301
gugacagauuugauuaucaa

SEQ ID NO: 3911862 - RNA, 12 nt, Shigella flexneri 2a str. 301
gugacagcagcg

SEQ ID NO: 3911863 - RNA, 13 nt, Shigella flexneri 2a str. 301
gugacagcgguga

SEQ ID NO: 3911864 - RNA, 23 nt, Shigella flexneri 2a str. 301
gugacaucgugcugguagaagcu

SEQ ID NO: 3911865 - RNA, 13 nt, Shigella flexneri 2a str. 301
gugacauuaacca

SEQ ID NO: 3911866 - RNA, 11 nt, Shigella flexneri 2a str. 301
gugacauucug

SEQ ID NO: 3911867 - RNA, 17 nt, Shigella flexneri 2a str. 301
gugaccaaaggcgaugc

SEQ ID NO: 3911868 - RNA, 13 nt, Shigella flexneri 2a str. 301
gugaccaucuucc

SEQ ID NO: 3911869 - RNA, 16 nt, Shigella flexneri 2a str. 301
gugacccgcagccagc

SEQ ID NO: 3911870 - RNA, 18 nt, Shigella flexneri 2a str. 301
gugacccgcagccagcac

SEQ ID NO: 3911871 - RNA, 22 nt, Shigella flexneri 2a str. 301
gugaccgaaccuguuuucaccg

SEQ ID NO: 3911872 - RNA, 15 nt, Shigella flexneri 2a str. 301
gugaccuguccugua

SEQ ID NO: 3911873 - RNA, 18 nt, Shigella flexneri 2a str. 301
gugacgaaacugcucaaa

SEQ ID NO: 3911874 - RNA, 16 nt, Shigella flexneri 2a str. 301
gugacgcaaccgcaaa

SEQ ID NO: 3911875 - RNA, 20 nt, Shigella flexneri 2a str. 301
gugacgcacaguacgcgccc

SEQ ID NO: 3911876 - RNA, 20 nt, Shigella flexneri 2a str. 301
gugacgccagaaaaccuggc

SEQ ID NO: 3911877 - RNA, 14 nt, Shigella flexneri 2a str. 301
gugacgcgggcagc

SEQ ID NO: 3911878 - RNA, 16 nt, Shigella flexneri 2a str. 301
gugacgcgggcagcag

SEQ ID NO: 3911879 - RNA, 19 nt, Shigella flexneri 2a str. 301
gugacguugucacguuauc

SEQ ID NO: 3911880 - RNA, 21 nt, Shigella flexneri 2a str. 301
gugacucaauggcauccgcca

SEQ ID NO: 3911881 - RNA, 11 nt, Shigella flexneri 2a str. 301
gugacugcugg

SEQ ID NO: 3911882 - RNA, 16 nt, Shigella flexneri 2a str. 301
gugacuggaaaucaaa

SEQ ID NO: 3911883 - RNA, 16 nt, Shigella flexneri 2a str. 301
gugacugggugccgcg

SEQ ID NO: 3911884 - RNA, 20 nt, Shigella flexneri 2a str. 301
gugacuucugccagcugcug

SEQ ID NO: 3911885 - RNA, 12 nt, Shigella flexneri 2a str. 301
gugagaacacca

SEQ ID NO: 3911886 - RNA, 13 nt, Shigella flexneri 2a str. 301
gugagaacugcug

SEQ ID NO: 3911887 - RNA, 16 nt, Shigella flexneri 2a str. 301
gugagagauaauaaaa

SEQ ID NO: 3911888 - RNA, 23 nt, Shigella flexneri 2a str. 301
gugagaucauuauuaaacagaca

SEQ ID NO: 3911889 - RNA, 20 nt, Shigella flexneri 2a str. 301
gugagauuaaucgcggcugg

SEQ ID NO: 3911890 - RNA, 14 nt, Shigella flexneri 2a str. 301
gugagcacaucugg

SEQ ID NO: 3911891 - RNA, 22 nt, Shigella flexneri 2a str. 301
gugagccaggacgauaaaccag

SEQ ID NO: 3911892 - RNA, 16 nt, Shigella flexneri 2a str. 301
gugagcgguuucgccu

SEQ ID NO: 3911893 - RNA, 12 nt, Shigella flexneri 2a str. 301
gugagcgugcgg

SEQ ID NO: 3911894 - RNA, 20 nt, Shigella flexneri 2a str. 301
gugagcguuuucucaaaaaa

SEQ ID NO: 3911895 - RNA, 17 nt, Shigella flexneri 2a str. 301
gugagcuacacgggcau

SEQ ID NO: 3911896 - RNA, 16 nt, Shigella flexneri 2a str. 301
gugagcugguaaccgc

SEQ ID NO: 3911897 - RNA, 15 nt, Shigella flexneri 2a str. 301
gugagggggcguuca

SEQ ID NO: 3911898 - RNA, 21 nt, Shigella flexneri 2a str. 301
gugaguaugauacguuuauua

SEQ ID NO: 3911899 - RNA, 22 nt, Shigella flexneri 2a str. 301
gugaguuccgcugcuggggcca

SEQ ID NO: 3911900 - RNA, 17 nt, Shigella flexneri 2a str. 301
gugaguugguuauucaa

SEQ ID NO: 3911901 - RNA, 14 nt, Shigella flexneri 2a str. 301
gugauaaaacgcag

SEQ ID NO: 3911902 - RNA, 22 nt, Shigella flexneri 2a str. 301
gugauaaaacgcagucuuccca

SEQ ID NO: 3911903 - RNA, 23 nt, Shigella flexneri 2a str. 301
gugauaaaacgcagucuucccag

SEQ ID NO: 3911904 - RNA, 17 nt, Shigella flexneri 2a str. 301
gugauacugaucgucau

SEQ ID NO: 3911905 - RNA, 13 nt, Shigella flexneri 2a str. 301
gugauacuucuuc

SEQ ID NO: 3911906 - RNA, 18 nt, Shigella flexneri 2a str. 301
gugauauuucgaauuuuc

SEQ ID NO: 3911907 - RNA, 20 nt, Shigella flexneri 2a str. 301
gugaucguggccaugaccgc

SEQ ID NO: 3911908 - RNA, 14 nt, Shigella flexneri 2a str. 301
gugaugccaucggg

SEQ ID NO: 3911909 - RNA, 22 nt, Shigella flexneri 2a str. 301
gugaugcggucgcugacgccau

SEQ ID NO: 3911910 - RNA, 20 nt, Shigella flexneri 2a str. 301
gugaugcguccgcuaguggc

SEQ ID NO: 3911911 - RNA, 15 nt, Shigella flexneri 2a str. 301
gugauggcuauuaga

SEQ ID NO: 3911912 - RNA, 17 nt, Shigella flexneri 2a str. 301
gugaugguaacgcgcca

SEQ ID NO: 3911913 - RNA, 12 nt, Shigella flexneri 2a str. 301
gugaugguggug

SEQ ID NO: 3911914 - RNA, 13 nt, Shigella flexneri 2a str. 301
gugaugguggugg

SEQ ID NO: 3911915 - RNA, 15 nt, Shigella flexneri 2a str. 301
gugauuaacgcgccg

SEQ ID NO: 3911916 - RNA, 16 nt, Shigella flexneri 2a str. 301
gugauuacacgcgaca

SEQ ID NO: 3911917 - RNA, 19 nt, Shigella flexneri 2a str. 301
gugauucauaguaagcaga

SEQ ID NO: 3911918 - RNA, 21 nt, Shigella flexneri 2a str. 301
gugauucauaguaagcagauu

SEQ ID NO: 3911919 - RNA, 16 nt, Shigella flexneri 2a str. 301
gugauugccggaaugg

SEQ ID NO: 3911920 - RNA, 23 nt, Shigella flexneri 2a str. 301
gugauuguggcaaucauauucac

SEQ ID NO: 3911921 - RNA, 23 nt, Shigella flexneri 2a str. 301
gugauuuccccuaacucuuucaa

SEQ ID NO: 3911922 - RNA, 22 nt, Shigella flexneri 2a str. 301
gugauuuccgccgccagcagac

SEQ ID NO: 3911923 - RNA, 13 nt, Shigella flexneri 2a str. 301
gugcaaaaucaaa

SEQ ID NO: 3911924 - RNA, 11 nt, Shigella flexneri 2a str. 301
gugcaaaugcc

SEQ ID NO: 3911925 - RNA, 17 nt, Shigella flexneri 2a str. 301
gugcaaaugccagauaa

SEQ ID NO: 3911926 - RNA, 23 nt, Shigella flexneri 2a str. 301
gugcaaaugccagauaagacacu

SEQ ID NO: 3911927 - RNA, 17 nt, Shigella flexneri 2a str. 301
gugcaagaaaugacaga

SEQ ID NO: 3911928 - RNA, 18 nt, Shigella flexneri 2a str. 301
gugcaagaaaugacagag

SEQ ID NO: 3911929 - RNA, 23 nt, Shigella flexneri 2a str. 301
gugcaagcauuagcauacugaaa

SEQ ID NO: 3911930 - RNA, 16 nt, Shigella flexneri 2a str. 301
gugcaaggaaauaaua

SEQ ID NO: 3911931 - RNA, 22 nt, Shigella flexneri 2a str. 301
gugcaauaccauggcucaccag

SEQ ID NO: 3911932 - RNA, 19 nt, Shigella flexneri 2a str. 301
gugcaaucaacaccacugc

SEQ ID NO: 3911933 - RNA, 20 nt, Shigella flexneri 2a str. 301
gugcacaacaaucugcaaau

SEQ ID NO: 3911934 - RNA, 22 nt, Shigella flexneri 2a str. 301
gugcacaauugccggaugcggc

SEQ ID NO: 3911935 - RNA, 20 nt, Shigella flexneri 2a str. 301
gugcaccagaaaguuuuuca

SEQ ID NO: 3911936 - RNA, 16 nt, Shigella flexneri 2a str. 301
gugcacgaaccagaga

SEQ ID NO: 3911937 - RNA, 22 nt, Shigella flexneri 2a str. 301
gugcacgauugccggaugcggc

SEQ ID NO: 3911938 - RNA, 16 nt, Shigella flexneri 2a str. 301
gugcacgcgcuucagu

SEQ ID NO: 3911939 - RNA, 15 nt, Shigella flexneri 2a str. 301
gugcacuuacaaggu

SEQ ID NO: 3911940 - RNA, 19 nt, Shigella flexneri 2a str. 301
gugcagaaucaaucucagc

SEQ ID NO: 3911941 - RNA, 21 nt, Shigella flexneri 2a str. 301
guggcgauaaucagcgccagc

SEQ ID NO: 3911942 - RNA, 21 nt, Shigella flexneri 2a str. 301
guggcgauguaauucagccau

SEQ ID NO: 3911943 - RNA, 20 nt, Shigella flexneri 2a str. 301
guggcgauucauaugcgcca

SEQ ID NO: 3911944 - RNA, 17 nt, Shigella flexneri 2a str. 301
guggcgcagccgucauu

SEQ ID NO: 3911945 - RNA, 21 nt, Shigella flexneri 2a str. 301
guggcgcgaagcccucaaaca

SEQ ID NO: 3911946 - RNA, 16 nt, Shigella flexneri 2a str. 301
guggcgcuccacuuca

SEQ ID NO: 3911947 - RNA, 13 nt, Shigella flexneri 2a str. 301
guggcggaauugg

SEQ ID NO: 3911948 - RNA, 15 nt, Shigella flexneri 2a str. 301
guggcggaauuggua

SEQ ID NO: 3911949 - RNA, 22 nt, Shigella flexneri 2a str. 301
guggcggaauugguagacgcgc

SEQ ID NO: 3911950 - RNA, 18 nt, Shigella flexneri 2a str. 301
guggcgguaacauccaga

SEQ ID NO: 3911951 - RNA, 14 nt, Shigella flexneri 2a str. 301
guggcgugaacgcc

SEQ ID NO: 3911952 - RNA, 14 nt, Shigella flexneri 2a str. 301
guggcguggcgcuc

SEQ ID NO: 3911953 - RNA, 15 nt, Shigella flexneri 2a str. 301
guggcguuuccagca

SEQ ID NO: 3911954 - RNA, 15 nt, Shigella flexneri 2a str. 301
guggcucagacucuc

SEQ ID NO: 3911955 - RNA, 15 nt, Shigella flexneri 2a str. 301
guggcugcguuucau

SEQ ID NO: 3911956 - RNA, 11 nt, Shigella flexneri 2a str. 301
guggcuggggu

SEQ ID NO: 3911957 - RNA, 18 nt, Shigella flexneri 2a str. 301
guggcugggguacgagga

SEQ ID NO: 3911958 - RNA, 23 nt, Shigella flexneri 2a str. 301
guggcuuuuuuauugcuucacca

SEQ ID NO: 3911959 - RNA, 18 nt, Shigella flexneri 2a str. 301
gugggaauaaccauggca

SEQ ID NO: 3911960 - RNA, 16 nt, Shigella flexneri 2a str. 301
gugggaccaccgcgcu

SEQ ID NO: 3911961 - RNA, 18 nt, Shigella flexneri 2a str. 301
gugggaucacaucuucaa

SEQ ID NO: 3911962 - RNA, 23 nt, Shigella flexneri 2a str. 301
gugggauucaccaaucggcagaa

SEQ ID NO: 3911963 - RNA, 16 nt, Shigella flexneri 2a str. 301
gugggauuccagcgcc

SEQ ID NO: 3911964 - RNA, 18 nt, Shigella flexneri 2a str. 301
gugggauuccagcgccgc

SEQ ID NO: 3911965 - RNA, 19 nt, Shigella flexneri 2a str. 301
gugggcuaacacccgucgu

SEQ ID NO: 3911966 - RNA, 16 nt, Shigella flexneri 2a str. 301
guggguaaugcuguga

SEQ ID NO: 3911967 - RNA, 16 nt, Shigella flexneri 2a str. 301
guggguaggaucaguu

SEQ ID NO: 3911968 - RNA, 19 nt, Shigella flexneri 2a str. 301
guggguauauuucaggcca

SEQ ID NO: 3911969 - RNA, 22 nt, Shigella flexneri 2a str. 301
gugggucgauuaaauucaccag

SEQ ID NO: 3911970 - RNA, 15 nt, Shigella flexneri 2a str. 301
guggguggucagcgu

SEQ ID NO: 3911971 - RNA, 19 nt, Shigella flexneri 2a str. 301
gugguccacauccguccuc

SEQ ID NO: 3911972 - RNA, 20 nt, Shigella flexneri 2a str. 301
guggugcuggacucccagaa

SEQ ID NO: 3911973 - RNA, 20 nt, Shigella flexneri 2a str. 301
gugguguuuuuuuaaucuuu

SEQ ID NO: 3911974 - RNA, 15 nt, Shigella flexneri 2a str. 301
gugguugccggucug

SEQ ID NO: 3911975 - RNA, 14 nt, Shigella flexneri 2a str. 301
guguaaaacagcac

SEQ ID NO: 3911976 - RNA, 21 nt, Shigella flexneri 2a str. 301
guguaacgcguacccagcagc

SEQ ID NO: 3911977 - RNA, 13 nt, Shigella flexneri 2a str. 301
guguaacgcuugc

SEQ ID NO: 3911978 - RNA, 18 nt, Shigella flexneri 2a str. 301
guguaaugccagucaguu

SEQ ID NO: 3911979 - RNA, 18 nt, Shigella flexneri 2a str. 301
guguacuuaucuuuuaca

SEQ ID NO: 3911980 - RNA, 20 nt, Shigella flexneri 2a str. 301
guguagcacuugcagcuccu

SEQ ID NO: 3911981 - RNA, 19 nt, Shigella flexneri 2a str. 301
guguagcucgccuucaggu

SEQ ID NO: 3911982 - RNA, 12 nt, Shigella flexneri 2a str. 301
guguagggcagg

SEQ ID NO: 3911983 - RNA, 17 nt, Shigella flexneri 2a str. 301
guguauggcauugucug

SEQ ID NO: 3911984 - RNA, 13 nt, Shigella flexneri 2a str. 301
gugucccacuggu

SEQ ID NO: 3911985 - RNA, 17 nt, Shigella flexneri 2a str. 301
guguccguuuguggugc

SEQ ID NO: 3911986 - RNA, 14 nt, Shigella flexneri 2a str. 301
guguccuguugaug

SEQ ID NO: 3911987 - RNA, 15 nt, Shigella flexneri 2a str. 301
gugucuuaucaggcc

SEQ ID NO: 3911988 - RNA, 22 nt, Shigella flexneri 2a str. 301
gugucuuaucuggcauuugcac

SEQ ID NO: 3911989 - RNA, 13 nt, Shigella flexneri 2a str. 301
gugugaaaccuuu

SEQ ID NO: 3911990 - RNA, 17 nt, Shigella flexneri 2a str. 301
gugugcaaucacuuccu

SEQ ID NO: 3911991 - RNA, 15 nt, Shigella flexneri 2a str. 301
gugugccaccagcgc

SEQ ID NO: 3911992 - RNA, 17 nt, Shigella flexneri 2a str. 301
gugugcuacggucugcc

SEQ ID NO: 3911993 - RNA, 12 nt, Shigella flexneri 2a str. 301
gugugcuccagu

SEQ ID NO: 3911994 - RNA, 16 nt, Shigella flexneri 2a str. 301
guguggagugcagcau

SEQ ID NO: 3911995 - RNA, 17 nt, Shigella flexneri 2a str. 301
guguggcaucguccguc

SEQ ID NO: 3911996 - RNA, 13 nt, Shigella flexneri 2a str. 301
guguggcgcgcca

SEQ ID NO: 3911997 - RNA, 16 nt, Shigella flexneri 2a str. 301
guguggcugcacaccu

SEQ ID NO: 3911998 - RNA, 13 nt, Shigella flexneri 2a str. 301
gugugugcugauu

SEQ ID NO: 3911999 - RNA, 22 nt, Shigella flexneri 2a str. 301
guguguuugaucacuuccagca

SEQ ID NO: 3912000 - RNA, 19 nt, Shigella flexneri 2a str. 301
guguuaaaugauaccgggc

SEQ ID NO: 3912001 - RNA, 24 nt, Shigella flexneri 2a str. 301
guguuagcccugucgaggccaauu

SEQ ID NO: 3912002 - RNA, 15 nt, Shigella flexneri 2a str. 301
guguuaucaaaucac

SEQ ID NO: 3912003 - RNA, 11 nt, Shigella flexneri 2a str. 301
guguuauucag

SEQ ID NO: 3912004 - RNA, 14 nt, Shigella flexneri 2a str. 301
guguuccagagaac

SEQ ID NO: 3912005 - RNA, 13 nt, Shigella flexneri 2a str. 301
guguuccucugcc

SEQ ID NO: 3912006 - RNA, 14 nt, Shigella flexneri 2a str. 301
guguuccucugcuc

SEQ ID NO: 3912007 - RNA, 18 nt, Shigella flexneri 2a str. 301
guguucgucacuggcgca

SEQ ID NO: 3912008 - RNA, 22 nt, Shigella flexneri 2a str. 301
guguucgucacuggcgcagaca

SEQ ID NO: 3912009 - RNA, 24 nt, Shigella flexneri 2a str. 301
guguucguuguaucaacagcgguu

SEQ ID NO: 3912010 - RNA, 15 nt, Shigella flexneri 2a str. 301
guguugcaggaaaag

SEQ ID NO: 3912011 - RNA, 21 nt, Shigella flexneri 2a str. 301
guguugcaggaaaagguaggc

SEQ ID NO: 3912012 - RNA, 22 nt, Shigella flexneri 2a str. 301
guguugccgccaccuuucuguu

SEQ ID NO: 3912013 - RNA, 17 nt, Shigella flexneri 2a str. 301
guguugcguuuaaacca

SEQ ID NO: 3912014 - RNA, 17 nt, Shigella flexneri 2a str. 301
guguugcuccccagaau

SEQ ID NO: 3912015 - RNA, 23 nt, Shigella flexneri 2a str. 301
guguugcugaacuuaugcaaaau

SEQ ID NO: 3912016 - RNA, 16 nt, Shigella flexneri 2a str. 301
guguuggcaaucagcg

SEQ ID NO: 3912017 - RNA, 15 nt, Shigella flexneri 2a str. 301
guguuggcgucagac

SEQ ID NO: 3912018 - RNA, 14 nt, Shigella flexneri 2a str. 301
guguugguaaauaa

SEQ ID NO: 3912019 - RNA, 19 nt, Shigella flexneri 2a str. 301
guguuucgacaauaaucaa

SEQ ID NO: 3912020 - RNA, 23 nt, Shigella flexneri 2a str. 301
guguuuuccaccgugauccgccg

SEQ ID NO: 3912021 - RNA, 17 nt, Shigella flexneri 2a str. 301
guuaaaaacauuuucau

SEQ ID NO: 3912022 - RNA, 21 nt, Shigella flexneri 2a str. 301
guuaaaauucaagacaucaau

SEQ ID NO: 3912023 - RNA, 16 nt, Shigella flexneri 2a str. 301
guuaaacccgcucaaa

SEQ ID NO: 3912024 - RNA, 18 nt, Shigella flexneri 2a str. 301
guuaaacccgcucaaaca

SEQ ID NO: 3912025 - RNA, 14 nt, Shigella flexneri 2a str. 301
guuaaaccgccagu

SEQ ID NO: 3912026 - RNA, 19 nt, Shigella flexneri 2a str. 301
guuaaacuuucauaaacac

SEQ ID NO: 3912027 - RNA, 22 nt, Shigella flexneri 2a str. 301
guuaaaguugagcgaaaacgaa

SEQ ID NO: 3912028 - RNA, 19 nt, Shigella flexneri 2a str. 301
guuaaauuccguugcuguu

SEQ ID NO: 3912029 - RNA, 14 nt, Shigella flexneri 2a str. 301
guuaacaaucacaa

SEQ ID NO: 3912030 - RNA, 18 nt, Shigella flexneri 2a str. 301
guuaacaccaguaaauaa

SEQ ID NO: 3912031 - RNA, 14 nt, Shigella flexneri 2a str. 301
guuaaccagcacca

SEQ ID NO: 3912032 - RNA, 18 nt, Shigella flexneri 2a str. 301
guuaaccccaguaauuca

SEQ ID NO: 3912033 - RNA, 20 nt, Shigella flexneri 2a str. 301
guuaacgccuuauccggccu

SEQ ID NO: 3912034 - RNA, 16 nt, Shigella flexneri 2a str. 301
guuaacgcgucuuuga

SEQ ID NO: 3912035 - RNA, 17 nt, Shigella flexneri 2a str. 301
guuaacguuuuucgcug

SEQ ID NO: 3912036 - RNA, 15 nt, Shigella flexneri 2a str. 301
guuaacucccccuuu

SEQ ID NO: 3912037 - RNA, 19 nt, Shigella flexneri 2a str. 301
guuaacugaauauuccagu

SEQ ID NO: 3912038 - RNA, 21 nt, Shigella flexneri 2a str. 301
guuaacugaauauuccaguua

SEQ ID NO: 3912039 - RNA, 15 nt, Shigella flexneri 2a str. 301
guuaagaaaacggaa

SEQ ID NO: 3912040 - RNA, 12 nt, Shigella flexneri 2a str. 301
guuaagaagauc

SEQ ID NO: 3912041 - RNA, 20 nt, Shigella flexneri 2a str. 301
guuccagggccuccugcagc

SEQ ID NO: 3912042 - RNA, 19 nt, Shigella flexneri 2a str. 301
guuccagugcguacccagc

SEQ ID NO: 3912043 - RNA, 21 nt, Shigella flexneri 2a str. 301
guuccagugcguacccagcgu

SEQ ID NO: 3912044 - RNA, 14 nt, Shigella flexneri 2a str. 301
guuccauaaucgcc

SEQ ID NO: 3912045 - RNA, 17 nt, Shigella flexneri 2a str. 301
guuccauaaucgccuga

SEQ ID NO: 3912046 - RNA, 22 nt, Shigella flexneri 2a str. 301
guuccauaaucgccugaccgau

SEQ ID NO: 3912047 - RNA, 22 nt, Shigella flexneri 2a str. 301
guuccauaccgucgccagacgc

SEQ ID NO: 3912048 - RNA, 15 nt, Shigella flexneri 2a str. 301
guuccaucaccagau

SEQ ID NO: 3912049 - RNA, 18 nt, Shigella flexneri 2a str. 301
guuccaucagauucagca

SEQ ID NO: 3912050 - RNA, 21 nt, Shigella flexneri 2a str. 301
guuccaucuuuaugaaauauc

SEQ ID NO: 3912051 - RNA, 13 nt, Shigella flexneri 2a str. 301
guuccauucaaac

SEQ ID NO: 3912052 - RNA, 14 nt, Shigella flexneri 2a str. 301
guuccauucaaacg

SEQ ID NO: 3912053 - RNA, 23 nt, Shigella flexneri 2a str. 301
guuccauugggcuguuaucccag

SEQ ID NO: 3912054 - RNA, 14 nt, Shigella flexneri 2a str. 301
guuccccagaagcu

SEQ ID NO: 3912055 - RNA, 20 nt, Shigella flexneri 2a str. 301
guuccccccacaaucagcca

SEQ ID NO: 3912056 - RNA, 13 nt, Shigella flexneri 2a str. 301
guuccccucaccc

SEQ ID NO: 3912057 - RNA, 13 nt, Shigella flexneri 2a str. 301
guuccgauaaguu

SEQ ID NO: 3912058 - RNA, 22 nt, Shigella flexneri 2a str. 301
guuccgccagagcuucaaccgu

SEQ ID NO: 3912059 - RNA, 22 nt, Shigella flexneri 2a str. 301
guuccgccauuuuaaucaucug

SEQ ID NO: 3912060 - RNA, 16 nt, Shigella flexneri 2a str. 301
guuccgcgacuaucga

SEQ ID NO: 3912061 - RNA, 13 nt, Shigella flexneri 2a str. 301
guuccgcugcuga

SEQ ID NO: 3912062 - RNA, 22 nt, Shigella flexneri 2a str. 301
guuccggcaacgacgucgauuu

SEQ ID NO: 3912063 - RNA, 21 nt, Shigella flexneri 2a str. 301
guuccggcaugauucauccgu

SEQ ID NO: 3912064 - RNA, 16 nt, Shigella flexneri 2a str. 301
guuccgggaucaccag

SEQ ID NO: 3912065 - RNA, 16 nt, Shigella flexneri 2a str. 301
guuccuaacaugccac

SEQ ID NO: 3912066 - RNA, 15 nt, Shigella flexneri 2a str. 301
guuccugcaacuucu

SEQ ID NO: 3912067 - RNA, 17 nt, Shigella flexneri 2a str. 301
guuccuugcgcuuucuu

SEQ ID NO: 3912068 - RNA, 15 nt, Shigella flexneri 2a str. 301
guucgagaaaaccga

SEQ ID NO: 3912069 - RNA, 18 nt, Shigella flexneri 2a str. 301
guucgagcaucacaucaa

SEQ ID NO: 3912070 - RNA, 21 nt, Shigella flexneri 2a str. 301
guucgauauccaguccgcgcu

SEQ ID NO: 3912071 - RNA, 16 nt, Shigella flexneri 2a str. 301
guucgauggcgcgcca

SEQ ID NO: 3912072 - RNA, 17 nt, Shigella flexneri 2a str. 301
guucgcaccaaauccaa

SEQ ID NO: 3912073 - RNA, 19 nt, Shigella flexneri 2a str. 301
guucgccccaaaaaagcga

SEQ ID NO: 3912074 - RNA, 19 nt, Shigella flexneri 2a str. 301
guucgcguaacugcugcuc

SEQ ID NO: 3912075 - RNA, 20 nt, Shigella flexneri 2a str. 301
guucgcguaacugcugcuca

SEQ ID NO: 3912076 - RNA, 14 nt, Shigella flexneri 2a str. 301
guucggaguggcag

SEQ ID NO: 3912077 - RNA, 20 nt, Shigella flexneri 2a str. 301
guucggggcuguuuuccagc

SEQ ID NO: 3912078 - RNA, 21 nt, Shigella flexneri 2a str. 301
guucguaagcgauaaccgcac

SEQ ID NO: 3912079 - RNA, 16 nt, Shigella flexneri 2a str. 301
guucgucauacuccag

SEQ ID NO: 3912080 - RNA, 18 nt, Shigella flexneri 2a str. 301
guucguguuaacagcaac

SEQ ID NO: 3912081 - RNA, 22 nt, Shigella flexneri 2a str. 301
guucguuauugggguuacgacc

SEQ ID NO: 3912082 - RNA, 22 nt, Shigella flexneri 2a str. 301
guucguugauaauaaagcuaca

SEQ ID NO: 3912083 - RNA, 17 nt, Shigella flexneri 2a str. 301
guucguugaucacuuuc

SEQ ID NO: 3912084 - RNA, 21 nt, Shigella flexneri 2a str. 301
guucguugaucacuuucaccg

SEQ ID NO: 3912085 - RNA, 16 nt, Shigella flexneri 2a str. 301
guucuacaaucugccc

SEQ ID NO: 3912086 - RNA, 15 nt, Shigella flexneri 2a str. 301
guucuaccgcagggg

SEQ ID NO: 3912087 - RNA, 14 nt, Shigella flexneri 2a str. 301
guucuacgugcgcu

SEQ ID NO: 3912088 - RNA, 14 nt, Shigella flexneri 2a str. 301
guucucaauuacug

SEQ ID NO: 3912089 - RNA, 23 nt, Shigella flexneri 2a str. 301
guucuccuggcccggaauggugc

SEQ ID NO: 3912090 - RNA, 14 nt, Shigella flexneri 2a str. 301
guucucucagucuu

SEQ ID NO: 3912091 - RNA, 14 nt, Shigella flexneri 2a str. 301
guucucuucugcuu

SEQ ID NO: 3912092 - RNA, 16 nt, Shigella flexneri 2a str. 301
guucugaaucacgccg

SEQ ID NO: 3912093 - RNA, 15 nt, Shigella flexneri 2a str. 301
guucugaccggccag

SEQ ID NO: 3912094 - RNA, 16 nt, Shigella flexneri 2a str. 301
guucugaucuuucuuc

SEQ ID NO: 3912095 - RNA, 17 nt, Shigella flexneri 2a str. 301
guucugcccugaauggu

SEQ ID NO: 3912096 - RNA, 20 nt, Shigella flexneri 2a str. 301
guucugccgcgcacgucagc

SEQ ID NO: 3912097 - RNA, 16 nt, Shigella flexneri 2a str. 301
guucugccuggcgcag

SEQ ID NO: 3912098 - RNA, 21 nt, Shigella flexneri 2a str. 301
guucugccuggcgcagcaaag

SEQ ID NO: 3912099 - RNA, 18 nt, Shigella flexneri 2a str. 301
guucugcgacgcgcggug

SEQ ID NO: 3912100 - RNA, 22 nt, Shigella flexneri 2a str. 301
guucugcguuaagacuuuuuuc

SEQ ID NO: 3912101 - RNA, 17 nt, Shigella flexneri 2a str. 301
guucuggcaccggacgc

SEQ ID NO: 3912102 - RNA, 17 nt, Shigella flexneri 2a str. 301
guucuggccguacccag

SEQ ID NO: 3912103 - RNA, 19 nt, Shigella flexneri 2a str. 301
guucugguaaaccuuccac

SEQ ID NO: 3912104 - RNA, 20 nt, Shigella flexneri 2a str. 301
guucugucgauaaacucaug

SEQ ID NO: 3912105 - RNA, 14 nt, Shigella flexneri 2a str. 301
guucugucgcucug

SEQ ID NO: 3912106 - RNA, 21 nt, Shigella flexneri 2a str. 301
guucuguggcagggcagcgau

SEQ ID NO: 3912107 - RNA, 15 nt, Shigella flexneri 2a str. 301
guucuguugcugaaa

SEQ ID NO: 3912108 - RNA, 11 nt, Shigella flexneri 2a str. 301
guucuucccuc

SEQ ID NO: 3912109 - RNA, 22 nt, Shigella flexneri 2a str. 301
guucuucuuuauugauuaaagg

SEQ ID NO: 3912110 - RNA, 19 nt, Shigella flexneri 2a str. 301
guucuuuguguugcugaac

SEQ ID NO: 3912111 - RNA, 13 nt, Shigella flexneri 2a str. 301
guucuuuuuuuaa

SEQ ID NO: 3912112 - RNA, 13 nt, Shigella flexneri 2a str. 301
guugaaaaaccag

SEQ ID NO: 3912113 - RNA, 14 nt, Shigella flexneri 2a str. 301
guugaaaaaccaga

SEQ ID NO: 3912114 - RNA, 16 nt, Shigella flexneri 2a str. 301
guugaagcguucuucu

SEQ ID NO: 3912115 - RNA, 17 nt, Shigella flexneri 2a str. 301
guugaagcguucuucug

SEQ ID NO: 3912116 - RNA, 23 nt, Shigella flexneri 2a str. 301
guugaagucagggucuuccagca

SEQ ID NO: 3912117 - RNA, 17 nt, Shigella flexneri 2a str. 301
guugaaucuucaugcgu

SEQ ID NO: 3912118 - RNA, 18 nt, Shigella flexneri 2a str. 301
guugaauuccgaauuuca

SEQ ID NO: 3912119 - RNA, 13 nt, Shigella flexneri 2a str. 301
guugacaaagugc

SEQ ID NO: 3912120 - RNA, 17 nt, Shigella flexneri 2a str. 301
guugacaaagugcgcgu

SEQ ID NO: 3912121 - RNA, 13 nt, Shigella flexneri 2a str. 301
guugaccgcccgg

SEQ ID NO: 3912122 - RNA, 19 nt, Shigella flexneri 2a str. 301
guugagagguaaaaccuga

SEQ ID NO: 3912123 - RNA, 21 nt, Shigella flexneri 2a str. 301
guugagagguaaaaccugaca

SEQ ID NO: 3912124 - RNA, 22 nt, Shigella flexneri 2a str. 301
guugagccucgguuguguggug

SEQ ID NO: 3912125 - RNA, 18 nt, Shigella flexneri 2a str. 301
guugaggaacucaaacca

SEQ ID NO: 3912126 - RNA, 14 nt, Shigella flexneri 2a str. 301
guugaggaucacaa

SEQ ID NO: 3912127 - RNA, 21 nt, Shigella flexneri 2a str. 301
guugaggauggcgucgauaau

SEQ ID NO: 3912128 - RNA, 19 nt, Shigella flexneri 2a str. 301
guugaguucgucgaguuua

SEQ ID NO: 3912129 - RNA, 16 nt, Shigella flexneri 2a str. 301
guugauacaggaacag

SEQ ID NO: 3912130 - RNA, 14 nt, Shigella flexneri 2a str. 301
guugaucauaaaaa

SEQ ID NO: 3912131 - RNA, 15 nt, Shigella flexneri 2a str. 301
guugaucauaaaaau

SEQ ID NO: 3912132 - RNA, 21 nt, Shigella flexneri 2a str. 301
guugaucauaaaaauuaaauc

SEQ ID NO: 3912133 - RNA, 12 nt, Shigella flexneri 2a str. 301
guugauccagga

SEQ ID NO: 3912134 - RNA, 14 nt, Shigella flexneri 2a str. 301
guugauccaggagc

SEQ ID NO: 3912135 - RNA, 12 nt, Shigella flexneri 2a str. 301
guugaucgccac

SEQ ID NO: 3912136 - RNA, 14 nt, Shigella flexneri 2a str. 301
guugaucuguaacg

SEQ ID NO: 3912137 - RNA, 19 nt, Shigella flexneri 2a str. 301
guugaucuucucgucaauc

SEQ ID NO: 3912138 - RNA, 13 nt, Shigella flexneri 2a str. 301
guugaugagcgcc

SEQ ID NO: 3912139 - RNA, 16 nt, Shigella flexneri 2a str. 301
guugauuuuauaauca

SEQ ID NO: 3912140 - RNA, 19 nt, Shigella flexneri 2a str. 301
guugauuuuucguuuuaau

SEQ ID NO: 3912141 - RNA, 17 nt, Shigella flexneri 2a str. 301
guuuucacccuuucguu

SEQ ID NO: 3912142 - RNA, 18 nt, Shigella flexneri 2a str. 301
guuuucagaccagacugc

SEQ ID NO: 3912143 - RNA, 21 nt, Shigella flexneri 2a str. 301
guuuucagcucgcgcaauuua

SEQ ID NO: 3912144 - RNA, 18 nt, Shigella flexneri 2a str. 301
guuuucaguugcucugca

SEQ ID NO: 3912145 - RNA, 21 nt, Shigella flexneri 2a str. 301
guuuuccggcacgcaggaucu

SEQ ID NO: 3912146 - RNA, 12 nt, Shigella flexneri 2a str. 301
guuuuccuucag

SEQ ID NO: 3912147 - RNA, 13 nt, Shigella flexneri 2a str. 301
guuuuccuucagg

SEQ ID NO: 3912148 - RNA, 17 nt, Shigella flexneri 2a str. 301
guuuucgauuuuuucca

SEQ ID NO: 3912149 - RNA, 20 nt, Shigella flexneri 2a str. 301
guuuucgauuuuuuccagcg

SEQ ID NO: 3912150 - RNA, 14 nt, Shigella flexneri 2a str. 301
guuuucgccacauc

SEQ ID NO: 3912151 - RNA, 19 nt, Shigella flexneri 2a str. 301
guuuucgccggaaccugau

SEQ ID NO: 3912152 - RNA, 17 nt, Shigella flexneri 2a str. 301
guuuucgcgcgcaguua

SEQ ID NO: 3912153 - RNA, 16 nt, Shigella flexneri 2a str. 301
guuuucgcugccacac

SEQ ID NO: 3912154 - RNA, 17 nt, Shigella flexneri 2a str. 301
guuuucuaacucauuuu

SEQ ID NO: 3912155 - RNA, 20 nt, Shigella flexneri 2a str. 301
guuuucuacuuuguaaacga

SEQ ID NO: 3912156 - RNA, 14 nt, Shigella flexneri 2a str. 301
guuuucucaucgcu

SEQ ID NO: 3912157 - RNA, 11 nt, Shigella flexneri 2a str. 301
guuuucucucu

SEQ ID NO: 3912158 - RNA, 15 nt, Shigella flexneri 2a str. 301
guuuucuggcugaca

SEQ ID NO: 3912159 - RNA, 18 nt, Shigella flexneri 2a str. 301
guuuugcauggcaacuaa

SEQ ID NO: 3912160 - RNA, 20 nt, Shigella flexneri 2a str. 301
guuuugcccacucaacgguu

SEQ ID NO: 3912161 - RNA, 17 nt, Shigella flexneri 2a str. 301
guuuugcggcgugaccu

SEQ ID NO: 3912162 - RNA, 19 nt, Shigella flexneri 2a str. 301
guuuugcuauccaguacau

SEQ ID NO: 3912163 - RNA, 20 nt, Shigella flexneri 2a str. 301
guuuuggccgugaauuacug

SEQ ID NO: 3912164 - RNA, 19 nt, Shigella flexneri 2a str. 301
guuuuggugaagugagaau

SEQ ID NO: 3912165 - RNA, 22 nt, Shigella flexneri 2a str. 301
guuuugguuaacugaauauucc

SEQ ID NO: 3912166 - RNA, 21 nt, Shigella flexneri 2a str. 301
guuuuguagaucuccauacuu

SEQ ID NO: 3912167 - RNA, 13 nt, Shigella flexneri 2a str. 301
guuuugucaucuu

SEQ ID NO: 3912168 - RNA, 22 nt, Shigella flexneri 2a str. 301
guuuuguugcccagcgcaucag

SEQ ID NO: 3912169 - RNA, 15 nt, Shigella flexneri 2a str. 301
guuuuuacagauuuc

SEQ ID NO: 3912170 - RNA, 15 nt, Shigella flexneri 2a str. 301
guuuuuauuuugccc

SEQ ID NO: 3912171 - RNA, 19 nt, Shigella flexneri 2a str. 301
guuuuucaguagacucaag

SEQ ID NO: 3912172 - RNA, 22 nt, Shigella flexneri 2a str. 301
guuuuucaguagacucaagcag

SEQ ID NO: 3912173 - RNA, 16 nt, Shigella flexneri 2a str. 301
guuuuuccaaaacugg

SEQ ID NO: 3912174 - RNA, 16 nt, Shigella flexneri 2a str. 301
guuuuuccccugccag

SEQ ID NO: 3912175 - RNA, 12 nt, Shigella flexneri 2a str. 301
guuuuucuuuuu

SEQ ID NO: 3912176 - RNA, 15 nt, Shigella flexneri 2a str. 301
guuuuucuuuuucaa

SEQ ID NO: 3912177 - RNA, 16 nt, Shigella flexneri 2a str. 301
guuuuugcuguuguuc

SEQ ID NO: 3912178 - RNA, 12 nt, Shigella flexneri 2a str. 301
guuuuuucaacc

SEQ ID NO: 3912179 - RNA, 22 nt, Shigella flexneri 2a str. 301
guuuuuucugccucugccagac

SEQ ID NO: 3912180 - RNA, 20 nt, Shigella flexneri 2a str. 301
guuuuuuuauaucucagaua

SEQ ID NO: 3912181 - RNA, 21 nt, Shigella flexneri 2a str. 301
uaaaaaaaacgccagcaacac

SEQ ID NO: 3912182 - RNA, 20 nt, Shigella flexneri 2a str. 301
uaaaaaaacaucauaauaau

SEQ ID NO: 3912183 - RNA, 17 nt, Shigella flexneri 2a str. 301
uaaaaaagaaggaaaau

SEQ ID NO: 3912184 - RNA, 18 nt, Shigella flexneri 2a str. 301
uaaaaaagaaggaaaaua

SEQ ID NO: 3912185 - RNA, 19 nt, Shigella flexneri 2a str. 301
uaaaaaagaaggaaaauac

SEQ ID NO: 3912186 - RNA, 21 nt, Shigella flexneri 2a str. 301
uaaaaaagaaggaaaauacag

SEQ ID NO: 3912187 - RNA, 22 nt, Shigella flexneri 2a str. 301
uaaaaaaguaaugccugcacuu

SEQ ID NO: 3912188 - RNA, 17 nt, Shigella flexneri 2a str. 301
uaaaaaauuaacaaaac

SEQ ID NO: 3912189 - RNA, 19 nt, Shigella flexneri 2a str. 301
uaaaaaauuaacaaaacaa

SEQ ID NO: 3912190 - RNA, 12 nt, Shigella flexneri 2a str. 301
uaaaaaauuuau

SEQ ID NO: 3912191 - RNA, 15 nt, Shigella flexneri 2a str. 301
uaaaaacagcaucaa

SEQ ID NO: 3912192 - RNA, 15 nt, Shigella flexneri 2a str. 301
uaaaaacagccagca

SEQ ID NO: 3912193 - RNA, 23 nt, Shigella flexneri 2a str. 301
uaaaaacaguaccagaccaacau

SEQ ID NO: 3912194 - RNA, 14 nt, Shigella flexneri 2a str. 301
uaaaaacaucauga

SEQ ID NO: 3912195 - RNA, 11 nt, Shigella flexneri 2a str. 301
uaaaaaccaga

SEQ ID NO: 3912196 - RNA, 21 nt, Shigella flexneri 2a str. 301
uaaaaaccagagaauauuaac

SEQ ID NO: 3912197 - RNA, 13 nt, Shigella flexneri 2a str. 301
uaaaaagauaaac

SEQ ID NO: 3912198 - RNA, 19 nt, Shigella flexneri 2a str. 301
uaaaaagguccuguaauga

SEQ ID NO: 3912199 - RNA, 19 nt, Shigella flexneri 2a str. 301
uaaaaaguaagaauugaua

SEQ ID NO: 3912200 - RNA, 20 nt, Shigella flexneri 2a str. 301
uaaaaaguaagaauugauaa

SEQ ID NO: 3912201 - RNA, 22 nt, Shigella flexneri 2a str. 301
uaaaaaguugcagcgucaucaa

SEQ ID NO: 3912202 - RNA, 17 nt, Shigella flexneri 2a str. 301
uaaaaauccuguuccau

SEQ ID NO: 3912203 - RNA, 14 nt, Shigella flexneri 2a str. 301
uaaaaaugaagccu

SEQ ID NO: 3912204 - RNA, 22 nt, Shigella flexneri 2a str. 301
uaaaaaugaagccuaccgggau

SEQ ID NO: 3912205 - RNA, 22 nt, Shigella flexneri 2a str. 301
uaaaaauugaaucacgacaaac

SEQ ID NO: 3912206 - RNA, 22 nt, Shigella flexneri 2a str. 301
uaaaacaacggaacgaaaaaaa

SEQ ID NO: 3912207 - RNA, 23 nt, Shigella flexneri 2a str. 301
uaaaacaacggaacgaaaaaaau

SEQ ID NO: 3912208 - RNA, 21 nt, Shigella flexneri 2a str. 301
uaaaacagacgagggaaaaua

SEQ ID NO: 3912209 - RNA, 20 nt, Shigella flexneri 2a str. 301
uaaaacaggcagcugccaga

SEQ ID NO: 3912210 - RNA, 22 nt, Shigella flexneri 2a str. 301
uaaaaccaacaguaucugaauc

SEQ ID NO: 3912211 - RNA, 13 nt, Shigella flexneri 2a str. 301
uaaaaccaguaau

SEQ ID NO: 3912212 - RNA, 16 nt, Shigella flexneri 2a str. 301
uaaaaccaucguacag

SEQ ID NO: 3912213 - RNA, 19 nt, Shigella flexneri 2a str. 301
uaaaacccuugugcucaau

SEQ ID NO: 3912214 - RNA, 15 nt, Shigella flexneri 2a str. 301
uaaaaccgacuuaaa

SEQ ID NO: 3912215 - RNA, 13 nt, Shigella flexneri 2a str. 301
uaaaaccugacaa

SEQ ID NO: 3912216 - RNA, 16 nt, Shigella flexneri 2a str. 301
uaaaaccugacaacaa

SEQ ID NO: 3912217 - RNA, 18 nt, Shigella flexneri 2a str. 301
uaaaacgaucgcccagac

SEQ ID NO: 3912218 - RNA, 20 nt, Shigella flexneri 2a str. 301
uaaaacgcagucuucccagc

SEQ ID NO: 3912219 - RNA, 23 nt, Shigella flexneri 2a str. 301
uaaaacgcgcuacugaaucccug

SEQ ID NO: 3912220 - RNA, 20 nt, Shigella flexneri 2a str. 301
uaaaacgguuuauccccaag

SEQ ID NO: 3912221 - RNA, 14 nt, Shigella flexneri 2a str. 301
uaaaacgugccauu

SEQ ID NO: 3912222 - RNA, 17 nt, Shigella flexneri 2a str. 301
uaaaacgugccauuaau

SEQ ID NO: 3912223 - RNA, 16 nt, Shigella flexneri 2a str. 301
uaaaacuaaaaacagc

SEQ ID NO: 3912224 - RNA, 15 nt, Shigella flexneri 2a str. 301
uaaaacucaggcugg

SEQ ID NO: 3912225 - RNA, 14 nt, Shigella flexneri 2a str. 301
uaaaacugccugau

SEQ ID NO: 3912226 - RNA, 16 nt, Shigella flexneri 2a str. 301
uaaaacuuuauucagu

SEQ ID NO: 3912227 - RNA, 12 nt, Shigella flexneri 2a str. 301
uaaaagaaaaaa

SEQ ID NO: 3912228 - RNA, 15 nt, Shigella flexneri 2a str. 301
uaaaagaaaucagac

SEQ ID NO: 3912229 - RNA, 17 nt, Shigella flexneri 2a str. 301
uaaaagaaaucagacca

SEQ ID NO: 3912230 - RNA, 21 nt, Shigella flexneri 2a str. 301
uaaaagcauagccccagcgca

SEQ ID NO: 3912231 - RNA, 20 nt, Shigella flexneri 2a str. 301
uaaaagccaggagccaacac

SEQ ID NO: 3912232 - RNA, 20 nt, Shigella flexneri 2a str. 301
uaaaagcgcgcccaacagua

SEQ ID NO: 3912233 - RNA, 15 nt, Shigella flexneri 2a str. 301
uaaaagcgugaaaca

SEQ ID NO: 3912234 - RNA, 14 nt, Shigella flexneri 2a str. 301
uaaaaggagauaaa

SEQ ID NO: 3912235 - RNA, 15 nt, Shigella flexneri 2a str. 301
uaaaaggagauaaac

SEQ ID NO: 3912236 - RNA, 21 nt, Shigella flexneri 2a str. 301
uaaaauaucuuccacuucacg

SEQ ID NO: 3912237 - RNA, 12 nt, Shigella flexneri 2a str. 301
uaaaauauugaa

SEQ ID NO: 3912238 - RNA, 23 nt, Shigella flexneri 2a str. 301
uaaaaucuauuauuauuuuugug

SEQ ID NO: 3912239 - RNA, 21 nt, Shigella flexneri 2a str. 301
uaaaaucuucacuaaaaucau

SEQ ID NO: 3912240 - RNA, 23 nt, Shigella flexneri 2a str. 301
uaaaaucuucacuaaaaucauuc

SEQ ID NO: 3912241 - RNA, 19 nt, Shigella flexneri 2a str. 301
uaaauaguccggaagaugc

SEQ ID NO: 3912242 - RNA, 12 nt, Shigella flexneri 2a str. 301
uaaauaguggca

SEQ ID NO: 3912243 - RNA, 18 nt, Shigella flexneri 2a str. 301
uaaauaguggcaaauucu

SEQ ID NO: 3912244 - RNA, 13 nt, Shigella flexneri 2a str. 301
uaaauauaaaaca

SEQ ID NO: 3912245 - RNA, 18 nt, Shigella flexneri 2a str. 301
uaaauauauaaaaaaaca

SEQ ID NO: 3912246 - RNA, 11 nt, Shigella flexneri 2a str. 301
uaaaucaaacc

SEQ ID NO: 3912247 - RNA, 20 nt, Shigella flexneri 2a str. 301
uaaaucaagcgccgccaguc

SEQ ID NO: 3912248 - RNA, 15 nt, Shigella flexneri 2a str. 301
uaaaucacgcuuauc

SEQ ID NO: 3912249 - RNA, 20 nt, Shigella flexneri 2a str. 301
uaaaucagaacuucgcguug

SEQ ID NO: 3912250 - RNA, 11 nt, Shigella flexneri 2a str. 301
uaaaucagauc

SEQ ID NO: 3912251 - RNA, 12 nt, Shigella flexneri 2a str. 301
uaaaucauaaua

SEQ ID NO: 3912252 - RNA, 15 nt, Shigella flexneri 2a str. 301
uaaaucauaauaaag

SEQ ID NO: 3912253 - RNA, 18 nt, Shigella flexneri 2a str. 301
uaaaucaucggguuacug

SEQ ID NO: 3912254 - RNA, 16 nt, Shigella flexneri 2a str. 301
uaaauccaacaacaca

SEQ ID NO: 3912255 - RNA, 21 nt, Shigella flexneri 2a str. 301
uaaauccaacaacacauucaa

SEQ ID NO: 3912256 - RNA, 16 nt, Shigella flexneri 2a str. 301
uaaaucccaggcuuca

SEQ ID NO: 3912257 - RNA, 20 nt, Shigella flexneri 2a str. 301
uaaaucccagugccugcaua

SEQ ID NO: 3912258 - RNA, 14 nt, Shigella flexneri 2a str. 301
uaaaucccgccauu

SEQ ID NO: 3912259 - RNA, 16 nt, Shigella flexneri 2a str. 301
uaaaucccuggcugca

SEQ ID NO: 3912260 - RNA, 15 nt, Shigella flexneri 2a str. 301
uaaauccugaaacca

SEQ ID NO: 3912261 - RNA, 14 nt, Shigella flexneri 2a str. 301
uaaauccuuuguac

SEQ ID NO: 3912262 - RNA, 15 nt, Shigella flexneri 2a str. 301
uaaauccuuuguaca

SEQ ID NO: 3912263 - RNA, 18 nt, Shigella flexneri 2a str. 301
uaaaucgacguucugcca

SEQ ID NO: 3912264 - RNA, 19 nt, Shigella flexneri 2a str. 301
uaaaugaacucaacgccuu

SEQ ID NO: 3912265 - RNA, 16 nt, Shigella flexneri 2a str. 301
uaaaugacagcgaaug

SEQ ID NO: 3912266 - RNA, 20 nt, Shigella flexneri 2a str. 301
uaaaugcacaauaauauuac

SEQ ID NO: 3912267 - RNA, 17 nt, Shigella flexneri 2a str. 301
uaaaugcacccgccaga

SEQ ID NO: 3912268 - RNA, 19 nt, Shigella flexneri 2a str. 301
uaaaugccacugaauaaag

SEQ ID NO: 3912269 - RNA, 20 nt, Shigella flexneri 2a str. 301
uaaaugccgcaaugugcucu

SEQ ID NO: 3912270 - RNA, 18 nt, Shigella flexneri 2a str. 301
uaaaugccgcguggccug

SEQ ID NO: 3912271 - RNA, 20 nt, Shigella flexneri 2a str. 301
uaaaugccuuauccggccua

SEQ ID NO: 3912272 - RNA, 15 nt, Shigella flexneri 2a str. 301
uaaaugcugcagcca

SEQ ID NO: 3912273 - RNA, 17 nt, Shigella flexneri 2a str. 301
uaaaugcugcagccagg

SEQ ID NO: 3912274 - RNA, 22 nt, Shigella flexneri 2a str. 301
uaaauggcgaacgggauaaacg

SEQ ID NO: 3912275 - RNA, 23 nt, Shigella flexneri 2a str. 301
uaaauuaacugcgcgauuaucau

SEQ ID NO: 3912276 - RNA, 21 nt, Shigella flexneri 2a str. 301
uaaauuacugagcaauugcuc

SEQ ID NO: 3912277 - RNA, 18 nt, Shigella flexneri 2a str. 301
uaaauuccagguagaagu

SEQ ID NO: 3912278 - RNA, 21 nt, Shigella flexneri 2a str. 301
uaaauucgcugcggacaaaac

SEQ ID NO: 3912279 - RNA, 17 nt, Shigella flexneri 2a str. 301
uaaauucuaauguuaaa

SEQ ID NO: 3912280 - RNA, 15 nt, Shigella flexneri 2a str. 301
uaaauucuucugaau

SEQ ID NO: 3912281 - RNA, 17 nt, Shigella flexneri 2a str. 301
uaaauugagcugcgcga

SEQ ID NO: 3912282 - RNA, 22 nt, Shigella flexneri 2a str. 301
uaaauugcaggacuuauucauu

SEQ ID NO: 3912283 - RNA, 22 nt, Shigella flexneri 2a str. 301
uaaauugcaggguuuuguuuaa

SEQ ID NO: 3912284 - RNA, 14 nt, Shigella flexneri 2a str. 301
uaaauugcgccaga

SEQ ID NO: 3912285 - RNA, 23 nt, Shigella flexneri 2a str. 301
uaaauuuacguucuuacauuccg

SEQ ID NO: 3912286 - RNA, 20 nt, Shigella flexneri 2a str. 301
uaaauuuauagucaucggua

SEQ ID NO: 3912287 - RNA, 22 nt, Shigella flexneri 2a str. 301
uaaauuucuuaccacugccgca

SEQ ID NO: 3912288 - RNA, 17 nt, Shigella flexneri 2a str. 301
uaaauuugccaucucug

SEQ ID NO: 3912289 - RNA, 19 nt, Shigella flexneri 2a str. 301
uaaauuugccaucucugca

SEQ ID NO: 3912290 - RNA, 17 nt, Shigella flexneri 2a str. 301
uaaauuugcuuuucaua

SEQ ID NO: 3912291 - RNA, 19 nt, Shigella flexneri 2a str. 301
uaaauuugcuuuucauaca

SEQ ID NO: 3912292 - RNA, 23 nt, Shigella flexneri 2a str. 301
uaaauuuuuucacuguucugaua

SEQ ID NO: 3912293 - RNA, 13 nt, Shigella flexneri 2a str. 301
uaacaaaacucag

SEQ ID NO: 3912294 - RNA, 15 nt, Shigella flexneri 2a str. 301
uaacaaagccugcac

SEQ ID NO: 3912295 - RNA, 20 nt, Shigella flexneri 2a str. 301
uaacaaaugcgcuuuauuca

SEQ ID NO: 3912296 - RNA, 16 nt, Shigella flexneri 2a str. 301
uaacaaaugugccauu

SEQ ID NO: 3912297 - RNA, 16 nt, Shigella flexneri 2a str. 301
uaacaacgggcuaaac

SEQ ID NO: 3912298 - RNA, 16 nt, Shigella flexneri 2a str. 301
uaacaacgugguuuuc

SEQ ID NO: 3912299 - RNA, 22 nt, Shigella flexneri 2a str. 301
uaacaacgugugcuuuguucau

SEQ ID NO: 3912300 - RNA, 20 nt, Shigella flexneri 2a str. 301
uaacaauccgauaaucccuu

SEQ ID NO: 3912301 - RNA, 12 nt, Shigella flexneri 2a str. 301
uaacacaugcaa

SEQ ID NO: 3912302 - RNA, 13 nt, Shigella flexneri 2a str. 301
uaacaccagaaug

SEQ ID NO: 3912303 - RNA, 20 nt, Shigella flexneri 2a str. 301
uaacaccagccagaauuacc

SEQ ID NO: 3912304 - RNA, 15 nt, Shigella flexneri 2a str. 301
uaacaccaucauauu

SEQ ID NO: 3912305 - RNA, 15 nt, Shigella flexneri 2a str. 301
uaacaccgauuuugu

SEQ ID NO: 3912306 - RNA, 21 nt, Shigella flexneri 2a str. 301
uaacaccgauuuuguaaaaga

SEQ ID NO: 3912307 - RNA, 17 nt, Shigella flexneri 2a str. 301
uaacacgcucuggcagg

SEQ ID NO: 3912308 - RNA, 22 nt, Shigella flexneri 2a str. 301
uaacacgcucuggcaggcuuca

SEQ ID NO: 3912309 - RNA, 21 nt, Shigella flexneri 2a str. 301
uaacacuuguuaugagauaau

SEQ ID NO: 3912310 - RNA, 15 nt, Shigella flexneri 2a str. 301
uaacagaaauggccc

SEQ ID NO: 3912311 - RNA, 21 nt, Shigella flexneri 2a str. 301
uaacagaacgcauaacagccc

SEQ ID NO: 3912312 - RNA, 17 nt, Shigella flexneri 2a str. 301
uaacagaaugcgggcga

SEQ ID NO: 3912313 - RNA, 23 nt, Shigella flexneri 2a str. 301
uaacagaaugcgggcgaaaacau

SEQ ID NO: 3912314 - RNA, 14 nt, Shigella flexneri 2a str. 301
uaacagauaaauca

SEQ ID NO: 3912315 - RNA, 16 nt, Shigella flexneri 2a str. 301
uaacagcaaaacgccc

SEQ ID NO: 3912316 - RNA, 21 nt, Shigella flexneri 2a str. 301
uaacagcaacauaggcugcua

SEQ ID NO: 3912317 - RNA, 17 nt, Shigella flexneri 2a str. 301
uaacagcaauuuuguca

SEQ ID NO: 3912318 - RNA, 16 nt, Shigella flexneri 2a str. 301
uaacagcaucgcauca

SEQ ID NO: 3912319 - RNA, 17 nt, Shigella flexneri 2a str. 301
uaacagcguccacagcc

SEQ ID NO: 3912320 - RNA, 21 nt, Shigella flexneri 2a str. 301
uaacagcguccacagccaaca

SEQ ID NO: 3912321 - RNA, 17 nt, Shigella flexneri 2a str. 301
uaacagguuuaaacaga

SEQ ID NO: 3912322 - RNA, 21 nt, Shigella flexneri 2a str. 301
uaacagguuuugauuauucaa

SEQ ID NO: 3912323 - RNA, 20 nt, Shigella flexneri 2a str. 301
uaacaguauccgggcaucca

SEQ ID NO: 3912324 - RNA, 17 nt, Shigella flexneri 2a str. 301
uaacagugcaccggaca

SEQ ID NO: 3912325 - RNA, 17 nt, Shigella flexneri 2a str. 301
uaacauaccuaaaagca

SEQ ID NO: 3912326 - RNA, 10 nt, Shigella flexneri 2a str. 301
uaacauccag

SEQ ID NO: 3912327 - RNA, 19 nt, Shigella flexneri 2a str. 301
uaacaucgccagaaaucag

SEQ ID NO: 3912328 - RNA, 13 nt, Shigella flexneri 2a str. 301
uaacauggcggua

SEQ ID NO: 3912329 - RNA, 14 nt, Shigella flexneri 2a str. 301
uaacauuaacucca

SEQ ID NO: 3912330 - RNA, 16 nt, Shigella flexneri 2a str. 301
uaacauugcaagauuu

SEQ ID NO: 3912331 - RNA, 23 nt, Shigella flexneri 2a str. 301
uaacauuuuacuuacuucagcaa

SEQ ID NO: 3912332 - RNA, 18 nt, Shigella flexneri 2a str. 301
uaaccaaaagcugggaug

SEQ ID NO: 3912333 - RNA, 21 nt, Shigella flexneri 2a str. 301
uaaccaacaaugcaaaauagg

SEQ ID NO: 3912334 - RNA, 21 nt, Shigella flexneri 2a str. 301
uaaccaacggcgagccagcgc

SEQ ID NO: 3912335 - RNA, 18 nt, Shigella flexneri 2a str. 301
uaaccaccaguaaauugu

SEQ ID NO: 3912336 - RNA, 23 nt, Shigella flexneri 2a str. 301
uaaccacgcaaaaucccacugcc

SEQ ID NO: 3912337 - RNA, 12 nt, Shigella flexneri 2a str. 301
uaaccagcacca

SEQ ID NO: 3912338 - RNA, 22 nt, Shigella flexneri 2a str. 301
uaaccagcacguugaacugacu

SEQ ID NO: 3912339 - RNA, 14 nt, Shigella flexneri 2a str. 301
uaaccagccuggcg

SEQ ID NO: 3912340 - RNA, 23 nt, Shigella flexneri 2a str. 301
uaaccagccuggcggaaagccag

SEQ ID NO: 3912341 - RNA, 16 nt, Shigella flexneri 2a str. 301
uaagaauugauaaaaa

SEQ ID NO: 3912342 - RNA, 23 nt, Shigella flexneri 2a str. 301
uaagacaccccacagcucuugcu

SEQ ID NO: 3912343 - RNA, 14 nt, Shigella flexneri 2a str. 301
uaagacgcgcagcg

SEQ ID NO: 3912344 - RNA, 22 nt, Shigella flexneri 2a str. 301
uaagacgcgccagcgucgcauc

SEQ ID NO: 3912345 - RNA, 16 nt, Shigella flexneri 2a str. 301
uaagacuggcaaagca

SEQ ID NO: 3912346 - RNA, 22 nt, Shigella flexneri 2a str. 301
uaagacuggcaaagcaggccag

SEQ ID NO: 3912347 - RNA, 18 nt, Shigella flexneri 2a str. 301
uaagagcgggacaacaaa

SEQ ID NO: 3912348 - RNA, 21 nt, Shigella flexneri 2a str. 301
uaagaggcuaaccuuauggug

SEQ ID NO: 3912349 - RNA, 20 nt, Shigella flexneri 2a str. 301
uaagaguagcccgauacgcu

SEQ ID NO: 3912350 - RNA, 15 nt, Shigella flexneri 2a str. 301
uaagaguuucaacau

SEQ ID NO: 3912351 - RNA, 14 nt, Shigella flexneri 2a str. 301
uaagauaaaagcaa

SEQ ID NO: 3912352 - RNA, 18 nt, Shigella flexneri 2a str. 301
uaagauaccccagcgcaa

SEQ ID NO: 3912353 - RNA, 20 nt, Shigella flexneri 2a str. 301
uaagaucagaagcguaaccg

SEQ ID NO: 3912354 - RNA, 13 nt, Shigella flexneri 2a str. 301
uaagaucaucggc

SEQ ID NO: 3912355 - RNA, 22 nt, Shigella flexneri 2a str. 301
uaagaucaucggccagauaaua

SEQ ID NO: 3912356 - RNA, 15 nt, Shigella flexneri 2a str. 301
uaagaugcgccagca

SEQ ID NO: 3912357 - RNA, 21 nt, Shigella flexneri 2a str. 301
uaagauuaccuuccucaauua

SEQ ID NO: 3912358 - RNA, 14 nt, Shigella flexneri 2a str. 301
uaagcaaacagcgc

SEQ ID NO: 3912359 - RNA, 22 nt, Shigella flexneri 2a str. 301
uaagcaaagcggucuucuguga

SEQ ID NO: 3912360 - RNA, 14 nt, Shigella flexneri 2a str. 301
uaagcaaaggugcc

SEQ ID NO: 3912361 - RNA, 16 nt, Shigella flexneri 2a str. 301
uaagcaacgcgcaccg

SEQ ID NO: 3912362 - RNA, 21 nt, Shigella flexneri 2a str. 301
uaagcaacugacuggcucuuu

SEQ ID NO: 3912363 - RNA, 23 nt, Shigella flexneri 2a str. 301
uaagcaacugacuggcucuuuuu

SEQ ID NO: 3912364 - RNA, 19 nt, Shigella flexneri 2a str. 301
uaagcacuacucuauacag

SEQ ID NO: 3912365 - RNA, 16 nt, Shigella flexneri 2a str. 301
uaagcagccaucugau

SEQ ID NO: 3912366 - RNA, 16 nt, Shigella flexneri 2a str. 301
uaagcagucaucugau

SEQ ID NO: 3912367 - RNA, 18 nt, Shigella flexneri 2a str. 301
uaagcaucccuuuaauua

SEQ ID NO: 3912368 - RNA, 17 nt, Shigella flexneri 2a str. 301
uaagcaucuauuauugu

SEQ ID NO: 3912369 - RNA, 18 nt, Shigella flexneri 2a str. 301
uaagcauuuagcgccggg

SEQ ID NO: 3912370 - RNA, 16 nt, Shigella flexneri 2a str. 301
uaagccaaauccagcg

SEQ ID NO: 3912371 - RNA, 14 nt, Shigella flexneri 2a str. 301
uaagccaagcgccg

SEQ ID NO: 3912372 - RNA, 18 nt, Shigella flexneri 2a str. 301
uaagccauguuuaacucc

SEQ ID NO: 3912373 - RNA, 17 nt, Shigella flexneri 2a str. 301
uaagccauuuaacucac

SEQ ID NO: 3912374 - RNA, 20 nt, Shigella flexneri 2a str. 301
uaagcccagaacaaauaaau

SEQ ID NO: 3912375 - RNA, 21 nt, Shigella flexneri 2a str. 301
uaagccgccacgaccugcaga

SEQ ID NO: 3912376 - RNA, 15 nt, Shigella flexneri 2a str. 301
uaagccggaucggag

SEQ ID NO: 3912377 - RNA, 14 nt, Shigella flexneri 2a str. 301
uaagccgugcauag

SEQ ID NO: 3912378 - RNA, 12 nt, Shigella flexneri 2a str. 301
uaagccuuccgc

SEQ ID NO: 3912379 - RNA, 17 nt, Shigella flexneri 2a str. 301
uaagccuuucaggaaac

SEQ ID NO: 3912380 - RNA, 20 nt, Shigella flexneri 2a str. 301
uaagcgauaaaaauaccgag

SEQ ID NO: 3912381 - RNA, 14 nt, Shigella flexneri 2a str. 301
uaagcgcagcgcau

SEQ ID NO: 3912382 - RNA, 20 nt, Shigella flexneri 2a str. 301
uaagcgcagucaccagcauc

SEQ ID NO: 3912383 - RNA, 14 nt, Shigella flexneri 2a str. 301
uaagcgcauccggc

SEQ ID NO: 3912384 - RNA, 14 nt, Shigella flexneri 2a str. 301
uaagcgccaccguc

SEQ ID NO: 3912385 - RNA, 22 nt, Shigella flexneri 2a str. 301
uaagcguaagcgcauccggcac

SEQ ID NO: 3912386 - RNA, 14 nt, Shigella flexneri 2a str. 301
uaagcguagcgcau

SEQ ID NO: 3912387 - RNA, 19 nt, Shigella flexneri 2a str. 301
uaagcguagcgcaucaggc

SEQ ID NO: 3912388 - RNA, 16 nt, Shigella flexneri 2a str. 301
uaagcguucauccaac

SEQ ID NO: 3912389 - RNA, 22 nt, Shigella flexneri 2a str. 301
uaagcguugugcaucaggcaaa

SEQ ID NO: 3912390 - RNA, 16 nt, Shigella flexneri 2a str. 301
uaagcucagaaacgcu

SEQ ID NO: 3912391 - RNA, 13 nt, Shigella flexneri 2a str. 301
uaagcugaugacg

SEQ ID NO: 3912392 - RNA, 12 nt, Shigella flexneri 2a str. 301
uaagcugcgggu

SEQ ID NO: 3912393 - RNA, 18 nt, Shigella flexneri 2a str. 301
uaagcugucgaaaagaua

SEQ ID NO: 3912394 - RNA, 14 nt, Shigella flexneri 2a str. 301
uaaggaauucacgc

SEQ ID NO: 3912395 - RNA, 12 nt, Shigella flexneri 2a str. 301
uaaggauaaaaa

SEQ ID NO: 3912396 - RNA, 13 nt, Shigella flexneri 2a str. 301
uaaggauaaaaaa

SEQ ID NO: 3912397 - RNA, 19 nt, Shigella flexneri 2a str. 301
uaaggcagaaacaaacgca

SEQ ID NO: 3912398 - RNA, 22 nt, Shigella flexneri 2a str. 301
uaaggccccuuccucgggaggg

SEQ ID NO: 3912399 - RNA, 14 nt, Shigella flexneri 2a str. 301
uaaggcgcaauaau

SEQ ID NO: 3912400 - RNA, 15 nt, Shigella flexneri 2a str. 301
uaaggcguuacgcag

SEQ ID NO: 3912401 - RNA, 12 nt, Shigella flexneri 2a str. 301
uaaggcguucac

SEQ ID NO: 3912402 - RNA, 14 nt, Shigella flexneri 2a str. 301
uaaggcuucaauca

SEQ ID NO: 3912403 - RNA, 17 nt, Shigella flexneri 2a str. 301
uaagggaggauuucucc

SEQ ID NO: 3912404 - RNA, 18 nt, Shigella flexneri 2a str. 301
uaagggaggauuucuccc

SEQ ID NO: 3912405 - RNA, 21 nt, Shigella flexneri 2a str. 301
uaagggaggauuucucccccc

SEQ ID NO: 3912406 - RNA, 23 nt, Shigella flexneri 2a str. 301
uaagggaggauuucuccccccuc

SEQ ID NO: 3912407 - RNA, 16 nt, Shigella flexneri 2a str. 301
uaagggcugacaguug

SEQ ID NO: 3912408 - RNA, 21 nt, Shigella flexneri 2a str. 301
uaaggucagacgaagucaaca

SEQ ID NO: 3912409 - RNA, 21 nt, Shigella flexneri 2a str. 301
uaagguuaagccucacgguuc

SEQ ID NO: 3912410 - RNA, 18 nt, Shigella flexneri 2a str. 301
uaagguucacuuaaucuc

SEQ ID NO: 3912411 - RNA, 13 nt, Shigella flexneri 2a str. 301
uaaguaagcaaca

SEQ ID NO: 3912412 - RNA, 16 nt, Shigella flexneri 2a str. 301
uaaguaaugaacuccg

SEQ ID NO: 3912413 - RNA, 23 nt, Shigella flexneri 2a str. 301
uaaguaguguagcacuugcagcu

SEQ ID NO: 3912414 - RNA, 18 nt, Shigella flexneri 2a str. 301
uaagucggucaaguaauu

SEQ ID NO: 3912415 - RNA, 21 nt, Shigella flexneri 2a str. 301
uaagucuggcacgaccgccuu

SEQ ID NO: 3912416 - RNA, 22 nt, Shigella flexneri 2a str. 301
uaagugauacccaucaucgcau

SEQ ID NO: 3912417 - RNA, 15 nt, Shigella flexneri 2a str. 301
uaaguguaaaauucu

SEQ ID NO: 3912418 - RNA, 22 nt, Shigella flexneri 2a str. 301
uaaguguccgccaauuucauca

SEQ ID NO: 3912419 - RNA, 15 nt, Shigella flexneri 2a str. 301
uaaguuacacaucau

SEQ ID NO: 3912420 - RNA, 21 nt, Shigella flexneri 2a str. 301
uaaguuagucgcuuucauuca

SEQ ID NO: 3912421 - RNA, 21 nt, Shigella flexneri 2a str. 301
uaaguucaguaugaucuugcc

SEQ ID NO: 3912422 - RNA, 14 nt, Shigella flexneri 2a str. 301
uaaguugaaucggc

SEQ ID NO: 3912423 - RNA, 17 nt, Shigella flexneri 2a str. 301
uaaguugccacgcuuca

SEQ ID NO: 3912424 - RNA, 14 nt, Shigella flexneri 2a str. 301
uaaguuuaacugcc

SEQ ID NO: 3912425 - RNA, 18 nt, Shigella flexneri 2a str. 301
uaaguuucaccaaacuuc

SEQ ID NO: 3912426 - RNA, 11 nt, Shigella flexneri 2a str. 301
uaauaaagcgg

SEQ ID NO: 3912427 - RNA, 13 nt, Shigella flexneri 2a str. 301
uaauaaauauuaa

SEQ ID NO: 3912428 - RNA, 19 nt, Shigella flexneri 2a str. 301
uaauaaaugccggaagcug

SEQ ID NO: 3912429 - RNA, 20 nt, Shigella flexneri 2a str. 301
uaauaaauguggagauaaac

SEQ ID NO: 3912430 - RNA, 13 nt, Shigella flexneri 2a str. 301
uaauaacacauau

SEQ ID NO: 3912431 - RNA, 20 nt, Shigella flexneri 2a str. 301
uaauaauauccuuuccccuc

SEQ ID NO: 3912432 - RNA, 13 nt, Shigella flexneri 2a str. 301
uaauaaucaucac

SEQ ID NO: 3912433 - RNA, 22 nt, Shigella flexneri 2a str. 301
uaauaaugagcagaaaaaccgu

SEQ ID NO: 3912434 - RNA, 17 nt, Shigella flexneri 2a str. 301
uaauaauucaaaaaccu

SEQ ID NO: 3912435 - RNA, 20 nt, Shigella flexneri 2a str. 301
uaauaauugccccuuggcau

SEQ ID NO: 3912436 - RNA, 18 nt, Shigella flexneri 2a str. 301
uaauaauuucugcacauc

SEQ ID NO: 3912437 - RNA, 13 nt, Shigella flexneri 2a str. 301
uaauacacacauc

SEQ ID NO: 3912438 - RNA, 13 nt, Shigella flexneri 2a str. 301
uaauacaccauca

SEQ ID NO: 3912439 - RNA, 17 nt, Shigella flexneri 2a str. 301
uaauacacuaacagaac

SEQ ID NO: 3912440 - RNA, 21 nt, Shigella flexneri 2a str. 301
uaauacaggcuacucccagua

SEQ ID NO: 3912441 - RNA, 13 nt, Shigella flexneri 2a str. 301
uaauuaaaaauag

SEQ ID NO: 3912442 - RNA, 14 nt, Shigella flexneri 2a str. 301
uaauuaauacgcca

SEQ ID NO: 3912443 - RNA, 20 nt, Shigella flexneri 2a str. 301
uaauuaaucugguaucgagu

SEQ ID NO: 3912444 - RNA, 15 nt, Shigella flexneri 2a str. 301
uaauuacacccuuaa

SEQ ID NO: 3912445 - RNA, 23 nt, Shigella flexneri 2a str. 301
uaauuaccguaaugaucgcgauc

SEQ ID NO: 3912446 - RNA, 12 nt, Shigella flexneri 2a str. 301
uaauuacugaga

SEQ ID NO: 3912447 - RNA, 23 nt, Shigella flexneri 2a str. 301
uaauuacuugaugcccgguauuu

SEQ ID NO: 3912448 - RNA, 19 nt, Shigella flexneri 2a str. 301
uaauuaggauacuuaucug

SEQ ID NO: 3912449 - RNA, 15 nt, Shigella flexneri 2a str. 301
uaauuagugcugcug

SEQ ID NO: 3912450 - RNA, 19 nt, Shigella flexneri 2a str. 301
uaauuaugccgaucaucau

SEQ ID NO: 3912451 - RNA, 11 nt, Shigella flexneri 2a str. 301
uaauuauuaac

SEQ ID NO: 3912452 - RNA, 12 nt, Shigella flexneri 2a str. 301
uaauucaggaaa

SEQ ID NO: 3912453 - RNA, 19 nt, Shigella flexneri 2a str. 301
uaauucaggaaauuaccgc

SEQ ID NO: 3912454 - RNA, 23 nt, Shigella flexneri 2a str. 301
uaauuccucccguuaugaucagc

SEQ ID NO: 3912455 - RNA, 16 nt, Shigella flexneri 2a str. 301
uaauucgcuaacaaaa

SEQ ID NO: 3912456 - RNA, 20 nt, Shigella flexneri 2a str. 301
uaauucgcuuuuauaaaggg

SEQ ID NO: 3912457 - RNA, 19 nt, Shigella flexneri 2a str. 301
uaauugagaaccacaauga

SEQ ID NO: 3912458 - RNA, 20 nt, Shigella flexneri 2a str. 301
uaauugccggaugcgacgca

SEQ ID NO: 3912459 - RNA, 22 nt, Shigella flexneri 2a str. 301
uaauugcgcaacugaggcaaua

SEQ ID NO: 3912460 - RNA, 10 nt, Shigella flexneri 2a str. 301
uaauugcucc

SEQ ID NO: 3912461 - RNA, 13 nt, Shigella flexneri 2a str. 301
uaauugcuuuuac

SEQ ID NO: 3912462 - RNA, 15 nt, Shigella flexneri 2a str. 301
uaauugcuuuuacca

SEQ ID NO: 3912463 - RNA, 23 nt, Shigella flexneri 2a str. 301
uaauugcuuuuaccauacuggau

SEQ ID NO: 3912464 - RNA, 16 nt, Shigella flexneri 2a str. 301
uaauuggaauacauau

SEQ ID NO: 3912465 - RNA, 20 nt, Shigella flexneri 2a str. 301
uaauuggaauacauauauua

SEQ ID NO: 3912466 - RNA, 20 nt, Shigella flexneri 2a str. 301
uaauuguuaucguuugcauu

SEQ ID NO: 3912467 - RNA, 12 nt, Shigella flexneri 2a str. 301
uaauuuaugccu

SEQ ID NO: 3912468 - RNA, 11 nt, Shigella flexneri 2a str. 301
uaauuucacaa

SEQ ID NO: 3912469 - RNA, 21 nt, Shigella flexneri 2a str. 301
uaauuucacaaguugucccau

SEQ ID NO: 3912470 - RNA, 19 nt, Shigella flexneri 2a str. 301
uaauuucacaccaucaaca

SEQ ID NO: 3912471 - RNA, 19 nt, Shigella flexneri 2a str. 301
uaauuucagcaagacaaug

SEQ ID NO: 3912472 - RNA, 22 nt, Shigella flexneri 2a str. 301
uaauuucaucugccuuauugaa

SEQ ID NO: 3912473 - RNA, 15 nt, Shigella flexneri 2a str. 301
uaauuucauuuacug

SEQ ID NO: 3912474 - RNA, 15 nt, Shigella flexneri 2a str. 301
uaauuucauuuugau

SEQ ID NO: 3912475 - RNA, 19 nt, Shigella flexneri 2a str. 301
uaauuucauuuugauauuu

SEQ ID NO: 3912476 - RNA, 15 nt, Shigella flexneri 2a str. 301
uaauuuccagcagug

SEQ ID NO: 3912477 - RNA, 18 nt, Shigella flexneri 2a str. 301
uaauuucggcagcgcgcu

SEQ ID NO: 3912478 - RNA, 19 nt, Shigella flexneri 2a str. 301
uaauuugaucgauggcagu

SEQ ID NO: 3912479 - RNA, 20 nt, Shigella flexneri 2a str. 301
uaauuugcggaauuuuuccg

SEQ ID NO: 3912480 - RNA, 23 nt, Shigella flexneri 2a str. 301
uaauuuuuauauagccagccuca

SEQ ID NO: 3912481 - RNA, 18 nt, Shigella flexneri 2a str. 301
uaauuuuucaaacucuuc

SEQ ID NO: 3912482 - RNA, 18 nt, Shigella flexneri 2a str. 301
uaauuuuucaauauccaa

SEQ ID NO: 3912483 - RNA, 23 nt, Shigella flexneri 2a str. 301
uaauuuuuccagcauuucuucca

SEQ ID NO: 3912484 - RNA, 17 nt, Shigella flexneri 2a str. 301
uaauuuuuguuguuuaa

SEQ ID NO: 3912485 - RNA, 14 nt, Shigella flexneri 2a str. 301
uaauuuuuucuucc

SEQ ID NO: 3912486 - RNA, 22 nt, Shigella flexneri 2a str. 301
uacaaaaaaggccgcaggcugu

SEQ ID NO: 3912487 - RNA, 14 nt, Shigella flexneri 2a str. 301
uacaaaaccugcac

SEQ ID NO: 3912488 - RNA, 18 nt, Shigella flexneri 2a str. 301
uacaaaagauuauugcuu

SEQ ID NO: 3912489 - RNA, 19 nt, Shigella flexneri 2a str. 301
uacaaaaucuauugcaaca

SEQ ID NO: 3912490 - RNA, 23 nt, Shigella flexneri 2a str. 301
uacaaaaucuugcaaauucaaua

SEQ ID NO: 3912491 - RNA, 19 nt, Shigella flexneri 2a str. 301
uacaaagccaacagcagcc

SEQ ID NO: 3912492 - RNA, 19 nt, Shigella flexneri 2a str. 301
uacaaagggcuaacgugca

SEQ ID NO: 3912493 - RNA, 21 nt, Shigella flexneri 2a str. 301
uacaaagggcuaacgugcagg

SEQ ID NO: 3912494 - RNA, 16 nt, Shigella flexneri 2a str. 301
uacaaaguguuguucu

SEQ ID NO: 3912495 - RNA, 20 nt, Shigella flexneri 2a str. 301
uacaaaguguuguucuagcg

SEQ ID NO: 3912496 - RNA, 20 nt, Shigella flexneri 2a str. 301
uacaaauuuaucgauaacag

SEQ ID NO: 3912497 - RNA, 21 nt, Shigella flexneri 2a str. 301
uacaacagggcgauuugcucc

SEQ ID NO: 3912498 - RNA, 21 nt, Shigella flexneri 2a str. 301
uacaaccaaaucugauuaaua

SEQ ID NO: 3912499 - RNA, 19 nt, Shigella flexneri 2a str. 301
uacaaccaccccaccuuac

SEQ ID NO: 3912500 - RNA, 17 nt, Shigella flexneri 2a str. 301
uacaaccaucccuccug

SEQ ID NO: 3912501 - RNA, 23 nt, Shigella flexneri 2a str. 301
uacaaccgcaaagguugcugcgc

SEQ ID NO: 3912502 - RNA, 17 nt, Shigella flexneri 2a str. 301
uacaaccugcuggaaag

SEQ ID NO: 3912503 - RNA, 19 nt, Shigella flexneri 2a str. 301
uacaacgccguuuaauauu

SEQ ID NO: 3912504 - RNA, 11 nt, Shigella flexneri 2a str. 301
uacaacgcugu

SEQ ID NO: 3912505 - RNA, 14 nt, Shigella flexneri 2a str. 301
uacaacgcuuuauc

SEQ ID NO: 3912506 - RNA, 20 nt, Shigella flexneri 2a str. 301
uacaacucgcuuaagccauc

SEQ ID NO: 3912507 - RNA, 12 nt, Shigella flexneri 2a str. 301
uacaacuuucuc

SEQ ID NO: 3912508 - RNA, 19 nt, Shigella flexneri 2a str. 301
uacaagcaacuugcaaucu

SEQ ID NO: 3912509 - RNA, 17 nt, Shigella flexneri 2a str. 301
uacaagcguuuacccaa

SEQ ID NO: 3912510 - RNA, 16 nt, Shigella flexneri 2a str. 301
uacaauauccagcgcg

SEQ ID NO: 3912511 - RNA, 23 nt, Shigella flexneri 2a str. 301
uacaauauccagcgcgcgcagca

SEQ ID NO: 3912512 - RNA, 16 nt, Shigella flexneri 2a str. 301
uacaauaugaauuacu

SEQ ID NO: 3912513 - RNA, 13 nt, Shigella flexneri 2a str. 301
uacaaucacacua

SEQ ID NO: 3912514 - RNA, 18 nt, Shigella flexneri 2a str. 301
uacaaucguuucaugcca

SEQ ID NO: 3912515 - RNA, 15 nt, Shigella flexneri 2a str. 301
uacaaucugcccgag

SEQ ID NO: 3912516 - RNA, 16 nt, Shigella flexneri 2a str. 301
uacaaucugcgcugga

SEQ ID NO: 3912517 - RNA, 22 nt, Shigella flexneri 2a str. 301
uacaauucuaccguuggccuga

SEQ ID NO: 3912518 - RNA, 17 nt, Shigella flexneri 2a str. 301
uacaauuuacguuuuaa

SEQ ID NO: 3912519 - RNA, 23 nt, Shigella flexneri 2a str. 301
uacaauuuacguuuuaaaccuac

SEQ ID NO: 3912520 - RNA, 14 nt, Shigella flexneri 2a str. 301
uacacauuaucuca

SEQ ID NO: 3912521 - RNA, 14 nt, Shigella flexneri 2a str. 301
uacaccaaagcggu

SEQ ID NO: 3912522 - RNA, 14 nt, Shigella flexneri 2a str. 301
uacacccagccccg

SEQ ID NO: 3912523 - RNA, 23 nt, Shigella flexneri 2a str. 301
uacacccagccccgguuuuucug

SEQ ID NO: 3912524 - RNA, 20 nt, Shigella flexneri 2a str. 301
uacaccgcagccgccacaau

SEQ ID NO: 3912525 - RNA, 22 nt, Shigella flexneri 2a str. 301
uacaccguuuuacaacgcuguu

SEQ ID NO: 3912526 - RNA, 16 nt, Shigella flexneri 2a str. 301
uacaccucucgcccgc

SEQ ID NO: 3912527 - RNA, 22 nt, Shigella flexneri 2a str. 301
uacaccuuaaggcuguucccac

SEQ ID NO: 3912528 - RNA, 15 nt, Shigella flexneri 2a str. 301
uacacuauuuccuug

SEQ ID NO: 3912529 - RNA, 17 nt, Shigella flexneri 2a str. 301
uacacuucacacacuuu

SEQ ID NO: 3912530 - RNA, 20 nt, Shigella flexneri 2a str. 301
uacacuucacacacuuuuau

SEQ ID NO: 3912531 - RNA, 21 nt, Shigella flexneri 2a str. 301
uacacuucacacacuuuuauu

SEQ ID NO: 3912532 - RNA, 14 nt, Shigella flexneri 2a str. 301
uacagaaaugaaaa

SEQ ID NO: 3912533 - RNA, 17 nt, Shigella flexneri 2a str. 301
uacagaaaugaaaaaau

SEQ ID NO: 3912534 - RNA, 18 nt, Shigella flexneri 2a str. 301
uacagaaaugaaaaaaua

SEQ ID NO: 3912535 - RNA, 13 nt, Shigella flexneri 2a str. 301
uacagaagcaccg

SEQ ID NO: 3912536 - RNA, 15 nt, Shigella flexneri 2a str. 301
uacagaagcaccgua

SEQ ID NO: 3912537 - RNA, 17 nt, Shigella flexneri 2a str. 301
uacagacucaaaccaau

SEQ ID NO: 3912538 - RNA, 21 nt, Shigella flexneri 2a str. 301
uacagacucaaaccaauggca

SEQ ID NO: 3912539 - RNA, 16 nt, Shigella flexneri 2a str. 301
uacagagggcaggcaa

SEQ ID NO: 3912540 - RNA, 20 nt, Shigella flexneri 2a str. 301
uacccugcaaugaaccggua

SEQ ID NO: 3912541 - RNA, 18 nt, Shigella flexneri 2a str. 301
uacccugcccgacgauac

SEQ ID NO: 3912542 - RNA, 18 nt, Shigella flexneri 2a str. 301
uacccuucaucacgcagc

SEQ ID NO: 3912543 - RNA, 15 nt, Shigella flexneri 2a str. 301
uacccuuuauuuucu

SEQ ID NO: 3912544 - RNA, 15 nt, Shigella flexneri 2a str. 301
uaccgaaccaaaaua

SEQ ID NO: 3912545 - RNA, 18 nt, Shigella flexneri 2a str. 301
uaccgaagaguaaccaaa

SEQ ID NO: 3912546 - RNA, 17 nt, Shigella flexneri 2a str. 301
uaccgacauaugcuuaa

SEQ ID NO: 3912547 - RNA, 19 nt, Shigella flexneri 2a str. 301
uaccgacgcgcuauugccg

SEQ ID NO: 3912548 - RNA, 12 nt, Shigella flexneri 2a str. 301
uaccgagcagcc

SEQ ID NO: 3912549 - RNA, 13 nt, Shigella flexneri 2a str. 301
uaccgagcagcca

SEQ ID NO: 3912550 - RNA, 17 nt, Shigella flexneri 2a str. 301
uaccgauagauucagca

SEQ ID NO: 3912551 - RNA, 13 nt, Shigella flexneri 2a str. 301
uaccgaucaccga

SEQ ID NO: 3912552 - RNA, 12 nt, Shigella flexneri 2a str. 301
uaccgaucgcca

SEQ ID NO: 3912553 - RNA, 13 nt, Shigella flexneri 2a str. 301
uaccgauucccag

SEQ ID NO: 3912554 - RNA, 23 nt, Shigella flexneri 2a str. 301
uaccgcaacucauuuacagaaac

SEQ ID NO: 3912555 - RNA, 13 nt, Shigella flexneri 2a str. 301
uaccgcaccacca

SEQ ID NO: 3912556 - RNA, 17 nt, Shigella flexneri 2a str. 301
uaccgcaccaccagcag

SEQ ID NO: 3912557 - RNA, 18 nt, Shigella flexneri 2a str. 301
uaccgcagugaaauuucu

SEQ ID NO: 3912558 - RNA, 12 nt, Shigella flexneri 2a str. 301
uaccgccacagc

SEQ ID NO: 3912559 - RNA, 12 nt, Shigella flexneri 2a str. 301
uaccgccagacc

SEQ ID NO: 3912560 - RNA, 14 nt, Shigella flexneri 2a str. 301
uaccgccagaccac

SEQ ID NO: 3912561 - RNA, 16 nt, Shigella flexneri 2a str. 301
uaccgccagcaggaac

SEQ ID NO: 3912562 - RNA, 21 nt, Shigella flexneri 2a str. 301
uaccgccaucaauugcucacu

SEQ ID NO: 3912563 - RNA, 13 nt, Shigella flexneri 2a str. 301
uaccgccauggcc

SEQ ID NO: 3912564 - RNA, 23 nt, Shigella flexneri 2a str. 301
uaccgcccgcgcgguaucaccac

SEQ ID NO: 3912565 - RNA, 18 nt, Shigella flexneri 2a str. 301
uaccgccgaucucaccga

SEQ ID NO: 3912566 - RNA, 19 nt, Shigella flexneri 2a str. 301
uaccgccucgcggcagcag

SEQ ID NO: 3912567 - RNA, 16 nt, Shigella flexneri 2a str. 301
uaccgcguaauacauc

SEQ ID NO: 3912568 - RNA, 21 nt, Shigella flexneri 2a str. 301
uaccgcugcuggcguugucau

SEQ ID NO: 3912569 - RNA, 16 nt, Shigella flexneri 2a str. 301
uaccgcuguccacgcc

SEQ ID NO: 3912570 - RNA, 20 nt, Shigella flexneri 2a str. 301
uaccggaacacucuuccagu

SEQ ID NO: 3912571 - RNA, 15 nt, Shigella flexneri 2a str. 301
uaccggacacacuuc

SEQ ID NO: 3912572 - RNA, 18 nt, Shigella flexneri 2a str. 301
uaccggacacacuucauu

SEQ ID NO: 3912573 - RNA, 17 nt, Shigella flexneri 2a str. 301
uaccggacuccagacac

SEQ ID NO: 3912574 - RNA, 16 nt, Shigella flexneri 2a str. 301
uaccggauaaauuuaa

SEQ ID NO: 3912575 - RNA, 18 nt, Shigella flexneri 2a str. 301
uaccggauuuuuuuuccg

SEQ ID NO: 3912576 - RNA, 13 nt, Shigella flexneri 2a str. 301
uaccggcaaacuu

SEQ ID NO: 3912577 - RNA, 19 nt, Shigella flexneri 2a str. 301
uaccggcgucccaucggca

SEQ ID NO: 3912578 - RNA, 20 nt, Shigella flexneri 2a str. 301
uaccgggccugaacaagcaa

SEQ ID NO: 3912579 - RNA, 20 nt, Shigella flexneri 2a str. 301
uaccgggcuguucacugugc

SEQ ID NO: 3912580 - RNA, 16 nt, Shigella flexneri 2a str. 301
uaccgggucgcacugg

SEQ ID NO: 3912581 - RNA, 17 nt, Shigella flexneri 2a str. 301
uaccgguuucaauccag

SEQ ID NO: 3912582 - RNA, 18 nt, Shigella flexneri 2a str. 301
uaccgguuucaauccagg

SEQ ID NO: 3912583 - RNA, 18 nt, Shigella flexneri 2a str. 301
uaccgguuuuggcaggcc

SEQ ID NO: 3912584 - RNA, 17 nt, Shigella flexneri 2a str. 301
uaccguaaugaucgcga

SEQ ID NO: 3912585 - RNA, 15 nt, Shigella flexneri 2a str. 301
uaccguaucuaccac

SEQ ID NO: 3912586 - RNA, 12 nt, Shigella flexneri 2a str. 301
uaccgucaccga

SEQ ID NO: 3912587 - RNA, 17 nt, Shigella flexneri 2a str. 301
uaccgugaaucaccaca

SEQ ID NO: 3912588 - RNA, 15 nt, Shigella flexneri 2a str. 301
uaccgugcugacuca

SEQ ID NO: 3912589 - RNA, 18 nt, Shigella flexneri 2a str. 301
uaccgugcuguacagcag

SEQ ID NO: 3912590 - RNA, 20 nt, Shigella flexneri 2a str. 301
uaccgugguacguuaaaguu

SEQ ID NO: 3912591 - RNA, 15 nt, Shigella flexneri 2a str. 301
uaccguucucuuuaa

SEQ ID NO: 3912592 - RNA, 19 nt, Shigella flexneri 2a str. 301
uaccuaaaagcacgccaga

SEQ ID NO: 3912593 - RNA, 21 nt, Shigella flexneri 2a str. 301
uaccuaaaagcacgccagaca

SEQ ID NO: 3912594 - RNA, 17 nt, Shigella flexneri 2a str. 301
uaccuaacauuuuacuu

SEQ ID NO: 3912595 - RNA, 20 nt, Shigella flexneri 2a str. 301
uaccuaaggaauccagcgac

SEQ ID NO: 3912596 - RNA, 22 nt, Shigella flexneri 2a str. 301
uaccucaucgcgcaacgucgcg

SEQ ID NO: 3912597 - RNA, 14 nt, Shigella flexneri 2a str. 301
uaccucauggagau

SEQ ID NO: 3912598 - RNA, 15 nt, Shigella flexneri 2a str. 301
uaccuccuucacagu

SEQ ID NO: 3912599 - RNA, 21 nt, Shigella flexneri 2a str. 301
uaccucuuguucgucgucuuu

SEQ ID NO: 3912600 - RNA, 23 nt, Shigella flexneri 2a str. 301
uaccugaaugcucugaggcugau

SEQ ID NO: 3912601 - RNA, 14 nt, Shigella flexneri 2a str. 301
uaccugacagcaga

SEQ ID NO: 3912602 - RNA, 17 nt, Shigella flexneri 2a str. 301
uaccugacagcagagca

SEQ ID NO: 3912603 - RNA, 23 nt, Shigella flexneri 2a str. 301
uaccugaggcgcuacgcuaucag

SEQ ID NO: 3912604 - RNA, 11 nt, Shigella flexneri 2a str. 301
uaccugccugu

SEQ ID NO: 3912605 - RNA, 13 nt, Shigella flexneri 2a str. 301
uaccuggauucga

SEQ ID NO: 3912606 - RNA, 14 nt, Shigella flexneri 2a str. 301
uaccugucauggca

SEQ ID NO: 3912607 - RNA, 18 nt, Shigella flexneri 2a str. 301
uaccuguccguuuucagu

SEQ ID NO: 3912608 - RNA, 21 nt, Shigella flexneri 2a str. 301
uaccuguguuuugcaucaacu

SEQ ID NO: 3912609 - RNA, 15 nt, Shigella flexneri 2a str. 301
uaccuuacacucaaa

SEQ ID NO: 3912610 - RNA, 20 nt, Shigella flexneri 2a str. 301
uaccuuaucaaucucagcaa

SEQ ID NO: 3912611 - RNA, 17 nt, Shigella flexneri 2a str. 301
uaccuucaacacuggca

SEQ ID NO: 3912612 - RNA, 14 nt, Shigella flexneri 2a str. 301
uaccuucaucccuu

SEQ ID NO: 3912613 - RNA, 13 nt, Shigella flexneri 2a str. 301
uaccuucauuugc

SEQ ID NO: 3912614 - RNA, 15 nt, Shigella flexneri 2a str. 301
uaccuucauuugcca

SEQ ID NO: 3912615 - RNA, 17 nt, Shigella flexneri 2a str. 301
uaccuuccacaauggca

SEQ ID NO: 3912616 - RNA, 23 nt, Shigella flexneri 2a str. 301
uaccuuccggcguaccuuugccu

SEQ ID NO: 3912617 - RNA, 12 nt, Shigella flexneri 2a str. 301
uaccuucuuccc

SEQ ID NO: 3912618 - RNA, 12 nt, Shigella flexneri 2a str. 301
uaccuucuuccu

SEQ ID NO: 3912619 - RNA, 22 nt, Shigella flexneri 2a str. 301
uaccuugcuuauccucuguaaa

SEQ ID NO: 3912620 - RNA, 23 nt, Shigella flexneri 2a str. 301
uacgaaaaaagggcauguucagg

SEQ ID NO: 3912621 - RNA, 18 nt, Shigella flexneri 2a str. 301
uacgaauucuaucaugca

SEQ ID NO: 3912622 - RNA, 16 nt, Shigella flexneri 2a str. 301
uacgacacgccuccug

SEQ ID NO: 3912623 - RNA, 13 nt, Shigella flexneri 2a str. 301
uacgaccagccga

SEQ ID NO: 3912624 - RNA, 16 nt, Shigella flexneri 2a str. 301
uacgaccgcaugcggu

SEQ ID NO: 3912625 - RNA, 23 nt, Shigella flexneri 2a str. 301
uacgacgcuucaguucagcgaua

SEQ ID NO: 3912626 - RNA, 22 nt, Shigella flexneri 2a str. 301
uacgacuuucuccgcauccggc

SEQ ID NO: 3912627 - RNA, 19 nt, Shigella flexneri 2a str. 301
uacgagugcgcucuucaac

SEQ ID NO: 3912628 - RNA, 20 nt, Shigella flexneri 2a str. 301
uacgauaaugccguuuggca

SEQ ID NO: 3912629 - RNA, 22 nt, Shigella flexneri 2a str. 301
uacgaucaagauugauccccgc

SEQ ID NO: 3912630 - RNA, 22 nt, Shigella flexneri 2a str. 301
uacgauccaccaccgcaaaaua

SEQ ID NO: 3912631 - RNA, 23 nt, Shigella flexneri 2a str. 301
uacgauuaacguaaggcgcaaca

SEQ ID NO: 3912632 - RNA, 24 nt, Shigella flexneri 2a str. 301
uacgcaaaaccucuuccagcagau

SEQ ID NO: 3912633 - RNA, 21 nt, Shigella flexneri 2a str. 301
uacgcaaucaaaaucuccugc

SEQ ID NO: 3912634 - RNA, 21 nt, Shigella flexneri 2a str. 301
uacgcaccgcuccaucgccuu

SEQ ID NO: 3912635 - RNA, 15 nt, Shigella flexneri 2a str. 301
uacgcauaaaaccag

SEQ ID NO: 3912636 - RNA, 22 nt, Shigella flexneri 2a str. 301
uacgcauaaaaccagcaaacag

SEQ ID NO: 3912637 - RNA, 20 nt, Shigella flexneri 2a str. 301
uacgcauaucuccauucuga

SEQ ID NO: 3912638 - RNA, 19 nt, Shigella flexneri 2a str. 301
uacgcauaugcaucagauc

SEQ ID NO: 3912639 - RNA, 16 nt, Shigella flexneri 2a str. 301
uacgcauugcucacuu

SEQ ID NO: 3912640 - RNA, 19 nt, Shigella flexneri 2a str. 301
uacuguauacgggcuuuuu

SEQ ID NO: 3912641 - RNA, 22 nt, Shigella flexneri 2a str. 301
uacuguccauagcgauguauuu

SEQ ID NO: 3912642 - RNA, 13 nt, Shigella flexneri 2a str. 301
uacugucggcaau

SEQ ID NO: 3912643 - RNA, 23 nt, Shigella flexneri 2a str. 301
uacugucuccacuauaaaaaaac

SEQ ID NO: 3912644 - RNA, 22 nt, Shigella flexneri 2a str. 301
uacugugaaccucgaucagagu

SEQ ID NO: 3912645 - RNA, 20 nt, Shigella flexneri 2a str. 301
uacuuaaacaguacgagaga

SEQ ID NO: 3912646 - RNA, 14 nt, Shigella flexneri 2a str. 301
uacuuaaugcuguc

SEQ ID NO: 3912647 - RNA, 14 nt, Shigella flexneri 2a str. 301
uacuuaucuuuuac

SEQ ID NO: 3912648 - RNA, 21 nt, Shigella flexneri 2a str. 301
uacuucagcaagcgauaauuu

SEQ ID NO: 3912649 - RNA, 23 nt, Shigella flexneri 2a str. 301
uacuucauaacguuuuuucguca

SEQ ID NO: 3912650 - RNA, 16 nt, Shigella flexneri 2a str. 301
uacuucaucugcuuca

SEQ ID NO: 3912651 - RNA, 15 nt, Shigella flexneri 2a str. 301
uacuucgcaauacgc

SEQ ID NO: 3912652 - RNA, 19 nt, Shigella flexneri 2a str. 301
uacuucucgauaaaccauc

SEQ ID NO: 3912653 - RNA, 16 nt, Shigella flexneri 2a str. 301
uacuucugaacccggu

SEQ ID NO: 3912654 - RNA, 18 nt, Shigella flexneri 2a str. 301
uacuuuauuuauaucagu

SEQ ID NO: 3912655 - RNA, 14 nt, Shigella flexneri 2a str. 301
uacuuucacaaaaa

SEQ ID NO: 3912656 - RNA, 18 nt, Shigella flexneri 2a str. 301
uacuuucacaaaaauaau

SEQ ID NO: 3912657 - RNA, 18 nt, Shigella flexneri 2a str. 301
uacuuuccagccacaguu

SEQ ID NO: 3912658 - RNA, 15 nt, Shigella flexneri 2a str. 301
uacuuuguuauucaa

SEQ ID NO: 3912659 - RNA, 23 nt, Shigella flexneri 2a str. 301
uacuuuugccgaauucauaagaa

SEQ ID NO: 3912660 - RNA, 14 nt, Shigella flexneri 2a str. 301
uacuuuuuccagua

SEQ ID NO: 3912661 - RNA, 13 nt, Shigella flexneri 2a str. 301
uagaaacaaaaaa

SEQ ID NO: 3912662 - RNA, 21 nt, Shigella flexneri 2a str. 301
uagaaacuggcccucgucuuu

SEQ ID NO: 3912663 - RNA, 12 nt, Shigella flexneri 2a str. 301
uagaaagggaag

SEQ ID NO: 3912664 - RNA, 16 nt, Shigella flexneri 2a str. 301
uagaaauuauuucuuu

SEQ ID NO: 3912665 - RNA, 22 nt, Shigella flexneri 2a str. 301
uagaaauuccuaugcaacaacu

SEQ ID NO: 3912666 - RNA, 15 nt, Shigella flexneri 2a str. 301
uagaacaucuuaccu

SEQ ID NO: 3912667 - RNA, 17 nt, Shigella flexneri 2a str. 301
uagaacguaacaguaca

SEQ ID NO: 3912668 - RNA, 18 nt, Shigella flexneri 2a str. 301
uagaacuauaauugcuuu

SEQ ID NO: 3912669 - RNA, 19 nt, Shigella flexneri 2a str. 301
uagaagccauuaaacacca

SEQ ID NO: 3912670 - RNA, 14 nt, Shigella flexneri 2a str. 301
uagaauauuucuau

SEQ ID NO: 3912671 - RNA, 20 nt, Shigella flexneri 2a str. 301
uagaauuguaaucuauugaa

SEQ ID NO: 3912672 - RNA, 15 nt, Shigella flexneri 2a str. 301
uagacaguucuuccu

SEQ ID NO: 3912673 - RNA, 17 nt, Shigella flexneri 2a str. 301
uagacaguuugccuuca

SEQ ID NO: 3912674 - RNA, 12 nt, Shigella flexneri 2a str. 301
uagaccagagcu

SEQ ID NO: 3912675 - RNA, 14 nt, Shigella flexneri 2a str. 301
uagaccugauacau

SEQ ID NO: 3912676 - RNA, 16 nt, Shigella flexneri 2a str. 301
uagaccugauacauag

SEQ ID NO: 3912677 - RNA, 20 nt, Shigella flexneri 2a str. 301
uagacgaacguuuaauaaaa

SEQ ID NO: 3912678 - RNA, 15 nt, Shigella flexneri 2a str. 301
uagacgaugaaaaag

SEQ ID NO: 3912679 - RNA, 16 nt, Shigella flexneri 2a str. 301
uagacgcuuucacccg

SEQ ID NO: 3912680 - RNA, 16 nt, Shigella flexneri 2a str. 301
uagacguucaguuccg

SEQ ID NO: 3912681 - RNA, 19 nt, Shigella flexneri 2a str. 301
uagacugcagcggucacau

SEQ ID NO: 3912682 - RNA, 17 nt, Shigella flexneri 2a str. 301
uagacuuuagucaucag

SEQ ID NO: 3912683 - RNA, 22 nt, Shigella flexneri 2a str. 301
uagagaaaguaaaccaccaguc

SEQ ID NO: 3912684 - RNA, 17 nt, Shigella flexneri 2a str. 301
uagagacuuuuccagcc

SEQ ID NO: 3912685 - RNA, 21 nt, Shigella flexneri 2a str. 301
uagagaucucucuugcuauca

SEQ ID NO: 3912686 - RNA, 15 nt, Shigella flexneri 2a str. 301
uagagcaaccaccug

SEQ ID NO: 3912687 - RNA, 21 nt, Shigella flexneri 2a str. 301
uagagcacaucacucauaaug

SEQ ID NO: 3912688 - RNA, 21 nt, Shigella flexneri 2a str. 301
uagagcgcggcgcaggcaaua

SEQ ID NO: 3912689 - RNA, 15 nt, Shigella flexneri 2a str. 301
uagaggaauggcaga

SEQ ID NO: 3912690 - RNA, 18 nt, Shigella flexneri 2a str. 301
uagaggcguuccugcaac

SEQ ID NO: 3912691 - RNA, 17 nt, Shigella flexneri 2a str. 301
uagaggucauuaggcca

SEQ ID NO: 3912692 - RNA, 17 nt, Shigella flexneri 2a str. 301
uagagguuauaaauaaa

SEQ ID NO: 3912693 - RNA, 19 nt, Shigella flexneri 2a str. 301
uagagugguuagagcacag

SEQ ID NO: 3912694 - RNA, 15 nt, Shigella flexneri 2a str. 301
uagaguuugaacuca

SEQ ID NO: 3912695 - RNA, 15 nt, Shigella flexneri 2a str. 301
uagauaaucgcuuuc

SEQ ID NO: 3912696 - RNA, 22 nt, Shigella flexneri 2a str. 301
uagauacccggauacaacucgc

SEQ ID NO: 3912697 - RNA, 13 nt, Shigella flexneri 2a str. 301
uagauagcguucu

SEQ ID NO: 3912698 - RNA, 16 nt, Shigella flexneri 2a str. 301
uagauagcguucuuua

SEQ ID NO: 3912699 - RNA, 14 nt, Shigella flexneri 2a str. 301
uagauaucaugcuc

SEQ ID NO: 3912700 - RNA, 14 nt, Shigella flexneri 2a str. 301
uagauauucuccag

SEQ ID NO: 3912701 - RNA, 15 nt, Shigella flexneri 2a str. 301
uagaucuaaaugcca

SEQ ID NO: 3912702 - RNA, 21 nt, Shigella flexneri 2a str. 301
uagaugaucgccgcacuuucu

SEQ ID NO: 3912703 - RNA, 18 nt, Shigella flexneri 2a str. 301
uagaugugcaguuccugc

SEQ ID NO: 3912704 - RNA, 19 nt, Shigella flexneri 2a str. 301
uagaugugggcaaucucac

SEQ ID NO: 3912705 - RNA, 14 nt, Shigella flexneri 2a str. 301
uagauucaacauaa

SEQ ID NO: 3912706 - RNA, 13 nt, Shigella flexneri 2a str. 301
uagauuuuuaaug

SEQ ID NO: 3912707 - RNA, 12 nt, Shigella flexneri 2a str. 301
uagcaaaacaau

SEQ ID NO: 3912708 - RNA, 13 nt, Shigella flexneri 2a str. 301
uagcaaaacaauu

SEQ ID NO: 3912709 - RNA, 20 nt, Shigella flexneri 2a str. 301
uagcaaaguaauaaugauca

SEQ ID NO: 3912710 - RNA, 23 nt, Shigella flexneri 2a str. 301
uagcaaauuaucccccagcacuu

SEQ ID NO: 3912711 - RNA, 15 nt, Shigella flexneri 2a str. 301
uagcaacagcagcca

SEQ ID NO: 3912712 - RNA, 19 nt, Shigella flexneri 2a str. 301
uagcaaccaaaaaaagaau

SEQ ID NO: 3912713 - RNA, 14 nt, Shigella flexneri 2a str. 301
uagcaauauuuugu

SEQ ID NO: 3912714 - RNA, 21 nt, Shigella flexneri 2a str. 301
uagcaauauuuuuaugccgga

SEQ ID NO: 3912715 - RNA, 22 nt, Shigella flexneri 2a str. 301
uagcaauccuugaguuucgucu

SEQ ID NO: 3912716 - RNA, 19 nt, Shigella flexneri 2a str. 301
uagcacaaaaauagcccca

SEQ ID NO: 3912717 - RNA, 18 nt, Shigella flexneri 2a str. 301
uagcacacggauauugcu

SEQ ID NO: 3912718 - RNA, 19 nt, Shigella flexneri 2a str. 301
uagcacuguaaaccucuuu

SEQ ID NO: 3912719 - RNA, 19 nt, Shigella flexneri 2a str. 301
uagcacuuuucgucaggau

SEQ ID NO: 3912720 - RNA, 14 nt, Shigella flexneri 2a str. 301
uagcagaaaacuca

SEQ ID NO: 3912721 - RNA, 18 nt, Shigella flexneri 2a str. 301
uagcagcuuucagcagcg

SEQ ID NO: 3912722 - RNA, 20 nt, Shigella flexneri 2a str. 301
uagcaguaauugcagcagcu

SEQ ID NO: 3912723 - RNA, 17 nt, Shigella flexneri 2a str. 301
uagcaguuccagcaucu

SEQ ID NO: 3912724 - RNA, 15 nt, Shigella flexneri 2a str. 301
uagcauaaaaacucg

SEQ ID NO: 3912725 - RNA, 14 nt, Shigella flexneri 2a str. 301
uagcaucagcgcca

SEQ ID NO: 3912726 - RNA, 21 nt, Shigella flexneri 2a str. 301
uagcauccaccacaucgcaaa

SEQ ID NO: 3912727 - RNA, 12 nt, Shigella flexneri 2a str. 301
uagcaucccaau

SEQ ID NO: 3912728 - RNA, 16 nt, Shigella flexneri 2a str. 301
uagcaucgcgauggca

SEQ ID NO: 3912729 - RNA, 21 nt, Shigella flexneri 2a str. 301
uagcaucuuaucacgaugcua

SEQ ID NO: 3912730 - RNA, 21 nt, Shigella flexneri 2a str. 301
uagcauugaugcguuagauga

SEQ ID NO: 3912731 - RNA, 18 nt, Shigella flexneri 2a str. 301
uagccaaagcaccacucc

SEQ ID NO: 3912732 - RNA, 22 nt, Shigella flexneri 2a str. 301
uagccaaagcaccacuccucaa

SEQ ID NO: 3912733 - RNA, 18 nt, Shigella flexneri 2a str. 301
uagccaaucauucccauu

SEQ ID NO: 3912734 - RNA, 20 nt, Shigella flexneri 2a str. 301
uagccagaaugccgcaaaac

SEQ ID NO: 3912735 - RNA, 12 nt, Shigella flexneri 2a str. 301
uagccagcagag

SEQ ID NO: 3912736 - RNA, 13 nt, Shigella flexneri 2a str. 301
uagccagcagagc

SEQ ID NO: 3912737 - RNA, 12 nt, Shigella flexneri 2a str. 301
uagccaucugcc

SEQ ID NO: 3912738 - RNA, 20 nt, Shigella flexneri 2a str. 301
uagcccugucgaggccaauu

SEQ ID NO: 3912739 - RNA, 19 nt, Shigella flexneri 2a str. 301
uagcccuuuguaggccaga

SEQ ID NO: 3912740 - RNA, 16 nt, Shigella flexneri 2a str. 301
uaguuaaacuuucaua

SEQ ID NO: 3912741 - RNA, 17 nt, Shigella flexneri 2a str. 301
uaguuagccggagaaau

SEQ ID NO: 3912742 - RNA, 20 nt, Shigella flexneri 2a str. 301
uaguuagcguugucaauacu

SEQ ID NO: 3912743 - RNA, 14 nt, Shigella flexneri 2a str. 301
uaguucaacagauu

SEQ ID NO: 3912744 - RNA, 13 nt, Shigella flexneri 2a str. 301
uaguucauccccu

SEQ ID NO: 3912745 - RNA, 16 nt, Shigella flexneri 2a str. 301
uaguucauccccucuu

SEQ ID NO: 3912746 - RNA, 18 nt, Shigella flexneri 2a str. 301
uaguucauccccucuucc

SEQ ID NO: 3912747 - RNA, 19 nt, Shigella flexneri 2a str. 301
uaguucauccccucuucca

SEQ ID NO: 3912748 - RNA, 19 nt, Shigella flexneri 2a str. 301
uaguugcauuccaguccac

SEQ ID NO: 3912749 - RNA, 19 nt, Shigella flexneri 2a str. 301
uaguugcugucgacaaagc

SEQ ID NO: 3912750 - RNA, 19 nt, Shigella flexneri 2a str. 301
uaguuucguucgccguuuu

SEQ ID NO: 3912751 - RNA, 14 nt, Shigella flexneri 2a str. 301
uaguuugauaauuu

SEQ ID NO: 3912752 - RNA, 19 nt, Shigella flexneri 2a str. 301
uaguuuuauacucagucag

SEQ ID NO: 3912753 - RNA, 13 nt, Shigella flexneri 2a str. 301
uauaaacaacggc

SEQ ID NO: 3912754 - RNA, 17 nt, Shigella flexneri 2a str. 301
uauaaaccugagaaccu

SEQ ID NO: 3912755 - RNA, 13 nt, Shigella flexneri 2a str. 301
uauaaauaaaaau

SEQ ID NO: 3912756 - RNA, 23 nt, Shigella flexneri 2a str. 301
uauaaauagcggcuguuaccuuu

SEQ ID NO: 3912757 - RNA, 19 nt, Shigella flexneri 2a str. 301
uauaaauuacccuuuauuu

SEQ ID NO: 3912758 - RNA, 16 nt, Shigella flexneri 2a str. 301
uauaacagucauacaa

SEQ ID NO: 3912759 - RNA, 16 nt, Shigella flexneri 2a str. 301
uauaaccgccauagaa

SEQ ID NO: 3912760 - RNA, 20 nt, Shigella flexneri 2a str. 301
uauaaccggcaacagaacgc

SEQ ID NO: 3912761 - RNA, 16 nt, Shigella flexneri 2a str. 301
uauaaccugaauauua

SEQ ID NO: 3912762 - RNA, 12 nt, Shigella flexneri 2a str. 301
uauaagcucaau

SEQ ID NO: 3912763 - RNA, 18 nt, Shigella flexneri 2a str. 301
uauaaguggcgcucucaa

SEQ ID NO: 3912764 - RNA, 12 nt, Shigella flexneri 2a str. 301
uauaauacgcuu

SEQ ID NO: 3912765 - RNA, 12 nt, Shigella flexneri 2a str. 301
uauaauaucuuu

SEQ ID NO: 3912766 - RNA, 23 nt, Shigella flexneri 2a str. 301
uauaauaucuuuucuuaacaaaa

SEQ ID NO: 3912767 - RNA, 17 nt, Shigella flexneri 2a str. 301
uauaaucacucaaaaua

SEQ ID NO: 3912768 - RNA, 14 nt, Shigella flexneri 2a str. 301
uauaaugacugccc

SEQ ID NO: 3912769 - RNA, 12 nt, Shigella flexneri 2a str. 301
uauaauuauugc

SEQ ID NO: 3912770 - RNA, 18 nt, Shigella flexneri 2a str. 301
uauaauugaccagaucuu

SEQ ID NO: 3912771 - RNA, 18 nt, Shigella flexneri 2a str. 301
uauaauugcuuuuuucca

SEQ ID NO: 3912772 - RNA, 16 nt, Shigella flexneri 2a str. 301
uauaauugguauucug

SEQ ID NO: 3912773 - RNA, 22 nt, Shigella flexneri 2a str. 301
uauacacgaggcauauaggucu

SEQ ID NO: 3912774 - RNA, 17 nt, Shigella flexneri 2a str. 301
uauacagacucaaacca

SEQ ID NO: 3912775 - RNA, 19 nt, Shigella flexneri 2a str. 301
uauacagccuuaacaagau

SEQ ID NO: 3912776 - RNA, 17 nt, Shigella flexneri 2a str. 301
uauacaucgcuuuccag

SEQ ID NO: 3912777 - RNA, 18 nt, Shigella flexneri 2a str. 301
uauacaucgcuuuccagg

SEQ ID NO: 3912778 - RNA, 15 nt, Shigella flexneri 2a str. 301
uauacccuucucagc

SEQ ID NO: 3912779 - RNA, 18 nt, Shigella flexneri 2a str. 301
uauacccuucucagcagu

SEQ ID NO: 3912780 - RNA, 23 nt, Shigella flexneri 2a str. 301
uauacggauagcagaaaacucac

SEQ ID NO: 3912781 - RNA, 17 nt, Shigella flexneri 2a str. 301
uauacgucccggugaag

SEQ ID NO: 3912782 - RNA, 14 nt, Shigella flexneri 2a str. 301
uauacgucggguua

SEQ ID NO: 3912783 - RNA, 16 nt, Shigella flexneri 2a str. 301
uauacuccugaugguc

SEQ ID NO: 3912784 - RNA, 19 nt, Shigella flexneri 2a str. 301
uauagauuuacuauuauuu

SEQ ID NO: 3912785 - RNA, 15 nt, Shigella flexneri 2a str. 301
uauagcacccgccag

SEQ ID NO: 3912786 - RNA, 20 nt, Shigella flexneri 2a str. 301
uauagcgcugaauuaguguu

SEQ ID NO: 3912787 - RNA, 16 nt, Shigella flexneri 2a str. 301
uauagcgggaaauacu

SEQ ID NO: 3912788 - RNA, 17 nt, Shigella flexneri 2a str. 301
uauagcggggaacauca

SEQ ID NO: 3912789 - RNA, 22 nt, Shigella flexneri 2a str. 301
uauagcguugcccgauugguuc

SEQ ID NO: 3912790 - RNA, 14 nt, Shigella flexneri 2a str. 301
uauagcuuauucuu

SEQ ID NO: 3912791 - RNA, 19 nt, Shigella flexneri 2a str. 301
uauauaaaaaaacaaugcg

SEQ ID NO: 3912792 - RNA, 13 nt, Shigella flexneri 2a str. 301
uauauaaauuacc

SEQ ID NO: 3912793 - RNA, 14 nt, Shigella flexneri 2a str. 301
uauauaauuaaaaa

SEQ ID NO: 3912794 - RNA, 15 nt, Shigella flexneri 2a str. 301
uauauaauuaaaaau

SEQ ID NO: 3912795 - RNA, 18 nt, Shigella flexneri 2a str. 301
uauauaauuaaaaauagu

SEQ ID NO: 3912796 - RNA, 21 nt, Shigella flexneri 2a str. 301
uauauauuaaucaucauuaau

SEQ ID NO: 3912797 - RNA, 23 nt, Shigella flexneri 2a str. 301
uauauauucucugagaauaaaua

SEQ ID NO: 3912798 - RNA, 13 nt, Shigella flexneri 2a str. 301
uauaucagugaua

SEQ ID NO: 3912799 - RNA, 14 nt, Shigella flexneri 2a str. 301
uauaucccauuuuu

SEQ ID NO: 3912800 - RNA, 17 nt, Shigella flexneri 2a str. 301
uauaucccauuuuugaa

SEQ ID NO: 3912801 - RNA, 17 nt, Shigella flexneri 2a str. 301
uauauccgaaaaaggau

SEQ ID NO: 3912802 - RNA, 16 nt, Shigella flexneri 2a str. 301
uauaucgcaagucauu

SEQ ID NO: 3912803 - RNA, 19 nt, Shigella flexneri 2a str. 301
uauaucucagauaaaugca

SEQ ID NO: 3912804 - RNA, 18 nt, Shigella flexneri 2a str. 301
uauaugauaauuauuaua

SEQ ID NO: 3912805 - RNA, 17 nt, Shigella flexneri 2a str. 301
uauaugaugaaacugau

SEQ ID NO: 3912806 - RNA, 22 nt, Shigella flexneri 2a str. 301
uauauugaauuagcaauauuuu

SEQ ID NO: 3912807 - RNA, 16 nt, Shigella flexneri 2a str. 301
uauauugaauuugcau

SEQ ID NO: 3912808 - RNA, 22 nt, Shigella flexneri 2a str. 301
uauauugggaucaaaaauguca

SEQ ID NO: 3912809 - RNA, 13 nt, Shigella flexneri 2a str. 301
uauauuuuuaaau

SEQ ID NO: 3912810 - RNA, 20 nt, Shigella flexneri 2a str. 301
uauauuuuuaaauauaaaac

SEQ ID NO: 3912811 - RNA, 15 nt, Shigella flexneri 2a str. 301
uaucaaacccuucca

SEQ ID NO: 3912812 - RNA, 15 nt, Shigella flexneri 2a str. 301
uaucaaacugaccuu

SEQ ID NO: 3912813 - RNA, 16 nt, Shigella flexneri 2a str. 301
uaucaaauucauugcg

SEQ ID NO: 3912814 - RNA, 19 nt, Shigella flexneri 2a str. 301
uaucaacuagcuguuguaa

SEQ ID NO: 3912815 - RNA, 21 nt, Shigella flexneri 2a str. 301
uaucaagccauagcgccguag

SEQ ID NO: 3912816 - RNA, 14 nt, Shigella flexneri 2a str. 301
uaucaaucaccgcu

SEQ ID NO: 3912817 - RNA, 17 nt, Shigella flexneri 2a str. 301
uaucaaucuucucuucc

SEQ ID NO: 3912818 - RNA, 22 nt, Shigella flexneri 2a str. 301
uaucaauuaacugugccagcgu

SEQ ID NO: 3912819 - RNA, 20 nt, Shigella flexneri 2a str. 301
uaucaauuagauuuaauaac

SEQ ID NO: 3912820 - RNA, 23 nt, Shigella flexneri 2a str. 301
uaucaccaaugauaaguuucacu

SEQ ID NO: 3912821 - RNA, 19 nt, Shigella flexneri 2a str. 301
uaucacccuuuucugccgc

SEQ ID NO: 3912822 - RNA, 19 nt, Shigella flexneri 2a str. 301
uaucacgaugcuaaaaaca

SEQ ID NO: 3912823 - RNA, 22 nt, Shigella flexneri 2a str. 301
uaucacgaugcuaaaaacauca

SEQ ID NO: 3912824 - RNA, 14 nt, Shigella flexneri 2a str. 301
uaucacgccaccag

SEQ ID NO: 3912825 - RNA, 15 nt, Shigella flexneri 2a str. 301
uaucacgccaccagc

SEQ ID NO: 3912826 - RNA, 21 nt, Shigella flexneri 2a str. 301
uaucacucggggcuuuucucu

SEQ ID NO: 3912827 - RNA, 13 nt, Shigella flexneri 2a str. 301
uaucacucugccg

SEQ ID NO: 3912828 - RNA, 13 nt, Shigella flexneri 2a str. 301
uaucagacaccag

SEQ ID NO: 3912829 - RNA, 14 nt, Shigella flexneri 2a str. 301
uaucagaccgcuuc

SEQ ID NO: 3912830 - RNA, 20 nt, Shigella flexneri 2a str. 301
uaucagagauaaccacguuc

SEQ ID NO: 3912831 - RNA, 17 nt, Shigella flexneri 2a str. 301
uaucagagauucuuuuc

SEQ ID NO: 3912832 - RNA, 21 nt, Shigella flexneri 2a str. 301
uaucagagauucuuuuccuuu

SEQ ID NO: 3912833 - RNA, 17 nt, Shigella flexneri 2a str. 301
uaucagauuggcuucau

SEQ ID NO: 3912834 - RNA, 14 nt, Shigella flexneri 2a str. 301
uaucagcaacucug

SEQ ID NO: 3912835 - RNA, 21 nt, Shigella flexneri 2a str. 301
uaucaggcauucuuuuucauu

SEQ ID NO: 3912836 - RNA, 20 nt, Shigella flexneri 2a str. 301
uaucaggccaauugaacucu

SEQ ID NO: 3912837 - RNA, 14 nt, Shigella flexneri 2a str. 301
uaucaggccuacaa

SEQ ID NO: 3912838 - RNA, 17 nt, Shigella flexneri 2a str. 301
uaucaggccuacaaugu

SEQ ID NO: 3912839 - RNA, 20 nt, Shigella flexneri 2a str. 301
uaucagggagucuugcugga

SEQ ID NO: 3912840 - RNA, 16 nt, Shigella flexneri 2a str. 301
uaugacguaucaccga

SEQ ID NO: 3912841 - RNA, 12 nt, Shigella flexneri 2a str. 301
uaugacuacauc

SEQ ID NO: 3912842 - RNA, 18 nt, Shigella flexneri 2a str. 301
uaugaggcacuaaggcga

SEQ ID NO: 3912843 - RNA, 15 nt, Shigella flexneri 2a str. 301
uaugauauuuuuuua

SEQ ID NO: 3912844 - RNA, 12 nt, Shigella flexneri 2a str. 301
uaugaucgccac

SEQ ID NO: 3912845 - RNA, 18 nt, Shigella flexneri 2a str. 301
uaugaugcgacuugucau

SEQ ID NO: 3912846 - RNA, 13 nt, Shigella flexneri 2a str. 301
uaugauugccuga

SEQ ID NO: 3912847 - RNA, 14 nt, Shigella flexneri 2a str. 301
uaugauuuaaaaaa

SEQ ID NO: 3912848 - RNA, 13 nt, Shigella flexneri 2a str. 301
uaugauuuuccug

SEQ ID NO: 3912849 - RNA, 23 nt, Shigella flexneri 2a str. 301
uaugcaacaacugaaaaaaaauu

SEQ ID NO: 3912850 - RNA, 16 nt, Shigella flexneri 2a str. 301
uaugcaagauguuaau

SEQ ID NO: 3912851 - RNA, 21 nt, Shigella flexneri 2a str. 301
uaugccacgugagcuuuucug

SEQ ID NO: 3912852 - RNA, 24 nt, Shigella flexneri 2a str. 301
uaugccacgugagcuuuucugcuu

SEQ ID NO: 3912853 - RNA, 22 nt, Shigella flexneri 2a str. 301
uaugccaugcgauggcggcagc

SEQ ID NO: 3912854 - RNA, 14 nt, Shigella flexneri 2a str. 301
uaugcccagcgcag

SEQ ID NO: 3912855 - RNA, 16 nt, Shigella flexneri 2a str. 301
uaugccgaucaucauc

SEQ ID NO: 3912856 - RNA, 15 nt, Shigella flexneri 2a str. 301
uaugccggaugcgga

SEQ ID NO: 3912857 - RNA, 15 nt, Shigella flexneri 2a str. 301
uaugccguaaaagua

SEQ ID NO: 3912858 - RNA, 13 nt, Shigella flexneri 2a str. 301
uaugccucuuuca

SEQ ID NO: 3912859 - RNA, 14 nt, Shigella flexneri 2a str. 301
uaugccucuuucag

SEQ ID NO: 3912860 - RNA, 17 nt, Shigella flexneri 2a str. 301
uaugccuguccucuuca

SEQ ID NO: 3912861 - RNA, 19 nt, Shigella flexneri 2a str. 301
uaugcgaccauaugaauau

SEQ ID NO: 3912862 - RNA, 17 nt, Shigella flexneri 2a str. 301
uaugcgcggcauacagc

SEQ ID NO: 3912863 - RNA, 21 nt, Shigella flexneri 2a str. 301
uaugcggugccauuaaaccaa

SEQ ID NO: 3912864 - RNA, 23 nt, Shigella flexneri 2a str. 301
uaugcugaaucgccaaaaacaua

SEQ ID NO: 3912865 - RNA, 15 nt, Shigella flexneri 2a str. 301
uaugcugcgccaguu

SEQ ID NO: 3912866 - RNA, 17 nt, Shigella flexneri 2a str. 301
uaugcuguccuaaaaaa

SEQ ID NO: 3912867 - RNA, 19 nt, Shigella flexneri 2a str. 301
uauggaaaaguugcuuugg

SEQ ID NO: 3912868 - RNA, 14 nt, Shigella flexneri 2a str. 301
uauggaaagcggcu

SEQ ID NO: 3912869 - RNA, 15 nt, Shigella flexneri 2a str. 301
uauggagcaggaaua

SEQ ID NO: 3912870 - RNA, 21 nt, Shigella flexneri 2a str. 301
uauggcaaucuuccucgccag

SEQ ID NO: 3912871 - RNA, 17 nt, Shigella flexneri 2a str. 301
uauggcaccuguugcca

SEQ ID NO: 3912872 - RNA, 15 nt, Shigella flexneri 2a str. 301
uauggcauugucuga

SEQ ID NO: 3912873 - RNA, 13 nt, Shigella flexneri 2a str. 301
uauggcucgccau

SEQ ID NO: 3912874 - RNA, 18 nt, Shigella flexneri 2a str. 301
uauggcuguuggugaaca

SEQ ID NO: 3912875 - RNA, 18 nt, Shigella flexneri 2a str. 301
uauggucggguuuacgug

SEQ ID NO: 3912876 - RNA, 16 nt, Shigella flexneri 2a str. 301
uauguaagcagaaaag

SEQ ID NO: 3912877 - RNA, 14 nt, Shigella flexneri 2a str. 301
uaugucauuaaccg

SEQ ID NO: 3912878 - RNA, 16 nt, Shigella flexneri 2a str. 301
uaugucguuauauaaa

SEQ ID NO: 3912879 - RNA, 18 nt, Shigella flexneri 2a str. 301
uaugucuggcgagcucca

SEQ ID NO: 3912880 - RNA, 14 nt, Shigella flexneri 2a str. 301
uaugugaaauuuau

SEQ ID NO: 3912881 - RNA, 19 nt, Shigella flexneri 2a str. 301
uaugugacuggaaaucaaa

SEQ ID NO: 3912882 - RNA, 23 nt, Shigella flexneri 2a str. 301
uauguuauagaguacuugcuaca

SEQ ID NO: 3912883 - RNA, 15 nt, Shigella flexneri 2a str. 301
uauguucagauaaug

SEQ ID NO: 3912884 - RNA, 22 nt, Shigella flexneri 2a str. 301
uauguucagauaaugcccgaug

SEQ ID NO: 3912885 - RNA, 22 nt, Shigella flexneri 2a str. 301
uauguucaggauauuuauauuu

SEQ ID NO: 3912886 - RNA, 13 nt, Shigella flexneri 2a str. 301
uauguuuaucagg

SEQ ID NO: 3912887 - RNA, 15 nt, Shigella flexneri 2a str. 301
uauguuuauuagccc

SEQ ID NO: 3912888 - RNA, 23 nt, Shigella flexneri 2a str. 301
uauuaaaagcguugcggcuauau

SEQ ID NO: 3912889 - RNA, 13 nt, Shigella flexneri 2a str. 301
uauuaaaccaccc

SEQ ID NO: 3912890 - RNA, 18 nt, Shigella flexneri 2a str. 301
uauuaacgaacucuuugc

SEQ ID NO: 3912891 - RNA, 21 nt, Shigella flexneri 2a str. 301
uauuaagcagacggcucaucu

SEQ ID NO: 3912892 - RNA, 18 nt, Shigella flexneri 2a str. 301
uauuaaggguaaaaggau

SEQ ID NO: 3912893 - RNA, 15 nt, Shigella flexneri 2a str. 301
uauuaauucuaaaac

SEQ ID NO: 3912894 - RNA, 23 nt, Shigella flexneri 2a str. 301
uauuacguggguaggaucagaau

SEQ ID NO: 3912895 - RNA, 15 nt, Shigella flexneri 2a str. 301
uauuacguuccuuua

SEQ ID NO: 3912896 - RNA, 12 nt, Shigella flexneri 2a str. 301
uauuacugcaac

SEQ ID NO: 3912897 - RNA, 20 nt, Shigella flexneri 2a str. 301
uauuacugcguauuuccugc

SEQ ID NO: 3912898 - RNA, 20 nt, Shigella flexneri 2a str. 301
uauuagccgccagcucuuua

SEQ ID NO: 3912899 - RNA, 20 nt, Shigella flexneri 2a str. 301
uauuagcgcaaucagagaua

SEQ ID NO: 3912900 - RNA, 14 nt, Shigella flexneri 2a str. 301
uauuaguacucauu

SEQ ID NO: 3912901 - RNA, 17 nt, Shigella flexneri 2a str. 301
uauuaguggcaaccaca

SEQ ID NO: 3912902 - RNA, 13 nt, Shigella flexneri 2a str. 301
uauuauauauaau

SEQ ID NO: 3912903 - RNA, 14 nt, Shigella flexneri 2a str. 301
uauuauauauaauu

SEQ ID NO: 3912904 - RNA, 16 nt, Shigella flexneri 2a str. 301
uauuaucuaucgcguu

SEQ ID NO: 3912905 - RNA, 20 nt, Shigella flexneri 2a str. 301
uauuaucugaucaauauaga

SEQ ID NO: 3912906 - RNA, 19 nt, Shigella flexneri 2a str. 301
uauuaucuucaucgauacu

SEQ ID NO: 3912907 - RNA, 21 nt, Shigella flexneri 2a str. 301
uauuaugcgaccauaugaaua

SEQ ID NO: 3912908 - RNA, 18 nt, Shigella flexneri 2a str. 301
uauuauucauaaugccca

SEQ ID NO: 3912909 - RNA, 13 nt, Shigella flexneri 2a str. 301
uauucaaaggcuc

SEQ ID NO: 3912910 - RNA, 16 nt, Shigella flexneri 2a str. 301
uauucaacgucacugg

SEQ ID NO: 3912911 - RNA, 14 nt, Shigella flexneri 2a str. 301
uauucacccgaaua

SEQ ID NO: 3912912 - RNA, 20 nt, Shigella flexneri 2a str. 301
uauucacgaaucuauucauu

SEQ ID NO: 3912913 - RNA, 22 nt, Shigella flexneri 2a str. 301
uauucacgaaucuauucauuua

SEQ ID NO: 3912914 - RNA, 21 nt, Shigella flexneri 2a str. 301
uauucacuacggucacgccac

SEQ ID NO: 3912915 - RNA, 21 nt, Shigella flexneri 2a str. 301
uauucagcaauucucucuuca

SEQ ID NO: 3912916 - RNA, 11 nt, Shigella flexneri 2a str. 301
uauucagcaga

SEQ ID NO: 3912917 - RNA, 12 nt, Shigella flexneri 2a str. 301
uauucagcagca

SEQ ID NO: 3912918 - RNA, 14 nt, Shigella flexneri 2a str. 301
uauucauaaaugcu

SEQ ID NO: 3912919 - RNA, 14 nt, Shigella flexneri 2a str. 301
uauucauugacuua

SEQ ID NO: 3912920 - RNA, 18 nt, Shigella flexneri 2a str. 301
uauucauuguucucccau

SEQ ID NO: 3912921 - RNA, 14 nt, Shigella flexneri 2a str. 301
uauuccauccugcu

SEQ ID NO: 3912922 - RNA, 17 nt, Shigella flexneri 2a str. 301
uauuccauccugcucaa

SEQ ID NO: 3912923 - RNA, 11 nt, Shigella flexneri 2a str. 301
uauuccccaga

SEQ ID NO: 3912924 - RNA, 20 nt, Shigella flexneri 2a str. 301
uauucccguauuacugagau

SEQ ID NO: 3912925 - RNA, 15 nt, Shigella flexneri 2a str. 301
uauucccguuuucuu

SEQ ID NO: 3912926 - RNA, 14 nt, Shigella flexneri 2a str. 301
uauucccuugcucu

SEQ ID NO: 3912927 - RNA, 19 nt, Shigella flexneri 2a str. 301
uauuccgcgugaaaugcca

SEQ ID NO: 3912928 - RNA, 23 nt, Shigella flexneri 2a str. 301
uauuccggcgugacgaucaccac

SEQ ID NO: 3912929 - RNA, 15 nt, Shigella flexneri 2a str. 301
uauuccuuuaucauu

SEQ ID NO: 3912930 - RNA, 21 nt, Shigella flexneri 2a str. 301
uauucgcgcagaacauaaaaa

SEQ ID NO: 3912931 - RNA, 18 nt, Shigella flexneri 2a str. 301
uauucgcucgccacuucu

SEQ ID NO: 3912932 - RNA, 15 nt, Shigella flexneri 2a str. 301
uauucgcugauuuuu

SEQ ID NO: 3912933 - RNA, 17 nt, Shigella flexneri 2a str. 301
uauucuggguaguccau

SEQ ID NO: 3912934 - RNA, 17 nt, Shigella flexneri 2a str. 301
uauucuuacuucaacac

SEQ ID NO: 3912935 - RNA, 17 nt, Shigella flexneri 2a str. 301
uauucuuauuaaauugu

SEQ ID NO: 3912936 - RNA, 23 nt, Shigella flexneri 2a str. 301
uauucuugcugauacuccucauu

SEQ ID NO: 3912937 - RNA, 15 nt, Shigella flexneri 2a str. 301
uauugaaaucacuaa

SEQ ID NO: 3912938 - RNA, 16 nt, Shigella flexneri 2a str. 301
uauugaagauuuugcu

SEQ ID NO: 3912939 - RNA, 22 nt, Shigella flexneri 2a str. 301
uauugaauuuacgggccggaua

SEQ ID NO: 3912940 - RNA, 14 nt, Shigella flexneri 2a str. 301
ucaaaguaauauuc

SEQ ID NO: 3912941 - RNA, 14 nt, Shigella flexneri 2a str. 301
ucaaaguaaucaag

SEQ ID NO: 3912942 - RNA, 21 nt, Shigella flexneri 2a str. 301
ucaaaguaauuuuugaagguu

SEQ ID NO: 3912943 - RNA, 19 nt, Shigella flexneri 2a str. 301
ucaaagucgagaugaaacu

SEQ ID NO: 3912944 - RNA, 18 nt, Shigella flexneri 2a str. 301
ucaaauaacggcaacggu

SEQ ID NO: 3912945 - RNA, 12 nt, Shigella flexneri 2a str. 301
ucaaauacccuu

SEQ ID NO: 3912946 - RNA, 17 nt, Shigella flexneri 2a str. 301
ucaaauaucuauauaca

SEQ ID NO: 3912947 - RNA, 20 nt, Shigella flexneri 2a str. 301
ucaaaucaacaaccugcauu

SEQ ID NO: 3912948 - RNA, 21 nt, Shigella flexneri 2a str. 301
ucaaaucaacaaccugcauuu

SEQ ID NO: 3912949 - RNA, 23 nt, Shigella flexneri 2a str. 301
ucaaaucaccauauucagcagca

SEQ ID NO: 3912950 - RNA, 14 nt, Shigella flexneri 2a str. 301
ucaaaugaaugcca

SEQ ID NO: 3912951 - RNA, 21 nt, Shigella flexneri 2a str. 301
ucaaaugaccgcgcuggcaau

SEQ ID NO: 3912952 - RNA, 21 nt, Shigella flexneri 2a str. 301
ucaaaugcugcggaucaaucg

SEQ ID NO: 3912953 - RNA, 23 nt, Shigella flexneri 2a str. 301
ucaaauggcauccuugcuaacca

SEQ ID NO: 3912954 - RNA, 21 nt, Shigella flexneri 2a str. 301
ucaaauguugcguucaucagu

SEQ ID NO: 3912955 - RNA, 19 nt, Shigella flexneri 2a str. 301
ucaaauuacgauccaccac

SEQ ID NO: 3912956 - RNA, 23 nt, Shigella flexneri 2a str. 301
ucaaauuugucgccaacuucaug

SEQ ID NO: 3912957 - RNA, 11 nt, Shigella flexneri 2a str. 301
ucaacaaacca

SEQ ID NO: 3912958 - RNA, 13 nt, Shigella flexneri 2a str. 301
ucaacaaaccaaa

SEQ ID NO: 3912959 - RNA, 19 nt, Shigella flexneri 2a str. 301
ucaacaaaguugcacacuu

SEQ ID NO: 3912960 - RNA, 21 nt, Shigella flexneri 2a str. 301
ucaacaaauucuggcaccacc

SEQ ID NO: 3912961 - RNA, 16 nt, Shigella flexneri 2a str. 301
ucaacaacaauuucac

SEQ ID NO: 3912962 - RNA, 17 nt, Shigella flexneri 2a str. 301
ucaacaaccagaaggug

SEQ ID NO: 3912963 - RNA, 19 nt, Shigella flexneri 2a str. 301
ucaacaagcaaauguuaau

SEQ ID NO: 3912964 - RNA, 18 nt, Shigella flexneri 2a str. 301
ucaacaauacaaaugccu

SEQ ID NO: 3912965 - RNA, 17 nt, Shigella flexneri 2a str. 301
ucaacaccaugacaaau

SEQ ID NO: 3912966 - RNA, 19 nt, Shigella flexneri 2a str. 301
ucaacaccgggugcagaca

SEQ ID NO: 3912967 - RNA, 20 nt, Shigella flexneri 2a str. 301
ucaacaccuguugcgcgucg

SEQ ID NO: 3912968 - RNA, 18 nt, Shigella flexneri 2a str. 301
ucaacagauuacauuaaa

SEQ ID NO: 3912969 - RNA, 15 nt, Shigella flexneri 2a str. 301
ucaacagcaucaucg

SEQ ID NO: 3912970 - RNA, 23 nt, Shigella flexneri 2a str. 301
ucaacagcggcauuacgcgcccc

SEQ ID NO: 3912971 - RNA, 16 nt, Shigella flexneri 2a str. 301
ucaacagcguuucuuc

SEQ ID NO: 3912972 - RNA, 18 nt, Shigella flexneri 2a str. 301
ucaacagggcagacauuc

SEQ ID NO: 3912973 - RNA, 13 nt, Shigella flexneri 2a str. 301
ucaacaguucaug

SEQ ID NO: 3912974 - RNA, 14 nt, Shigella flexneri 2a str. 301
ucaacauauuaaaa

SEQ ID NO: 3912975 - RNA, 13 nt, Shigella flexneri 2a str. 301
ucaacaucgcguu

SEQ ID NO: 3912976 - RNA, 15 nt, Shigella flexneri 2a str. 301
ucaacaugaaaauaa

SEQ ID NO: 3912977 - RNA, 20 nt, Shigella flexneri 2a str. 301
ucaacauguuccugccaguc

SEQ ID NO: 3912978 - RNA, 21 nt, Shigella flexneri 2a str. 301
ucaacauucccugcaccggug

SEQ ID NO: 3912979 - RNA, 18 nt, Shigella flexneri 2a str. 301
ucaacauuucccccuucc

SEQ ID NO: 3912980 - RNA, 22 nt, Shigella flexneri 2a str. 301
ucaaccacuacgugaucgucuu

SEQ ID NO: 3912981 - RNA, 18 nt, Shigella flexneri 2a str. 301
ucaaccacuuuaucgaga

SEQ ID NO: 3912982 - RNA, 20 nt, Shigella flexneri 2a str. 301
ucaaccacuuuaucgagaau

SEQ ID NO: 3912983 - RNA, 20 nt, Shigella flexneri 2a str. 301
ucaaccagaucggacuucau

SEQ ID NO: 3912984 - RNA, 16 nt, Shigella flexneri 2a str. 301
ucaaccagccagcgcu

SEQ ID NO: 3912985 - RNA, 23 nt, Shigella flexneri 2a str. 301
ucaaccauaucgcauaccaucca

SEQ ID NO: 3912986 - RNA, 17 nt, Shigella flexneri 2a str. 301
ucaaccaugguuucgaa

SEQ ID NO: 3912987 - RNA, 17 nt, Shigella flexneri 2a str. 301
ucaacccgcacagucac

SEQ ID NO: 3912988 - RNA, 13 nt, Shigella flexneri 2a str. 301
ucaacccuuucca

SEQ ID NO: 3912989 - RNA, 19 nt, Shigella flexneri 2a str. 301
ucaacccuuuuuuaaacau

SEQ ID NO: 3912990 - RNA, 23 nt, Shigella flexneri 2a str. 301
ucaaccgagagggcuuuuucaau

SEQ ID NO: 3912991 - RNA, 19 nt, Shigella flexneri 2a str. 301
ucaaccgcgccugaccauu

SEQ ID NO: 3912992 - RNA, 20 nt, Shigella flexneri 2a str. 301
ucaaccgucgcgcccuccug

SEQ ID NO: 3912993 - RNA, 20 nt, Shigella flexneri 2a str. 301
ucaaccguugcuggaaaacc

SEQ ID NO: 3912994 - RNA, 21 nt, Shigella flexneri 2a str. 301
ucaaccguuugauugaaaaau

SEQ ID NO: 3912995 - RNA, 20 nt, Shigella flexneri 2a str. 301
ucaaccugaucgugccagga

SEQ ID NO: 3912996 - RNA, 14 nt, Shigella flexneri 2a str. 301
ucaaccuuuccuug

SEQ ID NO: 3912997 - RNA, 18 nt, Shigella flexneri 2a str. 301
ucaaccuuuccuuguaac

SEQ ID NO: 3912998 - RNA, 14 nt, Shigella flexneri 2a str. 301
ucaacgaagaaaac

SEQ ID NO: 3912999 - RNA, 22 nt, Shigella flexneri 2a str. 301
ucaacgacccagccagacgcca

SEQ ID NO: 3913000 - RNA, 20 nt, Shigella flexneri 2a str. 301
ucaacgauuucucagcagac

SEQ ID NO: 3913001 - RNA, 20 nt, Shigella flexneri 2a str. 301
ucaacgccauacggcuauga

SEQ ID NO: 3913002 - RNA, 16 nt, Shigella flexneri 2a str. 301
ucaacgccgcuaucag

SEQ ID NO: 3913003 - RNA, 21 nt, Shigella flexneri 2a str. 301
ucaacgccgcuaucagauucg

SEQ ID NO: 3913004 - RNA, 22 nt, Shigella flexneri 2a str. 301
ucaacggccugaccaugcucaa

SEQ ID NO: 3913005 - RNA, 19 nt, Shigella flexneri 2a str. 301
ucaacguacucugccacua

SEQ ID NO: 3913006 - RNA, 12 nt, Shigella flexneri 2a str. 301
ucaacgucaaac

SEQ ID NO: 3913007 - RNA, 21 nt, Shigella flexneri 2a str. 301
ucaacgucacuggguucaaaa

SEQ ID NO: 3913008 - RNA, 20 nt, Shigella flexneri 2a str. 301
ucaacgucauuaucugcaga

SEQ ID NO: 3913009 - RNA, 17 nt, Shigella flexneri 2a str. 301
ucaacgugucuuuuacu

SEQ ID NO: 3913010 - RNA, 19 nt, Shigella flexneri 2a str. 301
ucaacguuauucgcuuccu

SEQ ID NO: 3913011 - RNA, 15 nt, Shigella flexneri 2a str. 301
ucaacguugaauuuc

SEQ ID NO: 3913012 - RNA, 23 nt, Shigella flexneri 2a str. 301
ucaacuccccgcauuuacucuca

SEQ ID NO: 3913013 - RNA, 18 nt, Shigella flexneri 2a str. 301
ucaacuccgccagcaacu

SEQ ID NO: 3913014 - RNA, 16 nt, Shigella flexneri 2a str. 301
ucaacugccaguuccc

SEQ ID NO: 3913015 - RNA, 15 nt, Shigella flexneri 2a str. 301
ucaacuuaagucucc

SEQ ID NO: 3913016 - RNA, 16 nt, Shigella flexneri 2a str. 301
ucaacuucagcagcag

SEQ ID NO: 3913017 - RNA, 16 nt, Shigella flexneri 2a str. 301
ucaacuuuaccuucau

SEQ ID NO: 3913018 - RNA, 15 nt, Shigella flexneri 2a str. 301
ucaacuuuguucuga

SEQ ID NO: 3913019 - RNA, 16 nt, Shigella flexneri 2a str. 301
ucaagaaacagcaguu

SEQ ID NO: 3913020 - RNA, 18 nt, Shigella flexneri 2a str. 301
ucaagaaaccgaaguugu

SEQ ID NO: 3913021 - RNA, 20 nt, Shigella flexneri 2a str. 301
ucaagaaagguugaggcuga

SEQ ID NO: 3913022 - RNA, 12 nt, Shigella flexneri 2a str. 301
ucaagaaaugca

SEQ ID NO: 3913023 - RNA, 13 nt, Shigella flexneri 2a str. 301
ucaagaauacugu

SEQ ID NO: 3913024 - RNA, 17 nt, Shigella flexneri 2a str. 301
ucaagaauacuguccau

SEQ ID NO: 3913025 - RNA, 15 nt, Shigella flexneri 2a str. 301
ucaagaaugacgcca

SEQ ID NO: 3913026 - RNA, 23 nt, Shigella flexneri 2a str. 301
ucaagaaugcucgcuggcaggcc

SEQ ID NO: 3913027 - RNA, 15 nt, Shigella flexneri 2a str. 301
ucaagacaucaauaa

SEQ ID NO: 3913028 - RNA, 15 nt, Shigella flexneri 2a str. 301
ucaagagacugcugg

SEQ ID NO: 3913029 - RNA, 17 nt, Shigella flexneri 2a str. 301
ucaagauauuucaccag

SEQ ID NO: 3913030 - RNA, 18 nt, Shigella flexneri 2a str. 301
ucaagauauuucaccagc

SEQ ID NO: 3913031 - RNA, 22 nt, Shigella flexneri 2a str. 301
ucaagauuagcccccguuuugu

SEQ ID NO: 3913032 - RNA, 21 nt, Shigella flexneri 2a str. 301
ucaagcaaggccagguuuucu

SEQ ID NO: 3913033 - RNA, 17 nt, Shigella flexneri 2a str. 301
ucaagcacaaucacguc

SEQ ID NO: 3913034 - RNA, 14 nt, Shigella flexneri 2a str. 301
ucaagcaccauccu

SEQ ID NO: 3913035 - RNA, 20 nt, Shigella flexneri 2a str. 301
ucaagcccugguaacugcca

SEQ ID NO: 3913036 - RNA, 19 nt, Shigella flexneri 2a str. 301
ucaagcgguaaccauccau

SEQ ID NO: 3913037 - RNA, 21 nt, Shigella flexneri 2a str. 301
ucaagcgucgcaucaggcaug

SEQ ID NO: 3913038 - RNA, 18 nt, Shigella flexneri 2a str. 301
ucaagcucaaaauaauac

SEQ ID NO: 3913039 - RNA, 19 nt, Shigella flexneri 2a str. 301
ucaagcucaaaauaauaca

SEQ ID NO: 3913040 - RNA, 16 nt, Shigella flexneri 2a str. 301
ucaagcucgccaccau

SEQ ID NO: 3913041 - RNA, 17 nt, Shigella flexneri 2a str. 301
ucaagcucgccaccauu

SEQ ID NO: 3913042 - RNA, 18 nt, Shigella flexneri 2a str. 301
ucaagcugugccugaaua

SEQ ID NO: 3913043 - RNA, 16 nt, Shigella flexneri 2a str. 301
ucaagcuguucuuccc

SEQ ID NO: 3913044 - RNA, 14 nt, Shigella flexneri 2a str. 301
ucaaggcgguaaau

SEQ ID NO: 3913045 - RNA, 18 nt, Shigella flexneri 2a str. 301
ucaaggucaacaguucau

SEQ ID NO: 3913046 - RNA, 13 nt, Shigella flexneri 2a str. 301
ucaaguaaccuuu

SEQ ID NO: 3913047 - RNA, 21 nt, Shigella flexneri 2a str. 301
ucaagucauugauucgaucaa

SEQ ID NO: 3913048 - RNA, 14 nt, Shigella flexneri 2a str. 301
ucaagucccccccc

SEQ ID NO: 3913049 - RNA, 13 nt, Shigella flexneri 2a str. 301
ucaagucgaaccu

SEQ ID NO: 3913050 - RNA, 23 nt, Shigella flexneri 2a str. 301
ucaagugacauacucuuuccauu

SEQ ID NO: 3913051 - RNA, 16 nt, Shigella flexneri 2a str. 301
ucaagugcuacccacu

SEQ ID NO: 3913052 - RNA, 19 nt, Shigella flexneri 2a str. 301
ucaaguugacucucaucca

SEQ ID NO: 3913053 - RNA, 17 nt, Shigella flexneri 2a str. 301
ucaauaaaaggaaacag

SEQ ID NO: 3913054 - RNA, 14 nt, Shigella flexneri 2a str. 301
ucaauaaacaauga

SEQ ID NO: 3913055 - RNA, 18 nt, Shigella flexneri 2a str. 301
ucaauaaagugauauuuc

SEQ ID NO: 3913056 - RNA, 22 nt, Shigella flexneri 2a str. 301
ucaauaccgccugcaaauaaau

SEQ ID NO: 3913057 - RNA, 18 nt, Shigella flexneri 2a str. 301
ucaauacuuucacaaaaa

SEQ ID NO: 3913058 - RNA, 19 nt, Shigella flexneri 2a str. 301
ucaauacuuucacaaaaau

SEQ ID NO: 3913059 - RNA, 16 nt, Shigella flexneri 2a str. 301
ucaauacuuuccagca

SEQ ID NO: 3913060 - RNA, 22 nt, Shigella flexneri 2a str. 301
ucaauacuuuccagcauauguu

SEQ ID NO: 3913061 - RNA, 14 nt, Shigella flexneri 2a str. 301
ucaauagcaccauu

SEQ ID NO: 3913062 - RNA, 18 nt, Shigella flexneri 2a str. 301
ucaauagcuaacgaaaga

SEQ ID NO: 3913063 - RNA, 14 nt, Shigella flexneri 2a str. 301
ucaauaucaucauu

SEQ ID NO: 3913064 - RNA, 18 nt, Shigella flexneri 2a str. 301
ucaauaucaucauuugca

SEQ ID NO: 3913065 - RNA, 17 nt, Shigella flexneri 2a str. 301
ucaauaucauuacgcca

SEQ ID NO: 3913066 - RNA, 19 nt, Shigella flexneri 2a str. 301
ucaauauccugaccuuuac

SEQ ID NO: 3913067 - RNA, 14 nt, Shigella flexneri 2a str. 301
ucaauaugaauuaa

SEQ ID NO: 3913068 - RNA, 17 nt, Shigella flexneri 2a str. 301
ucaauaugauaaaccuc

SEQ ID NO: 3913069 - RNA, 16 nt, Shigella flexneri 2a str. 301
ucaauauggaaguuuu

SEQ ID NO: 3913070 - RNA, 15 nt, Shigella flexneri 2a str. 301
ucaauauuaaugcug

SEQ ID NO: 3913071 - RNA, 12 nt, Shigella flexneri 2a str. 301
ucaauauuuuca

SEQ ID NO: 3913072 - RNA, 12 nt, Shigella flexneri 2a str. 301
ucaaucaccgca

SEQ ID NO: 3913073 - RNA, 15 nt, Shigella flexneri 2a str. 301
ucaaucaccgcuuca

SEQ ID NO: 3913074 - RNA, 17 nt, Shigella flexneri 2a str. 301
ucaaucaccgcuucacu

SEQ ID NO: 3913075 - RNA, 14 nt, Shigella flexneri 2a str. 301
ucaaucaggcuauc

SEQ ID NO: 3913076 - RNA, 14 nt, Shigella flexneri 2a str. 301
ucaaucaguucauu

SEQ ID NO: 3913077 - RNA, 20 nt, Shigella flexneri 2a str. 301
ucaaucauccauauuuucag

SEQ ID NO: 3913078 - RNA, 18 nt, Shigella flexneri 2a str. 301
ucaaucaucucucgcauc

SEQ ID NO: 3913079 - RNA, 14 nt, Shigella flexneri 2a str. 301
ucaaucgccaccac

SEQ ID NO: 3913080 - RNA, 22 nt, Shigella flexneri 2a str. 301
ucaaucgccucgccgaaacgcu

SEQ ID NO: 3913081 - RNA, 21 nt, Shigella flexneri 2a str. 301
ucaaucucuuuuuccaccgca

SEQ ID NO: 3913082 - RNA, 17 nt, Shigella flexneri 2a str. 301
ucaaucuucacgcgcag

SEQ ID NO: 3913083 - RNA, 15 nt, Shigella flexneri 2a str. 301
ucaaugaaauccauu

SEQ ID NO: 3913084 - RNA, 13 nt, Shigella flexneri 2a str. 301
ucaaugaaugcuu

SEQ ID NO: 3913085 - RNA, 15 nt, Shigella flexneri 2a str. 301
ucaaugaaugcuucg

SEQ ID NO: 3913086 - RNA, 20 nt, Shigella flexneri 2a str. 301
ucaaugaguucgcgcgcugc

SEQ ID NO: 3913087 - RNA, 21 nt, Shigella flexneri 2a str. 301
ucaaugauaguucaacagauu

SEQ ID NO: 3913088 - RNA, 17 nt, Shigella flexneri 2a str. 301
ucaaugauuucugccag

SEQ ID NO: 3913089 - RNA, 18 nt, Shigella flexneri 2a str. 301
ucaaugauuucugccagc

SEQ ID NO: 3913090 - RNA, 17 nt, Shigella flexneri 2a str. 301
ucaaugcauuaaauugu

SEQ ID NO: 3913091 - RNA, 16 nt, Shigella flexneri 2a str. 301
ucaaugcccaucacua

SEQ ID NO: 3913092 - RNA, 18 nt, Shigella flexneri 2a str. 301
ucaaugccgucaccagca

SEQ ID NO: 3913093 - RNA, 12 nt, Shigella flexneri 2a str. 301
ucaaugccugau

SEQ ID NO: 3913094 - RNA, 15 nt, Shigella flexneri 2a str. 301
ucaaugcuuuuugca

SEQ ID NO: 3913095 - RNA, 21 nt, Shigella flexneri 2a str. 301
ucaaugcuuuuugcauuuccg

SEQ ID NO: 3913096 - RNA, 20 nt, Shigella flexneri 2a str. 301
ucaaugguggcaaucugaau

SEQ ID NO: 3913097 - RNA, 16 nt, Shigella flexneri 2a str. 301
ucaaugguguuuucca

SEQ ID NO: 3913098 - RNA, 19 nt, Shigella flexneri 2a str. 301
ucaauuaaaaaauuagcaa

SEQ ID NO: 3913099 - RNA, 22 nt, Shigella flexneri 2a str. 301
ucaauuaaaaaauuagcaauac

SEQ ID NO: 3913100 - RNA, 15 nt, Shigella flexneri 2a str. 301
ucaauuaacauugca

SEQ ID NO: 3913101 - RNA, 23 nt, Shigella flexneri 2a str. 301
ucaauuaauucuccgcucucaau

SEQ ID NO: 3913102 - RNA, 18 nt, Shigella flexneri 2a str. 301
ucaauuagcuuuaaucca

SEQ ID NO: 3913103 - RNA, 16 nt, Shigella flexneri 2a str. 301
ucaauuccccuaguac

SEQ ID NO: 3913104 - RNA, 18 nt, Shigella flexneri 2a str. 301
ucaauucccgagcugcuc

SEQ ID NO: 3913105 - RNA, 14 nt, Shigella flexneri 2a str. 301
ucaauuccuauuuu

SEQ ID NO: 3913106 - RNA, 18 nt, Shigella flexneri 2a str. 301
ucaauuccuucugggcgc

SEQ ID NO: 3913107 - RNA, 13 nt, Shigella flexneri 2a str. 301
ucaauucucuaau

SEQ ID NO: 3913108 - RNA, 17 nt, Shigella flexneri 2a str. 301
ucaauugcgcaccagcu

SEQ ID NO: 3913109 - RNA, 20 nt, Shigella flexneri 2a str. 301
ucaauugcguuaaaaucagc

SEQ ID NO: 3913110 - RNA, 21 nt, Shigella flexneri 2a str. 301
ucaauuuauugaauuuacaca

SEQ ID NO: 3913111 - RNA, 17 nt, Shigella flexneri 2a str. 301
ucaauuucugcaaaaua

SEQ ID NO: 3913112 - RNA, 20 nt, Shigella flexneri 2a str. 301
ucaauuugagcgaagcgcau

SEQ ID NO: 3913113 - RNA, 20 nt, Shigella flexneri 2a str. 301
ucaauuuucacuuucggcag

SEQ ID NO: 3913114 - RNA, 10 nt, Shigella flexneri 2a str. 301
ucacaaaaag

SEQ ID NO: 3913115 - RNA, 22 nt, Shigella flexneri 2a str. 301
ucacaaaaauaauuuucguagu

SEQ ID NO: 3913116 - RNA, 14 nt, Shigella flexneri 2a str. 301
ucacaaaacgaaua

SEQ ID NO: 3913117 - RNA, 17 nt, Shigella flexneri 2a str. 301
ucacaaaacgaauaauu

SEQ ID NO: 3913118 - RNA, 18 nt, Shigella flexneri 2a str. 301
ucacaaaacgugacagcu

SEQ ID NO: 3913119 - RNA, 17 nt, Shigella flexneri 2a str. 301
ucacaaacagcgccugu

SEQ ID NO: 3913120 - RNA, 12 nt, Shigella flexneri 2a str. 301
ucacaaacauca

SEQ ID NO: 3913121 - RNA, 23 nt, Shigella flexneri 2a str. 301
ucacaaauucuggcggcaauaac

SEQ ID NO: 3913122 - RNA, 22 nt, Shigella flexneri 2a str. 301
ucacaaggccauugacgcaucg

SEQ ID NO: 3913123 - RNA, 18 nt, Shigella flexneri 2a str. 301
ucacaaucggcuuucacc

SEQ ID NO: 3913124 - RNA, 23 nt, Shigella flexneri 2a str. 301
ucacaauuacugagagaaaaaaa

SEQ ID NO: 3913125 - RNA, 15 nt, Shigella flexneri 2a str. 301
ucacaauugaugcau

SEQ ID NO: 3913126 - RNA, 12 nt, Shigella flexneri 2a str. 301
ucacacacaucg

SEQ ID NO: 3913127 - RNA, 15 nt, Shigella flexneri 2a str. 301
ucacacauaucacaa

SEQ ID NO: 3913128 - RNA, 15 nt, Shigella flexneri 2a str. 301
ucacaccauugagga

SEQ ID NO: 3913129 - RNA, 21 nt, Shigella flexneri 2a str. 301
ucacaccauugauaauccauc

SEQ ID NO: 3913130 - RNA, 22 nt, Shigella flexneri 2a str. 301
ucacaccauugauaauccauca

SEQ ID NO: 3913131 - RNA, 17 nt, Shigella flexneri 2a str. 301
ucacacccuugccagau

SEQ ID NO: 3913132 - RNA, 18 nt, Shigella flexneri 2a str. 301
ucacaccgcgaucuucca

SEQ ID NO: 3913133 - RNA, 19 nt, Shigella flexneri 2a str. 301
ucacaccgcgaucuuccac

SEQ ID NO: 3913134 - RNA, 20 nt, Shigella flexneri 2a str. 301
ucacaccuuauuuacauccc

SEQ ID NO: 3913135 - RNA, 15 nt, Shigella flexneri 2a str. 301
ucacacgccgaauuu

SEQ ID NO: 3913136 - RNA, 14 nt, Shigella flexneri 2a str. 301
ucacacuaaccguu

SEQ ID NO: 3913137 - RNA, 21 nt, Shigella flexneri 2a str. 301
ucacacuccagucccaguuca

SEQ ID NO: 3913138 - RNA, 18 nt, Shigella flexneri 2a str. 301
ucacacugaugacaggcu

SEQ ID NO: 3913139 - RNA, 23 nt, Shigella flexneri 2a str. 301
ucaccuuacggcacuccucuuca

SEQ ID NO: 3913140 - RNA, 13 nt, Shigella flexneri 2a str. 301
ucaccuuccagua

SEQ ID NO: 3913141 - RNA, 22 nt, Shigella flexneri 2a str. 301
ucaccuugcucgcccuggaugc

SEQ ID NO: 3913142 - RNA, 13 nt, Shigella flexneri 2a str. 301
ucaccuuuucggu

SEQ ID NO: 3913143 - RNA, 15 nt, Shigella flexneri 2a str. 301
ucaccuuuuuccaga

SEQ ID NO: 3913144 - RNA, 21 nt, Shigella flexneri 2a str. 301
ucacgaagcucucugcuauuc

SEQ ID NO: 3913145 - RNA, 15 nt, Shigella flexneri 2a str. 301
ucacgaauauuuccc

SEQ ID NO: 3913146 - RNA, 14 nt, Shigella flexneri 2a str. 301
ucacgaauccgcac

SEQ ID NO: 3913147 - RNA, 16 nt, Shigella flexneri 2a str. 301
ucacgaauccgcacca

SEQ ID NO: 3913148 - RNA, 15 nt, Shigella flexneri 2a str. 301
ucacgaaucgccgca

SEQ ID NO: 3913149 - RNA, 16 nt, Shigella flexneri 2a str. 301
ucacgaaucuauucau

SEQ ID NO: 3913150 - RNA, 20 nt, Shigella flexneri 2a str. 301
ucacgacaaaugcgccgcca

SEQ ID NO: 3913151 - RNA, 17 nt, Shigella flexneri 2a str. 301
ucacgacagaacucguu

SEQ ID NO: 3913152 - RNA, 15 nt, Shigella flexneri 2a str. 301
ucacgaccaccgaug

SEQ ID NO: 3913153 - RNA, 16 nt, Shigella flexneri 2a str. 301
ucacgacgcauccggc

SEQ ID NO: 3913154 - RNA, 14 nt, Shigella flexneri 2a str. 301
ucacgagagauacg

SEQ ID NO: 3913155 - RNA, 14 nt, Shigella flexneri 2a str. 301
ucacgauaucgaua

SEQ ID NO: 3913156 - RNA, 12 nt, Shigella flexneri 2a str. 301
ucacgaugcuaa

SEQ ID NO: 3913157 - RNA, 17 nt, Shigella flexneri 2a str. 301
ucacgauuguuaaucac

SEQ ID NO: 3913158 - RNA, 16 nt, Shigella flexneri 2a str. 301
ucacgcaaaacgcugc

SEQ ID NO: 3913159 - RNA, 15 nt, Shigella flexneri 2a str. 301
ucacgcagcaagccg

SEQ ID NO: 3913160 - RNA, 16 nt, Shigella flexneri 2a str. 301
ucacgcagcgucagca

SEQ ID NO: 3913161 - RNA, 16 nt, Shigella flexneri 2a str. 301
ucacgcagcucacgca

SEQ ID NO: 3913162 - RNA, 18 nt, Shigella flexneri 2a str. 301
ucacgcagcuucucguga

SEQ ID NO: 3913163 - RNA, 21 nt, Shigella flexneri 2a str. 301
ucacgcagggugugcuccagu

SEQ ID NO: 3913164 - RNA, 13 nt, Shigella flexneri 2a str. 301
ucacgccaccagc

SEQ ID NO: 3913165 - RNA, 22 nt, Shigella flexneri 2a str. 301
ucacgccagucgcacacaacag

SEQ ID NO: 3913166 - RNA, 13 nt, Shigella flexneri 2a str. 301
ucacgcccagucc

SEQ ID NO: 3913167 - RNA, 17 nt, Shigella flexneri 2a str. 301
ucacgcccaucagcauc

SEQ ID NO: 3913168 - RNA, 16 nt, Shigella flexneri 2a str. 301
ucacgccgaccagacc

SEQ ID NO: 3913169 - RNA, 23 nt, Shigella flexneri 2a str. 301
ucacgccgcauccgacauuugca

SEQ ID NO: 3913170 - RNA, 18 nt, Shigella flexneri 2a str. 301
ucacgccgcauccggcag

SEQ ID NO: 3913171 - RNA, 18 nt, Shigella flexneri 2a str. 301
ucacgccgcauccggcau

SEQ ID NO: 3913172 - RNA, 19 nt, Shigella flexneri 2a str. 301
ucacgccgcauccggcauu

SEQ ID NO: 3913173 - RNA, 21 nt, Shigella flexneri 2a str. 301
ucacgccgggaaauuuuuccg

SEQ ID NO: 3913174 - RNA, 22 nt, Shigella flexneri 2a str. 301
ucacgccgggaaauuuuuccgu

SEQ ID NO: 3913175 - RNA, 19 nt, Shigella flexneri 2a str. 301
ucacgccugcggcuuccag

SEQ ID NO: 3913176 - RNA, 21 nt, Shigella flexneri 2a str. 301
ucacgccuugcggaaauucca

SEQ ID NO: 3913177 - RNA, 13 nt, Shigella flexneri 2a str. 301
ucacgcgccagcu

SEQ ID NO: 3913178 - RNA, 12 nt, Shigella flexneri 2a str. 301
ucacgcgcugcc

SEQ ID NO: 3913179 - RNA, 21 nt, Shigella flexneri 2a str. 301
ucacgcggguugccaccggua

SEQ ID NO: 3913180 - RNA, 12 nt, Shigella flexneri 2a str. 301
ucacgcuaaaag

SEQ ID NO: 3913181 - RNA, 14 nt, Shigella flexneri 2a str. 301
ucacgcucauccug

SEQ ID NO: 3913182 - RNA, 15 nt, Shigella flexneri 2a str. 301
ucacggcacucgcug

SEQ ID NO: 3913183 - RNA, 13 nt, Shigella flexneri 2a str. 301
ucacggccacucu

SEQ ID NO: 3913184 - RNA, 18 nt, Shigella flexneri 2a str. 301
ucacggccacucugccug

SEQ ID NO: 3913185 - RNA, 19 nt, Shigella flexneri 2a str. 301
ucacggcgacggcuggcaa

SEQ ID NO: 3913186 - RNA, 18 nt, Shigella flexneri 2a str. 301
ucacggcugcuaauauuu

SEQ ID NO: 3913187 - RNA, 18 nt, Shigella flexneri 2a str. 301
ucacggcuguagccagcu

SEQ ID NO: 3913188 - RNA, 20 nt, Shigella flexneri 2a str. 301
ucacggcuguagccagcucg

SEQ ID NO: 3913189 - RNA, 12 nt, Shigella flexneri 2a str. 301
ucacguaccaga

SEQ ID NO: 3913190 - RNA, 14 nt, Shigella flexneri 2a str. 301
ucacguaggccuga

SEQ ID NO: 3913191 - RNA, 16 nt, Shigella flexneri 2a str. 301
ucacgugacaaaaauu

SEQ ID NO: 3913192 - RNA, 19 nt, Shigella flexneri 2a str. 301
ucacguuaucaacuagcug

SEQ ID NO: 3913193 - RNA, 13 nt, Shigella flexneri 2a str. 301
ucacguuccaggc

SEQ ID NO: 3913194 - RNA, 20 nt, Shigella flexneri 2a str. 301
ucacguugccguaugcgcca

SEQ ID NO: 3913195 - RNA, 19 nt, Shigella flexneri 2a str. 301
ucacuaaacccgaccacuu

SEQ ID NO: 3913196 - RNA, 21 nt, Shigella flexneri 2a str. 301
ucacuaaacccgaccacuucc

SEQ ID NO: 3913197 - RNA, 13 nt, Shigella flexneri 2a str. 301
ucacuacaaucag

SEQ ID NO: 3913198 - RNA, 23 nt, Shigella flexneri 2a str. 301
ucacuacgcgaccgugggcaauu

SEQ ID NO: 3913199 - RNA, 16 nt, Shigella flexneri 2a str. 301
ucacuauacuccugau

SEQ ID NO: 3913200 - RNA, 21 nt, Shigella flexneri 2a str. 301
ucacuaugagguagccugagu

SEQ ID NO: 3913201 - RNA, 16 nt, Shigella flexneri 2a str. 301
ucacuauguaauccug

SEQ ID NO: 3913202 - RNA, 21 nt, Shigella flexneri 2a str. 301
ucacuauuucuuuguagauga

SEQ ID NO: 3913203 - RNA, 14 nt, Shigella flexneri 2a str. 301
ucacucaaaauauc

SEQ ID NO: 3913204 - RNA, 17 nt, Shigella flexneri 2a str. 301
ucacucaccgcagaaua

SEQ ID NO: 3913205 - RNA, 12 nt, Shigella flexneri 2a str. 301
ucacucaguguu

SEQ ID NO: 3913206 - RNA, 20 nt, Shigella flexneri 2a str. 301
ucacucauacucaccguuca

SEQ ID NO: 3913207 - RNA, 18 nt, Shigella flexneri 2a str. 301
ucacucaucaugcacucc

SEQ ID NO: 3913208 - RNA, 21 nt, Shigella flexneri 2a str. 301
ucacucauuaagacuguaaau

SEQ ID NO: 3913209 - RNA, 19 nt, Shigella flexneri 2a str. 301
ucacuccccgcaacaguga

SEQ ID NO: 3913210 - RNA, 23 nt, Shigella flexneri 2a str. 301
ucacucccggauaaaucuccauu

SEQ ID NO: 3913211 - RNA, 14 nt, Shigella flexneri 2a str. 301
ucacuccggccaga

SEQ ID NO: 3913212 - RNA, 16 nt, Shigella flexneri 2a str. 301
ucacucgacagcaccg

SEQ ID NO: 3913213 - RNA, 21 nt, Shigella flexneri 2a str. 301
ucacucuauagucuuuucgcu

SEQ ID NO: 3913214 - RNA, 14 nt, Shigella flexneri 2a str. 301
ucacugauaagaug

SEQ ID NO: 3913215 - RNA, 20 nt, Shigella flexneri 2a str. 301
ucacugaugacaagcguaug

SEQ ID NO: 3913216 - RNA, 13 nt, Shigella flexneri 2a str. 301
ucacugcaaauac

SEQ ID NO: 3913217 - RNA, 21 nt, Shigella flexneri 2a str. 301
ucacugcaaauacccaaaaaa

SEQ ID NO: 3913218 - RNA, 21 nt, Shigella flexneri 2a str. 301
ucacugccagaauagccgcag

SEQ ID NO: 3913219 - RNA, 23 nt, Shigella flexneri 2a str. 301
ucacugcgaaagcgucagcuuuc

SEQ ID NO: 3913220 - RNA, 23 nt, Shigella flexneri 2a str. 301
ucacugcuuuggcucuucgcucc

SEQ ID NO: 3913221 - RNA, 17 nt, Shigella flexneri 2a str. 301
ucacuggcgcagacagg

SEQ ID NO: 3913222 - RNA, 22 nt, Shigella flexneri 2a str. 301
ucacugggcgauuaauaaaauu

SEQ ID NO: 3913223 - RNA, 14 nt, Shigella flexneri 2a str. 301
ucacugguucaaag

SEQ ID NO: 3913224 - RNA, 18 nt, Shigella flexneri 2a str. 301
ucacugucgaacuggcag

SEQ ID NO: 3913225 - RNA, 16 nt, Shigella flexneri 2a str. 301
ucacugugcuuuacau

SEQ ID NO: 3913226 - RNA, 19 nt, Shigella flexneri 2a str. 301
ucacugugcuuuacaucag

SEQ ID NO: 3913227 - RNA, 21 nt, Shigella flexneri 2a str. 301
ucacuguucugauaguuaaaa

SEQ ID NO: 3913228 - RNA, 17 nt, Shigella flexneri 2a str. 301
ucacuuaacccauuaca

SEQ ID NO: 3913229 - RNA, 23 nt, Shigella flexneri 2a str. 301
ucacuuaacccauuacaagcccg

SEQ ID NO: 3913230 - RNA, 21 nt, Shigella flexneri 2a str. 301
ucacuuaaucguucugugccg

SEQ ID NO: 3913231 - RNA, 15 nt, Shigella flexneri 2a str. 301
ucacuucaaauuuaa

SEQ ID NO: 3913232 - RNA, 13 nt, Shigella flexneri 2a str. 301
ucacuucaggaug

SEQ ID NO: 3913233 - RNA, 16 nt, Shigella flexneri 2a str. 301
ucacuuccggcaaggc

SEQ ID NO: 3913234 - RNA, 17 nt, Shigella flexneri 2a str. 301
ucacuucgauccaguga

SEQ ID NO: 3913235 - RNA, 22 nt, Shigella flexneri 2a str. 301
ucacuucgauccagugauucca

SEQ ID NO: 3913236 - RNA, 18 nt, Shigella flexneri 2a str. 301
ucacuucgccgaugaagu

SEQ ID NO: 3913237 - RNA, 18 nt, Shigella flexneri 2a str. 301
ucacuucgucagaaaugg

SEQ ID NO: 3913238 - RNA, 13 nt, Shigella flexneri 2a str. 301
ucacuucugccuc

SEQ ID NO: 3913239 - RNA, 13 nt, Shigella flexneri 2a str. 301
ucagcccaaccac

SEQ ID NO: 3913240 - RNA, 15 nt, Shigella flexneri 2a str. 301
ucagcccacccggua

SEQ ID NO: 3913241 - RNA, 13 nt, Shigella flexneri 2a str. 301
ucagcccagcccu

SEQ ID NO: 3913242 - RNA, 13 nt, Shigella flexneri 2a str. 301
ucagccccuccac

SEQ ID NO: 3913243 - RNA, 14 nt, Shigella flexneri 2a str. 301
ucagccccuccaca

SEQ ID NO: 3913244 - RNA, 16 nt, Shigella flexneri 2a str. 301
ucagcccuucuuuaug

SEQ ID NO: 3913245 - RNA, 15 nt, Shigella flexneri 2a str. 301
ucagccgcaaaccug

SEQ ID NO: 3913246 - RNA, 14 nt, Shigella flexneri 2a str. 301
ucagccgcaaacuc

SEQ ID NO: 3913247 - RNA, 18 nt, Shigella flexneri 2a str. 301
ucagccgucauccaggaa

SEQ ID NO: 3913248 - RNA, 21 nt, Shigella flexneri 2a str. 301
ucagcgaguuuuucaguccac

SEQ ID NO: 3913249 - RNA, 16 nt, Shigella flexneri 2a str. 301
ucagcgaucagcauuu

SEQ ID NO: 3913250 - RNA, 23 nt, Shigella flexneri 2a str. 301
ucagcgaucguuuuuaaccccag

SEQ ID NO: 3913251 - RNA, 14 nt, Shigella flexneri 2a str. 301
ucagcgcaaagagu

SEQ ID NO: 3913252 - RNA, 17 nt, Shigella flexneri 2a str. 301
ucagcgcaaagagugaa

SEQ ID NO: 3913253 - RNA, 20 nt, Shigella flexneri 2a str. 301
ucagcgcagacaaucacauc

SEQ ID NO: 3913254 - RNA, 13 nt, Shigella flexneri 2a str. 301
ucagcgcagcacc

SEQ ID NO: 3913255 - RNA, 14 nt, Shigella flexneri 2a str. 301
ucagcgcagcgcga

SEQ ID NO: 3913256 - RNA, 16 nt, Shigella flexneri 2a str. 301
ucagcgcauagagacu

SEQ ID NO: 3913257 - RNA, 14 nt, Shigella flexneri 2a str. 301
ucagcgccaggcuu

SEQ ID NO: 3913258 - RNA, 15 nt, Shigella flexneri 2a str. 301
ucagcgccugcugca

SEQ ID NO: 3913259 - RNA, 14 nt, Shigella flexneri 2a str. 301
ucagcgcguaagcg

SEQ ID NO: 3913260 - RNA, 22 nt, Shigella flexneri 2a str. 301
ucagcggcacuguuucgccagg

SEQ ID NO: 3913261 - RNA, 14 nt, Shigella flexneri 2a str. 301
ucagcggcaguucg

SEQ ID NO: 3913262 - RNA, 16 nt, Shigella flexneri 2a str. 301
ucagcggccaguuucg

SEQ ID NO: 3913263 - RNA, 15 nt, Shigella flexneri 2a str. 301
ucagcgggcagggca

SEQ ID NO: 3913264 - RNA, 17 nt, Shigella flexneri 2a str. 301
ucagcgggcagggcauc

SEQ ID NO: 3913265 - RNA, 22 nt, Shigella flexneri 2a str. 301
ucagcgggguucuccugagaau

SEQ ID NO: 3913266 - RNA, 16 nt, Shigella flexneri 2a str. 301
ucagcgguggugaaaa

SEQ ID NO: 3913267 - RNA, 16 nt, Shigella flexneri 2a str. 301
ucagcguaucaauuaa

SEQ ID NO: 3913268 - RNA, 17 nt, Shigella flexneri 2a str. 301
ucagcguaugcagccag

SEQ ID NO: 3913269 - RNA, 15 nt, Shigella flexneri 2a str. 301
ucagcgugacuggca

SEQ ID NO: 3913270 - RNA, 16 nt, Shigella flexneri 2a str. 301
ucagcgugacuggcag

SEQ ID NO: 3913271 - RNA, 18 nt, Shigella flexneri 2a str. 301
ucagcguuccacgugcgg

SEQ ID NO: 3913272 - RNA, 14 nt, Shigella flexneri 2a str. 301
ucagcguuccccag

SEQ ID NO: 3913273 - RNA, 18 nt, Shigella flexneri 2a str. 301
ucagcguugaaugcaugc

SEQ ID NO: 3913274 - RNA, 14 nt, Shigella flexneri 2a str. 301
ucagcguugccagu

SEQ ID NO: 3913275 - RNA, 19 nt, Shigella flexneri 2a str. 301
ucagcuaaacagcccaauc

SEQ ID NO: 3913276 - RNA, 13 nt, Shigella flexneri 2a str. 301
ucagcucaagaau

SEQ ID NO: 3913277 - RNA, 15 nt, Shigella flexneri 2a str. 301
ucagcucauccagcg

SEQ ID NO: 3913278 - RNA, 23 nt, Shigella flexneri 2a str. 301
ucagcuccccuggauugcagggg

SEQ ID NO: 3913279 - RNA, 19 nt, Shigella flexneri 2a str. 301
ucagcuccggcagcugcuc

SEQ ID NO: 3913280 - RNA, 16 nt, Shigella flexneri 2a str. 301
ucagcuccucuuucau

SEQ ID NO: 3913281 - RNA, 19 nt, Shigella flexneri 2a str. 301
ucagcucgcuaaagccguu

SEQ ID NO: 3913282 - RNA, 16 nt, Shigella flexneri 2a str. 301
ucagcucuuccuucag

SEQ ID NO: 3913283 - RNA, 12 nt, Shigella flexneri 2a str. 301
ucagcugccagu

SEQ ID NO: 3913284 - RNA, 15 nt, Shigella flexneri 2a str. 301
ucagcuggcguaccg

SEQ ID NO: 3913285 - RNA, 18 nt, Shigella flexneri 2a str. 301
ucagcuggcguaccggac

SEQ ID NO: 3913286 - RNA, 13 nt, Shigella flexneri 2a str. 301
ucagcuucaccuu

SEQ ID NO: 3913287 - RNA, 17 nt, Shigella flexneri 2a str. 301
ucagcuugcguccauaa

SEQ ID NO: 3913288 - RNA, 21 nt, Shigella flexneri 2a str. 301
ucagcuuucagagaagcaccg

SEQ ID NO: 3913289 - RNA, 17 nt, Shigella flexneri 2a str. 301
ucaggaaacccgccagu

SEQ ID NO: 3913290 - RNA, 14 nt, Shigella flexneri 2a str. 301
ucaggaaacugcgc

SEQ ID NO: 3913291 - RNA, 12 nt, Shigella flexneri 2a str. 301
ucaggaaauaaa

SEQ ID NO: 3913292 - RNA, 19 nt, Shigella flexneri 2a str. 301
ucaggaacaccgcacgcag

SEQ ID NO: 3913293 - RNA, 22 nt, Shigella flexneri 2a str. 301
ucaggaauagcggcaagcccag

SEQ ID NO: 3913294 - RNA, 23 nt, Shigella flexneri 2a str. 301
ucaggaccugcucugccagacgg

SEQ ID NO: 3913295 - RNA, 15 nt, Shigella flexneri 2a str. 301
ucaggacguuuucag

SEQ ID NO: 3913296 - RNA, 20 nt, Shigella flexneri 2a str. 301
ucaggacguuuucagccagc

SEQ ID NO: 3913297 - RNA, 16 nt, Shigella flexneri 2a str. 301
ucaggaguuuaaucuc

SEQ ID NO: 3913298 - RNA, 14 nt, Shigella flexneri 2a str. 301
ucaggauaaacucc

SEQ ID NO: 3913299 - RNA, 18 nt, Shigella flexneri 2a str. 301
ucaggauaaacuccugca

SEQ ID NO: 3913300 - RNA, 17 nt, Shigella flexneri 2a str. 301
ucaggauauuuauauuu

SEQ ID NO: 3913301 - RNA, 23 nt, Shigella flexneri 2a str. 301
ucaggcaaugggcaaacgcucuc

SEQ ID NO: 3913302 - RNA, 13 nt, Shigella flexneri 2a str. 301
ucaggcacguucc

SEQ ID NO: 3913303 - RNA, 18 nt, Shigella flexneri 2a str. 301
ucaggcagauacaaccaa

SEQ ID NO: 3913304 - RNA, 17 nt, Shigella flexneri 2a str. 301
ucaggcaggucuuucac

SEQ ID NO: 3913305 - RNA, 12 nt, Shigella flexneri 2a str. 301
ucaggcagucug

SEQ ID NO: 3913306 - RNA, 13 nt, Shigella flexneri 2a str. 301
ucaggcaucaugc

SEQ ID NO: 3913307 - RNA, 21 nt, Shigella flexneri 2a str. 301
ucaggcaucggugcuggccua

SEQ ID NO: 3913308 - RNA, 20 nt, Shigella flexneri 2a str. 301
ucaggcaucgugcaccaauu

SEQ ID NO: 3913309 - RNA, 18 nt, Shigella flexneri 2a str. 301
ucaggcauucuuuuucau

SEQ ID NO: 3913310 - RNA, 12 nt, Shigella flexneri 2a str. 301
ucaggccaggau

SEQ ID NO: 3913311 - RNA, 20 nt, Shigella flexneri 2a str. 301
ucaggcccgcauagagaaaa

SEQ ID NO: 3913312 - RNA, 22 nt, Shigella flexneri 2a str. 301
ucaggcccgccagcgccuggga

SEQ ID NO: 3913313 - RNA, 15 nt, Shigella flexneri 2a str. 301
ucaggccgauuucau

SEQ ID NO: 3913314 - RNA, 15 nt, Shigella flexneri 2a str. 301
ucaggccggaauaac

SEQ ID NO: 3913315 - RNA, 18 nt, Shigella flexneri 2a str. 301
ucaggccuacaaaaucua

SEQ ID NO: 3913316 - RNA, 22 nt, Shigella flexneri 2a str. 301
ucaggccuacaagucugugcug

SEQ ID NO: 3913317 - RNA, 23 nt, Shigella flexneri 2a str. 301
ucaggcgagucgagaucccuucc

SEQ ID NO: 3913318 - RNA, 15 nt, Shigella flexneri 2a str. 301
ucaggcgcugaaaga

SEQ ID NO: 3913319 - RNA, 22 nt, Shigella flexneri 2a str. 301
ucaggcgcugaaagaagcggug

SEQ ID NO: 3913320 - RNA, 23 nt, Shigella flexneri 2a str. 301
ucaggcgcugcauaucucccagu

SEQ ID NO: 3913321 - RNA, 15 nt, Shigella flexneri 2a str. 301
ucaggcggggucugg

SEQ ID NO: 3913322 - RNA, 16 nt, Shigella flexneri 2a str. 301
ucaggcguugaaaaau

SEQ ID NO: 3913323 - RNA, 13 nt, Shigella flexneri 2a str. 301
ucaggcuaaagaa

SEQ ID NO: 3913324 - RNA, 16 nt, Shigella flexneri 2a str. 301
ucaggcucucauuuuu

SEQ ID NO: 3913325 - RNA, 13 nt, Shigella flexneri 2a str. 301
ucaggcugccaga

SEQ ID NO: 3913326 - RNA, 19 nt, Shigella flexneri 2a str. 301
ucagggaagggucuuuuaa

SEQ ID NO: 3913327 - RNA, 12 nt, Shigella flexneri 2a str. 301
ucagggcggccg

SEQ ID NO: 3913328 - RNA, 21 nt, Shigella flexneri 2a str. 301
ucaggguaaauuuauagucau

SEQ ID NO: 3913329 - RNA, 21 nt, Shigella flexneri 2a str. 301
ucagggucuuccagcaaaucc

SEQ ID NO: 3913330 - RNA, 14 nt, Shigella flexneri 2a str. 301
ucagguaacaggga

SEQ ID NO: 3913331 - RNA, 22 nt, Shigella flexneri 2a str. 301
ucagguaagcgauaaaaauacc

SEQ ID NO: 3913332 - RNA, 13 nt, Shigella flexneri 2a str. 301
ucagguaccagca

SEQ ID NO: 3913333 - RNA, 21 nt, Shigella flexneri 2a str. 301
ucagguauaccgaaaucgcca

SEQ ID NO: 3913334 - RNA, 16 nt, Shigella flexneri 2a str. 301
ucagguauuuugucag

SEQ ID NO: 3913335 - RNA, 13 nt, Shigella flexneri 2a str. 301
ucaggucacccaa

SEQ ID NO: 3913336 - RNA, 19 nt, Shigella flexneri 2a str. 301
ucaggucacccaacaugcc

SEQ ID NO: 3913337 - RNA, 18 nt, Shigella flexneri 2a str. 301
ucagguggacgacugaca

SEQ ID NO: 3913338 - RNA, 22 nt, Shigella flexneri 2a str. 301
ucaggugucuaacccgcgacug

SEQ ID NO: 3913339 - RNA, 23 nt, Shigella flexneri 2a str. 301
ucaggugucuaacccgcgacugg

SEQ ID NO: 3913340 - RNA, 16 nt, Shigella flexneri 2a str. 301
ucaucagcauucucau

SEQ ID NO: 3913341 - RNA, 17 nt, Shigella flexneri 2a str. 301
ucaucaggccuacaaaa

SEQ ID NO: 3913342 - RNA, 18 nt, Shigella flexneri 2a str. 301
ucaucaggccuacaaaau

SEQ ID NO: 3913343 - RNA, 22 nt, Shigella flexneri 2a str. 301
ucaucaggccuacaaaaucuau

SEQ ID NO: 3913344 - RNA, 18 nt, Shigella flexneri 2a str. 301
ucaucaggggcagcacca

SEQ ID NO: 3913345 - RNA, 23 nt, Shigella flexneri 2a str. 301
ucaucagguuggaucaacaggca

SEQ ID NO: 3913346 - RNA, 19 nt, Shigella flexneri 2a str. 301
ucaucaguuccaguucauu

SEQ ID NO: 3913347 - RNA, 17 nt, Shigella flexneri 2a str. 301
ucaucaguuucaaaugg

SEQ ID NO: 3913348 - RNA, 19 nt, Shigella flexneri 2a str. 301
ucaucauaacccuuuccuu

SEQ ID NO: 3913349 - RNA, 17 nt, Shigella flexneri 2a str. 301
ucaucauaauggcugcc

SEQ ID NO: 3913350 - RNA, 18 nt, Shigella flexneri 2a str. 301
ucaucauagacuucccuc

SEQ ID NO: 3913351 - RNA, 13 nt, Shigella flexneri 2a str. 301
ucaucaucagcau

SEQ ID NO: 3913352 - RNA, 13 nt, Shigella flexneri 2a str. 301
ucaucauccagca

SEQ ID NO: 3913353 - RNA, 14 nt, Shigella flexneri 2a str. 301
ucaucauccagcac

SEQ ID NO: 3913354 - RNA, 21 nt, Shigella flexneri 2a str. 301
ucaucaucgcagauuucuucu

SEQ ID NO: 3913355 - RNA, 13 nt, Shigella flexneri 2a str. 301
ucaucaucgcggu

SEQ ID NO: 3913356 - RNA, 15 nt, Shigella flexneri 2a str. 301
ucaucaucgugcguu

SEQ ID NO: 3913357 - RNA, 19 nt, Shigella flexneri 2a str. 301
ucaucaugggcaagguauu

SEQ ID NO: 3913358 - RNA, 16 nt, Shigella flexneri 2a str. 301
ucaucauuaauaucuu

SEQ ID NO: 3913359 - RNA, 13 nt, Shigella flexneri 2a str. 301
ucaucauugcagu

SEQ ID NO: 3913360 - RNA, 17 nt, Shigella flexneri 2a str. 301
ucaucauuugcauaccc

SEQ ID NO: 3913361 - RNA, 16 nt, Shigella flexneri 2a str. 301
ucauccaccuuaaaac

SEQ ID NO: 3913362 - RNA, 17 nt, Shigella flexneri 2a str. 301
ucauccagacugcucag

SEQ ID NO: 3913363 - RNA, 22 nt, Shigella flexneri 2a str. 301
ucauccagacugcucagcuccu

SEQ ID NO: 3913364 - RNA, 21 nt, Shigella flexneri 2a str. 301
ucauccagcacggugaagaag

SEQ ID NO: 3913365 - RNA, 23 nt, Shigella flexneri 2a str. 301
ucauccagcacggugaagaagcg

SEQ ID NO: 3913366 - RNA, 17 nt, Shigella flexneri 2a str. 301
ucauccagcgcacgggc

SEQ ID NO: 3913367 - RNA, 17 nt, Shigella flexneri 2a str. 301
ucauccaggaacuccag

SEQ ID NO: 3913368 - RNA, 16 nt, Shigella flexneri 2a str. 301
ucauccauaaauaccu

SEQ ID NO: 3913369 - RNA, 17 nt, Shigella flexneri 2a str. 301
ucauccauaccacgacc

SEQ ID NO: 3913370 - RNA, 17 nt, Shigella flexneri 2a str. 301
ucauccaucaaauuacc

SEQ ID NO: 3913371 - RNA, 17 nt, Shigella flexneri 2a str. 301
ucaucccaguggauauc

SEQ ID NO: 3913372 - RNA, 19 nt, Shigella flexneri 2a str. 301
ucaucccucucauccacgu

SEQ ID NO: 3913373 - RNA, 16 nt, Shigella flexneri 2a str. 301
ucauccgccgcucaau

SEQ ID NO: 3913374 - RNA, 15 nt, Shigella flexneri 2a str. 301
ucauccggcuguucc

SEQ ID NO: 3913375 - RNA, 21 nt, Shigella flexneri 2a str. 301
ucauccggcuuuuuuacauca

SEQ ID NO: 3913376 - RNA, 17 nt, Shigella flexneri 2a str. 301
ucauccgguguggcaug

SEQ ID NO: 3913377 - RNA, 16 nt, Shigella flexneri 2a str. 301
ucauccguuucucugu

SEQ ID NO: 3913378 - RNA, 16 nt, Shigella flexneri 2a str. 301
ucauccugcaccgguc

SEQ ID NO: 3913379 - RNA, 14 nt, Shigella flexneri 2a str. 301
ucauccugcgguaa

SEQ ID NO: 3913380 - RNA, 17 nt, Shigella flexneri 2a str. 301
ucauccugcugcacgcc

SEQ ID NO: 3913381 - RNA, 21 nt, Shigella flexneri 2a str. 301
ucauccuuccccgcuugggca

SEQ ID NO: 3913382 - RNA, 13 nt, Shigella flexneri 2a str. 301
ucaucgaauaaau

SEQ ID NO: 3913383 - RNA, 14 nt, Shigella flexneri 2a str. 301
ucaucgaauaaauu

SEQ ID NO: 3913384 - RNA, 13 nt, Shigella flexneri 2a str. 301
ucaucgacaucaa

SEQ ID NO: 3913385 - RNA, 19 nt, Shigella flexneri 2a str. 301
ucaucgauauuaucuucau

SEQ ID NO: 3913386 - RNA, 17 nt, Shigella flexneri 2a str. 301
ucaucgcauccagugcg

SEQ ID NO: 3913387 - RNA, 15 nt, Shigella flexneri 2a str. 301
ucaucgccagcgaau

SEQ ID NO: 3913388 - RNA, 15 nt, Shigella flexneri 2a str. 301
ucaucgcccaggcaa

SEQ ID NO: 3913389 - RNA, 23 nt, Shigella flexneri 2a str. 301
ucaucgcccaguugaucaccagu

SEQ ID NO: 3913390 - RNA, 13 nt, Shigella flexneri 2a str. 301
ucaucgccgccaa

SEQ ID NO: 3913391 - RNA, 15 nt, Shigella flexneri 2a str. 301
ucaucgccuuccagc

SEQ ID NO: 3913392 - RNA, 19 nt, Shigella flexneri 2a str. 301
ucaucgcgcccaaaccacc

SEQ ID NO: 3913393 - RNA, 15 nt, Shigella flexneri 2a str. 301
ucaucgcuacaccaa

SEQ ID NO: 3913394 - RNA, 21 nt, Shigella flexneri 2a str. 301
ucaucggaaugcaccgccuga

SEQ ID NO: 3913395 - RNA, 16 nt, Shigella flexneri 2a str. 301
ucaucggaucauuagu

SEQ ID NO: 3913396 - RNA, 23 nt, Shigella flexneri 2a str. 301
ucaucggcguugcccaucgccac

SEQ ID NO: 3913397 - RNA, 22 nt, Shigella flexneri 2a str. 301
ucaucgggaagaggaucugcuc

SEQ ID NO: 3913398 - RNA, 23 nt, Shigella flexneri 2a str. 301
ucaucggguuacugauuuuauug

SEQ ID NO: 3913399 - RNA, 23 nt, Shigella flexneri 2a str. 301
ucaucggucagcgcagugacauu

SEQ ID NO: 3913400 - RNA, 22 nt, Shigella flexneri 2a str. 301
ucaucggugguguaaccuucac

SEQ ID NO: 3913401 - RNA, 22 nt, Shigella flexneri 2a str. 301
ucaucguugaucuguaacgcac

SEQ ID NO: 3913402 - RNA, 17 nt, Shigella flexneri 2a str. 301
ucaucucgcucaaaaau

SEQ ID NO: 3913403 - RNA, 14 nt, Shigella flexneri 2a str. 301
ucaucucuccuuuc

SEQ ID NO: 3913404 - RNA, 19 nt, Shigella flexneri 2a str. 301
ucaucucuucuuccggcac

SEQ ID NO: 3913405 - RNA, 16 nt, Shigella flexneri 2a str. 301
ucaucugauaucucac

SEQ ID NO: 3913406 - RNA, 16 nt, Shigella flexneri 2a str. 301
ucaucugccacuucug

SEQ ID NO: 3913407 - RNA, 13 nt, Shigella flexneri 2a str. 301
ucaucugucauaa

SEQ ID NO: 3913408 - RNA, 21 nt, Shigella flexneri 2a str. 301
ucaucuucacuucaucccuga

SEQ ID NO: 3913409 - RNA, 16 nt, Shigella flexneri 2a str. 301
ucaucuucauaacuuu

SEQ ID NO: 3913410 - RNA, 19 nt, Shigella flexneri 2a str. 301
ucaucuucucuauaaaaaa

SEQ ID NO: 3913411 - RNA, 15 nt, Shigella flexneri 2a str. 301
ucaucuuguaggccu

SEQ ID NO: 3913412 - RNA, 21 nt, Shigella flexneri 2a str. 301
ucaucuuugagcaugauuuca

SEQ ID NO: 3913413 - RNA, 14 nt, Shigella flexneri 2a str. 301
ucaucuuugccuga

SEQ ID NO: 3913414 - RNA, 15 nt, Shigella flexneri 2a str. 301
ucaugaacacacccg

SEQ ID NO: 3913415 - RNA, 19 nt, Shigella flexneri 2a str. 301
ucaugaacacacccggaga

SEQ ID NO: 3913416 - RNA, 20 nt, Shigella flexneri 2a str. 301
ucaugaauauauaauuaaaa

SEQ ID NO: 3913417 - RNA, 23 nt, Shigella flexneri 2a str. 301
ucaugaauauauaauuaaaaaua

SEQ ID NO: 3913418 - RNA, 16 nt, Shigella flexneri 2a str. 301
ucaugacuacacuaaa

SEQ ID NO: 3913419 - RNA, 16 nt, Shigella flexneri 2a str. 301
ucaugagcagaccaau

SEQ ID NO: 3913420 - RNA, 20 nt, Shigella flexneri 2a str. 301
ucaugaugugcuucaucaga

SEQ ID NO: 3913421 - RNA, 18 nt, Shigella flexneri 2a str. 301
ucaugcaucgguuuugcg

SEQ ID NO: 3913422 - RNA, 14 nt, Shigella flexneri 2a str. 301
ucaugccaaaaaua

SEQ ID NO: 3913423 - RNA, 15 nt, Shigella flexneri 2a str. 301
ucaugccaaaaggga

SEQ ID NO: 3913424 - RNA, 13 nt, Shigella flexneri 2a str. 301
ucaugccagugau

SEQ ID NO: 3913425 - RNA, 19 nt, Shigella flexneri 2a str. 301
ucaugccgauaacucauau

SEQ ID NO: 3913426 - RNA, 18 nt, Shigella flexneri 2a str. 301
ucaugccgaucgucuggg

SEQ ID NO: 3913427 - RNA, 19 nt, Shigella flexneri 2a str. 301
ucaugccgcaauugucugu

SEQ ID NO: 3913428 - RNA, 20 nt, Shigella flexneri 2a str. 301
ucaugccgggcaaaagucac

SEQ ID NO: 3913429 - RNA, 15 nt, Shigella flexneri 2a str. 301
ucaugccuacauauu

SEQ ID NO: 3913430 - RNA, 15 nt, Shigella flexneri 2a str. 301
ucaugcgccagguaa

SEQ ID NO: 3913431 - RNA, 21 nt, Shigella flexneri 2a str. 301
ucaugcgccagguaacgaaga

SEQ ID NO: 3913432 - RNA, 16 nt, Shigella flexneri 2a str. 301
ucaugcuauuccuuga

SEQ ID NO: 3913433 - RNA, 24 nt, Shigella flexneri 2a str. 301
ucaugcugcuggguguagcgcauc

SEQ ID NO: 3913434 - RNA, 17 nt, Shigella flexneri 2a str. 301
ucauggcugacugucgc

SEQ ID NO: 3913435 - RNA, 20 nt, Shigella flexneri 2a str. 301
ucaugguuacgccggugauu

SEQ ID NO: 3913436 - RNA, 19 nt, Shigella flexneri 2a str. 301
ucaugguuuauuucccaga

SEQ ID NO: 3913437 - RNA, 20 nt, Shigella flexneri 2a str. 301
ucaugugcaggauuaauaaa

SEQ ID NO: 3913438 - RNA, 23 nt, Shigella flexneri 2a str. 301
ucaugugcaggauuaauaaauuu

SEQ ID NO: 3913439 - RNA, 14 nt, Shigella flexneri 2a str. 301
ucaugugucgccgc

SEQ ID NO: 3913440 - RNA, 18 nt, Shigella flexneri 2a str. 301
uccacgcugcaucgccaa

SEQ ID NO: 3913441 - RNA, 17 nt, Shigella flexneri 2a str. 301
uccacggaaucaccgcc

SEQ ID NO: 3913442 - RNA, 21 nt, Shigella flexneri 2a str. 301
uccacggacugaacgcccacg

SEQ ID NO: 3913443 - RNA, 21 nt, Shigella flexneri 2a str. 301
uccacgguccgugugaacgau

SEQ ID NO: 3913444 - RNA, 18 nt, Shigella flexneri 2a str. 301
uccacgguucuccacucu

SEQ ID NO: 3913445 - RNA, 14 nt, Shigella flexneri 2a str. 301
uccacguuccccag

SEQ ID NO: 3913446 - RNA, 12 nt, Shigella flexneri 2a str. 301
uccacugucaaa

SEQ ID NO: 3913447 - RNA, 14 nt, Shigella flexneri 2a str. 301
uccacugucaaauc

SEQ ID NO: 3913448 - RNA, 21 nt, Shigella flexneri 2a str. 301
uccacuucacggcugcuaaua

SEQ ID NO: 3913449 - RNA, 21 nt, Shigella flexneri 2a str. 301
uccacuucaucaagcaaggcc

SEQ ID NO: 3913450 - RNA, 21 nt, Shigella flexneri 2a str. 301
uccacuucugcacgguuuuuc

SEQ ID NO: 3913451 - RNA, 13 nt, Shigella flexneri 2a str. 301
uccacuugaaaau

SEQ ID NO: 3913452 - RNA, 15 nt, Shigella flexneri 2a str. 301
uccacuuucgcggcu

SEQ ID NO: 3913453 - RNA, 16 nt, Shigella flexneri 2a str. 301
uccacuuucgcggcuu

SEQ ID NO: 3913454 - RNA, 17 nt, Shigella flexneri 2a str. 301
uccacuuucgcggcuuu

SEQ ID NO: 3913455 - RNA, 23 nt, Shigella flexneri 2a str. 301
uccagaauaucuucaaccgucac

SEQ ID NO: 3913456 - RNA, 20 nt, Shigella flexneri 2a str. 301
uccagacgcgcagcuucacu

SEQ ID NO: 3913457 - RNA, 13 nt, Shigella flexneri 2a str. 301
uccagacgcugca

SEQ ID NO: 3913458 - RNA, 20 nt, Shigella flexneri 2a str. 301
uccagacggagcugccaggc

SEQ ID NO: 3913459 - RNA, 21 nt, Shigella flexneri 2a str. 301
uccagacgggucauaaucaga

SEQ ID NO: 3913460 - RNA, 22 nt, Shigella flexneri 2a str. 301
uccagacgggucauaaucagau

SEQ ID NO: 3913461 - RNA, 17 nt, Shigella flexneri 2a str. 301
uccagauaauaaucaac

SEQ ID NO: 3913462 - RNA, 19 nt, Shigella flexneri 2a str. 301
uccagauaauuaugccgau

SEQ ID NO: 3913463 - RNA, 23 nt, Shigella flexneri 2a str. 301
uccagauccauaagguccuccag

SEQ ID NO: 3913464 - RNA, 18 nt, Shigella flexneri 2a str. 301
uccagaucgaucauauuu

SEQ ID NO: 3913465 - RNA, 19 nt, Shigella flexneri 2a str. 301
uccagaucuuuuugcgcaa

SEQ ID NO: 3913466 - RNA, 20 nt, Shigella flexneri 2a str. 301
uccagaugcgagaugucccc

SEQ ID NO: 3913467 - RNA, 20 nt, Shigella flexneri 2a str. 301
uccagauggcuauaaucacu

SEQ ID NO: 3913468 - RNA, 22 nt, Shigella flexneri 2a str. 301
uccagaugugcaccuuuuccac

SEQ ID NO: 3913469 - RNA, 17 nt, Shigella flexneri 2a str. 301
uccagauuacuuaacuu

SEQ ID NO: 3913470 - RNA, 14 nt, Shigella flexneri 2a str. 301
uccagauucucaua

SEQ ID NO: 3913471 - RNA, 21 nt, Shigella flexneri 2a str. 301
uccagauugaucucuaaggca

SEQ ID NO: 3913472 - RNA, 17 nt, Shigella flexneri 2a str. 301
uccagauuuauaaaaga

SEQ ID NO: 3913473 - RNA, 14 nt, Shigella flexneri 2a str. 301
uccagauuuuucag

SEQ ID NO: 3913474 - RNA, 12 nt, Shigella flexneri 2a str. 301
uccagcaaaaag

SEQ ID NO: 3913475 - RNA, 14 nt, Shigella flexneri 2a str. 301
uccagcaacaacag

SEQ ID NO: 3913476 - RNA, 15 nt, Shigella flexneri 2a str. 301
uccagcaacaacagc

SEQ ID NO: 3913477 - RNA, 16 nt, Shigella flexneri 2a str. 301
uccagcaacaacagcg

SEQ ID NO: 3913478 - RNA, 19 nt, Shigella flexneri 2a str. 301
uccagcaacaacagcgcga

SEQ ID NO: 3913479 - RNA, 19 nt, Shigella flexneri 2a str. 301
uccagcaaccaaugccacc

SEQ ID NO: 3913480 - RNA, 14 nt, Shigella flexneri 2a str. 301
uccagcaagccacu

SEQ ID NO: 3913481 - RNA, 10 nt, Shigella flexneri 2a str. 301
uccagcacca

SEQ ID NO: 3913482 - RNA, 13 nt, Shigella flexneri 2a str. 301
uccagcaccacuu

SEQ ID NO: 3913483 - RNA, 15 nt, Shigella flexneri 2a str. 301
uccagcaccgucacc

SEQ ID NO: 3913484 - RNA, 23 nt, Shigella flexneri 2a str. 301
uccagcacuugcaggaacagugc

SEQ ID NO: 3913485 - RNA, 18 nt, Shigella flexneri 2a str. 301
uccagcagaccagcaaaa

SEQ ID NO: 3913486 - RNA, 22 nt, Shigella flexneri 2a str. 301
uccagcagaccuucugccagac

SEQ ID NO: 3913487 - RNA, 12 nt, Shigella flexneri 2a str. 301
uccagcagcccu

SEQ ID NO: 3913488 - RNA, 17 nt, Shigella flexneri 2a str. 301
uccagcagcgcaauuaa

SEQ ID NO: 3913489 - RNA, 15 nt, Shigella flexneri 2a str. 301
uccagcauaaugacu

SEQ ID NO: 3913490 - RNA, 16 nt, Shigella flexneri 2a str. 301
uccagcauaaugugcg

SEQ ID NO: 3913491 - RNA, 15 nt, Shigella flexneri 2a str. 301
uccagcauaccuucc

SEQ ID NO: 3913492 - RNA, 18 nt, Shigella flexneri 2a str. 301
uccagcauaguacgggca

SEQ ID NO: 3913493 - RNA, 19 nt, Shigella flexneri 2a str. 301
uccagcauauguuuacgcu

SEQ ID NO: 3913494 - RNA, 16 nt, Shigella flexneri 2a str. 301
uccagcaucuguucuu

SEQ ID NO: 3913495 - RNA, 21 nt, Shigella flexneri 2a str. 301
uccagccaccgcguggcagac

SEQ ID NO: 3913496 - RNA, 19 nt, Shigella flexneri 2a str. 301
uccagccacggcuccagca

SEQ ID NO: 3913497 - RNA, 12 nt, Shigella flexneri 2a str. 301
uccagccagagc

SEQ ID NO: 3913498 - RNA, 16 nt, Shigella flexneri 2a str. 301
uccagccagucggaac

SEQ ID NO: 3913499 - RNA, 23 nt, Shigella flexneri 2a str. 301
uccagccagucggaaccggcgau

SEQ ID NO: 3913500 - RNA, 21 nt, Shigella flexneri 2a str. 301
uccagccguuuaccccaguca

SEQ ID NO: 3913501 - RNA, 15 nt, Shigella flexneri 2a str. 301
uccagcgacuccagu

SEQ ID NO: 3913502 - RNA, 16 nt, Shigella flexneri 2a str. 301
uccagcgacuccaguu

SEQ ID NO: 3913503 - RNA, 21 nt, Shigella flexneri 2a str. 301
uccagcgauaccggugcaccu

SEQ ID NO: 3913504 - RNA, 13 nt, Shigella flexneri 2a str. 301
uccagcgcaaagg

SEQ ID NO: 3913505 - RNA, 20 nt, Shigella flexneri 2a str. 301
uccagcgcaucccauuucuc

SEQ ID NO: 3913506 - RNA, 18 nt, Shigella flexneri 2a str. 301
uccagcgccaguaauucu

SEQ ID NO: 3913507 - RNA, 22 nt, Shigella flexneri 2a str. 301
uccagcgccauuggcuuuugcu

SEQ ID NO: 3913508 - RNA, 23 nt, Shigella flexneri 2a str. 301
uccagcgccauuggcuuuugcuu

SEQ ID NO: 3913509 - RNA, 13 nt, Shigella flexneri 2a str. 301
uccagcgccgcca

SEQ ID NO: 3913510 - RNA, 18 nt, Shigella flexneri 2a str. 301
uccagcgcguaaauaccu

SEQ ID NO: 3913511 - RNA, 14 nt, Shigella flexneri 2a str. 301
uccagcgcugcggc

SEQ ID NO: 3913512 - RNA, 23 nt, Shigella flexneri 2a str. 301
uccagcgguaacuuaucuguaau

SEQ ID NO: 3913513 - RNA, 12 nt, Shigella flexneri 2a str. 301
uccagcgucagu

SEQ ID NO: 3913514 - RNA, 16 nt, Shigella flexneri 2a str. 301
uccagcguuaccggcu

SEQ ID NO: 3913515 - RNA, 17 nt, Shigella flexneri 2a str. 301
uccagcguuaccggcuu

SEQ ID NO: 3913516 - RNA, 15 nt, Shigella flexneri 2a str. 301
uccagcuccguccag

SEQ ID NO: 3913517 - RNA, 16 nt, Shigella flexneri 2a str. 301
uccagcucuucuucac

SEQ ID NO: 3913518 - RNA, 18 nt, Shigella flexneri 2a str. 301
uccagcucuuuuccagcc

SEQ ID NO: 3913519 - RNA, 17 nt, Shigella flexneri 2a str. 301
uccagcuucacuuucag

SEQ ID NO: 3913520 - RNA, 18 nt, Shigella flexneri 2a str. 301
uccagcuucacuuucagu

SEQ ID NO: 3913521 - RNA, 20 nt, Shigella flexneri 2a str. 301
uccagcuuuuuaaucgccau

SEQ ID NO: 3913522 - RNA, 17 nt, Shigella flexneri 2a str. 301
uccaggaacagaagaaa

SEQ ID NO: 3913523 - RNA, 13 nt, Shigella flexneri 2a str. 301
uccaggaacucca

SEQ ID NO: 3913524 - RNA, 20 nt, Shigella flexneri 2a str. 301
uccaggagcuccagguccuc

SEQ ID NO: 3913525 - RNA, 14 nt, Shigella flexneri 2a str. 301
uccaggcaaucagc

SEQ ID NO: 3913526 - RNA, 20 nt, Shigella flexneri 2a str. 301
uccaggcagauuuuuuaacu

SEQ ID NO: 3913527 - RNA, 16 nt, Shigella flexneri 2a str. 301
uccaggcucgccgccg

SEQ ID NO: 3913528 - RNA, 22 nt, Shigella flexneri 2a str. 301
uccaggcugcaaagucugggcu

SEQ ID NO: 3913529 - RNA, 15 nt, Shigella flexneri 2a str. 301
uccagggccucuccu

SEQ ID NO: 3913530 - RNA, 23 nt, Shigella flexneri 2a str. 301
uccagggcgaaaagcuucuuccu

SEQ ID NO: 3913531 - RNA, 18 nt, Shigella flexneri 2a str. 301
uccaggguaaacaucggu

SEQ ID NO: 3913532 - RNA, 14 nt, Shigella flexneri 2a str. 301
uccagguauuuaac

SEQ ID NO: 3913533 - RNA, 13 nt, Shigella flexneri 2a str. 301
uccagguccuccu

SEQ ID NO: 3913534 - RNA, 21 nt, Shigella flexneri 2a str. 301
uccagguccuccuguaccuuc

SEQ ID NO: 3913535 - RNA, 14 nt, Shigella flexneri 2a str. 301
uccagguuacgcac

SEQ ID NO: 3913536 - RNA, 16 nt, Shigella flexneri 2a str. 301
uccagguuucuuccag

SEQ ID NO: 3913537 - RNA, 12 nt, Shigella flexneri 2a str. 301
uccaguaagcug

SEQ ID NO: 3913538 - RNA, 15 nt, Shigella flexneri 2a str. 301
uccaguaccugcaaa

SEQ ID NO: 3913539 - RNA, 17 nt, Shigella flexneri 2a str. 301
uccaguagauucaacau

SEQ ID NO: 3913540 - RNA, 23 nt, Shigella flexneri 2a str. 301
uccccaaaaaaucaacgacaaaa

SEQ ID NO: 3913541 - RNA, 11 nt, Shigella flexneri 2a str. 301
uccccaauacg

SEQ ID NO: 3913542 - RNA, 15 nt, Shigella flexneri 2a str. 301
uccccaaugaccuuu

SEQ ID NO: 3913543 - RNA, 16 nt, Shigella flexneri 2a str. 301
uccccacaaccggcgg

SEQ ID NO: 3913544 - RNA, 20 nt, Shigella flexneri 2a str. 301
uccccacaggcgaugcacau

SEQ ID NO: 3913545 - RNA, 15 nt, Shigella flexneri 2a str. 301
uccccaccucaucag

SEQ ID NO: 3913546 - RNA, 18 nt, Shigella flexneri 2a str. 301
uccccaccuguccagacg

SEQ ID NO: 3913547 - RNA, 14 nt, Shigella flexneri 2a str. 301
uccccagaaaauuu

SEQ ID NO: 3913548 - RNA, 16 nt, Shigella flexneri 2a str. 301
uccccagaccugcugu

SEQ ID NO: 3913549 - RNA, 17 nt, Shigella flexneri 2a str. 301
uccccagaccugcuguc

SEQ ID NO: 3913550 - RNA, 20 nt, Shigella flexneri 2a str. 301
uccccagcggaaaauaucgc

SEQ ID NO: 3913551 - RNA, 16 nt, Shigella flexneri 2a str. 301
uccccaggguuucucc

SEQ ID NO: 3913552 - RNA, 14 nt, Shigella flexneri 2a str. 301
uccccauaucaggc

SEQ ID NO: 3913553 - RNA, 22 nt, Shigella flexneri 2a str. 301
uccccauggacgcgucagucgc

SEQ ID NO: 3913554 - RNA, 12 nt, Shigella flexneri 2a str. 301
ucccccacagcu

SEQ ID NO: 3913555 - RNA, 14 nt, Shigella flexneri 2a str. 301
ucccccacagcucu

SEQ ID NO: 3913556 - RNA, 13 nt, Shigella flexneri 2a str. 301
uccccccucugau

SEQ ID NO: 3913557 - RNA, 16 nt, Shigella flexneri 2a str. 301
uccccccucugaucag

SEQ ID NO: 3913558 - RNA, 17 nt, Shigella flexneri 2a str. 301
ucccccgcgagaagcgg

SEQ ID NO: 3913559 - RNA, 18 nt, Shigella flexneri 2a str. 301
ucccccuuucugagagga

SEQ ID NO: 3913560 - RNA, 19 nt, Shigella flexneri 2a str. 301
uccccgauuguugaugagc

SEQ ID NO: 3913561 - RNA, 16 nt, Shigella flexneri 2a str. 301
uccccgcagcccaucc

SEQ ID NO: 3913562 - RNA, 15 nt, Shigella flexneri 2a str. 301
uccccgccucaccgc

SEQ ID NO: 3913563 - RNA, 13 nt, Shigella flexneri 2a str. 301
uccccgcucuccc

SEQ ID NO: 3913564 - RNA, 16 nt, Shigella flexneri 2a str. 301
uccccgcuucgcccgc

SEQ ID NO: 3913565 - RNA, 16 nt, Shigella flexneri 2a str. 301
uccccggaaucagagg

SEQ ID NO: 3913566 - RNA, 17 nt, Shigella flexneri 2a str. 301
uccccggauucaugcua

SEQ ID NO: 3913567 - RNA, 16 nt, Shigella flexneri 2a str. 301
uccccggucagcagca

SEQ ID NO: 3913568 - RNA, 11 nt, Shigella flexneri 2a str. 301
uccccggugaa

SEQ ID NO: 3913569 - RNA, 15 nt, Shigella flexneri 2a str. 301
uccccguaucuucau

SEQ ID NO: 3913570 - RNA, 16 nt, Shigella flexneri 2a str. 301
uccccucaauaauaau

SEQ ID NO: 3913571 - RNA, 22 nt, Shigella flexneri 2a str. 301
uccccucaucagugaacccaua

SEQ ID NO: 3913572 - RNA, 22 nt, Shigella flexneri 2a str. 301
uccccucgccccuucggggaga

SEQ ID NO: 3913573 - RNA, 14 nt, Shigella flexneri 2a str. 301
uccccucgcuccuc

SEQ ID NO: 3913574 - RNA, 14 nt, Shigella flexneri 2a str. 301
uccccugcgcggcg

SEQ ID NO: 3913575 - RNA, 16 nt, Shigella flexneri 2a str. 301
uccccuggggagugac

SEQ ID NO: 3913576 - RNA, 21 nt, Shigella flexneri 2a str. 301
uccccuucucaaucccuuucu

SEQ ID NO: 3913577 - RNA, 14 nt, Shigella flexneri 2a str. 301
ucccgaaaaaccug

SEQ ID NO: 3913578 - RNA, 22 nt, Shigella flexneri 2a str. 301
ucccgaggaucacaaugccacc

SEQ ID NO: 3913579 - RNA, 16 nt, Shigella flexneri 2a str. 301
ucccgauaaccgcaaa

SEQ ID NO: 3913580 - RNA, 18 nt, Shigella flexneri 2a str. 301
ucccgauggucagcuuca

SEQ ID NO: 3913581 - RNA, 13 nt, Shigella flexneri 2a str. 301
ucccgcaccagcg

SEQ ID NO: 3913582 - RNA, 19 nt, Shigella flexneri 2a str. 301
ucccgcagccacgucaccu

SEQ ID NO: 3913583 - RNA, 22 nt, Shigella flexneri 2a str. 301
ucccgcagccacgucaccugcc

SEQ ID NO: 3913584 - RNA, 22 nt, Shigella flexneri 2a str. 301
ucccgccagaugauauggcaaa

SEQ ID NO: 3913585 - RNA, 15 nt, Shigella flexneri 2a str. 301
ucccgccagcaccag

SEQ ID NO: 3913586 - RNA, 17 nt, Shigella flexneri 2a str. 301
ucccgccgcuggcggga

SEQ ID NO: 3913587 - RNA, 22 nt, Shigella flexneri 2a str. 301
ucccgccgcuucaccaaucaga

SEQ ID NO: 3913588 - RNA, 23 nt, Shigella flexneri 2a str. 301
ucccgcgccgcagccggaaaacc

SEQ ID NO: 3913589 - RNA, 14 nt, Shigella flexneri 2a str. 301
ucccgcucuguaag

SEQ ID NO: 3913590 - RNA, 23 nt, Shigella flexneri 2a str. 301
ucccgcuguuuguucaagcgcaa

SEQ ID NO: 3913591 - RNA, 15 nt, Shigella flexneri 2a str. 301
ucccgcuuacaucaa

SEQ ID NO: 3913592 - RNA, 20 nt, Shigella flexneri 2a str. 301
ucccgcuucaacgaccgcuu

SEQ ID NO: 3913593 - RNA, 18 nt, Shigella flexneri 2a str. 301
ucccgcuucguuuucagc

SEQ ID NO: 3913594 - RNA, 19 nt, Shigella flexneri 2a str. 301
ucccgcuucguuuucagcu

SEQ ID NO: 3913595 - RNA, 19 nt, Shigella flexneri 2a str. 301
ucccggauaaaucuccauu

SEQ ID NO: 3913596 - RNA, 20 nt, Shigella flexneri 2a str. 301
ucccggauaaaucuccauuu

SEQ ID NO: 3913597 - RNA, 17 nt, Shigella flexneri 2a str. 301
ucccggauaucccagcu

SEQ ID NO: 3913598 - RNA, 16 nt, Shigella flexneri 2a str. 301
ucccggcaagauucca

SEQ ID NO: 3913599 - RNA, 21 nt, Shigella flexneri 2a str. 301
ucccggcaaucaccgccagcg

SEQ ID NO: 3913600 - RNA, 15 nt, Shigella flexneri 2a str. 301
ucccggcagagaaaa

SEQ ID NO: 3913601 - RNA, 16 nt, Shigella flexneri 2a str. 301
ucccggcauuucugau

SEQ ID NO: 3913602 - RNA, 13 nt, Shigella flexneri 2a str. 301
ucccggcucaucc

SEQ ID NO: 3913603 - RNA, 13 nt, Shigella flexneri 2a str. 301
ucccggugaagcg

SEQ ID NO: 3913604 - RNA, 14 nt, Shigella flexneri 2a str. 301
ucccgguuauuaaa

SEQ ID NO: 3913605 - RNA, 21 nt, Shigella flexneri 2a str. 301
ucccguaauccguaaagccca

SEQ ID NO: 3913606 - RNA, 14 nt, Shigella flexneri 2a str. 301
ucccgugaugcggu

SEQ ID NO: 3913607 - RNA, 14 nt, Shigella flexneri 2a str. 301
ucccgugccagagc

SEQ ID NO: 3913608 - RNA, 16 nt, Shigella flexneri 2a str. 301
ucccgugccagagcau

SEQ ID NO: 3913609 - RNA, 17 nt, Shigella flexneri 2a str. 301
ucccguuucagccccuu

SEQ ID NO: 3913610 - RNA, 15 nt, Shigella flexneri 2a str. 301
ucccguuucccuguc

SEQ ID NO: 3913611 - RNA, 12 nt, Shigella flexneri 2a str. 301
ucccuaaaauau

SEQ ID NO: 3913612 - RNA, 13 nt, Shigella flexneri 2a str. 301
ucccuaaaauauu

SEQ ID NO: 3913613 - RNA, 23 nt, Shigella flexneri 2a str. 301
ucccucaacaacagucucugccg

SEQ ID NO: 3913614 - RNA, 22 nt, Shigella flexneri 2a str. 301
ucccucacccccauucccgcau

SEQ ID NO: 3913615 - RNA, 18 nt, Shigella flexneri 2a str. 301
ucccucauacugguuucu

SEQ ID NO: 3913616 - RNA, 19 nt, Shigella flexneri 2a str. 301
ucccucccguuucccuguc

SEQ ID NO: 3913617 - RNA, 14 nt, Shigella flexneri 2a str. 301
ucccucuuucuggc

SEQ ID NO: 3913618 - RNA, 15 nt, Shigella flexneri 2a str. 301
ucccugaaggcugcc

SEQ ID NO: 3913619 - RNA, 15 nt, Shigella flexneri 2a str. 301
ucccugacaaaucau

SEQ ID NO: 3913620 - RNA, 21 nt, Shigella flexneri 2a str. 301
ucccugacaaaucaugcggau

SEQ ID NO: 3913621 - RNA, 23 nt, Shigella flexneri 2a str. 301
ucccugcacuaugaaugaacaaa

SEQ ID NO: 3913622 - RNA, 15 nt, Shigella flexneri 2a str. 301
ucccugcgccagcgg

SEQ ID NO: 3913623 - RNA, 16 nt, Shigella flexneri 2a str. 301
ucccugcggaaaaaag

SEQ ID NO: 3913624 - RNA, 11 nt, Shigella flexneri 2a str. 301
ucccugcggua

SEQ ID NO: 3913625 - RNA, 16 nt, Shigella flexneri 2a str. 301
ucccugcuguccugag

SEQ ID NO: 3913626 - RNA, 21 nt, Shigella flexneri 2a str. 301
ucccuggcccaucgccagugc

SEQ ID NO: 3913627 - RNA, 14 nt, Shigella flexneri 2a str. 301
ucccuguaucccag

SEQ ID NO: 3913628 - RNA, 14 nt, Shigella flexneri 2a str. 301
ucccugucucucag

SEQ ID NO: 3913629 - RNA, 19 nt, Shigella flexneri 2a str. 301
ucccuuaacacuuguuaug

SEQ ID NO: 3913630 - RNA, 13 nt, Shigella flexneri 2a str. 301
ucccuucaaucuc

SEQ ID NO: 3913631 - RNA, 17 nt, Shigella flexneri 2a str. 301
ucccuucagccaccagg

SEQ ID NO: 3913632 - RNA, 20 nt, Shigella flexneri 2a str. 301
ucccuucagccaccagguuc

SEQ ID NO: 3913633 - RNA, 21 nt, Shigella flexneri 2a str. 301
ucccuucagccaccagguuca

SEQ ID NO: 3913634 - RNA, 15 nt, Shigella flexneri 2a str. 301
ucccuucccagccgg

SEQ ID NO: 3913635 - RNA, 18 nt, Shigella flexneri 2a str. 301
ucccuucguucucugcaa

SEQ ID NO: 3913636 - RNA, 12 nt, Shigella flexneri 2a str. 301
ucccuugucuga

SEQ ID NO: 3913637 - RNA, 17 nt, Shigella flexneri 2a str. 301
ucccuuguuauugugua

SEQ ID NO: 3913638 - RNA, 15 nt, Shigella flexneri 2a str. 301
ucccuuucucuucaa

SEQ ID NO: 3913639 - RNA, 13 nt, Shigella flexneri 2a str. 301
ucccuuucugcag

SEQ ID NO: 3913640 - RNA, 14 nt, Shigella flexneri 2a str. 301
ucccuuuuucaagc

SEQ ID NO: 3913641 - RNA, 23 nt, Shigella flexneri 2a str. 301
uccggcuaccgggccugaacaag

SEQ ID NO: 3913642 - RNA, 20 nt, Shigella flexneri 2a str. 301
uccggcugaggcguuucaac

SEQ ID NO: 3913643 - RNA, 20 nt, Shigella flexneri 2a str. 301
uccggcugccagccaggaua

SEQ ID NO: 3913644 - RNA, 16 nt, Shigella flexneri 2a str. 301
uccggcuguuccagca

SEQ ID NO: 3913645 - RNA, 18 nt, Shigella flexneri 2a str. 301
uccggcuuguucaucacc

SEQ ID NO: 3913646 - RNA, 18 nt, Shigella flexneri 2a str. 301
uccgggaaaacgcuggca

SEQ ID NO: 3913647 - RNA, 20 nt, Shigella flexneri 2a str. 301
uccgggaaaacgcuggcagc

SEQ ID NO: 3913648 - RNA, 23 nt, Shigella flexneri 2a str. 301
uccgggaaaacgcuggcagcauu

SEQ ID NO: 3913649 - RNA, 23 nt, Shigella flexneri 2a str. 301
uccgggaacaacgcaagcggcau

SEQ ID NO: 3913650 - RNA, 17 nt, Shigella flexneri 2a str. 301
uccgggagcaauuugua

SEQ ID NO: 3913651 - RNA, 16 nt, Shigella flexneri 2a str. 301
uccgggauggucagcg

SEQ ID NO: 3913652 - RNA, 17 nt, Shigella flexneri 2a str. 301
uccgggauggucagcgg

SEQ ID NO: 3913653 - RNA, 22 nt, Shigella flexneri 2a str. 301
uccgggccgaacaucagauaau

SEQ ID NO: 3913654 - RNA, 22 nt, Shigella flexneri 2a str. 301
uccgggccgcaaaccagcgcau

SEQ ID NO: 3913655 - RNA, 20 nt, Shigella flexneri 2a str. 301
uccgggcuauauacccuucu

SEQ ID NO: 3913656 - RNA, 23 nt, Shigella flexneri 2a str. 301
uccgggcugguuuucagcgaaac

SEQ ID NO: 3913657 - RNA, 14 nt, Shigella flexneri 2a str. 301
uccggggaagcgca

SEQ ID NO: 3913658 - RNA, 17 nt, Shigella flexneri 2a str. 301
uccgggucauccaggaa

SEQ ID NO: 3913659 - RNA, 19 nt, Shigella flexneri 2a str. 301
uccggguuugccacaucac

SEQ ID NO: 3913660 - RNA, 14 nt, Shigella flexneri 2a str. 301
uccgguacgugcgu

SEQ ID NO: 3913661 - RNA, 23 nt, Shigella flexneri 2a str. 301
uccgguauacgucccggugaagc

SEQ ID NO: 3913662 - RNA, 17 nt, Shigella flexneri 2a str. 301
uccggugcugcgucagu

SEQ ID NO: 3913663 - RNA, 18 nt, Shigella flexneri 2a str. 301
uccgguguaucugggcga

SEQ ID NO: 3913664 - RNA, 16 nt, Shigella flexneri 2a str. 301
uccgguguuuucucuc

SEQ ID NO: 3913665 - RNA, 23 nt, Shigella flexneri 2a str. 301
uccgguuuacuuccgggaaaacc

SEQ ID NO: 3913666 - RNA, 14 nt, Shigella flexneri 2a str. 301
uccguaauuuuuac

SEQ ID NO: 3913667 - RNA, 14 nt, Shigella flexneri 2a str. 301
uccguaccagccuu

SEQ ID NO: 3913668 - RNA, 22 nt, Shigella flexneri 2a str. 301
uccguagugaaaaagcucccua

SEQ ID NO: 3913669 - RNA, 19 nt, Shigella flexneri 2a str. 301
uccgucaccggaauaauga

SEQ ID NO: 3913670 - RNA, 15 nt, Shigella flexneri 2a str. 301
uccgucagaccaauc

SEQ ID NO: 3913671 - RNA, 22 nt, Shigella flexneri 2a str. 301
uccgucagccacuccacugaag

SEQ ID NO: 3913672 - RNA, 14 nt, Shigella flexneri 2a str. 301
uccgucagcggcaa

SEQ ID NO: 3913673 - RNA, 21 nt, Shigella flexneri 2a str. 301
uccguccuccguaucuuguca

SEQ ID NO: 3913674 - RNA, 20 nt, Shigella flexneri 2a str. 301
uccgucgcgaaucccgugcc

SEQ ID NO: 3913675 - RNA, 18 nt, Shigella flexneri 2a str. 301
uccgugacuuccagcgua

SEQ ID NO: 3913676 - RNA, 12 nt, Shigella flexneri 2a str. 301
uccguguucguc

SEQ ID NO: 3913677 - RNA, 21 nt, Shigella flexneri 2a str. 301
uccguuaaccgugggaaacag

SEQ ID NO: 3913678 - RNA, 21 nt, Shigella flexneri 2a str. 301
uccguucaaaacagcccuuuc

SEQ ID NO: 3913679 - RNA, 16 nt, Shigella flexneri 2a str. 301
uccguugaaaaugcug

SEQ ID NO: 3913680 - RNA, 16 nt, Shigella flexneri 2a str. 301
uccguuucuaucucuu

SEQ ID NO: 3913681 - RNA, 19 nt, Shigella flexneri 2a str. 301
uccguuugcgucaugguau

SEQ ID NO: 3913682 - RNA, 17 nt, Shigella flexneri 2a str. 301
uccguuuucagugucca

SEQ ID NO: 3913683 - RNA, 14 nt, Shigella flexneri 2a str. 301
uccguuuuccagcc

SEQ ID NO: 3913684 - RNA, 15 nt, Shigella flexneri 2a str. 301
uccuaaaaacaguac

SEQ ID NO: 3913685 - RNA, 19 nt, Shigella flexneri 2a str. 301
uccuaaaggcaaaaugcca

SEQ ID NO: 3913686 - RNA, 15 nt, Shigella flexneri 2a str. 301
uccuaacaaccaucc

SEQ ID NO: 3913687 - RNA, 21 nt, Shigella flexneri 2a str. 301
uccuacaacugggacaugauu

SEQ ID NO: 3913688 - RNA, 14 nt, Shigella flexneri 2a str. 301
uccuacacauacuu

SEQ ID NO: 3913689 - RNA, 19 nt, Shigella flexneri 2a str. 301
uccuacaccgaacaacugu

SEQ ID NO: 3913690 - RNA, 19 nt, Shigella flexneri 2a str. 301
uccuauauuugaggaguuu

SEQ ID NO: 3913691 - RNA, 15 nt, Shigella flexneri 2a str. 301
uccuaucgugguucc

SEQ ID NO: 3913692 - RNA, 18 nt, Shigella flexneri 2a str. 301
uccuaugcaacaacugaa

SEQ ID NO: 3913693 - RNA, 19 nt, Shigella flexneri 2a str. 301
uccuaugcaacaacugaaa

SEQ ID NO: 3913694 - RNA, 22 nt, Shigella flexneri 2a str. 301
uccuauuguugauaaggaaauu

SEQ ID NO: 3913695 - RNA, 13 nt, Shigella flexneri 2a str. 301
uccucaagaauau

SEQ ID NO: 3913696 - RNA, 22 nt, Shigella flexneri 2a str. 301
uccucaagaauaugcuuugccu

SEQ ID NO: 3913697 - RNA, 15 nt, Shigella flexneri 2a str. 301
uccucaauuaacauu

SEQ ID NO: 3913698 - RNA, 22 nt, Shigella flexneri 2a str. 301
uccucacuguuuucuaacucau

SEQ ID NO: 3913699 - RNA, 23 nt, Shigella flexneri 2a str. 301
uccucaucgauauuaucuucauc

SEQ ID NO: 3913700 - RNA, 19 nt, Shigella flexneri 2a str. 301
uccuccggcuccacuucgu

SEQ ID NO: 3913701 - RNA, 22 nt, Shigella flexneri 2a str. 301
uccuccgucaucuuuaacgugg

SEQ ID NO: 3913702 - RNA, 20 nt, Shigella flexneri 2a str. 301
uccucgaguccuuccagguc

SEQ ID NO: 3913703 - RNA, 20 nt, Shigella flexneri 2a str. 301
uccucgccguuuucuggggc

SEQ ID NO: 3913704 - RNA, 21 nt, Shigella flexneri 2a str. 301
uccucguuucgcccugccuuu

SEQ ID NO: 3913705 - RNA, 15 nt, Shigella flexneri 2a str. 301
uccucucaugagcag

SEQ ID NO: 3913706 - RNA, 16 nt, Shigella flexneri 2a str. 301
uccucugacuggacuc

SEQ ID NO: 3913707 - RNA, 23 nt, Shigella flexneri 2a str. 301
uccucugucaggguuauagccuu

SEQ ID NO: 3913708 - RNA, 20 nt, Shigella flexneri 2a str. 301
uccucuucccagacccaguu

SEQ ID NO: 3913709 - RNA, 17 nt, Shigella flexneri 2a str. 301
uccucuuucaucucccg

SEQ ID NO: 3913710 - RNA, 14 nt, Shigella flexneri 2a str. 301
uccugaaaccauag

SEQ ID NO: 3913711 - RNA, 23 nt, Shigella flexneri 2a str. 301
uccugaaaccauagcaucccaau

SEQ ID NO: 3913712 - RNA, 15 nt, Shigella flexneri 2a str. 301
uccugaaauuccuga

SEQ ID NO: 3913713 - RNA, 23 nt, Shigella flexneri 2a str. 301
uccugaacggucgaggcaaccag

SEQ ID NO: 3913714 - RNA, 14 nt, Shigella flexneri 2a str. 301
uccugaacuuucuc

SEQ ID NO: 3913715 - RNA, 20 nt, Shigella flexneri 2a str. 301
uccugaagaagcguuccauu

SEQ ID NO: 3913716 - RNA, 19 nt, Shigella flexneri 2a str. 301
uccugaagacgccucgcau

SEQ ID NO: 3913717 - RNA, 13 nt, Shigella flexneri 2a str. 301
uccugaccaccau

SEQ ID NO: 3913718 - RNA, 21 nt, Shigella flexneri 2a str. 301
uccugacccagcaaggcgcuu

SEQ ID NO: 3913719 - RNA, 22 nt, Shigella flexneri 2a str. 301
uccugacggugauacagcaaaa

SEQ ID NO: 3913720 - RNA, 23 nt, Shigella flexneri 2a str. 301
uccugacggugauacagcaaaau

SEQ ID NO: 3913721 - RNA, 22 nt, Shigella flexneri 2a str. 301
uccugacguaacgaccaccacc

SEQ ID NO: 3913722 - RNA, 16 nt, Shigella flexneri 2a str. 301
uccugacuugccagau

SEQ ID NO: 3913723 - RNA, 16 nt, Shigella flexneri 2a str. 301
uccugagcacuggggc

SEQ ID NO: 3913724 - RNA, 23 nt, Shigella flexneri 2a str. 301
uccugagccggaacuuugcugca

SEQ ID NO: 3913725 - RNA, 22 nt, Shigella flexneri 2a str. 301
uccugauaaaaaccauucaggc

SEQ ID NO: 3913726 - RNA, 19 nt, Shigella flexneri 2a str. 301
uccugauacagaccgcgca

SEQ ID NO: 3913727 - RNA, 23 nt, Shigella flexneri 2a str. 301
uccugaucaagcacaugcugaca

SEQ ID NO: 3913728 - RNA, 13 nt, Shigella flexneri 2a str. 301
uccugcaacagca

SEQ ID NO: 3913729 - RNA, 20 nt, Shigella flexneri 2a str. 301
uccugcacaaauuugccguc

SEQ ID NO: 3913730 - RNA, 22 nt, Shigella flexneri 2a str. 301
uccugcacggcuucccacguca

SEQ ID NO: 3913731 - RNA, 21 nt, Shigella flexneri 2a str. 301
uccugcacggucacaucgcug

SEQ ID NO: 3913732 - RNA, 15 nt, Shigella flexneri 2a str. 301
uccugcacuuucagc

SEQ ID NO: 3913733 - RNA, 15 nt, Shigella flexneri 2a str. 301
uccugcagcguugcc

SEQ ID NO: 3913734 - RNA, 18 nt, Shigella flexneri 2a str. 301
uccugcagcuucacggaa

SEQ ID NO: 3913735 - RNA, 18 nt, Shigella flexneri 2a str. 301
uccugcauugacucgccu

SEQ ID NO: 3913736 - RNA, 19 nt, Shigella flexneri 2a str. 301
uccugcauugacucgccuu

SEQ ID NO: 3913737 - RNA, 14 nt, Shigella flexneri 2a str. 301
uccugccacuguuc

SEQ ID NO: 3913738 - RNA, 19 nt, Shigella flexneri 2a str. 301
uccugccaguuauagcgca

SEQ ID NO: 3913739 - RNA, 20 nt, Shigella flexneri 2a str. 301
ucgacagcgauuccaguucg

SEQ ID NO: 3913740 - RNA, 15 nt, Shigella flexneri 2a str. 301
ucgacaguugcugcg

SEQ ID NO: 3913741 - RNA, 18 nt, Shigella flexneri 2a str. 301
ucgacaguuucaccugcu

SEQ ID NO: 3913742 - RNA, 14 nt, Shigella flexneri 2a str. 301
ucgacaucugcaau

SEQ ID NO: 3913743 - RNA, 20 nt, Shigella flexneri 2a str. 301
ucgaccacuuuaaccagucg

SEQ ID NO: 3913744 - RNA, 12 nt, Shigella flexneri 2a str. 301
ucgaccagccag

SEQ ID NO: 3913745 - RNA, 21 nt, Shigella flexneri 2a str. 301
ucgaccagccaggccgccagu

SEQ ID NO: 3913746 - RNA, 16 nt, Shigella flexneri 2a str. 301
ucgaccaggauuugau

SEQ ID NO: 3913747 - RNA, 21 nt, Shigella flexneri 2a str. 301
ucgaccaggccaucagcagcg

SEQ ID NO: 3913748 - RNA, 17 nt, Shigella flexneri 2a str. 301
ucgacccgacagaugcu

SEQ ID NO: 3913749 - RNA, 18 nt, Shigella flexneri 2a str. 301
ucgaccggguuucuuauu

SEQ ID NO: 3913750 - RNA, 17 nt, Shigella flexneri 2a str. 301
ucgacgagaauuuccuu

SEQ ID NO: 3913751 - RNA, 18 nt, Shigella flexneri 2a str. 301
ucgacgagaauuuccuuc

SEQ ID NO: 3913752 - RNA, 18 nt, Shigella flexneri 2a str. 301
ucgacgccacaaucugau

SEQ ID NO: 3913753 - RNA, 20 nt, Shigella flexneri 2a str. 301
ucgacgcccuggaagaaaaa

SEQ ID NO: 3913754 - RNA, 12 nt, Shigella flexneri 2a str. 301
ucgacgcgcgca

SEQ ID NO: 3913755 - RNA, 19 nt, Shigella flexneri 2a str. 301
ucgacggaauaaacccaca

SEQ ID NO: 3913756 - RNA, 21 nt, Shigella flexneri 2a str. 301
ucgacggcuggacaaaauacu

SEQ ID NO: 3913757 - RNA, 18 nt, Shigella flexneri 2a str. 301
ucgacggugacacuuugc

SEQ ID NO: 3913758 - RNA, 17 nt, Shigella flexneri 2a str. 301
ucgacguccaaucagca

SEQ ID NO: 3913759 - RNA, 21 nt, Shigella flexneri 2a str. 301
ucgacuuuagucgcuugcagg

SEQ ID NO: 3913760 - RNA, 19 nt, Shigella flexneri 2a str. 301
ucgagacgggcgaggaaau

SEQ ID NO: 3913761 - RNA, 20 nt, Shigella flexneri 2a str. 301
ucgagacgggcgaggaaauu

SEQ ID NO: 3913762 - RNA, 22 nt, Shigella flexneri 2a str. 301
ucgagagaauggggucagcagg

SEQ ID NO: 3913763 - RNA, 17 nt, Shigella flexneri 2a str. 301
ucgagauacguuugcca

SEQ ID NO: 3913764 - RNA, 20 nt, Shigella flexneri 2a str. 301
ucgagauucuuaaagucuuu

SEQ ID NO: 3913765 - RNA, 13 nt, Shigella flexneri 2a str. 301
ucgagcagagaaa

SEQ ID NO: 3913766 - RNA, 20 nt, Shigella flexneri 2a str. 301
ucgagcaucacaucaaaucc

SEQ ID NO: 3913767 - RNA, 13 nt, Shigella flexneri 2a str. 301
ucgagccuuuacg

SEQ ID NO: 3913768 - RNA, 16 nt, Shigella flexneri 2a str. 301
ucgagcgacagauuca

SEQ ID NO: 3913769 - RNA, 18 nt, Shigella flexneri 2a str. 301
ucgagcgcgagcaggccg

SEQ ID NO: 3913770 - RNA, 12 nt, Shigella flexneri 2a str. 301
ucgaggaaaacc

SEQ ID NO: 3913771 - RNA, 17 nt, Shigella flexneri 2a str. 301
ucgaggcaaccagcacg

SEQ ID NO: 3913772 - RNA, 17 nt, Shigella flexneri 2a str. 301
ucgaggcaauccguaau

SEQ ID NO: 3913773 - RNA, 22 nt, Shigella flexneri 2a str. 301
ucgaggccgcggcucaggcgca

SEQ ID NO: 3913774 - RNA, 18 nt, Shigella flexneri 2a str. 301
ucgagguacgcuccagca

SEQ ID NO: 3913775 - RNA, 17 nt, Shigella flexneri 2a str. 301
ucgagugcaauaacguu

SEQ ID NO: 3913776 - RNA, 20 nt, Shigella flexneri 2a str. 301
ucgaguucaucacaccaguc

SEQ ID NO: 3913777 - RNA, 18 nt, Shigella flexneri 2a str. 301
ucgaguuugccgcugucc

SEQ ID NO: 3913778 - RNA, 23 nt, Shigella flexneri 2a str. 301
ucgauaaaaccuuccucaccguu

SEQ ID NO: 3913779 - RNA, 22 nt, Shigella flexneri 2a str. 301
ucgauaaacaguuucgccaggg

SEQ ID NO: 3913780 - RNA, 20 nt, Shigella flexneri 2a str. 301
ucgauaaccaucuucuucac

SEQ ID NO: 3913781 - RNA, 14 nt, Shigella flexneri 2a str. 301
ucgauaaucaucag

SEQ ID NO: 3913782 - RNA, 23 nt, Shigella flexneri 2a str. 301
ucgauacucgcagucaacaagca

SEQ ID NO: 3913783 - RNA, 22 nt, Shigella flexneri 2a str. 301
ucgauaugucuuuuuuccagca

SEQ ID NO: 3913784 - RNA, 23 nt, Shigella flexneri 2a str. 301
ucgaucaaacaauuuucauugaa

SEQ ID NO: 3913785 - RNA, 21 nt, Shigella flexneri 2a str. 301
ucgaucacuucgcgcaaccag

SEQ ID NO: 3913786 - RNA, 23 nt, Shigella flexneri 2a str. 301
ucgaucaugacgggcaagaauau

SEQ ID NO: 3913787 - RNA, 19 nt, Shigella flexneri 2a str. 301
ucgauccagugauuccagu

SEQ ID NO: 3913788 - RNA, 15 nt, Shigella flexneri 2a str. 301
ucgaucuccgccuga

SEQ ID NO: 3913789 - RNA, 18 nt, Shigella flexneri 2a str. 301
ucgaucucuucgccugcc

SEQ ID NO: 3913790 - RNA, 13 nt, Shigella flexneri 2a str. 301
ucgaucuguuuua

SEQ ID NO: 3913791 - RNA, 14 nt, Shigella flexneri 2a str. 301
ucgaugaaagcgcc

SEQ ID NO: 3913792 - RNA, 20 nt, Shigella flexneri 2a str. 301
ucgaugccugaugacaugca

SEQ ID NO: 3913793 - RNA, 20 nt, Shigella flexneri 2a str. 301
ucgauuucauucagcguauc

SEQ ID NO: 3913794 - RNA, 21 nt, Shigella flexneri 2a str. 301
ucgauuuggcucaacaacugc

SEQ ID NO: 3913795 - RNA, 15 nt, Shigella flexneri 2a str. 301
ucgauuuucaaaaua

SEQ ID NO: 3913796 - RNA, 18 nt, Shigella flexneri 2a str. 301
ucgauuuuuuccagcgca

SEQ ID NO: 3913797 - RNA, 19 nt, Shigella flexneri 2a str. 301
ucgauuuuuuccagcgcau

SEQ ID NO: 3913798 - RNA, 22 nt, Shigella flexneri 2a str. 301
ucgcaaaaaaccaucccuggca

SEQ ID NO: 3913799 - RNA, 17 nt, Shigella flexneri 2a str. 301
ucgcaaacaguacaucu

SEQ ID NO: 3913800 - RNA, 14 nt, Shigella flexneri 2a str. 301
ucgcaaaccuggca

SEQ ID NO: 3913801 - RNA, 19 nt, Shigella flexneri 2a str. 301
ucgcaaauccauucaucgc

SEQ ID NO: 3913802 - RNA, 18 nt, Shigella flexneri 2a str. 301
ucgcaauacccugaccca

SEQ ID NO: 3913803 - RNA, 20 nt, Shigella flexneri 2a str. 301
ucgcaauacccugacccaga

SEQ ID NO: 3913804 - RNA, 20 nt, Shigella flexneri 2a str. 301
ucgcaaucggguuaccggaa

SEQ ID NO: 3913805 - RNA, 16 nt, Shigella flexneri 2a str. 301
ucgcacaaaaucauga

SEQ ID NO: 3913806 - RNA, 17 nt, Shigella flexneri 2a str. 301
ucgcacaaaaucaugag

SEQ ID NO: 3913807 - RNA, 15 nt, Shigella flexneri 2a str. 301
ucgcaccaaacgggc

SEQ ID NO: 3913808 - RNA, 16 nt, Shigella flexneri 2a str. 301
ucgcaccaaacgggca

SEQ ID NO: 3913809 - RNA, 14 nt, Shigella flexneri 2a str. 301
ucgcacccgccauc

SEQ ID NO: 3913810 - RNA, 17 nt, Shigella flexneri 2a str. 301
ucgcaccgcuggcagaa

SEQ ID NO: 3913811 - RNA, 16 nt, Shigella flexneri 2a str. 301
ucgcacgccuggcagu

SEQ ID NO: 3913812 - RNA, 14 nt, Shigella flexneri 2a str. 301
ucgcacguauaaac

SEQ ID NO: 3913813 - RNA, 18 nt, Shigella flexneri 2a str. 301
ucgcacguauaaacaucu

SEQ ID NO: 3913814 - RNA, 19 nt, Shigella flexneri 2a str. 301
ucgcacguugucagcaacu

SEQ ID NO: 3913815 - RNA, 17 nt, Shigella flexneri 2a str. 301
ucgcacuaaguucugcc

SEQ ID NO: 3913816 - RNA, 12 nt, Shigella flexneri 2a str. 301
ucgcacuaucga

SEQ ID NO: 3913817 - RNA, 13 nt, Shigella flexneri 2a str. 301
ucgcagaagccac

SEQ ID NO: 3913818 - RNA, 17 nt, Shigella flexneri 2a str. 301
ucgcagaagccacgcgu

SEQ ID NO: 3913819 - RNA, 15 nt, Shigella flexneri 2a str. 301
ucgcagacugggcaa

SEQ ID NO: 3913820 - RNA, 13 nt, Shigella flexneri 2a str. 301
ucgcagaugaauu

SEQ ID NO: 3913821 - RNA, 22 nt, Shigella flexneri 2a str. 301
ucgcagaugaauuuaucuuuaa

SEQ ID NO: 3913822 - RNA, 17 nt, Shigella flexneri 2a str. 301
ucgcagcaaacgaaagc

SEQ ID NO: 3913823 - RNA, 15 nt, Shigella flexneri 2a str. 301
ucgcagccagcgcgc

SEQ ID NO: 3913824 - RNA, 17 nt, Shigella flexneri 2a str. 301
ucgcagcgugcucucaa

SEQ ID NO: 3913825 - RNA, 16 nt, Shigella flexneri 2a str. 301
ucgcagguauaccgga

SEQ ID NO: 3913826 - RNA, 14 nt, Shigella flexneri 2a str. 301
ucgcaguagcgggc

SEQ ID NO: 3913827 - RNA, 14 nt, Shigella flexneri 2a str. 301
ucgcagucgccagc

SEQ ID NO: 3913828 - RNA, 15 nt, Shigella flexneri 2a str. 301
ucgcauaccauccag

SEQ ID NO: 3913829 - RNA, 19 nt, Shigella flexneri 2a str. 301
ucgcaucaggcauugugca

SEQ ID NO: 3913830 - RNA, 15 nt, Shigella flexneri 2a str. 301
ucgcaucaggcauuu

SEQ ID NO: 3913831 - RNA, 23 nt, Shigella flexneri 2a str. 301
ucgcaucaggcauuugcuccaga

SEQ ID NO: 3913832 - RNA, 23 nt, Shigella flexneri 2a str. 301
ucgcaucccgguaucaaagcgcc

SEQ ID NO: 3913833 - RNA, 17 nt, Shigella flexneri 2a str. 301
ucgcaucggauugcucc

SEQ ID NO: 3913834 - RNA, 17 nt, Shigella flexneri 2a str. 301
ucgcauuaacagccaga

SEQ ID NO: 3913835 - RNA, 22 nt, Shigella flexneri 2a str. 301
ucgccaaaugucaccagccgau

SEQ ID NO: 3913836 - RNA, 13 nt, Shigella flexneri 2a str. 301
ucgccaaguucga

SEQ ID NO: 3913837 - RNA, 19 nt, Shigella flexneri 2a str. 301
ucgccaccguuauccugau

SEQ ID NO: 3913838 - RNA, 16 nt, Shigella flexneri 2a str. 301
ucgccacggcaugaaa

SEQ ID NO: 3913839 - RNA, 20 nt, Shigella flexneri 2a str. 301
ucgcuacaccaaucgucaau

SEQ ID NO: 3913840 - RNA, 13 nt, Shigella flexneri 2a str. 301
ucgcuaccuuuca

SEQ ID NO: 3913841 - RNA, 16 nt, Shigella flexneri 2a str. 301
ucgcuaucagcgccac

SEQ ID NO: 3913842 - RNA, 17 nt, Shigella flexneri 2a str. 301
ucgcucaauauccugac

SEQ ID NO: 3913843 - RNA, 22 nt, Shigella flexneri 2a str. 301
ucgcucauaugacguaucaccg

SEQ ID NO: 3913844 - RNA, 16 nt, Shigella flexneri 2a str. 301
ucgcucaucugcugcg

SEQ ID NO: 3913845 - RNA, 22 nt, Shigella flexneri 2a str. 301
ucgcucgagagagaaaauaauc

SEQ ID NO: 3913846 - RNA, 17 nt, Shigella flexneri 2a str. 301
ucgcucucuuucucgcu

SEQ ID NO: 3913847 - RNA, 13 nt, Shigella flexneri 2a str. 301
ucgcugaagcuua

SEQ ID NO: 3913848 - RNA, 19 nt, Shigella flexneri 2a str. 301
ucgcugauuucaccaucuu

SEQ ID NO: 3913849 - RNA, 17 nt, Shigella flexneri 2a str. 301
ucgcugauuugcuucaa

SEQ ID NO: 3913850 - RNA, 20 nt, Shigella flexneri 2a str. 301
ucgcugcagcucugcgccgu

SEQ ID NO: 3913851 - RNA, 11 nt, Shigella flexneri 2a str. 301
ucgcugccagc

SEQ ID NO: 3913852 - RNA, 14 nt, Shigella flexneri 2a str. 301
ucgcugccagcacu

SEQ ID NO: 3913853 - RNA, 18 nt, Shigella flexneri 2a str. 301
ucgcugccgauaauacuc

SEQ ID NO: 3913854 - RNA, 16 nt, Shigella flexneri 2a str. 301
ucgcugcgcggcagcu

SEQ ID NO: 3913855 - RNA, 21 nt, Shigella flexneri 2a str. 301
ucgcugcgcucuaaaaucauc

SEQ ID NO: 3913856 - RNA, 22 nt, Shigella flexneri 2a str. 301
ucgcugcuaauuuaucggcguu

SEQ ID NO: 3913857 - RNA, 15 nt, Shigella flexneri 2a str. 301
ucgcugcugcggcga

SEQ ID NO: 3913858 - RNA, 15 nt, Shigella flexneri 2a str. 301
ucgcugcugguucug

SEQ ID NO: 3913859 - RNA, 13 nt, Shigella flexneri 2a str. 301
ucgcuggucagcg

SEQ ID NO: 3913860 - RNA, 22 nt, Shigella flexneri 2a str. 301
ucgcuggugccaagcuccagca

SEQ ID NO: 3913861 - RNA, 17 nt, Shigella flexneri 2a str. 301
ucgcuguauuuugcguu

SEQ ID NO: 3913862 - RNA, 16 nt, Shigella flexneri 2a str. 301
ucgcugucgccauccc

SEQ ID NO: 3913863 - RNA, 15 nt, Shigella flexneri 2a str. 301
ucgcugugcugcuga

SEQ ID NO: 3913864 - RNA, 17 nt, Shigella flexneri 2a str. 301
ucgcuguguaaacccag

SEQ ID NO: 3913865 - RNA, 20 nt, Shigella flexneri 2a str. 301
ucgcuguuuuuacucggucu

SEQ ID NO: 3913866 - RNA, 17 nt, Shigella flexneri 2a str. 301
ucgcuuaacgcccaugc

SEQ ID NO: 3913867 - RNA, 22 nt, Shigella flexneri 2a str. 301
ucgcuuaagccaucaucaauau

SEQ ID NO: 3913868 - RNA, 20 nt, Shigella flexneri 2a str. 301
ucgcuuaauggaaaacuguu

SEQ ID NO: 3913869 - RNA, 13 nt, Shigella flexneri 2a str. 301
ucgcuuaauugac

SEQ ID NO: 3913870 - RNA, 23 nt, Shigella flexneri 2a str. 301
ucgcuuacccuaaauccgccauc

SEQ ID NO: 3913871 - RNA, 13 nt, Shigella flexneri 2a str. 301
ucgcuuacgccug

SEQ ID NO: 3913872 - RNA, 11 nt, Shigella flexneri 2a str. 301
ucgcuucaacc

SEQ ID NO: 3913873 - RNA, 12 nt, Shigella flexneri 2a str. 301
ucgcuucauuua

SEQ ID NO: 3913874 - RNA, 19 nt, Shigella flexneri 2a str. 301
ucgcuuccauugagaaagc

SEQ ID NO: 3913875 - RNA, 14 nt, Shigella flexneri 2a str. 301
ucgcuucuagugcu

SEQ ID NO: 3913876 - RNA, 16 nt, Shigella flexneri 2a str. 301
ucgcuucuagugcuug

SEQ ID NO: 3913877 - RNA, 18 nt, Shigella flexneri 2a str. 301
ucgcuugcaggaucagcu

SEQ ID NO: 3913878 - RNA, 18 nt, Shigella flexneri 2a str. 301
ucgcuugcucgcgcaccu

SEQ ID NO: 3913879 - RNA, 21 nt, Shigella flexneri 2a str. 301
ucgcuuuccagucguuaugca

SEQ ID NO: 3913880 - RNA, 16 nt, Shigella flexneri 2a str. 301
ucgcuuucccagcgau

SEQ ID NO: 3913881 - RNA, 18 nt, Shigella flexneri 2a str. 301
ucgcuuucgcuuucucuu

SEQ ID NO: 3913882 - RNA, 14 nt, Shigella flexneri 2a str. 301
ucgcuuugugcugg

SEQ ID NO: 3913883 - RNA, 20 nt, Shigella flexneri 2a str. 301
ucgcuuuuucugcaucaacc

SEQ ID NO: 3913884 - RNA, 20 nt, Shigella flexneri 2a str. 301
ucggaaacaaauacaugaug

SEQ ID NO: 3913885 - RNA, 23 nt, Shigella flexneri 2a str. 301
ucggaacaacagucccaggcaga

SEQ ID NO: 3913886 - RNA, 13 nt, Shigella flexneri 2a str. 301
ucggaauaagacu

SEQ ID NO: 3913887 - RNA, 16 nt, Shigella flexneri 2a str. 301
ucggaaugccggaauc

SEQ ID NO: 3913888 - RNA, 19 nt, Shigella flexneri 2a str. 301
ucggacauguuuuccagca

SEQ ID NO: 3913889 - RNA, 16 nt, Shigella flexneri 2a str. 301
ucggagguucgaaucc

SEQ ID NO: 3913890 - RNA, 18 nt, Shigella flexneri 2a str. 301
ucggauaaccaaucacgu

SEQ ID NO: 3913891 - RNA, 21 nt, Shigella flexneri 2a str. 301
ucggauaaccaaucacgucgc

SEQ ID NO: 3913892 - RNA, 22 nt, Shigella flexneri 2a str. 301
ucggauaaggcgcucgcgccgc

SEQ ID NO: 3913893 - RNA, 17 nt, Shigella flexneri 2a str. 301
ucggaucggcaaugaga

SEQ ID NO: 3913894 - RNA, 13 nt, Shigella flexneri 2a str. 301
ucggaugcagaac

SEQ ID NO: 3913895 - RNA, 22 nt, Shigella flexneri 2a str. 301
ucggaugcggcgugaacgccuu

SEQ ID NO: 3913896 - RNA, 16 nt, Shigella flexneri 2a str. 301
ucggcaaaaucuucca

SEQ ID NO: 3913897 - RNA, 18 nt, Shigella flexneri 2a str. 301
ucggcaacaccucagcca

SEQ ID NO: 3913898 - RNA, 14 nt, Shigella flexneri 2a str. 301
ucggcaaucacauc

SEQ ID NO: 3913899 - RNA, 16 nt, Shigella flexneri 2a str. 301
ucggcaaucacgcccg

SEQ ID NO: 3913900 - RNA, 16 nt, Shigella flexneri 2a str. 301
ucggcaccagcgcaga

SEQ ID NO: 3913901 - RNA, 19 nt, Shigella flexneri 2a str. 301
ucggcaccagcgcagaaga

SEQ ID NO: 3913902 - RNA, 20 nt, Shigella flexneri 2a str. 301
ucggcaccauuuaaaucaau

SEQ ID NO: 3913903 - RNA, 13 nt, Shigella flexneri 2a str. 301
ucggcacugacca

SEQ ID NO: 3913904 - RNA, 22 nt, Shigella flexneri 2a str. 301
ucggcacugaccaccaccaccu

SEQ ID NO: 3913905 - RNA, 22 nt, Shigella flexneri 2a str. 301
ucggcaguaucagagauaacca

SEQ ID NO: 3913906 - RNA, 22 nt, Shigella flexneri 2a str. 301
ucggcaucaaaccauucccugc

SEQ ID NO: 3913907 - RNA, 15 nt, Shigella flexneri 2a str. 301
ucggcaucagcagaa

SEQ ID NO: 3913908 - RNA, 19 nt, Shigella flexneri 2a str. 301
ucggcaucgccaccguuau

SEQ ID NO: 3913909 - RNA, 16 nt, Shigella flexneri 2a str. 301
ucggcauggggucagg

SEQ ID NO: 3913910 - RNA, 12 nt, Shigella flexneri 2a str. 301
ucggccaugggc

SEQ ID NO: 3913911 - RNA, 21 nt, Shigella flexneri 2a str. 301
ucggccuuccauaaugcugac

SEQ ID NO: 3913912 - RNA, 23 nt, Shigella flexneri 2a str. 301
ucggcgaaacugaccugcggcac

SEQ ID NO: 3913913 - RNA, 13 nt, Shigella flexneri 2a str. 301
ucggcgcaaucgc

SEQ ID NO: 3913914 - RNA, 16 nt, Shigella flexneri 2a str. 301
ucggcgcagguuuaau

SEQ ID NO: 3913915 - RNA, 20 nt, Shigella flexneri 2a str. 301
ucggcgcauaaugccugaug

SEQ ID NO: 3913916 - RNA, 22 nt, Shigella flexneri 2a str. 301
ucggcgcggcgguugacgcccc

SEQ ID NO: 3913917 - RNA, 13 nt, Shigella flexneri 2a str. 301
ucggcggcgugcc

SEQ ID NO: 3913918 - RNA, 14 nt, Shigella flexneri 2a str. 301
ucggcggcuggcug

SEQ ID NO: 3913919 - RNA, 19 nt, Shigella flexneri 2a str. 301
ucggcgucuuguugaacag

SEQ ID NO: 3913920 - RNA, 23 nt, Shigella flexneri 2a str. 301
ucggcguucauccugcuggugcc

SEQ ID NO: 3913921 - RNA, 14 nt, Shigella flexneri 2a str. 301
ucggcuauggcgua

SEQ ID NO: 3913922 - RNA, 16 nt, Shigella flexneri 2a str. 301
ucggcugaacgugcuc

SEQ ID NO: 3913923 - RNA, 16 nt, Shigella flexneri 2a str. 301
ucggcuucauuggcgc

SEQ ID NO: 3913924 - RNA, 13 nt, Shigella flexneri 2a str. 301
ucggcuuucagcg

SEQ ID NO: 3913925 - RNA, 22 nt, Shigella flexneri 2a str. 301
ucggcuuugaauaucuccucug

SEQ ID NO: 3913926 - RNA, 22 nt, Shigella flexneri 2a str. 301
ucgggaaaaucugcgggaacau

SEQ ID NO: 3913927 - RNA, 13 nt, Shigella flexneri 2a str. 301
ucgggaaauaaca

SEQ ID NO: 3913928 - RNA, 22 nt, Shigella flexneri 2a str. 301
ucgggaaggcccuuccccuucu

SEQ ID NO: 3913929 - RNA, 20 nt, Shigella flexneri 2a str. 301
ucgggcaacguugaccaguc

SEQ ID NO: 3913930 - RNA, 21 nt, Shigella flexneri 2a str. 301
ucgggcaacguugaccaguca

SEQ ID NO: 3913931 - RNA, 15 nt, Shigella flexneri 2a str. 301
ucgggcacagcggug

SEQ ID NO: 3913932 - RNA, 17 nt, Shigella flexneri 2a str. 301
ucgggcagaaugcccug

SEQ ID NO: 3913933 - RNA, 23 nt, Shigella flexneri 2a str. 301
ucgggcagaaugcccugcggcug

SEQ ID NO: 3913934 - RNA, 13 nt, Shigella flexneri 2a str. 301
ucgggcagcaucg

SEQ ID NO: 3913935 - RNA, 21 nt, Shigella flexneri 2a str. 301
ucgggccguauugauuuucuu

SEQ ID NO: 3913936 - RNA, 16 nt, Shigella flexneri 2a str. 301
ucgggccgucuggcug

SEQ ID NO: 3913937 - RNA, 22 nt, Shigella flexneri 2a str. 301
ucgggcgauuuugcuuuuguca

SEQ ID NO: 3913938 - RNA, 21 nt, Shigella flexneri 2a str. 301
ucgggcguuucgccaggacag

SEQ ID NO: 3913939 - RNA, 21 nt, Shigella flexneri 2a str. 301
ucguuucaugccauccgcauc

SEQ ID NO: 3913940 - RNA, 17 nt, Shigella flexneri 2a str. 301
ucguuugcaggccugau

SEQ ID NO: 3913941 - RNA, 17 nt, Shigella flexneri 2a str. 301
ucguuugcauccagcuc

SEQ ID NO: 3913942 - RNA, 14 nt, Shigella flexneri 2a str. 301
ucguuugcugccuu

SEQ ID NO: 3913943 - RNA, 18 nt, Shigella flexneri 2a str. 301
ucguuuggggcauauuau

SEQ ID NO: 3913944 - RNA, 20 nt, Shigella flexneri 2a str. 301
ucguuugugggaauaaccau

SEQ ID NO: 3913945 - RNA, 22 nt, Shigella flexneri 2a str. 301
ucguuuuaaugcgauccugagc

SEQ ID NO: 3913946 - RNA, 21 nt, Shigella flexneri 2a str. 301
ucguuuucacgaagcucucug

SEQ ID NO: 3913947 - RNA, 16 nt, Shigella flexneri 2a str. 301
ucuaaaaaugugcccg

SEQ ID NO: 3913948 - RNA, 20 nt, Shigella flexneri 2a str. 301
ucuaaagcaacuccaucaag

SEQ ID NO: 3913949 - RNA, 15 nt, Shigella flexneri 2a str. 301
ucuaaauguucaaua

SEQ ID NO: 3913950 - RNA, 13 nt, Shigella flexneri 2a str. 301
ucuaaauuuugca

SEQ ID NO: 3913951 - RNA, 15 nt, Shigella flexneri 2a str. 301
ucuaacagaucaucc

SEQ ID NO: 3913952 - RNA, 19 nt, Shigella flexneri 2a str. 301
ucuaacagaucauccaucg

SEQ ID NO: 3913953 - RNA, 15 nt, Shigella flexneri 2a str. 301
ucuaacucuucugaa

SEQ ID NO: 3913954 - RNA, 20 nt, Shigella flexneri 2a str. 301
ucuaagcugccuguacggca

SEQ ID NO: 3913955 - RNA, 14 nt, Shigella flexneri 2a str. 301
ucuaauagccauca

SEQ ID NO: 3913956 - RNA, 16 nt, Shigella flexneri 2a str. 301
ucuaauccugaagacg

SEQ ID NO: 3913957 - RNA, 21 nt, Shigella flexneri 2a str. 301
ucuaaucgcacaaaaucauga

SEQ ID NO: 3913958 - RNA, 20 nt, Shigella flexneri 2a str. 301
ucuaaugcguagaccggaaa

SEQ ID NO: 3913959 - RNA, 12 nt, Shigella flexneri 2a str. 301
ucuaaugcuuuu

SEQ ID NO: 3913960 - RNA, 13 nt, Shigella flexneri 2a str. 301
ucuaaugucauaa

SEQ ID NO: 3913961 - RNA, 22 nt, Shigella flexneri 2a str. 301
ucuaauuuuuugcgccacuuuu

SEQ ID NO: 3913962 - RNA, 17 nt, Shigella flexneri 2a str. 301
ucuacaaaaacugccgc

SEQ ID NO: 3913963 - RNA, 15 nt, Shigella flexneri 2a str. 301
ucuacaaaagauuau

SEQ ID NO: 3913964 - RNA, 17 nt, Shigella flexneri 2a str. 301
ucuacacgcuaccaaaa

SEQ ID NO: 3913965 - RNA, 14 nt, Shigella flexneri 2a str. 301
ucuacagaaaugaa

SEQ ID NO: 3913966 - RNA, 19 nt, Shigella flexneri 2a str. 301
ucuacagaaaugaaaaaau

SEQ ID NO: 3913967 - RNA, 17 nt, Shigella flexneri 2a str. 301
ucuacagcauuuccuua

SEQ ID NO: 3913968 - RNA, 16 nt, Shigella flexneri 2a str. 301
ucuacagcgcccgcca

SEQ ID NO: 3913969 - RNA, 19 nt, Shigella flexneri 2a str. 301
ucuacagcuucacgcgcca

SEQ ID NO: 3913970 - RNA, 11 nt, Shigella flexneri 2a str. 301
ucuacaguacg

SEQ ID NO: 3913971 - RNA, 14 nt, Shigella flexneri 2a str. 301
ucuacauugcucau

SEQ ID NO: 3913972 - RNA, 22 nt, Shigella flexneri 2a str. 301
ucuaccagaugcucuuuucuga

SEQ ID NO: 3913973 - RNA, 16 nt, Shigella flexneri 2a str. 301
ucuaccagcaccugcu

SEQ ID NO: 3913974 - RNA, 15 nt, Shigella flexneri 2a str. 301
ucuaccaucaauggc

SEQ ID NO: 3913975 - RNA, 23 nt, Shigella flexneri 2a str. 301
ucuaccccagugguuucgccagc

SEQ ID NO: 3913976 - RNA, 14 nt, Shigella flexneri 2a str. 301
ucuaccgcaccuuc

SEQ ID NO: 3913977 - RNA, 14 nt, Shigella flexneri 2a str. 301
ucuaccgccagcca

SEQ ID NO: 3913978 - RNA, 19 nt, Shigella flexneri 2a str. 301
ucuaccgucuguaaccaga

SEQ ID NO: 3913979 - RNA, 17 nt, Shigella flexneri 2a str. 301
ucuaccguuggccugau

SEQ ID NO: 3913980 - RNA, 17 nt, Shigella flexneri 2a str. 301
ucuacucguuuauuaug

SEQ ID NO: 3913981 - RNA, 22 nt, Shigella flexneri 2a str. 301
ucuacucguuuauuaugccaca

SEQ ID NO: 3913982 - RNA, 20 nt, Shigella flexneri 2a str. 301
ucuacugaaggcgcauugcu

SEQ ID NO: 3913983 - RNA, 14 nt, Shigella flexneri 2a str. 301
ucuacugcaccgca

SEQ ID NO: 3913984 - RNA, 16 nt, Shigella flexneri 2a str. 301
ucuacugcgcgcgcca

SEQ ID NO: 3913985 - RNA, 16 nt, Shigella flexneri 2a str. 301
ucuauaaaaaagagcg

SEQ ID NO: 3913986 - RNA, 14 nt, Shigella flexneri 2a str. 301
ucuauaccgcugaa

SEQ ID NO: 3913987 - RNA, 23 nt, Shigella flexneri 2a str. 301
ucuauauuacgagucacaaacau

SEQ ID NO: 3913988 - RNA, 21 nt, Shigella flexneri 2a str. 301
ucuaucaaggcgauguuccuu

SEQ ID NO: 3913989 - RNA, 20 nt, Shigella flexneri 2a str. 301
ucuaugagaaaauuucauua

SEQ ID NO: 3913990 - RNA, 23 nt, Shigella flexneri 2a str. 301
ucuaugccagcuuucaccugcgc

SEQ ID NO: 3913991 - RNA, 20 nt, Shigella flexneri 2a str. 301
ucuaugguuuuuucuacaca

SEQ ID NO: 3913992 - RNA, 18 nt, Shigella flexneri 2a str. 301
ucuaugucgcauccggca

SEQ ID NO: 3913993 - RNA, 13 nt, Shigella flexneri 2a str. 301
ucuauuaaaaagc

SEQ ID NO: 3913994 - RNA, 15 nt, Shigella flexneri 2a str. 301
ucuauucaccgcauc

SEQ ID NO: 3913995 - RNA, 20 nt, Shigella flexneri 2a str. 301
ucuauuccgcgugaaaugcc

SEQ ID NO: 3913996 - RNA, 17 nt, Shigella flexneri 2a str. 301
ucuauugcaacauguug

SEQ ID NO: 3913997 - RNA, 18 nt, Shigella flexneri 2a str. 301
ucuauugcaacauguuga

SEQ ID NO: 3913998 - RNA, 13 nt, Shigella flexneri 2a str. 301
ucucaaaugaccg

SEQ ID NO: 3913999 - RNA, 12 nt, Shigella flexneri 2a str. 301
ucucaacacacg

SEQ ID NO: 3914000 - RNA, 21 nt, Shigella flexneri 2a str. 301
ucucaacguggauaccgauag

SEQ ID NO: 3914001 - RNA, 17 nt, Shigella flexneri 2a str. 301
ucucaagccacuuuccu

SEQ ID NO: 3914002 - RNA, 18 nt, Shigella flexneri 2a str. 301
ucucaagccacuuuccuu

SEQ ID NO: 3914003 - RNA, 18 nt, Shigella flexneri 2a str. 301
ucucaauaaaaggaaaca

SEQ ID NO: 3914004 - RNA, 15 nt, Shigella flexneri 2a str. 301
ucucaauaucaucau

SEQ ID NO: 3914005 - RNA, 12 nt, Shigella flexneri 2a str. 301
ucucaaucccuu

SEQ ID NO: 3914006 - RNA, 18 nt, Shigella flexneri 2a str. 301
ucucaaucccuuucucuu

SEQ ID NO: 3914007 - RNA, 18 nt, Shigella flexneri 2a str. 301
ucucaaucucuuuuucca

SEQ ID NO: 3914008 - RNA, 19 nt, Shigella flexneri 2a str. 301
ucucaaucucuuuuuccac

SEQ ID NO: 3914009 - RNA, 13 nt, Shigella flexneri 2a str. 301
ucucaaucuucac

SEQ ID NO: 3914010 - RNA, 18 nt, Shigella flexneri 2a str. 301
ucucaauguauucccgua

SEQ ID NO: 3914011 - RNA, 19 nt, Shigella flexneri 2a str. 301
ucucaauuacaguuucuga

SEQ ID NO: 3914012 - RNA, 14 nt, Shigella flexneri 2a str. 301
ucucaauuuucacu

SEQ ID NO: 3914013 - RNA, 15 nt, Shigella flexneri 2a str. 301
ucucaauuuucacuu

SEQ ID NO: 3914014 - RNA, 18 nt, Shigella flexneri 2a str. 301
ucucacccgcuucauaac

SEQ ID NO: 3914015 - RNA, 22 nt, Shigella flexneri 2a str. 301
ucucacccggaggaaagcaccu

SEQ ID NO: 3914016 - RNA, 16 nt, Shigella flexneri 2a str. 301
ucucacuccagccaga

SEQ ID NO: 3914017 - RNA, 18 nt, Shigella flexneri 2a str. 301
ucucacuuggguaacagc

SEQ ID NO: 3914018 - RNA, 20 nt, Shigella flexneri 2a str. 301
ucucacuuggguaacagccc

SEQ ID NO: 3914019 - RNA, 15 nt, Shigella flexneri 2a str. 301
ucucagauaaaugca

SEQ ID NO: 3914020 - RNA, 21 nt, Shigella flexneri 2a str. 301
ucucagauaaaugcaaacgca

SEQ ID NO: 3914021 - RNA, 11 nt, Shigella flexneri 2a str. 301
ucucagcagac

SEQ ID NO: 3914022 - RNA, 21 nt, Shigella flexneri 2a str. 301
ucucagcgccgcuuuccaggc

SEQ ID NO: 3914023 - RNA, 18 nt, Shigella flexneri 2a str. 301
ucucaggacguuuucagc

SEQ ID NO: 3914024 - RNA, 23 nt, Shigella flexneri 2a str. 301
ucucaggccuacaaaaucuugca

SEQ ID NO: 3914025 - RNA, 23 nt, Shigella flexneri 2a str. 301
ucucagguagcgcauaagccacc

SEQ ID NO: 3914026 - RNA, 13 nt, Shigella flexneri 2a str. 301
ucucaucaguuaa

SEQ ID NO: 3914027 - RNA, 22 nt, Shigella flexneri 2a str. 301
ucucaucaguuaacggcaggau

SEQ ID NO: 3914028 - RNA, 18 nt, Shigella flexneri 2a str. 301
ucucauccaauaacguga

SEQ ID NO: 3914029 - RNA, 12 nt, Shigella flexneri 2a str. 301
ucucauccauca

SEQ ID NO: 3914030 - RNA, 13 nt, Shigella flexneri 2a str. 301
ucucauccaucaa

SEQ ID NO: 3914031 - RNA, 18 nt, Shigella flexneri 2a str. 301
ucucaucuuugaaaucac

SEQ ID NO: 3914032 - RNA, 17 nt, Shigella flexneri 2a str. 301
ucucauggguggcagau

SEQ ID NO: 3914033 - RNA, 15 nt, Shigella flexneri 2a str. 301
ucucauuacagcgac

SEQ ID NO: 3914034 - RNA, 21 nt, Shigella flexneri 2a str. 301
ucucauuccaccgaaacuuuu

SEQ ID NO: 3914035 - RNA, 12 nt, Shigella flexneri 2a str. 301
ucucauuuuuca

SEQ ID NO: 3914036 - RNA, 13 nt, Shigella flexneri 2a str. 301
ucucauuuuucag

SEQ ID NO: 3914037 - RNA, 13 nt, Shigella flexneri 2a str. 301
ucuccacgccagu

SEQ ID NO: 3914038 - RNA, 16 nt, Shigella flexneri 2a str. 301
ucuccacuauaaaaaa

SEQ ID NO: 3914039 - RNA, 18 nt, Shigella flexneri 2a str. 301
ucugauguuguuuuuaac

SEQ ID NO: 3914040 - RNA, 20 nt, Shigella flexneri 2a str. 301
ucugauuuaaccaacaauaa

SEQ ID NO: 3914041 - RNA, 23 nt, Shigella flexneri 2a str. 301
ucugauuuaaccaacaauaaaau

SEQ ID NO: 3914042 - RNA, 22 nt, Shigella flexneri 2a str. 301
ucugcaaaauaccaauaaucaa

SEQ ID NO: 3914043 - RNA, 20 nt, Shigella flexneri 2a str. 301
ucugcaaaauagccaaucau

SEQ ID NO: 3914044 - RNA, 18 nt, Shigella flexneri 2a str. 301
ucugcaaauauuaauaau

SEQ ID NO: 3914045 - RNA, 17 nt, Shigella flexneri 2a str. 301
ucugcaagcaucauaaa

SEQ ID NO: 3914046 - RNA, 12 nt, Shigella flexneri 2a str. 301
ucugcaaggcga

SEQ ID NO: 3914047 - RNA, 19 nt, Shigella flexneri 2a str. 301
ucugcaagguucuuugcug

SEQ ID NO: 3914048 - RNA, 16 nt, Shigella flexneri 2a str. 301
ucugcaaucaccacug

SEQ ID NO: 3914049 - RNA, 16 nt, Shigella flexneri 2a str. 301
ucugcaauuacugcau

SEQ ID NO: 3914050 - RNA, 13 nt, Shigella flexneri 2a str. 301
ucugcacgccagg

SEQ ID NO: 3914051 - RNA, 17 nt, Shigella flexneri 2a str. 301
ucugcacgcuugccugu

SEQ ID NO: 3914052 - RNA, 18 nt, Shigella flexneri 2a str. 301
ucugcacguuuugcugau

SEQ ID NO: 3914053 - RNA, 18 nt, Shigella flexneri 2a str. 301
ucugcagcgcggcgagag

SEQ ID NO: 3914054 - RNA, 12 nt, Shigella flexneri 2a str. 301
ucugcagcuuua

SEQ ID NO: 3914055 - RNA, 14 nt, Shigella flexneri 2a str. 301
ucugcaugacggcu

SEQ ID NO: 3914056 - RNA, 21 nt, Shigella flexneri 2a str. 301
ucugcauggucgauucuuaua

SEQ ID NO: 3914057 - RNA, 13 nt, Shigella flexneri 2a str. 301
ucugcauuuucuc

SEQ ID NO: 3914058 - RNA, 14 nt, Shigella flexneri 2a str. 301
ucugcauuuucucg

SEQ ID NO: 3914059 - RNA, 22 nt, Shigella flexneri 2a str. 301
ucugccaacuuugccgugaaca

SEQ ID NO: 3914060 - RNA, 13 nt, Shigella flexneri 2a str. 301
ucugccacgccac

SEQ ID NO: 3914061 - RNA, 18 nt, Shigella flexneri 2a str. 301
ucugccacgccacgcugc

SEQ ID NO: 3914062 - RNA, 15 nt, Shigella flexneri 2a str. 301
ucugccagcaaauag

SEQ ID NO: 3914063 - RNA, 17 nt, Shigella flexneri 2a str. 301
ucugccagcugcucaua

SEQ ID NO: 3914064 - RNA, 23 nt, Shigella flexneri 2a str. 301
ucugccagucaggcaugaucagc

SEQ ID NO: 3914065 - RNA, 18 nt, Shigella flexneri 2a str. 301
ucugccaguuguugcuga

SEQ ID NO: 3914066 - RNA, 21 nt, Shigella flexneri 2a str. 301
ucugccaucauggcauccugu

SEQ ID NO: 3914067 - RNA, 23 nt, Shigella flexneri 2a str. 301
ucugccauccguaauuuuuacuc

SEQ ID NO: 3914068 - RNA, 14 nt, Shigella flexneri 2a str. 301
ucugcccaugcugg

SEQ ID NO: 3914069 - RNA, 17 nt, Shigella flexneri 2a str. 301
ucugcccgagauacauc

SEQ ID NO: 3914070 - RNA, 24 nt, Shigella flexneri 2a str. 301
ucugccgcauggaaccaguucacu

SEQ ID NO: 3914071 - RNA, 12 nt, Shigella flexneri 2a str. 301
ucugccgcuuca

SEQ ID NO: 3914072 - RNA, 17 nt, Shigella flexneri 2a str. 301
ucugccgcuuccagcag

SEQ ID NO: 3914073 - RNA, 16 nt, Shigella flexneri 2a str. 301
ucugccggaagacaca

SEQ ID NO: 3914074 - RNA, 22 nt, Shigella flexneri 2a str. 301
ucugccggagggauguggccca

SEQ ID NO: 3914075 - RNA, 17 nt, Shigella flexneri 2a str. 301
ucugccgggaagcucuc

SEQ ID NO: 3914076 - RNA, 23 nt, Shigella flexneri 2a str. 301
ucugccgggaagcucucuuccag

SEQ ID NO: 3914077 - RNA, 17 nt, Shigella flexneri 2a str. 301
ucugccugauccugggc

SEQ ID NO: 3914078 - RNA, 18 nt, Shigella flexneri 2a str. 301
ucugccuguaugugcccg

SEQ ID NO: 3914079 - RNA, 21 nt, Shigella flexneri 2a str. 301
ucugccuguccaccacgcugc

SEQ ID NO: 3914080 - RNA, 23 nt, Shigella flexneri 2a str. 301
ucugccuugaguuuuucaucccu

SEQ ID NO: 3914081 - RNA, 21 nt, Shigella flexneri 2a str. 301
ucugcgagcuuucgaccagcc

SEQ ID NO: 3914082 - RNA, 14 nt, Shigella flexneri 2a str. 301
ucugcgauagcagc

SEQ ID NO: 3914083 - RNA, 15 nt, Shigella flexneri 2a str. 301
ucugcgauagcagca

SEQ ID NO: 3914084 - RNA, 20 nt, Shigella flexneri 2a str. 301
ucugcgcauuucccagcaag

SEQ ID NO: 3914085 - RNA, 15 nt, Shigella flexneri 2a str. 301
ucugcgcccagcaac

SEQ ID NO: 3914086 - RNA, 19 nt, Shigella flexneri 2a str. 301
ucugcggguuagucugcau

SEQ ID NO: 3914087 - RNA, 14 nt, Shigella flexneri 2a str. 301
ucugcguaacccac

SEQ ID NO: 3914088 - RNA, 17 nt, Shigella flexneri 2a str. 301
ucugcguaucgcccugc

SEQ ID NO: 3914089 - RNA, 21 nt, Shigella flexneri 2a str. 301
ucugcgugaguuuuugucccc

SEQ ID NO: 3914090 - RNA, 22 nt, Shigella flexneri 2a str. 301
ucugcguggucauuaugaccgu

SEQ ID NO: 3914091 - RNA, 21 nt, Shigella flexneri 2a str. 301
ucugcguuagaaaacgccugc

SEQ ID NO: 3914092 - RNA, 12 nt, Shigella flexneri 2a str. 301
ucugcguucuga

SEQ ID NO: 3914093 - RNA, 20 nt, Shigella flexneri 2a str. 301
ucugcucuucuuucaucaug

SEQ ID NO: 3914094 - RNA, 21 nt, Shigella flexneri 2a str. 301
ucugcugcugcguuccggcau

SEQ ID NO: 3914095 - RNA, 18 nt, Shigella flexneri 2a str. 301
ucugcuuacgcaacugcc

SEQ ID NO: 3914096 - RNA, 19 nt, Shigella flexneri 2a str. 301
ucugcuucgccugagcggc

SEQ ID NO: 3914097 - RNA, 23 nt, Shigella flexneri 2a str. 301
ucugcuucguuaacgugucauaa

SEQ ID NO: 3914098 - RNA, 23 nt, Shigella flexneri 2a str. 301
ucugcuucugccaguuguugcug

SEQ ID NO: 3914099 - RNA, 14 nt, Shigella flexneri 2a str. 301
ucugcuucugccug

SEQ ID NO: 3914100 - RNA, 16 nt, Shigella flexneri 2a str. 301
ucugcuucugccuggg

SEQ ID NO: 3914101 - RNA, 19 nt, Shigella flexneri 2a str. 301
ucugcuucugccugggccu

SEQ ID NO: 3914102 - RNA, 20 nt, Shigella flexneri 2a str. 301
ucugcuuguggcggaaagac

SEQ ID NO: 3914103 - RNA, 17 nt, Shigella flexneri 2a str. 301
ucugcuuucucagcaaa

SEQ ID NO: 3914104 - RNA, 17 nt, Shigella flexneri 2a str. 301
ucugcuuuucccuccac

SEQ ID NO: 3914105 - RNA, 17 nt, Shigella flexneri 2a str. 301
ucuggaacgaacccgaa

SEQ ID NO: 3914106 - RNA, 20 nt, Shigella flexneri 2a str. 301
ucuggaacuggcugccagcg

SEQ ID NO: 3914107 - RNA, 14 nt, Shigella flexneri 2a str. 301
ucuggaagaggcug

SEQ ID NO: 3914108 - RNA, 23 nt, Shigella flexneri 2a str. 301
ucuggaauggaaacagcaccauc

SEQ ID NO: 3914109 - RNA, 10 nt, Shigella flexneri 2a str. 301
ucuggaauuc

SEQ ID NO: 3914110 - RNA, 20 nt, Shigella flexneri 2a str. 301
ucuggacaaagagcuuucau

SEQ ID NO: 3914111 - RNA, 11 nt, Shigella flexneri 2a str. 301
ucuggaugaaa

SEQ ID NO: 3914112 - RNA, 14 nt, Shigella flexneri 2a str. 301
ucuggcacauuuug

SEQ ID NO: 3914113 - RNA, 15 nt, Shigella flexneri 2a str. 301
ucuggcaccuguacc

SEQ ID NO: 3914114 - RNA, 16 nt, Shigella flexneri 2a str. 301
ucuggcagauccugaa

SEQ ID NO: 3914115 - RNA, 20 nt, Shigella flexneri 2a str. 301
ucuggcagauccugaaauuc

SEQ ID NO: 3914116 - RNA, 20 nt, Shigella flexneri 2a str. 301
ucuggcauaaacaaagcgca

SEQ ID NO: 3914117 - RNA, 15 nt, Shigella flexneri 2a str. 301
ucuggcauaacgcca

SEQ ID NO: 3914118 - RNA, 16 nt, Shigella flexneri 2a str. 301
ucuggccguacccagc

SEQ ID NO: 3914119 - RNA, 16 nt, Shigella flexneri 2a str. 301
ucuggcgcaggugaua

SEQ ID NO: 3914120 - RNA, 22 nt, Shigella flexneri 2a str. 301
ucuggcgcgaacagcacaucag

SEQ ID NO: 3914121 - RNA, 16 nt, Shigella flexneri 2a str. 301
ucuggcggaagcucca

SEQ ID NO: 3914122 - RNA, 23 nt, Shigella flexneri 2a str. 301
ucuggcguacagagggcaggcaa

SEQ ID NO: 3914123 - RNA, 15 nt, Shigella flexneri 2a str. 301
ucuggcuuaaacgca

SEQ ID NO: 3914124 - RNA, 15 nt, Shigella flexneri 2a str. 301
ucuggcuucccggca

SEQ ID NO: 3914125 - RNA, 14 nt, Shigella flexneri 2a str. 301
ucugggcugaagag

SEQ ID NO: 3914126 - RNA, 16 nt, Shigella flexneri 2a str. 301
ucuggguugccugaug

SEQ ID NO: 3914127 - RNA, 14 nt, Shigella flexneri 2a str. 301
ucugguauuaaccg

SEQ ID NO: 3914128 - RNA, 15 nt, Shigella flexneri 2a str. 301
ucuggucaugaaccu

SEQ ID NO: 3914129 - RNA, 14 nt, Shigella flexneri 2a str. 301
ucuggugaccuggg

SEQ ID NO: 3914130 - RNA, 20 nt, Shigella flexneri 2a str. 301
ucuggugaccugggaaaucc

SEQ ID NO: 3914131 - RNA, 16 nt, Shigella flexneri 2a str. 301
ucuggugcuuuuucaa

SEQ ID NO: 3914132 - RNA, 22 nt, Shigella flexneri 2a str. 301
ucugguggacaaccauaaauuu

SEQ ID NO: 3914133 - RNA, 19 nt, Shigella flexneri 2a str. 301
ucuggugguaaucgacaac

SEQ ID NO: 3914134 - RNA, 23 nt, Shigella flexneri 2a str. 301
ucuggugguguggcugcacaccu

SEQ ID NO: 3914135 - RNA, 20 nt, Shigella flexneri 2a str. 301
ucugguucgccaaaugucac

SEQ ID NO: 3914136 - RNA, 22 nt, Shigella flexneri 2a str. 301
ucugguucgccaaaugucacca

SEQ ID NO: 3914137 - RNA, 14 nt, Shigella flexneri 2a str. 301
ucugguuucaagau

SEQ ID NO: 3914138 - RNA, 13 nt, Shigella flexneri 2a str. 301
ucuucgccugccu

SEQ ID NO: 3914139 - RNA, 17 nt, Shigella flexneri 2a str. 301
ucuucggcaaguguugg

SEQ ID NO: 3914140 - RNA, 16 nt, Shigella flexneri 2a str. 301
ucuucggucagagaau

SEQ ID NO: 3914141 - RNA, 21 nt, Shigella flexneri 2a str. 301
ucuucgguggucauuuuauug

SEQ ID NO: 3914142 - RNA, 20 nt, Shigella flexneri 2a str. 301
ucuucgguucguaagcaaga

SEQ ID NO: 3914143 - RNA, 15 nt, Shigella flexneri 2a str. 301
ucuucgucccagucg

SEQ ID NO: 3914144 - RNA, 14 nt, Shigella flexneri 2a str. 301
ucuucguucuucuu

SEQ ID NO: 3914145 - RNA, 20 nt, Shigella flexneri 2a str. 301
ucuucuaacgacauuuucug

SEQ ID NO: 3914146 - RNA, 18 nt, Shigella flexneri 2a str. 301
ucuucuagcgcaauaacc

SEQ ID NO: 3914147 - RNA, 15 nt, Shigella flexneri 2a str. 301
ucuucucaacgugga

SEQ ID NO: 3914148 - RNA, 22 nt, Shigella flexneri 2a str. 301
ucuucucaacguggauaccgau

SEQ ID NO: 3914149 - RNA, 13 nt, Shigella flexneri 2a str. 301
ucuucuccggcau

SEQ ID NO: 3914150 - RNA, 20 nt, Shigella flexneri 2a str. 301
ucuucucgauaaaaccuucc

SEQ ID NO: 3914151 - RNA, 14 nt, Shigella flexneri 2a str. 301
ucuucugcaagcau

SEQ ID NO: 3914152 - RNA, 15 nt, Shigella flexneri 2a str. 301
ucuucugguuucagu

SEQ ID NO: 3914153 - RNA, 15 nt, Shigella flexneri 2a str. 301
ucuucugguuuuucu

SEQ ID NO: 3914154 - RNA, 14 nt, Shigella flexneri 2a str. 301
ucuucuucacucuc

SEQ ID NO: 3914155 - RNA, 20 nt, Shigella flexneri 2a str. 301
ucuucuucacuucuucaaua

SEQ ID NO: 3914156 - RNA, 14 nt, Shigella flexneri 2a str. 301
ucuucuuccgcuuc

SEQ ID NO: 3914157 - RNA, 20 nt, Shigella flexneri 2a str. 301
ucuucuugcagcuuaaucau

SEQ ID NO: 3914158 - RNA, 13 nt, Shigella flexneri 2a str. 301
ucuugaaaccaga

SEQ ID NO: 3914159 - RNA, 16 nt, Shigella flexneri 2a str. 301
ucuugaacgcaaaugu

SEQ ID NO: 3914160 - RNA, 12 nt, Shigella flexneri 2a str. 301
ucuugacgcuga

SEQ ID NO: 3914161 - RNA, 14 nt, Shigella flexneri 2a str. 301
ucuugagcuccaca

SEQ ID NO: 3914162 - RNA, 16 nt, Shigella flexneri 2a str. 301
ucuugaguuggcaugc

SEQ ID NO: 3914163 - RNA, 14 nt, Shigella flexneri 2a str. 301
ucuugauuuacuac

SEQ ID NO: 3914164 - RNA, 13 nt, Shigella flexneri 2a str. 301
ucuugcaaaauca

SEQ ID NO: 3914165 - RNA, 18 nt, Shigella flexneri 2a str. 301
ucuugccaucaaucacuu

SEQ ID NO: 3914166 - RNA, 22 nt, Shigella flexneri 2a str. 301
ucuugccuuaaugcuugugccg

SEQ ID NO: 3914167 - RNA, 13 nt, Shigella flexneri 2a str. 301
ucuugcuggaugc

SEQ ID NO: 3914168 - RNA, 15 nt, Shigella flexneri 2a str. 301
ucuuggcugcucauu

SEQ ID NO: 3914169 - RNA, 15 nt, Shigella flexneri 2a str. 301
ucuuggguauaaaac

SEQ ID NO: 3914170 - RNA, 12 nt, Shigella flexneri 2a str. 301
ucuuguaggcca

SEQ ID NO: 3914171 - RNA, 15 nt, Shigella flexneri 2a str. 301
ucuuguaggccugau

SEQ ID NO: 3914172 - RNA, 16 nt, Shigella flexneri 2a str. 301
ucuuguaggccugaua

SEQ ID NO: 3914173 - RNA, 21 nt, Shigella flexneri 2a str. 301
ucuugucaggccggaauaacu

SEQ ID NO: 3914174 - RNA, 14 nt, Shigella flexneri 2a str. 301
ucuuguugaacagg

SEQ ID NO: 3914175 - RNA, 15 nt, Shigella flexneri 2a str. 301
ucuuuaaacaguuuu

SEQ ID NO: 3914176 - RNA, 19 nt, Shigella flexneri 2a str. 301
ucuuuaaaucacccgugag

SEQ ID NO: 3914177 - RNA, 12 nt, Shigella flexneri 2a str. 301
ucuuuaaugaca

SEQ ID NO: 3914178 - RNA, 16 nt, Shigella flexneri 2a str. 301
ucuuuacugauaauuu

SEQ ID NO: 3914179 - RNA, 22 nt, Shigella flexneri 2a str. 301
ucuuuauaaccacgcaaaaucc

SEQ ID NO: 3914180 - RNA, 13 nt, Shigella flexneri 2a str. 301
ucuuuauauauug

SEQ ID NO: 3914181 - RNA, 22 nt, Shigella flexneri 2a str. 301
ucuuuauauauugggaucaaaa

SEQ ID NO: 3914182 - RNA, 13 nt, Shigella flexneri 2a str. 301
ucuuuaucaauca

SEQ ID NO: 3914183 - RNA, 23 nt, Shigella flexneri 2a str. 301
ucuuuaucaccaaugauaaguuu

SEQ ID NO: 3914184 - RNA, 13 nt, Shigella flexneri 2a str. 301
ucuuuauccugac

SEQ ID NO: 3914185 - RNA, 22 nt, Shigella flexneri 2a str. 301
ucuuuaucggucuuagcaaagg

SEQ ID NO: 3914186 - RNA, 14 nt, Shigella flexneri 2a str. 301
ucuuucaauuugua

SEQ ID NO: 3914187 - RNA, 18 nt, Shigella flexneri 2a str. 301
ucuuucacgaacacagug

SEQ ID NO: 3914188 - RNA, 17 nt, Shigella flexneri 2a str. 301
ucuuucacgcccagucc

SEQ ID NO: 3914189 - RNA, 17 nt, Shigella flexneri 2a str. 301
ucuuucagcaccagccc

SEQ ID NO: 3914190 - RNA, 22 nt, Shigella flexneri 2a str. 301
ucuuuccagacucaacaggccc

SEQ ID NO: 3914191 - RNA, 17 nt, Shigella flexneri 2a str. 301
ucuuuccguucaaaaca

SEQ ID NO: 3914192 - RNA, 20 nt, Shigella flexneri 2a str. 301
ucuuucgacggcaucagaaa

SEQ ID NO: 3914193 - RNA, 18 nt, Shigella flexneri 2a str. 301
ucuuucgcggcaaccuga

SEQ ID NO: 3914194 - RNA, 11 nt, Shigella flexneri 2a str. 301
ucuuucucauc

SEQ ID NO: 3914195 - RNA, 17 nt, Shigella flexneri 2a str. 301
ucuuucugccaccagua

SEQ ID NO: 3914196 - RNA, 19 nt, Shigella flexneri 2a str. 301
ucuuucuuugcaugacgau

SEQ ID NO: 3914197 - RNA, 17 nt, Shigella flexneri 2a str. 301
ucuuugcagcuuugcug

SEQ ID NO: 3914198 - RNA, 22 nt, Shigella flexneri 2a str. 301
ucuuugcccgcagauccagugc

SEQ ID NO: 3914199 - RNA, 12 nt, Shigella flexneri 2a str. 301
ucuuugccugau

SEQ ID NO: 3914200 - RNA, 18 nt, Shigella flexneri 2a str. 301
ucuuugccugaucgguga

SEQ ID NO: 3914201 - RNA, 23 nt, Shigella flexneri 2a str. 301
ucuuugccugaucggugaaagua

SEQ ID NO: 3914202 - RNA, 22 nt, Shigella flexneri 2a str. 301
ucuuugcggcuauucuugaagu

SEQ ID NO: 3914203 - RNA, 15 nt, Shigella flexneri 2a str. 301
ucuuuggcaucaauc

SEQ ID NO: 3914204 - RNA, 23 nt, Shigella flexneri 2a str. 301
ucuuuguaucgcugaaagauggc

SEQ ID NO: 3914205 - RNA, 21 nt, Shigella flexneri 2a str. 301
ucuuugugccacgcuggcccg

SEQ ID NO: 3914206 - RNA, 13 nt, Shigella flexneri 2a str. 301
ucuuuguucggca

SEQ ID NO: 3914207 - RNA, 19 nt, Shigella flexneri 2a str. 301
ucuuuuacagcgccagaag

SEQ ID NO: 3914208 - RNA, 20 nt, Shigella flexneri 2a str. 301
ucuuuuacagcgccagaagg

SEQ ID NO: 3914209 - RNA, 14 nt, Shigella flexneri 2a str. 301
ucuuuucgcuuuac

SEQ ID NO: 3914210 - RNA, 16 nt, Shigella flexneri 2a str. 301
ucuuuucguuuugguc

SEQ ID NO: 3914211 - RNA, 20 nt, Shigella flexneri 2a str. 301
ucuuuugcuugacaaaaaga

SEQ ID NO: 3914212 - RNA, 18 nt, Shigella flexneri 2a str. 301
ucuuuuggcgagagacgc

SEQ ID NO: 3914213 - RNA, 21 nt, Shigella flexneri 2a str. 301
ucuuuuucauuaugaucaaaa

SEQ ID NO: 3914214 - RNA, 23 nt, Shigella flexneri 2a str. 301
ucuuuuucgaacauuucgagaau

SEQ ID NO: 3914215 - RNA, 22 nt, Shigella flexneri 2a str. 301
ucuuuuuuguucaguucagaaa

SEQ ID NO: 3914216 - RNA, 19 nt, Shigella flexneri 2a str. 301
ucuuuuuuuauuaaaugug

SEQ ID NO: 3914217 - RNA, 23 nt, Shigella flexneri 2a str. 301
ugaaaaaacaaauauugauggga

SEQ ID NO: 3914218 - RNA, 15 nt, Shigella flexneri 2a str. 301
ugaaaaaaccagaaa

SEQ ID NO: 3914219 - RNA, 14 nt, Shigella flexneri 2a str. 301
ugaaaaaaugauga

SEQ ID NO: 3914220 - RNA, 20 nt, Shigella flexneri 2a str. 301
ugaaaaagccaaaacugcac

SEQ ID NO: 3914221 - RNA, 20 nt, Shigella flexneri 2a str. 301
ugaaaaagcucccuaaaaua

SEQ ID NO: 3914222 - RNA, 22 nt, Shigella flexneri 2a str. 301
ugaaaaagugccaaaaaucgca

SEQ ID NO: 3914223 - RNA, 14 nt, Shigella flexneri 2a str. 301
ugaaaaaucaaaaa

SEQ ID NO: 3914224 - RNA, 22 nt, Shigella flexneri 2a str. 301
ugaaaaaucaaaaaacuggaaa

SEQ ID NO: 3914225 - RNA, 17 nt, Shigella flexneri 2a str. 301
ugaaaaccucucuggaa

SEQ ID NO: 3914226 - RNA, 14 nt, Shigella flexneri 2a str. 301
ugaaaacgaaggcc

SEQ ID NO: 3914227 - RNA, 19 nt, Shigella flexneri 2a str. 301
ugaaaacgcauaccagucu

SEQ ID NO: 3914228 - RNA, 20 nt, Shigella flexneri 2a str. 301
ugaaaacgccggagugaaaa

SEQ ID NO: 3914229 - RNA, 18 nt, Shigella flexneri 2a str. 301
ugaaaacgcgcauccggc

SEQ ID NO: 3914230 - RNA, 17 nt, Shigella flexneri 2a str. 301
ugaaaagaguaguaauu

SEQ ID NO: 3914231 - RNA, 21 nt, Shigella flexneri 2a str. 301
ugaaaagaguaguaauugcuu

SEQ ID NO: 3914232 - RNA, 20 nt, Shigella flexneri 2a str. 301
ugaaaaggucacucccggau

SEQ ID NO: 3914233 - RNA, 18 nt, Shigella flexneri 2a str. 301
ugaaaagguugccugucu

SEQ ID NO: 3914234 - RNA, 16 nt, Shigella flexneri 2a str. 301
ugaaaagucauccggc

SEQ ID NO: 3914235 - RNA, 20 nt, Shigella flexneri 2a str. 301
ugaaaaguccaggcugcaaa

SEQ ID NO: 3914236 - RNA, 18 nt, Shigella flexneri 2a str. 301
ugaaaauaacaucgccag

SEQ ID NO: 3914237 - RNA, 15 nt, Shigella flexneri 2a str. 301
ugaaaauaaccauau

SEQ ID NO: 3914238 - RNA, 22 nt, Shigella flexneri 2a str. 301
ugaacuucgcagccgugacugg

SEQ ID NO: 3914239 - RNA, 12 nt, Shigella flexneri 2a str. 301
ugaagaaaucag

SEQ ID NO: 3914240 - RNA, 14 nt, Shigella flexneri 2a str. 301
ugaagaaccgcacc

SEQ ID NO: 3914241 - RNA, 15 nt, Shigella flexneri 2a str. 301
ugaagaacucaaagc

SEQ ID NO: 3914242 - RNA, 21 nt, Shigella flexneri 2a str. 301
ugaagaacugcuugcccagca

SEQ ID NO: 3914243 - RNA, 19 nt, Shigella flexneri 2a str. 301
ugaagaacuggaacgcgua

SEQ ID NO: 3914244 - RNA, 15 nt, Shigella flexneri 2a str. 301
ugaagaagcggaaau

SEQ ID NO: 3914245 - RNA, 18 nt, Shigella flexneri 2a str. 301
ugaagaagcggaaaucac

SEQ ID NO: 3914246 - RNA, 23 nt, Shigella flexneri 2a str. 301
ugaagaagcggaaaucacgcauc

SEQ ID NO: 3914247 - RNA, 18 nt, Shigella flexneri 2a str. 301
ugaagaggaacaaauuuu

SEQ ID NO: 3914248 - RNA, 19 nt, Shigella flexneri 2a str. 301
ugaagaugccaacuggcau

SEQ ID NO: 3914249 - RNA, 20 nt, Shigella flexneri 2a str. 301
ugaagcaauccauaccagca

SEQ ID NO: 3914250 - RNA, 21 nt, Shigella flexneri 2a str. 301
ugaagcaguuucaccagcagu

SEQ ID NO: 3914251 - RNA, 20 nt, Shigella flexneri 2a str. 301
ugaagccaaccgggccgcag

SEQ ID NO: 3914252 - RNA, 19 nt, Shigella flexneri 2a str. 301
ugaagcccaguaccgccag

SEQ ID NO: 3914253 - RNA, 20 nt, Shigella flexneri 2a str. 301
ugaagcccgcugaaaagcgg

SEQ ID NO: 3914254 - RNA, 22 nt, Shigella flexneri 2a str. 301
ugaagcccucgacauguucuau

SEQ ID NO: 3914255 - RNA, 23 nt, Shigella flexneri 2a str. 301
ugaagcguucuucugcuucuuua

SEQ ID NO: 3914256 - RNA, 23 nt, Shigella flexneri 2a str. 301
ugaagcucacuucgcuuacgccu

SEQ ID NO: 3914257 - RNA, 20 nt, Shigella flexneri 2a str. 301
ugaagcuggcagaaguuguc

SEQ ID NO: 3914258 - RNA, 14 nt, Shigella flexneri 2a str. 301
ugaaggauaagacg

SEQ ID NO: 3914259 - RNA, 20 nt, Shigella flexneri 2a str. 301
ugaaggaugaaacugccgga

SEQ ID NO: 3914260 - RNA, 16 nt, Shigella flexneri 2a str. 301
ugaaggcaaacuucuc

SEQ ID NO: 3914261 - RNA, 20 nt, Shigella flexneri 2a str. 301
ugaaggcgcauugcuggcug

SEQ ID NO: 3914262 - RNA, 15 nt, Shigella flexneri 2a str. 301
ugaaggcggcgcauc

SEQ ID NO: 3914263 - RNA, 20 nt, Shigella flexneri 2a str. 301
ugaagguuguuaaccaccag

SEQ ID NO: 3914264 - RNA, 21 nt, Shigella flexneri 2a str. 301
ugaagguuucugcauuaucca

SEQ ID NO: 3914265 - RNA, 22 nt, Shigella flexneri 2a str. 301
ugaagguuucugcauuauccag

SEQ ID NO: 3914266 - RNA, 21 nt, Shigella flexneri 2a str. 301
ugaaguaaaaggucugaaaga

SEQ ID NO: 3914267 - RNA, 23 nt, Shigella flexneri 2a str. 301
ugaaguaaaaggucugaaagaua

SEQ ID NO: 3914268 - RNA, 16 nt, Shigella flexneri 2a str. 301
ugaaguacagcccagg

SEQ ID NO: 3914269 - RNA, 20 nt, Shigella flexneri 2a str. 301
ugaagucagggucuuccagc

SEQ ID NO: 3914270 - RNA, 18 nt, Shigella flexneri 2a str. 301
ugaagucgcgcucaucag

SEQ ID NO: 3914271 - RNA, 22 nt, Shigella flexneri 2a str. 301
ugaagucgggcagaaugcccug

SEQ ID NO: 3914272 - RNA, 19 nt, Shigella flexneri 2a str. 301
ugaagucuuuuuucaacuu

SEQ ID NO: 3914273 - RNA, 18 nt, Shigella flexneri 2a str. 301
ugaagugagaauuuuuca

SEQ ID NO: 3914274 - RNA, 22 nt, Shigella flexneri 2a str. 301
ugaagugugcaaacgauaaaag

SEQ ID NO: 3914275 - RNA, 19 nt, Shigella flexneri 2a str. 301
ugaaguuacuaacaucgau

SEQ ID NO: 3914276 - RNA, 17 nt, Shigella flexneri 2a str. 301
ugaaguuauaaggcguu

SEQ ID NO: 3914277 - RNA, 23 nt, Shigella flexneri 2a str. 301
ugaaguugccggauguguugcau

SEQ ID NO: 3914278 - RNA, 19 nt, Shigella flexneri 2a str. 301
ugaauaaauacauugcagu

SEQ ID NO: 3914279 - RNA, 14 nt, Shigella flexneri 2a str. 301
ugaauaacaccagc

SEQ ID NO: 3914280 - RNA, 18 nt, Shigella flexneri 2a str. 301
ugaauaacaccagccaga

SEQ ID NO: 3914281 - RNA, 15 nt, Shigella flexneri 2a str. 301
ugaauaauacacaca

SEQ ID NO: 3914282 - RNA, 21 nt, Shigella flexneri 2a str. 301
ugaauaauccccauaucaggc

SEQ ID NO: 3914283 - RNA, 14 nt, Shigella flexneri 2a str. 301
ugaauagcggaaau

SEQ ID NO: 3914284 - RNA, 16 nt, Shigella flexneri 2a str. 301
ugaauagcggaaaucu

SEQ ID NO: 3914285 - RNA, 17 nt, Shigella flexneri 2a str. 301
ugaauagcggaaaucuc

SEQ ID NO: 3914286 - RNA, 20 nt, Shigella flexneri 2a str. 301
ugaauagcggaaaucuccag

SEQ ID NO: 3914287 - RNA, 19 nt, Shigella flexneri 2a str. 301
ugaauagugccacaccagc

SEQ ID NO: 3914288 - RNA, 20 nt, Shigella flexneri 2a str. 301
ugaauagugccacaccagcu

SEQ ID NO: 3914289 - RNA, 16 nt, Shigella flexneri 2a str. 301
ugaauauauaauuaaa

SEQ ID NO: 3914290 - RNA, 18 nt, Shigella flexneri 2a str. 301
ugaauauauccgaaaaag

SEQ ID NO: 3914291 - RNA, 19 nt, Shigella flexneri 2a str. 301
ugaauaugucgcgccaggc

SEQ ID NO: 3914292 - RNA, 20 nt, Shigella flexneri 2a str. 301
ugaauauuccacagcucacg

SEQ ID NO: 3914293 - RNA, 18 nt, Shigella flexneri 2a str. 301
ugaauauuccuuaugguu

SEQ ID NO: 3914294 - RNA, 15 nt, Shigella flexneri 2a str. 301
ugaaucaccacaggc

SEQ ID NO: 3914295 - RNA, 17 nt, Shigella flexneri 2a str. 301
ugaaucaccacaggccu

SEQ ID NO: 3914296 - RNA, 16 nt, Shigella flexneri 2a str. 301
ugaaucacgacaaaca

SEQ ID NO: 3914297 - RNA, 15 nt, Shigella flexneri 2a str. 301
ugaaucacgccgccc

SEQ ID NO: 3914298 - RNA, 17 nt, Shigella flexneri 2a str. 301
ugaaucacgccgcccau

SEQ ID NO: 3914299 - RNA, 23 nt, Shigella flexneri 2a str. 301
ugaaucgcuauuaacccgcaaca

SEQ ID NO: 3914300 - RNA, 19 nt, Shigella flexneri 2a str. 301
ugaaucgggaccagcauuc

SEQ ID NO: 3914301 - RNA, 19 nt, Shigella flexneri 2a str. 301
ugaaucgucggaauggcau

SEQ ID NO: 3914302 - RNA, 13 nt, Shigella flexneri 2a str. 301
ugaaucugagcau

SEQ ID NO: 3914303 - RNA, 13 nt, Shigella flexneri 2a str. 301
ugaaucuuuucau

SEQ ID NO: 3914304 - RNA, 13 nt, Shigella flexneri 2a str. 301
ugaaugaucggau

SEQ ID NO: 3914305 - RNA, 21 nt, Shigella flexneri 2a str. 301
ugaaugccccuuuaaauaccu

SEQ ID NO: 3914306 - RNA, 13 nt, Shigella flexneri 2a str. 301
ugaaugccggaug

SEQ ID NO: 3914307 - RNA, 13 nt, Shigella flexneri 2a str. 301
ugaaugcggcagg

SEQ ID NO: 3914308 - RNA, 20 nt, Shigella flexneri 2a str. 301
ugaaugcuuucauauuccag

SEQ ID NO: 3914309 - RNA, 22 nt, Shigella flexneri 2a str. 301
ugaaugguggcgaugauuuccg

SEQ ID NO: 3914310 - RNA, 19 nt, Shigella flexneri 2a str. 301
ugaaugucugucugacaac

SEQ ID NO: 3914311 - RNA, 21 nt, Shigella flexneri 2a str. 301
ugaauuacugggaugugaaaa

SEQ ID NO: 3914312 - RNA, 17 nt, Shigella flexneri 2a str. 301
ugaauuacuucucuuuc

SEQ ID NO: 3914313 - RNA, 15 nt, Shigella flexneri 2a str. 301
ugaauuguuuuauaa

SEQ ID NO: 3914314 - RNA, 19 nt, Shigella flexneri 2a str. 301
ugaauuuacacaauuuugu

SEQ ID NO: 3914315 - RNA, 18 nt, Shigella flexneri 2a str. 301
ugaauuucuaucaaggcg

SEQ ID NO: 3914316 - RNA, 15 nt, Shigella flexneri 2a str. 301
ugaauuugcaugacu

SEQ ID NO: 3914317 - RNA, 17 nt, Shigella flexneri 2a str. 301
ugaauuugucgauuucc

SEQ ID NO: 3914318 - RNA, 18 nt, Shigella flexneri 2a str. 301
ugaauuugugaacagccu

SEQ ID NO: 3914319 - RNA, 19 nt, Shigella flexneri 2a str. 301
ugacaaauuccgaacaaaa

SEQ ID NO: 3914320 - RNA, 16 nt, Shigella flexneri 2a str. 301
ugacaacucaucacug

SEQ ID NO: 3914321 - RNA, 13 nt, Shigella flexneri 2a str. 301
ugacaacuuucau

SEQ ID NO: 3914322 - RNA, 17 nt, Shigella flexneri 2a str. 301
ugacaacuuucaucagc

SEQ ID NO: 3914323 - RNA, 18 nt, Shigella flexneri 2a str. 301
ugacaagcguaugauugc

SEQ ID NO: 3914324 - RNA, 15 nt, Shigella flexneri 2a str. 301
ugacaagcucaccuc

SEQ ID NO: 3914325 - RNA, 21 nt, Shigella flexneri 2a str. 301
ugacaauaauugucaacggca

SEQ ID NO: 3914326 - RNA, 17 nt, Shigella flexneri 2a str. 301
ugacaaucgcugcggca

SEQ ID NO: 3914327 - RNA, 16 nt, Shigella flexneri 2a str. 301
ugacacaggcagcaau

SEQ ID NO: 3914328 - RNA, 19 nt, Shigella flexneri 2a str. 301
ugacacaggcagcaaucac

SEQ ID NO: 3914329 - RNA, 17 nt, Shigella flexneri 2a str. 301
ugacacaucaccuccag

SEQ ID NO: 3914330 - RNA, 14 nt, Shigella flexneri 2a str. 301
ugacaccagcacau

SEQ ID NO: 3914331 - RNA, 15 nt, Shigella flexneri 2a str. 301
ugacaccagcacauc

SEQ ID NO: 3914332 - RNA, 13 nt, Shigella flexneri 2a str. 301
ugacacccaaugu

SEQ ID NO: 3914333 - RNA, 14 nt, Shigella flexneri 2a str. 301
ugacacggaacaac

SEQ ID NO: 3914334 - RNA, 23 nt, Shigella flexneri 2a str. 301
ugacagaccguugcucagaauca

SEQ ID NO: 3914335 - RNA, 19 nt, Shigella flexneri 2a str. 301
ugacagaguuccggcccua

SEQ ID NO: 3914336 - RNA, 17 nt, Shigella flexneri 2a str. 301
ugacagauuugauuauc

SEQ ID NO: 3914337 - RNA, 18 nt, Shigella flexneri 2a str. 301
ugacuccaacuuacugau

SEQ ID NO: 3914338 - RNA, 21 nt, Shigella flexneri 2a str. 301
ugacuccaacuuacugauagu

SEQ ID NO: 3914339 - RNA, 22 nt, Shigella flexneri 2a str. 301
ugacuccccgauuguugaugag

SEQ ID NO: 3914340 - RNA, 21 nt, Shigella flexneri 2a str. 301
ugacucggacgcguuucauuc

SEQ ID NO: 3914341 - RNA, 21 nt, Shigella flexneri 2a str. 301
ugacucggcucauuauuugcc

SEQ ID NO: 3914342 - RNA, 15 nt, Shigella flexneri 2a str. 301
ugacucuuuauuuca

SEQ ID NO: 3914343 - RNA, 18 nt, Shigella flexneri 2a str. 301
ugacucuuuauuucauuu

SEQ ID NO: 3914344 - RNA, 15 nt, Shigella flexneri 2a str. 301
ugacugaaaaguuaa

SEQ ID NO: 3914345 - RNA, 14 nt, Shigella flexneri 2a str. 301
ugacugaagaaauc

SEQ ID NO: 3914346 - RNA, 17 nt, Shigella flexneri 2a str. 301
ugacugaaugccacauc

SEQ ID NO: 3914347 - RNA, 14 nt, Shigella flexneri 2a str. 301
ugacugacuucaac

SEQ ID NO: 3914348 - RNA, 15 nt, Shigella flexneri 2a str. 301
ugacugccccaguuc

SEQ ID NO: 3914349 - RNA, 16 nt, Shigella flexneri 2a str. 301
ugacugccccaguucc

SEQ ID NO: 3914350 - RNA, 16 nt, Shigella flexneri 2a str. 301
ugacugcggcgugggc

SEQ ID NO: 3914351 - RNA, 13 nt, Shigella flexneri 2a str. 301
ugacuggcauuac

SEQ ID NO: 3914352 - RNA, 14 nt, Shigella flexneri 2a str. 301
ugacuggcuacugu

SEQ ID NO: 3914353 - RNA, 21 nt, Shigella flexneri 2a str. 301
ugacuggggcggcuaaaauau

SEQ ID NO: 3914354 - RNA, 16 nt, Shigella flexneri 2a str. 301
ugacugguagugcagu

SEQ ID NO: 3914355 - RNA, 19 nt, Shigella flexneri 2a str. 301
ugacugguagugcaguaca

SEQ ID NO: 3914356 - RNA, 21 nt, Shigella flexneri 2a str. 301
ugacugguagugcaguacauc

SEQ ID NO: 3914357 - RNA, 13 nt, Shigella flexneri 2a str. 301
ugacuguacagau

SEQ ID NO: 3914358 - RNA, 16 nt, Shigella flexneri 2a str. 301
ugacuguacagauccg

SEQ ID NO: 3914359 - RNA, 15 nt, Shigella flexneri 2a str. 301
ugacuuauaagucuc

SEQ ID NO: 3914360 - RNA, 19 nt, Shigella flexneri 2a str. 301
ugacuucaauuugagcgaa

SEQ ID NO: 3914361 - RNA, 14 nt, Shigella flexneri 2a str. 301
ugacuuccacuucc

SEQ ID NO: 3914362 - RNA, 15 nt, Shigella flexneri 2a str. 301
ugacuuccacuuccu

SEQ ID NO: 3914363 - RNA, 22 nt, Shigella flexneri 2a str. 301
ugacuuccacuuccugcggagc

SEQ ID NO: 3914364 - RNA, 20 nt, Shigella flexneri 2a str. 301
ugacuuccguaccagccuug

SEQ ID NO: 3914365 - RNA, 21 nt, Shigella flexneri 2a str. 301
ugacuugccgcaaaacccagg

SEQ ID NO: 3914366 - RNA, 17 nt, Shigella flexneri 2a str. 301
ugacuuugauccagcca

SEQ ID NO: 3914367 - RNA, 22 nt, Shigella flexneri 2a str. 301
ugacuuugccgauuuaacccug

SEQ ID NO: 3914368 - RNA, 10 nt, Shigella flexneri 2a str. 301
ugagaaaaag

SEQ ID NO: 3914369 - RNA, 19 nt, Shigella flexneri 2a str. 301
ugagaaaaagcgaagcggc

SEQ ID NO: 3914370 - RNA, 19 nt, Shigella flexneri 2a str. 301
ugagaaacucaguugauuc

SEQ ID NO: 3914371 - RNA, 13 nt, Shigella flexneri 2a str. 301
ugagaaagcugcg

SEQ ID NO: 3914372 - RNA, 20 nt, Shigella flexneri 2a str. 301
ugagaacaagauugccugau

SEQ ID NO: 3914373 - RNA, 13 nt, Shigella flexneri 2a str. 301
ugagaacaccacc

SEQ ID NO: 3914374 - RNA, 14 nt, Shigella flexneri 2a str. 301
ugagaacaccaccu

SEQ ID NO: 3914375 - RNA, 21 nt, Shigella flexneri 2a str. 301
ugagaacgacagugacuuccg

SEQ ID NO: 3914376 - RNA, 16 nt, Shigella flexneri 2a str. 301
ugagaauaaccucuuu

SEQ ID NO: 3914377 - RNA, 22 nt, Shigella flexneri 2a str. 301
ugagaauaaucaccuuuaaccu

SEQ ID NO: 3914378 - RNA, 21 nt, Shigella flexneri 2a str. 301
ugagaauuccggcagagaaag

SEQ ID NO: 3914379 - RNA, 11 nt, Shigella flexneri 2a str. 301
ugagagaaaaa

SEQ ID NO: 3914380 - RNA, 14 nt, Shigella flexneri 2a str. 301
ugagauaauucugu

SEQ ID NO: 3914381 - RNA, 23 nt, Shigella flexneri 2a str. 301
ugagauaauucuguaauccucuu

SEQ ID NO: 3914382 - RNA, 21 nt, Shigella flexneri 2a str. 301
ugagauaccaguugaucaaau

SEQ ID NO: 3914383 - RNA, 15 nt, Shigella flexneri 2a str. 301
ugagauacucaagca

SEQ ID NO: 3914384 - RNA, 22 nt, Shigella flexneri 2a str. 301
ugagauacucaagcagccaggu

SEQ ID NO: 3914385 - RNA, 19 nt, Shigella flexneri 2a str. 301
ugagaucaaacucuuucaa

SEQ ID NO: 3914386 - RNA, 20 nt, Shigella flexneri 2a str. 301
ugagaucauuauuaaacaga

SEQ ID NO: 3914387 - RNA, 18 nt, Shigella flexneri 2a str. 301
ugagaucgugaaacucag

SEQ ID NO: 3914388 - RNA, 17 nt, Shigella flexneri 2a str. 301
ugagauucaaauaagcg

SEQ ID NO: 3914389 - RNA, 15 nt, Shigella flexneri 2a str. 301
ugagauuucaccaau

SEQ ID NO: 3914390 - RNA, 21 nt, Shigella flexneri 2a str. 301
ugagcaaacaguucugcagcg

SEQ ID NO: 3914391 - RNA, 16 nt, Shigella flexneri 2a str. 301
ugagcaaggcauaggc

SEQ ID NO: 3914392 - RNA, 18 nt, Shigella flexneri 2a str. 301
ugagcaaggcauaggcuu

SEQ ID NO: 3914393 - RNA, 14 nt, Shigella flexneri 2a str. 301
ugagcacaucuggc

SEQ ID NO: 3914394 - RNA, 19 nt, Shigella flexneri 2a str. 301
ugagcagaagguaaauugu

SEQ ID NO: 3914395 - RNA, 19 nt, Shigella flexneri 2a str. 301
ugagcaguggcaaacugag

SEQ ID NO: 3914396 - RNA, 19 nt, Shigella flexneri 2a str. 301
ugagcaugaugccugaugc

SEQ ID NO: 3914397 - RNA, 18 nt, Shigella flexneri 2a str. 301
ugagccaaaaugccugau

SEQ ID NO: 3914398 - RNA, 13 nt, Shigella flexneri 2a str. 301
ugagccgccgcca

SEQ ID NO: 3914399 - RNA, 13 nt, Shigella flexneri 2a str. 301
ugagcgacaucuu

SEQ ID NO: 3914400 - RNA, 16 nt, Shigella flexneri 2a str. 301
ugagcgauaaacaagu

SEQ ID NO: 3914401 - RNA, 13 nt, Shigella flexneri 2a str. 301
ugagcgauaccca

SEQ ID NO: 3914402 - RNA, 20 nt, Shigella flexneri 2a str. 301
ugagcgauacccauuuuauu

SEQ ID NO: 3914403 - RNA, 23 nt, Shigella flexneri 2a str. 301
ugagcgauuuuuuauaguacuuc

SEQ ID NO: 3914404 - RNA, 11 nt, Shigella flexneri 2a str. 301
ugagcgcaaau

SEQ ID NO: 3914405 - RNA, 16 nt, Shigella flexneri 2a str. 301
ugagcggccuuuuccu

SEQ ID NO: 3914406 - RNA, 19 nt, Shigella flexneri 2a str. 301
ugagcggcgggcuuuaauc

SEQ ID NO: 3914407 - RNA, 19 nt, Shigella flexneri 2a str. 301
ugagcgggcgaaccaggcc

SEQ ID NO: 3914408 - RNA, 16 nt, Shigella flexneri 2a str. 301
ugagcgguacaccaaa

SEQ ID NO: 3914409 - RNA, 15 nt, Shigella flexneri 2a str. 301
ugagcgguuaacacg

SEQ ID NO: 3914410 - RNA, 20 nt, Shigella flexneri 2a str. 301
ugagcguuacccgcagccau

SEQ ID NO: 3914411 - RNA, 15 nt, Shigella flexneri 2a str. 301
ugagcugcaucuguu

SEQ ID NO: 3914412 - RNA, 18 nt, Shigella flexneri 2a str. 301
ugagcugccucgcugaag

SEQ ID NO: 3914413 - RNA, 20 nt, Shigella flexneri 2a str. 301
ugagcugcgcgacucccuga

SEQ ID NO: 3914414 - RNA, 13 nt, Shigella flexneri 2a str. 301
ugagcuucucgau

SEQ ID NO: 3914415 - RNA, 22 nt, Shigella flexneri 2a str. 301
ugagcuuuguucaugccggaug

SEQ ID NO: 3914416 - RNA, 14 nt, Shigella flexneri 2a str. 301
ugaggaagcgcagc

SEQ ID NO: 3914417 - RNA, 16 nt, Shigella flexneri 2a str. 301
ugaggaguuuaauaaa

SEQ ID NO: 3914418 - RNA, 21 nt, Shigella flexneri 2a str. 301
ugaggaguuuaauaaauuuag

SEQ ID NO: 3914419 - RNA, 17 nt, Shigella flexneri 2a str. 301
ugaggaucacaaaacga

SEQ ID NO: 3914420 - RNA, 14 nt, Shigella flexneri 2a str. 301
ugaggaucaccagu

SEQ ID NO: 3914421 - RNA, 19 nt, Shigella flexneri 2a str. 301
ugaggcaauaaugacgcug

SEQ ID NO: 3914422 - RNA, 19 nt, Shigella flexneri 2a str. 301
ugaggcauaagcgacaucu

SEQ ID NO: 3914423 - RNA, 19 nt, Shigella flexneri 2a str. 301
ugaggcgcuacgcuaucag

SEQ ID NO: 3914424 - RNA, 16 nt, Shigella flexneri 2a str. 301
ugaggcguuaacagcg

SEQ ID NO: 3914425 - RNA, 17 nt, Shigella flexneri 2a str. 301
ugagggaggauuucucc

SEQ ID NO: 3914426 - RNA, 16 nt, Shigella flexneri 2a str. 301
ugagggcgcaauuucc

SEQ ID NO: 3914427 - RNA, 12 nt, Shigella flexneri 2a str. 301
ugagguuaugca

SEQ ID NO: 3914428 - RNA, 14 nt, Shigella flexneri 2a str. 301
ugagguuucccgcc

SEQ ID NO: 3914429 - RNA, 16 nt, Shigella flexneri 2a str. 301
ugaguaaacuuuugga

SEQ ID NO: 3914430 - RNA, 22 nt, Shigella flexneri 2a str. 301
ugaguaagcaggguugcagcca

SEQ ID NO: 3914431 - RNA, 13 nt, Shigella flexneri 2a str. 301
ugaguaauaacuu

SEQ ID NO: 3914432 - RNA, 15 nt, Shigella flexneri 2a str. 301
ugaguaccagcgcac

SEQ ID NO: 3914433 - RNA, 16 nt, Shigella flexneri 2a str. 301
ugagucuucccuuguu

SEQ ID NO: 3914434 - RNA, 13 nt, Shigella flexneri 2a str. 301
ugagugaaauuuu

SEQ ID NO: 3914435 - RNA, 18 nt, Shigella flexneri 2a str. 301
ugaguggaguccagcgcc

SEQ ID NO: 3914436 - RNA, 18 nt, Shigella flexneri 2a str. 301
ugaguggugaaaaaaagg

SEQ ID NO: 3914437 - RNA, 14 nt, Shigella flexneri 2a str. 301
ugaugcauccggca

SEQ ID NO: 3914438 - RNA, 14 nt, Shigella flexneri 2a str. 301
ugaugcauuuuuua

SEQ ID NO: 3914439 - RNA, 20 nt, Shigella flexneri 2a str. 301
ugaugcauuuuuuagugauu

SEQ ID NO: 3914440 - RNA, 21 nt, Shigella flexneri 2a str. 301
ugaugccgauuguauacgcug

SEQ ID NO: 3914441 - RNA, 14 nt, Shigella flexneri 2a str. 301
ugaugccgugcagc

SEQ ID NO: 3914442 - RNA, 15 nt, Shigella flexneri 2a str. 301
ugaugccgugcagca

SEQ ID NO: 3914443 - RNA, 17 nt, Shigella flexneri 2a str. 301
ugaugcgacgcuugacg

SEQ ID NO: 3914444 - RNA, 17 nt, Shigella flexneri 2a str. 301
ugaugcgaugcuugacg

SEQ ID NO: 3914445 - RNA, 16 nt, Shigella flexneri 2a str. 301
ugaugcgcggcuccag

SEQ ID NO: 3914446 - RNA, 22 nt, Shigella flexneri 2a str. 301
ugaugcgcuacgcucaucaggc

SEQ ID NO: 3914447 - RNA, 22 nt, Shigella flexneri 2a str. 301
ugaugcgcugcgcuuaucaggc

SEQ ID NO: 3914448 - RNA, 18 nt, Shigella flexneri 2a str. 301
ugaugcggcgcuuucagc

SEQ ID NO: 3914449 - RNA, 12 nt, Shigella flexneri 2a str. 301
ugaugcguaccu

SEQ ID NO: 3914450 - RNA, 22 nt, Shigella flexneri 2a str. 301
ugaugcguugcgcuucucaggc

SEQ ID NO: 3914451 - RNA, 22 nt, Shigella flexneri 2a str. 301
ugauggaaaauuguuccgucag

SEQ ID NO: 3914452 - RNA, 20 nt, Shigella flexneri 2a str. 301
ugauggcauaacguugcagc

SEQ ID NO: 3914453 - RNA, 21 nt, Shigella flexneri 2a str. 301
ugauggcauucucacuccagc

SEQ ID NO: 3914454 - RNA, 16 nt, Shigella flexneri 2a str. 301
ugauggcccguuuuag

SEQ ID NO: 3914455 - RNA, 17 nt, Shigella flexneri 2a str. 301
ugauggcgauaaucuuu

SEQ ID NO: 3914456 - RNA, 15 nt, Shigella flexneri 2a str. 301
ugauggcuauuagaa

SEQ ID NO: 3914457 - RNA, 19 nt, Shigella flexneri 2a str. 301
ugaugguaaaauaucacuc

SEQ ID NO: 3914458 - RNA, 21 nt, Shigella flexneri 2a str. 301
ugaugguaacgcgccaggauc

SEQ ID NO: 3914459 - RNA, 20 nt, Shigella flexneri 2a str. 301
ugaugucagcacuuccagcu

SEQ ID NO: 3914460 - RNA, 22 nt, Shigella flexneri 2a str. 301
ugaugucagcacuuccagcucc

SEQ ID NO: 3914461 - RNA, 21 nt, Shigella flexneri 2a str. 301
ugaugucguguuaauuaccua

SEQ ID NO: 3914462 - RNA, 16 nt, Shigella flexneri 2a str. 301
ugaugucucuguuuug

SEQ ID NO: 3914463 - RNA, 21 nt, Shigella flexneri 2a str. 301
ugaugugacgcugucuuauca

SEQ ID NO: 3914464 - RNA, 15 nt, Shigella flexneri 2a str. 301
ugaugugauccauca

SEQ ID NO: 3914465 - RNA, 16 nt, Shigella flexneri 2a str. 301
ugaugugcuucaucag

SEQ ID NO: 3914466 - RNA, 19 nt, Shigella flexneri 2a str. 301
ugauguggugcaaggaaau

SEQ ID NO: 3914467 - RNA, 21 nt, Shigella flexneri 2a str. 301
ugauuaacgcuuguaaaugaa

SEQ ID NO: 3914468 - RNA, 18 nt, Shigella flexneri 2a str. 301
ugauuacgguauugcuau

SEQ ID NO: 3914469 - RNA, 22 nt, Shigella flexneri 2a str. 301
ugauuagggcggacaaccagcu

SEQ ID NO: 3914470 - RNA, 13 nt, Shigella flexneri 2a str. 301
ugauuaucggcau

SEQ ID NO: 3914471 - RNA, 15 nt, Shigella flexneri 2a str. 301
ugauucacguucgug

SEQ ID NO: 3914472 - RNA, 20 nt, Shigella flexneri 2a str. 301
ugauucacuuucugaaggau

SEQ ID NO: 3914473 - RNA, 13 nt, Shigella flexneri 2a str. 301
ugauucaggauau

SEQ ID NO: 3914474 - RNA, 15 nt, Shigella flexneri 2a str. 301
ugauucauggcauuu

SEQ ID NO: 3914475 - RNA, 20 nt, Shigella flexneri 2a str. 301
ugauuccagcauaaugacuc

SEQ ID NO: 3914476 - RNA, 16 nt, Shigella flexneri 2a str. 301
ugauuccgaauccaac

SEQ ID NO: 3914477 - RNA, 13 nt, Shigella flexneri 2a str. 301
ugauuccgccagu

SEQ ID NO: 3914478 - RNA, 20 nt, Shigella flexneri 2a str. 301
ugauuccggcaaauaacaga

SEQ ID NO: 3914479 - RNA, 23 nt, Shigella flexneri 2a str. 301
ugauuccgggaauucgaagcugu

SEQ ID NO: 3914480 - RNA, 21 nt, Shigella flexneri 2a str. 301
ugauucgcgccacguucggug

SEQ ID NO: 3914481 - RNA, 14 nt, Shigella flexneri 2a str. 301
ugauucgcgcguuc

SEQ ID NO: 3914482 - RNA, 13 nt, Shigella flexneri 2a str. 301
ugauucucccuca

SEQ ID NO: 3914483 - RNA, 21 nt, Shigella flexneri 2a str. 301
ugauucugauccugcacuuuc

SEQ ID NO: 3914484 - RNA, 19 nt, Shigella flexneri 2a str. 301
ugauugaaaaauaccucau

SEQ ID NO: 3914485 - RNA, 19 nt, Shigella flexneri 2a str. 301
ugauugaaauagccaauac

SEQ ID NO: 3914486 - RNA, 15 nt, Shigella flexneri 2a str. 301
ugauugaagaaauca

SEQ ID NO: 3914487 - RNA, 16 nt, Shigella flexneri 2a str. 301
ugauugaagaaaucag

SEQ ID NO: 3914488 - RNA, 15 nt, Shigella flexneri 2a str. 301
ugauugaccgccagc

SEQ ID NO: 3914489 - RNA, 20 nt, Shigella flexneri 2a str. 301
ugauugacgcguucgcuaaa

SEQ ID NO: 3914490 - RNA, 22 nt, Shigella flexneri 2a str. 301
ugauugagauaaacugccgaca

SEQ ID NO: 3914491 - RNA, 17 nt, Shigella flexneri 2a str. 301
ugauugccacccugcgg

SEQ ID NO: 3914492 - RNA, 18 nt, Shigella flexneri 2a str. 301
ugauugccuuccaccaga

SEQ ID NO: 3914493 - RNA, 20 nt, Shigella flexneri 2a str. 301
ugauugcucugguuguggug

SEQ ID NO: 3914494 - RNA, 22 nt, Shigella flexneri 2a str. 301
ugauugcugcugccgcgccaga

SEQ ID NO: 3914495 - RNA, 19 nt, Shigella flexneri 2a str. 301
ugauugcugucggcaaauc

SEQ ID NO: 3914496 - RNA, 20 nt, Shigella flexneri 2a str. 301
ugauugcuuuaucaaucacc

SEQ ID NO: 3914497 - RNA, 17 nt, Shigella flexneri 2a str. 301
ugauuguuaacaacgug

SEQ ID NO: 3914498 - RNA, 23 nt, Shigella flexneri 2a str. 301
ugauuguugcgccaguaaauuua

SEQ ID NO: 3914499 - RNA, 20 nt, Shigella flexneri 2a str. 301
ugauuuaaaaaauggccaga

SEQ ID NO: 3914500 - RNA, 22 nt, Shigella flexneri 2a str. 301
ugauuuaaccaacaauaaaauu

SEQ ID NO: 3914501 - RNA, 12 nt, Shigella flexneri 2a str. 301
ugauuuauagau

SEQ ID NO: 3914502 - RNA, 14 nt, Shigella flexneri 2a str. 301
ugauuuauagauuu

SEQ ID NO: 3914503 - RNA, 16 nt, Shigella flexneri 2a str. 301
ugauuuauagauuuac

SEQ ID NO: 3914504 - RNA, 22 nt, Shigella flexneri 2a str. 301
ugauuuccccuaacucuuucaa

SEQ ID NO: 3914505 - RNA, 19 nt, Shigella flexneri 2a str. 301
ugauuucgucauccggugu

SEQ ID NO: 3914506 - RNA, 15 nt, Shigella flexneri 2a str. 301
ugauuuuauugcguc

SEQ ID NO: 3914507 - RNA, 19 nt, Shigella flexneri 2a str. 301
ugauuuuccuccagcagca

SEQ ID NO: 3914508 - RNA, 19 nt, Shigella flexneri 2a str. 301
ugauuuucgaaaaaaaaga

SEQ ID NO: 3914509 - RNA, 22 nt, Shigella flexneri 2a str. 301
ugauuuucucgcccguuuugag

SEQ ID NO: 3914510 - RNA, 20 nt, Shigella flexneri 2a str. 301
ugauuuugcugaucggcaag

SEQ ID NO: 3914511 - RNA, 17 nt, Shigella flexneri 2a str. 301
ugauuuuucguuuuaau

SEQ ID NO: 3914512 - RNA, 19 nt, Shigella flexneri 2a str. 301
ugauuuuucguuuuaaugc

SEQ ID NO: 3914513 - RNA, 23 nt, Shigella flexneri 2a str. 301
ugauuuuucguuuuaaugcgauc

SEQ ID NO: 3914514 - RNA, 20 nt, Shigella flexneri 2a str. 301
ugauuuuuuuucaaccuaaa

SEQ ID NO: 3914515 - RNA, 20 nt, Shigella flexneri 2a str. 301
ugcaaaaaauacguaaaauc

SEQ ID NO: 3914516 - RNA, 16 nt, Shigella flexneri 2a str. 301
ugcaaaaccugguugg

SEQ ID NO: 3914517 - RNA, 16 nt, Shigella flexneri 2a str. 301
ugcaaaauaccaauaa

SEQ ID NO: 3914518 - RNA, 22 nt, Shigella flexneri 2a str. 301
ugcaaaauuuuuuugcaccaua

SEQ ID NO: 3914519 - RNA, 23 nt, Shigella flexneri 2a str. 301
ugcaaacgcuggugaguaacgcg

SEQ ID NO: 3914520 - RNA, 17 nt, Shigella flexneri 2a str. 301
ugcaaauaaauaccguu

SEQ ID NO: 3914521 - RNA, 14 nt, Shigella flexneri 2a str. 301
ugcaaauaauccac

SEQ ID NO: 3914522 - RNA, 18 nt, Shigella flexneri 2a str. 301
ugcaaauacccaaaaaau

SEQ ID NO: 3914523 - RNA, 12 nt, Shigella flexneri 2a str. 301
ugcaaauauaca

SEQ ID NO: 3914524 - RNA, 13 nt, Shigella flexneri 2a str. 301
ugcaaauauuaau

SEQ ID NO: 3914525 - RNA, 14 nt, Shigella flexneri 2a str. 301
ugcaaaucaccaca

SEQ ID NO: 3914526 - RNA, 18 nt, Shigella flexneri 2a str. 301
ugcaaaucacgcugcuga

SEQ ID NO: 3914527 - RNA, 13 nt, Shigella flexneri 2a str. 301
ugcaaaugccaga

SEQ ID NO: 3914528 - RNA, 20 nt, Shigella flexneri 2a str. 301
ugcaaaugccagauaagaca

SEQ ID NO: 3914529 - RNA, 15 nt, Shigella flexneri 2a str. 301
ugcaaauucaauaua

SEQ ID NO: 3914530 - RNA, 22 nt, Shigella flexneri 2a str. 301
ugcaaauucucuauuucacccg

SEQ ID NO: 3914531 - RNA, 18 nt, Shigella flexneri 2a str. 301
ugcaacaacugaaaaaaa

SEQ ID NO: 3914532 - RNA, 20 nt, Shigella flexneri 2a str. 301
ugcaacaacugaaaaaaaau

SEQ ID NO: 3914533 - RNA, 13 nt, Shigella flexneri 2a str. 301
ugcaacagcacca

SEQ ID NO: 3914534 - RNA, 17 nt, Shigella flexneri 2a str. 301
ugcaacaucagaggcga

SEQ ID NO: 3914535 - RNA, 18 nt, Shigella flexneri 2a str. 301
ugcaacauguugaaucuu

SEQ ID NO: 3914536 - RNA, 20 nt, Shigella flexneri 2a str. 301
ugcagcacggagagacguug

SEQ ID NO: 3914537 - RNA, 14 nt, Shigella flexneri 2a str. 301
ugcagcacugauaa

SEQ ID NO: 3914538 - RNA, 20 nt, Shigella flexneri 2a str. 301
ugcagcaguauuaacgccau

SEQ ID NO: 3914539 - RNA, 14 nt, Shigella flexneri 2a str. 301
ugcagcaugcaccc

SEQ ID NO: 3914540 - RNA, 15 nt, Shigella flexneri 2a str. 301
ugcagcaugcacccu

SEQ ID NO: 3914541 - RNA, 16 nt, Shigella flexneri 2a str. 301
ugcagcaugcacccuc

SEQ ID NO: 3914542 - RNA, 21 nt, Shigella flexneri 2a str. 301
ugcagccagcgucacccagac

SEQ ID NO: 3914543 - RNA, 14 nt, Shigella flexneri 2a str. 301
ugcagccaggguca

SEQ ID NO: 3914544 - RNA, 18 nt, Shigella flexneri 2a str. 301
ugcagcccagcaucagac

SEQ ID NO: 3914545 - RNA, 14 nt, Shigella flexneri 2a str. 301
ugcagccuucauuc

SEQ ID NO: 3914546 - RNA, 18 nt, Shigella flexneri 2a str. 301
ugcagcggaucgccgccg

SEQ ID NO: 3914547 - RNA, 17 nt, Shigella flexneri 2a str. 301
ugcagcggguuaauuuc

SEQ ID NO: 3914548 - RNA, 18 nt, Shigella flexneri 2a str. 301
ugcagcguaaaccccuua

SEQ ID NO: 3914549 - RNA, 14 nt, Shigella flexneri 2a str. 301
ugcagcguacuuca

SEQ ID NO: 3914550 - RNA, 16 nt, Shigella flexneri 2a str. 301
ugcagcguacuucaug

SEQ ID NO: 3914551 - RNA, 15 nt, Shigella flexneri 2a str. 301
ugcagcgucaucaac

SEQ ID NO: 3914552 - RNA, 14 nt, Shigella flexneri 2a str. 301
ugcagcguuuccag

SEQ ID NO: 3914553 - RNA, 16 nt, Shigella flexneri 2a str. 301
ugcagcguuuccagcc

SEQ ID NO: 3914554 - RNA, 17 nt, Shigella flexneri 2a str. 301
ugcagcugccuggccca

SEQ ID NO: 3914555 - RNA, 21 nt, Shigella flexneri 2a str. 301
ugcagcuucuuauccagcugc

SEQ ID NO: 3914556 - RNA, 20 nt, Shigella flexneri 2a str. 301
ugcagcuuuaacgaucacug

SEQ ID NO: 3914557 - RNA, 16 nt, Shigella flexneri 2a str. 301
ugcaggaccauacuga

SEQ ID NO: 3914558 - RNA, 23 nt, Shigella flexneri 2a str. 301
ugcaggacuuaaccguucgcggc

SEQ ID NO: 3914559 - RNA, 22 nt, Shigella flexneri 2a str. 301
ugcaggagcgauuaugaaacaa

SEQ ID NO: 3914560 - RNA, 19 nt, Shigella flexneri 2a str. 301
ugcaggauuaauaaauuuu

SEQ ID NO: 3914561 - RNA, 16 nt, Shigella flexneri 2a str. 301
ugcaggcauucagcaa

SEQ ID NO: 3914562 - RNA, 20 nt, Shigella flexneri 2a str. 301
ugcaggccagauaaggcguu

SEQ ID NO: 3914563 - RNA, 20 nt, Shigella flexneri 2a str. 301
ugcaggcgcagauacagccu

SEQ ID NO: 3914564 - RNA, 16 nt, Shigella flexneri 2a str. 301
ugcaggcuauuucugg

SEQ ID NO: 3914565 - RNA, 11 nt, Shigella flexneri 2a str. 301
ugcaggcuggu

SEQ ID NO: 3914566 - RNA, 20 nt, Shigella flexneri 2a str. 301
ugcagggcaucgcaggccag

SEQ ID NO: 3914567 - RNA, 14 nt, Shigella flexneri 2a str. 301
ugcagguucgacug

SEQ ID NO: 3914568 - RNA, 17 nt, Shigella flexneri 2a str. 301
ugcagucaccugcccuc

SEQ ID NO: 3914569 - RNA, 17 nt, Shigella flexneri 2a str. 301
ugcagucauaaccaguc

SEQ ID NO: 3914570 - RNA, 17 nt, Shigella flexneri 2a str. 301
ugcagugccgcugcucg

SEQ ID NO: 3914571 - RNA, 15 nt, Shigella flexneri 2a str. 301
ugcaguuaucugccg

SEQ ID NO: 3914572 - RNA, 15 nt, Shigella flexneri 2a str. 301
ugcauaaaugccgca

SEQ ID NO: 3914573 - RNA, 14 nt, Shigella flexneri 2a str. 301
ugcauaauccugcc

SEQ ID NO: 3914574 - RNA, 20 nt, Shigella flexneri 2a str. 301
ugcauaaucgacauuuccug

SEQ ID NO: 3914575 - RNA, 23 nt, Shigella flexneri 2a str. 301
ugcauaaucgcaacgccuuccgu

SEQ ID NO: 3914576 - RNA, 20 nt, Shigella flexneri 2a str. 301
ugcauacccagaacuaucau

SEQ ID NO: 3914577 - RNA, 18 nt, Shigella flexneri 2a str. 301
ugcauagcagcacaccac

SEQ ID NO: 3914578 - RNA, 13 nt, Shigella flexneri 2a str. 301
ugcauaggcggca

SEQ ID NO: 3914579 - RNA, 15 nt, Shigella flexneri 2a str. 301
ugcauauaaucgauc

SEQ ID NO: 3914580 - RNA, 23 nt, Shigella flexneri 2a str. 301
ugcauauccaggcuaauccaguc

SEQ ID NO: 3914581 - RNA, 18 nt, Shigella flexneri 2a str. 301
ugcaucaaguugauuuuu

SEQ ID NO: 3914582 - RNA, 22 nt, Shigella flexneri 2a str. 301
ugcaucacauccggcaauauuc

SEQ ID NO: 3914583 - RNA, 23 nt, Shigella flexneri 2a str. 301
ugcaucacauccggcaauauuca

SEQ ID NO: 3914584 - RNA, 18 nt, Shigella flexneri 2a str. 301
ugcaucacgcgcaucugu

SEQ ID NO: 3914585 - RNA, 22 nt, Shigella flexneri 2a str. 301
ugcaucaggcaaacuucacgca

SEQ ID NO: 3914586 - RNA, 13 nt, Shigella flexneri 2a str. 301
ugcaucagucacg

SEQ ID NO: 3914587 - RNA, 15 nt, Shigella flexneri 2a str. 301
ugcaucauggaagca

SEQ ID NO: 3914588 - RNA, 16 nt, Shigella flexneri 2a str. 301
ugcauccacuuugguu

SEQ ID NO: 3914589 - RNA, 19 nt, Shigella flexneri 2a str. 301
ugcauccacuuugguuaca

SEQ ID NO: 3914590 - RNA, 19 nt, Shigella flexneri 2a str. 301
ugcaucccgccguaccggc

SEQ ID NO: 3914591 - RNA, 20 nt, Shigella flexneri 2a str. 301
ugcauccgcuuacucaucca

SEQ ID NO: 3914592 - RNA, 23 nt, Shigella flexneri 2a str. 301
ugcaucgccauaauaagcgccau

SEQ ID NO: 3914593 - RNA, 12 nt, Shigella flexneri 2a str. 301
ugcaucgccuga

SEQ ID NO: 3914594 - RNA, 14 nt, Shigella flexneri 2a str. 301
ugcaucgccugauu

SEQ ID NO: 3914595 - RNA, 21 nt, Shigella flexneri 2a str. 301
ugcaucgccugauucaaugag

SEQ ID NO: 3914596 - RNA, 16 nt, Shigella flexneri 2a str. 301
ugcaucgccugcgcga

SEQ ID NO: 3914597 - RNA, 17 nt, Shigella flexneri 2a str. 301
ugcaucgcgaccaauca

SEQ ID NO: 3914598 - RNA, 22 nt, Shigella flexneri 2a str. 301
ugcaucgcgauuaugccgccga

SEQ ID NO: 3914599 - RNA, 14 nt, Shigella flexneri 2a str. 301
ugcaucgcgcaaag

SEQ ID NO: 3914600 - RNA, 17 nt, Shigella flexneri 2a str. 301
ugcaucgcgcugaacau

SEQ ID NO: 3914601 - RNA, 11 nt, Shigella flexneri 2a str. 301
ugcaucggcaa

SEQ ID NO: 3914602 - RNA, 14 nt, Shigella flexneri 2a str. 301
ugcaucggcauaau

SEQ ID NO: 3914603 - RNA, 23 nt, Shigella flexneri 2a str. 301
ugcaucggggaauugugcuuuca

SEQ ID NO: 3914604 - RNA, 15 nt, Shigella flexneri 2a str. 301
ugcaucggugcgcug

SEQ ID NO: 3914605 - RNA, 13 nt, Shigella flexneri 2a str. 301
ugcaucuguuuuc

SEQ ID NO: 3914606 - RNA, 14 nt, Shigella flexneri 2a str. 301
ugcaugauccggca

SEQ ID NO: 3914607 - RNA, 18 nt, Shigella flexneri 2a str. 301
ugcaugcgaaugcagggc

SEQ ID NO: 3914608 - RNA, 17 nt, Shigella flexneri 2a str. 301
ugcauggcagauaaaca

SEQ ID NO: 3914609 - RNA, 19 nt, Shigella flexneri 2a str. 301
ugcauggucgauucuuaua

SEQ ID NO: 3914610 - RNA, 23 nt, Shigella flexneri 2a str. 301
ugcauuaaauugugaacgagaaa

SEQ ID NO: 3914611 - RNA, 20 nt, Shigella flexneri 2a str. 301
ugcauuccaguccacaucaa

SEQ ID NO: 3914612 - RNA, 18 nt, Shigella flexneri 2a str. 301
ugcauugauggaguaguu

SEQ ID NO: 3914613 - RNA, 17 nt, Shigella flexneri 2a str. 301
ugcauuuccauaaauug

SEQ ID NO: 3914614 - RNA, 20 nt, Shigella flexneri 2a str. 301
ugcauuucgcuaccaccaaa

SEQ ID NO: 3914615 - RNA, 13 nt, Shigella flexneri 2a str. 301
ugcauuugcugca

SEQ ID NO: 3914616 - RNA, 19 nt, Shigella flexneri 2a str. 301
ugcauuuucaaagguacgu

SEQ ID NO: 3914617 - RNA, 13 nt, Shigella flexneri 2a str. 301
ugcauuuucucgc

SEQ ID NO: 3914618 - RNA, 15 nt, Shigella flexneri 2a str. 301
ugccaaaaugcugga

SEQ ID NO: 3914619 - RNA, 18 nt, Shigella flexneri 2a str. 301
ugccaaacgcguccauca

SEQ ID NO: 3914620 - RNA, 15 nt, Shigella flexneri 2a str. 301
ugccaaauauuucuu

SEQ ID NO: 3914621 - RNA, 19 nt, Shigella flexneri 2a str. 301
ugccaaauccggcaaauaa

SEQ ID NO: 3914622 - RNA, 15 nt, Shigella flexneri 2a str. 301
ugccaaccugaacaa

SEQ ID NO: 3914623 - RNA, 23 nt, Shigella flexneri 2a str. 301
ugccaacgcaaacgcccguccau

SEQ ID NO: 3914624 - RNA, 13 nt, Shigella flexneri 2a str. 301
ugccaacuggcau

SEQ ID NO: 3914625 - RNA, 14 nt, Shigella flexneri 2a str. 301
ugccaaucagcaga

SEQ ID NO: 3914626 - RNA, 15 nt, Shigella flexneri 2a str. 301
ugccaaucagcagaa

SEQ ID NO: 3914627 - RNA, 23 nt, Shigella flexneri 2a str. 301
ugccaaucaguucaccacuuugu

SEQ ID NO: 3914628 - RNA, 21 nt, Shigella flexneri 2a str. 301
ugccaaucuucacaucaucau

SEQ ID NO: 3914629 - RNA, 21 nt, Shigella flexneri 2a str. 301
ugccacacaggccauuucccc

SEQ ID NO: 3914630 - RNA, 18 nt, Shigella flexneri 2a str. 301
ugccacacgcccaacuaa

SEQ ID NO: 3914631 - RNA, 19 nt, Shigella flexneri 2a str. 301
ugccacacgcucuuccagg

SEQ ID NO: 3914632 - RNA, 21 nt, Shigella flexneri 2a str. 301
ugccacauuagauaaaaauga

SEQ ID NO: 3914633 - RNA, 15 nt, Shigella flexneri 2a str. 301
ugccaccaauaauga

SEQ ID NO: 3914634 - RNA, 13 nt, Shigella flexneri 2a str. 301
ugccaccacaccg

SEQ ID NO: 3914635 - RNA, 18 nt, Shigella flexneri 2a str. 301
ugccaccacaccggacca

SEQ ID NO: 3914636 - RNA, 13 nt, Shigella flexneri 2a str. 301
ugcccaugcgcuc

SEQ ID NO: 3914637 - RNA, 13 nt, Shigella flexneri 2a str. 301
ugcccauggcaag

SEQ ID NO: 3914638 - RNA, 16 nt, Shigella flexneri 2a str. 301
ugcccauggcaagaau

SEQ ID NO: 3914639 - RNA, 16 nt, Shigella flexneri 2a str. 301
ugcccauguaguaccc

SEQ ID NO: 3914640 - RNA, 14 nt, Shigella flexneri 2a str. 301
ugccccagugggcu

SEQ ID NO: 3914641 - RNA, 13 nt, Shigella flexneri 2a str. 301
ugccccaguuccu

SEQ ID NO: 3914642 - RNA, 15 nt, Shigella flexneri 2a str. 301
ugccccugaauaauc

SEQ ID NO: 3914643 - RNA, 13 nt, Shigella flexneri 2a str. 301
ugcccgaagccaa

SEQ ID NO: 3914644 - RNA, 14 nt, Shigella flexneri 2a str. 301
ugcccgaagccaau

SEQ ID NO: 3914645 - RNA, 18 nt, Shigella flexneri 2a str. 301
ugcccgaaugcagcucca

SEQ ID NO: 3914646 - RNA, 16 nt, Shigella flexneri 2a str. 301
ugcccgaccacuucau

SEQ ID NO: 3914647 - RNA, 19 nt, Shigella flexneri 2a str. 301
ugcccgaccagauaagaac

SEQ ID NO: 3914648 - RNA, 19 nt, Shigella flexneri 2a str. 301
ugcccgagcgccauuucuu

SEQ ID NO: 3914649 - RNA, 23 nt, Shigella flexneri 2a str. 301
ugcccgaugaccuugucaugcag

SEQ ID NO: 3914650 - RNA, 19 nt, Shigella flexneri 2a str. 301
ugcccgaugcgcaaacuua

SEQ ID NO: 3914651 - RNA, 13 nt, Shigella flexneri 2a str. 301
ugcccgcaucugc

SEQ ID NO: 3914652 - RNA, 16 nt, Shigella flexneri 2a str. 301
ugcccgccccggcgau

SEQ ID NO: 3914653 - RNA, 17 nt, Shigella flexneri 2a str. 301
ugcccgcccgacaaagc

SEQ ID NO: 3914654 - RNA, 16 nt, Shigella flexneri 2a str. 301
ugcccgccgugcugcc

SEQ ID NO: 3914655 - RNA, 20 nt, Shigella flexneri 2a str. 301
ugcccgcgcugucgggcagc

SEQ ID NO: 3914656 - RNA, 15 nt, Shigella flexneri 2a str. 301
ugcccgcuugagaca

SEQ ID NO: 3914657 - RNA, 16 nt, Shigella flexneri 2a str. 301
ugcccggagcagcagu

SEQ ID NO: 3914658 - RNA, 17 nt, Shigella flexneri 2a str. 301
ugcccggagcagcaguc

SEQ ID NO: 3914659 - RNA, 17 nt, Shigella flexneri 2a str. 301
ugcccggcccggaggau

SEQ ID NO: 3914660 - RNA, 22 nt, Shigella flexneri 2a str. 301
ugcccggcugcgcgacuucauu

SEQ ID NO: 3914661 - RNA, 17 nt, Shigella flexneri 2a str. 301
ugcccgggucagcgcca

SEQ ID NO: 3914662 - RNA, 14 nt, Shigella flexneri 2a str. 301
ugcccggucaggau

SEQ ID NO: 3914663 - RNA, 16 nt, Shigella flexneri 2a str. 301
ugcccgugacucccac

SEQ ID NO: 3914664 - RNA, 14 nt, Shigella flexneri 2a str. 301
ugcccgugaugcaa

SEQ ID NO: 3914665 - RNA, 16 nt, Shigella flexneri 2a str. 301
ugcccguuaaccauaa

SEQ ID NO: 3914666 - RNA, 19 nt, Shigella flexneri 2a str. 301
ugcccguuacuaucuagcg

SEQ ID NO: 3914667 - RNA, 14 nt, Shigella flexneri 2a str. 301
ugcccguuccaggc

SEQ ID NO: 3914668 - RNA, 16 nt, Shigella flexneri 2a str. 301
ugcccguugccaggac

SEQ ID NO: 3914669 - RNA, 21 nt, Shigella flexneri 2a str. 301
ugcccguuggcagaccgccaa

SEQ ID NO: 3914670 - RNA, 14 nt, Shigella flexneri 2a str. 301
ugcccuacaaacug

SEQ ID NO: 3914671 - RNA, 12 nt, Shigella flexneri 2a str. 301
ugcccuaucacg

SEQ ID NO: 3914672 - RNA, 18 nt, Shigella flexneri 2a str. 301
ugcccuaucacgccacca

SEQ ID NO: 3914673 - RNA, 14 nt, Shigella flexneri 2a str. 301
ugcccucugaauaa

SEQ ID NO: 3914674 - RNA, 15 nt, Shigella flexneri 2a str. 301
ugcccugcuaugcaa

SEQ ID NO: 3914675 - RNA, 17 nt, Shigella flexneri 2a str. 301
ugcccugcugaucgcca

SEQ ID NO: 3914676 - RNA, 16 nt, Shigella flexneri 2a str. 301
ugcccuggcgcgaaac

SEQ ID NO: 3914677 - RNA, 21 nt, Shigella flexneri 2a str. 301
ugccgaaaaaagucauuacca

SEQ ID NO: 3914678 - RNA, 14 nt, Shigella flexneri 2a str. 301
ugccgaaaugucuu

SEQ ID NO: 3914679 - RNA, 14 nt, Shigella flexneri 2a str. 301
ugccgaaccacuga

SEQ ID NO: 3914680 - RNA, 14 nt, Shigella flexneri 2a str. 301
ugccgaacguacgc

SEQ ID NO: 3914681 - RNA, 16 nt, Shigella flexneri 2a str. 301
ugccgaagaacauaaa

SEQ ID NO: 3914682 - RNA, 17 nt, Shigella flexneri 2a str. 301
ugccgaagcagucaaca

SEQ ID NO: 3914683 - RNA, 22 nt, Shigella flexneri 2a str. 301
ugccgaagccuguaaagucauc

SEQ ID NO: 3914684 - RNA, 15 nt, Shigella flexneri 2a str. 301
ugccgacaucgccac

SEQ ID NO: 3914685 - RNA, 14 nt, Shigella flexneri 2a str. 301
ugccgauaaauaca

SEQ ID NO: 3914686 - RNA, 17 nt, Shigella flexneri 2a str. 301
ugccgauacgcuggaug

SEQ ID NO: 3914687 - RNA, 18 nt, Shigella flexneri 2a str. 301
ugccgaucaccacggaaa

SEQ ID NO: 3914688 - RNA, 23 nt, Shigella flexneri 2a str. 301
ugccgaugaacggcggcggcgcg

SEQ ID NO: 3914689 - RNA, 20 nt, Shigella flexneri 2a str. 301
ugccgaugauuuacaucuuc

SEQ ID NO: 3914690 - RNA, 16 nt, Shigella flexneri 2a str. 301
ugccgauggcaaaagu

SEQ ID NO: 3914691 - RNA, 17 nt, Shigella flexneri 2a str. 301
ugccgauuacguaauuc

SEQ ID NO: 3914692 - RNA, 14 nt, Shigella flexneri 2a str. 301
ugccgcaaaaccca

SEQ ID NO: 3914693 - RNA, 21 nt, Shigella flexneri 2a str. 301
ugccgcaaaacccaggcuuaa

SEQ ID NO: 3914694 - RNA, 13 nt, Shigella flexneri 2a str. 301
ugccgcaauggcc

SEQ ID NO: 3914695 - RNA, 15 nt, Shigella flexneri 2a str. 301
ugccgcaauggccgu

SEQ ID NO: 3914696 - RNA, 20 nt, Shigella flexneri 2a str. 301
ugccgcaauugucuguuugc

SEQ ID NO: 3914697 - RNA, 13 nt, Shigella flexneri 2a str. 301
ugccgcacuuaau

SEQ ID NO: 3914698 - RNA, 13 nt, Shigella flexneri 2a str. 301
ugccgcagaagau

SEQ ID NO: 3914699 - RNA, 15 nt, Shigella flexneri 2a str. 301
ugccgcauccggcau

SEQ ID NO: 3914700 - RNA, 20 nt, Shigella flexneri 2a str. 301
ugccgcauuucgugcgggua

SEQ ID NO: 3914701 - RNA, 21 nt, Shigella flexneri 2a str. 301
ugccgccaaaucggaacaaca

SEQ ID NO: 3914702 - RNA, 12 nt, Shigella flexneri 2a str. 301
ugccgccaggcu

SEQ ID NO: 3914703 - RNA, 17 nt, Shigella flexneri 2a str. 301
ugccgcccuaaagggcg

SEQ ID NO: 3914704 - RNA, 20 nt, Shigella flexneri 2a str. 301
ugccgcgccagaucagggaa

SEQ ID NO: 3914705 - RNA, 21 nt, Shigella flexneri 2a str. 301
ugccgcgccagaucagggaag

SEQ ID NO: 3914706 - RNA, 20 nt, Shigella flexneri 2a str. 301
ugccgcgccucuuacgcgaa

SEQ ID NO: 3914707 - RNA, 17 nt, Shigella flexneri 2a str. 301
ugccgcgucuuaucagg

SEQ ID NO: 3914708 - RNA, 18 nt, Shigella flexneri 2a str. 301
ugccgcguuggcaauguc

SEQ ID NO: 3914709 - RNA, 14 nt, Shigella flexneri 2a str. 301
ugccgcuacaucac

SEQ ID NO: 3914710 - RNA, 22 nt, Shigella flexneri 2a str. 301
ugccgcugguguugcugaccaa

SEQ ID NO: 3914711 - RNA, 13 nt, Shigella flexneri 2a str. 301
ugccgcuuccagc

SEQ ID NO: 3914712 - RNA, 19 nt, Shigella flexneri 2a str. 301
ugccgcuuuaugugcuucu

SEQ ID NO: 3914713 - RNA, 14 nt, Shigella flexneri 2a str. 301
ugccggaacgugca

SEQ ID NO: 3914714 - RNA, 18 nt, Shigella flexneri 2a str. 301
ugccggaagacacauugc

SEQ ID NO: 3914715 - RNA, 18 nt, Shigella flexneri 2a str. 301
ugccggagucgcauuaac

SEQ ID NO: 3914716 - RNA, 16 nt, Shigella flexneri 2a str. 301
ugccggauauucagua

SEQ ID NO: 3914717 - RNA, 22 nt, Shigella flexneri 2a str. 301
ugccggaugcaucacauccggc

SEQ ID NO: 3914718 - RNA, 23 nt, Shigella flexneri 2a str. 301
ugccggaugcgaugcugacgcau

SEQ ID NO: 3914719 - RNA, 20 nt, Shigella flexneri 2a str. 301
ugccggaugcgccagcaucc

SEQ ID NO: 3914720 - RNA, 15 nt, Shigella flexneri 2a str. 301
ugccggaugcggcgu

SEQ ID NO: 3914721 - RNA, 20 nt, Shigella flexneri 2a str. 301
ugccggaugcggugcaagca

SEQ ID NO: 3914722 - RNA, 17 nt, Shigella flexneri 2a str. 301
ugccggauggcagaguu

SEQ ID NO: 3914723 - RNA, 17 nt, Shigella flexneri 2a str. 301
ugccggaugugaugcau

SEQ ID NO: 3914724 - RNA, 22 nt, Shigella flexneri 2a str. 301
ugccggauguguugcauccggc

SEQ ID NO: 3914725 - RNA, 21 nt, Shigella flexneri 2a str. 301
ugccggauguuuccauccggc

SEQ ID NO: 3914726 - RNA, 21 nt, Shigella flexneri 2a str. 301
ugccggcaucaaacgguugau

SEQ ID NO: 3914727 - RNA, 16 nt, Shigella flexneri 2a str. 301
ugccggccagcgccac

SEQ ID NO: 3914728 - RNA, 21 nt, Shigella flexneri 2a str. 301
ugccggggagauauuccccag

SEQ ID NO: 3914729 - RNA, 15 nt, Shigella flexneri 2a str. 301
ugccggggcgcggcg

SEQ ID NO: 3914730 - RNA, 21 nt, Shigella flexneri 2a str. 301
ugccggucgcgcgggaaauca

SEQ ID NO: 3914731 - RNA, 18 nt, Shigella flexneri 2a str. 301
ugccgguggaagggcuuu

SEQ ID NO: 3914732 - RNA, 17 nt, Shigella flexneri 2a str. 301
ugccgguggccuugccg

SEQ ID NO: 3914733 - RNA, 13 nt, Shigella flexneri 2a str. 301
ugccgguuauuuu

SEQ ID NO: 3914734 - RNA, 23 nt, Shigella flexneri 2a str. 301
ugccgguucgacggcuggacaaa

SEQ ID NO: 3914735 - RNA, 15 nt, Shigella flexneri 2a str. 301
ugccguaaaucccag

SEQ ID NO: 3914736 - RNA, 12 nt, Shigella flexneri 2a str. 301
ugcggcaaauac

SEQ ID NO: 3914737 - RNA, 13 nt, Shigella flexneri 2a str. 301
ugcggcaccagcg

SEQ ID NO: 3914738 - RNA, 15 nt, Shigella flexneri 2a str. 301
ugcggcaccagcggu

SEQ ID NO: 3914739 - RNA, 13 nt, Shigella flexneri 2a str. 301
ugcggcaggcaca

SEQ ID NO: 3914740 - RNA, 13 nt, Shigella flexneri 2a str. 301
ugcggcagggcaa

SEQ ID NO: 3914741 - RNA, 17 nt, Shigella flexneri 2a str. 301
ugcggcaucuucuccac

SEQ ID NO: 3914742 - RNA, 16 nt, Shigella flexneri 2a str. 301
ugcggcauucccagcc

SEQ ID NO: 3914743 - RNA, 12 nt, Shigella flexneri 2a str. 301
ugcggccagcag

SEQ ID NO: 3914744 - RNA, 19 nt, Shigella flexneri 2a str. 301
ugcggcgaaaacgccacau

SEQ ID NO: 3914745 - RNA, 14 nt, Shigella flexneri 2a str. 301
ugcggcgaggaauc

SEQ ID NO: 3914746 - RNA, 22 nt, Shigella flexneri 2a str. 301
ugcggcgcaagcggcgacugag

SEQ ID NO: 3914747 - RNA, 19 nt, Shigella flexneri 2a str. 301
ugcggcgcaugcauuuuca

SEQ ID NO: 3914748 - RNA, 17 nt, Shigella flexneri 2a str. 301
ugcggcguaaacgccuu

SEQ ID NO: 3914749 - RNA, 16 nt, Shigella flexneri 2a str. 301
ugcggcguaaaugccu

SEQ ID NO: 3914750 - RNA, 17 nt, Shigella flexneri 2a str. 301
ugcggcgugaacgccuu

SEQ ID NO: 3914751 - RNA, 13 nt, Shigella flexneri 2a str. 301
ugcggcugcaucu

SEQ ID NO: 3914752 - RNA, 22 nt, Shigella flexneri 2a str. 301
ugcggcugcaucuccggcgcau

SEQ ID NO: 3914753 - RNA, 18 nt, Shigella flexneri 2a str. 301
ugcggcugcugaggcuga

SEQ ID NO: 3914754 - RNA, 20 nt, Shigella flexneri 2a str. 301
ugcggcugguuacucaccag

SEQ ID NO: 3914755 - RNA, 18 nt, Shigella flexneri 2a str. 301
ugcggcuuccagagcagc

SEQ ID NO: 3914756 - RNA, 16 nt, Shigella flexneri 2a str. 301
ugcggcuucgcuucau

SEQ ID NO: 3914757 - RNA, 23 nt, Shigella flexneri 2a str. 301
ugcgggagcgcuuuuuuccugcc

SEQ ID NO: 3914758 - RNA, 13 nt, Shigella flexneri 2a str. 301
ugcgggccaaaga

SEQ ID NO: 3914759 - RNA, 15 nt, Shigella flexneri 2a str. 301
ugcgggcgaaaacau

SEQ ID NO: 3914760 - RNA, 16 nt, Shigella flexneri 2a str. 301
ugcgggucaggccagg

SEQ ID NO: 3914761 - RNA, 17 nt, Shigella flexneri 2a str. 301
ugcgggucaggccagga

SEQ ID NO: 3914762 - RNA, 16 nt, Shigella flexneri 2a str. 301
ugcggguuagucugca

SEQ ID NO: 3914763 - RNA, 18 nt, Shigella flexneri 2a str. 301
ugcggguuagucugcauu

SEQ ID NO: 3914764 - RNA, 14 nt, Shigella flexneri 2a str. 301
ugcgguaagcugcg

SEQ ID NO: 3914765 - RNA, 22 nt, Shigella flexneri 2a str. 301
ugcgguaguuucuccccaugga

SEQ ID NO: 3914766 - RNA, 17 nt, Shigella flexneri 2a str. 301
ugcggucaaaagcugca

SEQ ID NO: 3914767 - RNA, 23 nt, Shigella flexneri 2a str. 301
ugcggucguaaucgcccgcuucc

SEQ ID NO: 3914768 - RNA, 21 nt, Shigella flexneri 2a str. 301
ugcggucuaaaucuuccgccg

SEQ ID NO: 3914769 - RNA, 16 nt, Shigella flexneri 2a str. 301
ugcguaaucgccgaac

SEQ ID NO: 3914770 - RNA, 18 nt, Shigella flexneri 2a str. 301
ugcguaaucuuuucauau

SEQ ID NO: 3914771 - RNA, 21 nt, Shigella flexneri 2a str. 301
ugcguaaucuuuucauauuau

SEQ ID NO: 3914772 - RNA, 14 nt, Shigella flexneri 2a str. 301
ugcguaauguuuag

SEQ ID NO: 3914773 - RNA, 18 nt, Shigella flexneri 2a str. 301
ugcguacaccaacaucac

SEQ ID NO: 3914774 - RNA, 15 nt, Shigella flexneri 2a str. 301
ugcguacuucuuacc

SEQ ID NO: 3914775 - RNA, 20 nt, Shigella flexneri 2a str. 301
ugcguagucugaccucuucu

SEQ ID NO: 3914776 - RNA, 22 nt, Shigella flexneri 2a str. 301
ugcguaucgacggcguauugca

SEQ ID NO: 3914777 - RNA, 22 nt, Shigella flexneri 2a str. 301
ugcguauggcgacaaggcguug

SEQ ID NO: 3914778 - RNA, 23 nt, Shigella flexneri 2a str. 301
ugcgucaagcgguaaccauccau

SEQ ID NO: 3914779 - RNA, 19 nt, Shigella flexneri 2a str. 301
ugcgucaccacauccagcu

SEQ ID NO: 3914780 - RNA, 22 nt, Shigella flexneri 2a str. 301
ugcgucagcaucgcauccggca

SEQ ID NO: 3914781 - RNA, 13 nt, Shigella flexneri 2a str. 301
ugcgucagcuuca

SEQ ID NO: 3914782 - RNA, 14 nt, Shigella flexneri 2a str. 301
ugcgucaguauugg

SEQ ID NO: 3914783 - RNA, 16 nt, Shigella flexneri 2a str. 301
ugcgucauccagcacu

SEQ ID NO: 3914784 - RNA, 15 nt, Shigella flexneri 2a str. 301
ugcgucauuccggag

SEQ ID NO: 3914785 - RNA, 20 nt, Shigella flexneri 2a str. 301
ugcgucgacauagccauccc

SEQ ID NO: 3914786 - RNA, 18 nt, Shigella flexneri 2a str. 301
ugcgucguuucagccaga

SEQ ID NO: 3914787 - RNA, 17 nt, Shigella flexneri 2a str. 301
ugcgucucgacaaacuc

SEQ ID NO: 3914788 - RNA, 19 nt, Shigella flexneri 2a str. 301
ugcgucucugguuuuacaa

SEQ ID NO: 3914789 - RNA, 19 nt, Shigella flexneri 2a str. 301
ugcgucucuuguugcaaca

SEQ ID NO: 3914790 - RNA, 20 nt, Shigella flexneri 2a str. 301
ugcgucucuuguugcaacaa

SEQ ID NO: 3914791 - RNA, 15 nt, Shigella flexneri 2a str. 301
ugcgucuuccgugcc

SEQ ID NO: 3914792 - RNA, 13 nt, Shigella flexneri 2a str. 301
ugcgugaccgcca

SEQ ID NO: 3914793 - RNA, 16 nt, Shigella flexneri 2a str. 301
ugcgugacuaaaaccc

SEQ ID NO: 3914794 - RNA, 16 nt, Shigella flexneri 2a str. 301
ugcgugagguaacaau

SEQ ID NO: 3914795 - RNA, 19 nt, Shigella flexneri 2a str. 301
ugcguggcaucaaacacug

SEQ ID NO: 3914796 - RNA, 14 nt, Shigella flexneri 2a str. 301
ugcguuaaucgccg

SEQ ID NO: 3914797 - RNA, 19 nt, Shigella flexneri 2a str. 301
ugcguuacccacaguuuca

SEQ ID NO: 3914798 - RNA, 14 nt, Shigella flexneri 2a str. 301
ugcguucaauaccg

SEQ ID NO: 3914799 - RNA, 14 nt, Shigella flexneri 2a str. 301
ugcguucaucaguu

SEQ ID NO: 3914800 - RNA, 23 nt, Shigella flexneri 2a str. 301
ugcguucgcgaccggcgauggca

SEQ ID NO: 3914801 - RNA, 15 nt, Shigella flexneri 2a str. 301
ugcguugcgcuucuc

SEQ ID NO: 3914802 - RNA, 15 nt, Shigella flexneri 2a str. 301
ugcguuucagccacg

SEQ ID NO: 3914803 - RNA, 19 nt, Shigella flexneri 2a str. 301
ugcguuucauguaacgaug

SEQ ID NO: 3914804 - RNA, 15 nt, Shigella flexneri 2a str. 301
ugcguuucugcuucu

SEQ ID NO: 3914805 - RNA, 22 nt, Shigella flexneri 2a str. 301
ugcguuuuaccaguuucagaau

SEQ ID NO: 3914806 - RNA, 13 nt, Shigella flexneri 2a str. 301
ugcguuuuccggc

SEQ ID NO: 3914807 - RNA, 18 nt, Shigella flexneri 2a str. 301
ugcguuuuuaucuucaca

SEQ ID NO: 3914808 - RNA, 20 nt, Shigella flexneri 2a str. 301
ugcuaaaccagcccugguuu

SEQ ID NO: 3914809 - RNA, 21 nt, Shigella flexneri 2a str. 301
ugcuacaggguaaaaagaggu

SEQ ID NO: 3914810 - RNA, 14 nt, Shigella flexneri 2a str. 301
ugcuacccacuucc

SEQ ID NO: 3914811 - RNA, 23 nt, Shigella flexneri 2a str. 301
ugcuaccgcuucgcucacaucau

SEQ ID NO: 3914812 - RNA, 19 nt, Shigella flexneri 2a str. 301
ugcuacggcaauucccaga

SEQ ID NO: 3914813 - RNA, 20 nt, Shigella flexneri 2a str. 301
ugcuacuaugauuuuccuga

SEQ ID NO: 3914814 - RNA, 12 nt, Shigella flexneri 2a str. 301
ugcuaucacaau

SEQ ID NO: 3914815 - RNA, 22 nt, Shigella flexneri 2a str. 301
ugcuauccaguacauugagaau

SEQ ID NO: 3914816 - RNA, 23 nt, Shigella flexneri 2a str. 301
ugcuaucuccuguugugaugcaa

SEQ ID NO: 3914817 - RNA, 16 nt, Shigella flexneri 2a str. 301
ugcuaugcugaaugau

SEQ ID NO: 3914818 - RNA, 15 nt, Shigella flexneri 2a str. 301
ugcuauucaccagca

SEQ ID NO: 3914819 - RNA, 15 nt, Shigella flexneri 2a str. 301
ugcuauuccuugaaa

SEQ ID NO: 3914820 - RNA, 15 nt, Shigella flexneri 2a str. 301
ugcuauugcggauga

SEQ ID NO: 3914821 - RNA, 18 nt, Shigella flexneri 2a str. 301
ugcuauuuaccacuacug

SEQ ID NO: 3914822 - RNA, 15 nt, Shigella flexneri 2a str. 301
ugcucaacccuuucc

SEQ ID NO: 3914823 - RNA, 19 nt, Shigella flexneri 2a str. 301
ugcucaacccuuuccagcg

SEQ ID NO: 3914824 - RNA, 17 nt, Shigella flexneri 2a str. 301
ugcucaaucaucacgau

SEQ ID NO: 3914825 - RNA, 16 nt, Shigella flexneri 2a str. 301
ugcucaaugagcaccu

SEQ ID NO: 3914826 - RNA, 18 nt, Shigella flexneri 2a str. 301
ugcucaauugacaguuua

SEQ ID NO: 3914827 - RNA, 20 nt, Shigella flexneri 2a str. 301
ugcucaauugacaguuuauu

SEQ ID NO: 3914828 - RNA, 23 nt, Shigella flexneri 2a str. 301
ugcucaauugacaguuuauuuuc

SEQ ID NO: 3914829 - RNA, 20 nt, Shigella flexneri 2a str. 301
ugcucacaaccccggcaaau

SEQ ID NO: 3914830 - RNA, 22 nt, Shigella flexneri 2a str. 301
ugcucacagaguauuuccagcu

SEQ ID NO: 3914831 - RNA, 14 nt, Shigella flexneri 2a str. 301
ugcucacuacggcu

SEQ ID NO: 3914832 - RNA, 18 nt, Shigella flexneri 2a str. 301
ugcucagaaucacgccaa

SEQ ID NO: 3914833 - RNA, 21 nt, Shigella flexneri 2a str. 301
ugcucagaaucacgccaacaa

SEQ ID NO: 3914834 - RNA, 15 nt, Shigella flexneri 2a str. 301
ugcucauaaaaugau

SEQ ID NO: 3914835 - RNA, 14 nt, Shigella flexneri 2a str. 301
ugcucauaaacgcg

SEQ ID NO: 3914836 - RNA, 21 nt, Shigella flexneri 2a str. 301
ugcuucacgcggguugccacc

SEQ ID NO: 3914837 - RNA, 22 nt, Shigella flexneri 2a str. 301
ugcuucagccgcacuuuuuaaa

SEQ ID NO: 3914838 - RNA, 19 nt, Shigella flexneri 2a str. 301
ugcuucauuaccuuuuuuc

SEQ ID NO: 3914839 - RNA, 22 nt, Shigella flexneri 2a str. 301
ugcuucauuaccuuuuuucccu

SEQ ID NO: 3914840 - RNA, 15 nt, Shigella flexneri 2a str. 301
ugcuuccgccagcgg

SEQ ID NO: 3914841 - RNA, 15 nt, Shigella flexneri 2a str. 301
ugcuuccggcaagca

SEQ ID NO: 3914842 - RNA, 22 nt, Shigella flexneri 2a str. 301
ugcuuccugaguaauaacuucc

SEQ ID NO: 3914843 - RNA, 16 nt, Shigella flexneri 2a str. 301
ugcuucggucagcacg

SEQ ID NO: 3914844 - RNA, 19 nt, Shigella flexneri 2a str. 301
ugcuucguuaacgugucau

SEQ ID NO: 3914845 - RNA, 22 nt, Shigella flexneri 2a str. 301
ugcuucucuucagccaacgcau

SEQ ID NO: 3914846 - RNA, 18 nt, Shigella flexneri 2a str. 301
ugcuucugacuauauaaa

SEQ ID NO: 3914847 - RNA, 13 nt, Shigella flexneri 2a str. 301
ugcuucugccugg

SEQ ID NO: 3914848 - RNA, 13 nt, Shigella flexneri 2a str. 301
ugcuucugcuuca

SEQ ID NO: 3914849 - RNA, 23 nt, Shigella flexneri 2a str. 301
ugcuugcacaaccggaaccagcg

SEQ ID NO: 3914850 - RNA, 15 nt, Shigella flexneri 2a str. 301
ugcuugccccuuccc

SEQ ID NO: 3914851 - RNA, 20 nt, Shigella flexneri 2a str. 301
ugcuugccggaagcaaaaua

SEQ ID NO: 3914852 - RNA, 18 nt, Shigella flexneri 2a str. 301
ugcuugcgauauucuuca

SEQ ID NO: 3914853 - RNA, 19 nt, Shigella flexneri 2a str. 301
ugcuugucccaaccuuguu

SEQ ID NO: 3914854 - RNA, 14 nt, Shigella flexneri 2a str. 301
ugcuuuaaaugcug

SEQ ID NO: 3914855 - RNA, 15 nt, Shigella flexneri 2a str. 301
ugcuuuaaguucagc

SEQ ID NO: 3914856 - RNA, 19 nt, Shigella flexneri 2a str. 301
ugcuuuacgcuuaucccag

SEQ ID NO: 3914857 - RNA, 19 nt, Shigella flexneri 2a str. 301
ugcuuuccaacuguaccag

SEQ ID NO: 3914858 - RNA, 15 nt, Shigella flexneri 2a str. 301
ugcuuuggcugccgc

SEQ ID NO: 3914859 - RNA, 19 nt, Shigella flexneri 2a str. 301
ugcuuugguggucaccaug

SEQ ID NO: 3914860 - RNA, 20 nt, Shigella flexneri 2a str. 301
ugcuuuuaccauacuggauu

SEQ ID NO: 3914861 - RNA, 18 nt, Shigella flexneri 2a str. 301
ugcuuuucccuccacucc

SEQ ID NO: 3914862 - RNA, 13 nt, Shigella flexneri 2a str. 301
ugcuuuugcuucu

SEQ ID NO: 3914863 - RNA, 16 nt, Shigella flexneri 2a str. 301
ugcuuuugucaucaga

SEQ ID NO: 3914864 - RNA, 20 nt, Shigella flexneri 2a str. 301
ugcuuuuuacuagccugcuc

SEQ ID NO: 3914865 - RNA, 14 nt, Shigella flexneri 2a str. 301
ugcuuuuuccugcg

SEQ ID NO: 3914866 - RNA, 14 nt, Shigella flexneri 2a str. 301
ugcuuuuuuccaua

SEQ ID NO: 3914867 - RNA, 14 nt, Shigella flexneri 2a str. 301
uggaaacagugauu

SEQ ID NO: 3914868 - RNA, 17 nt, Shigella flexneri 2a str. 301
uggaaacgcgaucgcca

SEQ ID NO: 3914869 - RNA, 23 nt, Shigella flexneri 2a str. 301
uggaacagccggaugucuggaac

SEQ ID NO: 3914870 - RNA, 22 nt, Shigella flexneri 2a str. 301
uggaacgcguacagaaaacuca

SEQ ID NO: 3914871 - RNA, 18 nt, Shigella flexneri 2a str. 301
uggaacggcagauccaaa

SEQ ID NO: 3914872 - RNA, 21 nt, Shigella flexneri 2a str. 301
uggaacuggcuguagaagcug

SEQ ID NO: 3914873 - RNA, 18 nt, Shigella flexneri 2a str. 301
uggaagaaaccagcgugu

SEQ ID NO: 3914874 - RNA, 15 nt, Shigella flexneri 2a str. 301
uggaagaaacgcuua

SEQ ID NO: 3914875 - RNA, 20 nt, Shigella flexneri 2a str. 301
uggaagaccugacuguucca

SEQ ID NO: 3914876 - RNA, 21 nt, Shigella flexneri 2a str. 301
uggaagagcgacaaucccugc

SEQ ID NO: 3914877 - RNA, 18 nt, Shigella flexneri 2a str. 301
uggaagcagaucuggaag

SEQ ID NO: 3914878 - RNA, 20 nt, Shigella flexneri 2a str. 301
uggaagcauaauaagcuuuu

SEQ ID NO: 3914879 - RNA, 19 nt, Shigella flexneri 2a str. 301
uggaagguaaggauaaaaa

SEQ ID NO: 3914880 - RNA, 22 nt, Shigella flexneri 2a str. 301
uggaagguaaggauaaaaaagg

SEQ ID NO: 3914881 - RNA, 15 nt, Shigella flexneri 2a str. 301
uggaaguuacucaaa

SEQ ID NO: 3914882 - RNA, 21 nt, Shigella flexneri 2a str. 301
uggaauaagccaaauccagcg

SEQ ID NO: 3914883 - RNA, 23 nt, Shigella flexneri 2a str. 301
uggaauaauuccgggcguugauu

SEQ ID NO: 3914884 - RNA, 22 nt, Shigella flexneri 2a str. 301
uggaauauccgucacuucagga

SEQ ID NO: 3914885 - RNA, 14 nt, Shigella flexneri 2a str. 301
uggaaucaauaauu

SEQ ID NO: 3914886 - RNA, 22 nt, Shigella flexneri 2a str. 301
uggaaucaauaauuaaucuggu

SEQ ID NO: 3914887 - RNA, 11 nt, Shigella flexneri 2a str. 301
uggaaucaccg

SEQ ID NO: 3914888 - RNA, 16 nt, Shigella flexneri 2a str. 301
uggaaucacucaucau

SEQ ID NO: 3914889 - RNA, 19 nt, Shigella flexneri 2a str. 301
uggaaucacucaucaugca

SEQ ID NO: 3914890 - RNA, 15 nt, Shigella flexneri 2a str. 301
uggaauggaaacagc

SEQ ID NO: 3914891 - RNA, 19 nt, Shigella flexneri 2a str. 301
uggaauuacugauugcuca

SEQ ID NO: 3914892 - RNA, 17 nt, Shigella flexneri 2a str. 301
uggaauuccuuucccua

SEQ ID NO: 3914893 - RNA, 21 nt, Shigella flexneri 2a str. 301
uggaauuuguccaccaauagc

SEQ ID NO: 3914894 - RNA, 12 nt, Shigella flexneri 2a str. 301
uggacaccagcu

SEQ ID NO: 3914895 - RNA, 21 nt, Shigella flexneri 2a str. 301
uggacaggcucuugaucuggu

SEQ ID NO: 3914896 - RNA, 17 nt, Shigella flexneri 2a str. 301
uggacauagcucugcca

SEQ ID NO: 3914897 - RNA, 13 nt, Shigella flexneri 2a str. 301
uggacaucaugcu

SEQ ID NO: 3914898 - RNA, 13 nt, Shigella flexneri 2a str. 301
uggacauucuccg

SEQ ID NO: 3914899 - RNA, 13 nt, Shigella flexneri 2a str. 301
uggacgaacaguu

SEQ ID NO: 3914900 - RNA, 20 nt, Shigella flexneri 2a str. 301
uggacgacagcaacaucguu

SEQ ID NO: 3914901 - RNA, 16 nt, Shigella flexneri 2a str. 301
uggacgauaagcaccg

SEQ ID NO: 3914902 - RNA, 14 nt, Shigella flexneri 2a str. 301
uggacgcagcucau

SEQ ID NO: 3914903 - RNA, 12 nt, Shigella flexneri 2a str. 301
uggacguuacca

SEQ ID NO: 3914904 - RNA, 18 nt, Shigella flexneri 2a str. 301
uggacucccagaacaacc

SEQ ID NO: 3914905 - RNA, 16 nt, Shigella flexneri 2a str. 301
uggacuugaaccagcg

SEQ ID NO: 3914906 - RNA, 18 nt, Shigella flexneri 2a str. 301
uggacuuuaugaaccuga

SEQ ID NO: 3914907 - RNA, 16 nt, Shigella flexneri 2a str. 301
uggagaacgccugugu

SEQ ID NO: 3914908 - RNA, 15 nt, Shigella flexneri 2a str. 301
uggagacugaugaca

SEQ ID NO: 3914909 - RNA, 17 nt, Shigella flexneri 2a str. 301
uggagagagcccuggau

SEQ ID NO: 3914910 - RNA, 16 nt, Shigella flexneri 2a str. 301
uggagagcagcaucaa

SEQ ID NO: 3914911 - RNA, 17 nt, Shigella flexneri 2a str. 301
uggagagugacaguuca

SEQ ID NO: 3914912 - RNA, 20 nt, Shigella flexneri 2a str. 301
uggagaguugcaccagcaac

SEQ ID NO: 3914913 - RNA, 22 nt, Shigella flexneri 2a str. 301
uggagauauuuuuauggcaggu

SEQ ID NO: 3914914 - RNA, 20 nt, Shigella flexneri 2a str. 301
uggagcacauugccugaugc

SEQ ID NO: 3914915 - RNA, 13 nt, Shigella flexneri 2a str. 301
uggagcaggaaua

SEQ ID NO: 3914916 - RNA, 19 nt, Shigella flexneri 2a str. 301
uggagcuaaacagcgcugc

SEQ ID NO: 3914917 - RNA, 18 nt, Shigella flexneri 2a str. 301
uggagggaaauuaaaugg

SEQ ID NO: 3914918 - RNA, 13 nt, Shigella flexneri 2a str. 301
uggaguaauaauu

SEQ ID NO: 3914919 - RNA, 15 nt, Shigella flexneri 2a str. 301
uggagugagaaugca

SEQ ID NO: 3914920 - RNA, 12 nt, Shigella flexneri 2a str. 301
uggagugcagca

SEQ ID NO: 3914921 - RNA, 16 nt, Shigella flexneri 2a str. 301
uggagugcagcaugca

SEQ ID NO: 3914922 - RNA, 14 nt, Shigella flexneri 2a str. 301
uggaguggcccagg

SEQ ID NO: 3914923 - RNA, 21 nt, Shigella flexneri 2a str. 301
uggaguuaaauuaauaaucac

SEQ ID NO: 3914924 - RNA, 21 nt, Shigella flexneri 2a str. 301
uggauaacguuuaucccaguc

SEQ ID NO: 3914925 - RNA, 21 nt, Shigella flexneri 2a str. 301
uggauaagaugcuacaacauc

SEQ ID NO: 3914926 - RNA, 13 nt, Shigella flexneri 2a str. 301
uggauaaucauac

SEQ ID NO: 3914927 - RNA, 22 nt, Shigella flexneri 2a str. 301
uggauaaugaagucugccguug

SEQ ID NO: 3914928 - RNA, 13 nt, Shigella flexneri 2a str. 301
uggauaggcaccg

SEQ ID NO: 3914929 - RNA, 14 nt, Shigella flexneri 2a str. 301
uggauauuuuaauc

SEQ ID NO: 3914930 - RNA, 15 nt, Shigella flexneri 2a str. 301
uggaucaagccccag

SEQ ID NO: 3914931 - RNA, 21 nt, Shigella flexneri 2a str. 301
uggaucaagccccagcaggau

SEQ ID NO: 3914932 - RNA, 23 nt, Shigella flexneri 2a str. 301
uggaucaaggauugcagcacuga

SEQ ID NO: 3914933 - RNA, 18 nt, Shigella flexneri 2a str. 301
uggaucccagaagaauau

SEQ ID NO: 3914934 - RNA, 18 nt, Shigella flexneri 2a str. 301
uggaucgagauugucggc

SEQ ID NO: 3914935 - RNA, 22 nt, Shigella flexneri 2a str. 301
uggaugaacuucgcagccguga

SEQ ID NO: 3914936 - RNA, 14 nt, Shigella flexneri 2a str. 301
uggcgcuuauagcg

SEQ ID NO: 3914937 - RNA, 24 nt, Shigella flexneri 2a str. 301
uggcgcuuauagcgaccauacagc

SEQ ID NO: 3914938 - RNA, 14 nt, Shigella flexneri 2a str. 301
uggcggaaacgggu

SEQ ID NO: 3914939 - RNA, 17 nt, Shigella flexneri 2a str. 301
uggcggaaaucuuucau

SEQ ID NO: 3914940 - RNA, 22 nt, Shigella flexneri 2a str. 301
uggcggacgggugaguaauguc

SEQ ID NO: 3914941 - RNA, 16 nt, Shigella flexneri 2a str. 301
uggcggagcucccagg

SEQ ID NO: 3914942 - RNA, 21 nt, Shigella flexneri 2a str. 301
uggcggggagggaauccagca

SEQ ID NO: 3914943 - RNA, 22 nt, Shigella flexneri 2a str. 301
uggcggggagggaauccagcaa

SEQ ID NO: 3914944 - RNA, 16 nt, Shigella flexneri 2a str. 301
uggcgguaacauccag

SEQ ID NO: 3914945 - RNA, 15 nt, Shigella flexneri 2a str. 301
uggcguacccaucaa

SEQ ID NO: 3914946 - RNA, 23 nt, Shigella flexneri 2a str. 301
uggcgucagaccggcaaccagca

SEQ ID NO: 3914947 - RNA, 20 nt, Shigella flexneri 2a str. 301
uggcgucaggguguuacgcu

SEQ ID NO: 3914948 - RNA, 20 nt, Shigella flexneri 2a str. 301
uggcguccgugccuuuacca

SEQ ID NO: 3914949 - RNA, 18 nt, Shigella flexneri 2a str. 301
uggcgucggauauaaaaa

SEQ ID NO: 3914950 - RNA, 14 nt, Shigella flexneri 2a str. 301
uggcgucuccugcc

SEQ ID NO: 3914951 - RNA, 18 nt, Shigella flexneri 2a str. 301
uggcgugaacgccuuauc

SEQ ID NO: 3914952 - RNA, 16 nt, Shigella flexneri 2a str. 301
uggcgugagaucgcgc

SEQ ID NO: 3914953 - RNA, 17 nt, Shigella flexneri 2a str. 301
uggcguggcgcuccacu

SEQ ID NO: 3914954 - RNA, 22 nt, Shigella flexneri 2a str. 301
uggcguuaaucugcguuacuca

SEQ ID NO: 3914955 - RNA, 20 nt, Shigella flexneri 2a str. 301
uggcuacccugguuuccgcu

SEQ ID NO: 3914956 - RNA, 18 nt, Shigella flexneri 2a str. 301
uggcuauaaucacucaaa

SEQ ID NO: 3914957 - RNA, 23 nt, Shigella flexneri 2a str. 301
uggcuauaaucacucaaaauauc

SEQ ID NO: 3914958 - RNA, 15 nt, Shigella flexneri 2a str. 301
uggcuauguaggcuu

SEQ ID NO: 3914959 - RNA, 23 nt, Shigella flexneri 2a str. 301
uggcuauuuaccaauauaauucc

SEQ ID NO: 3914960 - RNA, 16 nt, Shigella flexneri 2a str. 301
uggcucaacaacugcg

SEQ ID NO: 3914961 - RNA, 11 nt, Shigella flexneri 2a str. 301
uggcucaagca

SEQ ID NO: 3914962 - RNA, 17 nt, Shigella flexneri 2a str. 301
uggcucaagcaccaucc

SEQ ID NO: 3914963 - RNA, 21 nt, Shigella flexneri 2a str. 301
uggcucaagcaccauccuguu

SEQ ID NO: 3914964 - RNA, 19 nt, Shigella flexneri 2a str. 301
uggcucaaucgccaccacc

SEQ ID NO: 3914965 - RNA, 13 nt, Shigella flexneri 2a str. 301
uggcucaucgccu

SEQ ID NO: 3914966 - RNA, 20 nt, Shigella flexneri 2a str. 301
uggcucaucgccuuccagcg

SEQ ID NO: 3914967 - RNA, 20 nt, Shigella flexneri 2a str. 301
uggcuccgggugugacaaca

SEQ ID NO: 3914968 - RNA, 15 nt, Shigella flexneri 2a str. 301
uggcucgccauccag

SEQ ID NO: 3914969 - RNA, 19 nt, Shigella flexneri 2a str. 301
uggcucugaauaaagcguu

SEQ ID NO: 3914970 - RNA, 19 nt, Shigella flexneri 2a str. 301
uggcugacauaaacaccag

SEQ ID NO: 3914971 - RNA, 20 nt, Shigella flexneri 2a str. 301
uggcugacauaaacaccagc

SEQ ID NO: 3914972 - RNA, 14 nt, Shigella flexneri 2a str. 301
uggcugacugucgc

SEQ ID NO: 3914973 - RNA, 19 nt, Shigella flexneri 2a str. 301
uggcugacugucgcagcca

SEQ ID NO: 3914974 - RNA, 21 nt, Shigella flexneri 2a str. 301
uggcugacugucgcagccagc

SEQ ID NO: 3914975 - RNA, 22 nt, Shigella flexneri 2a str. 301
uggcugagcaaacaguucugca

SEQ ID NO: 3914976 - RNA, 23 nt, Shigella flexneri 2a str. 301
uggcugagcaaacaguucugcag

SEQ ID NO: 3914977 - RNA, 15 nt, Shigella flexneri 2a str. 301
uggcugauauuaagc

SEQ ID NO: 3914978 - RNA, 16 nt, Shigella flexneri 2a str. 301
uggcugcaaagcauuu

SEQ ID NO: 3914979 - RNA, 16 nt, Shigella flexneri 2a str. 301
uggcugccaugguuug

SEQ ID NO: 3914980 - RNA, 19 nt, Shigella flexneri 2a str. 301
uggcugcgcgaaaacccuc

SEQ ID NO: 3914981 - RNA, 20 nt, Shigella flexneri 2a str. 301
uggcugcgcgaaaacccucg

SEQ ID NO: 3914982 - RNA, 19 nt, Shigella flexneri 2a str. 301
uggcuggccccgucagcaa

SEQ ID NO: 3914983 - RNA, 23 nt, Shigella flexneri 2a str. 301
uggcuguaaaauuauccucuuca

SEQ ID NO: 3914984 - RNA, 14 nt, Shigella flexneri 2a str. 301
uggcuuaaucugcc

SEQ ID NO: 3914985 - RNA, 16 nt, Shigella flexneri 2a str. 301
uggcuuaucuuccugu

SEQ ID NO: 3914986 - RNA, 18 nt, Shigella flexneri 2a str. 301
uggcuuaucuuccuguuc

SEQ ID NO: 3914987 - RNA, 20 nt, Shigella flexneri 2a str. 301
uggcuucuuccccggaugag

SEQ ID NO: 3914988 - RNA, 17 nt, Shigella flexneri 2a str. 301
uggcuugcgucauccag

SEQ ID NO: 3914989 - RNA, 17 nt, Shigella flexneri 2a str. 301
uggcuuugcccuuucug

SEQ ID NO: 3914990 - RNA, 12 nt, Shigella flexneri 2a str. 301
ugggaaaacagg

SEQ ID NO: 3914991 - RNA, 14 nt, Shigella flexneri 2a str. 301
ugggaaaugacauu

SEQ ID NO: 3914992 - RNA, 21 nt, Shigella flexneri 2a str. 301
ugggaacaguacauuguuuuc

SEQ ID NO: 3914993 - RNA, 22 nt, Shigella flexneri 2a str. 301
ugggacaguaucgauauggacu

SEQ ID NO: 3914994 - RNA, 20 nt, Shigella flexneri 2a str. 301
ugggagcgauucggcuacua

SEQ ID NO: 3914995 - RNA, 21 nt, Shigella flexneri 2a str. 301
ugggauaugagcgauuuuuua

SEQ ID NO: 3914996 - RNA, 15 nt, Shigella flexneri 2a str. 301
ugggaucgccagguu

SEQ ID NO: 3914997 - RNA, 21 nt, Shigella flexneri 2a str. 301
ugggauuaaaaaguaagaauu

SEQ ID NO: 3914998 - RNA, 16 nt, Shigella flexneri 2a str. 301
ugggcaauuucuuuug

SEQ ID NO: 3914999 - RNA, 20 nt, Shigella flexneri 2a str. 301
ugggcaggccuggguaaaaa

SEQ ID NO: 3915000 - RNA, 24 nt, Shigella flexneri 2a str. 301
ugggcaucgcgacagugcauaaau

SEQ ID NO: 3915001 - RNA, 17 nt, Shigella flexneri 2a str. 301
ugggcaucggcaaucac

SEQ ID NO: 3915002 - RNA, 21 nt, Shigella flexneri 2a str. 301
ugggcaucggcaaucacauca

SEQ ID NO: 3915003 - RNA, 18 nt, Shigella flexneri 2a str. 301
ugggcaugauacugaugu

SEQ ID NO: 3915004 - RNA, 18 nt, Shigella flexneri 2a str. 301
ugggcauugaaggcagca

SEQ ID NO: 3915005 - RNA, 20 nt, Shigella flexneri 2a str. 301
ugggcgaagagaaagaacga

SEQ ID NO: 3915006 - RNA, 13 nt, Shigella flexneri 2a str. 301
ugggcgaggucca

SEQ ID NO: 3915007 - RNA, 15 nt, Shigella flexneri 2a str. 301
ugggcgauuuccuuc

SEQ ID NO: 3915008 - RNA, 15 nt, Shigella flexneri 2a str. 301
ugggcgcaccugaau

SEQ ID NO: 3915009 - RNA, 17 nt, Shigella flexneri 2a str. 301
ugggcgcaccugaaucg

SEQ ID NO: 3915010 - RNA, 14 nt, Shigella flexneri 2a str. 301
ugggcgcugcugua

SEQ ID NO: 3915011 - RNA, 14 nt, Shigella flexneri 2a str. 301
ugggcguagcuggg

SEQ ID NO: 3915012 - RNA, 15 nt, Shigella flexneri 2a str. 301
ugggcguagcugggu

SEQ ID NO: 3915013 - RNA, 18 nt, Shigella flexneri 2a str. 301
ugggcguuacagcuggag

SEQ ID NO: 3915014 - RNA, 15 nt, Shigella flexneri 2a str. 301
ugggcuaacacccgu

SEQ ID NO: 3915015 - RNA, 16 nt, Shigella flexneri 2a str. 301
ugggcucaucaauacg

SEQ ID NO: 3915016 - RNA, 20 nt, Shigella flexneri 2a str. 301
ugggcugacauuaucagaca

SEQ ID NO: 3915017 - RNA, 15 nt, Shigella flexneri 2a str. 301
ugggcugccccagcc

SEQ ID NO: 3915018 - RNA, 24 nt, Shigella flexneri 2a str. 301
ugggcuguucaccacugaauaaca

SEQ ID NO: 3915019 - RNA, 14 nt, Shigella flexneri 2a str. 301
ugggcuucauccag

SEQ ID NO: 3915020 - RNA, 19 nt, Shigella flexneri 2a str. 301
uggggacaaucaccaugcc

SEQ ID NO: 3915021 - RNA, 22 nt, Shigella flexneri 2a str. 301
uggggauagaaacagucuggag

SEQ ID NO: 3915022 - RNA, 20 nt, Shigella flexneri 2a str. 301
uggggcauauuaucagcaaa

SEQ ID NO: 3915023 - RNA, 17 nt, Shigella flexneri 2a str. 301
uggggcguguuuuguca

SEQ ID NO: 3915024 - RNA, 19 nt, Shigella flexneri 2a str. 301
uggggcuugccagagcagc

SEQ ID NO: 3915025 - RNA, 16 nt, Shigella flexneri 2a str. 301
uggggguaacccaccg

SEQ ID NO: 3915026 - RNA, 19 nt, Shigella flexneri 2a str. 301
ugggguauuuccagggccu

SEQ ID NO: 3915027 - RNA, 13 nt, Shigella flexneri 2a str. 301
uggguaacgcacg

SEQ ID NO: 3915028 - RNA, 12 nt, Shigella flexneri 2a str. 301
uggguaacggca

SEQ ID NO: 3915029 - RNA, 13 nt, Shigella flexneri 2a str. 301
uggguaacggcag

SEQ ID NO: 3915030 - RNA, 15 nt, Shigella flexneri 2a str. 301
uggguaaugcuguga

SEQ ID NO: 3915031 - RNA, 22 nt, Shigella flexneri 2a str. 301
uggguaccgagaaaaucauccg

SEQ ID NO: 3915032 - RNA, 18 nt, Shigella flexneri 2a str. 301
uggguacgaaaagggcug

SEQ ID NO: 3915033 - RNA, 15 nt, Shigella flexneri 2a str. 301
uggguaggaucagaa

SEQ ID NO: 3915034 - RNA, 22 nt, Shigella flexneri 2a str. 301
ugggucugcagauauucaugca

SEQ ID NO: 3915035 - RNA, 16 nt, Shigella flexneri 2a str. 301
uggguguuuaugcccg

SEQ ID NO: 3915036 - RNA, 12 nt, Shigella flexneri 2a str. 301
uggguuuccgga

SEQ ID NO: 3915037 - RNA, 15 nt, Shigella flexneri 2a str. 301
uggguuucugccgcu

SEQ ID NO: 3915038 - RNA, 18 nt, Shigella flexneri 2a str. 301
ugguaacgccccacaaac

SEQ ID NO: 3915039 - RNA, 19 nt, Shigella flexneri 2a str. 301
ugguaacgccccacaaacc

SEQ ID NO: 3915040 - RNA, 18 nt, Shigella flexneri 2a str. 301
ugguaagaggaauugauu

SEQ ID NO: 3915041 - RNA, 15 nt, Shigella flexneri 2a str. 301
ugguacauaacacaa

SEQ ID NO: 3915042 - RNA, 21 nt, Shigella flexneri 2a str. 301
ugguaccguguaaaaugacuc

SEQ ID NO: 3915043 - RNA, 22 nt, Shigella flexneri 2a str. 301
ugguacgucaccacacgccgca

SEQ ID NO: 3915044 - RNA, 15 nt, Shigella flexneri 2a str. 301
ugguacuggugcaaa

SEQ ID NO: 3915045 - RNA, 17 nt, Shigella flexneri 2a str. 301
ugguacuggugcaaaac

SEQ ID NO: 3915046 - RNA, 14 nt, Shigella flexneri 2a str. 301
ugguacuuucacag

SEQ ID NO: 3915047 - RNA, 15 nt, Shigella flexneri 2a str. 301
ugguagcugcccccg

SEQ ID NO: 3915048 - RNA, 23 nt, Shigella flexneri 2a str. 301
ugguagggcugacgcaucauuac

SEQ ID NO: 3915049 - RNA, 22 nt, Shigella flexneri 2a str. 301
ugguauaaaauagcaauauuuu

SEQ ID NO: 3915050 - RNA, 21 nt, Shigella flexneri 2a str. 301
ugguauaaggcgcaauaauca

SEQ ID NO: 3915051 - RNA, 11 nt, Shigella flexneri 2a str. 301
ugguaucgaga

SEQ ID NO: 3915052 - RNA, 16 nt, Shigella flexneri 2a str. 301
ugguauuggaagguua

SEQ ID NO: 3915053 - RNA, 19 nt, Shigella flexneri 2a str. 301
ugguauuggaagguuaaua

SEQ ID NO: 3915054 - RNA, 19 nt, Shigella flexneri 2a str. 301
uggucaaugauuucugcca

SEQ ID NO: 3915055 - RNA, 12 nt, Shigella flexneri 2a str. 301
uggucaccacgg

SEQ ID NO: 3915056 - RNA, 13 nt, Shigella flexneri 2a str. 301
uggucagagcauu

SEQ ID NO: 3915057 - RNA, 12 nt, Shigella flexneri 2a str. 301
uggucagcaucg

SEQ ID NO: 3915058 - RNA, 21 nt, Shigella flexneri 2a str. 301
uggucaguaagccuuucagga

SEQ ID NO: 3915059 - RNA, 17 nt, Shigella flexneri 2a str. 301
uggucaguacgccgccg

SEQ ID NO: 3915060 - RNA, 19 nt, Shigella flexneri 2a str. 301
uggucaguuguggcagaau

SEQ ID NO: 3915061 - RNA, 22 nt, Shigella flexneri 2a str. 301
uggucauaucaauaguaaccag

SEQ ID NO: 3915062 - RNA, 22 nt, Shigella flexneri 2a str. 301
uggucaucacuuuugaaaucaa

SEQ ID NO: 3915063 - RNA, 17 nt, Shigella flexneri 2a str. 301
uggucaucgguuuucag

SEQ ID NO: 3915064 - RNA, 20 nt, Shigella flexneri 2a str. 301
uggucauugccaggcaggau

SEQ ID NO: 3915065 - RNA, 14 nt, Shigella flexneri 2a str. 301
uggucauuuuauug

SEQ ID NO: 3915066 - RNA, 17 nt, Shigella flexneri 2a str. 301
uggucccgacaaccuga

SEQ ID NO: 3915067 - RNA, 19 nt, Shigella flexneri 2a str. 301
ugguccuggcugauugaua

SEQ ID NO: 3915068 - RNA, 23 nt, Shigella flexneri 2a str. 301
ugguccuucaucuucaacugcca

SEQ ID NO: 3915069 - RNA, 14 nt, Shigella flexneri 2a str. 301
uggucgauuccucg

SEQ ID NO: 3915070 - RNA, 17 nt, Shigella flexneri 2a str. 301
uggucgguuaacuccac

SEQ ID NO: 3915071 - RNA, 23 nt, Shigella flexneri 2a str. 301
uggucguaucaccacgaaaacag

SEQ ID NO: 3915072 - RNA, 17 nt, Shigella flexneri 2a str. 301
uggucgugaucaaugug

SEQ ID NO: 3915073 - RNA, 21 nt, Shigella flexneri 2a str. 301
uggucuccacgcuuaacaacc

SEQ ID NO: 3915074 - RNA, 13 nt, Shigella flexneri 2a str. 301
uggucugaaucaa

SEQ ID NO: 3915075 - RNA, 16 nt, Shigella flexneri 2a str. 301
uggucugcaugacggc

SEQ ID NO: 3915076 - RNA, 13 nt, Shigella flexneri 2a str. 301
uggucugccauca

SEQ ID NO: 3915077 - RNA, 17 nt, Shigella flexneri 2a str. 301
uggugaaaaaaaggcga

SEQ ID NO: 3915078 - RNA, 17 nt, Shigella flexneri 2a str. 301
uggugaagccaccagca

SEQ ID NO: 3915079 - RNA, 19 nt, Shigella flexneri 2a str. 301
uggugacaaaguacaacgc

SEQ ID NO: 3915080 - RNA, 14 nt, Shigella flexneri 2a str. 301
uggugaccugcagc

SEQ ID NO: 3915081 - RNA, 20 nt, Shigella flexneri 2a str. 301
uggugacgcgcuuuaacuuc

SEQ ID NO: 3915082 - RNA, 14 nt, Shigella flexneri 2a str. 301
uggugagccugcug

SEQ ID NO: 3915083 - RNA, 23 nt, Shigella flexneri 2a str. 301
uggugauaaaacgcagucuuccc

SEQ ID NO: 3915084 - RNA, 19 nt, Shigella flexneri 2a str. 301
uggugaugagcugaccaga

SEQ ID NO: 3915085 - RNA, 14 nt, Shigella flexneri 2a str. 301
uggugaugcauugu

SEQ ID NO: 3915086 - RNA, 21 nt, Shigella flexneri 2a str. 301
uggugaugcauuguuugcaaa

SEQ ID NO: 3915087 - RNA, 17 nt, Shigella flexneri 2a str. 301
uggugaugccaucgggc

SEQ ID NO: 3915088 - RNA, 18 nt, Shigella flexneri 2a str. 301
uggugaugccaucgggcu

SEQ ID NO: 3915089 - RNA, 19 nt, Shigella flexneri 2a str. 301
uggugaugguauuguccug

SEQ ID NO: 3915090 - RNA, 16 nt, Shigella flexneri 2a str. 301
uggugauuucaggcuu

SEQ ID NO: 3915091 - RNA, 22 nt, Shigella flexneri 2a str. 301
uggugcaaauugcaccauccau

SEQ ID NO: 3915092 - RNA, 17 nt, Shigella flexneri 2a str. 301
uggugcgugcggcaaau

SEQ ID NO: 3915093 - RNA, 15 nt, Shigella flexneri 2a str. 301
ugguggagauaaacu

SEQ ID NO: 3915094 - RNA, 15 nt, Shigella flexneri 2a str. 301
ugguggcccggauuc

SEQ ID NO: 3915095 - RNA, 21 nt, Shigella flexneri 2a str. 301
ugguggccgccacgcgugagc

SEQ ID NO: 3915096 - RNA, 15 nt, Shigella flexneri 2a str. 301
ugguggucaccauga

SEQ ID NO: 3915097 - RNA, 23 nt, Shigella flexneri 2a str. 301
ugguggucuccacgcuuaacaac

SEQ ID NO: 3915098 - RNA, 15 nt, Shigella flexneri 2a str. 301
uggugguguggcugc

SEQ ID NO: 3915099 - RNA, 19 nt, Shigella flexneri 2a str. 301
ugguguagcgauccugacc

SEQ ID NO: 3915100 - RNA, 18 nt, Shigella flexneri 2a str. 301
ugguguagggcaggcgug

SEQ ID NO: 3915101 - RNA, 17 nt, Shigella flexneri 2a str. 301
ugguguggcugcacacc

SEQ ID NO: 3915102 - RNA, 23 nt, Shigella flexneri 2a str. 301
ugguguuauaggccccugccuca

SEQ ID NO: 3915103 - RNA, 14 nt, Shigella flexneri 2a str. 301
ugguguugaagaaa

SEQ ID NO: 3915104 - RNA, 23 nt, Shigella flexneri 2a str. 301
ugguguugcguuuuuaucuucac

SEQ ID NO: 3915105 - RNA, 22 nt, Shigella flexneri 2a str. 301
ugguguuggcaaucagcggcag

SEQ ID NO: 3915106 - RNA, 18 nt, Shigella flexneri 2a str. 301
ugguuaaauaaggcuuua

SEQ ID NO: 3915107 - RNA, 11 nt, Shigella flexneri 2a str. 301
ugguuaacaau

SEQ ID NO: 3915108 - RNA, 15 nt, Shigella flexneri 2a str. 301
ugguuacgcagauau

SEQ ID NO: 3915109 - RNA, 21 nt, Shigella flexneri 2a str. 301
ugguuagagcacaucacucau

SEQ ID NO: 3915110 - RNA, 19 nt, Shigella flexneri 2a str. 301
ugguuagcggcgguaaaau

SEQ ID NO: 3915111 - RNA, 20 nt, Shigella flexneri 2a str. 301
ugguuauccagcaaccaggu

SEQ ID NO: 3915112 - RNA, 17 nt, Shigella flexneri 2a str. 301
ugguuauuucacuucaa

SEQ ID NO: 3915113 - RNA, 22 nt, Shigella flexneri 2a str. 301
ugguuauuucacuucaaccaca

SEQ ID NO: 3915114 - RNA, 14 nt, Shigella flexneri 2a str. 301
ugguucaagagaga

SEQ ID NO: 3915115 - RNA, 22 nt, Shigella flexneri 2a str. 301
ugguucagacgcuacuuuuuuc

SEQ ID NO: 3915116 - RNA, 21 nt, Shigella flexneri 2a str. 301
ugguucagugggcgcugcugu

SEQ ID NO: 3915117 - RNA, 21 nt, Shigella flexneri 2a str. 301
ugguuccgguuuauccauccc

SEQ ID NO: 3915118 - RNA, 14 nt, Shigella flexneri 2a str. 301
ugguuccugacucc

SEQ ID NO: 3915119 - RNA, 15 nt, Shigella flexneri 2a str. 301
ugguucgcaacggcu

SEQ ID NO: 3915120 - RNA, 13 nt, Shigella flexneri 2a str. 301
ugguucuccaaau

SEQ ID NO: 3915121 - RNA, 13 nt, Shigella flexneri 2a str. 301
ugguugcgccugg

SEQ ID NO: 3915122 - RNA, 14 nt, Shigella flexneri 2a str. 301
ugguugcuggaaag

SEQ ID NO: 3915123 - RNA, 13 nt, Shigella flexneri 2a str. 301
ugguuguaaucca

SEQ ID NO: 3915124 - RNA, 14 nt, Shigella flexneri 2a str. 301
ugguuguuccugcg

SEQ ID NO: 3915125 - RNA, 21 nt, Shigella flexneri 2a str. 301
ugguuuaucuccguuaaaggc

SEQ ID NO: 3915126 - RNA, 15 nt, Shigella flexneri 2a str. 301
ugguuuauuucccag

SEQ ID NO: 3915127 - RNA, 14 nt, Shigella flexneri 2a str. 301
ugguuucaaagauu

SEQ ID NO: 3915128 - RNA, 14 nt, Shigella flexneri 2a str. 301
ugguuucaaugcuc

SEQ ID NO: 3915129 - RNA, 20 nt, Shigella flexneri 2a str. 301
ugguuucugguggaaaagaa

SEQ ID NO: 3915130 - RNA, 14 nt, Shigella flexneri 2a str. 301
ugguuugcauccac

SEQ ID NO: 3915131 - RNA, 14 nt, Shigella flexneri 2a str. 301
ugguuuguuccgca

SEQ ID NO: 3915132 - RNA, 22 nt, Shigella flexneri 2a str. 301
ugguuuuaaagaaucgggcaac

SEQ ID NO: 3915133 - RNA, 17 nt, Shigella flexneri 2a str. 301
ugguuuucaauuaucac

SEQ ID NO: 3915134 - RNA, 17 nt, Shigella flexneri 2a str. 301
ugguuuucgccggaacc

SEQ ID NO: 3915135 - RNA, 16 nt, Shigella flexneri 2a str. 301
ugucagguaacaagcc

SEQ ID NO: 3915136 - RNA, 20 nt, Shigella flexneri 2a str. 301
ugucaguauaacuacugaug

SEQ ID NO: 3915137 - RNA, 13 nt, Shigella flexneri 2a str. 301
ugucagugcgcga

SEQ ID NO: 3915138 - RNA, 14 nt, Shigella flexneri 2a str. 301
ugucaguuggcugu

SEQ ID NO: 3915139 - RNA, 20 nt, Shigella flexneri 2a str. 301
ugucauaacuggucaucaaa

SEQ ID NO: 3915140 - RNA, 19 nt, Shigella flexneri 2a str. 301
ugucauaagcaucccuuua

SEQ ID NO: 3915141 - RNA, 22 nt, Shigella flexneri 2a str. 301
ugucauacgagucgccuguacu

SEQ ID NO: 3915142 - RNA, 19 nt, Shigella flexneri 2a str. 301
ugucauacugcccaaucuc

SEQ ID NO: 3915143 - RNA, 21 nt, Shigella flexneri 2a str. 301
ugucauacugcccaaucucac

SEQ ID NO: 3915144 - RNA, 15 nt, Shigella flexneri 2a str. 301
ugucauauuaucuau

SEQ ID NO: 3915145 - RNA, 18 nt, Shigella flexneri 2a str. 301
ugucaucagucuagcccg

SEQ ID NO: 3915146 - RNA, 20 nt, Shigella flexneri 2a str. 301
ugucaucggucagaucggca

SEQ ID NO: 3915147 - RNA, 18 nt, Shigella flexneri 2a str. 301
ugucaugacuacacuaaa

SEQ ID NO: 3915148 - RNA, 13 nt, Shigella flexneri 2a str. 301
ugucaugauuccg

SEQ ID NO: 3915149 - RNA, 14 nt, Shigella flexneri 2a str. 301
ugucaugcagcucc

SEQ ID NO: 3915150 - RNA, 16 nt, Shigella flexneri 2a str. 301
ugucaugcagcuccac

SEQ ID NO: 3915151 - RNA, 18 nt, Shigella flexneri 2a str. 301
ugucaugcgcucucccau

SEQ ID NO: 3915152 - RNA, 22 nt, Shigella flexneri 2a str. 301
ugucauggcagucuuaaucgcu

SEQ ID NO: 3915153 - RNA, 14 nt, Shigella flexneri 2a str. 301
ugucauggcaguuc

SEQ ID NO: 3915154 - RNA, 22 nt, Shigella flexneri 2a str. 301
ugucauguauauuauccaucaa

SEQ ID NO: 3915155 - RNA, 16 nt, Shigella flexneri 2a str. 301
ugucauucaagauugc

SEQ ID NO: 3915156 - RNA, 12 nt, Shigella flexneri 2a str. 301
uguccacuuccg

SEQ ID NO: 3915157 - RNA, 20 nt, Shigella flexneri 2a str. 301
uguccagcuugaucaauaac

SEQ ID NO: 3915158 - RNA, 14 nt, Shigella flexneri 2a str. 301
uguccauccauacg

SEQ ID NO: 3915159 - RNA, 20 nt, Shigella flexneri 2a str. 301
uguccauggugucugaugag

SEQ ID NO: 3915160 - RNA, 16 nt, Shigella flexneri 2a str. 301
uguccauuauuucaau

SEQ ID NO: 3915161 - RNA, 20 nt, Shigella flexneri 2a str. 301
ugucccaaccuuguuucuga

SEQ ID NO: 3915162 - RNA, 13 nt, Shigella flexneri 2a str. 301
ugucccgcuggug

SEQ ID NO: 3915163 - RNA, 18 nt, Shigella flexneri 2a str. 301
uguccgccaauuucauca

SEQ ID NO: 3915164 - RNA, 19 nt, Shigella flexneri 2a str. 301
uguccgccaauuucaucac

SEQ ID NO: 3915165 - RNA, 14 nt, Shigella flexneri 2a str. 301
uguccgcggccuuu

SEQ ID NO: 3915166 - RNA, 18 nt, Shigella flexneri 2a str. 301
uguccggcgcacuggugc

SEQ ID NO: 3915167 - RNA, 18 nt, Shigella flexneri 2a str. 301
uguccucgccguuuucug

SEQ ID NO: 3915168 - RNA, 23 nt, Shigella flexneri 2a str. 301
uguccucgccguuuucuggggcg

SEQ ID NO: 3915169 - RNA, 17 nt, Shigella flexneri 2a str. 301
ugucgaaagccccagcc

SEQ ID NO: 3915170 - RNA, 19 nt, Shigella flexneri 2a str. 301
ugucgacggaauaaaccca

SEQ ID NO: 3915171 - RNA, 21 nt, Shigella flexneri 2a str. 301
ugucgaggccaauuuggcugc

SEQ ID NO: 3915172 - RNA, 23 nt, Shigella flexneri 2a str. 301
ugucgauaaacaguuucgccagg

SEQ ID NO: 3915173 - RNA, 21 nt, Shigella flexneri 2a str. 301
ugucgaucaucaggcccgcau

SEQ ID NO: 3915174 - RNA, 14 nt, Shigella flexneri 2a str. 301
ugucgcagugaagu

SEQ ID NO: 3915175 - RNA, 19 nt, Shigella flexneri 2a str. 301
ugucgccacaaacgccaga

SEQ ID NO: 3915176 - RNA, 13 nt, Shigella flexneri 2a str. 301
ugucgccauccag

SEQ ID NO: 3915177 - RNA, 22 nt, Shigella flexneri 2a str. 301
ugucgcucaaugcgcugagugu

SEQ ID NO: 3915178 - RNA, 18 nt, Shigella flexneri 2a str. 301
ugucgcucaaugugcuga

SEQ ID NO: 3915179 - RNA, 20 nt, Shigella flexneri 2a str. 301
ugucgcucaaugugcugagu

SEQ ID NO: 3915180 - RNA, 15 nt, Shigella flexneri 2a str. 301
ugucgcugaagucuc

SEQ ID NO: 3915181 - RNA, 15 nt, Shigella flexneri 2a str. 301
ugucggaugcggcgu

SEQ ID NO: 3915182 - RNA, 13 nt, Shigella flexneri 2a str. 301
ugucggcacugac

SEQ ID NO: 3915183 - RNA, 20 nt, Shigella flexneri 2a str. 301
ugucggcacugaccaccacc

SEQ ID NO: 3915184 - RNA, 17 nt, Shigella flexneri 2a str. 301
ugucggcccgcauuauu

SEQ ID NO: 3915185 - RNA, 20 nt, Shigella flexneri 2a str. 301
ugucggcccgcauuauucag

SEQ ID NO: 3915186 - RNA, 16 nt, Shigella flexneri 2a str. 301
ugucggcggauaauaa

SEQ ID NO: 3915187 - RNA, 12 nt, Shigella flexneri 2a str. 301
ugucgggcauca

SEQ ID NO: 3915188 - RNA, 21 nt, Shigella flexneri 2a str. 301
ugucgggugcuuuuuucaauu

SEQ ID NO: 3915189 - RNA, 19 nt, Shigella flexneri 2a str. 301
ugucggugguguuaucacc

SEQ ID NO: 3915190 - RNA, 17 nt, Shigella flexneri 2a str. 301
ugucguccggcagcaga

SEQ ID NO: 3915191 - RNA, 16 nt, Shigella flexneri 2a str. 301
ugucgugcgaggaaaa

SEQ ID NO: 3915192 - RNA, 17 nt, Shigella flexneri 2a str. 301
ugucguuaaugcgccaa

SEQ ID NO: 3915193 - RNA, 17 nt, Shigella flexneri 2a str. 301
ugucguuacgccgcaga

SEQ ID NO: 3915194 - RNA, 22 nt, Shigella flexneri 2a str. 301
ugucguucaggcgcugaaagaa

SEQ ID NO: 3915195 - RNA, 18 nt, Shigella flexneri 2a str. 301
ugucguuuccauggacga

SEQ ID NO: 3915196 - RNA, 19 nt, Shigella flexneri 2a str. 301
ugucuaacaugagguccag

SEQ ID NO: 3915197 - RNA, 20 nt, Shigella flexneri 2a str. 301
ugucuacgccuuguuucuuc

SEQ ID NO: 3915198 - RNA, 16 nt, Shigella flexneri 2a str. 301
ugucuauuccgcguga

SEQ ID NO: 3915199 - RNA, 13 nt, Shigella flexneri 2a str. 301
ugucuauuuccac

SEQ ID NO: 3915200 - RNA, 16 nt, Shigella flexneri 2a str. 301
ugucuauuuccaccca

SEQ ID NO: 3915201 - RNA, 14 nt, Shigella flexneri 2a str. 301
ugucucagauucag

SEQ ID NO: 3915202 - RNA, 15 nt, Shigella flexneri 2a str. 301
ugucucagauucaga

SEQ ID NO: 3915203 - RNA, 14 nt, Shigella flexneri 2a str. 301
ugucuccacuauaa

SEQ ID NO: 3915204 - RNA, 18 nt, Shigella flexneri 2a str. 301
ugucuccacuauaaaaaa

SEQ ID NO: 3915205 - RNA, 18 nt, Shigella flexneri 2a str. 301
ugucucccgcccaaucga

SEQ ID NO: 3915206 - RNA, 13 nt, Shigella flexneri 2a str. 301
ugucucucagcac

SEQ ID NO: 3915207 - RNA, 13 nt, Shigella flexneri 2a str. 301
ugucugagccgaa

SEQ ID NO: 3915208 - RNA, 17 nt, Shigella flexneri 2a str. 301
ugucugcuucugccugg

SEQ ID NO: 3915209 - RNA, 19 nt, Shigella flexneri 2a str. 301
ugucuguacggcagugaac

SEQ ID NO: 3915210 - RNA, 14 nt, Shigella flexneri 2a str. 301
ugucuucccugcug

SEQ ID NO: 3915211 - RNA, 23 nt, Shigella flexneri 2a str. 301
ugucuuuaaauugcguaaagccu

SEQ ID NO: 3915212 - RNA, 15 nt, Shigella flexneri 2a str. 301
ugucuuuacccggac

SEQ ID NO: 3915213 - RNA, 16 nt, Shigella flexneri 2a str. 301
ugugaaaucagcacau

SEQ ID NO: 3915214 - RNA, 20 nt, Shigella flexneri 2a str. 301
ugugaacgagaaaaugacga

SEQ ID NO: 3915215 - RNA, 17 nt, Shigella flexneri 2a str. 301
ugugaagugaguugguu

SEQ ID NO: 3915216 - RNA, 16 nt, Shigella flexneri 2a str. 301
ugugaaucgccuggac

SEQ ID NO: 3915217 - RNA, 15 nt, Shigella flexneri 2a str. 301
ugugacaacaacauc

SEQ ID NO: 3915218 - RNA, 17 nt, Shigella flexneri 2a str. 301
ugugacaacaacaucac

SEQ ID NO: 3915219 - RNA, 13 nt, Shigella flexneri 2a str. 301
ugugacagagcca

SEQ ID NO: 3915220 - RNA, 13 nt, Shigella flexneri 2a str. 301
ugugacagcagcg

SEQ ID NO: 3915221 - RNA, 16 nt, Shigella flexneri 2a str. 301
ugugacagcagcggca

SEQ ID NO: 3915222 - RNA, 15 nt, Shigella flexneri 2a str. 301
ugugaccccaucauu

SEQ ID NO: 3915223 - RNA, 16 nt, Shigella flexneri 2a str. 301
ugugacgacaccaucu

SEQ ID NO: 3915224 - RNA, 17 nt, Shigella flexneri 2a str. 301
ugugacgacaccaucuc

SEQ ID NO: 3915225 - RNA, 22 nt, Shigella flexneri 2a str. 301
ugugacguguccguuuguggug

SEQ ID NO: 3915226 - RNA, 19 nt, Shigella flexneri 2a str. 301
ugugacucaaugaaaucca

SEQ ID NO: 3915227 - RNA, 17 nt, Shigella flexneri 2a str. 301
ugugacuuccgacagaa

SEQ ID NO: 3915228 - RNA, 14 nt, Shigella flexneri 2a str. 301
ugugagcauaacgu

SEQ ID NO: 3915229 - RNA, 19 nt, Shigella flexneri 2a str. 301
ugugauaaaaaucggcagg

SEQ ID NO: 3915230 - RNA, 15 nt, Shigella flexneri 2a str. 301
ugugauacuucuucg

SEQ ID NO: 3915231 - RNA, 12 nt, Shigella flexneri 2a str. 301
ugugauggaccg

SEQ ID NO: 3915232 - RNA, 15 nt, Shigella flexneri 2a str. 301
ugugauuuaaaucaa

SEQ ID NO: 3915233 - RNA, 16 nt, Shigella flexneri 2a str. 301
ugugcacgaggcuggc

SEQ ID NO: 3915234 - RNA, 19 nt, Shigella flexneri 2a str. 301
ugugcacgugccagauguu

SEQ ID NO: 3915235 - RNA, 16 nt, Shigella flexneri 2a str. 301
uguugaguuuuuuguc

SEQ ID NO: 3915236 - RNA, 21 nt, Shigella flexneri 2a str. 301
uguugauuucccgcacguugg

SEQ ID NO: 3915237 - RNA, 13 nt, Shigella flexneri 2a str. 301
uguugcaaacuga

SEQ ID NO: 3915238 - RNA, 12 nt, Shigella flexneri 2a str. 301
uguugcaaauaa

SEQ ID NO: 3915239 - RNA, 23 nt, Shigella flexneri 2a str. 301
uguugcaggaaaagguaggccug

SEQ ID NO: 3915240 - RNA, 16 nt, Shigella flexneri 2a str. 301
uguugcaggaacagaa

SEQ ID NO: 3915241 - RNA, 15 nt, Shigella flexneri 2a str. 301
uguugcaucgccugc

SEQ ID NO: 3915242 - RNA, 15 nt, Shigella flexneri 2a str. 301
uguugccauuucugc

SEQ ID NO: 3915243 - RNA, 20 nt, Shigella flexneri 2a str. 301
uguugcccagcgcaucaggc

SEQ ID NO: 3915244 - RNA, 17 nt, Shigella flexneri 2a str. 301
uguugcccaugcuucug

SEQ ID NO: 3915245 - RNA, 19 nt, Shigella flexneri 2a str. 301
uguugccguuuaccgccau

SEQ ID NO: 3915246 - RNA, 12 nt, Shigella flexneri 2a str. 301
uguugcgucucg

SEQ ID NO: 3915247 - RNA, 13 nt, Shigella flexneri 2a str. 301
uguugcugaauuu

SEQ ID NO: 3915248 - RNA, 22 nt, Shigella flexneri 2a str. 301
uguugcugccgacaaaugcagu

SEQ ID NO: 3915249 - RNA, 16 nt, Shigella flexneri 2a str. 301
uguuggaacccgcagc

SEQ ID NO: 3915250 - RNA, 22 nt, Shigella flexneri 2a str. 301
uguuggauccccugcccggcaa

SEQ ID NO: 3915251 - RNA, 17 nt, Shigella flexneri 2a str. 301
uguuguacaugcugcuu

SEQ ID NO: 3915252 - RNA, 20 nt, Shigella flexneri 2a str. 301
uguuguagaccggaaaaggu

SEQ ID NO: 3915253 - RNA, 15 nt, Shigella flexneri 2a str. 301
uguugucugaaugau

SEQ ID NO: 3915254 - RNA, 14 nt, Shigella flexneri 2a str. 301
uguuguuucagaaa

SEQ ID NO: 3915255 - RNA, 21 nt, Shigella flexneri 2a str. 301
uguuuaacuccuucuaaagca

SEQ ID NO: 3915256 - RNA, 21 nt, Shigella flexneri 2a str. 301
uguuuaccaucugcgccgcca

SEQ ID NO: 3915257 - RNA, 16 nt, Shigella flexneri 2a str. 301
uguuuagccacaccga

SEQ ID NO: 3915258 - RNA, 23 nt, Shigella flexneri 2a str. 301
uguuuagccgcuucugcagcuuu

SEQ ID NO: 3915259 - RNA, 22 nt, Shigella flexneri 2a str. 301
uguuuagcuucugcguggccuu

SEQ ID NO: 3915260 - RNA, 20 nt, Shigella flexneri 2a str. 301
uguuuauaacuucccgcauc

SEQ ID NO: 3915261 - RNA, 14 nt, Shigella flexneri 2a str. 301
uguuuauaagccau

SEQ ID NO: 3915262 - RNA, 14 nt, Shigella flexneri 2a str. 301
uguuuaucaggcca

SEQ ID NO: 3915263 - RNA, 22 nt, Shigella flexneri 2a str. 301
uguuuaucuauaacaaaacuga

SEQ ID NO: 3915264 - RNA, 11 nt, Shigella flexneri 2a str. 301
uguuuaugccc

SEQ ID NO: 3915265 - RNA, 18 nt, Shigella flexneri 2a str. 301
uguuuauuuauacaguga

SEQ ID NO: 3915266 - RNA, 14 nt, Shigella flexneri 2a str. 301
uguuucaggaacac

SEQ ID NO: 3915267 - RNA, 16 nt, Shigella flexneri 2a str. 301
uguuucauaucaccgu

SEQ ID NO: 3915268 - RNA, 16 nt, Shigella flexneri 2a str. 301
uguuuccauccggcaa

SEQ ID NO: 3915269 - RNA, 17 nt, Shigella flexneri 2a str. 301
uguuuccuuaugacuac

SEQ ID NO: 3915270 - RNA, 18 nt, Shigella flexneri 2a str. 301
uguuucggugaauucagc

SEQ ID NO: 3915271 - RNA, 13 nt, Shigella flexneri 2a str. 301
uguuucucuuucu

SEQ ID NO: 3915272 - RNA, 22 nt, Shigella flexneri 2a str. 301
uguuugaaccagauaucgcgga

SEQ ID NO: 3915273 - RNA, 14 nt, Shigella flexneri 2a str. 301
uguuugaaucaaca

SEQ ID NO: 3915274 - RNA, 15 nt, Shigella flexneri 2a str. 301
uguuugacaacucau

SEQ ID NO: 3915275 - RNA, 18 nt, Shigella flexneri 2a str. 301
uguuugacaacucaucac

SEQ ID NO: 3915276 - RNA, 19 nt, Shigella flexneri 2a str. 301
uguuugcaggugaccagca

SEQ ID NO: 3915277 - RNA, 23 nt, Shigella flexneri 2a str. 301
uguuugcauccggcacaaugcuu

SEQ ID NO: 3915278 - RNA, 22 nt, Shigella flexneri 2a str. 301
uguuuuaacacacaauuaccuu

SEQ ID NO: 3915279 - RNA, 13 nt, Shigella flexneri 2a str. 301
uguuuuauaaaga

SEQ ID NO: 3915280 - RNA, 13 nt, Shigella flexneri 2a str. 301
uguuuuauauaac

SEQ ID NO: 3915281 - RNA, 23 nt, Shigella flexneri 2a str. 301
uguuuuaucucccuguaucccag

SEQ ID NO: 3915282 - RNA, 16 nt, Shigella flexneri 2a str. 301
uguuuuauguucagau

SEQ ID NO: 3915283 - RNA, 17 nt, Shigella flexneri 2a str. 301
uguuuuccgaugagcga

SEQ ID NO: 3915284 - RNA, 11 nt, Shigella flexneri 2a str. 301
uguuuucucuc

SEQ ID NO: 3915285 - RNA, 15 nt, Shigella flexneri 2a str. 301
uguuuuuaagguuuc

SEQ ID NO: 3915286 - RNA, 17 nt, Shigella flexneri 2a str. 301
uguuuuuaguuaaaucg

SEQ ID NO: 3915287 - RNA, 15 nt, Shigella flexneri 2a str. 301
uguuuuuucaaccua

SEQ ID NO: 3915288 - RNA, 12 nt, Shigella flexneri 2a str. 301
uuaaaaaaacac

SEQ ID NO: 3915289 - RNA, 21 nt, Shigella flexneri 2a str. 301
uuaaaaaaggugcucaaugag

SEQ ID NO: 3915290 - RNA, 13 nt, Shigella flexneri 2a str. 301
uuaaaaacagcca

SEQ ID NO: 3915291 - RNA, 21 nt, Shigella flexneri 2a str. 301
uuaaaaacuucguuagguucu

SEQ ID NO: 3915292 - RNA, 20 nt, Shigella flexneri 2a str. 301
uuaaaaagaaaaaacuaaca

SEQ ID NO: 3915293 - RNA, 17 nt, Shigella flexneri 2a str. 301
uuaaaacaauauaaccu

SEQ ID NO: 3915294 - RNA, 16 nt, Shigella flexneri 2a str. 301
uuaaaaccgaggggcu

SEQ ID NO: 3915295 - RNA, 18 nt, Shigella flexneri 2a str. 301
uuaaaacgcacgcuguca

SEQ ID NO: 3915296 - RNA, 13 nt, Shigella flexneri 2a str. 301
uuaaaacuaaaaa

SEQ ID NO: 3915297 - RNA, 20 nt, Shigella flexneri 2a str. 301
uuaaaauucaagacaucaau

SEQ ID NO: 3915298 - RNA, 18 nt, Shigella flexneri 2a str. 301
uuaaacaagguuugaaaa

SEQ ID NO: 3915299 - RNA, 22 nt, Shigella flexneri 2a str. 301
uuaaacaauuucagaauagaca

SEQ ID NO: 3915300 - RNA, 16 nt, Shigella flexneri 2a str. 301
uuaaaccauuccagca

SEQ ID NO: 3915301 - RNA, 17 nt, Shigella flexneri 2a str. 301
uuaaacccgcucaaaca

SEQ ID NO: 3915302 - RNA, 19 nt, Shigella flexneri 2a str. 301
uuaaacgcagagacaucac

SEQ ID NO: 3915303 - RNA, 17 nt, Shigella flexneri 2a str. 301
uuaaacgggucaucaaa

SEQ ID NO: 3915304 - RNA, 15 nt, Shigella flexneri 2a str. 301
uuaaacuuucauaaa

SEQ ID NO: 3915305 - RNA, 13 nt, Shigella flexneri 2a str. 301
uuaaagaaaguaa

SEQ ID NO: 3915306 - RNA, 22 nt, Shigella flexneri 2a str. 301
uuaaagagacagaaucaggcca

SEQ ID NO: 3915307 - RNA, 22 nt, Shigella flexneri 2a str. 301
uuaaagagcauuacacgcggcu

SEQ ID NO: 3915308 - RNA, 12 nt, Shigella flexneri 2a str. 301
uuaaaggaaagu

SEQ ID NO: 3915309 - RNA, 17 nt, Shigella flexneri 2a str. 301
uuaaaggcaccaauauu

SEQ ID NO: 3915310 - RNA, 16 nt, Shigella flexneri 2a str. 301
uuaaaggggugaaaaa

SEQ ID NO: 3915311 - RNA, 22 nt, Shigella flexneri 2a str. 301
uuaaaguacucuuugaacagcc

SEQ ID NO: 3915312 - RNA, 21 nt, Shigella flexneri 2a str. 301
uuaaagucuuuguauuuauuu

SEQ ID NO: 3915313 - RNA, 20 nt, Shigella flexneri 2a str. 301
uuaaaguugagcgaaaacga

SEQ ID NO: 3915314 - RNA, 22 nt, Shigella flexneri 2a str. 301
uuaaauacauauaagcguuaau

SEQ ID NO: 3915315 - RNA, 12 nt, Shigella flexneri 2a str. 301
uuaaauauaaaa

SEQ ID NO: 3915316 - RNA, 19 nt, Shigella flexneri 2a str. 301
uuaaauauaaaacaacgga

SEQ ID NO: 3915317 - RNA, 15 nt, Shigella flexneri 2a str. 301
uuaaauaucaucaaa

SEQ ID NO: 3915318 - RNA, 17 nt, Shigella flexneri 2a str. 301
uuaaauaucaucaaaau

SEQ ID NO: 3915319 - RNA, 18 nt, Shigella flexneri 2a str. 301
uuaaauauuuauguguuu

SEQ ID NO: 3915320 - RNA, 14 nt, Shigella flexneri 2a str. 301
uuaaauccugcaca

SEQ ID NO: 3915321 - RNA, 17 nt, Shigella flexneri 2a str. 301
uuaaaugauaccgggcu

SEQ ID NO: 3915322 - RNA, 12 nt, Shigella flexneri 2a str. 301
uuaaauuaauaa

SEQ ID NO: 3915323 - RNA, 14 nt, Shigella flexneri 2a str. 301
uuaaauuaauaauc

SEQ ID NO: 3915324 - RNA, 15 nt, Shigella flexneri 2a str. 301
uuaaauugucuuaaa

SEQ ID NO: 3915325 - RNA, 14 nt, Shigella flexneri 2a str. 301
uuaacaaucacaau

SEQ ID NO: 3915326 - RNA, 15 nt, Shigella flexneri 2a str. 301
uuaacaaucacaaua

SEQ ID NO: 3915327 - RNA, 17 nt, Shigella flexneri 2a str. 301
uuaacaaucacaauaga

SEQ ID NO: 3915328 - RNA, 19 nt, Shigella flexneri 2a str. 301
uuaacacacaauuaccuuc

SEQ ID NO: 3915329 - RNA, 17 nt, Shigella flexneri 2a str. 301
uuaacaccaguaaauaa

SEQ ID NO: 3915330 - RNA, 19 nt, Shigella flexneri 2a str. 301
uuaacaccaguaaauaacg

SEQ ID NO: 3915331 - RNA, 16 nt, Shigella flexneri 2a str. 301
uuaacaucaugucggc

SEQ ID NO: 3915332 - RNA, 19 nt, Shigella flexneri 2a str. 301
uuaaccaaaaauuuccaca

SEQ ID NO: 3915333 - RNA, 15 nt, Shigella flexneri 2a str. 301
uuaaccaacaauaaa

SEQ ID NO: 3915334 - RNA, 17 nt, Shigella flexneri 2a str. 301
uuaaccaccuccacgcc

SEQ ID NO: 3915335 - RNA, 21 nt, Shigella flexneri 2a str. 301
uuacaugcgcgacaaaaauua

SEQ ID NO: 3915336 - RNA, 22 nt, Shigella flexneri 2a str. 301
uuaccaaauaaacgaaucugca

SEQ ID NO: 3915337 - RNA, 20 nt, Shigella flexneri 2a str. 301
uuaccaaauuggcaaaauuu

SEQ ID NO: 3915338 - RNA, 19 nt, Shigella flexneri 2a str. 301
uuaccacaccggcaauaau

SEQ ID NO: 3915339 - RNA, 18 nt, Shigella flexneri 2a str. 301
uuaccaccgucaaaaaaa

SEQ ID NO: 3915340 - RNA, 23 nt, Shigella flexneri 2a str. 301
uuaccaccuuacuuacacaucaa

SEQ ID NO: 3915341 - RNA, 22 nt, Shigella flexneri 2a str. 301
uuaccagcaaauugaggaucug

SEQ ID NO: 3915342 - RNA, 21 nt, Shigella flexneri 2a str. 301
uuaccaguccugugacucaau

SEQ ID NO: 3915343 - RNA, 13 nt, Shigella flexneri 2a str. 301
uuaccaugcuuca

SEQ ID NO: 3915344 - RNA, 13 nt, Shigella flexneri 2a str. 301
uuacccagcagca

SEQ ID NO: 3915345 - RNA, 13 nt, Shigella flexneri 2a str. 301
uuacccauucaag

SEQ ID NO: 3915346 - RNA, 22 nt, Shigella flexneri 2a str. 301
uuaccccacgucaucugucaua

SEQ ID NO: 3915347 - RNA, 17 nt, Shigella flexneri 2a str. 301
uuacccggacacucggc

SEQ ID NO: 3915348 - RNA, 23 nt, Shigella flexneri 2a str. 301
uuacccuacaccaugccggugau

SEQ ID NO: 3915349 - RNA, 16 nt, Shigella flexneri 2a str. 301
uuaccgcaaagcccac

SEQ ID NO: 3915350 - RNA, 17 nt, Shigella flexneri 2a str. 301
uuaccgcaccaccagca

SEQ ID NO: 3915351 - RNA, 14 nt, Shigella flexneri 2a str. 301
uuaccgccaccagg

SEQ ID NO: 3915352 - RNA, 14 nt, Shigella flexneri 2a str. 301
uuaccgccauggcc

SEQ ID NO: 3915353 - RNA, 19 nt, Shigella flexneri 2a str. 301
uuaccgcuauuugcgccug

SEQ ID NO: 3915354 - RNA, 23 nt, Shigella flexneri 2a str. 301
uuaccgcuuggcgauaccccaac

SEQ ID NO: 3915355 - RNA, 14 nt, Shigella flexneri 2a str. 301
uuaccggcagagug

SEQ ID NO: 3915356 - RNA, 19 nt, Shigella flexneri 2a str. 301
uuaccggucccuucaaucu

SEQ ID NO: 3915357 - RNA, 17 nt, Shigella flexneri 2a str. 301
uuaccggugccagcaac

SEQ ID NO: 3915358 - RNA, 19 nt, Shigella flexneri 2a str. 301
uuaccggugccagcaacug

SEQ ID NO: 3915359 - RNA, 18 nt, Shigella flexneri 2a str. 301
uuaccgguuugcguauca

SEQ ID NO: 3915360 - RNA, 15 nt, Shigella flexneri 2a str. 301
uuaccucgauauuca

SEQ ID NO: 3915361 - RNA, 23 nt, Shigella flexneri 2a str. 301
uuaccugaaugcucugaggcuga

SEQ ID NO: 3915362 - RNA, 16 nt, Shigella flexneri 2a str. 301
uuaccugagugcaggc

SEQ ID NO: 3915363 - RNA, 21 nt, Shigella flexneri 2a str. 301
uuaccuguggcguauucggca

SEQ ID NO: 3915364 - RNA, 13 nt, Shigella flexneri 2a str. 301
uuaccuucauuug

SEQ ID NO: 3915365 - RNA, 17 nt, Shigella flexneri 2a str. 301
uuaccuuuaugacgauc

SEQ ID NO: 3915366 - RNA, 19 nt, Shigella flexneri 2a str. 301
uuacgacgcaaucaaaaaa

SEQ ID NO: 3915367 - RNA, 21 nt, Shigella flexneri 2a str. 301
uuacgacucaaccccagccau

SEQ ID NO: 3915368 - RNA, 16 nt, Shigella flexneri 2a str. 301
uuacgagucacaaaca

SEQ ID NO: 3915369 - RNA, 13 nt, Shigella flexneri 2a str. 301
uuacgauagaaua

SEQ ID NO: 3915370 - RNA, 20 nt, Shigella flexneri 2a str. 301
uuacgaucaagauugauccc

SEQ ID NO: 3915371 - RNA, 17 nt, Shigella flexneri 2a str. 301
uuacgcagcgguauaau

SEQ ID NO: 3915372 - RNA, 23 nt, Shigella flexneri 2a str. 301
uuacgcaggcaauccauaacgcu

SEQ ID NO: 3915373 - RNA, 23 nt, Shigella flexneri 2a str. 301
uuacgcauuaccccuuccugaac

SEQ ID NO: 3915374 - RNA, 16 nt, Shigella flexneri 2a str. 301
uuacgccaccagcuga

SEQ ID NO: 3915375 - RNA, 13 nt, Shigella flexneri 2a str. 301
uuacgccaccgca

SEQ ID NO: 3915376 - RNA, 23 nt, Shigella flexneri 2a str. 301
uuacgccgagcgccagccauuca

SEQ ID NO: 3915377 - RNA, 14 nt, Shigella flexneri 2a str. 301
uuacgccgcaucag

SEQ ID NO: 3915378 - RNA, 17 nt, Shigella flexneri 2a str. 301
uuacgccgcauccaaca

SEQ ID NO: 3915379 - RNA, 20 nt, Shigella flexneri 2a str. 301
uuacgccgcauccggcauaa

SEQ ID NO: 3915380 - RNA, 16 nt, Shigella flexneri 2a str. 301
uuacgcucuuccacgc

SEQ ID NO: 3915381 - RNA, 14 nt, Shigella flexneri 2a str. 301
uuacggcacuccuc

SEQ ID NO: 3915382 - RNA, 23 nt, Shigella flexneri 2a str. 301
uuacggguucaagucccguccuc

SEQ ID NO: 3915383 - RNA, 17 nt, Shigella flexneri 2a str. 301
uuacguuuacgcaucug

SEQ ID NO: 3915384 - RNA, 16 nt, Shigella flexneri 2a str. 301
uuacguuuuaaaccua

SEQ ID NO: 3915385 - RNA, 22 nt, Shigella flexneri 2a str. 301
uuacuaauaaaucgugaaacaa

SEQ ID NO: 3915386 - RNA, 19 nt, Shigella flexneri 2a str. 301
uuacuacccuguccgccau

SEQ ID NO: 3915387 - RNA, 16 nt, Shigella flexneri 2a str. 301
uuacuagccugcuccc

SEQ ID NO: 3915388 - RNA, 21 nt, Shigella flexneri 2a str. 301
uuacucauccacugccuguca

SEQ ID NO: 3915389 - RNA, 11 nt, Shigella flexneri 2a str. 301
uuacuccagau

SEQ ID NO: 3915390 - RNA, 20 nt, Shigella flexneri 2a str. 301
uuacucccgugccagagcau

SEQ ID NO: 3915391 - RNA, 21 nt, Shigella flexneri 2a str. 301
uuacuccuuagcaacaggcca

SEQ ID NO: 3915392 - RNA, 13 nt, Shigella flexneri 2a str. 301
uuacucuccugcg

SEQ ID NO: 3915393 - RNA, 11 nt, Shigella flexneri 2a str. 301
uuacucucugg

SEQ ID NO: 3915394 - RNA, 13 nt, Shigella flexneri 2a str. 301
uuacucuuaucaa

SEQ ID NO: 3915395 - RNA, 18 nt, Shigella flexneri 2a str. 301
uuacugacaauuugccca

SEQ ID NO: 3915396 - RNA, 13 nt, Shigella flexneri 2a str. 301
uuacugacaucaa

SEQ ID NO: 3915397 - RNA, 19 nt, Shigella flexneri 2a str. 301
uuacugacaucaaacccuu

SEQ ID NO: 3915398 - RNA, 20 nt, Shigella flexneri 2a str. 301
uuacugacuagaugugcagu

SEQ ID NO: 3915399 - RNA, 13 nt, Shigella flexneri 2a str. 301
uuacugacugucc

SEQ ID NO: 3915400 - RNA, 16 nt, Shigella flexneri 2a str. 301
uuacugagagaaaaaa

SEQ ID NO: 3915401 - RNA, 22 nt, Shigella flexneri 2a str. 301
uuacugagauggcuucauccca

SEQ ID NO: 3915402 - RNA, 22 nt, Shigella flexneri 2a str. 301
uuacugaggccggaugucgcug

SEQ ID NO: 3915403 - RNA, 15 nt, Shigella flexneri 2a str. 301
uuacugcagccagcg

SEQ ID NO: 3915404 - RNA, 15 nt, Shigella flexneri 2a str. 301
uuacugccaccaucc

SEQ ID NO: 3915405 - RNA, 22 nt, Shigella flexneri 2a str. 301
uuacugcguauuuccugccaga

SEQ ID NO: 3915406 - RNA, 18 nt, Shigella flexneri 2a str. 301
uuacuggaguuauucauu

SEQ ID NO: 3915407 - RNA, 22 nt, Shigella flexneri 2a str. 301
uuacuggcggguuuuuuauuua

SEQ ID NO: 3915408 - RNA, 16 nt, Shigella flexneri 2a str. 301
uuacuguacagauccg

SEQ ID NO: 3915409 - RNA, 15 nt, Shigella flexneri 2a str. 301
uuacugucugcuucu

SEQ ID NO: 3915410 - RNA, 16 nt, Shigella flexneri 2a str. 301
uuacuucaccuucuuu

SEQ ID NO: 3915411 - RNA, 20 nt, Shigella flexneri 2a str. 301
uuacuuccgguuacgccacc

SEQ ID NO: 3915412 - RNA, 23 nt, Shigella flexneri 2a str. 301
uuacuucugcugcacgaaauugc

SEQ ID NO: 3915413 - RNA, 23 nt, Shigella flexneri 2a str. 301
uuacuugcugcucugaagguugu

SEQ ID NO: 3915414 - RNA, 15 nt, Shigella flexneri 2a str. 301
uuacuuuauuuauau

SEQ ID NO: 3915415 - RNA, 17 nt, Shigella flexneri 2a str. 301
uuagaauaccugccugu

SEQ ID NO: 3915416 - RNA, 23 nt, Shigella flexneri 2a str. 301
uuagacuuuagucaucagucuga

SEQ ID NO: 3915417 - RNA, 14 nt, Shigella flexneri 2a str. 301
uuagagcacaucac

SEQ ID NO: 3915418 - RNA, 15 nt, Shigella flexneri 2a str. 301
uuagauaaaaaugaa

SEQ ID NO: 3915419 - RNA, 18 nt, Shigella flexneri 2a str. 301
uuagaugauggcauucuc

SEQ ID NO: 3915420 - RNA, 21 nt, Shigella flexneri 2a str. 301
uuagaugauggcauucucacu

SEQ ID NO: 3915421 - RNA, 21 nt, Shigella flexneri 2a str. 301
uuagaugugggcaaucucacu

SEQ ID NO: 3915422 - RNA, 20 nt, Shigella flexneri 2a str. 301
uuagcaacaggccaguucga

SEQ ID NO: 3915423 - RNA, 14 nt, Shigella flexneri 2a str. 301
uuagcaauccuuga

SEQ ID NO: 3915424 - RNA, 16 nt, Shigella flexneri 2a str. 301
uuagcaucagcgccac

SEQ ID NO: 3915425 - RNA, 21 nt, Shigella flexneri 2a str. 301
uuagcaucagcgccaccagcg

SEQ ID NO: 3915426 - RNA, 21 nt, Shigella flexneri 2a str. 301
uuagccaggcaccgaaaauca

SEQ ID NO: 3915427 - RNA, 14 nt, Shigella flexneri 2a str. 301
uuagcccaauaauc

SEQ ID NO: 3915428 - RNA, 19 nt, Shigella flexneri 2a str. 301
uuagccgcagguaaacuca

SEQ ID NO: 3915429 - RNA, 16 nt, Shigella flexneri 2a str. 301
uuagccgccagcucuu

SEQ ID NO: 3915430 - RNA, 15 nt, Shigella flexneri 2a str. 301
uuagccggauaaaca

SEQ ID NO: 3915431 - RNA, 19 nt, Shigella flexneri 2a str. 301
uuagccuguaaugucaucu

SEQ ID NO: 3915432 - RNA, 17 nt, Shigella flexneri 2a str. 301
uuagcgaauuuuucgag

SEQ ID NO: 3915433 - RNA, 17 nt, Shigella flexneri 2a str. 301
uuagcgacgaacagcga

SEQ ID NO: 3915434 - RNA, 14 nt, Shigella flexneri 2a str. 301
uuaugaucaucaag

SEQ ID NO: 3915435 - RNA, 18 nt, Shigella flexneri 2a str. 301
uuaugcaauagcgccugc

SEQ ID NO: 3915436 - RNA, 23 nt, Shigella flexneri 2a str. 301
uuaugcaauagcgccugcugcug

SEQ ID NO: 3915437 - RNA, 14 nt, Shigella flexneri 2a str. 301
uuaugcaauauauu

SEQ ID NO: 3915438 - RNA, 19 nt, Shigella flexneri 2a str. 301
uuaugcagugcauccagca

SEQ ID NO: 3915439 - RNA, 18 nt, Shigella flexneri 2a str. 301
uuauggcgauaucaaaaa

SEQ ID NO: 3915440 - RNA, 19 nt, Shigella flexneri 2a str. 301
uuauggcgauaucaaaaaa

SEQ ID NO: 3915441 - RNA, 18 nt, Shigella flexneri 2a str. 301
uuauggcucgccauccag

SEQ ID NO: 3915442 - RNA, 13 nt, Shigella flexneri 2a str. 301
uuauggugcuagu

SEQ ID NO: 3915443 - RNA, 22 nt, Shigella flexneri 2a str. 301
uuauguaacaacuggcggucau

SEQ ID NO: 3915444 - RNA, 23 nt, Shigella flexneri 2a str. 301
uuaugugcuucuaccaugaugau

SEQ ID NO: 3915445 - RNA, 22 nt, Shigella flexneri 2a str. 301
uuaugugguuaugccauuuucc

SEQ ID NO: 3915446 - RNA, 20 nt, Shigella flexneri 2a str. 301
uuauguucagccgucaucca

SEQ ID NO: 3915447 - RNA, 13 nt, Shigella flexneri 2a str. 301
uuauuaaacagac

SEQ ID NO: 3915448 - RNA, 16 nt, Shigella flexneri 2a str. 301
uuauuaaauuuaauaa

SEQ ID NO: 3915449 - RNA, 19 nt, Shigella flexneri 2a str. 301
uuauuaaccuggucgcuga

SEQ ID NO: 3915450 - RNA, 15 nt, Shigella flexneri 2a str. 301
uuauuaacuucccac

SEQ ID NO: 3915451 - RNA, 22 nt, Shigella flexneri 2a str. 301
uuauuaucuggcaagccugaaa

SEQ ID NO: 3915452 - RNA, 20 nt, Shigella flexneri 2a str. 301
uuauugauuccagcauaaug

SEQ ID NO: 3915453 - RNA, 20 nt, Shigella flexneri 2a str. 301
uuauugguaguguguuugau

SEQ ID NO: 3915454 - RNA, 16 nt, Shigella flexneri 2a str. 301
uuauuguuugucauga

SEQ ID NO: 3915455 - RNA, 16 nt, Shigella flexneri 2a str. 301
uuauuuacucuccugc

SEQ ID NO: 3915456 - RNA, 23 nt, Shigella flexneri 2a str. 301
uuauuuacuugggaaaacagcgc

SEQ ID NO: 3915457 - RNA, 13 nt, Shigella flexneri 2a str. 301
uuauuuccaguuc

SEQ ID NO: 3915458 - RNA, 12 nt, Shigella flexneri 2a str. 301
uuauuucgcugc

SEQ ID NO: 3915459 - RNA, 14 nt, Shigella flexneri 2a str. 301
uuauuucucacuuu

SEQ ID NO: 3915460 - RNA, 14 nt, Shigella flexneri 2a str. 301
uuauuucuguauua

SEQ ID NO: 3915461 - RNA, 11 nt, Shigella flexneri 2a str. 301
uuauuuuauuu

SEQ ID NO: 3915462 - RNA, 12 nt, Shigella flexneri 2a str. 301
uuauuuuuaaac

SEQ ID NO: 3915463 - RNA, 16 nt, Shigella flexneri 2a str. 301
uucaaaaacuaauuca

SEQ ID NO: 3915464 - RNA, 19 nt, Shigella flexneri 2a str. 301
uucaaaagaugagaaaaau

SEQ ID NO: 3915465 - RNA, 23 nt, Shigella flexneri 2a str. 301
uucaaacacccgaccaucaacua

SEQ ID NO: 3915466 - RNA, 21 nt, Shigella flexneri 2a str. 301
uucaaaguucugugucuuauu

SEQ ID NO: 3915467 - RNA, 18 nt, Shigella flexneri 2a str. 301
uucaaauccucaaugacu

SEQ ID NO: 3915468 - RNA, 16 nt, Shigella flexneri 2a str. 301
uucaaaucgaaaucaa

SEQ ID NO: 3915469 - RNA, 15 nt, Shigella flexneri 2a str. 301
uucaaauuacgaucc

SEQ ID NO: 3915470 - RNA, 14 nt, Shigella flexneri 2a str. 301
uucaaauuaugucu

SEQ ID NO: 3915471 - RNA, 19 nt, Shigella flexneri 2a str. 301
uucaacaauugaagaauau

SEQ ID NO: 3915472 - RNA, 13 nt, Shigella flexneri 2a str. 301
uucaacagauuuc

SEQ ID NO: 3915473 - RNA, 16 nt, Shigella flexneri 2a str. 301
uucaacagauuucgaa

SEQ ID NO: 3915474 - RNA, 17 nt, Shigella flexneri 2a str. 301
uucaacagcgugaacug

SEQ ID NO: 3915475 - RNA, 16 nt, Shigella flexneri 2a str. 301
uucaacaguaaacucg

SEQ ID NO: 3915476 - RNA, 13 nt, Shigella flexneri 2a str. 301
uucaacaguuuuc

SEQ ID NO: 3915477 - RNA, 18 nt, Shigella flexneri 2a str. 301
uucaacauauccuucaca

SEQ ID NO: 3915478 - RNA, 13 nt, Shigella flexneri 2a str. 301
uucaaccagccga

SEQ ID NO: 3915479 - RNA, 15 nt, Shigella flexneri 2a str. 301
uucaaccgucaccag

SEQ ID NO: 3915480 - RNA, 18 nt, Shigella flexneri 2a str. 301
uucaaccguugcuggaaa

SEQ ID NO: 3915481 - RNA, 14 nt, Shigella flexneri 2a str. 301
uucaaccuaaagua

SEQ ID NO: 3915482 - RNA, 21 nt, Shigella flexneri 2a str. 301
uucaacgccgcuaucagauuc

SEQ ID NO: 3915483 - RNA, 16 nt, Shigella flexneri 2a str. 301
uucaacgcggcgcugc

SEQ ID NO: 3915484 - RNA, 23 nt, Shigella flexneri 2a str. 301
uucaacgcucuccugcggaaugc

SEQ ID NO: 3915485 - RNA, 22 nt, Shigella flexneri 2a str. 301
uucaacgguaaguugacgagau

SEQ ID NO: 3915486 - RNA, 19 nt, Shigella flexneri 2a str. 301
uucaacguacucugccacu

SEQ ID NO: 3915487 - RNA, 21 nt, Shigella flexneri 2a str. 301
uucaagacaucaauaaacaau

SEQ ID NO: 3915488 - RNA, 17 nt, Shigella flexneri 2a str. 301
uucaagacgccguccau

SEQ ID NO: 3915489 - RNA, 22 nt, Shigella flexneri 2a str. 301
uucaagccaaaacgcgcaacca

SEQ ID NO: 3915490 - RNA, 17 nt, Shigella flexneri 2a str. 301
uucaagcucaaaauaau

SEQ ID NO: 3915491 - RNA, 21 nt, Shigella flexneri 2a str. 301
uucaaggagggaucgacagau

SEQ ID NO: 3915492 - RNA, 13 nt, Shigella flexneri 2a str. 301
uucaaguaauuca

SEQ ID NO: 3915493 - RNA, 18 nt, Shigella flexneri 2a str. 301
uucaauaaauugcaggaa

SEQ ID NO: 3915494 - RNA, 19 nt, Shigella flexneri 2a str. 301
uucaauaaccugcaaaaua

SEQ ID NO: 3915495 - RNA, 22 nt, Shigella flexneri 2a str. 301
uucaauaaccugcaaaauaguc

SEQ ID NO: 3915496 - RNA, 22 nt, Shigella flexneri 2a str. 301
uucaauaccgccugcaaauaaa

SEQ ID NO: 3915497 - RNA, 23 nt, Shigella flexneri 2a str. 301
uucaauaccgccugcaaauaaau

SEQ ID NO: 3915498 - RNA, 17 nt, Shigella flexneri 2a str. 301
uucaauacgcucgaaca

SEQ ID NO: 3915499 - RNA, 14 nt, Shigella flexneri 2a str. 301
uucaauauauugca

SEQ ID NO: 3915500 - RNA, 13 nt, Shigella flexneri 2a str. 301
uucaaucugguga

SEQ ID NO: 3915501 - RNA, 22 nt, Shigella flexneri 2a str. 301
uucaaugaaugcuucgcucucu

SEQ ID NO: 3915502 - RNA, 20 nt, Shigella flexneri 2a str. 301
uucaaugauaaaggucauca

SEQ ID NO: 3915503 - RNA, 15 nt, Shigella flexneri 2a str. 301
uucaaugccgccgau

SEQ ID NO: 3915504 - RNA, 20 nt, Shigella flexneri 2a str. 301
uucaauucacgaauauuucc

SEQ ID NO: 3915505 - RNA, 17 nt, Shigella flexneri 2a str. 301
uucacaaaggcuugcug

SEQ ID NO: 3915506 - RNA, 15 nt, Shigella flexneri 2a str. 301
uucacaaguuguccc

SEQ ID NO: 3915507 - RNA, 17 nt, Shigella flexneri 2a str. 301
uucacaaucagcgcgau

SEQ ID NO: 3915508 - RNA, 18 nt, Shigella flexneri 2a str. 301
uucacaggccgccaggca

SEQ ID NO: 3915509 - RNA, 16 nt, Shigella flexneri 2a str. 301
uucacauauugcagcu

SEQ ID NO: 3915510 - RNA, 20 nt, Shigella flexneri 2a str. 301
uucacaucaccauagccuaa

SEQ ID NO: 3915511 - RNA, 12 nt, Shigella flexneri 2a str. 301
uucacaucauca

SEQ ID NO: 3915512 - RNA, 22 nt, Shigella flexneri 2a str. 301
uucacaucauccggcaccuuuu

SEQ ID NO: 3915513 - RNA, 15 nt, Shigella flexneri 2a str. 301
uucacauuuaaacaa

SEQ ID NO: 3915514 - RNA, 21 nt, Shigella flexneri 2a str. 301
uucaccaaacuucagcccuuu

SEQ ID NO: 3915515 - RNA, 14 nt, Shigella flexneri 2a str. 301
uucaccaaagcuga

SEQ ID NO: 3915516 - RNA, 20 nt, Shigella flexneri 2a str. 301
uucaccaaagcugauuucug

SEQ ID NO: 3915517 - RNA, 18 nt, Shigella flexneri 2a str. 301
uucaccacugaauaacau

SEQ ID NO: 3915518 - RNA, 23 nt, Shigella flexneri 2a str. 301
uucaccagaccugaaaccgccuu

SEQ ID NO: 3915519 - RNA, 16 nt, Shigella flexneri 2a str. 301
uucaccagcaucgccg

SEQ ID NO: 3915520 - RNA, 21 nt, Shigella flexneri 2a str. 301
uucaccaguugguagguccag

SEQ ID NO: 3915521 - RNA, 23 nt, Shigella flexneri 2a str. 301
uucaccaguuguaaaucgcccac

SEQ ID NO: 3915522 - RNA, 22 nt, Shigella flexneri 2a str. 301
uucaccauucugcgcugacucu

SEQ ID NO: 3915523 - RNA, 16 nt, Shigella flexneri 2a str. 301
uucaccauuggucuuu

SEQ ID NO: 3915524 - RNA, 13 nt, Shigella flexneri 2a str. 301
uucaccauuuuuu

SEQ ID NO: 3915525 - RNA, 15 nt, Shigella flexneri 2a str. 301
uucacccaccggaau

SEQ ID NO: 3915526 - RNA, 21 nt, Shigella flexneri 2a str. 301
uucacccaucacuaccugauu

SEQ ID NO: 3915527 - RNA, 15 nt, Shigella flexneri 2a str. 301
uucacccauugccgc

SEQ ID NO: 3915528 - RNA, 16 nt, Shigella flexneri 2a str. 301
uucaccgauauccgcc

SEQ ID NO: 3915529 - RNA, 23 nt, Shigella flexneri 2a str. 301
uucaccgcguaugcccagcgcag

SEQ ID NO: 3915530 - RNA, 16 nt, Shigella flexneri 2a str. 301
uucaccggugagcugc

SEQ ID NO: 3915531 - RNA, 14 nt, Shigella flexneri 2a str. 301
uucaccuuuuucca

SEQ ID NO: 3915532 - RNA, 23 nt, Shigella flexneri 2a str. 301
uucacgaaucuauucauuuaugu

SEQ ID NO: 3915533 - RNA, 14 nt, Shigella flexneri 2a str. 301
uucacgcacuuccg

SEQ ID NO: 3915534 - RNA, 20 nt, Shigella flexneri 2a str. 301
uucauacagcggccagccau

SEQ ID NO: 3915535 - RNA, 14 nt, Shigella flexneri 2a str. 301
uucauacccugaau

SEQ ID NO: 3915536 - RNA, 22 nt, Shigella flexneri 2a str. 301
uucauacggcacuuucaucgcg

SEQ ID NO: 3915537 - RNA, 21 nt, Shigella flexneri 2a str. 301
uucauacugccgaccaucugu

SEQ ID NO: 3915538 - RNA, 19 nt, Shigella flexneri 2a str. 301
uucauaguaagcagauucu

SEQ ID NO: 3915539 - RNA, 19 nt, Shigella flexneri 2a str. 301
uucauauaauuccacgcca

SEQ ID NO: 3915540 - RNA, 15 nt, Shigella flexneri 2a str. 301
uucauauagaucuuu

SEQ ID NO: 3915541 - RNA, 14 nt, Shigella flexneri 2a str. 301
uucauaucugccag

SEQ ID NO: 3915542 - RNA, 20 nt, Shigella flexneri 2a str. 301
uucauaugcgccagcugcau

SEQ ID NO: 3915543 - RNA, 22 nt, Shigella flexneri 2a str. 301
uucauauuauuugcuaucgcga

SEQ ID NO: 3915544 - RNA, 12 nt, Shigella flexneri 2a str. 301
uucauauugccg

SEQ ID NO: 3915545 - RNA, 20 nt, Shigella flexneri 2a str. 301
uucauauuuuacauccggca

SEQ ID NO: 3915546 - RNA, 22 nt, Shigella flexneri 2a str. 301
uucaucaagaaaacgaauacug

SEQ ID NO: 3915547 - RNA, 22 nt, Shigella flexneri 2a str. 301
uucaucaagcugugccugaaua

SEQ ID NO: 3915548 - RNA, 14 nt, Shigella flexneri 2a str. 301
uucaucaccagcuc

SEQ ID NO: 3915549 - RNA, 20 nt, Shigella flexneri 2a str. 301
uucaucacuaccuucuuccc

SEQ ID NO: 3915550 - RNA, 22 nt, Shigella flexneri 2a str. 301
uucaucauccgugaauaaugca

SEQ ID NO: 3915551 - RNA, 11 nt, Shigella flexneri 2a str. 301
uucauccagca

SEQ ID NO: 3915552 - RNA, 12 nt, Shigella flexneri 2a str. 301
uucauccagcag

SEQ ID NO: 3915553 - RNA, 13 nt, Shigella flexneri 2a str. 301
uucauccagcagu

SEQ ID NO: 3915554 - RNA, 12 nt, Shigella flexneri 2a str. 301
uucauccagcau

SEQ ID NO: 3915555 - RNA, 13 nt, Shigella flexneri 2a str. 301
uucauccagugcu

SEQ ID NO: 3915556 - RNA, 18 nt, Shigella flexneri 2a str. 301
uucaucccgaccaaugca

SEQ ID NO: 3915557 - RNA, 20 nt, Shigella flexneri 2a str. 301
uucaucccgguuauuaaaac

SEQ ID NO: 3915558 - RNA, 22 nt, Shigella flexneri 2a str. 301
uucaucccgguuauuaaaacga

SEQ ID NO: 3915559 - RNA, 16 nt, Shigella flexneri 2a str. 301
uucauccgauccucac

SEQ ID NO: 3915560 - RNA, 20 nt, Shigella flexneri 2a str. 301
uucauccggcuguuccagca

SEQ ID NO: 3915561 - RNA, 16 nt, Shigella flexneri 2a str. 301
uucauccguuucucug

SEQ ID NO: 3915562 - RNA, 20 nt, Shigella flexneri 2a str. 301
uucauccguuucucuguuca

SEQ ID NO: 3915563 - RNA, 22 nt, Shigella flexneri 2a str. 301
uucauccguuucucuguucagc

SEQ ID NO: 3915564 - RNA, 17 nt, Shigella flexneri 2a str. 301
uucauccuggcacagca

SEQ ID NO: 3915565 - RNA, 19 nt, Shigella flexneri 2a str. 301
uucauccuggcacagcagu

SEQ ID NO: 3915566 - RNA, 19 nt, Shigella flexneri 2a str. 301
uucauccuguacgacaaaa

SEQ ID NO: 3915567 - RNA, 12 nt, Shigella flexneri 2a str. 301
uucaucgccagc

SEQ ID NO: 3915568 - RNA, 13 nt, Shigella flexneri 2a str. 301
uucaucgcccaca

SEQ ID NO: 3915569 - RNA, 15 nt, Shigella flexneri 2a str. 301
uucaucgcccuuuuu

SEQ ID NO: 3915570 - RNA, 19 nt, Shigella flexneri 2a str. 301
uucaucgccuucuugaacc

SEQ ID NO: 3915571 - RNA, 17 nt, Shigella flexneri 2a str. 301
uucaucgcuaaaauacu

SEQ ID NO: 3915572 - RNA, 18 nt, Shigella flexneri 2a str. 301
uucaucgcuacaccaauc

SEQ ID NO: 3915573 - RNA, 16 nt, Shigella flexneri 2a str. 301
uucaucggauacgcca

SEQ ID NO: 3915574 - RNA, 17 nt, Shigella flexneri 2a str. 301
uucaucggcguuuucug

SEQ ID NO: 3915575 - RNA, 17 nt, Shigella flexneri 2a str. 301
uucaucgugcucgcuuu

SEQ ID NO: 3915576 - RNA, 16 nt, Shigella flexneri 2a str. 301
uucaucugauagcuuu

SEQ ID NO: 3915577 - RNA, 15 nt, Shigella flexneri 2a str. 301
uucaucuucagucag

SEQ ID NO: 3915578 - RNA, 16 nt, Shigella flexneri 2a str. 301
uucaugaacacacccg

SEQ ID NO: 3915579 - RNA, 15 nt, Shigella flexneri 2a str. 301
uucaugaguuccacu

SEQ ID NO: 3915580 - RNA, 14 nt, Shigella flexneri 2a str. 301
uucaugcacuuggu

SEQ ID NO: 3915581 - RNA, 16 nt, Shigella flexneri 2a str. 301
uucaugccauccgcau

SEQ ID NO: 3915582 - RNA, 14 nt, Shigella flexneri 2a str. 301
uucaugcuauuccu

SEQ ID NO: 3915583 - RNA, 14 nt, Shigella flexneri 2a str. 301
uucaugcuccagca

SEQ ID NO: 3915584 - RNA, 20 nt, Shigella flexneri 2a str. 301
uucaugcuuaaucaucgacu

SEQ ID NO: 3915585 - RNA, 14 nt, Shigella flexneri 2a str. 301
uucauggugcaaga

SEQ ID NO: 3915586 - RNA, 16 nt, Shigella flexneri 2a str. 301
uucauggugcaagaaa

SEQ ID NO: 3915587 - RNA, 21 nt, Shigella flexneri 2a str. 301
uucauggugcaagaaaugaca

SEQ ID NO: 3915588 - RNA, 20 nt, Shigella flexneri 2a str. 301
uucauuaagaacuccugaaa

SEQ ID NO: 3915589 - RNA, 13 nt, Shigella flexneri 2a str. 301
uucauuaauauca

SEQ ID NO: 3915590 - RNA, 16 nt, Shigella flexneri 2a str. 301
uucauuacaccaauac

SEQ ID NO: 3915591 - RNA, 19 nt, Shigella flexneri 2a str. 301
uucauuaugaucaaaauca

SEQ ID NO: 3915592 - RNA, 18 nt, Shigella flexneri 2a str. 301
uucauucaauuaauaaca

SEQ ID NO: 3915593 - RNA, 15 nt, Shigella flexneri 2a str. 301
uucauucaggccaaa

SEQ ID NO: 3915594 - RNA, 21 nt, Shigella flexneri 2a str. 301
uucauugaaugcggcaggcac

SEQ ID NO: 3915595 - RNA, 21 nt, Shigella flexneri 2a str. 301
uucauugagcgcaaaugguga

SEQ ID NO: 3915596 - RNA, 18 nt, Shigella flexneri 2a str. 301
uucauuucaauaaauucc

SEQ ID NO: 3915597 - RNA, 21 nt, Shigella flexneri 2a str. 301
uuccaacuguaccagcaacug

SEQ ID NO: 3915598 - RNA, 17 nt, Shigella flexneri 2a str. 301
uuccacagcucacggcc

SEQ ID NO: 3915599 - RNA, 18 nt, Shigella flexneri 2a str. 301
uuccacagcucacggccc

SEQ ID NO: 3915600 - RNA, 17 nt, Shigella flexneri 2a str. 301
uuccacauaaaguagcc

SEQ ID NO: 3915601 - RNA, 21 nt, Shigella flexneri 2a str. 301
uuccacccacggcguuaacug

SEQ ID NO: 3915602 - RNA, 12 nt, Shigella flexneri 2a str. 301
uuccaccgccgg

SEQ ID NO: 3915603 - RNA, 18 nt, Shigella flexneri 2a str. 301
uuccacgcaggcauuauc

SEQ ID NO: 3915604 - RNA, 22 nt, Shigella flexneri 2a str. 301
uuccacgcggguaaguacgcca

SEQ ID NO: 3915605 - RNA, 18 nt, Shigella flexneri 2a str. 301
uuccacggaauauuucac

SEQ ID NO: 3915606 - RNA, 19 nt, Shigella flexneri 2a str. 301
uuccacggaauauuucacc

SEQ ID NO: 3915607 - RNA, 12 nt, Shigella flexneri 2a str. 301
uuccacuucauc

SEQ ID NO: 3915608 - RNA, 13 nt, Shigella flexneri 2a str. 301
uuccagaauaucu

SEQ ID NO: 3915609 - RNA, 14 nt, Shigella flexneri 2a str. 301
uuccagacucaaca

SEQ ID NO: 3915610 - RNA, 17 nt, Shigella flexneri 2a str. 301
uuccagacucaacaggc

SEQ ID NO: 3915611 - RNA, 16 nt, Shigella flexneri 2a str. 301
uuccagagcagcgaau

SEQ ID NO: 3915612 - RNA, 22 nt, Shigella flexneri 2a str. 301
uuccagauugcuuaaguuuugc

SEQ ID NO: 3915613 - RNA, 20 nt, Shigella flexneri 2a str. 301
uuccagcaaaucuucgucgu

SEQ ID NO: 3915614 - RNA, 21 nt, Shigella flexneri 2a str. 301
uuccagcaaaucuucgucgug

SEQ ID NO: 3915615 - RNA, 15 nt, Shigella flexneri 2a str. 301
uuccagcaccaguuc

SEQ ID NO: 3915616 - RNA, 14 nt, Shigella flexneri 2a str. 301
uuccagcaguucca

SEQ ID NO: 3915617 - RNA, 17 nt, Shigella flexneri 2a str. 301
uuccagcaguuccagca

SEQ ID NO: 3915618 - RNA, 14 nt, Shigella flexneri 2a str. 301
uuccagcaguucgc

SEQ ID NO: 3915619 - RNA, 19 nt, Shigella flexneri 2a str. 301
uuccagcauaaugacucuc

SEQ ID NO: 3915620 - RNA, 16 nt, Shigella flexneri 2a str. 301
uuccagcaucgaccag

SEQ ID NO: 3915621 - RNA, 16 nt, Shigella flexneri 2a str. 301
uuccagcauuucuucc

SEQ ID NO: 3915622 - RNA, 14 nt, Shigella flexneri 2a str. 301
uuccagcgaauaug

SEQ ID NO: 3915623 - RNA, 23 nt, Shigella flexneri 2a str. 301
uuccagcgcaaggaaauaacguu

SEQ ID NO: 3915624 - RNA, 22 nt, Shigella flexneri 2a str. 301
uuccagcgccgccagaagggaa

SEQ ID NO: 3915625 - RNA, 15 nt, Shigella flexneri 2a str. 301
uuccagcggcaggcc

SEQ ID NO: 3915626 - RNA, 16 nt, Shigella flexneri 2a str. 301
uuccagcggcaggccg

SEQ ID NO: 3915627 - RNA, 21 nt, Shigella flexneri 2a str. 301
uuccagcguagugaaggcaaa

SEQ ID NO: 3915628 - RNA, 23 nt, Shigella flexneri 2a str. 301
uuccagcguagugaaggcaaacu

SEQ ID NO: 3915629 - RNA, 18 nt, Shigella flexneri 2a str. 301
uuccagcuccauccacca

SEQ ID NO: 3915630 - RNA, 18 nt, Shigella flexneri 2a str. 301
uuccagcucggcaaucug

SEQ ID NO: 3915631 - RNA, 14 nt, Shigella flexneri 2a str. 301
uuccagcugugcca

SEQ ID NO: 3915632 - RNA, 13 nt, Shigella flexneri 2a str. 301
uuccagcuucaaa

SEQ ID NO: 3915633 - RNA, 23 nt, Shigella flexneri 2a str. 301
uuccagcuucaaauuagccgcag

SEQ ID NO: 3915634 - RNA, 13 nt, Shigella flexneri 2a str. 301
uuccuucaacccg

SEQ ID NO: 3915635 - RNA, 18 nt, Shigella flexneri 2a str. 301
uuccuucacgugacaaaa

SEQ ID NO: 3915636 - RNA, 15 nt, Shigella flexneri 2a str. 301
uuccuucagcagcag

SEQ ID NO: 3915637 - RNA, 13 nt, Shigella flexneri 2a str. 301
uuccuucagcuuu

SEQ ID NO: 3915638 - RNA, 12 nt, Shigella flexneri 2a str. 301
uuccuugaaaaa

SEQ ID NO: 3915639 - RNA, 22 nt, Shigella flexneri 2a str. 301
uuccuugauugggguugcagaa

SEQ ID NO: 3915640 - RNA, 17 nt, Shigella flexneri 2a str. 301
uuccuuguuuaaggaaa

SEQ ID NO: 3915641 - RNA, 17 nt, Shigella flexneri 2a str. 301
uuccuuucccuauuuuu

SEQ ID NO: 3915642 - RNA, 14 nt, Shigella flexneri 2a str. 301
uucgaaaaaaaaga

SEQ ID NO: 3915643 - RNA, 15 nt, Shigella flexneri 2a str. 301
uucgaaaaaaaagaa

SEQ ID NO: 3915644 - RNA, 14 nt, Shigella flexneri 2a str. 301
uucgaaaaucucau

SEQ ID NO: 3915645 - RNA, 16 nt, Shigella flexneri 2a str. 301
uucgaaaaucucauau

SEQ ID NO: 3915646 - RNA, 21 nt, Shigella flexneri 2a str. 301
uucgaaauccagacguuccgg

SEQ ID NO: 3915647 - RNA, 18 nt, Shigella flexneri 2a str. 301
uucgaacauuucgagaau

SEQ ID NO: 3915648 - RNA, 11 nt, Shigella flexneri 2a str. 301
uucgaacugga

SEQ ID NO: 3915649 - RNA, 16 nt, Shigella flexneri 2a str. 301
uucgaagaaaccgaug

SEQ ID NO: 3915650 - RNA, 14 nt, Shigella flexneri 2a str. 301
uucgaagacaucca

SEQ ID NO: 3915651 - RNA, 17 nt, Shigella flexneri 2a str. 301
uucgaagaguuccaacg

SEQ ID NO: 3915652 - RNA, 13 nt, Shigella flexneri 2a str. 301
uucgaauuuucca

SEQ ID NO: 3915653 - RNA, 14 nt, Shigella flexneri 2a str. 301
uucgacaauaauca

SEQ ID NO: 3915654 - RNA, 17 nt, Shigella flexneri 2a str. 301
uucgacaauaaucaacg

SEQ ID NO: 3915655 - RNA, 14 nt, Shigella flexneri 2a str. 301
uucgacggcaucag

SEQ ID NO: 3915656 - RNA, 15 nt, Shigella flexneri 2a str. 301
uucgagauucuuaaa

SEQ ID NO: 3915657 - RNA, 16 nt, Shigella flexneri 2a str. 301
uucgagcaauuuuccu

SEQ ID NO: 3915658 - RNA, 18 nt, Shigella flexneri 2a str. 301
uucgagcuggaagccaca

SEQ ID NO: 3915659 - RNA, 23 nt, Shigella flexneri 2a str. 301
uucgaguacauccacugcauacu

SEQ ID NO: 3915660 - RNA, 23 nt, Shigella flexneri 2a str. 301
uucgauaaacucaaucaggcuau

SEQ ID NO: 3915661 - RNA, 17 nt, Shigella flexneri 2a str. 301
uucgauacauucagaau

SEQ ID NO: 3915662 - RNA, 20 nt, Shigella flexneri 2a str. 301
uucgauagacucccagccuc

SEQ ID NO: 3915663 - RNA, 16 nt, Shigella flexneri 2a str. 301
uucgauagcaaauugc

SEQ ID NO: 3915664 - RNA, 14 nt, Shigella flexneri 2a str. 301
uucgauauaaaccu

SEQ ID NO: 3915665 - RNA, 13 nt, Shigella flexneri 2a str. 301
uucgaucuggcag

SEQ ID NO: 3915666 - RNA, 17 nt, Shigella flexneri 2a str. 301
uucgaucuggcagcuaa

SEQ ID NO: 3915667 - RNA, 19 nt, Shigella flexneri 2a str. 301
uucgaugaugccggaauca

SEQ ID NO: 3915668 - RNA, 23 nt, Shigella flexneri 2a str. 301
uucgaugaugccggaaucaacca

SEQ ID NO: 3915669 - RNA, 16 nt, Shigella flexneri 2a str. 301
uucgauuuuuuccagc

SEQ ID NO: 3915670 - RNA, 19 nt, Shigella flexneri 2a str. 301
uucgcaaaaaaccaucccu

SEQ ID NO: 3915671 - RNA, 21 nt, Shigella flexneri 2a str. 301
uucgcaauaaucaucucuccu

SEQ ID NO: 3915672 - RNA, 15 nt, Shigella flexneri 2a str. 301
uucgcaccaaaucca

SEQ ID NO: 3915673 - RNA, 20 nt, Shigella flexneri 2a str. 301
uucgcagcuuauuucuguga

SEQ ID NO: 3915674 - RNA, 20 nt, Shigella flexneri 2a str. 301
uucgccaaaugucaccagcc

SEQ ID NO: 3915675 - RNA, 23 nt, Shigella flexneri 2a str. 301
uucgccaccguguucaugaccgu

SEQ ID NO: 3915676 - RNA, 15 nt, Shigella flexneri 2a str. 301
uucgccacuccccac

SEQ ID NO: 3915677 - RNA, 9 nt, Shigella flexneri 2a str. 301
uucgccaga

SEQ ID NO: 3915678 - RNA, 16 nt, Shigella flexneri 2a str. 301
uucgccaggacagaga

SEQ ID NO: 3915679 - RNA, 12 nt, Shigella flexneri 2a str. 301
uucgcccugcag

SEQ ID NO: 3915680 - RNA, 17 nt, Shigella flexneri 2a str. 301
uucgcccuggacaacau

SEQ ID NO: 3915681 - RNA, 20 nt, Shigella flexneri 2a str. 301
uucgcccuggacaacauucc

SEQ ID NO: 3915682 - RNA, 23 nt, Shigella flexneri 2a str. 301
uucgccgcugcgaucgcaaaucc

SEQ ID NO: 3915683 - RNA, 16 nt, Shigella flexneri 2a str. 301
uucgccgguuccagcu

SEQ ID NO: 3915684 - RNA, 14 nt, Shigella flexneri 2a str. 301
uucgccguuuucuu

SEQ ID NO: 3915685 - RNA, 20 nt, Shigella flexneri 2a str. 301
uucgccuccuguucugugcg

SEQ ID NO: 3915686 - RNA, 15 nt, Shigella flexneri 2a str. 301
uucgccugccugcag

SEQ ID NO: 3915687 - RNA, 16 nt, Shigella flexneri 2a str. 301
uucgccuuucaguuca

SEQ ID NO: 3915688 - RNA, 20 nt, Shigella flexneri 2a str. 301
uucgcgaacacccgacgugc

SEQ ID NO: 3915689 - RNA, 14 nt, Shigella flexneri 2a str. 301
uucgcgaccggcga

SEQ ID NO: 3915690 - RNA, 22 nt, Shigella flexneri 2a str. 301
uucgcgaucaaacgccagauca

SEQ ID NO: 3915691 - RNA, 16 nt, Shigella flexneri 2a str. 301
uucgcgcacaggcugc

SEQ ID NO: 3915692 - RNA, 13 nt, Shigella flexneri 2a str. 301
uucgcgcgggcag

SEQ ID NO: 3915693 - RNA, 16 nt, Shigella flexneri 2a str. 301
uucgcggaauuucaga

SEQ ID NO: 3915694 - RNA, 20 nt, Shigella flexneri 2a str. 301
uucgcggcguugaauuuaug

SEQ ID NO: 3915695 - RNA, 21 nt, Shigella flexneri 2a str. 301
uucgcggcguugaauuuaugu

SEQ ID NO: 3915696 - RNA, 16 nt, Shigella flexneri 2a str. 301
uucgcgguaaugacuc

SEQ ID NO: 3915697 - RNA, 15 nt, Shigella flexneri 2a str. 301
uucgcguacugcuga

SEQ ID NO: 3915698 - RNA, 18 nt, Shigella flexneri 2a str. 301
uucgcguaguaaagccuu

SEQ ID NO: 3915699 - RNA, 18 nt, Shigella flexneri 2a str. 301
uucgcuaaaaaaugacgu

SEQ ID NO: 3915700 - RNA, 22 nt, Shigella flexneri 2a str. 301
uucgcuaaagacuuugcugccu

SEQ ID NO: 3915701 - RNA, 23 nt, Shigella flexneri 2a str. 301
uucgcuaaggucaccaguucacg

SEQ ID NO: 3915702 - RNA, 15 nt, Shigella flexneri 2a str. 301
uucgcuaccuuucag

SEQ ID NO: 3915703 - RNA, 16 nt, Shigella flexneri 2a str. 301
uucgcuggaauaaucg

SEQ ID NO: 3915704 - RNA, 16 nt, Shigella flexneri 2a str. 301
uucgcuuaccaugcca

SEQ ID NO: 3915705 - RNA, 18 nt, Shigella flexneri 2a str. 301
uucgcuuacgccugccag

SEQ ID NO: 3915706 - RNA, 13 nt, Shigella flexneri 2a str. 301
uucgcuucuucag

SEQ ID NO: 3915707 - RNA, 22 nt, Shigella flexneri 2a str. 301
uucgcuugucacuucugccucu

SEQ ID NO: 3915708 - RNA, 17 nt, Shigella flexneri 2a str. 301
uucgcuuuaucgccuac

SEQ ID NO: 3915709 - RNA, 14 nt, Shigella flexneri 2a str. 301
uucgcuuucacuca

SEQ ID NO: 3915710 - RNA, 17 nt, Shigella flexneri 2a str. 301
uucgcuuucacucagug

SEQ ID NO: 3915711 - RNA, 14 nt, Shigella flexneri 2a str. 301
uucgcuuucaucga

SEQ ID NO: 3915712 - RNA, 18 nt, Shigella flexneri 2a str. 301
uucgcuuuggaagguaaa

SEQ ID NO: 3915713 - RNA, 16 nt, Shigella flexneri 2a str. 301
uucggacguuugccau

SEQ ID NO: 3915714 - RNA, 18 nt, Shigella flexneri 2a str. 301
uucggcaaccgcauccag

SEQ ID NO: 3915715 - RNA, 16 nt, Shigella flexneri 2a str. 301
uucggcaggcuuugcu

SEQ ID NO: 3915716 - RNA, 18 nt, Shigella flexneri 2a str. 301
uucggcagucacuuuuuu

SEQ ID NO: 3915717 - RNA, 15 nt, Shigella flexneri 2a str. 301
uucggcagugccagu

SEQ ID NO: 3915718 - RNA, 13 nt, Shigella flexneri 2a str. 301
uucggcaucagca

SEQ ID NO: 3915719 - RNA, 16 nt, Shigella flexneri 2a str. 301
uucggcgggguuuuuu

SEQ ID NO: 3915720 - RNA, 18 nt, Shigella flexneri 2a str. 301
uucgggcacagauuucca

SEQ ID NO: 3915721 - RNA, 15 nt, Shigella flexneri 2a str. 301
uucggguuauugguu

SEQ ID NO: 3915722 - RNA, 21 nt, Shigella flexneri 2a str. 301
uucggguuauugguuaacaag

SEQ ID NO: 3915723 - RNA, 23 nt, Shigella flexneri 2a str. 301
uucgguccgacgugcucgaacau

SEQ ID NO: 3915724 - RNA, 22 nt, Shigella flexneri 2a str. 301
uucggugauauacgucacuuca

SEQ ID NO: 3915725 - RNA, 17 nt, Shigella flexneri 2a str. 301
uucggugcgacaaacau

SEQ ID NO: 3915726 - RNA, 23 nt, Shigella flexneri 2a str. 301
uucggugugcagcguacuucaug

SEQ ID NO: 3915727 - RNA, 15 nt, Shigella flexneri 2a str. 301
uucgguucaaguccc

SEQ ID NO: 3915728 - RNA, 15 nt, Shigella flexneri 2a str. 301
uucgguugccagcgc

SEQ ID NO: 3915729 - RNA, 23 nt, Shigella flexneri 2a str. 301
uucguaaacgacugauugaacug

SEQ ID NO: 3915730 - RNA, 17 nt, Shigella flexneri 2a str. 301
uucguaaguacauuaaa

SEQ ID NO: 3915731 - RNA, 14 nt, Shigella flexneri 2a str. 301
uucguaauaacuca

SEQ ID NO: 3915732 - RNA, 12 nt, Shigella flexneri 2a str. 301
uucguauuuaaa

SEQ ID NO: 3915733 - RNA, 16 nt, Shigella flexneri 2a str. 301
uucgucaauaucgaga

SEQ ID NO: 3915734 - RNA, 21 nt, Shigella flexneri 2a str. 301
uucuucaauuuccgucgcaug

SEQ ID NO: 3915735 - RNA, 12 nt, Shigella flexneri 2a str. 301
uucuucacugac

SEQ ID NO: 3915736 - RNA, 14 nt, Shigella flexneri 2a str. 301
uucuucacugacgc

SEQ ID NO: 3915737 - RNA, 15 nt, Shigella flexneri 2a str. 301
uucuucagcagccca

SEQ ID NO: 3915738 - RNA, 16 nt, Shigella flexneri 2a str. 301
uucuucagcaguucag

SEQ ID NO: 3915739 - RNA, 22 nt, Shigella flexneri 2a str. 301
uucuucagcgacagggccagga

SEQ ID NO: 3915740 - RNA, 16 nt, Shigella flexneri 2a str. 301
uucuucaugccaaaag

SEQ ID NO: 3915741 - RNA, 23 nt, Shigella flexneri 2a str. 301
uucuucauucccggaaauugcca

SEQ ID NO: 3915742 - RNA, 11 nt, Shigella flexneri 2a str. 301
uucuuccagca

SEQ ID NO: 3915743 - RNA, 15 nt, Shigella flexneri 2a str. 301
uucuuccagcggcag

SEQ ID NO: 3915744 - RNA, 20 nt, Shigella flexneri 2a str. 301
uucuuccucgucccaaaagc

SEQ ID NO: 3915745 - RNA, 20 nt, Shigella flexneri 2a str. 301
uucuucgcugacaguaccca

SEQ ID NO: 3915746 - RNA, 20 nt, Shigella flexneri 2a str. 301
uucuucggucagagaaucga

SEQ ID NO: 3915747 - RNA, 22 nt, Shigella flexneri 2a str. 301
uucuucgucgucuucgucccag

SEQ ID NO: 3915748 - RNA, 19 nt, Shigella flexneri 2a str. 301
uucuucuccggcauccuua

SEQ ID NO: 3915749 - RNA, 22 nt, Shigella flexneri 2a str. 301
uucuucucgauaaaaccuuccu

SEQ ID NO: 3915750 - RNA, 14 nt, Shigella flexneri 2a str. 301
uucuucuuucagua

SEQ ID NO: 3915751 - RNA, 13 nt, Shigella flexneri 2a str. 301
uucuucuuucgcc

SEQ ID NO: 3915752 - RNA, 21 nt, Shigella flexneri 2a str. 301
uucuugcuccacguucagaga

SEQ ID NO: 3915753 - RNA, 20 nt, Shigella flexneri 2a str. 301
uucuuggcacccagcgcuuu

SEQ ID NO: 3915754 - RNA, 20 nt, Shigella flexneri 2a str. 301
uucuugguaaugacuccaac

SEQ ID NO: 3915755 - RNA, 21 nt, Shigella flexneri 2a str. 301
uucuuuauaucugguuugcca

SEQ ID NO: 3915756 - RNA, 21 nt, Shigella flexneri 2a str. 301
uucuuuauugauuaaaggaag

SEQ ID NO: 3915757 - RNA, 14 nt, Shigella flexneri 2a str. 301
uucuuucaccucuu

SEQ ID NO: 3915758 - RNA, 13 nt, Shigella flexneri 2a str. 301
uucuuucgcccaa

SEQ ID NO: 3915759 - RNA, 17 nt, Shigella flexneri 2a str. 301
uucuuucucgccuuucu

SEQ ID NO: 3915760 - RNA, 18 nt, Shigella flexneri 2a str. 301
uucuuucucgcucaguuu

SEQ ID NO: 3915761 - RNA, 21 nt, Shigella flexneri 2a str. 301
uucuuugagcuucgccuggac

SEQ ID NO: 3915762 - RNA, 21 nt, Shigella flexneri 2a str. 301
uucuuugcaugacgaucaacc

SEQ ID NO: 3915763 - RNA, 21 nt, Shigella flexneri 2a str. 301
uucuuugcugccguuaacccg

SEQ ID NO: 3915764 - RNA, 19 nt, Shigella flexneri 2a str. 301
uucuuuguagaugauuuuu

SEQ ID NO: 3915765 - RNA, 18 nt, Shigella flexneri 2a str. 301
uucuuuucgagcagguca

SEQ ID NO: 3915766 - RNA, 15 nt, Shigella flexneri 2a str. 301
uucuuuugagcgucc

SEQ ID NO: 3915767 - RNA, 11 nt, Shigella flexneri 2a str. 301
uucuuuuucaa

SEQ ID NO: 3915768 - RNA, 11 nt, Shigella flexneri 2a str. 301
uucuuuuucau

SEQ ID NO: 3915769 - RNA, 12 nt, Shigella flexneri 2a str. 301
uugaaaaacaug

SEQ ID NO: 3915770 - RNA, 19 nt, Shigella flexneri 2a str. 301
uugaaagagccgauaaaca

SEQ ID NO: 3915771 - RNA, 14 nt, Shigella flexneri 2a str. 301
uugaaauaccaggu

SEQ ID NO: 3915772 - RNA, 13 nt, Shigella flexneri 2a str. 301
uugaaauagccaa

SEQ ID NO: 3915773 - RNA, 21 nt, Shigella flexneri 2a str. 301
uugaaccuaagcuuucgagca

SEQ ID NO: 3915774 - RNA, 16 nt, Shigella flexneri 2a str. 301
uugaacgcaaauguaa

SEQ ID NO: 3915775 - RNA, 12 nt, Shigella flexneri 2a str. 301
uugaacuaucau

SEQ ID NO: 3915776 - RNA, 15 nt, Shigella flexneri 2a str. 301
uugaacucugaaucg

SEQ ID NO: 3915777 - RNA, 13 nt, Shigella flexneri 2a str. 301
uugaagaaaucag

SEQ ID NO: 3915778 - RNA, 20 nt, Shigella flexneri 2a str. 301
uugaagaacugcuugcccag

SEQ ID NO: 3915779 - RNA, 22 nt, Shigella flexneri 2a str. 301
uugaagauguugccacacgccc

SEQ ID NO: 3915780 - RNA, 19 nt, Shigella flexneri 2a str. 301
uugaagauuuugcugugcu

SEQ ID NO: 3915781 - RNA, 13 nt, Shigella flexneri 2a str. 301
uugaagcaaucca

SEQ ID NO: 3915782 - RNA, 21 nt, Shigella flexneri 2a str. 301
uugaagcccaguaccgccagu

SEQ ID NO: 3915783 - RNA, 18 nt, Shigella flexneri 2a str. 301
uugaaggcagcauucgcc

SEQ ID NO: 3915784 - RNA, 23 nt, Shigella flexneri 2a str. 301
uugaaggguauugccgaugaacg

SEQ ID NO: 3915785 - RNA, 17 nt, Shigella flexneri 2a str. 301
uugaagucuuuuuucaa

SEQ ID NO: 3915786 - RNA, 20 nt, Shigella flexneri 2a str. 301
uugaagucuuuuuucaacuu

SEQ ID NO: 3915787 - RNA, 21 nt, Shigella flexneri 2a str. 301
uugaauaaauuggcuggggua

SEQ ID NO: 3915788 - RNA, 15 nt, Shigella flexneri 2a str. 301
uugaauaucuccucu

SEQ ID NO: 3915789 - RNA, 16 nt, Shigella flexneri 2a str. 301
uugaauaucuccucug

SEQ ID NO: 3915790 - RNA, 19 nt, Shigella flexneri 2a str. 301
uugaauuuauguuuccuua

SEQ ID NO: 3915791 - RNA, 13 nt, Shigella flexneri 2a str. 301
uugacaaagugcg

SEQ ID NO: 3915792 - RNA, 11 nt, Shigella flexneri 2a str. 301
uugacaacauc

SEQ ID NO: 3915793 - RNA, 19 nt, Shigella flexneri 2a str. 301
uugacaacucaucacugua

SEQ ID NO: 3915794 - RNA, 13 nt, Shigella flexneri 2a str. 301
uugacauguugcu

SEQ ID NO: 3915795 - RNA, 12 nt, Shigella flexneri 2a str. 301
uugaccugaaua

SEQ ID NO: 3915796 - RNA, 21 nt, Shigella flexneri 2a str. 301
uugaccuugcggcuuaacugu

SEQ ID NO: 3915797 - RNA, 18 nt, Shigella flexneri 2a str. 301
uugacgugucuuaucagg

SEQ ID NO: 3915798 - RNA, 23 nt, Shigella flexneri 2a str. 301
uugacucgccuucaggaauacgc

SEQ ID NO: 3915799 - RNA, 13 nt, Shigella flexneri 2a str. 301
uugacucggaguc

SEQ ID NO: 3915800 - RNA, 12 nt, Shigella flexneri 2a str. 301
uugacucucauc

SEQ ID NO: 3915801 - RNA, 14 nt, Shigella flexneri 2a str. 301
uugacucucaucca

SEQ ID NO: 3915802 - RNA, 13 nt, Shigella flexneri 2a str. 301
uugacugaaauuu

SEQ ID NO: 3915803 - RNA, 23 nt, Shigella flexneri 2a str. 301
uugacuuauaugcgcgaauacga

SEQ ID NO: 3915804 - RNA, 16 nt, Shigella flexneri 2a str. 301
uugagaacgacaguga

SEQ ID NO: 3915805 - RNA, 16 nt, Shigella flexneri 2a str. 301
uugagauagccuucgg

SEQ ID NO: 3915806 - RNA, 22 nt, Shigella flexneri 2a str. 301
uugagaugguuacuuuuuaugu

SEQ ID NO: 3915807 - RNA, 15 nt, Shigella flexneri 2a str. 301
uugagcaaucgacgc

SEQ ID NO: 3915808 - RNA, 19 nt, Shigella flexneri 2a str. 301
uugagcaggagcagcaggu

SEQ ID NO: 3915809 - RNA, 15 nt, Shigella flexneri 2a str. 301
uugagcauugccgcc

SEQ ID NO: 3915810 - RNA, 16 nt, Shigella flexneri 2a str. 301
uugagcgaaaacgaau

SEQ ID NO: 3915811 - RNA, 16 nt, Shigella flexneri 2a str. 301
uugagcguauccagca

SEQ ID NO: 3915812 - RNA, 18 nt, Shigella flexneri 2a str. 301
uugaggaacucaaaccau

SEQ ID NO: 3915813 - RNA, 15 nt, Shigella flexneri 2a str. 301
uugaggcacaucuua

SEQ ID NO: 3915814 - RNA, 17 nt, Shigella flexneri 2a str. 301
uugagguguacuggcaa

SEQ ID NO: 3915815 - RNA, 22 nt, Shigella flexneri 2a str. 301
uugaguaagcaggguugcagcc

SEQ ID NO: 3915816 - RNA, 16 nt, Shigella flexneri 2a str. 301
uugaguauuuaccaga

SEQ ID NO: 3915817 - RNA, 15 nt, Shigella flexneri 2a str. 301
uugaguucacugccg

SEQ ID NO: 3915818 - RNA, 18 nt, Shigella flexneri 2a str. 301
uugaguuggcaugcguau

SEQ ID NO: 3915819 - RNA, 21 nt, Shigella flexneri 2a str. 301
uugaguuuuucaucccucuca

SEQ ID NO: 3915820 - RNA, 13 nt, Shigella flexneri 2a str. 301
uugauaaaaaaaa

SEQ ID NO: 3915821 - RNA, 17 nt, Shigella flexneri 2a str. 301
uugauaaggaaauucag

SEQ ID NO: 3915822 - RNA, 16 nt, Shigella flexneri 2a str. 301
uugauaauaaagcuac

SEQ ID NO: 3915823 - RNA, 13 nt, Shigella flexneri 2a str. 301
uugauaauguuau

SEQ ID NO: 3915824 - RNA, 12 nt, Shigella flexneri 2a str. 301
uugauauccgca

SEQ ID NO: 3915825 - RNA, 18 nt, Shigella flexneri 2a str. 301
uugauauuuauuuccuuc

SEQ ID NO: 3915826 - RNA, 16 nt, Shigella flexneri 2a str. 301
uugaucacuuccagca

SEQ ID NO: 3915827 - RNA, 21 nt, Shigella flexneri 2a str. 301
uugaucacuuccagcaguucg

SEQ ID NO: 3915828 - RNA, 23 nt, Shigella flexneri 2a str. 301
uugaucagccaggcgaugaaauu

SEQ ID NO: 3915829 - RNA, 13 nt, Shigella flexneri 2a str. 301
uugauccaggagc

SEQ ID NO: 3915830 - RNA, 21 nt, Shigella flexneri 2a str. 301
uugauccaggagcuccagguc

SEQ ID NO: 3915831 - RNA, 16 nt, Shigella flexneri 2a str. 301
uugaucgccaaagaaa

SEQ ID NO: 3915832 - RNA, 13 nt, Shigella flexneri 2a str. 301
uugaucucaaacg

SEQ ID NO: 3915833 - RNA, 20 nt, Shigella flexneri 2a str. 301
uugaugaguugaaaaccucu

SEQ ID NO: 3915834 - RNA, 17 nt, Shigella flexneri 2a str. 301
uugcgaucgaccugcgc

SEQ ID NO: 3915835 - RNA, 19 nt, Shigella flexneri 2a str. 301
uugcgcaacggugcggcuc

SEQ ID NO: 3915836 - RNA, 17 nt, Shigella flexneri 2a str. 301
uugcgcaacugaggcaa

SEQ ID NO: 3915837 - RNA, 23 nt, Shigella flexneri 2a str. 301
uugcgcaccggguaaugacucca

SEQ ID NO: 3915838 - RNA, 14 nt, Shigella flexneri 2a str. 301
uugcgcaugacaca

SEQ ID NO: 3915839 - RNA, 21 nt, Shigella flexneri 2a str. 301
uugcgccgguuuaucuccgcu

SEQ ID NO: 3915840 - RNA, 15 nt, Shigella flexneri 2a str. 301
uugcgccugcuuaac

SEQ ID NO: 3915841 - RNA, 17 nt, Shigella flexneri 2a str. 301
uugcgcgacuuuuuccu

SEQ ID NO: 3915842 - RNA, 24 nt, Shigella flexneri 2a str. 301
uugcgcggauggccucugccagcu

SEQ ID NO: 3915843 - RNA, 17 nt, Shigella flexneri 2a str. 301
uugcgcuaaaaaguucc

SEQ ID NO: 3915844 - RNA, 13 nt, Shigella flexneri 2a str. 301
uugcgcugaagua

SEQ ID NO: 3915845 - RNA, 15 nt, Shigella flexneri 2a str. 301
uugcgcugaaguaau

SEQ ID NO: 3915846 - RNA, 14 nt, Shigella flexneri 2a str. 301
uugcgcuggcaccg

SEQ ID NO: 3915847 - RNA, 19 nt, Shigella flexneri 2a str. 301
uugcggaaacugucaauaa

SEQ ID NO: 3915848 - RNA, 20 nt, Shigella flexneri 2a str. 301
uugcggaaauuccagcggca

SEQ ID NO: 3915849 - RNA, 13 nt, Shigella flexneri 2a str. 301
uugcggcacccau

SEQ ID NO: 3915850 - RNA, 20 nt, Shigella flexneri 2a str. 301
uugcggcuacacuauuuccu

SEQ ID NO: 3915851 - RNA, 23 nt, Shigella flexneri 2a str. 301
uugcggcuuuugaagcugaacgu

SEQ ID NO: 3915852 - RNA, 18 nt, Shigella flexneri 2a str. 301
uugcgggccaaagaccag

SEQ ID NO: 3915853 - RNA, 19 nt, Shigella flexneri 2a str. 301
uugcgguaagcugaugacg

SEQ ID NO: 3915854 - RNA, 15 nt, Shigella flexneri 2a str. 301
uugcgguuucaacug

SEQ ID NO: 3915855 - RNA, 12 nt, Shigella flexneri 2a str. 301
uugcguaacuga

SEQ ID NO: 3915856 - RNA, 20 nt, Shigella flexneri 2a str. 301
uugcguacaccaacaucacg

SEQ ID NO: 3915857 - RNA, 13 nt, Shigella flexneri 2a str. 301
uugcgucaaugcc

SEQ ID NO: 3915858 - RNA, 12 nt, Shigella flexneri 2a str. 301
uugcgucauggu

SEQ ID NO: 3915859 - RNA, 16 nt, Shigella flexneri 2a str. 301
uugcguccauuuugag

SEQ ID NO: 3915860 - RNA, 17 nt, Shigella flexneri 2a str. 301
uugcguggcgauuugag

SEQ ID NO: 3915861 - RNA, 16 nt, Shigella flexneri 2a str. 301
uugcgugguuuuugcu

SEQ ID NO: 3915862 - RNA, 19 nt, Shigella flexneri 2a str. 301
uugcgugguuuuugcugac

SEQ ID NO: 3915863 - RNA, 14 nt, Shigella flexneri 2a str. 301
uugcguuaacugcu

SEQ ID NO: 3915864 - RNA, 18 nt, Shigella flexneri 2a str. 301
uugcguucaucaguucca

SEQ ID NO: 3915865 - RNA, 13 nt, Shigella flexneri 2a str. 301
uugcguuucugac

SEQ ID NO: 3915866 - RNA, 18 nt, Shigella flexneri 2a str. 301
uugcuaacuggaaaggaa

SEQ ID NO: 3915867 - RNA, 17 nt, Shigella flexneri 2a str. 301
uugcuaccgcgaugacc

SEQ ID NO: 3915868 - RNA, 23 nt, Shigella flexneri 2a str. 301
uugcuaccgcuucgcucacauca

SEQ ID NO: 3915869 - RNA, 19 nt, Shigella flexneri 2a str. 301
uugcuaucgcgaaucccua

SEQ ID NO: 3915870 - RNA, 15 nt, Shigella flexneri 2a str. 301
uugcuaucgggaaua

SEQ ID NO: 3915871 - RNA, 21 nt, Shigella flexneri 2a str. 301
uugcuauuuccaccucccccu

SEQ ID NO: 3915872 - RNA, 16 nt, Shigella flexneri 2a str. 301
uugcucaaauccauca

SEQ ID NO: 3915873 - RNA, 14 nt, Shigella flexneri 2a str. 301
uugcucaacccuuu

SEQ ID NO: 3915874 - RNA, 19 nt, Shigella flexneri 2a str. 301
uugcucaacccuuuccagc

SEQ ID NO: 3915875 - RNA, 16 nt, Shigella flexneri 2a str. 301
uugcucauaaaaugau

SEQ ID NO: 3915876 - RNA, 16 nt, Shigella flexneri 2a str. 301
uugcucauccauugcu

SEQ ID NO: 3915877 - RNA, 17 nt, Shigella flexneri 2a str. 301
uugcuccuuaauaaaau

SEQ ID NO: 3915878 - RNA, 20 nt, Shigella flexneri 2a str. 301
uugcucugguucaccauucu

SEQ ID NO: 3915879 - RNA, 14 nt, Shigella flexneri 2a str. 301
uugcugaacucgac

SEQ ID NO: 3915880 - RNA, 21 nt, Shigella flexneri 2a str. 301
uugcugacggccguugugacu

SEQ ID NO: 3915881 - RNA, 15 nt, Shigella flexneri 2a str. 301
uugcugauucucccu

SEQ ID NO: 3915882 - RNA, 14 nt, Shigella flexneri 2a str. 301
uugcugcaccaggc

SEQ ID NO: 3915883 - RNA, 19 nt, Shigella flexneri 2a str. 301
uugcugccguuuucaaagg

SEQ ID NO: 3915884 - RNA, 13 nt, Shigella flexneri 2a str. 301
uugcugccuucac

SEQ ID NO: 3915885 - RNA, 20 nt, Shigella flexneri 2a str. 301
uugcugcgccccacaccacc

SEQ ID NO: 3915886 - RNA, 15 nt, Shigella flexneri 2a str. 301
uugcugcguggaauu

SEQ ID NO: 3915887 - RNA, 19 nt, Shigella flexneri 2a str. 301
uugcugcguggaauuuguc

SEQ ID NO: 3915888 - RNA, 15 nt, Shigella flexneri 2a str. 301
uugcugcugaagcaa

SEQ ID NO: 3915889 - RNA, 12 nt, Shigella flexneri 2a str. 301
uugcugcugccg

SEQ ID NO: 3915890 - RNA, 13 nt, Shigella flexneri 2a str. 301
uugcuggaaaacc

SEQ ID NO: 3915891 - RNA, 15 nt, Shigella flexneri 2a str. 301
uugcuggacuugaac

SEQ ID NO: 3915892 - RNA, 12 nt, Shigella flexneri 2a str. 301
uugcuguacaua

SEQ ID NO: 3915893 - RNA, 20 nt, Shigella flexneri 2a str. 301
uugcuguaucacuaugaaaa

SEQ ID NO: 3915894 - RNA, 14 nt, Shigella flexneri 2a str. 301
uugcuguugguuca

SEQ ID NO: 3915895 - RNA, 14 nt, Shigella flexneri 2a str. 301
uugcuguuguucaa

SEQ ID NO: 3915896 - RNA, 14 nt, Shigella flexneri 2a str. 301
uugcuuaacugacu

SEQ ID NO: 3915897 - RNA, 16 nt, Shigella flexneri 2a str. 301
uugcuuaaguuuugca

SEQ ID NO: 3915898 - RNA, 18 nt, Shigella flexneri 2a str. 301
uugcuucaagaugccauu

SEQ ID NO: 3915899 - RNA, 13 nt, Shigella flexneri 2a str. 301
uugcuucgccagu

SEQ ID NO: 3915900 - RNA, 12 nt, Shigella flexneri 2a str. 301
uugcuucucuug

SEQ ID NO: 3915901 - RNA, 15 nt, Shigella flexneri 2a str. 301
uugcuuguucgaugc

SEQ ID NO: 3915902 - RNA, 13 nt, Shigella flexneri 2a str. 301
uugcuuuccagcu

SEQ ID NO: 3915903 - RNA, 13 nt, Shigella flexneri 2a str. 301
uugcuuuuacauu

SEQ ID NO: 3915904 - RNA, 17 nt, Shigella flexneri 2a str. 301
uugcuuuugauguuuga

SEQ ID NO: 3915905 - RNA, 13 nt, Shigella flexneri 2a str. 301
uuggaauacauau

SEQ ID NO: 3915906 - RNA, 22 nt, Shigella flexneri 2a str. 301
uuggagacugaugacaaacgca

SEQ ID NO: 3915907 - RNA, 16 nt, Shigella flexneri 2a str. 301
uuggauaggcaccgcc

SEQ ID NO: 3915908 - RNA, 23 nt, Shigella flexneri 2a str. 301
uuggauaggcaccgccaaagaua

SEQ ID NO: 3915909 - RNA, 18 nt, Shigella flexneri 2a str. 301
uuggaucuguugcuggcu

SEQ ID NO: 3915910 - RNA, 21 nt, Shigella flexneri 2a str. 301
uuggcaaagugccgaacguac

SEQ ID NO: 3915911 - RNA, 14 nt, Shigella flexneri 2a str. 301
uuggcaaauacaaa

SEQ ID NO: 3915912 - RNA, 16 nt, Shigella flexneri 2a str. 301
uuggcaagauaggcau

SEQ ID NO: 3915913 - RNA, 16 nt, Shigella flexneri 2a str. 301
uuggcaaucagcggca

SEQ ID NO: 3915914 - RNA, 15 nt, Shigella flexneri 2a str. 301
uuggcacccagcgcu

SEQ ID NO: 3915915 - RNA, 16 nt, Shigella flexneri 2a str. 301
uuggcgauaccccaac

SEQ ID NO: 3915916 - RNA, 16 nt, Shigella flexneri 2a str. 301
uuggcgcaauagcacu

SEQ ID NO: 3915917 - RNA, 20 nt, Shigella flexneri 2a str. 301
uuggcgcacaaugccugaug

SEQ ID NO: 3915918 - RNA, 21 nt, Shigella flexneri 2a str. 301
uuggcgcauaacucaccauca

SEQ ID NO: 3915919 - RNA, 18 nt, Shigella flexneri 2a str. 301
uuggcucaacaacugcgc

SEQ ID NO: 3915920 - RNA, 20 nt, Shigella flexneri 2a str. 301
uuggcugggguacgaggauu

SEQ ID NO: 3915921 - RNA, 18 nt, Shigella flexneri 2a str. 301
uugggcaauucaccguaa

SEQ ID NO: 3915922 - RNA, 17 nt, Shigella flexneri 2a str. 301
uugggcauuugcacaau

SEQ ID NO: 3915923 - RNA, 17 nt, Shigella flexneri 2a str. 301
uugggcgaucucccgcu

SEQ ID NO: 3915924 - RNA, 13 nt, Shigella flexneri 2a str. 301
uuggggagacuaa

SEQ ID NO: 3915925 - RNA, 19 nt, Shigella flexneri 2a str. 301
uuggggauuaucugaauca

SEQ ID NO: 3915926 - RNA, 13 nt, Shigella flexneri 2a str. 301
uuggguaacagcc

SEQ ID NO: 3915927 - RNA, 16 nt, Shigella flexneri 2a str. 301
uugggucgugauuaca

SEQ ID NO: 3915928 - RNA, 13 nt, Shigella flexneri 2a str. 301
uugguaaugacuc

SEQ ID NO: 3915929 - RNA, 16 nt, Shigella flexneri 2a str. 301
uugguacauaacacaa

SEQ ID NO: 3915930 - RNA, 17 nt, Shigella flexneri 2a str. 301
uuggucagcucaaagcg

SEQ ID NO: 3915931 - RNA, 16 nt, Shigella flexneri 2a str. 301
uugguccuggucugau

SEQ ID NO: 3915932 - RNA, 14 nt, Shigella flexneri 2a str. 301
uuggugaacagcau

SEQ ID NO: 3915933 - RNA, 21 nt, Shigella flexneri 2a str. 301
uuggugauaaaacgcagucuu

SEQ ID NO: 3915934 - RNA, 22 nt, Shigella flexneri 2a str. 301
uuggugauauucauggugaaua

SEQ ID NO: 3915935 - RNA, 15 nt, Shigella flexneri 2a str. 301
uuuacaagcaacuug

SEQ ID NO: 3915936 - RNA, 15 nt, Shigella flexneri 2a str. 301
uuuacaauaaccauu

SEQ ID NO: 3915937 - RNA, 17 nt, Shigella flexneri 2a str. 301
uuuacagauuucccauu

SEQ ID NO: 3915938 - RNA, 22 nt, Shigella flexneri 2a str. 301
uuuacagcccuggcucugcacu

SEQ ID NO: 3915939 - RNA, 17 nt, Shigella flexneri 2a str. 301
uuuacagccugccagca

SEQ ID NO: 3915940 - RNA, 16 nt, Shigella flexneri 2a str. 301
uuuacagcuuagcgcc

SEQ ID NO: 3915941 - RNA, 14 nt, Shigella flexneri 2a str. 301
uuuacauccggcaa

SEQ ID NO: 3915942 - RNA, 13 nt, Shigella flexneri 2a str. 301
uuuaccaauauaa

SEQ ID NO: 3915943 - RNA, 20 nt, Shigella flexneri 2a str. 301
uuuaccaauauaauuccauu

SEQ ID NO: 3915944 - RNA, 18 nt, Shigella flexneri 2a str. 301
uuuaccaccgucaaaaaa

SEQ ID NO: 3915945 - RNA, 19 nt, Shigella flexneri 2a str. 301
uuuaccaccgucaaaaaaa

SEQ ID NO: 3915946 - RNA, 20 nt, Shigella flexneri 2a str. 301
uuuaccaccgucaaaaaaac

SEQ ID NO: 3915947 - RNA, 21 nt, Shigella flexneri 2a str. 301
uuuaccaccgucaaaaaaacg

SEQ ID NO: 3915948 - RNA, 13 nt, Shigella flexneri 2a str. 301
uuuaccagcagcc

SEQ ID NO: 3915949 - RNA, 16 nt, Shigella flexneri 2a str. 301
uuuacccaauccccca

SEQ ID NO: 3915950 - RNA, 14 nt, Shigella flexneri 2a str. 301
uuuacccagcagca

SEQ ID NO: 3915951 - RNA, 11 nt, Shigella flexneri 2a str. 301
uuuacccagcg

SEQ ID NO: 3915952 - RNA, 11 nt, Shigella flexneri 2a str. 301
uuuacccuucg

SEQ ID NO: 3915953 - RNA, 22 nt, Shigella flexneri 2a str. 301
uuuaccgcgaccaccaccaaac

SEQ ID NO: 3915954 - RNA, 23 nt, Shigella flexneri 2a str. 301
uuuaccggucaggauuuccagcu

SEQ ID NO: 3915955 - RNA, 13 nt, Shigella flexneri 2a str. 301
uuuaccugauccu

SEQ ID NO: 3915956 - RNA, 20 nt, Shigella flexneri 2a str. 301
uuuaccugcuuaaucauauu

SEQ ID NO: 3915957 - RNA, 14 nt, Shigella flexneri 2a str. 301
uuuaccuucauuug

SEQ ID NO: 3915958 - RNA, 17 nt, Shigella flexneri 2a str. 301
uuuaccuugcucaucca

SEQ ID NO: 3915959 - RNA, 21 nt, Shigella flexneri 2a str. 301
uuuacgaagaaagcaauauug

SEQ ID NO: 3915960 - RNA, 16 nt, Shigella flexneri 2a str. 301
uuuacgcaaccacaaa

SEQ ID NO: 3915961 - RNA, 19 nt, Shigella flexneri 2a str. 301
uuuacgccgcaucaggcau

SEQ ID NO: 3915962 - RNA, 14 nt, Shigella flexneri 2a str. 301
uuuacgccgcaucc

SEQ ID NO: 3915963 - RNA, 19 nt, Shigella flexneri 2a str. 301
uuuacgccgcauccggcaa

SEQ ID NO: 3915964 - RNA, 19 nt, Shigella flexneri 2a str. 301
uuuacgccgcauccggcau

SEQ ID NO: 3915965 - RNA, 18 nt, Shigella flexneri 2a str. 301
uuuacgcucccacggaau

SEQ ID NO: 3915966 - RNA, 20 nt, Shigella flexneri 2a str. 301
uuuacgggccggauacgcca

SEQ ID NO: 3915967 - RNA, 19 nt, Shigella flexneri 2a str. 301
uuuacuacguaauuucaau

SEQ ID NO: 3915968 - RNA, 15 nt, Shigella flexneri 2a str. 301
uuuacuauuauuuuu

SEQ ID NO: 3915969 - RNA, 24 nt, Shigella flexneri 2a str. 301
uuuacuauuauuuuucauauggau

SEQ ID NO: 3915970 - RNA, 22 nt, Shigella flexneri 2a str. 301
uuuacucccguucauucaacuu

SEQ ID NO: 3915971 - RNA, 22 nt, Shigella flexneri 2a str. 301
uuuacugacuagaugugcaguu

SEQ ID NO: 3915972 - RNA, 16 nt, Shigella flexneri 2a str. 301
uuuacugucugcuucu

SEQ ID NO: 3915973 - RNA, 13 nt, Shigella flexneri 2a str. 301
uuuacuucucagc

SEQ ID NO: 3915974 - RNA, 14 nt, Shigella flexneri 2a str. 301
uuuagagaauuaau

SEQ ID NO: 3915975 - RNA, 13 nt, Shigella flexneri 2a str. 301
uuuagcaaacuga

SEQ ID NO: 3915976 - RNA, 13 nt, Shigella flexneri 2a str. 301
uuuagcauaaaaa

SEQ ID NO: 3915977 - RNA, 11 nt, Shigella flexneri 2a str. 301
uuuagcgccag

SEQ ID NO: 3915978 - RNA, 17 nt, Shigella flexneri 2a str. 301
uuuagguacaaagccaa

SEQ ID NO: 3915979 - RNA, 12 nt, Shigella flexneri 2a str. 301
uuuauaaagaac

SEQ ID NO: 3915980 - RNA, 17 nt, Shigella flexneri 2a str. 301
uuuauaccaacaaaaaa

SEQ ID NO: 3915981 - RNA, 14 nt, Shigella flexneri 2a str. 301
uuuauacucaguca

SEQ ID NO: 3915982 - RNA, 16 nt, Shigella flexneri 2a str. 301
uuuauagggugccauu

SEQ ID NO: 3915983 - RNA, 15 nt, Shigella flexneri 2a str. 301
uuuaucaccaaugau

SEQ ID NO: 3915984 - RNA, 22 nt, Shigella flexneri 2a str. 301
uuuaucacgcaaccacaacgca

SEQ ID NO: 3915985 - RNA, 12 nt, Shigella flexneri 2a str. 301
uuuaucacugag

SEQ ID NO: 3915986 - RNA, 16 nt, Shigella flexneri 2a str. 301
uuuaucacugugaugg

SEQ ID NO: 3915987 - RNA, 21 nt, Shigella flexneri 2a str. 301
uuuaucagaccgcuucugcgu

SEQ ID NO: 3915988 - RNA, 12 nt, Shigella flexneri 2a str. 301
uuuaucaggcca

SEQ ID NO: 3915989 - RNA, 20 nt, Shigella flexneri 2a str. 301
uuuaucgaucacauccagua

SEQ ID NO: 3915990 - RNA, 15 nt, Shigella flexneri 2a str. 301
uuuaucggucuuagc

SEQ ID NO: 3915991 - RNA, 18 nt, Shigella flexneri 2a str. 301
uuuaucucuuacagaaau

SEQ ID NO: 3915992 - RNA, 20 nt, Shigella flexneri 2a str. 301
uuuaucugucuguacggcag

SEQ ID NO: 3915993 - RNA, 13 nt, Shigella flexneri 2a str. 301
uuuaucuucccag

SEQ ID NO: 3915994 - RNA, 18 nt, Shigella flexneri 2a str. 301
uuuaucuucccagcgcag

SEQ ID NO: 3915995 - RNA, 15 nt, Shigella flexneri 2a str. 301
uuuaugauauuuuuu

SEQ ID NO: 3915996 - RNA, 23 nt, Shigella flexneri 2a str. 301
uuuaugcccgcgauaaauaaacu

SEQ ID NO: 3915997 - RNA, 17 nt, Shigella flexneri 2a str. 301
uuuaugcgcuaaauguu

SEQ ID NO: 3915998 - RNA, 22 nt, Shigella flexneri 2a str. 301
uuuaugcggcggaacaucaaag

SEQ ID NO: 3915999 - RNA, 16 nt, Shigella flexneri 2a str. 301
uuuaugggagauuuua

SEQ ID NO: 3916000 - RNA, 14 nt, Shigella flexneri 2a str. 301
uuuauguucagaua

SEQ ID NO: 3916001 - RNA, 18 nt, Shigella flexneri 2a str. 301
uuuauuaaugacauucag

SEQ ID NO: 3916002 - RNA, 20 nt, Shigella flexneri 2a str. 301
uuuauuaugccacagagaau

SEQ ID NO: 3916003 - RNA, 11 nt, Shigella flexneri 2a str. 301
uuuauuauucc

SEQ ID NO: 3916004 - RNA, 13 nt, Shigella flexneri 2a str. 301
uuuauuauuguuu

SEQ ID NO: 3916005 - RNA, 14 nt, Shigella flexneri 2a str. 301
uuuauucaccagua

SEQ ID NO: 3916006 - RNA, 20 nt, Shigella flexneri 2a str. 301
uuuauucggcauacauaauc

SEQ ID NO: 3916007 - RNA, 20 nt, Shigella flexneri 2a str. 301
uuuauucugacgccaccauu

SEQ ID NO: 3916008 - RNA, 12 nt, Shigella flexneri 2a str. 301
uuuauuucagua

SEQ ID NO: 3916009 - RNA, 21 nt, Shigella flexneri 2a str. 301
uuuauuugacccgcaguaaau

SEQ ID NO: 3916010 - RNA, 13 nt, Shigella flexneri 2a str. 301
uuuauuuuuccuc

SEQ ID NO: 3916011 - RNA, 12 nt, Shigella flexneri 2a str. 301
uuucaaaaacaa

SEQ ID NO: 3916012 - RNA, 16 nt, Shigella flexneri 2a str. 301
uuucaaaaacaaagaa

SEQ ID NO: 3916013 - RNA, 16 nt, Shigella flexneri 2a str. 301
uuucaaaacggucacg

SEQ ID NO: 3916014 - RNA, 12 nt, Shigella flexneri 2a str. 301
uuucaaacgcca

SEQ ID NO: 3916015 - RNA, 18 nt, Shigella flexneri 2a str. 301
uuucaaacucuucacacc

SEQ ID NO: 3916016 - RNA, 13 nt, Shigella flexneri 2a str. 301
uuucaaauuguuc

SEQ ID NO: 3916017 - RNA, 23 nt, Shigella flexneri 2a str. 301
uuucaacaaccuugcguuuuuca

SEQ ID NO: 3916018 - RNA, 18 nt, Shigella flexneri 2a str. 301
uuucaacaauacaaaugc

SEQ ID NO: 3916019 - RNA, 15 nt, Shigella flexneri 2a str. 301
uuucaaccuaaagua

SEQ ID NO: 3916020 - RNA, 17 nt, Shigella flexneri 2a str. 301
uuucaaccuaaaguaaa

SEQ ID NO: 3916021 - RNA, 23 nt, Shigella flexneri 2a str. 301
uuucaacgacccagccagacgcc

SEQ ID NO: 3916022 - RNA, 19 nt, Shigella flexneri 2a str. 301
uuucaacgccccauuuuua

SEQ ID NO: 3916023 - RNA, 17 nt, Shigella flexneri 2a str. 301
uuucaacggaccaauaa

SEQ ID NO: 3916024 - RNA, 21 nt, Shigella flexneri 2a str. 301
uuucaagcucaaaauaauaca

SEQ ID NO: 3916025 - RNA, 23 nt, Shigella flexneri 2a str. 301
uuucaagcucaaaauaauacaca

SEQ ID NO: 3916026 - RNA, 19 nt, Shigella flexneri 2a str. 301
uuucaauaucguuaucacc

SEQ ID NO: 3916027 - RNA, 15 nt, Shigella flexneri 2a str. 301
uuucaaugcucugca

SEQ ID NO: 3916028 - RNA, 23 nt, Shigella flexneri 2a str. 301
uuucaauucacgaauauuucccg

SEQ ID NO: 3916029 - RNA, 20 nt, Shigella flexneri 2a str. 301
uuucacaggaaaaacuuuua

SEQ ID NO: 3916030 - RNA, 14 nt, Shigella flexneri 2a str. 301
uuucacaguacgcu

SEQ ID NO: 3916031 - RNA, 22 nt, Shigella flexneri 2a str. 301
uuucacaguacgcuugauuucu

SEQ ID NO: 3916032 - RNA, 17 nt, Shigella flexneri 2a str. 301
uuucacauguucauuua

SEQ ID NO: 3916033 - RNA, 20 nt, Shigella flexneri 2a str. 301
uuucaccaacgaugaagaga

SEQ ID NO: 3916034 - RNA, 17 nt, Shigella flexneri 2a str. 301
uuucaccgaugcacaga

SEQ ID NO: 3916035 - RNA, 22 nt, Shigella flexneri 2a str. 301
uuucgccggacgucaggccgcc

SEQ ID NO: 3916036 - RNA, 17 nt, Shigella flexneri 2a str. 301
uuucgccuuucugcaau

SEQ ID NO: 3916037 - RNA, 19 nt, Shigella flexneri 2a str. 301
uuucgcggcauaacagaau

SEQ ID NO: 3916038 - RNA, 16 nt, Shigella flexneri 2a str. 301
uuucgcugucgguacu

SEQ ID NO: 3916039 - RNA, 22 nt, Shigella flexneri 2a str. 301
uuucgcuucaaccaccucagua

SEQ ID NO: 3916040 - RNA, 13 nt, Shigella flexneri 2a str. 301
uuucgcuucuuca

SEQ ID NO: 3916041 - RNA, 17 nt, Shigella flexneri 2a str. 301
uuucgcuucuucagccu

SEQ ID NO: 3916042 - RNA, 17 nt, Shigella flexneri 2a str. 301
uuucgcuuuacucccgu

SEQ ID NO: 3916043 - RNA, 16 nt, Shigella flexneri 2a str. 301
uuucggcaucagcaga

SEQ ID NO: 3916044 - RNA, 19 nt, Shigella flexneri 2a str. 301
uuucggugaauucagcgac

SEQ ID NO: 3916045 - RNA, 23 nt, Shigella flexneri 2a str. 301
uuucguagacugcagcggucaca

SEQ ID NO: 3916046 - RNA, 11 nt, Shigella flexneri 2a str. 301
uuucgucgcua

SEQ ID NO: 3916047 - RNA, 22 nt, Shigella flexneri 2a str. 301
uuucgucugguucgccaaaugu

SEQ ID NO: 3916048 - RNA, 13 nt, Shigella flexneri 2a str. 301
uuucuaauauuag

SEQ ID NO: 3916049 - RNA, 12 nt, Shigella flexneri 2a str. 301
uuucuacaagca

SEQ ID NO: 3916050 - RNA, 13 nt, Shigella flexneri 2a str. 301
uuucuaccagguu

SEQ ID NO: 3916051 - RNA, 19 nt, Shigella flexneri 2a str. 301
uuucuaugagaaaauuuca

SEQ ID NO: 3916052 - RNA, 14 nt, Shigella flexneri 2a str. 301
uuucucauccgcag

SEQ ID NO: 3916053 - RNA, 15 nt, Shigella flexneri 2a str. 301
uuucucauccgcagu

SEQ ID NO: 3916054 - RNA, 17 nt, Shigella flexneri 2a str. 301
uuucucauuacagcgac

SEQ ID NO: 3916055 - RNA, 14 nt, Shigella flexneri 2a str. 301
uuucucauuuuuua

SEQ ID NO: 3916056 - RNA, 20 nt, Shigella flexneri 2a str. 301
uuucuccccauggacgcguc

SEQ ID NO: 3916057 - RNA, 10 nt, Shigella flexneri 2a str. 301
uuucuccccc

SEQ ID NO: 3916058 - RNA, 11 nt, Shigella flexneri 2a str. 301
uuucucccccc

SEQ ID NO: 3916059 - RNA, 14 nt, Shigella flexneri 2a str. 301
uuucuccccccucu

SEQ ID NO: 3916060 - RNA, 17 nt, Shigella flexneri 2a str. 301
uuucuccuucacucuau

SEQ ID NO: 3916061 - RNA, 22 nt, Shigella flexneri 2a str. 301
uuucucgccaccggcacaucca

SEQ ID NO: 3916062 - RNA, 21 nt, Shigella flexneri 2a str. 301
uuucucggaucgcacaaucca

SEQ ID NO: 3916063 - RNA, 19 nt, Shigella flexneri 2a str. 301
uuucucugcaaauauuaau

SEQ ID NO: 3916064 - RNA, 12 nt, Shigella flexneri 2a str. 301
uuucucuuucuu

SEQ ID NO: 3916065 - RNA, 15 nt, Shigella flexneri 2a str. 301
uuucucuuucuucag

SEQ ID NO: 3916066 - RNA, 17 nt, Shigella flexneri 2a str. 301
uuucucuuucuucagca

SEQ ID NO: 3916067 - RNA, 13 nt, Shigella flexneri 2a str. 301
uuucugaacugaa

SEQ ID NO: 3916068 - RNA, 13 nt, Shigella flexneri 2a str. 301
uuucugaauuuca

SEQ ID NO: 3916069 - RNA, 18 nt, Shigella flexneri 2a str. 301
uuucugaauuucagcgcc

SEQ ID NO: 3916070 - RNA, 20 nt, Shigella flexneri 2a str. 301
uuucugacuguguuagccug

SEQ ID NO: 3916071 - RNA, 16 nt, Shigella flexneri 2a str. 301
uuucugagauucaauu

SEQ ID NO: 3916072 - RNA, 15 nt, Shigella flexneri 2a str. 301
uuucugagcaucaca

SEQ ID NO: 3916073 - RNA, 21 nt, Shigella flexneri 2a str. 301
uuucugaugcauaaaaaaacg

SEQ ID NO: 3916074 - RNA, 17 nt, Shigella flexneri 2a str. 301
uuucugccauuuugcuu

SEQ ID NO: 3916075 - RNA, 23 nt, Shigella flexneri 2a str. 301
uuucugccgcuguuuugucaucu

SEQ ID NO: 3916076 - RNA, 14 nt, Shigella flexneri 2a str. 301
uuucuggaguuaaa

SEQ ID NO: 3916077 - RNA, 15 nt, Shigella flexneri 2a str. 301
uuucuggaugauccu

SEQ ID NO: 3916078 - RNA, 19 nt, Shigella flexneri 2a str. 301
uuucuggcaccuguaccag

SEQ ID NO: 3916079 - RNA, 19 nt, Shigella flexneri 2a str. 301
uuucuggcaucacuucuuu

SEQ ID NO: 3916080 - RNA, 23 nt, Shigella flexneri 2a str. 301
uuucuggcggcuuauauauuaau

SEQ ID NO: 3916081 - RNA, 21 nt, Shigella flexneri 2a str. 301
uuucuggguggcguuccagca

SEQ ID NO: 3916082 - RNA, 21 nt, Shigella flexneri 2a str. 301
uuucugucuuaacgcaccaug

SEQ ID NO: 3916083 - RNA, 19 nt, Shigella flexneri 2a str. 301
uuucuguuaauguuagcaa

SEQ ID NO: 3916084 - RNA, 21 nt, Shigella flexneri 2a str. 301
uuucuuaccccugauuuuguu

SEQ ID NO: 3916085 - RNA, 14 nt, Shigella flexneri 2a str. 301
uuucuuauuucacu

SEQ ID NO: 3916086 - RNA, 12 nt, Shigella flexneri 2a str. 301
uuucuuauuuuu

SEQ ID NO: 3916087 - RNA, 16 nt, Shigella flexneri 2a str. 301
uuucuucagccccucc

SEQ ID NO: 3916088 - RNA, 14 nt, Shigella flexneri 2a str. 301
uuucuucauuaaau

SEQ ID NO: 3916089 - RNA, 12 nt, Shigella flexneri 2a str. 301
uuucuucauucg

SEQ ID NO: 3916090 - RNA, 14 nt, Shigella flexneri 2a str. 301
uuucuuccagcgcc

SEQ ID NO: 3916091 - RNA, 16 nt, Shigella flexneri 2a str. 301
uuucuuccagcgccau

SEQ ID NO: 3916092 - RNA, 11 nt, Shigella flexneri 2a str. 301
uuucuucuucg

SEQ ID NO: 3916093 - RNA, 16 nt, Shigella flexneri 2a str. 301
uuucuugcgaacaggu

SEQ ID NO: 3916094 - RNA, 13 nt, Shigella flexneri 2a str. 301
uuucuugguaaug

SEQ ID NO: 3916095 - RNA, 21 nt, Shigella flexneri 2a str. 301
uuucuuucgcccaauaaaaaa

SEQ ID NO: 3916096 - RNA, 22 nt, Shigella flexneri 2a str. 301
uuucuuugcuuuguaaagcgcc

SEQ ID NO: 3916097 - RNA, 17 nt, Shigella flexneri 2a str. 301
uuucuuuggcaucaauc

SEQ ID NO: 3916098 - RNA, 22 nt, Shigella flexneri 2a str. 301
uuucuuuuacaucuacaaaaaa

SEQ ID NO: 3916099 - RNA, 14 nt, Shigella flexneri 2a str. 301
uuucuuuugccaga

SEQ ID NO: 3916100 - RNA, 12 nt, Shigella flexneri 2a str. 301
uuucuuuuuaaa

SEQ ID NO: 3916101 - RNA, 22 nt, Shigella flexneri 2a str. 301
uuugaacauaucagcgcaaaga

SEQ ID NO: 3916102 - RNA, 21 nt, Shigella flexneri 2a str. 301
uuugaaugaguacugaugaau

SEQ ID NO: 3916103 - RNA, 15 nt, Shigella flexneri 2a str. 301
uuugacauguugcug

SEQ ID NO: 3916104 - RNA, 16 nt, Shigella flexneri 2a str. 301
uuugacauguugcuga

SEQ ID NO: 3916105 - RNA, 21 nt, Shigella flexneri 2a str. 301
uuugacuacgacgccaagaaa

SEQ ID NO: 3916106 - RNA, 18 nt, Shigella flexneri 2a str. 301
uuugagaacgacagugac

SEQ ID NO: 3916107 - RNA, 11 nt, Shigella flexneri 2a str. 301
uuugagcagca

SEQ ID NO: 3916108 - RNA, 22 nt, Shigella flexneri 2a str. 301
uuugagcaucaaacuuuuaaau

SEQ ID NO: 3916109 - RNA, 15 nt, Shigella flexneri 2a str. 301
uuugaggaagcugcc

SEQ ID NO: 3916110 - RNA, 12 nt, Shigella flexneri 2a str. 301
uuugauccagcc

SEQ ID NO: 3916111 - RNA, 16 nt, Shigella flexneri 2a str. 301
uuugaucgauggcagu

SEQ ID NO: 3916112 - RNA, 20 nt, Shigella flexneri 2a str. 301
uuugaugaguugaaaaccuc

SEQ ID NO: 3916113 - RNA, 12 nt, Shigella flexneri 2a str. 301
uuugaugcugua

SEQ ID NO: 3916114 - RNA, 18 nt, Shigella flexneri 2a str. 301
uuugcaaaaucaaauaca

SEQ ID NO: 3916115 - RNA, 18 nt, Shigella flexneri 2a str. 301
uuugcaaaguuccuauau

SEQ ID NO: 3916116 - RNA, 18 nt, Shigella flexneri 2a str. 301
uuugcaacgcuuugcuga

SEQ ID NO: 3916117 - RNA, 15 nt, Shigella flexneri 2a str. 301
uuugcaaucagauaa

SEQ ID NO: 3916118 - RNA, 12 nt, Shigella flexneri 2a str. 301
uuugcacauucc

SEQ ID NO: 3916119 - RNA, 16 nt, Shigella flexneri 2a str. 301
uuugcacauuccagau

SEQ ID NO: 3916120 - RNA, 12 nt, Shigella flexneri 2a str. 301
uuugcaccagaa

SEQ ID NO: 3916121 - RNA, 13 nt, Shigella flexneri 2a str. 301
uuugcacgcuuuc

SEQ ID NO: 3916122 - RNA, 20 nt, Shigella flexneri 2a str. 301
uuugcacgcuuucugcguga

SEQ ID NO: 3916123 - RNA, 16 nt, Shigella flexneri 2a str. 301
uuugcagccauaaauu

SEQ ID NO: 3916124 - RNA, 18 nt, Shigella flexneri 2a str. 301
uuugcagccauaaauuua

SEQ ID NO: 3916125 - RNA, 21 nt, Shigella flexneri 2a str. 301
uuugcagccauaaauuuaccu

SEQ ID NO: 3916126 - RNA, 15 nt, Shigella flexneri 2a str. 301
uuugcagcuuugcug

SEQ ID NO: 3916127 - RNA, 14 nt, Shigella flexneri 2a str. 301
uuugcaggaaaaac

SEQ ID NO: 3916128 - RNA, 18 nt, Shigella flexneri 2a str. 301
uuugcaggaaaaacugcc

SEQ ID NO: 3916129 - RNA, 20 nt, Shigella flexneri 2a str. 301
uuugcagugaucgugugcca

SEQ ID NO: 3916130 - RNA, 16 nt, Shigella flexneri 2a str. 301
uuugcagugcuuguua

SEQ ID NO: 3916131 - RNA, 14 nt, Shigella flexneri 2a str. 301
uuugcauaauuucc

SEQ ID NO: 3916132 - RNA, 17 nt, Shigella flexneri 2a str. 301
uuugcauccacaacccg

SEQ ID NO: 3916133 - RNA, 14 nt, Shigella flexneri 2a str. 301
uuugcauccagcuc

SEQ ID NO: 3916134 - RNA, 22 nt, Shigella flexneri 2a str. 301
uuugcaucccagaaaaaaagua

SEQ ID NO: 3916135 - RNA, 13 nt, Shigella flexneri 2a str. 301
uuugcaucgccau

SEQ ID NO: 3916136 - RNA, 19 nt, Shigella flexneri 2a str. 301
uuuucaauuaauugugaag

SEQ ID NO: 3916137 - RNA, 22 nt, Shigella flexneri 2a str. 301
uuuucaauucacgaauauuucc

SEQ ID NO: 3916138 - RNA, 13 nt, Shigella flexneri 2a str. 301
uuuucaauucucu

SEQ ID NO: 3916139 - RNA, 22 nt, Shigella flexneri 2a str. 301
uuuucaauucucuaaucaggaa

SEQ ID NO: 3916140 - RNA, 12 nt, Shigella flexneri 2a str. 301
uuuucacauguu

SEQ ID NO: 3916141 - RNA, 19 nt, Shigella flexneri 2a str. 301
uuuucaccaacgcaaaaag

SEQ ID NO: 3916142 - RNA, 11 nt, Shigella flexneri 2a str. 301
uuuucaccagu

SEQ ID NO: 3916143 - RNA, 16 nt, Shigella flexneri 2a str. 301
uuuucaccaucgccau

SEQ ID NO: 3916144 - RNA, 19 nt, Shigella flexneri 2a str. 301
uuuucacccacacuucaau

SEQ ID NO: 3916145 - RNA, 15 nt, Shigella flexneri 2a str. 301
uuuucagcaccagau

SEQ ID NO: 3916146 - RNA, 16 nt, Shigella flexneri 2a str. 301
uuuucagcguucccca

SEQ ID NO: 3916147 - RNA, 20 nt, Shigella flexneri 2a str. 301
uuuucaguagacucaagcag

SEQ ID NO: 3916148 - RNA, 21 nt, Shigella flexneri 2a str. 301
uuuucauugaaugcggcaggc

SEQ ID NO: 3916149 - RNA, 15 nt, Shigella flexneri 2a str. 301
uuuucauugccgcau

SEQ ID NO: 3916150 - RNA, 14 nt, Shigella flexneri 2a str. 301
uuuuccacaaugcc

SEQ ID NO: 3916151 - RNA, 11 nt, Shigella flexneri 2a str. 301
uuuuccagcac

SEQ ID NO: 3916152 - RNA, 16 nt, Shigella flexneri 2a str. 301
uuuuccagcugugcca

SEQ ID NO: 3916153 - RNA, 17 nt, Shigella flexneri 2a str. 301
uuuuccagcugugccag

SEQ ID NO: 3916154 - RNA, 15 nt, Shigella flexneri 2a str. 301
uuuuccaucgaccaa

SEQ ID NO: 3916155 - RNA, 19 nt, Shigella flexneri 2a str. 301
uuuuccccaccucaucaga

SEQ ID NO: 3916156 - RNA, 18 nt, Shigella flexneri 2a str. 301
uuuucccuuccgccauca

SEQ ID NO: 3916157 - RNA, 21 nt, Shigella flexneri 2a str. 301
uuuuccgcacguuagaaacaa

SEQ ID NO: 3916158 - RNA, 17 nt, Shigella flexneri 2a str. 301
uuuuccgccucaucauc

SEQ ID NO: 3916159 - RNA, 22 nt, Shigella flexneri 2a str. 301
uuuuccugcugcaucugaaacu

SEQ ID NO: 3916160 - RNA, 16 nt, Shigella flexneri 2a str. 301
uuuucgccacuucagc

SEQ ID NO: 3916161 - RNA, 12 nt, Shigella flexneri 2a str. 301
uuuucgccgcau

SEQ ID NO: 3916162 - RNA, 15 nt, Shigella flexneri 2a str. 301
uuuucggauuuaccg

SEQ ID NO: 3916163 - RNA, 19 nt, Shigella flexneri 2a str. 301
uuuucggcaaccgcaucca

SEQ ID NO: 3916164 - RNA, 22 nt, Shigella flexneri 2a str. 301
uuuucgucguacccggcgacuu

SEQ ID NO: 3916165 - RNA, 22 nt, Shigella flexneri 2a str. 301
uuuucguuacguggcacauucu

SEQ ID NO: 3916166 - RNA, 15 nt, Shigella flexneri 2a str. 301
uuuucuacacagacg

SEQ ID NO: 3916167 - RNA, 14 nt, Shigella flexneri 2a str. 301
uuuucucaauauaa

SEQ ID NO: 3916168 - RNA, 17 nt, Shigella flexneri 2a str. 301
uuuucuguagauaaaac

SEQ ID NO: 3916169 - RNA, 24 nt, Shigella flexneri 2a str. 301
uuuucugucacaccuuauuuacau

SEQ ID NO: 3916170 - RNA, 17 nt, Shigella flexneri 2a str. 301
uuuucuuaacaaaaacu

SEQ ID NO: 3916171 - RNA, 22 nt, Shigella flexneri 2a str. 301
uuuugaacagcgguguacccug

SEQ ID NO: 3916172 - RNA, 23 nt, Shigella flexneri 2a str. 301
uuuugaagguucgggucagaguu

SEQ ID NO: 3916173 - RNA, 15 nt, Shigella flexneri 2a str. 301
uuuugagcgguacac

SEQ ID NO: 3916174 - RNA, 14 nt, Shigella flexneri 2a str. 301
uuuugauagugcgu

SEQ ID NO: 3916175 - RNA, 20 nt, Shigella flexneri 2a str. 301
uuuugaugcuguaaaaugag

SEQ ID NO: 3916176 - RNA, 22 nt, Shigella flexneri 2a str. 301
uuuugcaaucagauaaaauaca

SEQ ID NO: 3916177 - RNA, 17 nt, Shigella flexneri 2a str. 301
uuuugcagaucgccaau

SEQ ID NO: 3916178 - RNA, 22 nt, Shigella flexneri 2a str. 301
uuuugcaggaaaaacugcccgu

SEQ ID NO: 3916179 - RNA, 16 nt, Shigella flexneri 2a str. 301
uuuugcauaauuucca

SEQ ID NO: 3916180 - RNA, 15 nt, Shigella flexneri 2a str. 301
uuuugccaaauaucu

SEQ ID NO: 3916181 - RNA, 20 nt, Shigella flexneri 2a str. 301
uuuugcccggcaacaacagg

SEQ ID NO: 3916182 - RNA, 21 nt, Shigella flexneri 2a str. 301
uuuugccgcccagucacggcu

SEQ ID NO: 3916183 - RNA, 22 nt, Shigella flexneri 2a str. 301
uuuugccggacggcuguaaaug

SEQ ID NO: 3916184 - RNA, 19 nt, Shigella flexneri 2a str. 301
uuuugccggauguggcgug

SEQ ID NO: 3916185 - RNA, 18 nt, Shigella flexneri 2a str. 301
uuuugcgcauccagcgcu

SEQ ID NO: 3916186 - RNA, 20 nt, Shigella flexneri 2a str. 301
uuuugcguccgguaauuuuu

SEQ ID NO: 3916187 - RNA, 23 nt, Shigella flexneri 2a str. 301
uuuugcugcaaaauuauuccguu

SEQ ID NO: 3916188 - RNA, 17 nt, Shigella flexneri 2a str. 301
uuuuggcgaauuguucu

SEQ ID NO: 3916189 - RNA, 17 nt, Shigella flexneri 2a str. 301
uuuuggcgagagacgcu

SEQ ID NO: 3916190 - RNA, 17 nt, Shigella flexneri 2a str. 301
uuuugggccagggauau

SEQ ID NO: 3916191 - RNA, 23 nt, Shigella flexneri 2a str. 301
uuuugguccuggucugaugaaug

SEQ ID NO: 3916192 - RNA, 12 nt, Shigella flexneri 2a str. 301
uuuuggugcuuu

SEQ ID NO: 3916193 - RNA, 12 nt, Shigella flexneri 2a str. 301
uuuuguagaccu

SEQ ID NO: 3916194 - RNA, 17 nt, Shigella flexneri 2a str. 301
uuuuguaucgaacaaga

SEQ ID NO: 3916195 - RNA, 18 nt, Shigella flexneri 2a str. 301
uuuuguaucgaacaagau

SEQ ID NO: 3916196 - RNA, 11 nt, Shigella flexneri 2a str. 301
uuuugugggca

SEQ ID NO: 3916197 - RNA, 16 nt, Shigella flexneri 2a str. 301
uuuuguuuaaauaucu

SEQ ID NO: 3916198 - RNA, 11 nt, Shigella flexneri 2a str. 301
uuuuuaaacau

SEQ ID NO: 3916199 - RNA, 16 nt, Shigella flexneri 2a str. 301
uuuuuaaacaucaaac

SEQ ID NO: 3916200 - RNA, 14 nt, Shigella flexneri 2a str. 301
uuuuuaaacauuaa

SEQ ID NO: 3916201 - RNA, 15 nt, Shigella flexneri 2a str. 301
uuuuuaaauuuccca

SEQ ID NO: 3916202 - RNA, 22 nt, Shigella flexneri 2a str. 301
uuuuuaacgccgcuauacgccu

SEQ ID NO: 3916203 - RNA, 20 nt, Shigella flexneri 2a str. 301
uuuuuaauguggcuggggua

SEQ ID NO: 3916204 - RNA, 15 nt, Shigella flexneri 2a str. 301
uuuuuaucuucaaga

SEQ ID NO: 3916205 - RNA, 18 nt, Shigella flexneri 2a str. 301
uuuuuaugcuuccuuccu

SEQ ID NO: 3916206 - RNA, 19 nt, Shigella flexneri 2a str. 301
uuuuucaaccuaaaguaaa

SEQ ID NO: 3916207 - RNA, 23 nt, Shigella flexneri 2a str. 301
uuuuuccacuuccaccagcggcu

SEQ ID NO: 3916208 - RNA, 17 nt, Shigella flexneri 2a str. 301
uuuuuccagauugcuua

SEQ ID NO: 3916209 - RNA, 12 nt, Shigella flexneri 2a str. 301
uuuuuccagcug

SEQ ID NO: 3916210 - RNA, 12 nt, Shigella flexneri 2a str. 301
uuuuuccguuuu

SEQ ID NO: 3916211 - RNA, 22 nt, Shigella flexneri 2a str. 301
uuuuucgacaucaagaaaugca

SEQ ID NO: 3916212 - RNA, 14 nt, Shigella flexneri 2a str. 301
uuuuucgauaauca

SEQ ID NO: 3916213 - RNA, 22 nt, Shigella flexneri 2a str. 301
uuuuucgcgauagccgcuuucu

SEQ ID NO: 3916214 - RNA, 21 nt, Shigella flexneri 2a str. 301
uuuuucgcgcguuaucccuua

SEQ ID NO: 3916215 - RNA, 12 nt, Shigella flexneri 2a str. 301
uuuuucuucagu

SEQ ID NO: 3916216 - RNA, 12 nt, Shigella flexneri 2a str. 301
uuuuugaacaga

SEQ ID NO: 3916217 - RNA, 16 nt, Shigella flexneri 2a str. 301
uuuuugacgcuuuuac

SEQ ID NO: 3916218 - RNA, 23 nt, Shigella flexneri 2a str. 301
uuuuugcauaauuuccagcagug

SEQ ID NO: 3916219 - RNA, 15 nt, Shigella flexneri 2a str. 301
uuuuugcauuuccgc

SEQ ID NO: 3916220 - RNA, 18 nt, Shigella flexneri 2a str. 301
uuuuugccccagaauuuu

SEQ ID NO: 3916221 - RNA, 16 nt, Shigella flexneri 2a str. 301
uuuuugcgcgaagaaa

SEQ ID NO: 3916222 - RNA, 20 nt, Shigella flexneri 2a str. 301
uuuuugcucaacccuuucca

SEQ ID NO: 3916223 - RNA, 15 nt, Shigella flexneri 2a str. 301
uuuuugggguuuuaa

SEQ ID NO: 3916224 - RNA, 16 nt, Shigella flexneri 2a str. 301
uuuuugguaaugacuc

SEQ ID NO: 3916225 - RNA, 18 nt, Shigella flexneri 2a str. 301
uuuuugucugcuauuuac

SEQ ID NO: 3916226 - RNA, 16 nt, Shigella flexneri 2a str. 301
uuuuuuaaacauuaaa

SEQ ID NO: 3916227 - RNA, 20 nt, Shigella flexneri 2a str. 301
uuuuuuaucuucaagaauca

SEQ ID NO: 3916228 - RNA, 18 nt, Shigella flexneri 2a str. 301
uuuuuucaaccuaaagua

SEQ ID NO: 3916229 - RNA, 12 nt, Shigella flexneri 2a str. 301
uuuuuucacaug

SEQ ID NO: 3916230 - RNA, 10 nt, Shigella flexneri 2a str. 301
uuuuuuccug

SEQ ID NO: 3916231 - RNA, 13 nt, Shigella flexneri 2a str. 301
uuuuuugcauuac

SEQ ID NO: 3916232 - RNA, 11 nt, Shigella flexneri 2a str. 301
uuuuuuugcca

SEQ ID NO: 3916233 - RNA, 13 nt, Shigella flexneri 2a str. 301
aaaaaaaagaaga

SEQ ID NO: 3916234 - RNA, 13 nt, Shigella flexneri 2a str. 301
aaaaaaaaugccc

SEQ ID NO: 3916235 - RNA, 12 nt, Shigella flexneri 2a str. 301
aaaaaaagaaga

SEQ ID NO: 3916236 - RNA, 12 nt, Shigella flexneri 2a str. 301
aaaaaaauaagc

SEQ ID NO: 3916237 - RNA, 18 nt, Shigella flexneri 2a str. 301
aaaaaaauucugaacaau

SEQ ID NO: 3916238 - RNA, 13 nt, Shigella flexneri 2a str. 301
aaaaaaccgccau

SEQ ID NO: 3916239 - RNA, 16 nt, Shigella flexneri 2a str. 301
aaaaaacgaucauuau

SEQ ID NO: 3916240 - RNA, 11 nt, Shigella flexneri 2a str. 301
aaaaaagaaga

SEQ ID NO: 3916241 - RNA, 21 nt, Shigella flexneri 2a str. 301
aaaaaagggcauguucaggcg

SEQ ID NO: 3916242 - RNA, 13 nt, Shigella flexneri 2a str. 301
aaaaaauagcaaa

SEQ ID NO: 3916243 - RNA, 23 nt, Shigella flexneri 2a str. 301
aaaaaaucaaugcccaucacuau

SEQ ID NO: 3916244 - RNA, 11 nt, Shigella flexneri 2a str. 301
aaaaaauccca

SEQ ID NO: 3916245 - RNA, 20 nt, Shigella flexneri 2a str. 301
aaaaaauggccagacauuau

SEQ ID NO: 3916246 - RNA, 15 nt, Shigella flexneri 2a str. 301
aaaaaauuaacaaaa

SEQ ID NO: 3916247 - RNA, 17 nt, Shigella flexneri 2a str. 301
aaaaaauuaacaaaaca

SEQ ID NO: 3916248 - RNA, 20 nt, Shigella flexneri 2a str. 301
aaaaaauuacaaaaagugcu

SEQ ID NO: 3916249 - RNA, 12 nt, Shigella flexneri 2a str. 301
aaaaaauucuga

SEQ ID NO: 3916250 - RNA, 23 nt, Shigella flexneri 2a str. 301
aaaaacaccccauugccccaugu

SEQ ID NO: 3916251 - RNA, 19 nt, Shigella flexneri 2a str. 301
aaaaacagcaucaauaauc

SEQ ID NO: 3916252 - RNA, 21 nt, Shigella flexneri 2a str. 301
aaaaacagcaucaauaaucaa

SEQ ID NO: 3916253 - RNA, 12 nt, Shigella flexneri 2a str. 301
aaaaacagccag

SEQ ID NO: 3916254 - RNA, 13 nt, Shigella flexneri 2a str. 301
aaaaacaucauga

SEQ ID NO: 3916255 - RNA, 14 nt, Shigella flexneri 2a str. 301
aaaaacaucaugau

SEQ ID NO: 3916256 - RNA, 15 nt, Shigella flexneri 2a str. 301
aaaaaccagacgaua

SEQ ID NO: 3916257 - RNA, 12 nt, Shigella flexneri 2a str. 301
aaaaacccgccc

SEQ ID NO: 3916258 - RNA, 13 nt, Shigella flexneri 2a str. 301
aaaaaccugaccu

SEQ ID NO: 3916259 - RNA, 23 nt, Shigella flexneri 2a str. 301
aaaaaccuguauacgcauaucaa

SEQ ID NO: 3916260 - RNA, 22 nt, Shigella flexneri 2a str. 301
aaaaacgccagcaacacauagu

SEQ ID NO: 3916261 - RNA, 17 nt, Shigella flexneri 2a str. 301
aaaaacggaaagcagau

SEQ ID NO: 3916262 - RNA, 13 nt, Shigella flexneri 2a str. 301
aaaaacuaauuca

SEQ ID NO: 3916263 - RNA, 22 nt, Shigella flexneri 2a str. 301
aaaaacuccgccgcaucuuccc

SEQ ID NO: 3916264 - RNA, 12 nt, Shigella flexneri 2a str. 301
aaaaagaaagaa

SEQ ID NO: 3916265 - RNA, 12 nt, Shigella flexneri 2a str. 301
aaaaagaaaguu

SEQ ID NO: 3916266 - RNA, 13 nt, Shigella flexneri 2a str. 301
aaaaagaaggaaa

SEQ ID NO: 3916267 - RNA, 16 nt, Shigella flexneri 2a str. 301
aaaaagccaaucacaa

SEQ ID NO: 3916268 - RNA, 19 nt, Shigella flexneri 2a str. 301
aaaaagccaaucacaaaaa

SEQ ID NO: 3916269 - RNA, 14 nt, Shigella flexneri 2a str. 301
aaaaagccggauga

SEQ ID NO: 3916270 - RNA, 16 nt, Shigella flexneri 2a str. 301
aaaaagccuaagaagu

SEQ ID NO: 3916271 - RNA, 21 nt, Shigella flexneri 2a str. 301
aaaaagcgccggacauugcgu

SEQ ID NO: 3916272 - RNA, 19 nt, Shigella flexneri 2a str. 301
aaaaagcguauccugacgg

SEQ ID NO: 3916273 - RNA, 13 nt, Shigella flexneri 2a str. 301
aaaaaggcaugca

SEQ ID NO: 3916274 - RNA, 23 nt, Shigella flexneri 2a str. 301
aaaaaguaagaauugauaaaaaa

SEQ ID NO: 3916275 - RNA, 18 nt, Shigella flexneri 2a str. 301
aaaaaguccaaaaggucc

SEQ ID NO: 3916276 - RNA, 22 nt, Shigella flexneri 2a str. 301
aaaaaguugcagcgucaucaac

SEQ ID NO: 3916277 - RNA, 13 nt, Shigella flexneri 2a str. 301
aaaaauaacaaau

SEQ ID NO: 3916278 - RNA, 20 nt, Shigella flexneri 2a str. 301
aaaaauacccuguauaauag

SEQ ID NO: 3916279 - RNA, 14 nt, Shigella flexneri 2a str. 301
aaaaauaccgagca

SEQ ID NO: 3916280 - RNA, 16 nt, Shigella flexneri 2a str. 301
aaaaauaccgagcagc

SEQ ID NO: 3916281 - RNA, 13 nt, Shigella flexneri 2a str. 301
aaaaauaccucau

SEQ ID NO: 3916282 - RNA, 21 nt, Shigella flexneri 2a str. 301
aaaaauaguuacuaucuucaa

SEQ ID NO: 3916283 - RNA, 19 nt, Shigella flexneri 2a str. 301
aaaaauauugagcagaagg

SEQ ID NO: 3916284 - RNA, 15 nt, Shigella flexneri 2a str. 301
aaaaaucaaaaaacu

SEQ ID NO: 3916285 - RNA, 20 nt, Shigella flexneri 2a str. 301
aaaaaucaugcaauaaauau

SEQ ID NO: 3916286 - RNA, 16 nt, Shigella flexneri 2a str. 301
aaaaaucccacugcgc

SEQ ID NO: 3916287 - RNA, 18 nt, Shigella flexneri 2a str. 301
aaaaaucuaaccuacuuu

SEQ ID NO: 3916288 - RNA, 18 nt, Shigella flexneri 2a str. 301
aaaaaugcccgauaagca

SEQ ID NO: 3916289 - RNA, 21 nt, Shigella flexneri 2a str. 301
aaaaaugcccgauaagcaaaa

SEQ ID NO: 3916290 - RNA, 13 nt, Shigella flexneri 2a str. 301
aaaaauggcgcac

SEQ ID NO: 3916291 - RNA, 13 nt, Shigella flexneri 2a str. 301
aaaaauggcuggc

SEQ ID NO: 3916292 - RNA, 22 nt, Shigella flexneri 2a str. 301
aaaaaugugcccggacaguccc

SEQ ID NO: 3916293 - RNA, 15 nt, Shigella flexneri 2a str. 301
aaaaauuaacaaaac

SEQ ID NO: 3916294 - RNA, 18 nt, Shigella flexneri 2a str. 301
aaaaauuaacaaaacaau

SEQ ID NO: 3916295 - RNA, 16 nt, Shigella flexneri 2a str. 301
aaaaauuacaaaaagu

SEQ ID NO: 3916296 - RNA, 13 nt, Shigella flexneri 2a str. 301
aaaacaaaaaccg

SEQ ID NO: 3916297 - RNA, 12 nt, Shigella flexneri 2a str. 301
aaaacaaacggc

SEQ ID NO: 3916298 - RNA, 23 nt, Shigella flexneri 2a str. 301
aaaacaacgagccaauaaaaaua

SEQ ID NO: 3916299 - RNA, 13 nt, Shigella flexneri 2a str. 301
aaaacaauauguc

SEQ ID NO: 3916300 - RNA, 15 nt, Shigella flexneri 2a str. 301
aaaacacucuucaac

SEQ ID NO: 3916301 - RNA, 19 nt, Shigella flexneri 2a str. 301
aaaacagccagcagcgaau

SEQ ID NO: 3916302 - RNA, 14 nt, Shigella flexneri 2a str. 301
aaaaucaaaaaacu

SEQ ID NO: 3916303 - RNA, 14 nt, Shigella flexneri 2a str. 301
aaaaucaccaucac

SEQ ID NO: 3916304 - RNA, 12 nt, Shigella flexneri 2a str. 301
aaaaucaucauc

SEQ ID NO: 3916305 - RNA, 19 nt, Shigella flexneri 2a str. 301
aaaaucauccgcucccugg

SEQ ID NO: 3916306 - RNA, 15 nt, Shigella flexneri 2a str. 301
aaaaucaugcaauaa

SEQ ID NO: 3916307 - RNA, 22 nt, Shigella flexneri 2a str. 301
aaaaucauucgccgguuccagc

SEQ ID NO: 3916308 - RNA, 15 nt, Shigella flexneri 2a str. 301
aaaaucccacugcca

SEQ ID NO: 3916309 - RNA, 21 nt, Shigella flexneri 2a str. 301
aaaaucccggcaacaaauuca

SEQ ID NO: 3916310 - RNA, 15 nt, Shigella flexneri 2a str. 301
aaaauccgaacuauu

SEQ ID NO: 3916311 - RNA, 17 nt, Shigella flexneri 2a str. 301
aaaauccugccagcgug

SEQ ID NO: 3916312 - RNA, 13 nt, Shigella flexneri 2a str. 301
aaaaucgcuucag

SEQ ID NO: 3916313 - RNA, 14 nt, Shigella flexneri 2a str. 301
aaaaucgcuucagc

SEQ ID NO: 3916314 - RNA, 23 nt, Shigella flexneri 2a str. 301
aaaaucgugaaaaaucaauauau

SEQ ID NO: 3916315 - RNA, 13 nt, Shigella flexneri 2a str. 301
aaaaucgugccag

SEQ ID NO: 3916316 - RNA, 21 nt, Shigella flexneri 2a str. 301
aaaaucuauugcaacauguug

SEQ ID NO: 3916317 - RNA, 19 nt, Shigella flexneri 2a str. 301
aaaaucuccugccaauaca

SEQ ID NO: 3916318 - RNA, 14 nt, Shigella flexneri 2a str. 301
aaaaucugaauugu

SEQ ID NO: 3916319 - RNA, 22 nt, Shigella flexneri 2a str. 301
aaaaucugcgggaacauaugca

SEQ ID NO: 3916320 - RNA, 14 nt, Shigella flexneri 2a str. 301
aaaaucuuaaagau

SEQ ID NO: 3916321 - RNA, 21 nt, Shigella flexneri 2a str. 301
aaaaucuucguuaucccaggc

SEQ ID NO: 3916322 - RNA, 14 nt, Shigella flexneri 2a str. 301
aaaaugacuuaaua

SEQ ID NO: 3916323 - RNA, 20 nt, Shigella flexneri 2a str. 301
aaaaugcaucggcauaauca

SEQ ID NO: 3916324 - RNA, 17 nt, Shigella flexneri 2a str. 301
aaaaugcccgauaagca

SEQ ID NO: 3916325 - RNA, 15 nt, Shigella flexneri 2a str. 301
aaaaugcgaaaaaaa

SEQ ID NO: 3916326 - RNA, 14 nt, Shigella flexneri 2a str. 301
aaaaugcgcaugau

SEQ ID NO: 3916327 - RNA, 16 nt, Shigella flexneri 2a str. 301
aaaauggccagccagc

SEQ ID NO: 3916328 - RNA, 14 nt, Shigella flexneri 2a str. 301
aaaauggccgauac

SEQ ID NO: 3916329 - RNA, 13 nt, Shigella flexneri 2a str. 301
aaaauggucagcc

SEQ ID NO: 3916330 - RNA, 19 nt, Shigella flexneri 2a str. 301
aaaauggucagccagcggc

SEQ ID NO: 3916331 - RNA, 15 nt, Shigella flexneri 2a str. 301
aaaaugugaugccua

SEQ ID NO: 3916332 - RNA, 12 nt, Shigella flexneri 2a str. 301
aaaauguugcgc

SEQ ID NO: 3916333 - RNA, 12 nt, Shigella flexneri 2a str. 301
aaaauuaacaaa

SEQ ID NO: 3916334 - RNA, 13 nt, Shigella flexneri 2a str. 301
aaaauuaacaaaa

SEQ ID NO: 3916335 - RNA, 12 nt, Shigella flexneri 2a str. 301
aaaauuacaaaa

SEQ ID NO: 3916336 - RNA, 23 nt, Shigella flexneri 2a str. 301
aaaauuacaaaaagugcuuucug

SEQ ID NO: 3916337 - RNA, 22 nt, Shigella flexneri 2a str. 301
aaaauuacucccgugccagagc

SEQ ID NO: 3916338 - RNA, 16 nt, Shigella flexneri 2a str. 301
aaaauuagcaauacca

SEQ ID NO: 3916339 - RNA, 19 nt, Shigella flexneri 2a str. 301
aaaauuauaucuuauugcu

SEQ ID NO: 3916340 - RNA, 13 nt, Shigella flexneri 2a str. 301
aaaauuauucgcc

SEQ ID NO: 3916341 - RNA, 15 nt, Shigella flexneri 2a str. 301
aaaauuauuuuaaau

SEQ ID NO: 3916342 - RNA, 13 nt, Shigella flexneri 2a str. 301
aaaauucaagaca

SEQ ID NO: 3916343 - RNA, 21 nt, Shigella flexneri 2a str. 301
aaaauucacaucguugacauu

SEQ ID NO: 3916344 - RNA, 13 nt, Shigella flexneri 2a str. 301
aaaauucaucaaa

SEQ ID NO: 3916345 - RNA, 22 nt, Shigella flexneri 2a str. 301
aaaauucuacagaaaugaaaaa

SEQ ID NO: 3916346 - RNA, 12 nt, Shigella flexneri 2a str. 301
aaaauuuacagu

SEQ ID NO: 3916347 - RNA, 17 nt, Shigella flexneri 2a str. 301
aaaauuuauugacaauc

SEQ ID NO: 3916348 - RNA, 13 nt, Shigella flexneri 2a str. 301
aaaauuucaugcu

SEQ ID NO: 3916349 - RNA, 20 nt, Shigella flexneri 2a str. 301
aaaauuucccccacagcucu

SEQ ID NO: 3916350 - RNA, 19 nt, Shigella flexneri 2a str. 301
aaaauuucuccuucacucu

SEQ ID NO: 3916351 - RNA, 21 nt, Shigella flexneri 2a str. 301
aaaauuucuugguaaugacuc

SEQ ID NO: 3916352 - RNA, 13 nt, Shigella flexneri 2a str. 301
aaaauuuuuuugc

SEQ ID NO: 3916353 - RNA, 14 nt, Shigella flexneri 2a str. 301
aaacaaauccgcuu

SEQ ID NO: 3916354 - RNA, 14 nt, Shigella flexneri 2a str. 301
aaacaacaugcuau

SEQ ID NO: 3916355 - RNA, 13 nt, Shigella flexneri 2a str. 301
aaacaaccccauc

SEQ ID NO: 3916356 - RNA, 21 nt, Shigella flexneri 2a str. 301
aaacaacguggaacaaauaga

SEQ ID NO: 3916357 - RNA, 20 nt, Shigella flexneri 2a str. 301
aaacaagaucgcccugaggg

SEQ ID NO: 3916358 - RNA, 16 nt, Shigella flexneri 2a str. 301
aaacaagcccaugagc

SEQ ID NO: 3916359 - RNA, 16 nt, Shigella flexneri 2a str. 301
aaacaagguuugaaaa

SEQ ID NO: 3916360 - RNA, 21 nt, Shigella flexneri 2a str. 301
aaacaauaagggcugacaguu

SEQ ID NO: 3916361 - RNA, 13 nt, Shigella flexneri 2a str. 301
aaacaauacgauc

SEQ ID NO: 3916362 - RNA, 11 nt, Shigella flexneri 2a str. 301
aaacaauaugu

SEQ ID NO: 3916363 - RNA, 18 nt, Shigella flexneri 2a str. 301
aaacaauguucaucugca

SEQ ID NO: 3916364 - RNA, 17 nt, Shigella flexneri 2a str. 301
aaacaauuuucauugaa

SEQ ID NO: 3916365 - RNA, 20 nt, Shigella flexneri 2a str. 301
aaacacaaaacugccugaug

SEQ ID NO: 3916366 - RNA, 21 nt, Shigella flexneri 2a str. 301
aaacacaucaaugaugaacgc

SEQ ID NO: 3916367 - RNA, 18 nt, Shigella flexneri 2a str. 301
aaacaccagaaugcccca

SEQ ID NO: 3916368 - RNA, 15 nt, Shigella flexneri 2a str. 301
aaacacgacaugacc

SEQ ID NO: 3916369 - RNA, 17 nt, Shigella flexneri 2a str. 301
aaacacgcgaccaaagg

SEQ ID NO: 3916370 - RNA, 16 nt, Shigella flexneri 2a str. 301
aaacacugaaccgaaa

SEQ ID NO: 3916371 - RNA, 19 nt, Shigella flexneri 2a str. 301
aaacacugcgcucuucugg

SEQ ID NO: 3916372 - RNA, 13 nt, Shigella flexneri 2a str. 301
aaacagcaggcag

SEQ ID NO: 3916373 - RNA, 12 nt, Shigella flexneri 2a str. 301
aaacagccaacu

SEQ ID NO: 3916374 - RNA, 14 nt, Shigella flexneri 2a str. 301
aaacagccagcagc

SEQ ID NO: 3916375 - RNA, 23 nt, Shigella flexneri 2a str. 301
aaacagccagcagcgaaucagcc

SEQ ID NO: 3916376 - RNA, 13 nt, Shigella flexneri 2a str. 301
aaacagcccaauc

SEQ ID NO: 3916377 - RNA, 22 nt, Shigella flexneri 2a str. 301
aaacagcccaaucaucgcggca

SEQ ID NO: 3916378 - RNA, 19 nt, Shigella flexneri 2a str. 301
aaacagcgcaccagaaaca

SEQ ID NO: 3916379 - RNA, 22 nt, Shigella flexneri 2a str. 301
aaacagcgcaccagaaacaaua

SEQ ID NO: 3916380 - RNA, 16 nt, Shigella flexneri 2a str. 301
aaacagcgcugcgaaa

SEQ ID NO: 3916381 - RNA, 23 nt, Shigella flexneri 2a str. 301
aaacagcgcugcgaaaguaccau

SEQ ID NO: 3916382 - RNA, 18 nt, Shigella flexneri 2a str. 301
aaacagcggccacucuuu

SEQ ID NO: 3916383 - RNA, 23 nt, Shigella flexneri 2a str. 301
aaacagcguauuaauuccgguga

SEQ ID NO: 3916384 - RNA, 13 nt, Shigella flexneri 2a str. 301
aaacagcugcugg

SEQ ID NO: 3916385 - RNA, 21 nt, Shigella flexneri 2a str. 301
aaacaggcgacgcguccgguu

SEQ ID NO: 3916386 - RNA, 20 nt, Shigella flexneri 2a str. 301
aaacagggcuggaagaguuu

SEQ ID NO: 3916387 - RNA, 17 nt, Shigella flexneri 2a str. 301
aaacaggggcuggaaga

SEQ ID NO: 3916388 - RNA, 11 nt, Shigella flexneri 2a str. 301
aaacagguacu

SEQ ID NO: 3916389 - RNA, 21 nt, Shigella flexneri 2a str. 301
aaacaguacgagagaagagac

SEQ ID NO: 3916390 - RNA, 22 nt, Shigella flexneri 2a str. 301
aaacagucacuuucgagcaauu

SEQ ID NO: 3916391 - RNA, 18 nt, Shigella flexneri 2a str. 301
aaacagugauuacuaaau

SEQ ID NO: 3916392 - RNA, 21 nt, Shigella flexneri 2a str. 301
aaacaguggugcuuugcugug

SEQ ID NO: 3916393 - RNA, 15 nt, Shigella flexneri 2a str. 301
aaacaguucugcagc

SEQ ID NO: 3916394 - RNA, 17 nt, Shigella flexneri 2a str. 301
aaacaguuucugcagcu

SEQ ID NO: 3916395 - RNA, 12 nt, Shigella flexneri 2a str. 301
aaacaucaaaaa

SEQ ID NO: 3916396 - RNA, 14 nt, Shigella flexneri 2a str. 301
aaacaucaccaaug

SEQ ID NO: 3916397 - RNA, 16 nt, Shigella flexneri 2a str. 301
aaacaucauaauaauu

SEQ ID NO: 3916398 - RNA, 19 nt, Shigella flexneri 2a str. 301
aaacaucgcugauuucacc

SEQ ID NO: 3916399 - RNA, 22 nt, Shigella flexneri 2a str. 301
aaacaucggcuuauucauauca

SEQ ID NO: 3916400 - RNA, 23 nt, Shigella flexneri 2a str. 301
aaacaucggcuuauucauaucaa

SEQ ID NO: 3916401 - RNA, 17 nt, Shigella flexneri 2a str. 301
aaacaucgggacaugau

SEQ ID NO: 3916402 - RNA, 13 nt, Shigella flexneri 2a str. 301
aaacucacgcagg

SEQ ID NO: 3916403 - RNA, 22 nt, Shigella flexneri 2a str. 301
aaacucacgccagcagcgcaau

SEQ ID NO: 3916404 - RNA, 16 nt, Shigella flexneri 2a str. 301
aaacucacgccugaaa

SEQ ID NO: 3916405 - RNA, 23 nt, Shigella flexneri 2a str. 301
aaacucaggcuggcaagcugcug

SEQ ID NO: 3916406 - RNA, 14 nt, Shigella flexneri 2a str. 301
aaacucaugggucu

SEQ ID NO: 3916407 - RNA, 22 nt, Shigella flexneri 2a str. 301
aaacuccgccgcaucuucccag

SEQ ID NO: 3916408 - RNA, 15 nt, Shigella flexneri 2a str. 301
aaacucucaaaacaa

SEQ ID NO: 3916409 - RNA, 21 nt, Shigella flexneri 2a str. 301
aaacugccgcacuuugagcag

SEQ ID NO: 3916410 - RNA, 15 nt, Shigella flexneri 2a str. 301
aaacuggauggcucu

SEQ ID NO: 3916411 - RNA, 22 nt, Shigella flexneri 2a str. 301
aaacugguggcggguucuuuuu

SEQ ID NO: 3916412 - RNA, 18 nt, Shigella flexneri 2a str. 301
aaacuggugguaagaaua

SEQ ID NO: 3916413 - RNA, 23 nt, Shigella flexneri 2a str. 301
aaacuguaguguugcaguaaauu

SEQ ID NO: 3916414 - RNA, 14 nt, Shigella flexneri 2a str. 301
aaacuucacuuccc

SEQ ID NO: 3916415 - RNA, 15 nt, Shigella flexneri 2a str. 301
aaacuucacuucccc

SEQ ID NO: 3916416 - RNA, 17 nt, Shigella flexneri 2a str. 301
aaacuucguuagguucu

SEQ ID NO: 3916417 - RNA, 14 nt, Shigella flexneri 2a str. 301
aaacuucugccgga

SEQ ID NO: 3916418 - RNA, 17 nt, Shigella flexneri 2a str. 301
aaacuugauagaacaaa

SEQ ID NO: 3916419 - RNA, 16 nt, Shigella flexneri 2a str. 301
aaacuuucauaaacac

SEQ ID NO: 3916420 - RNA, 11 nt, Shigella flexneri 2a str. 301
aaagaaaaucu

SEQ ID NO: 3916421 - RNA, 16 nt, Shigella flexneri 2a str. 301
aaagaaaaucugaauu

SEQ ID NO: 3916422 - RNA, 13 nt, Shigella flexneri 2a str. 301
aaagaaagaagcc

SEQ ID NO: 3916423 - RNA, 13 nt, Shigella flexneri 2a str. 301
aaagaaugacacu

SEQ ID NO: 3916424 - RNA, 13 nt, Shigella flexneri 2a str. 301
aaagacaucaaac

SEQ ID NO: 3916425 - RNA, 23 nt, Shigella flexneri 2a str. 301
aaagacaucgcccgauucacaua

SEQ ID NO: 3916426 - RNA, 21 nt, Shigella flexneri 2a str. 301
aaagaccacaguaacgccugg

SEQ ID NO: 3916427 - RNA, 15 nt, Shigella flexneri 2a str. 301
aaagaccugaccaga

SEQ ID NO: 3916428 - RNA, 17 nt, Shigella flexneri 2a str. 301
aaagacgaagauuuuac

SEQ ID NO: 3916429 - RNA, 20 nt, Shigella flexneri 2a str. 301
aaagacggcggcaacauggc

SEQ ID NO: 3916430 - RNA, 20 nt, Shigella flexneri 2a str. 301
aaagacguuaaaaaaggugc

SEQ ID NO: 3916431 - RNA, 13 nt, Shigella flexneri 2a str. 301
aaagagaacucuu

SEQ ID NO: 3916432 - RNA, 17 nt, Shigella flexneri 2a str. 301
aaagagaacucuuuuuu

SEQ ID NO: 3916433 - RNA, 13 nt, Shigella flexneri 2a str. 301
aaagagacagaau

SEQ ID NO: 3916434 - RNA, 16 nt, Shigella flexneri 2a str. 301
aaagagacgcugaaaa

SEQ ID NO: 3916435 - RNA, 19 nt, Shigella flexneri 2a str. 301
aaagagcagcugauugaaa

SEQ ID NO: 3916436 - RNA, 20 nt, Shigella flexneri 2a str. 301
aaagagccgguuuguaggcc

SEQ ID NO: 3916437 - RNA, 23 nt, Shigella flexneri 2a str. 301
aaagaggcccgauggugaugcca

SEQ ID NO: 3916438 - RNA, 17 nt, Shigella flexneri 2a str. 301
aaagagugugaauauuc

SEQ ID NO: 3916439 - RNA, 21 nt, Shigella flexneri 2a str. 301
aaagauaccagacauguggau

SEQ ID NO: 3916440 - RNA, 15 nt, Shigella flexneri 2a str. 301
aaagauagaacaucu

SEQ ID NO: 3916441 - RNA, 23 nt, Shigella flexneri 2a str. 301
aaagauauuggggguaauucccu

SEQ ID NO: 3916442 - RNA, 17 nt, Shigella flexneri 2a str. 301
aaagaucgaucauuuuu

SEQ ID NO: 3916443 - RNA, 16 nt, Shigella flexneri 2a str. 301
aaagaucgccacugcu

SEQ ID NO: 3916444 - RNA, 18 nt, Shigella flexneri 2a str. 301
aaagauggauugcugaaa

SEQ ID NO: 3916445 - RNA, 23 nt, Shigella flexneri 2a str. 301
aaagauggcgcgcagaaagaggc

SEQ ID NO: 3916446 - RNA, 15 nt, Shigella flexneri 2a str. 301
aaagauguugucauu

SEQ ID NO: 3916447 - RNA, 19 nt, Shigella flexneri 2a str. 301
aaagauguugucauuacaa

SEQ ID NO: 3916448 - RNA, 22 nt, Shigella flexneri 2a str. 301
aaagauguugucauuacaacaa

SEQ ID NO: 3916449 - RNA, 23 nt, Shigella flexneri 2a str. 301
aaagauguugucauuacaacaag

SEQ ID NO: 3916450 - RNA, 17 nt, Shigella flexneri 2a str. 301
aaagauuaaaaaaacac

SEQ ID NO: 3916451 - RNA, 21 nt, Shigella flexneri 2a str. 301
aaagauuacugacaauuugcc

SEQ ID NO: 3916452 - RNA, 23 nt, Shigella flexneri 2a str. 301
aaagauuauugcuugaucaggaa

SEQ ID NO: 3916453 - RNA, 20 nt, Shigella flexneri 2a str. 301
aaagauucaucgcccuuuuu

SEQ ID NO: 3916454 - RNA, 13 nt, Shigella flexneri 2a str. 301
aaagcaaauuuug

SEQ ID NO: 3916455 - RNA, 11 nt, Shigella flexneri 2a str. 301
aaagcaacucc

SEQ ID NO: 3916456 - RNA, 12 nt, Shigella flexneri 2a str. 301
aaagcaacucca

SEQ ID NO: 3916457 - RNA, 15 nt, Shigella flexneri 2a str. 301
aaagcaauauugaug

SEQ ID NO: 3916458 - RNA, 17 nt, Shigella flexneri 2a str. 301
aaagcaauuccagcgcc

SEQ ID NO: 3916459 - RNA, 14 nt, Shigella flexneri 2a str. 301
aaagcaccacuccu

SEQ ID NO: 3916460 - RNA, 19 nt, Shigella flexneri 2a str. 301
aaagcagacaacccacaca

SEQ ID NO: 3916461 - RNA, 21 nt, Shigella flexneri 2a str. 301
aaagcagacaacccacacauu

SEQ ID NO: 3916462 - RNA, 21 nt, Shigella flexneri 2a str. 301
aaagcagacggcugucaucca

SEQ ID NO: 3916463 - RNA, 17 nt, Shigella flexneri 2a str. 301
aaagcagagcagggaag

SEQ ID NO: 3916464 - RNA, 20 nt, Shigella flexneri 2a str. 301
aaagcagauaacccagcagc

SEQ ID NO: 3916465 - RNA, 16 nt, Shigella flexneri 2a str. 301
aaagcagcauguagau

SEQ ID NO: 3916466 - RNA, 22 nt, Shigella flexneri 2a str. 301
aaagcagcauguagaugccggu

SEQ ID NO: 3916467 - RNA, 19 nt, Shigella flexneri 2a str. 301
aaagcaggccagauagcca

SEQ ID NO: 3916468 - RNA, 20 nt, Shigella flexneri 2a str. 301
aaagcaggucccauccugau

SEQ ID NO: 3916469 - RNA, 14 nt, Shigella flexneri 2a str. 301
aaagcagguuuuac

SEQ ID NO: 3916470 - RNA, 23 nt, Shigella flexneri 2a str. 301
aaagcaguaaggucaucaaucau

SEQ ID NO: 3916471 - RNA, 18 nt, Shigella flexneri 2a str. 301
aaagcauagccccagcgc

SEQ ID NO: 3916472 - RNA, 18 nt, Shigella flexneri 2a str. 301
aaagcauuuuuucacaug

SEQ ID NO: 3916473 - RNA, 13 nt, Shigella flexneri 2a str. 301
aaagccaacagca

SEQ ID NO: 3916474 - RNA, 14 nt, Shigella flexneri 2a str. 301
aaagccaacagcag

SEQ ID NO: 3916475 - RNA, 14 nt, Shigella flexneri 2a str. 301
aaagccaaccugcg

SEQ ID NO: 3916476 - RNA, 20 nt, Shigella flexneri 2a str. 301
aaagccaaccugcggguugg

SEQ ID NO: 3916477 - RNA, 22 nt, Shigella flexneri 2a str. 301
aaagccaauuaacgaaaucuca

SEQ ID NO: 3916478 - RNA, 14 nt, Shigella flexneri 2a str. 301
aaagcccaucaucc

SEQ ID NO: 3916479 - RNA, 22 nt, Shigella flexneri 2a str. 301
aaagcccccgcaacauugcgcc

SEQ ID NO: 3916480 - RNA, 23 nt, Shigella flexneri 2a str. 301
aaagcccccgcaacauugcgccu

SEQ ID NO: 3916481 - RNA, 22 nt, Shigella flexneri 2a str. 301
aaagccgagacgagcauaaaag

SEQ ID NO: 3916482 - RNA, 21 nt, Shigella flexneri 2a str. 301
aaagccgccaucucuuccagc

SEQ ID NO: 3916483 - RNA, 14 nt, Shigella flexneri 2a str. 301
aaagccgcgugcgc

SEQ ID NO: 3916484 - RNA, 23 nt, Shigella flexneri 2a str. 301
aaagccgcuuaacgguguuuagu

SEQ ID NO: 3916485 - RNA, 18 nt, Shigella flexneri 2a str. 301
aaagccgguuuugguuaa

SEQ ID NO: 3916486 - RNA, 14 nt, Shigella flexneri 2a str. 301
aaagccugcuggca

SEQ ID NO: 3916487 - RNA, 12 nt, Shigella flexneri 2a str. 301
aaagccugcuuc

SEQ ID NO: 3916488 - RNA, 13 nt, Shigella flexneri 2a str. 301
aaagccuuucacu

SEQ ID NO: 3916489 - RNA, 13 nt, Shigella flexneri 2a str. 301
aaagcgaagcggc

SEQ ID NO: 3916490 - RNA, 16 nt, Shigella flexneri 2a str. 301
aaagcgacgcgcagua

SEQ ID NO: 3916491 - RNA, 19 nt, Shigella flexneri 2a str. 301
aaagcgacuuugccuggcg

SEQ ID NO: 3916492 - RNA, 18 nt, Shigella flexneri 2a str. 301
aaagcgagaguuacagcu

SEQ ID NO: 3916493 - RNA, 21 nt, Shigella flexneri 2a str. 301
aaagcgagcaguacagccgcc

SEQ ID NO: 3916494 - RNA, 18 nt, Shigella flexneri 2a str. 301
aaagcgagcgagcaauau

SEQ ID NO: 3916495 - RNA, 23 nt, Shigella flexneri 2a str. 301
aaagcgcaaaauaccagcaauuu

SEQ ID NO: 3916496 - RNA, 14 nt, Shigella flexneri 2a str. 301
aaagcgcaccugau

SEQ ID NO: 3916497 - RNA, 14 nt, Shigella flexneri 2a str. 301
aaagcgccaaaucu

SEQ ID NO: 3916498 - RNA, 14 nt, Shigella flexneri 2a str. 301
aaagcgcgcaguuu

SEQ ID NO: 3916499 - RNA, 23 nt, Shigella flexneri 2a str. 301
aaagcgcggcagugacugcccca

SEQ ID NO: 3916500 - RNA, 18 nt, Shigella flexneri 2a str. 301
aaagcgcugaagaaaaug

SEQ ID NO: 3916501 - RNA, 16 nt, Shigella flexneri 2a str. 301
aaagcggcccuuuuuu

SEQ ID NO: 3916502 - RNA, 23 nt, Shigella flexneri 2a str. 301
aaauacuguuuaccggugccagc

SEQ ID NO: 3916503 - RNA, 20 nt, Shigella flexneri 2a str. 301
aaauacuguuuaucuuccca

SEQ ID NO: 3916504 - RNA, 14 nt, Shigella flexneri 2a str. 301
aaauacuuaaacag

SEQ ID NO: 3916505 - RNA, 19 nt, Shigella flexneri 2a str. 301
aaauagaauggcaucagaa

SEQ ID NO: 3916506 - RNA, 19 nt, Shigella flexneri 2a str. 301
aaauagacacaagaaauau

SEQ ID NO: 3916507 - RNA, 23 nt, Shigella flexneri 2a str. 301
aaauagagaaaguaaaccaccag

SEQ ID NO: 3916508 - RNA, 12 nt, Shigella flexneri 2a str. 301
aaauagcaaagu

SEQ ID NO: 3916509 - RNA, 15 nt, Shigella flexneri 2a str. 301
aaauagcaaaguaau

SEQ ID NO: 3916510 - RNA, 17 nt, Shigella flexneri 2a str. 301
aaauagcauaauauaac

SEQ ID NO: 3916511 - RNA, 15 nt, Shigella flexneri 2a str. 301
aaauagccagcagag

SEQ ID NO: 3916512 - RNA, 23 nt, Shigella flexneri 2a str. 301
aaauagccagcagagcaaaaauc

SEQ ID NO: 3916513 - RNA, 21 nt, Shigella flexneri 2a str. 301
aaauagcccgauggauuuauc

SEQ ID NO: 3916514 - RNA, 15 nt, Shigella flexneri 2a str. 301
aaauagcucaaugaa

SEQ ID NO: 3916515 - RNA, 17 nt, Shigella flexneri 2a str. 301
aaauagcuguuuauuua

SEQ ID NO: 3916516 - RNA, 23 nt, Shigella flexneri 2a str. 301
aaauaggaauccgggucuguaaa

SEQ ID NO: 3916517 - RNA, 16 nt, Shigella flexneri 2a str. 301
aaauauaaaacaacgg

SEQ ID NO: 3916518 - RNA, 11 nt, Shigella flexneri 2a str. 301
aaauauauccu

SEQ ID NO: 3916519 - RNA, 12 nt, Shigella flexneri 2a str. 301
aaauauauccua

SEQ ID NO: 3916520 - RNA, 22 nt, Shigella flexneri 2a str. 301
aaauauauuccccggucagcag

SEQ ID NO: 3916521 - RNA, 15 nt, Shigella flexneri 2a str. 301
aaauaucacugauua

SEQ ID NO: 3916522 - RNA, 20 nt, Shigella flexneri 2a str. 301
aaauaucaucaaaauuaaca

SEQ ID NO: 3916523 - RNA, 18 nt, Shigella flexneri 2a str. 301
aaauaucgcccauaugaa

SEQ ID NO: 3916524 - RNA, 21 nt, Shigella flexneri 2a str. 301
aaauaucuauauacaaucaca

SEQ ID NO: 3916525 - RNA, 18 nt, Shigella flexneri 2a str. 301
aaauaucucggcaaucau

SEQ ID NO: 3916526 - RNA, 11 nt, Shigella flexneri 2a str. 301
aaauaucugua

SEQ ID NO: 3916527 - RNA, 17 nt, Shigella flexneri 2a str. 301
aaauaucuucaauagca

SEQ ID NO: 3916528 - RNA, 17 nt, Shigella flexneri 2a str. 301
aaauaugaaaucucuug

SEQ ID NO: 3916529 - RNA, 17 nt, Shigella flexneri 2a str. 301
aaauauggugaaaguaa

SEQ ID NO: 3916530 - RNA, 20 nt, Shigella flexneri 2a str. 301
aaauauggugaaaguaaaaa

SEQ ID NO: 3916531 - RNA, 21 nt, Shigella flexneri 2a str. 301
aaauauggugaaaguaaaaaa

SEQ ID NO: 3916532 - RNA, 18 nt, Shigella flexneri 2a str. 301
aaauauuaagaaaggcag

SEQ ID NO: 3916533 - RNA, 17 nt, Shigella flexneri 2a str. 301
aaauauuauuggcaucg

SEQ ID NO: 3916534 - RNA, 17 nt, Shigella flexneri 2a str. 301
aaauauugaugggaagc

SEQ ID NO: 3916535 - RNA, 19 nt, Shigella flexneri 2a str. 301
aaaucaaaaaacuggaaaa

SEQ ID NO: 3916536 - RNA, 13 nt, Shigella flexneri 2a str. 301
aaaucaacauguu

SEQ ID NO: 3916537 - RNA, 14 nt, Shigella flexneri 2a str. 301
aaaucaagcgccgc

SEQ ID NO: 3916538 - RNA, 23 nt, Shigella flexneri 2a str. 301
aaaucaauccaguguaaaacagc

SEQ ID NO: 3916539 - RNA, 12 nt, Shigella flexneri 2a str. 301
aaaucaaugguc

SEQ ID NO: 3916540 - RNA, 12 nt, Shigella flexneri 2a str. 301
aaaucacaccau

SEQ ID NO: 3916541 - RNA, 23 nt, Shigella flexneri 2a str. 301
aaaucaccauauucagcagcaga

SEQ ID NO: 3916542 - RNA, 17 nt, Shigella flexneri 2a str. 301
aaaucaccgccaccagc

SEQ ID NO: 3916543 - RNA, 18 nt, Shigella flexneri 2a str. 301
aaaucaccucaucaccac

SEQ ID NO: 3916544 - RNA, 21 nt, Shigella flexneri 2a str. 301
aaaucacgcugcugauuaaaa

SEQ ID NO: 3916545 - RNA, 14 nt, Shigella flexneri 2a str. 301
aaaucacgcuucac

SEQ ID NO: 3916546 - RNA, 18 nt, Shigella flexneri 2a str. 301
aaaucacuauuaaagaaa

SEQ ID NO: 3916547 - RNA, 20 nt, Shigella flexneri 2a str. 301
aaaucagaucgacgccgaug

SEQ ID NO: 3916548 - RNA, 14 nt, Shigella flexneri 2a str. 301
aaaucagcgugaug

SEQ ID NO: 3916549 - RNA, 22 nt, Shigella flexneri 2a str. 301
aaaucagcuuuggugaaaaaau

SEQ ID NO: 3916550 - RNA, 12 nt, Shigella flexneri 2a str. 301
aaaucaucaauc

SEQ ID NO: 3916551 - RNA, 15 nt, Shigella flexneri 2a str. 301
aaaucaucaucuuua

SEQ ID NO: 3916552 - RNA, 21 nt, Shigella flexneri 2a str. 301
aaaucauccagaccgcucagc

SEQ ID NO: 3916553 - RNA, 16 nt, Shigella flexneri 2a str. 301
aaaucauccagacugc

SEQ ID NO: 3916554 - RNA, 14 nt, Shigella flexneri 2a str. 301
aaaucauccauccg

SEQ ID NO: 3916555 - RNA, 16 nt, Shigella flexneri 2a str. 301
aaaucauccugcugca

SEQ ID NO: 3916556 - RNA, 15 nt, Shigella flexneri 2a str. 301
aaaucaugaaugcaa

SEQ ID NO: 3916557 - RNA, 14 nt, Shigella flexneri 2a str. 301
aaaucaugcaauaa

SEQ ID NO: 3916558 - RNA, 13 nt, Shigella flexneri 2a str. 301
aaauccaacaaca

SEQ ID NO: 3916559 - RNA, 20 nt, Shigella flexneri 2a str. 301
aaauccaaccucuucuuuua

SEQ ID NO: 3916560 - RNA, 20 nt, Shigella flexneri 2a str. 301
aaauccagcgguugggcauc

SEQ ID NO: 3916561 - RNA, 14 nt, Shigella flexneri 2a str. 301
aaaucccagugccu

SEQ ID NO: 3916562 - RNA, 14 nt, Shigella flexneri 2a str. 301
aaaucccgccagcg

SEQ ID NO: 3916563 - RNA, 13 nt, Shigella flexneri 2a str. 301
aaaucccgccgcu

SEQ ID NO: 3916564 - RNA, 14 nt, Shigella flexneri 2a str. 301
aaaucccgcugaau

SEQ ID NO: 3916565 - RNA, 12 nt, Shigella flexneri 2a str. 301
aaaucccugauc

SEQ ID NO: 3916566 - RNA, 20 nt, Shigella flexneri 2a str. 301
aaauccgccaauagcuggca

SEQ ID NO: 3916567 - RNA, 13 nt, Shigella flexneri 2a str. 301
aaauccgccacuu

SEQ ID NO: 3916568 - RNA, 14 nt, Shigella flexneri 2a str. 301
aaauccggccagcg

SEQ ID NO: 3916569 - RNA, 14 nt, Shigella flexneri 2a str. 301
aaauccugccgcag

SEQ ID NO: 3916570 - RNA, 22 nt, Shigella flexneri 2a str. 301
aaauccugccgcaguuucugau

SEQ ID NO: 3916571 - RNA, 20 nt, Shigella flexneri 2a str. 301
aaauccuucagcaacuuguu

SEQ ID NO: 3916572 - RNA, 16 nt, Shigella flexneri 2a str. 301
aaaucgaaaucaacau

SEQ ID NO: 3916573 - RNA, 14 nt, Shigella flexneri 2a str. 301
aaaucgcauugcgu

SEQ ID NO: 3916574 - RNA, 20 nt, Shigella flexneri 2a str. 301
aaaucgccaacaaucucuuc

SEQ ID NO: 3916575 - RNA, 23 nt, Shigella flexneri 2a str. 301
aaaucgccaacaaucucuuccag

SEQ ID NO: 3916576 - RNA, 14 nt, Shigella flexneri 2a str. 301
aaaucgccaagauu

SEQ ID NO: 3916577 - RNA, 14 nt, Shigella flexneri 2a str. 301
aaaucgcccagcaa

SEQ ID NO: 3916578 - RNA, 15 nt, Shigella flexneri 2a str. 301
aaaucgccggugauu

SEQ ID NO: 3916579 - RNA, 21 nt, Shigella flexneri 2a str. 301
aaaucgcugaauaucuuucuc

SEQ ID NO: 3916580 - RNA, 18 nt, Shigella flexneri 2a str. 301
aaaucgggcagcacauag

SEQ ID NO: 3916581 - RNA, 14 nt, Shigella flexneri 2a str. 301
aaaucguaagcagg

SEQ ID NO: 3916582 - RNA, 19 nt, Shigella flexneri 2a str. 301
aaaucguauccggcauuau

SEQ ID NO: 3916583 - RNA, 17 nt, Shigella flexneri 2a str. 301
aaaucgugaaaaaucaa

SEQ ID NO: 3916584 - RNA, 15 nt, Shigella flexneri 2a str. 301
aaaucgugaaacaau

SEQ ID NO: 3916585 - RNA, 15 nt, Shigella flexneri 2a str. 301
aaaucgugcaaauuc

SEQ ID NO: 3916586 - RNA, 12 nt, Shigella flexneri 2a str. 301
aaaucuauugca

SEQ ID NO: 3916587 - RNA, 16 nt, Shigella flexneri 2a str. 301
aaaucuauugcaacau

SEQ ID NO: 3916588 - RNA, 13 nt, Shigella flexneri 2a str. 301
aaaucuccauuuc

SEQ ID NO: 3916589 - RNA, 14 nt, Shigella flexneri 2a str. 301
aaaucuccauuuca

SEQ ID NO: 3916590 - RNA, 15 nt, Shigella flexneri 2a str. 301
aaaucugaaaucauc

SEQ ID NO: 3916591 - RNA, 16 nt, Shigella flexneri 2a str. 301
aaaucugaaaucauca

SEQ ID NO: 3916592 - RNA, 16 nt, Shigella flexneri 2a str. 301
aaaucugcccguuaac

SEQ ID NO: 3916593 - RNA, 20 nt, Shigella flexneri 2a str. 301
aaaucugcccguuaaccaua

SEQ ID NO: 3916594 - RNA, 18 nt, Shigella flexneri 2a str. 301
aaaucugccgauuucaac

SEQ ID NO: 3916595 - RNA, 18 nt, Shigella flexneri 2a str. 301
aaaucugcgccuacggca

SEQ ID NO: 3916596 - RNA, 21 nt, Shigella flexneri 2a str. 301
aaaucugucagguaacaagcc

SEQ ID NO: 3916597 - RNA, 11 nt, Shigella flexneri 2a str. 301
aaaucuuuaua

SEQ ID NO: 3916598 - RNA, 16 nt, Shigella flexneri 2a str. 301
aaaucuuuauaauuaa

SEQ ID NO: 3916599 - RNA, 14 nt, Shigella flexneri 2a str. 301
aaaucuuucauuuc

SEQ ID NO: 3916600 - RNA, 12 nt, Shigella flexneri 2a str. 301
aaaugaaaaaau

SEQ ID NO: 3916601 - RNA, 17 nt, Shigella flexneri 2a str. 301
aaaugaaaaaauagaau

SEQ ID NO: 3916602 - RNA, 23 nt, Shigella flexneri 2a str. 301
aaaugacauucacgcugucggca

SEQ ID NO: 3916603 - RNA, 13 nt, Shigella flexneri 2a str. 301
aacaaaaaagagu

SEQ ID NO: 3916604 - RNA, 22 nt, Shigella flexneri 2a str. 301
aacaaaaccuguugaaauuauu

SEQ ID NO: 3916605 - RNA, 12 nt, Shigella flexneri 2a str. 301
aacaaaaucgug

SEQ ID NO: 3916606 - RNA, 16 nt, Shigella flexneri 2a str. 301
aacaaaaucuucuaac

SEQ ID NO: 3916607 - RNA, 21 nt, Shigella flexneri 2a str. 301
aacaaacagcgcgccagccac

SEQ ID NO: 3916608 - RNA, 12 nt, Shigella flexneri 2a str. 301
aacaaacaguac

SEQ ID NO: 3916609 - RNA, 19 nt, Shigella flexneri 2a str. 301
aacaaacgauuuaucgauu

SEQ ID NO: 3916610 - RNA, 16 nt, Shigella flexneri 2a str. 301
aacaaagcgcacuuua

SEQ ID NO: 3916611 - RNA, 18 nt, Shigella flexneri 2a str. 301
aacaaagcgcacuuuguc

SEQ ID NO: 3916612 - RNA, 17 nt, Shigella flexneri 2a str. 301
aacaaaguuugcaacuu

SEQ ID NO: 3916613 - RNA, 14 nt, Shigella flexneri 2a str. 301
aacaaauaaaagca

SEQ ID NO: 3916614 - RNA, 19 nt, Shigella flexneri 2a str. 301
aacaaaugcgcuuuauuca

SEQ ID NO: 3916615 - RNA, 14 nt, Shigella flexneri 2a str. 301
aacaacaagaagcg

SEQ ID NO: 3916616 - RNA, 19 nt, Shigella flexneri 2a str. 301
aacaacagaucaacauacu

SEQ ID NO: 3916617 - RNA, 19 nt, Shigella flexneri 2a str. 301
aacaacagcgauuauggau

SEQ ID NO: 3916618 - RNA, 20 nt, Shigella flexneri 2a str. 301
aacaacccggcgaaagagcu

SEQ ID NO: 3916619 - RNA, 19 nt, Shigella flexneri 2a str. 301
aacaacccuaaagcaccca

SEQ ID NO: 3916620 - RNA, 20 nt, Shigella flexneri 2a str. 301
aacaaccugcauuugcgcag

SEQ ID NO: 3916621 - RNA, 20 nt, Shigella flexneri 2a str. 301
aacaacgccucguaaugcuc

SEQ ID NO: 3916622 - RNA, 23 nt, Shigella flexneri 2a str. 301
aacaacgggcaccgccgccgcuu

SEQ ID NO: 3916623 - RNA, 15 nt, Shigella flexneri 2a str. 301
aacaacgugguuuuc

SEQ ID NO: 3916624 - RNA, 21 nt, Shigella flexneri 2a str. 301
aacaacgugugcuuuguucau

SEQ ID NO: 3916625 - RNA, 21 nt, Shigella flexneri 2a str. 301
aacaagaagcguuuaugacgc

SEQ ID NO: 3916626 - RNA, 22 nt, Shigella flexneri 2a str. 301
aacaagacgucgcgaauggccu

SEQ ID NO: 3916627 - RNA, 15 nt, Shigella flexneri 2a str. 301
aacaagcaaacccga

SEQ ID NO: 3916628 - RNA, 20 nt, Shigella flexneri 2a str. 301
aacaagccaguccagaaaug

SEQ ID NO: 3916629 - RNA, 16 nt, Shigella flexneri 2a str. 301
aacaaggguaagggag

SEQ ID NO: 3916630 - RNA, 17 nt, Shigella flexneri 2a str. 301
aacaaggguaagggagg

SEQ ID NO: 3916631 - RNA, 23 nt, Shigella flexneri 2a str. 301
aacaaggguaugcuguaaacaac

SEQ ID NO: 3916632 - RNA, 21 nt, Shigella flexneri 2a str. 301
aacaagguuugaaaaaaccug

SEQ ID NO: 3916633 - RNA, 18 nt, Shigella flexneri 2a str. 301
aacaauaaaaccaguaau

SEQ ID NO: 3916634 - RNA, 16 nt, Shigella flexneri 2a str. 301
aacaauacaaaugccu

SEQ ID NO: 3916635 - RNA, 19 nt, Shigella flexneri 2a str. 301
aacaaucacaauagaaaua

SEQ ID NO: 3916636 - RNA, 17 nt, Shigella flexneri 2a str. 301
aacaaucgggaaaaucu

SEQ ID NO: 3916637 - RNA, 15 nt, Shigella flexneri 2a str. 301
aacaaucucuuccag

SEQ ID NO: 3916638 - RNA, 17 nt, Shigella flexneri 2a str. 301
aacaaugccgauaaaua

SEQ ID NO: 3916639 - RNA, 12 nt, Shigella flexneri 2a str. 301
aacaaugcguuu

SEQ ID NO: 3916640 - RNA, 20 nt, Shigella flexneri 2a str. 301
aacaaugggaaaacaggaua

SEQ ID NO: 3916641 - RNA, 18 nt, Shigella flexneri 2a str. 301
aacaauguuauccggcua

SEQ ID NO: 3916642 - RNA, 19 nt, Shigella flexneri 2a str. 301
aacaauucguuguuuuugu

SEQ ID NO: 3916643 - RNA, 16 nt, Shigella flexneri 2a str. 301
aacaauugaagaauau

SEQ ID NO: 3916644 - RNA, 23 nt, Shigella flexneri 2a str. 301
aacaauugcgggccaaagaccag

SEQ ID NO: 3916645 - RNA, 16 nt, Shigella flexneri 2a str. 301
aacaauuucuucuggu

SEQ ID NO: 3916646 - RNA, 15 nt, Shigella flexneri 2a str. 301
aacacaaaacugccu

SEQ ID NO: 3916647 - RNA, 18 nt, Shigella flexneri 2a str. 301
aacacaacgcuuucaaca

SEQ ID NO: 3916648 - RNA, 13 nt, Shigella flexneri 2a str. 301
aacacaacguggu

SEQ ID NO: 3916649 - RNA, 20 nt, Shigella flexneri 2a str. 301
aacacaauaccuucugcgcc

SEQ ID NO: 3916650 - RNA, 21 nt, Shigella flexneri 2a str. 301
aacacaauaccuucugcgccc

SEQ ID NO: 3916651 - RNA, 17 nt, Shigella flexneri 2a str. 301
aacacaauccccgcgcc

SEQ ID NO: 3916652 - RNA, 21 nt, Shigella flexneri 2a str. 301
aacacacaauuaccuuccaca

SEQ ID NO: 3916653 - RNA, 14 nt, Shigella flexneri 2a str. 301
aacacacauuuauc

SEQ ID NO: 3916654 - RNA, 20 nt, Shigella flexneri 2a str. 301
aacacacguaggccggauaa

SEQ ID NO: 3916655 - RNA, 13 nt, Shigella flexneri 2a str. 301
aacacacuuucca

SEQ ID NO: 3916656 - RNA, 22 nt, Shigella flexneri 2a str. 301
aacacacuuuccaguuccggca

SEQ ID NO: 3916657 - RNA, 17 nt, Shigella flexneri 2a str. 301
aacacagcgauccggua

SEQ ID NO: 3916658 - RNA, 17 nt, Shigella flexneri 2a str. 301
aacacaggauacgcaua

SEQ ID NO: 3916659 - RNA, 20 nt, Shigella flexneri 2a str. 301
aacacauaaccguacaaucg

SEQ ID NO: 3916660 - RNA, 24 nt, Shigella flexneri 2a str. 301
aacacauauauuaauugccguuaa

SEQ ID NO: 3916661 - RNA, 16 nt, Shigella flexneri 2a str. 301
aacacauuauuaagaa

SEQ ID NO: 3916662 - RNA, 12 nt, Shigella flexneri 2a str. 301
aacaccaaaccc

SEQ ID NO: 3916663 - RNA, 15 nt, Shigella flexneri 2a str. 301
aacaccagcaauaau

SEQ ID NO: 3916664 - RNA, 12 nt, Shigella flexneri 2a str. 301
aacaccagcagu

SEQ ID NO: 3916665 - RNA, 13 nt, Shigella flexneri 2a str. 301
aacaccagccaga

SEQ ID NO: 3916666 - RNA, 13 nt, Shigella flexneri 2a str. 301
aacaccagcgaau

SEQ ID NO: 3916667 - RNA, 12 nt, Shigella flexneri 2a str. 301
aacaccauaaug

SEQ ID NO: 3916668 - RNA, 22 nt, Shigella flexneri 2a str. 301
aacaccauaucuaugguuuuuu

SEQ ID NO: 3916669 - RNA, 18 nt, Shigella flexneri 2a str. 301
aacaccaucauauuuucc

SEQ ID NO: 3916670 - RNA, 22 nt, Shigella flexneri 2a str. 301
aacacccauggggaugcugcag

SEQ ID NO: 3916671 - RNA, 14 nt, Shigella flexneri 2a str. 301
aacaccgaaccaga

SEQ ID NO: 3916672 - RNA, 17 nt, Shigella flexneri 2a str. 301
aacaccgaaccagagau

SEQ ID NO: 3916673 - RNA, 22 nt, Shigella flexneri 2a str. 301
aacaccgauuuuguaaaagaag

SEQ ID NO: 3916674 - RNA, 23 nt, Shigella flexneri 2a str. 301
aacaccgauuuuguaaaagaagg

SEQ ID NO: 3916675 - RNA, 18 nt, Shigella flexneri 2a str. 301
aacaccgcuucaacagcg

SEQ ID NO: 3916676 - RNA, 12 nt, Shigella flexneri 2a str. 301
aacaccgggugc

SEQ ID NO: 3916677 - RNA, 15 nt, Shigella flexneri 2a str. 301
aacaccgucgccuuc

SEQ ID NO: 3916678 - RNA, 15 nt, Shigella flexneri 2a str. 301
aacaccguuuuacca

SEQ ID NO: 3916679 - RNA, 15 nt, Shigella flexneri 2a str. 301
aacaccuaccggcug

SEQ ID NO: 3916680 - RNA, 16 nt, Shigella flexneri 2a str. 301
aacaccuggcaccagu

SEQ ID NO: 3916681 - RNA, 18 nt, Shigella flexneri 2a str. 301
aacaccugggcaauggug

SEQ ID NO: 3916682 - RNA, 20 nt, Shigella flexneri 2a str. 301
aacacgacauacaccgcagc

SEQ ID NO: 3916683 - RNA, 20 nt, Shigella flexneri 2a str. 301
aacacgaucucacgcugaaa

SEQ ID NO: 3916684 - RNA, 11 nt, Shigella flexneri 2a str. 301
aacacgcucag

SEQ ID NO: 3916685 - RNA, 17 nt, Shigella flexneri 2a str. 301
aacacgcucccagcaga

SEQ ID NO: 3916686 - RNA, 21 nt, Shigella flexneri 2a str. 301
aacacggaucaggcggcucac

SEQ ID NO: 3916687 - RNA, 20 nt, Shigella flexneri 2a str. 301
aacacggcagcaaccgcuuc

SEQ ID NO: 3916688 - RNA, 19 nt, Shigella flexneri 2a str. 301
aacacgggguuaaauugau

SEQ ID NO: 3916689 - RNA, 22 nt, Shigella flexneri 2a str. 301
aacacucgugcgucgcauccgg

SEQ ID NO: 3916690 - RNA, 23 nt, Shigella flexneri 2a str. 301
aacacucuuccagucgccugcuu

SEQ ID NO: 3916691 - RNA, 21 nt, Shigella flexneri 2a str. 301
aacacugcgcucuucuggcac

SEQ ID NO: 3916692 - RNA, 20 nt, Shigella flexneri 2a str. 301
aacacuguuaccgcugcugg

SEQ ID NO: 3916693 - RNA, 20 nt, Shigella flexneri 2a str. 301
aacacuuugccgucagccac

SEQ ID NO: 3916694 - RNA, 17 nt, Shigella flexneri 2a str. 301
aacagaaacgccaucca

SEQ ID NO: 3916695 - RNA, 16 nt, Shigella flexneri 2a str. 301
aacagaacaauaauaa

SEQ ID NO: 3916696 - RNA, 13 nt, Shigella flexneri 2a str. 301
aacagaacgcaua

SEQ ID NO: 3916697 - RNA, 14 nt, Shigella flexneri 2a str. 301
aacagaagaaagca

SEQ ID NO: 3916698 - RNA, 19 nt, Shigella flexneri 2a str. 301
aacagaagugcguuucugg

SEQ ID NO: 3916699 - RNA, 16 nt, Shigella flexneri 2a str. 301
aacagaauaacgucgc

SEQ ID NO: 3916700 - RNA, 14 nt, Shigella flexneri 2a str. 301
aacagaaugcacgu

SEQ ID NO: 3916701 - RNA, 15 nt, Shigella flexneri 2a str. 301
aacagacaaaaagaa

SEQ ID NO: 3916702 - RNA, 19 nt, Shigella flexneri 2a str. 301
aacagaccacauuccaggc

SEQ ID NO: 3916703 - RNA, 13 nt, Shigella flexneri 2a str. 301
aaccacaucaauc

SEQ ID NO: 3916704 - RNA, 14 nt, Shigella flexneri 2a str. 301
aaccacccagcagc

SEQ ID NO: 3916705 - RNA, 15 nt, Shigella flexneri 2a str. 301
aaccaccggcaccac

SEQ ID NO: 3916706 - RNA, 14 nt, Shigella flexneri 2a str. 301
aaccaccuccacgc

SEQ ID NO: 3916707 - RNA, 18 nt, Shigella flexneri 2a str. 301
aaccacgacuuuuugucu

SEQ ID NO: 3916708 - RNA, 19 nt, Shigella flexneri 2a str. 301
aaccacgcagcguuggcag

SEQ ID NO: 3916709 - RNA, 23 nt, Shigella flexneri 2a str. 301
aaccacggaguugaccagcucca

SEQ ID NO: 3916710 - RNA, 15 nt, Shigella flexneri 2a str. 301
aaccacggcagcaac

SEQ ID NO: 3916711 - RNA, 23 nt, Shigella flexneri 2a str. 301
aaccacggcagcaacuuaaucau

SEQ ID NO: 3916712 - RNA, 18 nt, Shigella flexneri 2a str. 301
aaccacguucauuucaua

SEQ ID NO: 3916713 - RNA, 12 nt, Shigella flexneri 2a str. 301
aaccacucacga

SEQ ID NO: 3916714 - RNA, 16 nt, Shigella flexneri 2a str. 301
aaccacuuaauuauua

SEQ ID NO: 3916715 - RNA, 15 nt, Shigella flexneri 2a str. 301
aaccagaaagggaag

SEQ ID NO: 3916716 - RNA, 19 nt, Shigella flexneri 2a str. 301
aaccagaaagggaagaaca

SEQ ID NO: 3916717 - RNA, 13 nt, Shigella flexneri 2a str. 301
aaccagagacaga

SEQ ID NO: 3916718 - RNA, 17 nt, Shigella flexneri 2a str. 301
aaccagagacagaccaa

SEQ ID NO: 3916719 - RNA, 23 nt, Shigella flexneri 2a str. 301
aaccagagcgccgcaaaagguca

SEQ ID NO: 3916720 - RNA, 15 nt, Shigella flexneri 2a str. 301
aaccagaucggacuu

SEQ ID NO: 3916721 - RNA, 18 nt, Shigella flexneri 2a str. 301
aaccagccaaauaaaauc

SEQ ID NO: 3916722 - RNA, 14 nt, Shigella flexneri 2a str. 301
aaccagcggacaau

SEQ ID NO: 3916723 - RNA, 14 nt, Shigella flexneri 2a str. 301
aaccagcgucagcc

SEQ ID NO: 3916724 - RNA, 21 nt, Shigella flexneri 2a str. 301
aaccagcguuuccagcaccag

SEQ ID NO: 3916725 - RNA, 23 nt, Shigella flexneri 2a str. 301
aaccagcguuuccagcaccaguu

SEQ ID NO: 3916726 - RNA, 16 nt, Shigella flexneri 2a str. 301
aaccagcuuaugccug

SEQ ID NO: 3916727 - RNA, 22 nt, Shigella flexneri 2a str. 301
aaccaggaagauguacgccagu

SEQ ID NO: 3916728 - RNA, 18 nt, Shigella flexneri 2a str. 301
aaccaggcgagaucggca

SEQ ID NO: 3916729 - RNA, 23 nt, Shigella flexneri 2a str. 301
aaccaggcgagaucggcaggcag

SEQ ID NO: 3916730 - RNA, 20 nt, Shigella flexneri 2a str. 301
aaccagucggaaacaugaaa

SEQ ID NO: 3916731 - RNA, 19 nt, Shigella flexneri 2a str. 301
aaccagugaauacugcgcg

SEQ ID NO: 3916732 - RNA, 14 nt, Shigella flexneri 2a str. 301
aaccagugacauac

SEQ ID NO: 3916733 - RNA, 20 nt, Shigella flexneri 2a str. 301
aaccaguugugcaccaccaa

SEQ ID NO: 3916734 - RNA, 13 nt, Shigella flexneri 2a str. 301
aaccauaaaauca

SEQ ID NO: 3916735 - RNA, 13 nt, Shigella flexneri 2a str. 301
aaccauaaucuca

SEQ ID NO: 3916736 - RNA, 19 nt, Shigella flexneri 2a str. 301
aaccaucaccaucgcccca

SEQ ID NO: 3916737 - RNA, 22 nt, Shigella flexneri 2a str. 301
aaccaucgagaaucagcgagac

SEQ ID NO: 3916738 - RNA, 16 nt, Shigella flexneri 2a str. 301
aaccaucgcauacugc

SEQ ID NO: 3916739 - RNA, 20 nt, Shigella flexneri 2a str. 301
aaccaucgcuacauaacgca

SEQ ID NO: 3916740 - RNA, 17 nt, Shigella flexneri 2a str. 301
aaccaucgguacgcuuu

SEQ ID NO: 3916741 - RNA, 14 nt, Shigella flexneri 2a str. 301
aaccauuauccguc

SEQ ID NO: 3916742 - RNA, 17 nt, Shigella flexneri 2a str. 301
aacccaacggcaaacau

SEQ ID NO: 3916743 - RNA, 13 nt, Shigella flexneri 2a str. 301
aacccaccaugcc

SEQ ID NO: 3916744 - RNA, 17 nt, Shigella flexneri 2a str. 301
aacccaccaugccgaug

SEQ ID NO: 3916745 - RNA, 23 nt, Shigella flexneri 2a str. 301
aacccagaagaaagccggaugau

SEQ ID NO: 3916746 - RNA, 21 nt, Shigella flexneri 2a str. 301
aacccagcgauggacgcagac

SEQ ID NO: 3916747 - RNA, 22 nt, Shigella flexneri 2a str. 301
aacccagcggaugacccagcgc

SEQ ID NO: 3916748 - RNA, 22 nt, Shigella flexneri 2a str. 301
aacccaucaacugaccgauuua

SEQ ID NO: 3916749 - RNA, 18 nt, Shigella flexneri 2a str. 301
aacccaucaagcgaaaau

SEQ ID NO: 3916750 - RNA, 21 nt, Shigella flexneri 2a str. 301
aacccauccagcagagauaca

SEQ ID NO: 3916751 - RNA, 13 nt, Shigella flexneri 2a str. 301
aaccccgggcugg

SEQ ID NO: 3916752 - RNA, 22 nt, Shigella flexneri 2a str. 301
aacccgaaggaauuuuacagcc

SEQ ID NO: 3916753 - RNA, 19 nt, Shigella flexneri 2a str. 301
aacccgcagccgccagaaa

SEQ ID NO: 3916754 - RNA, 13 nt, Shigella flexneri 2a str. 301
aacccgccagacc

SEQ ID NO: 3916755 - RNA, 23 nt, Shigella flexneri 2a str. 301
aacccgccaguuugucuggcaau

SEQ ID NO: 3916756 - RNA, 15 nt, Shigella flexneri 2a str. 301
aacccgccaugcaug

SEQ ID NO: 3916757 - RNA, 12 nt, Shigella flexneri 2a str. 301
aacccgcugcca

SEQ ID NO: 3916758 - RNA, 14 nt, Shigella flexneri 2a str. 301
aacccgcugccauc

SEQ ID NO: 3916759 - RNA, 15 nt, Shigella flexneri 2a str. 301
aacccggucccuuca

SEQ ID NO: 3916760 - RNA, 23 nt, Shigella flexneri 2a str. 301
aacccguacugccgaacagaaug

SEQ ID NO: 3916761 - RNA, 23 nt, Shigella flexneri 2a str. 301
aacccgucugguuugggcaugau

SEQ ID NO: 3916762 - RNA, 17 nt, Shigella flexneri 2a str. 301
aacccuaacccaacauu

SEQ ID NO: 3916763 - RNA, 18 nt, Shigella flexneri 2a str. 301
aacccugaacgccgggcu

SEQ ID NO: 3916764 - RNA, 14 nt, Shigella flexneri 2a str. 301
aacccugcgucagg

SEQ ID NO: 3916765 - RNA, 14 nt, Shigella flexneri 2a str. 301
aacccuucuuccau

SEQ ID NO: 3916766 - RNA, 21 nt, Shigella flexneri 2a str. 301
aacccuugcguuucugacucu

SEQ ID NO: 3916767 - RNA, 11 nt, Shigella flexneri 2a str. 301
aacccuuucca

SEQ ID NO: 3916768 - RNA, 16 nt, Shigella flexneri 2a str. 301
aacccuuuccagcgcc

SEQ ID NO: 3916769 - RNA, 19 nt, Shigella flexneri 2a str. 301
aacccuuuuuuaaacauua

SEQ ID NO: 3916770 - RNA, 16 nt, Shigella flexneri 2a str. 301
aaccgaacccagcagg

SEQ ID NO: 3916771 - RNA, 19 nt, Shigella flexneri 2a str. 301
aaccgaauucaaauccuuc

SEQ ID NO: 3916772 - RNA, 17 nt, Shigella flexneri 2a str. 301
aaccgacaauauugaug

SEQ ID NO: 3916773 - RNA, 13 nt, Shigella flexneri 2a str. 301
aaccgacugccug

SEQ ID NO: 3916774 - RNA, 14 nt, Shigella flexneri 2a str. 301
aaccgagcagauac

SEQ ID NO: 3916775 - RNA, 18 nt, Shigella flexneri 2a str. 301
aaccgaguuaguccacac

SEQ ID NO: 3916776 - RNA, 21 nt, Shigella flexneri 2a str. 301
aaccgcaaaugauuagugcca

SEQ ID NO: 3916777 - RNA, 15 nt, Shigella flexneri 2a str. 301
aaccgcagugauuuc

SEQ ID NO: 3916778 - RNA, 21 nt, Shigella flexneri 2a str. 301
aaccgcagugauuucaaccgg

SEQ ID NO: 3916779 - RNA, 23 nt, Shigella flexneri 2a str. 301
aaccgcaguguaguucuggccuu

SEQ ID NO: 3916780 - RNA, 19 nt, Shigella flexneri 2a str. 301
aaccgcauacgcagcauca

SEQ ID NO: 3916781 - RNA, 20 nt, Shigella flexneri 2a str. 301
aaccgcaucaacagugccaa

SEQ ID NO: 3916782 - RNA, 16 nt, Shigella flexneri 2a str. 301
aaccgccaucauggau

SEQ ID NO: 3916783 - RNA, 20 nt, Shigella flexneri 2a str. 301
aaccgcccagaccugcguuc

SEQ ID NO: 3916784 - RNA, 15 nt, Shigella flexneri 2a str. 301
aaccgcccugcggcu

SEQ ID NO: 3916785 - RNA, 17 nt, Shigella flexneri 2a str. 301
aaccgccucaggcaaca

SEQ ID NO: 3916786 - RNA, 21 nt, Shigella flexneri 2a str. 301
aaccgccugcgaguguuaccu

SEQ ID NO: 3916787 - RNA, 17 nt, Shigella flexneri 2a str. 301
aaccgcgaugaccaaaa

SEQ ID NO: 3916788 - RNA, 15 nt, Shigella flexneri 2a str. 301
aaccgcgcagcgggc

SEQ ID NO: 3916789 - RNA, 19 nt, Shigella flexneri 2a str. 301
aaccgcuacauacuuaaau

SEQ ID NO: 3916790 - RNA, 15 nt, Shigella flexneri 2a str. 301
aaccgcucgucacau

SEQ ID NO: 3916791 - RNA, 18 nt, Shigella flexneri 2a str. 301
aaccgcucgugggcaucg

SEQ ID NO: 3916792 - RNA, 15 nt, Shigella flexneri 2a str. 301
aaccgcugcaaaaaa

SEQ ID NO: 3916793 - RNA, 16 nt, Shigella flexneri 2a str. 301
aaccgcuguugucuga

SEQ ID NO: 3916794 - RNA, 14 nt, Shigella flexneri 2a str. 301
aaccgcuuuuucaa

SEQ ID NO: 3916795 - RNA, 19 nt, Shigella flexneri 2a str. 301
aaccggaaauccaggucag

SEQ ID NO: 3916796 - RNA, 15 nt, Shigella flexneri 2a str. 301
aaccggaaccagcgc

SEQ ID NO: 3916797 - RNA, 19 nt, Shigella flexneri 2a str. 301
aaccggaccagcaacaaau

SEQ ID NO: 3916798 - RNA, 17 nt, Shigella flexneri 2a str. 301
aaccggacugaaaguac

SEQ ID NO: 3916799 - RNA, 13 nt, Shigella flexneri 2a str. 301
aaccggagucaga

SEQ ID NO: 3916800 - RNA, 14 nt, Shigella flexneri 2a str. 301
aaccggauacccug

SEQ ID NO: 3916801 - RNA, 19 nt, Shigella flexneri 2a str. 301
aaccggaucaggguuaaaa

SEQ ID NO: 3916802 - RNA, 18 nt, Shigella flexneri 2a str. 301
aaccggauuuucaccauc

SEQ ID NO: 3916803 - RNA, 15 nt, Shigella flexneri 2a str. 301
aacgccagcagcagc

SEQ ID NO: 3916804 - RNA, 14 nt, Shigella flexneri 2a str. 301
aacgccaguuuaau

SEQ ID NO: 3916805 - RNA, 14 nt, Shigella flexneri 2a str. 301
aacgccauccagcc

SEQ ID NO: 3916806 - RNA, 14 nt, Shigella flexneri 2a str. 301
aacgccauccggca

SEQ ID NO: 3916807 - RNA, 15 nt, Shigella flexneri 2a str. 301
aacgccaucgccagg

SEQ ID NO: 3916808 - RNA, 22 nt, Shigella flexneri 2a str. 301
aacgcccagcuaaucgagccga

SEQ ID NO: 3916809 - RNA, 11 nt, Shigella flexneri 2a str. 301
aacgcccauca

SEQ ID NO: 3916810 - RNA, 16 nt, Shigella flexneri 2a str. 301
aacgcccaucaacaug

SEQ ID NO: 3916811 - RNA, 18 nt, Shigella flexneri 2a str. 301
aacgccccuucugccgca

SEQ ID NO: 3916812 - RNA, 18 nt, Shigella flexneri 2a str. 301
aacgcccgcaagccaaca

SEQ ID NO: 3916813 - RNA, 17 nt, Shigella flexneri 2a str. 301
aacgcccgcuuucacca

SEQ ID NO: 3916814 - RNA, 12 nt, Shigella flexneri 2a str. 301
aacgccgcgcca

SEQ ID NO: 3916815 - RNA, 20 nt, Shigella flexneri 2a str. 301
aacgccggagugaaaauucu

SEQ ID NO: 3916816 - RNA, 14 nt, Shigella flexneri 2a str. 301
aacgccgucaucac

SEQ ID NO: 3916817 - RNA, 20 nt, Shigella flexneri 2a str. 301
aacgccgucaucacaccgcg

SEQ ID NO: 3916818 - RNA, 15 nt, Shigella flexneri 2a str. 301
aacgccuaaugccag

SEQ ID NO: 3916819 - RNA, 17 nt, Shigella flexneri 2a str. 301
aacgccuaucaccagaa

SEQ ID NO: 3916820 - RNA, 24 nt, Shigella flexneri 2a str. 301
aacgccucaugcaggcggugcaau

SEQ ID NO: 3916821 - RNA, 21 nt, Shigella flexneri 2a str. 301
aacgccugauagcccgcacaa

SEQ ID NO: 3916822 - RNA, 17 nt, Shigella flexneri 2a str. 301
aacgccugcucuuauua

SEQ ID NO: 3916823 - RNA, 14 nt, Shigella flexneri 2a str. 301
aacgccuguguccu

SEQ ID NO: 3916824 - RNA, 16 nt, Shigella flexneri 2a str. 301
aacgccuuauccggcc

SEQ ID NO: 3916825 - RNA, 18 nt, Shigella flexneri 2a str. 301
aacgccuuauccggccua

SEQ ID NO: 3916826 - RNA, 21 nt, Shigella flexneri 2a str. 301
aacgccuuauccggccuaccg

SEQ ID NO: 3916827 - RNA, 22 nt, Shigella flexneri 2a str. 301
aacgccuuauccggccuggaug

SEQ ID NO: 3916828 - RNA, 16 nt, Shigella flexneri 2a str. 301
aacgccuuauccggcu

SEQ ID NO: 3916829 - RNA, 20 nt, Shigella flexneri 2a str. 301
aacgcgaaggccagaaccac

SEQ ID NO: 3916830 - RNA, 16 nt, Shigella flexneri 2a str. 301
aacgcgaccgccgcca

SEQ ID NO: 3916831 - RNA, 13 nt, Shigella flexneri 2a str. 301
aacgcgccaagau

SEQ ID NO: 3916832 - RNA, 14 nt, Shigella flexneri 2a str. 301
aacgcgcggcuuau

SEQ ID NO: 3916833 - RNA, 17 nt, Shigella flexneri 2a str. 301
aacgcggcuacuuucuu

SEQ ID NO: 3916834 - RNA, 14 nt, Shigella flexneri 2a str. 301
aacgcgucucaugg

SEQ ID NO: 3916835 - RNA, 14 nt, Shigella flexneri 2a str. 301
aacgcguucacugc

SEQ ID NO: 3916836 - RNA, 15 nt, Shigella flexneri 2a str. 301
aacgcguucacugcc

SEQ ID NO: 3916837 - RNA, 15 nt, Shigella flexneri 2a str. 301
aacgcucccugccag

SEQ ID NO: 3916838 - RNA, 16 nt, Shigella flexneri 2a str. 301
aacgcucccugccagu

SEQ ID NO: 3916839 - RNA, 20 nt, Shigella flexneri 2a str. 301
aacgcucggcaacaccucag

SEQ ID NO: 3916840 - RNA, 16 nt, Shigella flexneri 2a str. 301
aacgcucuccugcgga

SEQ ID NO: 3916841 - RNA, 17 nt, Shigella flexneri 2a str. 301
aacgcucugagcugcuc

SEQ ID NO: 3916842 - RNA, 13 nt, Shigella flexneri 2a str. 301
aacgcucugcgcg

SEQ ID NO: 3916843 - RNA, 18 nt, Shigella flexneri 2a str. 301
aacgcugacggugccagg

SEQ ID NO: 3916844 - RNA, 14 nt, Shigella flexneri 2a str. 301
aacgcugccagccg

SEQ ID NO: 3916845 - RNA, 15 nt, Shigella flexneri 2a str. 301
aacgcuucucccagc

SEQ ID NO: 3916846 - RNA, 18 nt, Shigella flexneri 2a str. 301
aacgcuucucccagccgc

SEQ ID NO: 3916847 - RNA, 13 nt, Shigella flexneri 2a str. 301
aacgcuugcugau

SEQ ID NO: 3916848 - RNA, 20 nt, Shigella flexneri 2a str. 301
aacgcuuguaaaugaacuca

SEQ ID NO: 3916849 - RNA, 20 nt, Shigella flexneri 2a str. 301
aacgcuuuacucaacucccc

SEQ ID NO: 3916850 - RNA, 19 nt, Shigella flexneri 2a str. 301
aacgcuuucucaccaugac

SEQ ID NO: 3916851 - RNA, 22 nt, Shigella flexneri 2a str. 301
aacgcuuucucaccaugaccga

SEQ ID NO: 3916852 - RNA, 23 nt, Shigella flexneri 2a str. 301
aacgcuuucuuuggcaucaauca

SEQ ID NO: 3916853 - RNA, 17 nt, Shigella flexneri 2a str. 301
aacgcuuuugcaucggc

SEQ ID NO: 3916854 - RNA, 16 nt, Shigella flexneri 2a str. 301
aacggaaagcagauaa

SEQ ID NO: 3916855 - RNA, 15 nt, Shigella flexneri 2a str. 301
aacggaacgaaaaaa

SEQ ID NO: 3916856 - RNA, 17 nt, Shigella flexneri 2a str. 301
aacggaacgaaaaaaau

SEQ ID NO: 3916857 - RNA, 13 nt, Shigella flexneri 2a str. 301
aacggaccaauaa

SEQ ID NO: 3916858 - RNA, 20 nt, Shigella flexneri 2a str. 301
aacggaccaauaaacgccag

SEQ ID NO: 3916859 - RNA, 15 nt, Shigella flexneri 2a str. 301
aacggacgaccgauu

SEQ ID NO: 3916860 - RNA, 14 nt, Shigella flexneri 2a str. 301
aacggcaaacgcaa

SEQ ID NO: 3916861 - RNA, 18 nt, Shigella flexneri 2a str. 301
aacggcacgacacugcug

SEQ ID NO: 3916862 - RNA, 16 nt, Shigella flexneri 2a str. 301
aacggcacgaugagca

SEQ ID NO: 3916863 - RNA, 17 nt, Shigella flexneri 2a str. 301
aacggcagaagcugcag

SEQ ID NO: 3916864 - RNA, 23 nt, Shigella flexneri 2a str. 301
aacggcagcaaggcuauucagca

SEQ ID NO: 3916865 - RNA, 17 nt, Shigella flexneri 2a str. 301
aacggccaaaguacgga

SEQ ID NO: 3916866 - RNA, 18 nt, Shigella flexneri 2a str. 301
aacggccaaauauccgcg

SEQ ID NO: 3916867 - RNA, 17 nt, Shigella flexneri 2a str. 301
aacggccugaccauuac

SEQ ID NO: 3916868 - RNA, 12 nt, Shigella flexneri 2a str. 301
aacggcgaaaaa

SEQ ID NO: 3916869 - RNA, 16 nt, Shigella flexneri 2a str. 301
aacggcgagccagcgc

SEQ ID NO: 3916870 - RNA, 22 nt, Shigella flexneri 2a str. 301
aacggcgagguacgcccagcgc

SEQ ID NO: 3916871 - RNA, 18 nt, Shigella flexneri 2a str. 301
aacggcgcaccagaauac

SEQ ID NO: 3916872 - RNA, 15 nt, Shigella flexneri 2a str. 301
aacggcgcuuccagc

SEQ ID NO: 3916873 - RNA, 12 nt, Shigella flexneri 2a str. 301
aacggcggauga

SEQ ID NO: 3916874 - RNA, 12 nt, Shigella flexneri 2a str. 301
aacggcggcuug

SEQ ID NO: 3916875 - RNA, 17 nt, Shigella flexneri 2a str. 301
aacggcgguuucgcaaa

SEQ ID NO: 3916876 - RNA, 21 nt, Shigella flexneri 2a str. 301
aacggcgguuucgcaaaccaa

SEQ ID NO: 3916877 - RNA, 14 nt, Shigella flexneri 2a str. 301
aacggcuaaagccg

SEQ ID NO: 3916878 - RNA, 18 nt, Shigella flexneri 2a str. 301
aacgggauuccugcgcuu

SEQ ID NO: 3916879 - RNA, 18 nt, Shigella flexneri 2a str. 301
aacgggcaaucucauacc

SEQ ID NO: 3916880 - RNA, 21 nt, Shigella flexneri 2a str. 301
aacgggcauggugucaccacc

SEQ ID NO: 3916881 - RNA, 19 nt, Shigella flexneri 2a str. 301
aacgggcggcguugaccac

SEQ ID NO: 3916882 - RNA, 23 nt, Shigella flexneri 2a str. 301
aacggggguuuuacuuuuuaacu

SEQ ID NO: 3916883 - RNA, 16 nt, Shigella flexneri 2a str. 301
aacggguuaaauccug

SEQ ID NO: 3916884 - RNA, 20 nt, Shigella flexneri 2a str. 301
aacggguugcgguuucaacu

SEQ ID NO: 3916885 - RNA, 13 nt, Shigella flexneri 2a str. 301
aacgguaagaaca

SEQ ID NO: 3916886 - RNA, 14 nt, Shigella flexneri 2a str. 301
aacgguaaggacaa

SEQ ID NO: 3916887 - RNA, 13 nt, Shigella flexneri 2a str. 301
aacggucacggcu

SEQ ID NO: 3916888 - RNA, 16 nt, Shigella flexneri 2a str. 301
aacggucccucaacaa

SEQ ID NO: 3916889 - RNA, 19 nt, Shigella flexneri 2a str. 301
aacgguccggcauccagcc

SEQ ID NO: 3916890 - RNA, 14 nt, Shigella flexneri 2a str. 301
aacgguccuuacca

SEQ ID NO: 3916891 - RNA, 18 nt, Shigella flexneri 2a str. 301
aacggucgccgcgcaaau

SEQ ID NO: 3916892 - RNA, 22 nt, Shigella flexneri 2a str. 301
aacggucgccgcgcaaauccac

SEQ ID NO: 3916893 - RNA, 12 nt, Shigella flexneri 2a str. 301
aacggucgcgga

SEQ ID NO: 3916894 - RNA, 22 nt, Shigella flexneri 2a str. 301
aacggugaucaaaacgggcaau

SEQ ID NO: 3916895 - RNA, 18 nt, Shigella flexneri 2a str. 301
aacggugcgaccaaacug

SEQ ID NO: 3916896 - RNA, 15 nt, Shigella flexneri 2a str. 301
aacggugucgauacc

SEQ ID NO: 3916897 - RNA, 19 nt, Shigella flexneri 2a str. 301
aacgguuucagcagcggca

SEQ ID NO: 3916898 - RNA, 22 nt, Shigella flexneri 2a str. 301
aacguaaacgcagcaucaugcc

SEQ ID NO: 3916899 - RNA, 14 nt, Shigella flexneri 2a str. 301
aacguaacaaaacu

SEQ ID NO: 3916900 - RNA, 16 nt, Shigella flexneri 2a str. 301
aacguaacaguacaau

SEQ ID NO: 3916901 - RNA, 19 nt, Shigella flexneri 2a str. 301
aacguaaggcgcaacauau

SEQ ID NO: 3916902 - RNA, 14 nt, Shigella flexneri 2a str. 301
aacguacugcugaa

SEQ ID NO: 3916903 - RNA, 16 nt, Shigella flexneri 2a str. 301
aacguaggcacauucg

SEQ ID NO: 3916904 - RNA, 17 nt, Shigella flexneri 2a str. 301
aacuggaagcugccucg

SEQ ID NO: 3916905 - RNA, 16 nt, Shigella flexneri 2a str. 301
aacuggagcaggaacu

SEQ ID NO: 3916906 - RNA, 18 nt, Shigella flexneri 2a str. 301
aacuggauuacaaauaaa

SEQ ID NO: 3916907 - RNA, 11 nt, Shigella flexneri 2a str. 301
aacuggcaaca

SEQ ID NO: 3916908 - RNA, 17 nt, Shigella flexneri 2a str. 301
aacuggcaaccagaaga

SEQ ID NO: 3916909 - RNA, 21 nt, Shigella flexneri 2a str. 301
aacuggcguguuucauuagcc

SEQ ID NO: 3916910 - RNA, 15 nt, Shigella flexneri 2a str. 301
aacuggucaucaaau

SEQ ID NO: 3916911 - RNA, 20 nt, Shigella flexneri 2a str. 301
aacugguggauuauauggaa

SEQ ID NO: 3916912 - RNA, 16 nt, Shigella flexneri 2a str. 301
aacugguguaagucgg

SEQ ID NO: 3916913 - RNA, 19 nt, Shigella flexneri 2a str. 301
aacuguaaugaaucgucgg

SEQ ID NO: 3916914 - RNA, 13 nt, Shigella flexneri 2a str. 301
aacuguacaggcu

SEQ ID NO: 3916915 - RNA, 22 nt, Shigella flexneri 2a str. 301
aacuguaguguugcaguaaauu

SEQ ID NO: 3916916 - RNA, 19 nt, Shigella flexneri 2a str. 301
aacugucgcugaagucucg

SEQ ID NO: 3916917 - RNA, 13 nt, Shigella flexneri 2a str. 301
aacugucuaaugg

SEQ ID NO: 3916918 - RNA, 16 nt, Shigella flexneri 2a str. 301
aacugugccgccgcca

SEQ ID NO: 3916919 - RNA, 19 nt, Shigella flexneri 2a str. 301
aacuguggcgcgaagcccu

SEQ ID NO: 3916920 - RNA, 16 nt, Shigella flexneri 2a str. 301
aacugugguccuggcu

SEQ ID NO: 3916921 - RNA, 13 nt, Shigella flexneri 2a str. 301
aacuguuccaacu

SEQ ID NO: 3916922 - RNA, 13 nt, Shigella flexneri 2a str. 301
aacuguugaccau

SEQ ID NO: 3916923 - RNA, 19 nt, Shigella flexneri 2a str. 301
aacuguugauccaggagcu

SEQ ID NO: 3916924 - RNA, 15 nt, Shigella flexneri 2a str. 301
aacuuaagucuccau

SEQ ID NO: 3916925 - RNA, 14 nt, Shigella flexneri 2a str. 301
aacuuaaugucaua

SEQ ID NO: 3916926 - RNA, 22 nt, Shigella flexneri 2a str. 301
aacuuaccgccgcuccagaauc

SEQ ID NO: 3916927 - RNA, 20 nt, Shigella flexneri 2a str. 301
aacuuacugacaucaaaccc

SEQ ID NO: 3916928 - RNA, 14 nt, Shigella flexneri 2a str. 301
aacuuacugaugca

SEQ ID NO: 3916929 - RNA, 15 nt, Shigella flexneri 2a str. 301
aacuuaucaucaggc

SEQ ID NO: 3916930 - RNA, 14 nt, Shigella flexneri 2a str. 301
aacuuaucuguaau

SEQ ID NO: 3916931 - RNA, 18 nt, Shigella flexneri 2a str. 301
aacuuaucuguaauuaaa

SEQ ID NO: 3916932 - RNA, 17 nt, Shigella flexneri 2a str. 301
aacuucacaucaccaua

SEQ ID NO: 3916933 - RNA, 22 nt, Shigella flexneri 2a str. 301
aacuucacaucaccauagccua

SEQ ID NO: 3916934 - RNA, 14 nt, Shigella flexneri 2a str. 301
aacuucaccagcac

SEQ ID NO: 3916935 - RNA, 20 nt, Shigella flexneri 2a str. 301
aacuucaccagcacuucacu

SEQ ID NO: 3916936 - RNA, 16 nt, Shigella flexneri 2a str. 301
aacuucaccgguucau

SEQ ID NO: 3916937 - RNA, 16 nt, Shigella flexneri 2a str. 301
aacuucacuaaucaau

SEQ ID NO: 3916938 - RNA, 15 nt, Shigella flexneri 2a str. 301
aacuucacucucuuu

SEQ ID NO: 3916939 - RNA, 24 nt, Shigella flexneri 2a str. 301
aacuucacuuccccgagcucaaua

SEQ ID NO: 3916940 - RNA, 15 nt, Shigella flexneri 2a str. 301
aacuuccugagugaa

SEQ ID NO: 3916941 - RNA, 13 nt, Shigella flexneri 2a str. 301
aacuuccugcugg

SEQ ID NO: 3916942 - RNA, 19 nt, Shigella flexneri 2a str. 301
aacuucucuucuuccgcuu

SEQ ID NO: 3916943 - RNA, 14 nt, Shigella flexneri 2a str. 301
aacuucuucaguuu

SEQ ID NO: 3916944 - RNA, 17 nt, Shigella flexneri 2a str. 301
aacuucuucaguuuuuc

SEQ ID NO: 3916945 - RNA, 18 nt, Shigella flexneri 2a str. 301
aacuucuuuuucgacaaa

SEQ ID NO: 3916946 - RNA, 21 nt, Shigella flexneri 2a str. 301
aacuucuuuuucgacaaacac

SEQ ID NO: 3916947 - RNA, 18 nt, Shigella flexneri 2a str. 301
aacuugauagaacaaaag

SEQ ID NO: 3916948 - RNA, 19 nt, Shigella flexneri 2a str. 301
aacuuguagcuuucaacgc

SEQ ID NO: 3916949 - RNA, 15 nt, Shigella flexneri 2a str. 301
aacuuuaagcugaaa

SEQ ID NO: 3916950 - RNA, 17 nt, Shigella flexneri 2a str. 301
aacuuuagucgcccauu

SEQ ID NO: 3916951 - RNA, 17 nt, Shigella flexneri 2a str. 301
aacuuuucaacaaauuc

SEQ ID NO: 3916952 - RNA, 17 nt, Shigella flexneri 2a str. 301
aacuuuucccuacugcu

SEQ ID NO: 3916953 - RNA, 22 nt, Shigella flexneri 2a str. 301
aacuuuugggcguaagaugaca

SEQ ID NO: 3916954 - RNA, 13 nt, Shigella flexneri 2a str. 301
aagaaacaccaga

SEQ ID NO: 3916955 - RNA, 14 nt, Shigella flexneri 2a str. 301
aagaaacauccguu

SEQ ID NO: 3916956 - RNA, 19 nt, Shigella flexneri 2a str. 301
aagaaaccgaaguuguagc

SEQ ID NO: 3916957 - RNA, 13 nt, Shigella flexneri 2a str. 301
aagaaaccgauga

SEQ ID NO: 3916958 - RNA, 17 nt, Shigella flexneri 2a str. 301
aagaaacgccaucugaa

SEQ ID NO: 3916959 - RNA, 19 nt, Shigella flexneri 2a str. 301
aagaaacgccgaaaccgcg

SEQ ID NO: 3916960 - RNA, 16 nt, Shigella flexneri 2a str. 301
aagaaacgcuuaaaac

SEQ ID NO: 3916961 - RNA, 14 nt, Shigella flexneri 2a str. 301
aagaaagguugagg

SEQ ID NO: 3916962 - RNA, 22 nt, Shigella flexneri 2a str. 301
aagaaaguuugcagaaauuguc

SEQ ID NO: 3916963 - RNA, 16 nt, Shigella flexneri 2a str. 301
aagaaauaacgccgga

SEQ ID NO: 3916964 - RNA, 22 nt, Shigella flexneri 2a str. 301
aagaaauaacgccggagagaaa

SEQ ID NO: 3916965 - RNA, 17 nt, Shigella flexneri 2a str. 301
aagaaauccacaaauuc

SEQ ID NO: 3916966 - RNA, 19 nt, Shigella flexneri 2a str. 301
aagaacagccuuaaacuca

SEQ ID NO: 3916967 - RNA, 13 nt, Shigella flexneri 2a str. 301
aagaacaucauuc

SEQ ID NO: 3916968 - RNA, 17 nt, Shigella flexneri 2a str. 301
aagaaccaacgcugcca

SEQ ID NO: 3916969 - RNA, 11 nt, Shigella flexneri 2a str. 301
aagaaccaugc

SEQ ID NO: 3916970 - RNA, 15 nt, Shigella flexneri 2a str. 301
aagaaccugaacgcc

SEQ ID NO: 3916971 - RNA, 14 nt, Shigella flexneri 2a str. 301
aagaacuccugaaa

SEQ ID NO: 3916972 - RNA, 19 nt, Shigella flexneri 2a str. 301
aagaacucgaggauaaauu

SEQ ID NO: 3916973 - RNA, 22 nt, Shigella flexneri 2a str. 301
aagaacucgaggauaaauuuuc

SEQ ID NO: 3916974 - RNA, 12 nt, Shigella flexneri 2a str. 301
aagaacugacuu

SEQ ID NO: 3916975 - RNA, 15 nt, Shigella flexneri 2a str. 301
aagaacugcuugccc

SEQ ID NO: 3916976 - RNA, 22 nt, Shigella flexneri 2a str. 301
aagaagaccugccagaacaacc

SEQ ID NO: 3916977 - RNA, 23 nt, Shigella flexneri 2a str. 301
aagaagaccugccagaacaacca

SEQ ID NO: 3916978 - RNA, 24 nt, Shigella flexneri 2a str. 301
aagaagaccugccagaacaaccag

SEQ ID NO: 3916979 - RNA, 22 nt, Shigella flexneri 2a str. 301
aagaagaucguggagaacaaua

SEQ ID NO: 3916980 - RNA, 22 nt, Shigella flexneri 2a str. 301
aagaagccuuuaucugguuguu

SEQ ID NO: 3916981 - RNA, 18 nt, Shigella flexneri 2a str. 301
aagaagcggugaaaaaau

SEQ ID NO: 3916982 - RNA, 19 nt, Shigella flexneri 2a str. 301
aagaagcuuuccacgcagg

SEQ ID NO: 3916983 - RNA, 16 nt, Shigella flexneri 2a str. 301
aagaagcuuuucucaa

SEQ ID NO: 3916984 - RNA, 14 nt, Shigella flexneri 2a str. 301
aagaaggaaaauac

SEQ ID NO: 3916985 - RNA, 20 nt, Shigella flexneri 2a str. 301
aagaagggcuggccaauugg

SEQ ID NO: 3916986 - RNA, 20 nt, Shigella flexneri 2a str. 301
aagaaguaaaacagucgcuc

SEQ ID NO: 3916987 - RNA, 17 nt, Shigella flexneri 2a str. 301
aagaagucauuggcuga

SEQ ID NO: 3916988 - RNA, 17 nt, Shigella flexneri 2a str. 301
aagaauaaaacgccuga

SEQ ID NO: 3916989 - RNA, 21 nt, Shigella flexneri 2a str. 301
aagaauaucagagcccucauu

SEQ ID NO: 3916990 - RNA, 16 nt, Shigella flexneri 2a str. 301
aagaauaucuucuguu

SEQ ID NO: 3916991 - RNA, 21 nt, Shigella flexneri 2a str. 301
aagaauaugcuuugccuuauu

SEQ ID NO: 3916992 - RNA, 14 nt, Shigella flexneri 2a str. 301
aagaaucaugccaa

SEQ ID NO: 3916993 - RNA, 16 nt, Shigella flexneri 2a str. 301
aagaaugacacuuuca

SEQ ID NO: 3916994 - RNA, 22 nt, Shigella flexneri 2a str. 301
aagaaugacacuuucagcgcag

SEQ ID NO: 3916995 - RNA, 15 nt, Shigella flexneri 2a str. 301
aagaaugccugccag

SEQ ID NO: 3916996 - RNA, 16 nt, Shigella flexneri 2a str. 301
aagaaugcgaaaacga

SEQ ID NO: 3916997 - RNA, 20 nt, Shigella flexneri 2a str. 301
aagaauguccauuauuucaa

SEQ ID NO: 3916998 - RNA, 21 nt, Shigella flexneri 2a str. 301
aagaauguccauuauuucaau

SEQ ID NO: 3916999 - RNA, 19 nt, Shigella flexneri 2a str. 301
aagaauguuaaauacagau

SEQ ID NO: 3917000 - RNA, 14 nt, Shigella flexneri 2a str. 301
aagaauuaaaauau

SEQ ID NO: 3917001 - RNA, 23 nt, Shigella flexneri 2a str. 301
aagaauugauaaaaaaaacgcca

SEQ ID NO: 3917002 - RNA, 13 nt, Shigella flexneri 2a str. 301
aagacaauuuaau

SEQ ID NO: 3917003 - RNA, 20 nt, Shigella flexneri 2a str. 301
aagacacuaacgcgucuuau

SEQ ID NO: 3917004 - RNA, 21 nt, Shigella flexneri 2a str. 301
aagcagcgaugcuuugcgcuu

SEQ ID NO: 3917005 - RNA, 12 nt, Shigella flexneri 2a str. 301
aagcagcuugcu

SEQ ID NO: 3917006 - RNA, 18 nt, Shigella flexneri 2a str. 301
aagcaggccagauagcca

SEQ ID NO: 3917007 - RNA, 15 nt, Shigella flexneri 2a str. 301
aagcaggcuucacgc

SEQ ID NO: 3917008 - RNA, 16 nt, Shigella flexneri 2a str. 301
aagcaggguugcagcc

SEQ ID NO: 3917009 - RNA, 17 nt, Shigella flexneri 2a str. 301
aagcaggucggcucagc

SEQ ID NO: 3917010 - RNA, 12 nt, Shigella flexneri 2a str. 301
aagcaguccagc

SEQ ID NO: 3917011 - RNA, 20 nt, Shigella flexneri 2a str. 301
aagcaguccagcgccugacg

SEQ ID NO: 3917012 - RNA, 15 nt, Shigella flexneri 2a str. 301
aagcaguuucaccag

SEQ ID NO: 3917013 - RNA, 17 nt, Shigella flexneri 2a str. 301
aagcaguuucaccagca

SEQ ID NO: 3917014 - RNA, 14 nt, Shigella flexneri 2a str. 301
aagcaucaauugcu

SEQ ID NO: 3917015 - RNA, 23 nt, Shigella flexneri 2a str. 301
aagcaucagggcgauuagcagca

SEQ ID NO: 3917016 - RNA, 23 nt, Shigella flexneri 2a str. 301
aagcaucgcaacgccuaaauccg

SEQ ID NO: 3917017 - RNA, 13 nt, Shigella flexneri 2a str. 301
aagcaugauauuc

SEQ ID NO: 3917018 - RNA, 21 nt, Shigella flexneri 2a str. 301
aagcaugaucgaggcaaagag

SEQ ID NO: 3917019 - RNA, 20 nt, Shigella flexneri 2a str. 301
aagcaugucauacaugguuu

SEQ ID NO: 3917020 - RNA, 18 nt, Shigella flexneri 2a str. 301
aagcauuauauaaugcca

SEQ ID NO: 3917021 - RNA, 19 nt, Shigella flexneri 2a str. 301
aagcauuauauaaugccag

SEQ ID NO: 3917022 - RNA, 21 nt, Shigella flexneri 2a str. 301
aagcauuuggugucgcugaaa

SEQ ID NO: 3917023 - RNA, 18 nt, Shigella flexneri 2a str. 301
aagcauuuuuucacaugu

SEQ ID NO: 3917024 - RNA, 14 nt, Shigella flexneri 2a str. 301
aagccaacagcagc

SEQ ID NO: 3917025 - RNA, 18 nt, Shigella flexneri 2a str. 301
aagccaacagcagccaca

SEQ ID NO: 3917026 - RNA, 13 nt, Shigella flexneri 2a str. 301
aagccaccacgcc

SEQ ID NO: 3917027 - RNA, 18 nt, Shigella flexneri 2a str. 301
aagccaccacgccaagaa

SEQ ID NO: 3917028 - RNA, 20 nt, Shigella flexneri 2a str. 301
aagccaccgaacaaaacagc

SEQ ID NO: 3917029 - RNA, 19 nt, Shigella flexneri 2a str. 301
aagccacugugcgcgccag

SEQ ID NO: 3917030 - RNA, 15 nt, Shigella flexneri 2a str. 301
aagccagcauacagc

SEQ ID NO: 3917031 - RNA, 14 nt, Shigella flexneri 2a str. 301
aagccagguuuuga

SEQ ID NO: 3917032 - RNA, 19 nt, Shigella flexneri 2a str. 301
aagccauaucguucugcca

SEQ ID NO: 3917033 - RNA, 21 nt, Shigella flexneri 2a str. 301
aagccauaucguucugccaga

SEQ ID NO: 3917034 - RNA, 13 nt, Shigella flexneri 2a str. 301
aagccauccagca

SEQ ID NO: 3917035 - RNA, 14 nt, Shigella flexneri 2a str. 301
aagccaucccugua

SEQ ID NO: 3917036 - RNA, 13 nt, Shigella flexneri 2a str. 301
aagccaugcccgu

SEQ ID NO: 3917037 - RNA, 20 nt, Shigella flexneri 2a str. 301
aagccauguuuaacuccuuc

SEQ ID NO: 3917038 - RNA, 21 nt, Shigella flexneri 2a str. 301
aagcccaaaucauaaaaauca

SEQ ID NO: 3917039 - RNA, 15 nt, Shigella flexneri 2a str. 301
aagcccauaccacag

SEQ ID NO: 3917040 - RNA, 13 nt, Shigella flexneri 2a str. 301
aagccccagcagg

SEQ ID NO: 3917041 - RNA, 17 nt, Shigella flexneri 2a str. 301
aagccccagcaggaugu

SEQ ID NO: 3917042 - RNA, 19 nt, Shigella flexneri 2a str. 301
aagcccccgcaacauugcg

SEQ ID NO: 3917043 - RNA, 15 nt, Shigella flexneri 2a str. 301
aagcccgccaucgcc

SEQ ID NO: 3917044 - RNA, 13 nt, Shigella flexneri 2a str. 301
aagcccucaaaca

SEQ ID NO: 3917045 - RNA, 13 nt, Shigella flexneri 2a str. 301
aagccgccaaacg

SEQ ID NO: 3917046 - RNA, 19 nt, Shigella flexneri 2a str. 301
aagccgccaucucuuccag

SEQ ID NO: 3917047 - RNA, 15 nt, Shigella flexneri 2a str. 301
aagccgccgccgcug

SEQ ID NO: 3917048 - RNA, 17 nt, Shigella flexneri 2a str. 301
aagccgcgugcgcugga

SEQ ID NO: 3917049 - RNA, 16 nt, Shigella flexneri 2a str. 301
aagccgcuaacagcag

SEQ ID NO: 3917050 - RNA, 18 nt, Shigella flexneri 2a str. 301
aagccgcuaacagcagca

SEQ ID NO: 3917051 - RNA, 16 nt, Shigella flexneri 2a str. 301
aagccggaauuuuccu

SEQ ID NO: 3917052 - RNA, 17 nt, Shigella flexneri 2a str. 301
aagccggaugaucaucc

SEQ ID NO: 3917053 - RNA, 21 nt, Shigella flexneri 2a str. 301
aagccggaugaucauccggcu

SEQ ID NO: 3917054 - RNA, 18 nt, Shigella flexneri 2a str. 301
aagccguuagucaucauc

SEQ ID NO: 3917055 - RNA, 22 nt, Shigella flexneri 2a str. 301
aagccguuagucaucaucagga

SEQ ID NO: 3917056 - RNA, 12 nt, Shigella flexneri 2a str. 301
aagccugacagg

SEQ ID NO: 3917057 - RNA, 15 nt, Shigella flexneri 2a str. 301
aagccugauaagcgu

SEQ ID NO: 3917058 - RNA, 23 nt, Shigella flexneri 2a str. 301
aagccugcccgugggcaggccug

SEQ ID NO: 3917059 - RNA, 20 nt, Shigella flexneri 2a str. 301
aagccuguuuagccgcuucu

SEQ ID NO: 3917060 - RNA, 18 nt, Shigella flexneri 2a str. 301
aagccuuccgcaaacagg

SEQ ID NO: 3917061 - RNA, 17 nt, Shigella flexneri 2a str. 301
aagccuucgccuuucag

SEQ ID NO: 3917062 - RNA, 22 nt, Shigella flexneri 2a str. 301
aagccuuucaggaaacugcgcc

SEQ ID NO: 3917063 - RNA, 16 nt, Shigella flexneri 2a str. 301
aagcgaguugcgccag

SEQ ID NO: 3917064 - RNA, 21 nt, Shigella flexneri 2a str. 301
aagcgaguugcgccaguauga

SEQ ID NO: 3917065 - RNA, 14 nt, Shigella flexneri 2a str. 301
aagcgauaacgcug

SEQ ID NO: 3917066 - RNA, 21 nt, Shigella flexneri 2a str. 301
aagcgauaacgcuggcagcaa

SEQ ID NO: 3917067 - RNA, 15 nt, Shigella flexneri 2a str. 301
aagcgaucuuucugu

SEQ ID NO: 3917068 - RNA, 17 nt, Shigella flexneri 2a str. 301
aagcgcaaaggccagca

SEQ ID NO: 3917069 - RNA, 17 nt, Shigella flexneri 2a str. 301
aagcgcacaauggcggu

SEQ ID NO: 3917070 - RNA, 20 nt, Shigella flexneri 2a str. 301
aagcgcaccugaucagcaau

SEQ ID NO: 3917071 - RNA, 20 nt, Shigella flexneri 2a str. 301
aagcgcacuuuacuggucug

SEQ ID NO: 3917072 - RNA, 18 nt, Shigella flexneri 2a str. 301
aagcgcacuuugccagaa

SEQ ID NO: 3917073 - RNA, 22 nt, Shigella flexneri 2a str. 301
aagcgcacuuugucaaaaaucu

SEQ ID NO: 3917074 - RNA, 14 nt, Shigella flexneri 2a str. 301
aagcgcagccaaaa

SEQ ID NO: 3917075 - RNA, 15 nt, Shigella flexneri 2a str. 301
aagcgcagcgcauca

SEQ ID NO: 3917076 - RNA, 16 nt, Shigella flexneri 2a str. 301
aagcgccaaaucugcc

SEQ ID NO: 3917077 - RNA, 16 nt, Shigella flexneri 2a str. 301
aagcgccacaaucgcu

SEQ ID NO: 3917078 - RNA, 14 nt, Shigella flexneri 2a str. 301
aagcgccaucaaug

SEQ ID NO: 3917079 - RNA, 19 nt, Shigella flexneri 2a str. 301
aagcgccgaguaaaaaaac

SEQ ID NO: 3917080 - RNA, 19 nt, Shigella flexneri 2a str. 301
aagcgccggacauugcguu

SEQ ID NO: 3917081 - RNA, 13 nt, Shigella flexneri 2a str. 301
aagcgccgggaau

SEQ ID NO: 3917082 - RNA, 17 nt, Shigella flexneri 2a str. 301
aagcgcgcuagccuguu

SEQ ID NO: 3917083 - RNA, 20 nt, Shigella flexneri 2a str. 301
aagcgcucccgcaggagcgc

SEQ ID NO: 3917084 - RNA, 19 nt, Shigella flexneri 2a str. 301
aagcgcugagacgcgcuug

SEQ ID NO: 3917085 - RNA, 13 nt, Shigella flexneri 2a str. 301
aagcggcacugcu

SEQ ID NO: 3917086 - RNA, 19 nt, Shigella flexneri 2a str. 301
aagcggccgucagaucgcc

SEQ ID NO: 3917087 - RNA, 15 nt, Shigella flexneri 2a str. 301
aagcggcgcucugcc

SEQ ID NO: 3917088 - RNA, 23 nt, Shigella flexneri 2a str. 301
aagcggcguuccaccgcucccag

SEQ ID NO: 3917089 - RNA, 15 nt, Shigella flexneri 2a str. 301
aagcggugauaaacc

SEQ ID NO: 3917090 - RNA, 18 nt, Shigella flexneri 2a str. 301
aagcguaauugauccgcg

SEQ ID NO: 3917091 - RNA, 21 nt, Shigella flexneri 2a str. 301
aagcguagcgcaucaggcaau

SEQ ID NO: 3917092 - RNA, 17 nt, Shigella flexneri 2a str. 301
aagcguauccaucacua

SEQ ID NO: 3917093 - RNA, 14 nt, Shigella flexneri 2a str. 301
aagcguauguggug

SEQ ID NO: 3917094 - RNA, 12 nt, Shigella flexneri 2a str. 301
aagcgucaccgg

SEQ ID NO: 3917095 - RNA, 21 nt, Shigella flexneri 2a str. 301
aagcgucaccggaaccgucgc

SEQ ID NO: 3917096 - RNA, 15 nt, Shigella flexneri 2a str. 301
aagcgucagaaaaau

SEQ ID NO: 3917097 - RNA, 13 nt, Shigella flexneri 2a str. 301
aagcgucagcuuu

SEQ ID NO: 3917098 - RNA, 16 nt, Shigella flexneri 2a str. 301
aagcgugcaaauauac

SEQ ID NO: 3917099 - RNA, 20 nt, Shigella flexneri 2a str. 301
aagcucgcucaucgaagaga

SEQ ID NO: 3917100 - RNA, 23 nt, Shigella flexneri 2a str. 301
aagcucugguguggagugcagca

SEQ ID NO: 3917101 - RNA, 18 nt, Shigella flexneri 2a str. 301
aagcugaaaauggcgcug

SEQ ID NO: 3917102 - RNA, 14 nt, Shigella flexneri 2a str. 301
aagcugagcacaaa

SEQ ID NO: 3917103 - RNA, 16 nt, Shigella flexneri 2a str. 301
aagcugcaaggugaaa

SEQ ID NO: 3917104 - RNA, 20 nt, Shigella flexneri 2a str. 301
aaguagccuucaucagauga

SEQ ID NO: 3917105 - RNA, 15 nt, Shigella flexneri 2a str. 301
aaguagcugaaaauc

SEQ ID NO: 3917106 - RNA, 16 nt, Shigella flexneri 2a str. 301
aaguagugauuuuaau

SEQ ID NO: 3917107 - RNA, 23 nt, Shigella flexneri 2a str. 301
aaguaguguagcacuugcagcuc

SEQ ID NO: 3917108 - RNA, 17 nt, Shigella flexneri 2a str. 301
aaguaguuccagcauga

SEQ ID NO: 3917109 - RNA, 16 nt, Shigella flexneri 2a str. 301
aaguauauaaaaaaca

SEQ ID NO: 3917110 - RNA, 18 nt, Shigella flexneri 2a str. 301
aaguauauaaaaaacaau

SEQ ID NO: 3917111 - RNA, 19 nt, Shigella flexneri 2a str. 301
aaguauccacacagacaau

SEQ ID NO: 3917112 - RNA, 20 nt, Shigella flexneri 2a str. 301
aaguauugcgcaaauguuug

SEQ ID NO: 3917113 - RNA, 13 nt, Shigella flexneri 2a str. 301
aagucaaacuggu

SEQ ID NO: 3917114 - RNA, 17 nt, Shigella flexneri 2a str. 301
aagucaggguauuaacc

SEQ ID NO: 3917115 - RNA, 16 nt, Shigella flexneri 2a str. 301
aagucauuaccagcga

SEQ ID NO: 3917116 - RNA, 15 nt, Shigella flexneri 2a str. 301
aagucauuguccagu

SEQ ID NO: 3917117 - RNA, 12 nt, Shigella flexneri 2a str. 301
aaguccaaaagg

SEQ ID NO: 3917118 - RNA, 16 nt, Shigella flexneri 2a str. 301
aaguccauacugucuc

SEQ ID NO: 3917119 - RNA, 22 nt, Shigella flexneri 2a str. 301
aaguccccaguaaucgggcaac

SEQ ID NO: 3917120 - RNA, 12 nt, Shigella flexneri 2a str. 301
aagucgaaccuu

SEQ ID NO: 3917121 - RNA, 18 nt, Shigella flexneri 2a str. 301
aagucgggaaacuuaaca

SEQ ID NO: 3917122 - RNA, 16 nt, Shigella flexneri 2a str. 301
aagucggucacagucu

SEQ ID NO: 3917123 - RNA, 20 nt, Shigella flexneri 2a str. 301
aagucguaggccugauaaga

SEQ ID NO: 3917124 - RNA, 22 nt, Shigella flexneri 2a str. 301
aagucguucagaucuuucacga

SEQ ID NO: 3917125 - RNA, 17 nt, Shigella flexneri 2a str. 301
aagucucaauuaguaau

SEQ ID NO: 3917126 - RNA, 12 nt, Shigella flexneri 2a str. 301
aagucucagaaa

SEQ ID NO: 3917127 - RNA, 23 nt, Shigella flexneri 2a str. 301
aagucuuccggugcaucaacaua

SEQ ID NO: 3917128 - RNA, 22 nt, Shigella flexneri 2a str. 301
aagucuuuuuucaacuuuaucu

SEQ ID NO: 3917129 - RNA, 19 nt, Shigella flexneri 2a str. 301
aagugaaaaacaccccauu

SEQ ID NO: 3917130 - RNA, 22 nt, Shigella flexneri 2a str. 301
aagugaauacagaacagugcca

SEQ ID NO: 3917131 - RNA, 15 nt, Shigella flexneri 2a str. 301
aagugauuuuuaaua

SEQ ID NO: 3917132 - RNA, 23 nt, Shigella flexneri 2a str. 301
aagugcgucacgcauucagcaaa

SEQ ID NO: 3917133 - RNA, 16 nt, Shigella flexneri 2a str. 301
aagugcugggaaaccu

SEQ ID NO: 3917134 - RNA, 21 nt, Shigella flexneri 2a str. 301
aaguggacucuauggcuggca

SEQ ID NO: 3917135 - RNA, 17 nt, Shigella flexneri 2a str. 301
aaguggcgauacagugc

SEQ ID NO: 3917136 - RNA, 23 nt, Shigella flexneri 2a str. 301
aaguggcggggucgugcagaacg

SEQ ID NO: 3917137 - RNA, 17 nt, Shigella flexneri 2a str. 301
aagugguguugaagaaa

SEQ ID NO: 3917138 - RNA, 14 nt, Shigella flexneri 2a str. 301
aagugguuucauga

SEQ ID NO: 3917139 - RNA, 16 nt, Shigella flexneri 2a str. 301
aaguuaauccacagca

SEQ ID NO: 3917140 - RNA, 19 nt, Shigella flexneri 2a str. 301
aaguuaauccacagcaaug

SEQ ID NO: 3917141 - RNA, 16 nt, Shigella flexneri 2a str. 301
aaguuagaggcacaua

SEQ ID NO: 3917142 - RNA, 21 nt, Shigella flexneri 2a str. 301
aaguuauacagacucaaacca

SEQ ID NO: 3917143 - RNA, 21 nt, Shigella flexneri 2a str. 301
aaguuauccugguacucgacu

SEQ ID NO: 3917144 - RNA, 20 nt, Shigella flexneri 2a str. 301
aaguucaggguuaaaucuca

SEQ ID NO: 3917145 - RNA, 22 nt, Shigella flexneri 2a str. 301
aaguucguugguguccacgccg

SEQ ID NO: 3917146 - RNA, 21 nt, Shigella flexneri 2a str. 301
aaguucuucgaagcacucgua

SEQ ID NO: 3917147 - RNA, 17 nt, Shigella flexneri 2a str. 301
aaguugcucaagcugaa

SEQ ID NO: 3917148 - RNA, 23 nt, Shigella flexneri 2a str. 301
aaguugcucaagcugaacauuuu

SEQ ID NO: 3917149 - RNA, 20 nt, Shigella flexneri 2a str. 301
aaguuggugauguauaucgg

SEQ ID NO: 3917150 - RNA, 11 nt, Shigella flexneri 2a str. 301
aaguuuaaccu

SEQ ID NO: 3917151 - RNA, 22 nt, Shigella flexneri 2a str. 301
aaguuucacugggcgauuaaua

SEQ ID NO: 3917152 - RNA, 17 nt, Shigella flexneri 2a str. 301
aaguuugcuucagaaua

SEQ ID NO: 3917153 - RNA, 21 nt, Shigella flexneri 2a str. 301
aaguuuuagcaugcaggcugg

SEQ ID NO: 3917154 - RNA, 12 nt, Shigella flexneri 2a str. 301
aaguuuuccuca

SEQ ID NO: 3917155 - RNA, 13 nt, Shigella flexneri 2a str. 301
aaguuuuccucag

SEQ ID NO: 3917156 - RNA, 12 nt, Shigella flexneri 2a str. 301
aaguuuuuauga

SEQ ID NO: 3917157 - RNA, 16 nt, Shigella flexneri 2a str. 301
aaguuuuuaugaguuu

SEQ ID NO: 3917158 - RNA, 14 nt, Shigella flexneri 2a str. 301
aaguuuuucaacac

SEQ ID NO: 3917159 - RNA, 14 nt, Shigella flexneri 2a str. 301
aauaaaaauugaau

SEQ ID NO: 3917160 - RNA, 14 nt, Shigella flexneri 2a str. 301
aauaaaacagaaac

SEQ ID NO: 3917161 - RNA, 14 nt, Shigella flexneri 2a str. 301
aauaaaacagggcg

SEQ ID NO: 3917162 - RNA, 14 nt, Shigella flexneri 2a str. 301
aauaaaacaucacc

SEQ ID NO: 3917163 - RNA, 14 nt, Shigella flexneri 2a str. 301
aauaaaagccagga

SEQ ID NO: 3917164 - RNA, 13 nt, Shigella flexneri 2a str. 301
aauaaaauaucuu

SEQ ID NO: 3917165 - RNA, 14 nt, Shigella flexneri 2a str. 301
aauaaaaucuauua

SEQ ID NO: 3917166 - RNA, 15 nt, Shigella flexneri 2a str. 301
aauaaaaucuauuau

SEQ ID NO: 3917167 - RNA, 18 nt, Shigella flexneri 2a str. 301
aauaaaauucuccagcgc

SEQ ID NO: 3917168 - RNA, 22 nt, Shigella flexneri 2a str. 301
aauaaacaaugagauauuuaaa

SEQ ID NO: 3917169 - RNA, 21 nt, Shigella flexneri 2a str. 301
aauaaacaucagcuauucuua

SEQ ID NO: 3917170 - RNA, 19 nt, Shigella flexneri 2a str. 301
aauaaacaugaugaucuua

SEQ ID NO: 3917171 - RNA, 22 nt, Shigella flexneri 2a str. 301
aauaaacaugaugaucuuauga

SEQ ID NO: 3917172 - RNA, 22 nt, Shigella flexneri 2a str. 301
aauaaaccugccuuacauauca

SEQ ID NO: 3917173 - RNA, 15 nt, Shigella flexneri 2a str. 301
aauaaacuuuugggc

SEQ ID NO: 3917174 - RNA, 21 nt, Shigella flexneri 2a str. 301
aauaaagccuauccagaagcc

SEQ ID NO: 3917175 - RNA, 20 nt, Shigella flexneri 2a str. 301
aauaaauacacuauaaaaua

SEQ ID NO: 3917176 - RNA, 20 nt, Shigella flexneri 2a str. 301
aauaaauaugggugcaauga

SEQ ID NO: 3917177 - RNA, 18 nt, Shigella flexneri 2a str. 301
aauaaauauuaauacaac

SEQ ID NO: 3917178 - RNA, 23 nt, Shigella flexneri 2a str. 301
aauaaauccccggcggcguucag

SEQ ID NO: 3917179 - RNA, 16 nt, Shigella flexneri 2a str. 301
aauaaaucuaaaagau

SEQ ID NO: 3917180 - RNA, 17 nt, Shigella flexneri 2a str. 301
aauaaaucuaaaagaug

SEQ ID NO: 3917181 - RNA, 11 nt, Shigella flexneri 2a str. 301
aauaaauuuag

SEQ ID NO: 3917182 - RNA, 12 nt, Shigella flexneri 2a str. 301
aauaaauuuuau

SEQ ID NO: 3917183 - RNA, 14 nt, Shigella flexneri 2a str. 301
aauaacaauacuua

SEQ ID NO: 3917184 - RNA, 18 nt, Shigella flexneri 2a str. 301
aauaacaauacuuauaaa

SEQ ID NO: 3917185 - RNA, 20 nt, Shigella flexneri 2a str. 301
aauaacaauacuuauaaacc

SEQ ID NO: 3917186 - RNA, 16 nt, Shigella flexneri 2a str. 301
aauaacacauauauua

SEQ ID NO: 3917187 - RNA, 17 nt, Shigella flexneri 2a str. 301
aauaacacauauauuaa

SEQ ID NO: 3917188 - RNA, 15 nt, Shigella flexneri 2a str. 301
aauaacaccagccag

SEQ ID NO: 3917189 - RNA, 15 nt, Shigella flexneri 2a str. 301
aauaacacgcggcuu

SEQ ID NO: 3917190 - RNA, 18 nt, Shigella flexneri 2a str. 301
aauaacagauuuuuaugc

SEQ ID NO: 3917191 - RNA, 18 nt, Shigella flexneri 2a str. 301
aauaaccacaacggcaau

SEQ ID NO: 3917192 - RNA, 13 nt, Shigella flexneri 2a str. 301
aauaaccauauau

SEQ ID NO: 3917193 - RNA, 14 nt, Shigella flexneri 2a str. 301
aauaaccaucagcu

SEQ ID NO: 3917194 - RNA, 18 nt, Shigella flexneri 2a str. 301
aauaaccauggcagaagc

SEQ ID NO: 3917195 - RNA, 19 nt, Shigella flexneri 2a str. 301
aauaaccauggcagaagca

SEQ ID NO: 3917196 - RNA, 20 nt, Shigella flexneri 2a str. 301
aauaaccauuccacgggcaa

SEQ ID NO: 3917197 - RNA, 16 nt, Shigella flexneri 2a str. 301
aauaacccgcuguaaa

SEQ ID NO: 3917198 - RNA, 22 nt, Shigella flexneri 2a str. 301
aauaacccgcuguaaaugcugc

SEQ ID NO: 3917199 - RNA, 16 nt, Shigella flexneri 2a str. 301
aauaaccggcacuuca

SEQ ID NO: 3917200 - RNA, 19 nt, Shigella flexneri 2a str. 301
aauaacggcucaaacugcu

SEQ ID NO: 3917201 - RNA, 22 nt, Shigella flexneri 2a str. 301
aauaacguaaaaacccgcuucg

SEQ ID NO: 3917202 - RNA, 22 nt, Shigella flexneri 2a str. 301
aauaacucacccaugaagaaua

SEQ ID NO: 3917203 - RNA, 19 nt, Shigella flexneri 2a str. 301
aauaacugcuauucaccag

SEQ ID NO: 3917204 - RNA, 19 nt, Shigella flexneri 2a str. 301
aauacuuucacaaaaauaa

SEQ ID NO: 3917205 - RNA, 20 nt, Shigella flexneri 2a str. 301
aauacuuuuacucucuggac

SEQ ID NO: 3917206 - RNA, 20 nt, Shigella flexneri 2a str. 301
aauagaacuauaauugcuuu

SEQ ID NO: 3917207 - RNA, 14 nt, Shigella flexneri 2a str. 301
aauagacggagggg

SEQ ID NO: 3917208 - RNA, 15 nt, Shigella flexneri 2a str. 301
aauagagauagaaug

SEQ ID NO: 3917209 - RNA, 17 nt, Shigella flexneri 2a str. 301
aauagagaucucucuug

SEQ ID NO: 3917210 - RNA, 21 nt, Shigella flexneri 2a str. 301
aauagagugguuagagcacag

SEQ ID NO: 3917211 - RNA, 16 nt, Shigella flexneri 2a str. 301
aauagcaacugauuua

SEQ ID NO: 3917212 - RNA, 17 nt, Shigella flexneri 2a str. 301
aauagcaacugauuuau

SEQ ID NO: 3917213 - RNA, 19 nt, Shigella flexneri 2a str. 301
aauagcaacugauuuauag

SEQ ID NO: 3917214 - RNA, 14 nt, Shigella flexneri 2a str. 301
aauagcaauauuuu

SEQ ID NO: 3917215 - RNA, 16 nt, Shigella flexneri 2a str. 301
aauagcacugcuuucc

SEQ ID NO: 3917216 - RNA, 14 nt, Shigella flexneri 2a str. 301
aauagcauccacca

SEQ ID NO: 3917217 - RNA, 17 nt, Shigella flexneri 2a str. 301
aauagccacauugcugc

SEQ ID NO: 3917218 - RNA, 20 nt, Shigella flexneri 2a str. 301
aauagccagcagagcaaaaa

SEQ ID NO: 3917219 - RNA, 16 nt, Shigella flexneri 2a str. 301
aauagccaucacaaaa

SEQ ID NO: 3917220 - RNA, 16 nt, Shigella flexneri 2a str. 301
aauagcccucgccgcu

SEQ ID NO: 3917221 - RNA, 19 nt, Shigella flexneri 2a str. 301
aauagcccucgccgcuucc

SEQ ID NO: 3917222 - RNA, 24 nt, Shigella flexneri 2a str. 301
aauagccgcagccaucagcgagac

SEQ ID NO: 3917223 - RNA, 18 nt, Shigella flexneri 2a str. 301
aauagccugccagaggag

SEQ ID NO: 3917224 - RNA, 23 nt, Shigella flexneri 2a str. 301
aauagcgccugcugcuguugcgu

SEQ ID NO: 3917225 - RNA, 20 nt, Shigella flexneri 2a str. 301
aauagcggaaaucuccagau

SEQ ID NO: 3917226 - RNA, 19 nt, Shigella flexneri 2a str. 301
aauagcggacacuaccauu

SEQ ID NO: 3917227 - RNA, 20 nt, Shigella flexneri 2a str. 301
aauagcgucuacuaacgcuu

SEQ ID NO: 3917228 - RNA, 19 nt, Shigella flexneri 2a str. 301
aauagcguuaaucaucaac

SEQ ID NO: 3917229 - RNA, 15 nt, Shigella flexneri 2a str. 301
aauagcuucuucaac

SEQ ID NO: 3917230 - RNA, 13 nt, Shigella flexneri 2a str. 301
aauagcuuuaccc

SEQ ID NO: 3917231 - RNA, 13 nt, Shigella flexneri 2a str. 301
aauaggaaucauu

SEQ ID NO: 3917232 - RNA, 17 nt, Shigella flexneri 2a str. 301
aauaguccggaagaugc

SEQ ID NO: 3917233 - RNA, 14 nt, Shigella flexneri 2a str. 301
aauagugccgcacu

SEQ ID NO: 3917234 - RNA, 22 nt, Shigella flexneri 2a str. 301
aauagugccuggcugcgugagg

SEQ ID NO: 3917235 - RNA, 22 nt, Shigella flexneri 2a str. 301
aauagugcuuuuuacuaagagu

SEQ ID NO: 3917236 - RNA, 22 nt, Shigella flexneri 2a str. 301
aauaguuccacuauuucaauau

SEQ ID NO: 3917237 - RNA, 14 nt, Shigella flexneri 2a str. 301
aauaguuucaguau

SEQ ID NO: 3917238 - RNA, 16 nt, Shigella flexneri 2a str. 301
aauaguuuccgcuucu

SEQ ID NO: 3917239 - RNA, 18 nt, Shigella flexneri 2a str. 301
aauaguuucugacauuuu

SEQ ID NO: 3917240 - RNA, 21 nt, Shigella flexneri 2a str. 301
aauauacagccuuaacaagau

SEQ ID NO: 3917241 - RNA, 16 nt, Shigella flexneri 2a str. 301
aauauagcgccacgcu

SEQ ID NO: 3917242 - RNA, 20 nt, Shigella flexneri 2a str. 301
aauauaguagaucuugauuu

SEQ ID NO: 3917243 - RNA, 17 nt, Shigella flexneri 2a str. 301
aauauauaaaaaaacaa

SEQ ID NO: 3917244 - RNA, 13 nt, Shigella flexneri 2a str. 301
aauauauaaagau

SEQ ID NO: 3917245 - RNA, 22 nt, Shigella flexneri 2a str. 301
aauauauacaccaacaggugcc

SEQ ID NO: 3917246 - RNA, 21 nt, Shigella flexneri 2a str. 301
aauauaucagccugaaugcuu

SEQ ID NO: 3917247 - RNA, 23 nt, Shigella flexneri 2a str. 301
aauauauccccccaugaaauaaa

SEQ ID NO: 3917248 - RNA, 19 nt, Shigella flexneri 2a str. 301
aauauauccgaaaaaggau

SEQ ID NO: 3917249 - RNA, 20 nt, Shigella flexneri 2a str. 301
aauauauccgaaaaaggaua

SEQ ID NO: 3917250 - RNA, 22 nt, Shigella flexneri 2a str. 301
aauauauuccccggucagcagc

SEQ ID NO: 3917251 - RNA, 21 nt, Shigella flexneri 2a str. 301
aauauauugcaaucaucuugu

SEQ ID NO: 3917252 - RNA, 14 nt, Shigella flexneri 2a str. 301
aauaucaauacauc

SEQ ID NO: 3917253 - RNA, 21 nt, Shigella flexneri 2a str. 301
aauaucacucggggcuuuucu

SEQ ID NO: 3917254 - RNA, 19 nt, Shigella flexneri 2a str. 301
aauaucaggcauucuuuuu

SEQ ID NO: 3917255 - RNA, 16 nt, Shigella flexneri 2a str. 301
aauaucaguuauuaca

SEQ ID NO: 3917256 - RNA, 14 nt, Shigella flexneri 2a str. 301
aauaucaucccccu

SEQ ID NO: 3917257 - RNA, 15 nt, Shigella flexneri 2a str. 301
aauauccaacagguu

SEQ ID NO: 3917258 - RNA, 22 nt, Shigella flexneri 2a str. 301
aauauccagcgcgcgcagcacg

SEQ ID NO: 3917259 - RNA, 21 nt, Shigella flexneri 2a str. 301
aauauccggcucuuugcgcac

SEQ ID NO: 3917260 - RNA, 16 nt, Shigella flexneri 2a str. 301
aauauccgucacuuca

SEQ ID NO: 3917261 - RNA, 12 nt, Shigella flexneri 2a str. 301
aauauccugagc

SEQ ID NO: 3917262 - RNA, 22 nt, Shigella flexneri 2a str. 301
aauauccuguggacgcagcuca

SEQ ID NO: 3917263 - RNA, 16 nt, Shigella flexneri 2a str. 301
aauaucgacauucaau

SEQ ID NO: 3917264 - RNA, 23 nt, Shigella flexneri 2a str. 301
aauaucgagacgggcgaggaaau

SEQ ID NO: 3917265 - RNA, 18 nt, Shigella flexneri 2a str. 301
aauaucgcggcacagaaa

SEQ ID NO: 3917266 - RNA, 13 nt, Shigella flexneri 2a str. 301
aauaucguugauu

SEQ ID NO: 3917267 - RNA, 22 nt, Shigella flexneri 2a str. 301
aauaucuauauacaaucacacu

SEQ ID NO: 3917268 - RNA, 18 nt, Shigella flexneri 2a str. 301
aauaucuauccaguaucu

SEQ ID NO: 3917269 - RNA, 12 nt, Shigella flexneri 2a str. 301
aauaucuccucu

SEQ ID NO: 3917270 - RNA, 13 nt, Shigella flexneri 2a str. 301
aauaucuccucug

SEQ ID NO: 3917271 - RNA, 11 nt, Shigella flexneri 2a str. 301
aauaucuuccu

SEQ ID NO: 3917272 - RNA, 16 nt, Shigella flexneri 2a str. 301
aauaucuuccuggcgc

SEQ ID NO: 3917273 - RNA, 12 nt, Shigella flexneri 2a str. 301
aauaucuuuucu

SEQ ID NO: 3917274 - RNA, 15 nt, Shigella flexneri 2a str. 301
aauaucuuuucuuaa

SEQ ID NO: 3917275 - RNA, 20 nt, Shigella flexneri 2a str. 301
aauaucuuuucuuaacaaaa

SEQ ID NO: 3917276 - RNA, 13 nt, Shigella flexneri 2a str. 301
aauaugaacauga

SEQ ID NO: 3917277 - RNA, 21 nt, Shigella flexneri 2a str. 301
aauaugaauuaacgucaggug

SEQ ID NO: 3917278 - RNA, 15 nt, Shigella flexneri 2a str. 301
aauaugauaaaccuc

SEQ ID NO: 3917279 - RNA, 17 nt, Shigella flexneri 2a str. 301
aauaugccguaaaagua

SEQ ID NO: 3917280 - RNA, 18 nt, Shigella flexneri 2a str. 301
aauaugcugaaucgccaa

SEQ ID NO: 3917281 - RNA, 23 nt, Shigella flexneri 2a str. 301
aauauggugaaaguaaaaaagaa

SEQ ID NO: 3917282 - RNA, 16 nt, Shigella flexneri 2a str. 301
aauaugguuagagaac

SEQ ID NO: 3917283 - RNA, 22 nt, Shigella flexneri 2a str. 301
aauauguaagaucgaaggcugu

SEQ ID NO: 3917284 - RNA, 17 nt, Shigella flexneri 2a str. 301
aauauuaacuuaauaaa

SEQ ID NO: 3917285 - RNA, 20 nt, Shigella flexneri 2a str. 301
aauauuaacuuaauaaacau

SEQ ID NO: 3917286 - RNA, 20 nt, Shigella flexneri 2a str. 301
aauauuaaggguaaaaggau

SEQ ID NO: 3917287 - RNA, 14 nt, Shigella flexneri 2a str. 301
aauauuacuucaga

SEQ ID NO: 3917288 - RNA, 18 nt, Shigella flexneri 2a str. 301
aauauuauggcugucaug

SEQ ID NO: 3917289 - RNA, 22 nt, Shigella flexneri 2a str. 301
aauauucacccgaauaccuuuc

SEQ ID NO: 3917290 - RNA, 14 nt, Shigella flexneri 2a str. 301
aauauucagccaaa

SEQ ID NO: 3917291 - RNA, 21 nt, Shigella flexneri 2a str. 301
aauauucagccaaauccgauu

SEQ ID NO: 3917292 - RNA, 20 nt, Shigella flexneri 2a str. 301
aauauucugaagcaaacuug

SEQ ID NO: 3917293 - RNA, 23 nt, Shigella flexneri 2a str. 301
aauauucuggguaguccaugacc

SEQ ID NO: 3917294 - RNA, 21 nt, Shigella flexneri 2a str. 301
aauauugaauugcucaguaca

SEQ ID NO: 3917295 - RNA, 19 nt, Shigella flexneri 2a str. 301
aauauugaugcacaccauc

SEQ ID NO: 3917296 - RNA, 16 nt, Shigella flexneri 2a str. 301
aauauugaugggaagc

SEQ ID NO: 3917297 - RNA, 15 nt, Shigella flexneri 2a str. 301
aauauugauuauugg

SEQ ID NO: 3917298 - RNA, 22 nt, Shigella flexneri 2a str. 301
aauauugccggaugugaugcau

SEQ ID NO: 3917299 - RNA, 18 nt, Shigella flexneri 2a str. 301
aauauuguuauucgccag

SEQ ID NO: 3917300 - RNA, 16 nt, Shigella flexneri 2a str. 301
aauauuucccggccag

SEQ ID NO: 3917301 - RNA, 20 nt, Shigella flexneri 2a str. 301
aauauuuuguugcauaauuu

SEQ ID NO: 3917302 - RNA, 22 nt, Shigella flexneri 2a str. 301
aauauuuuguugcauaauuuca

SEQ ID NO: 3917303 - RNA, 19 nt, Shigella flexneri 2a str. 301
aaucaucccacaugaauuc

SEQ ID NO: 3917304 - RNA, 12 nt, Shigella flexneri 2a str. 301
aaucauccgcuc

SEQ ID NO: 3917305 - RNA, 17 nt, Shigella flexneri 2a str. 301
aaucaucgacuccagcg

SEQ ID NO: 3917306 - RNA, 20 nt, Shigella flexneri 2a str. 301
aaucaucgccuuaugcugcu

SEQ ID NO: 3917307 - RNA, 20 nt, Shigella flexneri 2a str. 301
aaucaucgcggcacacagca

SEQ ID NO: 3917308 - RNA, 21 nt, Shigella flexneri 2a str. 301
aaucaucgcggcacacagcac

SEQ ID NO: 3917309 - RNA, 16 nt, Shigella flexneri 2a str. 301
aaucaucgcguacuca

SEQ ID NO: 3917310 - RNA, 17 nt, Shigella flexneri 2a str. 301
aaucaucgcgugacagc

SEQ ID NO: 3917311 - RNA, 19 nt, Shigella flexneri 2a str. 301
aaucaucugauaucucacc

SEQ ID NO: 3917312 - RNA, 20 nt, Shigella flexneri 2a str. 301
aaucaucugauaucucacca

SEQ ID NO: 3917313 - RNA, 13 nt, Shigella flexneri 2a str. 301
aaucaugcaacac

SEQ ID NO: 3917314 - RNA, 14 nt, Shigella flexneri 2a str. 301
aaucaugcaauaaa

SEQ ID NO: 3917315 - RNA, 17 nt, Shigella flexneri 2a str. 301
aaucaugcaauaaauau

SEQ ID NO: 3917316 - RNA, 21 nt, Shigella flexneri 2a str. 301
aaucaugguuuauuucccaga

SEQ ID NO: 3917317 - RNA, 17 nt, Shigella flexneri 2a str. 301
aaucauucgcaguugca

SEQ ID NO: 3917318 - RNA, 22 nt, Shigella flexneri 2a str. 301
aaucauucgccgguuccagcuu

SEQ ID NO: 3917319 - RNA, 13 nt, Shigella flexneri 2a str. 301
aauccaacaacac

SEQ ID NO: 3917320 - RNA, 15 nt, Shigella flexneri 2a str. 301
aauccaacaacacau

SEQ ID NO: 3917321 - RNA, 18 nt, Shigella flexneri 2a str. 301
aauccaaccauccccauc

SEQ ID NO: 3917322 - RNA, 21 nt, Shigella flexneri 2a str. 301
aauccacaucggcaucaggcc

SEQ ID NO: 3917323 - RNA, 22 nt, Shigella flexneri 2a str. 301
aauccacguuccuggaaccagu

SEQ ID NO: 3917324 - RNA, 16 nt, Shigella flexneri 2a str. 301
aauccacuucgccaga

SEQ ID NO: 3917325 - RNA, 15 nt, Shigella flexneri 2a str. 301
aauccagaacaccau

SEQ ID NO: 3917326 - RNA, 21 nt, Shigella flexneri 2a str. 301
aauccagauccugauccugca

SEQ ID NO: 3917327 - RNA, 22 nt, Shigella flexneri 2a str. 301
aauccagauuuauaaaagaaaa

SEQ ID NO: 3917328 - RNA, 20 nt, Shigella flexneri 2a str. 301
aauccagcucuuuuccagcc

SEQ ID NO: 3917329 - RNA, 23 nt, Shigella flexneri 2a str. 301
aauccaggggagcugauucagau

SEQ ID NO: 3917330 - RNA, 16 nt, Shigella flexneri 2a str. 301
aauccauaccagcaca

SEQ ID NO: 3917331 - RNA, 22 nt, Shigella flexneri 2a str. 301
aauccauaccagcacauaacuc

SEQ ID NO: 3917332 - RNA, 14 nt, Shigella flexneri 2a str. 301
aauccaucccgcuc

SEQ ID NO: 3917333 - RNA, 20 nt, Shigella flexneri 2a str. 301
aauccaucccgcucuguaag

SEQ ID NO: 3917334 - RNA, 14 nt, Shigella flexneri 2a str. 301
aaucccacauccua

SEQ ID NO: 3917335 - RNA, 20 nt, Shigella flexneri 2a str. 301
aaucccaucuucgaguaaaa

SEQ ID NO: 3917336 - RNA, 16 nt, Shigella flexneri 2a str. 301
aauccccaaugaccuu

SEQ ID NO: 3917337 - RNA, 13 nt, Shigella flexneri 2a str. 301
aauccccacugca

SEQ ID NO: 3917338 - RNA, 16 nt, Shigella flexneri 2a str. 301
aauccccuccagcgag

SEQ ID NO: 3917339 - RNA, 22 nt, Shigella flexneri 2a str. 301
aauccccucuucagccgcaaac

SEQ ID NO: 3917340 - RNA, 16 nt, Shigella flexneri 2a str. 301
aaucccgcgcaacaaa

SEQ ID NO: 3917341 - RNA, 14 nt, Shigella flexneri 2a str. 301
aaucccggcaccaa

SEQ ID NO: 3917342 - RNA, 13 nt, Shigella flexneri 2a str. 301
aaucccugcgaac

SEQ ID NO: 3917343 - RNA, 19 nt, Shigella flexneri 2a str. 301
aaucccugcgaacugcgca

SEQ ID NO: 3917344 - RNA, 19 nt, Shigella flexneri 2a str. 301
aaucccugcuucggucaga

SEQ ID NO: 3917345 - RNA, 16 nt, Shigella flexneri 2a str. 301
aaucccuggauuugcc

SEQ ID NO: 3917346 - RNA, 20 nt, Shigella flexneri 2a str. 301
aaucccuuagcuaauuuuug

SEQ ID NO: 3917347 - RNA, 19 nt, Shigella flexneri 2a str. 301
aauccgccagaaaucagcu

SEQ ID NO: 3917348 - RNA, 18 nt, Shigella flexneri 2a str. 301
aauccgcuuguucaguau

SEQ ID NO: 3917349 - RNA, 17 nt, Shigella flexneri 2a str. 301
aauccggaaacgcucac

SEQ ID NO: 3917350 - RNA, 15 nt, Shigella flexneri 2a str. 301
aauccggcagcgaac

SEQ ID NO: 3917351 - RNA, 16 nt, Shigella flexneri 2a str. 301
aauccgggucuguaaa

SEQ ID NO: 3917352 - RNA, 18 nt, Shigella flexneri 2a str. 301
aauccgguagguucaaca

SEQ ID NO: 3917353 - RNA, 16 nt, Shigella flexneri 2a str. 301
aauccggugccuuacc

SEQ ID NO: 3917354 - RNA, 17 nt, Shigella flexneri 2a str. 301
aauccggugccuuaccg

SEQ ID NO: 3917355 - RNA, 19 nt, Shigella flexneri 2a str. 301
aauccggugccuuaccgcu

SEQ ID NO: 3917356 - RNA, 19 nt, Shigella flexneri 2a str. 301
aauccguaauauucgccuc

SEQ ID NO: 3917357 - RNA, 23 nt, Shigella flexneri 2a str. 301
aauccucuuugcuuccugaguaa

SEQ ID NO: 3917358 - RNA, 17 nt, Shigella flexneri 2a str. 301
aauccuucacuuuugcc

SEQ ID NO: 3917359 - RNA, 22 nt, Shigella flexneri 2a str. 301
aauccuucacuuuugccagacg

SEQ ID NO: 3917360 - RNA, 14 nt, Shigella flexneri 2a str. 301
aauccuucuuguuc

SEQ ID NO: 3917361 - RNA, 21 nt, Shigella flexneri 2a str. 301
aaucgaaccaaacagcgccag

SEQ ID NO: 3917362 - RNA, 14 nt, Shigella flexneri 2a str. 301
aaucgaacuucccg

SEQ ID NO: 3917363 - RNA, 15 nt, Shigella flexneri 2a str. 301
aaucgacagccaguu

SEQ ID NO: 3917364 - RNA, 20 nt, Shigella flexneri 2a str. 301
aaucgacggggugcgguaaa

SEQ ID NO: 3917365 - RNA, 19 nt, Shigella flexneri 2a str. 301
aaucgagauacguuugcca

SEQ ID NO: 3917366 - RNA, 22 nt, Shigella flexneri 2a str. 301
aaucgagcccagaugccggaug

SEQ ID NO: 3917367 - RNA, 19 nt, Shigella flexneri 2a str. 301
aaucgagccgauuaaaauc

SEQ ID NO: 3917368 - RNA, 18 nt, Shigella flexneri 2a str. 301
aaucgauaaaacuucccg

SEQ ID NO: 3917369 - RNA, 24 nt, Shigella flexneri 2a str. 301
aaucgaucaucaccugagcuggca

SEQ ID NO: 3917370 - RNA, 19 nt, Shigella flexneri 2a str. 301
aaucgcaacgccuuccguc

SEQ ID NO: 3917371 - RNA, 15 nt, Shigella flexneri 2a str. 301
aaucgcaagaucuca

SEQ ID NO: 3917372 - RNA, 19 nt, Shigella flexneri 2a str. 301
aaucgcacaaaaucaugag

SEQ ID NO: 3917373 - RNA, 19 nt, Shigella flexneri 2a str. 301
aaucgcacguugucagcaa

SEQ ID NO: 3917374 - RNA, 20 nt, Shigella flexneri 2a str. 301
aaucgcagcacuggugcugu

SEQ ID NO: 3917375 - RNA, 21 nt, Shigella flexneri 2a str. 301
aaucgcauugacgccaaaaua

SEQ ID NO: 3917376 - RNA, 12 nt, Shigella flexneri 2a str. 301
aaucgcauugcg

SEQ ID NO: 3917377 - RNA, 15 nt, Shigella flexneri 2a str. 301
aaucgccaaaaacau

SEQ ID NO: 3917378 - RNA, 14 nt, Shigella flexneri 2a str. 301
aaucgccagcggca

SEQ ID NO: 3917379 - RNA, 15 nt, Shigella flexneri 2a str. 301
aaucgccagcggcag

SEQ ID NO: 3917380 - RNA, 20 nt, Shigella flexneri 2a str. 301
aaucgcccgcuguuuauguu

SEQ ID NO: 3917381 - RNA, 14 nt, Shigella flexneri 2a str. 301
aaucgcccgcuucc

SEQ ID NO: 3917382 - RNA, 23 nt, Shigella flexneri 2a str. 301
aaucgccuuacccggaccgucuu

SEQ ID NO: 3917383 - RNA, 17 nt, Shigella flexneri 2a str. 301
aaucgcgaaauaacugc

SEQ ID NO: 3917384 - RNA, 18 nt, Shigella flexneri 2a str. 301
aaucgcgaaauaacugcu

SEQ ID NO: 3917385 - RNA, 13 nt, Shigella flexneri 2a str. 301
aaucgcucagcgc

SEQ ID NO: 3917386 - RNA, 13 nt, Shigella flexneri 2a str. 301
aaucgcugcggca

SEQ ID NO: 3917387 - RNA, 18 nt, Shigella flexneri 2a str. 301
aaucgcugcggcaauaau

SEQ ID NO: 3917388 - RNA, 22 nt, Shigella flexneri 2a str. 301
aaucgcuucagccggaauaauc

SEQ ID NO: 3917389 - RNA, 13 nt, Shigella flexneri 2a str. 301
aaucgcuuucgga

SEQ ID NO: 3917390 - RNA, 14 nt, Shigella flexneri 2a str. 301
aaucggaacaacag

SEQ ID NO: 3917391 - RNA, 15 nt, Shigella flexneri 2a str. 301
aaucggcgaucccau

SEQ ID NO: 3917392 - RNA, 20 nt, Shigella flexneri 2a str. 301
aaucgggaaaaucugcggga

SEQ ID NO: 3917393 - RNA, 20 nt, Shigella flexneri 2a str. 301
aaucgggagagauaagauaa

SEQ ID NO: 3917394 - RNA, 18 nt, Shigella flexneri 2a str. 301
aaucggggauaagaauau

SEQ ID NO: 3917395 - RNA, 14 nt, Shigella flexneri 2a str. 301
aaucgguaacgcuu

SEQ ID NO: 3917396 - RNA, 20 nt, Shigella flexneri 2a str. 301
aaucggugcaaaugccagau

SEQ ID NO: 3917397 - RNA, 22 nt, Shigella flexneri 2a str. 301
aaucgucaaugccgucaccagc

SEQ ID NO: 3917398 - RNA, 12 nt, Shigella flexneri 2a str. 301
aaucgucaguuc

SEQ ID NO: 3917399 - RNA, 14 nt, Shigella flexneri 2a str. 301
aaucgucaguucac

SEQ ID NO: 3917400 - RNA, 19 nt, Shigella flexneri 2a str. 301
aaucgucaguuuuucacga

SEQ ID NO: 3917401 - RNA, 17 nt, Shigella flexneri 2a str. 301
aaucgucgauuguuaua

SEQ ID NO: 3917402 - RNA, 21 nt, Shigella flexneri 2a str. 301
aaucgucgguguccacuuccg

SEQ ID NO: 3917403 - RNA, 22 nt, Shigella flexneri 2a str. 301
aaugcccgaugaccuugucaug

SEQ ID NO: 3917404 - RNA, 23 nt, Shigella flexneri 2a str. 301
aaugccgauauaaauuccacgcg

SEQ ID NO: 3917405 - RNA, 15 nt, Shigella flexneri 2a str. 301
aaugccgcaaaacuu

SEQ ID NO: 3917406 - RNA, 17 nt, Shigella flexneri 2a str. 301
aaugccggaaucagaau

SEQ ID NO: 3917407 - RNA, 18 nt, Shigella flexneri 2a str. 301
aaugccgguggugaccug

SEQ ID NO: 3917408 - RNA, 13 nt, Shigella flexneri 2a str. 301
aaugccgucacca

SEQ ID NO: 3917409 - RNA, 16 nt, Shigella flexneri 2a str. 301
aaugccguucucuggc

SEQ ID NO: 3917410 - RNA, 18 nt, Shigella flexneri 2a str. 301
aaugccucucaaaccccg

SEQ ID NO: 3917411 - RNA, 17 nt, Shigella flexneri 2a str. 301
aaugccuuauccgaugg

SEQ ID NO: 3917412 - RNA, 11 nt, Shigella flexneri 2a str. 301
aaugcgaaaac

SEQ ID NO: 3917413 - RNA, 16 nt, Shigella flexneri 2a str. 301
aaugcgacaacagaaa

SEQ ID NO: 3917414 - RNA, 20 nt, Shigella flexneri 2a str. 301
aaugcgauccugagccaguu

SEQ ID NO: 3917415 - RNA, 16 nt, Shigella flexneri 2a str. 301
aaugcgauggcaaaag

SEQ ID NO: 3917416 - RNA, 17 nt, Shigella flexneri 2a str. 301
aaugcgcaucaaagcca

SEQ ID NO: 3917417 - RNA, 23 nt, Shigella flexneri 2a str. 301
aaugcgcccagcgucagcauaaa

SEQ ID NO: 3917418 - RNA, 14 nt, Shigella flexneri 2a str. 301
aaugcgcucagggu

SEQ ID NO: 3917419 - RNA, 20 nt, Shigella flexneri 2a str. 301
aaugcgcuccucgccguuaa

SEQ ID NO: 3917420 - RNA, 21 nt, Shigella flexneri 2a str. 301
aaugcgcuguuuagcgcggca

SEQ ID NO: 3917421 - RNA, 20 nt, Shigella flexneri 2a str. 301
aaugcggauaagccugugcg

SEQ ID NO: 3917422 - RNA, 16 nt, Shigella flexneri 2a str. 301
aaugcgggugcaauca

SEQ ID NO: 3917423 - RNA, 19 nt, Shigella flexneri 2a str. 301
aaugcucuccguaggccag

SEQ ID NO: 3917424 - RNA, 20 nt, Shigella flexneri 2a str. 301
aaugcucugcacguuuugcu

SEQ ID NO: 3917425 - RNA, 23 nt, Shigella flexneri 2a str. 301
aaugcucugcacguuuugcugau

SEQ ID NO: 3917426 - RNA, 15 nt, Shigella flexneri 2a str. 301
aaugcugcagccagg

SEQ ID NO: 3917427 - RNA, 22 nt, Shigella flexneri 2a str. 301
aaugcugucgguuuauggaaaa

SEQ ID NO: 3917428 - RNA, 19 nt, Shigella flexneri 2a str. 301
aaugcuguuccagaccaua

SEQ ID NO: 3917429 - RNA, 12 nt, Shigella flexneri 2a str. 301
aaugcuucacac

SEQ ID NO: 3917430 - RNA, 13 nt, Shigella flexneri 2a str. 301
aaugcuuuaaaug

SEQ ID NO: 3917431 - RNA, 19 nt, Shigella flexneri 2a str. 301
aaugcuuuuuccugcguca

SEQ ID NO: 3917432 - RNA, 12 nt, Shigella flexneri 2a str. 301
aauggaaaacug

SEQ ID NO: 3917433 - RNA, 14 nt, Shigella flexneri 2a str. 301
aauggaaacagcac

SEQ ID NO: 3917434 - RNA, 16 nt, Shigella flexneri 2a str. 301
aauggaaacagcacca

SEQ ID NO: 3917435 - RNA, 17 nt, Shigella flexneri 2a str. 301
aauggacacuauuuccc

SEQ ID NO: 3917436 - RNA, 14 nt, Shigella flexneri 2a str. 301
aauggacuccaccg

SEQ ID NO: 3917437 - RNA, 19 nt, Shigella flexneri 2a str. 301
aauggagcuaaacagcgcu

SEQ ID NO: 3917438 - RNA, 16 nt, Shigella flexneri 2a str. 301
aauggaugcaaucaca

SEQ ID NO: 3917439 - RNA, 22 nt, Shigella flexneri 2a str. 301
aauggauuagcgaccgaacaga

SEQ ID NO: 3917440 - RNA, 14 nt, Shigella flexneri 2a str. 301
aauggcaaagaugu

SEQ ID NO: 3917441 - RNA, 17 nt, Shigella flexneri 2a str. 301
aauggcacaaauggcaa

SEQ ID NO: 3917442 - RNA, 14 nt, Shigella flexneri 2a str. 301
aauggcagauaauc

SEQ ID NO: 3917443 - RNA, 15 nt, Shigella flexneri 2a str. 301
aauggcaggcucaga

SEQ ID NO: 3917444 - RNA, 17 nt, Shigella flexneri 2a str. 301
aauggcaggcucagacu

SEQ ID NO: 3917445 - RNA, 19 nt, Shigella flexneri 2a str. 301
aauggcaggcucagacuga

SEQ ID NO: 3917446 - RNA, 14 nt, Shigella flexneri 2a str. 301
aauggcaucugaua

SEQ ID NO: 3917447 - RNA, 12 nt, Shigella flexneri 2a str. 301
aauggcaugcuc

SEQ ID NO: 3917448 - RNA, 17 nt, Shigella flexneri 2a str. 301
aauggcccaaaaggcag

SEQ ID NO: 3917449 - RNA, 23 nt, Shigella flexneri 2a str. 301
aauggccggaacgcuuucuuugg

SEQ ID NO: 3917450 - RNA, 19 nt, Shigella flexneri 2a str. 301
aauggccgucgccacaacc

SEQ ID NO: 3917451 - RNA, 13 nt, Shigella flexneri 2a str. 301
aauggccugcgcg

SEQ ID NO: 3917452 - RNA, 20 nt, Shigella flexneri 2a str. 301
aauggcgauuuuugauaauu

SEQ ID NO: 3917453 - RNA, 21 nt, Shigella flexneri 2a str. 301
aauggcgcuuuauagggugcc

SEQ ID NO: 3917454 - RNA, 17 nt, Shigella flexneri 2a str. 301
aauggcggugaucccaa

SEQ ID NO: 3917455 - RNA, 15 nt, Shigella flexneri 2a str. 301
aauggcgucaacaac

SEQ ID NO: 3917456 - RNA, 17 nt, Shigella flexneri 2a str. 301
aauggcgucaacaacac

SEQ ID NO: 3917457 - RNA, 22 nt, Shigella flexneri 2a str. 301
aauggcguuagucaugaaauau

SEQ ID NO: 3917458 - RNA, 22 nt, Shigella flexneri 2a str. 301
aauggcugaccagaauuuaccc

SEQ ID NO: 3917459 - RNA, 22 nt, Shigella flexneri 2a str. 301
aauggcugcgggcgaccaauca

SEQ ID NO: 3917460 - RNA, 14 nt, Shigella flexneri 2a str. 301
aaugggaucgaaag

SEQ ID NO: 3917461 - RNA, 21 nt, Shigella flexneri 2a str. 301
aaugggccaacaccagacauc

SEQ ID NO: 3917462 - RNA, 18 nt, Shigella flexneri 2a str. 301
aaugguccgugacccgga

SEQ ID NO: 3917463 - RNA, 23 nt, Shigella flexneri 2a str. 301
aaugguccgugacccggaauaaa

SEQ ID NO: 3917464 - RNA, 19 nt, Shigella flexneri 2a str. 301
aauggucuggugaccuggg

SEQ ID NO: 3917465 - RNA, 15 nt, Shigella flexneri 2a str. 301
aauggugagauggcc

SEQ ID NO: 3917466 - RNA, 18 nt, Shigella flexneri 2a str. 301
aaugguuucauuccagua

SEQ ID NO: 3917467 - RNA, 21 nt, Shigella flexneri 2a str. 301
aauguacucuuuauugcaaac

SEQ ID NO: 3917468 - RNA, 10 nt, Shigella flexneri 2a str. 301
aauguagccg

SEQ ID NO: 3917469 - RNA, 12 nt, Shigella flexneri 2a str. 301
aauguaugaggu

SEQ ID NO: 3917470 - RNA, 13 nt, Shigella flexneri 2a str. 301
aaugucaucagca

SEQ ID NO: 3917471 - RNA, 20 nt, Shigella flexneri 2a str. 301
aaugucaucucuggcacgag

SEQ ID NO: 3917472 - RNA, 21 nt, Shigella flexneri 2a str. 301
aaugucaucucuggcacgaga

SEQ ID NO: 3917473 - RNA, 23 nt, Shigella flexneri 2a str. 301
aaugucaucucuggcacgagauc

SEQ ID NO: 3917474 - RNA, 20 nt, Shigella flexneri 2a str. 301
aaugucgauaaaguuagagc

SEQ ID NO: 3917475 - RNA, 20 nt, Shigella flexneri 2a str. 301
aaugucggaugcggcgugaa

SEQ ID NO: 3917476 - RNA, 18 nt, Shigella flexneri 2a str. 301
aaugucggcccgcauuau

SEQ ID NO: 3917477 - RNA, 16 nt, Shigella flexneri 2a str. 301
aaugugaagaggaaca

SEQ ID NO: 3917478 - RNA, 21 nt, Shigella flexneri 2a str. 301
aaugugcuccauuguuagcaa

SEQ ID NO: 3917479 - RNA, 15 nt, Shigella flexneri 2a str. 301
aaugugcugagaaca

SEQ ID NO: 3917480 - RNA, 22 nt, Shigella flexneri 2a str. 301
aauguggcaaugaguggugaaa

SEQ ID NO: 3917481 - RNA, 21 nt, Shigella flexneri 2a str. 301
aauguggccccugaaguucau

SEQ ID NO: 3917482 - RNA, 18 nt, Shigella flexneri 2a str. 301
aauguguaaucaggcaau

SEQ ID NO: 3917483 - RNA, 23 nt, Shigella flexneri 2a str. 301
aauguguuuacgcguuuuucaga

SEQ ID NO: 3917484 - RNA, 18 nt, Shigella flexneri 2a str. 301
aauguguuuauaagccau

SEQ ID NO: 3917485 - RNA, 13 nt, Shigella flexneri 2a str. 301
aauguuaacgcca

SEQ ID NO: 3917486 - RNA, 13 nt, Shigella flexneri 2a str. 301
aauguuacgaccu

SEQ ID NO: 3917487 - RNA, 23 nt, Shigella flexneri 2a str. 301
aauguuauuuaauuacugagaac

SEQ ID NO: 3917488 - RNA, 15 nt, Shigella flexneri 2a str. 301
aauguucccugcgcc

SEQ ID NO: 3917489 - RNA, 21 nt, Shigella flexneri 2a str. 301
aauguuccggguuugccacau

SEQ ID NO: 3917490 - RNA, 23 nt, Shigella flexneri 2a str. 301
aauguucguccauuucagcgcag

SEQ ID NO: 3917491 - RNA, 20 nt, Shigella flexneri 2a str. 301
aauguugucucagauucaga

SEQ ID NO: 3917492 - RNA, 19 nt, Shigella flexneri 2a str. 301
aauguuucugcaauauauu

SEQ ID NO: 3917493 - RNA, 15 nt, Shigella flexneri 2a str. 301
aauguuugcaauaaa

SEQ ID NO: 3917494 - RNA, 16 nt, Shigella flexneri 2a str. 301
aauuaacauugcaaga

SEQ ID NO: 3917495 - RNA, 22 nt, Shigella flexneri 2a str. 301
aauuacaaaaagugcuuucuga

SEQ ID NO: 3917496 - RNA, 19 nt, Shigella flexneri 2a str. 301
aauuacacagcgacguaaa

SEQ ID NO: 3917497 - RNA, 19 nt, Shigella flexneri 2a str. 301
aauuacaggcaguaaccaa

SEQ ID NO: 3917498 - RNA, 17 nt, Shigella flexneri 2a str. 301
aauuaccagccagacac

SEQ ID NO: 3917499 - RNA, 22 nt, Shigella flexneri 2a str. 301
aauuaccagccagacacuguua

SEQ ID NO: 3917500 - RNA, 14 nt, Shigella flexneri 2a str. 301
aauuaccgcaaagc

SEQ ID NO: 3917501 - RNA, 19 nt, Shigella flexneri 2a str. 301
aauuaccgcaccaccagca

SEQ ID NO: 3917502 - RNA, 19 nt, Shigella flexneri 2a str. 301
aauugcgguuuucucuugu

SEQ ID NO: 3917503 - RNA, 19 nt, Shigella flexneri 2a str. 301
aauugcguaaagccugcug

SEQ ID NO: 3917504 - RNA, 22 nt, Shigella flexneri 2a str. 301
aauugcguaaagccugcuggca

SEQ ID NO: 3917505 - RNA, 12 nt, Shigella flexneri 2a str. 301
aauugcgucagu

SEQ ID NO: 3917506 - RNA, 14 nt, Shigella flexneri 2a str. 301
aauugcgucaguau

SEQ ID NO: 3917507 - RNA, 17 nt, Shigella flexneri 2a str. 301
aauugcugguuuuguag

SEQ ID NO: 3917508 - RNA, 18 nt, Shigella flexneri 2a str. 301
aauugcuuuuaccauacu

SEQ ID NO: 3917509 - RNA, 16 nt, Shigella flexneri 2a str. 301
aauuggaauacauaua

SEQ ID NO: 3917510 - RNA, 16 nt, Shigella flexneri 2a str. 301
aauuggauagugagua

SEQ ID NO: 3917511 - RNA, 13 nt, Shigella flexneri 2a str. 301
aauugguagacgc

SEQ ID NO: 3917512 - RNA, 21 nt, Shigella flexneri 2a str. 301
aauugguagacgcgcuagccu

SEQ ID NO: 3917513 - RNA, 23 nt, Shigella flexneri 2a str. 301
aauugguauucugggaacuauau

SEQ ID NO: 3917514 - RNA, 20 nt, Shigella flexneri 2a str. 301
aauugguugccggauauucc

SEQ ID NO: 3917515 - RNA, 22 nt, Shigella flexneri 2a str. 301
aauuguuccgucagccgcccgc

SEQ ID NO: 3917516 - RNA, 14 nt, Shigella flexneri 2a str. 301
aauuguucugcgcu

SEQ ID NO: 3917517 - RNA, 22 nt, Shigella flexneri 2a str. 301
aauuguuugacuuauaagucuc

SEQ ID NO: 3917518 - RNA, 13 nt, Shigella flexneri 2a str. 301
aauuuaacaccau

SEQ ID NO: 3917519 - RNA, 13 nt, Shigella flexneri 2a str. 301
aauuuacccgguu

SEQ ID NO: 3917520 - RNA, 16 nt, Shigella flexneri 2a str. 301
aauuuacgcuuuucuu

SEQ ID NO: 3917521 - RNA, 19 nt, Shigella flexneri 2a str. 301
aauuuauaaucuuuaaaaa

SEQ ID NO: 3917522 - RNA, 14 nt, Shigella flexneri 2a str. 301
aauuuaucagacaa

SEQ ID NO: 3917523 - RNA, 11 nt, Shigella flexneri 2a str. 301
aauuuauguuu

SEQ ID NO: 3917524 - RNA, 12 nt, Shigella flexneri 2a str. 301
aauuucacacca

SEQ ID NO: 3917525 - RNA, 16 nt, Shigella flexneri 2a str. 301
aauuucacaccaucaa

SEQ ID NO: 3917526 - RNA, 19 nt, Shigella flexneri 2a str. 301
aauuucacaccaucaacaa

SEQ ID NO: 3917527 - RNA, 17 nt, Shigella flexneri 2a str. 301
aauuucacguucaccca

SEQ ID NO: 3917528 - RNA, 12 nt, Shigella flexneri 2a str. 301
aauuucacugcu

SEQ ID NO: 3917529 - RNA, 20 nt, Shigella flexneri 2a str. 301
aauuucagcaagacaauguu

SEQ ID NO: 3917530 - RNA, 15 nt, Shigella flexneri 2a str. 301
aauuucagcgccuga

SEQ ID NO: 3917531 - RNA, 17 nt, Shigella flexneri 2a str. 301
aauuucagcgccugaua

SEQ ID NO: 3917532 - RNA, 17 nt, Shigella flexneri 2a str. 301
aauuucagcggcacugu

SEQ ID NO: 3917533 - RNA, 17 nt, Shigella flexneri 2a str. 301
aauuucagcguccugcc

SEQ ID NO: 3917534 - RNA, 22 nt, Shigella flexneri 2a str. 301
aauuucaucacugaauuucgcc

SEQ ID NO: 3917535 - RNA, 23 nt, Shigella flexneri 2a str. 301
aauuucaucaucacgaaauccca

SEQ ID NO: 3917536 - RNA, 18 nt, Shigella flexneri 2a str. 301
aauuucaucgcuacacca

SEQ ID NO: 3917537 - RNA, 21 nt, Shigella flexneri 2a str. 301
aauuucaucgcuacaccaauc

SEQ ID NO: 3917538 - RNA, 14 nt, Shigella flexneri 2a str. 301
aauuucauuuugau

SEQ ID NO: 3917539 - RNA, 17 nt, Shigella flexneri 2a str. 301
aauuuccagaaagugag

SEQ ID NO: 3917540 - RNA, 13 nt, Shigella flexneri 2a str. 301
aauuuccauugcu

SEQ ID NO: 3917541 - RNA, 23 nt, Shigella flexneri 2a str. 301
aauuuccccaaaacguaaccaug

SEQ ID NO: 3917542 - RNA, 14 nt, Shigella flexneri 2a str. 301
aauuuccgucgcau

SEQ ID NO: 3917543 - RNA, 18 nt, Shigella flexneri 2a str. 301
aauuucguuaagcucaga

SEQ ID NO: 3917544 - RNA, 18 nt, Shigella flexneri 2a str. 301
aauuucuccuucacucua

SEQ ID NO: 3917545 - RNA, 21 nt, Shigella flexneri 2a str. 301
aauuucugugcagccaaaaau

SEQ ID NO: 3917546 - RNA, 22 nt, Shigella flexneri 2a str. 301
aauuucugugcagccaaaaaug

SEQ ID NO: 3917547 - RNA, 18 nt, Shigella flexneri 2a str. 301
aauuucuucccuuucugc

SEQ ID NO: 3917548 - RNA, 19 nt, Shigella flexneri 2a str. 301
aauuucuucugguuucagu

SEQ ID NO: 3917549 - RNA, 14 nt, Shigella flexneri 2a str. 301
aauuugaucaaaua

SEQ ID NO: 3917550 - RNA, 21 nt, Shigella flexneri 2a str. 301
aauuugcagccauaaauuuac

SEQ ID NO: 3917551 - RNA, 17 nt, Shigella flexneri 2a str. 301
aauuugcaggucauggu

SEQ ID NO: 3917552 - RNA, 20 nt, Shigella flexneri 2a str. 301
aauuugcgcucaauaaucaa

SEQ ID NO: 3917553 - RNA, 23 nt, Shigella flexneri 2a str. 301
aauuuggcugagugaaucagaag

SEQ ID NO: 3917554 - RNA, 12 nt, Shigella flexneri 2a str. 301
aauuuguaacug

SEQ ID NO: 3917555 - RNA, 12 nt, Shigella flexneri 2a str. 301
aauuuuaaauau

SEQ ID NO: 3917556 - RNA, 20 nt, Shigella flexneri 2a str. 301
aauuuuaccuagcacuguaa

SEQ ID NO: 3917557 - RNA, 15 nt, Shigella flexneri 2a str. 301
aauuuuaggaugcug

SEQ ID NO: 3917558 - RNA, 18 nt, Shigella flexneri 2a str. 301
aauuuuauguuucgcauc

SEQ ID NO: 3917559 - RNA, 13 nt, Shigella flexneri 2a str. 301
aauuuucaucagu

SEQ ID NO: 3917560 - RNA, 19 nt, Shigella flexneri 2a str. 301
aauuuuccuugaaaaagag

SEQ ID NO: 3917561 - RNA, 19 nt, Shigella flexneri 2a str. 301
aauuuucgccaucucaaaa

SEQ ID NO: 3917562 - RNA, 20 nt, Shigella flexneri 2a str. 301
aauuuucguaggucacuccc

SEQ ID NO: 3917563 - RNA, 14 nt, Shigella flexneri 2a str. 301
aauuuuuauuauuu

SEQ ID NO: 3917564 - RNA, 17 nt, Shigella flexneri 2a str. 301
aauuuuuguuguuuaaa

SEQ ID NO: 3917565 - RNA, 19 nt, Shigella flexneri 2a str. 301
aauuuuuuugcaccauaaa

SEQ ID NO: 3917566 - RNA, 16 nt, Shigella flexneri 2a str. 301
aauuuuuuuucaguug

SEQ ID NO: 3917567 - RNA, 15 nt, Shigella flexneri 2a str. 301
acaaaaacucauaaa

SEQ ID NO: 3917568 - RNA, 20 nt, Shigella flexneri 2a str. 301
acaaaaagugcuuucugaac

SEQ ID NO: 3917569 - RNA, 16 nt, Shigella flexneri 2a str. 301
acaaaaauaccaccaa

SEQ ID NO: 3917570 - RNA, 17 nt, Shigella flexneri 2a str. 301
acaaaaaugcccgaucc

SEQ ID NO: 3917571 - RNA, 18 nt, Shigella flexneri 2a str. 301
acaaaaaugcccgauccu

SEQ ID NO: 3917572 - RNA, 21 nt, Shigella flexneri 2a str. 301
acaaaacagcgaguucaggcg

SEQ ID NO: 3917573 - RNA, 16 nt, Shigella flexneri 2a str. 301
acaaaacccuccguua

SEQ ID NO: 3917574 - RNA, 14 nt, Shigella flexneri 2a str. 301
acaaaacgggggcu

SEQ ID NO: 3917575 - RNA, 20 nt, Shigella flexneri 2a str. 301
acaaaagacgauaguaauuu

SEQ ID NO: 3917576 - RNA, 18 nt, Shigella flexneri 2a str. 301
acaaaagcacguaaauuc

SEQ ID NO: 3917577 - RNA, 16 nt, Shigella flexneri 2a str. 301
acaaaagcgaagcgaa

SEQ ID NO: 3917578 - RNA, 17 nt, Shigella flexneri 2a str. 301
acaaaagcggugauaaa

SEQ ID NO: 3917579 - RNA, 22 nt, Shigella flexneri 2a str. 301
acaaaaucacgucgauuuuuaa

SEQ ID NO: 3917580 - RNA, 14 nt, Shigella flexneri 2a str. 301
acaaaauccugcca

SEQ ID NO: 3917581 - RNA, 18 nt, Shigella flexneri 2a str. 301
acaaaaucggaaacaaau

SEQ ID NO: 3917582 - RNA, 23 nt, Shigella flexneri 2a str. 301
acaaaaucgugaaaaaucaauau

SEQ ID NO: 3917583 - RNA, 15 nt, Shigella flexneri 2a str. 301
acaaaaucuuaaaga

SEQ ID NO: 3917584 - RNA, 14 nt, Shigella flexneri 2a str. 301
acaaaaugugccag

SEQ ID NO: 3917585 - RNA, 15 nt, Shigella flexneri 2a str. 301
acaaacaaugagaau

SEQ ID NO: 3917586 - RNA, 14 nt, Shigella flexneri 2a str. 301
acaaacacaaaacu

SEQ ID NO: 3917587 - RNA, 13 nt, Shigella flexneri 2a str. 301
acaaacacaauau

SEQ ID NO: 3917588 - RNA, 18 nt, Shigella flexneri 2a str. 301
acaaacaccgaaccagag

SEQ ID NO: 3917589 - RNA, 22 nt, Shigella flexneri 2a str. 301
acaaacagcucgacaccaaaca

SEQ ID NO: 3917590 - RNA, 13 nt, Shigella flexneri 2a str. 301
acaaacaucaucc

SEQ ID NO: 3917591 - RNA, 18 nt, Shigella flexneri 2a str. 301
acaaacauugcugccaga

SEQ ID NO: 3917592 - RNA, 18 nt, Shigella flexneri 2a str. 301
acaaaccauaagguggga

SEQ ID NO: 3917593 - RNA, 22 nt, Shigella flexneri 2a str. 301
acaaaccgaguuaguccacacg

SEQ ID NO: 3917594 - RNA, 17 nt, Shigella flexneri 2a str. 301
acaaaccguugcugcaa

SEQ ID NO: 3917595 - RNA, 11 nt, Shigella flexneri 2a str. 301
acaaacgacgg

SEQ ID NO: 3917596 - RNA, 18 nt, Shigella flexneri 2a str. 301
acaaacgcaaaauugccu

SEQ ID NO: 3917597 - RNA, 16 nt, Shigella flexneri 2a str. 301
acaaacgcaaacacca

SEQ ID NO: 3917598 - RNA, 19 nt, Shigella flexneri 2a str. 301
acaaacgccagauacauca

SEQ ID NO: 3917599 - RNA, 21 nt, Shigella flexneri 2a str. 301
acaaacgcuuuacucaacucc

SEQ ID NO: 3917600 - RNA, 14 nt, Shigella flexneri 2a str. 301
acaaacggaaaaca

SEQ ID NO: 3917601 - RNA, 13 nt, Shigella flexneri 2a str. 301
acaaacucuuuuc

SEQ ID NO: 3917602 - RNA, 21 nt, Shigella flexneri 2a str. 301
acaauaaucaacgcgaaaaug

SEQ ID NO: 3917603 - RNA, 17 nt, Shigella flexneri 2a str. 301
acaauaaucaccacaca

SEQ ID NO: 3917604 - RNA, 15 nt, Shigella flexneri 2a str. 301
acaauacaaaugccu

SEQ ID NO: 3917605 - RNA, 12 nt, Shigella flexneri 2a str. 301
acaauacuuaua

SEQ ID NO: 3917606 - RNA, 19 nt, Shigella flexneri 2a str. 301
acaauagcgaacagacaaa

SEQ ID NO: 3917607 - RNA, 14 nt, Shigella flexneri 2a str. 301
acaauauccagcgc

SEQ ID NO: 3917608 - RNA, 13 nt, Shigella flexneri 2a str. 301
acaaucagccaga

SEQ ID NO: 3917609 - RNA, 23 nt, Shigella flexneri 2a str. 301
acaaucagccagaacagcggugc

SEQ ID NO: 3917610 - RNA, 20 nt, Shigella flexneri 2a str. 301
acaaucccgcccgcagaggc

SEQ ID NO: 3917611 - RNA, 17 nt, Shigella flexneri 2a str. 301
acaaucccuuaguaacg

SEQ ID NO: 3917612 - RNA, 23 nt, Shigella flexneri 2a str. 301
acaaucgggaaaaucugcgggaa

SEQ ID NO: 3917613 - RNA, 17 nt, Shigella flexneri 2a str. 301
acaaucgucagcucgcu

SEQ ID NO: 3917614 - RNA, 24 nt, Shigella flexneri 2a str. 301
acaaucgucagcucgcugccauca

SEQ ID NO: 3917615 - RNA, 18 nt, Shigella flexneri 2a str. 301
acaaucguugccugaugc

SEQ ID NO: 3917616 - RNA, 17 nt, Shigella flexneri 2a str. 301
acaaucucaaccgcuuc

SEQ ID NO: 3917617 - RNA, 19 nt, Shigella flexneri 2a str. 301
acaaucucacccgcuucau

SEQ ID NO: 3917618 - RNA, 13 nt, Shigella flexneri 2a str. 301
acaaucugauaau

SEQ ID NO: 3917619 - RNA, 16 nt, Shigella flexneri 2a str. 301
acaaucugcgcuggaa

SEQ ID NO: 3917620 - RNA, 14 nt, Shigella flexneri 2a str. 301
acaaugaagaaagu

SEQ ID NO: 3917621 - RNA, 13 nt, Shigella flexneri 2a str. 301
acaaugcaauaau

SEQ ID NO: 3917622 - RNA, 21 nt, Shigella flexneri 2a str. 301
acaaugcaguuccauaugaau

SEQ ID NO: 3917623 - RNA, 17 nt, Shigella flexneri 2a str. 301
acaaugcuguaaccagc

SEQ ID NO: 3917624 - RNA, 20 nt, Shigella flexneri 2a str. 301
acaauggagcacauugccug

SEQ ID NO: 3917625 - RNA, 21 nt, Shigella flexneri 2a str. 301
acaauggagcuaaacagcgcu

SEQ ID NO: 3917626 - RNA, 16 nt, Shigella flexneri 2a str. 301
acaauggcggugaucc

SEQ ID NO: 3917627 - RNA, 20 nt, Shigella flexneri 2a str. 301
acaauggucaacauucccug

SEQ ID NO: 3917628 - RNA, 22 nt, Shigella flexneri 2a str. 301
acaaugucauggcagucuuaau

SEQ ID NO: 3917629 - RNA, 20 nt, Shigella flexneri 2a str. 301
acaauguguaggcguugaug

SEQ ID NO: 3917630 - RNA, 21 nt, Shigella flexneri 2a str. 301
acaauuaccugucgccagagc

SEQ ID NO: 3917631 - RNA, 22 nt, Shigella flexneri 2a str. 301
acaauuacugagagaaaaaaaa

SEQ ID NO: 3917632 - RNA, 11 nt, Shigella flexneri 2a str. 301
acaauucaggg

SEQ ID NO: 3917633 - RNA, 18 nt, Shigella flexneri 2a str. 301
acaauucccaguuacugc

SEQ ID NO: 3917634 - RNA, 15 nt, Shigella flexneri 2a str. 301
acaauucgccagggc

SEQ ID NO: 3917635 - RNA, 20 nt, Shigella flexneri 2a str. 301
acaauugccccccauaacgc

SEQ ID NO: 3917636 - RNA, 15 nt, Shigella flexneri 2a str. 301
acaauugucgccaca

SEQ ID NO: 3917637 - RNA, 23 nt, Shigella flexneri 2a str. 301
acaauugucgccacaaacgccag

SEQ ID NO: 3917638 - RNA, 21 nt, Shigella flexneri 2a str. 301
acaauuuaccggcaggugacu

SEQ ID NO: 3917639 - RNA, 22 nt, Shigella flexneri 2a str. 301
acaauuucagaauagacaaaaa

SEQ ID NO: 3917640 - RNA, 15 nt, Shigella flexneri 2a str. 301
acaauuucagcaaua

SEQ ID NO: 3917641 - RNA, 16 nt, Shigella flexneri 2a str. 301
acaauuucagcaauaa

SEQ ID NO: 3917642 - RNA, 23 nt, Shigella flexneri 2a str. 301
acaauuugcccauguaguacccg

SEQ ID NO: 3917643 - RNA, 17 nt, Shigella flexneri 2a str. 301
acacaacagacauuacc

SEQ ID NO: 3917644 - RNA, 19 nt, Shigella flexneri 2a str. 301
acacaauauugcggauaaa

SEQ ID NO: 3917645 - RNA, 15 nt, Shigella flexneri 2a str. 301
acacaaugccugaug

SEQ ID NO: 3917646 - RNA, 12 nt, Shigella flexneri 2a str. 301
acacacaucacg

SEQ ID NO: 3917647 - RNA, 15 nt, Shigella flexneri 2a str. 301
acacacuaucccaac

SEQ ID NO: 3917648 - RNA, 13 nt, Shigella flexneri 2a str. 301
acacacuuuccag

SEQ ID NO: 3917649 - RNA, 21 nt, Shigella flexneri 2a str. 301
acacagugaaucucuuaucau

SEQ ID NO: 3917650 - RNA, 19 nt, Shigella flexneri 2a str. 301
acacaguucuucaaaaaua

SEQ ID NO: 3917651 - RNA, 19 nt, Shigella flexneri 2a str. 301
acacauaacgccaauucau

SEQ ID NO: 3917652 - RNA, 14 nt, Shigella flexneri 2a str. 301
acacauaucacaau

SEQ ID NO: 3917653 - RNA, 16 nt, Shigella flexneri 2a str. 301
acacaucaccuccagc

SEQ ID NO: 3917654 - RNA, 20 nt, Shigella flexneri 2a str. 301
acacauugcgguucguugau

SEQ ID NO: 3917655 - RNA, 14 nt, Shigella flexneri 2a str. 301
acacauugcuguau

SEQ ID NO: 3917656 - RNA, 24 nt, Shigella flexneri 2a str. 301
acacauugcuguaucacuaugaaa

SEQ ID NO: 3917657 - RNA, 20 nt, Shigella flexneri 2a str. 301
acacauugugaaugaucagc

SEQ ID NO: 3917658 - RNA, 13 nt, Shigella flexneri 2a str. 301
acaccaaacagac

SEQ ID NO: 3917659 - RNA, 13 nt, Shigella flexneri 2a str. 301
acaccaacaucac

SEQ ID NO: 3917660 - RNA, 15 nt, Shigella flexneri 2a str. 301
acaccaaggaacugu

SEQ ID NO: 3917661 - RNA, 15 nt, Shigella flexneri 2a str. 301
acaccacaucgccga

SEQ ID NO: 3917662 - RNA, 20 nt, Shigella flexneri 2a str. 301
acaccaccaauggcuggccu

SEQ ID NO: 3917663 - RNA, 14 nt, Shigella flexneri 2a str. 301
acaccagagccugc

SEQ ID NO: 3917664 - RNA, 18 nt, Shigella flexneri 2a str. 301
acaccagagccugccaau

SEQ ID NO: 3917665 - RNA, 12 nt, Shigella flexneri 2a str. 301
acaccagaugag

SEQ ID NO: 3917666 - RNA, 15 nt, Shigella flexneri 2a str. 301
acaccagaugauuag

SEQ ID NO: 3917667 - RNA, 15 nt, Shigella flexneri 2a str. 301
acaccagcacaucau

SEQ ID NO: 3917668 - RNA, 17 nt, Shigella flexneri 2a str. 301
acaccagcacaucauca

SEQ ID NO: 3917669 - RNA, 18 nt, Shigella flexneri 2a str. 301
acaccagcaguaaaccac

SEQ ID NO: 3917670 - RNA, 22 nt, Shigella flexneri 2a str. 301
acaccagcaguaaaccacccac

SEQ ID NO: 3917671 - RNA, 17 nt, Shigella flexneri 2a str. 301
acaccagcccucauucg

SEQ ID NO: 3917672 - RNA, 19 nt, Shigella flexneri 2a str. 301
acaccaggcucuuuaaaca

SEQ ID NO: 3917673 - RNA, 14 nt, Shigella flexneri 2a str. 301
acaccaucaguggc

SEQ ID NO: 3917674 - RNA, 15 nt, Shigella flexneri 2a str. 301
acaccaucuuccuca

SEQ ID NO: 3917675 - RNA, 12 nt, Shigella flexneri 2a str. 301
acacccacauca

SEQ ID NO: 3917676 - RNA, 18 nt, Shigella flexneri 2a str. 301
acacccauggggaugcug

SEQ ID NO: 3917677 - RNA, 17 nt, Shigella flexneri 2a str. 301
acacccggagacaaaca

SEQ ID NO: 3917678 - RNA, 20 nt, Shigella flexneri 2a str. 301
acacccgguaucaaacccuu

SEQ ID NO: 3917679 - RNA, 15 nt, Shigella flexneri 2a str. 301
acaccgauugccccu

SEQ ID NO: 3917680 - RNA, 23 nt, Shigella flexneri 2a str. 301
acaccgauuuuguaaaagaaggc

SEQ ID NO: 3917681 - RNA, 22 nt, Shigella flexneri 2a str. 301
acaccgcagccgccacaauaaa

SEQ ID NO: 3917682 - RNA, 16 nt, Shigella flexneri 2a str. 301
acaccgcccaacagac

SEQ ID NO: 3917683 - RNA, 13 nt, Shigella flexneri 2a str. 301
acaccggaccaga

SEQ ID NO: 3917684 - RNA, 23 nt, Shigella flexneri 2a str. 301
acaccguccggcgggcaaauucu

SEQ ID NO: 3917685 - RNA, 19 nt, Shigella flexneri 2a str. 301
acaccguugcccgcauuau

SEQ ID NO: 3917686 - RNA, 19 nt, Shigella flexneri 2a str. 301
acaccuaccggcuggcgca

SEQ ID NO: 3917687 - RNA, 17 nt, Shigella flexneri 2a str. 301
acaccugacgauguggu

SEQ ID NO: 3917688 - RNA, 13 nt, Shigella flexneri 2a str. 301
acaccuuaaggcu

SEQ ID NO: 3917689 - RNA, 15 nt, Shigella flexneri 2a str. 301
acaccuuaaggcugu

SEQ ID NO: 3917690 - RNA, 14 nt, Shigella flexneri 2a str. 301
acaccuucauccag

SEQ ID NO: 3917691 - RNA, 19 nt, Shigella flexneri 2a str. 301
acaccuucauccagcauca

SEQ ID NO: 3917692 - RNA, 18 nt, Shigella flexneri 2a str. 301
acacgacauacaccgcag

SEQ ID NO: 3917693 - RNA, 15 nt, Shigella flexneri 2a str. 301
acacgagucauuccg

SEQ ID NO: 3917694 - RNA, 13 nt, Shigella flexneri 2a str. 301
acacgaucucacg

SEQ ID NO: 3917695 - RNA, 18 nt, Shigella flexneri 2a str. 301
acacgccgcgaggcaaau

SEQ ID NO: 3917696 - RNA, 22 nt, Shigella flexneri 2a str. 301
acacgccuggcucaagcaccau

SEQ ID NO: 3917697 - RNA, 22 nt, Shigella flexneri 2a str. 301
acacgcugcgguuuacgccagg

SEQ ID NO: 3917698 - RNA, 19 nt, Shigella flexneri 2a str. 301
acacgcuucaaguucagca

SEQ ID NO: 3917699 - RNA, 15 nt, Shigella flexneri 2a str. 301
acacguuaacaaugu

SEQ ID NO: 3917700 - RNA, 23 nt, Shigella flexneri 2a str. 301
acacguuaacaauguuguggcca

SEQ ID NO: 3917701 - RNA, 16 nt, Shigella flexneri 2a str. 301
acacuaacagaacaau

SEQ ID NO: 3917702 - RNA, 18 nt, Shigella flexneri 2a str. 301
acagccuuauugucuuua

SEQ ID NO: 3917703 - RNA, 23 nt, Shigella flexneri 2a str. 301
acagccuucggacguuugccaug

SEQ ID NO: 3917704 - RNA, 15 nt, Shigella flexneri 2a str. 301
acagccuugcgugcc

SEQ ID NO: 3917705 - RNA, 22 nt, Shigella flexneri 2a str. 301
acagcgacucucugagccagcu

SEQ ID NO: 3917706 - RNA, 15 nt, Shigella flexneri 2a str. 301
acagcgauuccaguu

SEQ ID NO: 3917707 - RNA, 22 nt, Shigella flexneri 2a str. 301
acagcgcaaaacgcaggaucca

SEQ ID NO: 3917708 - RNA, 17 nt, Shigella flexneri 2a str. 301
acagcgcaccagaaaca

SEQ ID NO: 3917709 - RNA, 15 nt, Shigella flexneri 2a str. 301
acagcgcauucggca

SEQ ID NO: 3917710 - RNA, 15 nt, Shigella flexneri 2a str. 301
acagcgccagaaggg

SEQ ID NO: 3917711 - RNA, 23 nt, Shigella flexneri 2a str. 301
acagcgccagacaaaccacgccu

SEQ ID NO: 3917712 - RNA, 23 nt, Shigella flexneri 2a str. 301
acagcgccaucugcagggcaucg

SEQ ID NO: 3917713 - RNA, 14 nt, Shigella flexneri 2a str. 301
acagcgcccaacac

SEQ ID NO: 3917714 - RNA, 22 nt, Shigella flexneri 2a str. 301
acagcgcgcgccgccaaucacg

SEQ ID NO: 3917715 - RNA, 15 nt, Shigella flexneri 2a str. 301
acagcgcgcugacau

SEQ ID NO: 3917716 - RNA, 14 nt, Shigella flexneri 2a str. 301
acagcggaguaauc

SEQ ID NO: 3917717 - RNA, 20 nt, Shigella flexneri 2a str. 301
acagcggcgaauguuccauc

SEQ ID NO: 3917718 - RNA, 14 nt, Shigella flexneri 2a str. 301
acagcguuaaaaag

SEQ ID NO: 3917719 - RNA, 15 nt, Shigella flexneri 2a str. 301
acagcguuucuucga

SEQ ID NO: 3917720 - RNA, 20 nt, Shigella flexneri 2a str. 301
acagcuaaucaucaucagug

SEQ ID NO: 3917721 - RNA, 22 nt, Shigella flexneri 2a str. 301
acagcucacggcccugugccug

SEQ ID NO: 3917722 - RNA, 21 nt, Shigella flexneri 2a str. 301
acagcuggaguacggccuugg

SEQ ID NO: 3917723 - RNA, 18 nt, Shigella flexneri 2a str. 301
acagcuggaguagauaau

SEQ ID NO: 3917724 - RNA, 11 nt, Shigella flexneri 2a str. 301
acagcugggcg

SEQ ID NO: 3917725 - RNA, 15 nt, Shigella flexneri 2a str. 301
acagcuuagacagcg

SEQ ID NO: 3917726 - RNA, 17 nt, Shigella flexneri 2a str. 301
acagcuuuuacagccaa

SEQ ID NO: 3917727 - RNA, 20 nt, Shigella flexneri 2a str. 301
acagcuuuuacagccaaugc

SEQ ID NO: 3917728 - RNA, 14 nt, Shigella flexneri 2a str. 301
acagcuuuuuccug

SEQ ID NO: 3917729 - RNA, 15 nt, Shigella flexneri 2a str. 301
acaggaacagccacu

SEQ ID NO: 3917730 - RNA, 17 nt, Shigella flexneri 2a str. 301
acaggaagcagcuugcu

SEQ ID NO: 3917731 - RNA, 14 nt, Shigella flexneri 2a str. 301
acaggauauauuuc

SEQ ID NO: 3917732 - RNA, 16 nt, Shigella flexneri 2a str. 301
acaggauauguaagca

SEQ ID NO: 3917733 - RNA, 22 nt, Shigella flexneri 2a str. 301
acaggauggcguucgcaacacc

SEQ ID NO: 3917734 - RNA, 20 nt, Shigella flexneri 2a str. 301
acaggcaagcauaugacgaa

SEQ ID NO: 3917735 - RNA, 13 nt, Shigella flexneri 2a str. 301
acaggcagcugcc

SEQ ID NO: 3917736 - RNA, 16 nt, Shigella flexneri 2a str. 301
acaggcagcuuagaaa

SEQ ID NO: 3917737 - RNA, 20 nt, Shigella flexneri 2a str. 301
acaggccggagccagccguu

SEQ ID NO: 3917738 - RNA, 13 nt, Shigella flexneri 2a str. 301
acaggcgaugcca

SEQ ID NO: 3917739 - RNA, 21 nt, Shigella flexneri 2a str. 301
acaggcgcuggguaaagagcg

SEQ ID NO: 3917740 - RNA, 15 nt, Shigella flexneri 2a str. 301
acaggcgggaagaac

SEQ ID NO: 3917741 - RNA, 21 nt, Shigella flexneri 2a str. 301
acaggcuuuccugauaaucca

SEQ ID NO: 3917742 - RNA, 17 nt, Shigella flexneri 2a str. 301
acagggcucuuaagcac

SEQ ID NO: 3917743 - RNA, 15 nt, Shigella flexneri 2a str. 301
acaggggcuggaaga

SEQ ID NO: 3917744 - RNA, 15 nt, Shigella flexneri 2a str. 301
acagggugagcagaa

SEQ ID NO: 3917745 - RNA, 18 nt, Shigella flexneri 2a str. 301
acagguaucgacaauguc

SEQ ID NO: 3917746 - RNA, 20 nt, Shigella flexneri 2a str. 301
acaggucgagaacaacggcg

SEQ ID NO: 3917747 - RNA, 14 nt, Shigella flexneri 2a str. 301
acaggucuguauga

SEQ ID NO: 3917748 - RNA, 19 nt, Shigella flexneri 2a str. 301
acagguggcguuugccacc

SEQ ID NO: 3917749 - RNA, 23 nt, Shigella flexneri 2a str. 301
acagguugccgaugauucccagu

SEQ ID NO: 3917750 - RNA, 16 nt, Shigella flexneri 2a str. 301
acagguuuaaacagag

SEQ ID NO: 3917751 - RNA, 15 nt, Shigella flexneri 2a str. 301
acaguaaagcgcaaa

SEQ ID NO: 3917752 - RNA, 12 nt, Shigella flexneri 2a str. 301
acaguaaaguuu

SEQ ID NO: 3917753 - RNA, 15 nt, Shigella flexneri 2a str. 301
acaguaacccggcac

SEQ ID NO: 3917754 - RNA, 17 nt, Shigella flexneri 2a str. 301
acaguaaugauuuaaaa

SEQ ID NO: 3917755 - RNA, 16 nt, Shigella flexneri 2a str. 301
acaguacaauaugaau

SEQ ID NO: 3917756 - RNA, 15 nt, Shigella flexneri 2a str. 301
acaguacaucuucca

SEQ ID NO: 3917757 - RNA, 20 nt, Shigella flexneri 2a str. 301
acaguacgguaaagccgugc

SEQ ID NO: 3917758 - RNA, 21 nt, Shigella flexneri 2a str. 301
acaguacgguaaagccgugcu

SEQ ID NO: 3917759 - RNA, 18 nt, Shigella flexneri 2a str. 301
acaguacguguuguucca

SEQ ID NO: 3917760 - RNA, 21 nt, Shigella flexneri 2a str. 301
acaguagacaauuuuucauaa

SEQ ID NO: 3917761 - RNA, 15 nt, Shigella flexneri 2a str. 301
acaguaucaucauua

SEQ ID NO: 3917762 - RNA, 18 nt, Shigella flexneri 2a str. 301
acaguauccgggcaucca

SEQ ID NO: 3917763 - RNA, 20 nt, Shigella flexneri 2a str. 301
acagucaguuaucgcauuau

SEQ ID NO: 3917764 - RNA, 14 nt, Shigella flexneri 2a str. 301
acagucgcucggcg

SEQ ID NO: 3917765 - RNA, 15 nt, Shigella flexneri 2a str. 301
acagucgcucggcga

SEQ ID NO: 3917766 - RNA, 14 nt, Shigella flexneri 2a str. 301
acagucugcucccu

SEQ ID NO: 3917767 - RNA, 21 nt, Shigella flexneri 2a str. 301
acagugaccaucuuccagcau

SEQ ID NO: 3917768 - RNA, 21 nt, Shigella flexneri 2a str. 301
acagugacccgcagccagcac

SEQ ID NO: 3917769 - RNA, 21 nt, Shigella flexneri 2a str. 301
acagugauuacuaaaugugca

SEQ ID NO: 3917770 - RNA, 14 nt, Shigella flexneri 2a str. 301
acagugcaccggac

SEQ ID NO: 3917771 - RNA, 15 nt, Shigella flexneri 2a str. 301
acagugcaccggaca

SEQ ID NO: 3917772 - RNA, 22 nt, Shigella flexneri 2a str. 301
acagugcugauuuugcaacaac

SEQ ID NO: 3917773 - RNA, 16 nt, Shigella flexneri 2a str. 301
acaguggcgacaucuu

SEQ ID NO: 3917774 - RNA, 17 nt, Shigella flexneri 2a str. 301
acagugggauuaaaaag

SEQ ID NO: 3917775 - RNA, 20 nt, Shigella flexneri 2a str. 301
acagugggauuaaaaaguaa

SEQ ID NO: 3917776 - RNA, 19 nt, Shigella flexneri 2a str. 301
acaguggugcuuugcugug

SEQ ID NO: 3917777 - RNA, 20 nt, Shigella flexneri 2a str. 301
acaguguaauuaggcuaaau

SEQ ID NO: 3917778 - RNA, 12 nt, Shigella flexneri 2a str. 301
acaguuaucaaa

SEQ ID NO: 3917779 - RNA, 12 nt, Shigella flexneri 2a str. 301
acaguucuuccu

SEQ ID NO: 3917780 - RNA, 23 nt, Shigella flexneri 2a str. 301
acaguugucagcccuuuuucacg

SEQ ID NO: 3917781 - RNA, 15 nt, Shigella flexneri 2a str. 301
acaguuucaccugcu

SEQ ID NO: 3917782 - RNA, 19 nt, Shigella flexneri 2a str. 301
acaguuucggaccagccgc

SEQ ID NO: 3917783 - RNA, 19 nt, Shigella flexneri 2a str. 301
acaguuucugcagcuccag

SEQ ID NO: 3917784 - RNA, 22 nt, Shigella flexneri 2a str. 301
acaguuuuaucuccauccggga

SEQ ID NO: 3917785 - RNA, 20 nt, Shigella flexneri 2a str. 301
acaguuuucaagacgccguc

SEQ ID NO: 3917786 - RNA, 14 nt, Shigella flexneri 2a str. 301
acauaaaaaagccg

SEQ ID NO: 3917787 - RNA, 17 nt, Shigella flexneri 2a str. 301
acauaaacagguaaaga

SEQ ID NO: 3917788 - RNA, 21 nt, Shigella flexneri 2a str. 301
acauaaacagguaaagaccau

SEQ ID NO: 3917789 - RNA, 16 nt, Shigella flexneri 2a str. 301
acauaaagucuuucuu

SEQ ID NO: 3917790 - RNA, 13 nt, Shigella flexneri 2a str. 301
acauaacacuagc

SEQ ID NO: 3917791 - RNA, 13 nt, Shigella flexneri 2a str. 301
acauaaccacuca

SEQ ID NO: 3917792 - RNA, 18 nt, Shigella flexneri 2a str. 301
acauaaccacucaccgcc

SEQ ID NO: 3917793 - RNA, 18 nt, Shigella flexneri 2a str. 301
acauaaggaaacuccagc

SEQ ID NO: 3917794 - RNA, 14 nt, Shigella flexneri 2a str. 301
acauaauccagaca

SEQ ID NO: 3917795 - RNA, 13 nt, Shigella flexneri 2a str. 301
acauaaucgaaaa

SEQ ID NO: 3917796 - RNA, 16 nt, Shigella flexneri 2a str. 301
acauacaaauagccaa

SEQ ID NO: 3917797 - RNA, 14 nt, Shigella flexneri 2a str. 301
acauacacaagcca

SEQ ID NO: 3917798 - RNA, 19 nt, Shigella flexneri 2a str. 301
acauacccuugaucaccgu

SEQ ID NO: 3917799 - RNA, 21 nt, Shigella flexneri 2a str. 301
acauacugcuccauaauugcc

SEQ ID NO: 3917800 - RNA, 15 nt, Shigella flexneri 2a str. 301
acauagcacaacagg

SEQ ID NO: 3917801 - RNA, 14 nt, Shigella flexneri 2a str. 301
acauagcgcaucag

SEQ ID NO: 3917802 - RNA, 15 nt, Shigella flexneri 2a str. 301
accacaucgcaaaau

SEQ ID NO: 3917803 - RNA, 14 nt, Shigella flexneri 2a str. 301
accaccaaaaccac

SEQ ID NO: 3917804 - RNA, 13 nt, Shigella flexneri 2a str. 301
accaccaccgcag

SEQ ID NO: 3917805 - RNA, 20 nt, Shigella flexneri 2a str. 301
accaccagacgcaacagaaa

SEQ ID NO: 3917806 - RNA, 15 nt, Shigella flexneri 2a str. 301
accaccagcaauaau

SEQ ID NO: 3917807 - RNA, 16 nt, Shigella flexneri 2a str. 301
accaccagcaauaaua

SEQ ID NO: 3917808 - RNA, 15 nt, Shigella flexneri 2a str. 301
accaccagcaccgcg

SEQ ID NO: 3917809 - RNA, 13 nt, Shigella flexneri 2a str. 301
accaccagcacug

SEQ ID NO: 3917810 - RNA, 19 nt, Shigella flexneri 2a str. 301
accaccaguaaauugucgc

SEQ ID NO: 3917811 - RNA, 19 nt, Shigella flexneri 2a str. 301
accaccauauucgccaccg

SEQ ID NO: 3917812 - RNA, 11 nt, Shigella flexneri 2a str. 301
accaccaugcu

SEQ ID NO: 3917813 - RNA, 20 nt, Shigella flexneri 2a str. 301
accaccaugcuaauagcugc

SEQ ID NO: 3917814 - RNA, 17 nt, Shigella flexneri 2a str. 301
accacccaccagcgccg

SEQ ID NO: 3917815 - RNA, 12 nt, Shigella flexneri 2a str. 301
accacccagcgg

SEQ ID NO: 3917816 - RNA, 22 nt, Shigella flexneri 2a str. 301
accacccccagacgacggcugc

SEQ ID NO: 3917817 - RNA, 15 nt, Shigella flexneri 2a str. 301
accacccguaaucac

SEQ ID NO: 3917818 - RNA, 21 nt, Shigella flexneri 2a str. 301
accaccgaugcacagcacgcu

SEQ ID NO: 3917819 - RNA, 23 nt, Shigella flexneri 2a str. 301
accaccgcaucggcaucaaacca

SEQ ID NO: 3917820 - RNA, 23 nt, Shigella flexneri 2a str. 301
accaccggauguagcaacggagg

SEQ ID NO: 3917821 - RNA, 13 nt, Shigella flexneri 2a str. 301
accaccggcacca

SEQ ID NO: 3917822 - RNA, 18 nt, Shigella flexneri 2a str. 301
accaccggcaccacuugc

SEQ ID NO: 3917823 - RNA, 16 nt, Shigella flexneri 2a str. 301
accaccguuuucccgc

SEQ ID NO: 3917824 - RNA, 12 nt, Shigella flexneri 2a str. 301
accaccuccacg

SEQ ID NO: 3917825 - RNA, 15 nt, Shigella flexneri 2a str. 301
accaccuccacgccc

SEQ ID NO: 3917826 - RNA, 16 nt, Shigella flexneri 2a str. 301
accaccuccacgccca

SEQ ID NO: 3917827 - RNA, 21 nt, Shigella flexneri 2a str. 301
accaccuccacgcccagcgca

SEQ ID NO: 3917828 - RNA, 15 nt, Shigella flexneri 2a str. 301
accacgaacgagguu

SEQ ID NO: 3917829 - RNA, 15 nt, Shigella flexneri 2a str. 301
accacgaagcaaugg

SEQ ID NO: 3917830 - RNA, 17 nt, Shigella flexneri 2a str. 301
accacgaagcaauggcg

SEQ ID NO: 3917831 - RNA, 17 nt, Shigella flexneri 2a str. 301
accacgacgaagcgccu

SEQ ID NO: 3917832 - RNA, 14 nt, Shigella flexneri 2a str. 301
accacgauauguuc

SEQ ID NO: 3917833 - RNA, 18 nt, Shigella flexneri 2a str. 301
accacgauauguucagga

SEQ ID NO: 3917834 - RNA, 14 nt, Shigella flexneri 2a str. 301
accacgcagcgccg

SEQ ID NO: 3917835 - RNA, 17 nt, Shigella flexneri 2a str. 301
accacgccugccgccag

SEQ ID NO: 3917836 - RNA, 18 nt, Shigella flexneri 2a str. 301
accacgccugccgccagc

SEQ ID NO: 3917837 - RNA, 13 nt, Shigella flexneri 2a str. 301
accacgcgggcca

SEQ ID NO: 3917838 - RNA, 23 nt, Shigella flexneri 2a str. 301
accacgcgggccauccaccagug

SEQ ID NO: 3917839 - RNA, 20 nt, Shigella flexneri 2a str. 301
accacggaguugaccagcuc

SEQ ID NO: 3917840 - RNA, 15 nt, Shigella flexneri 2a str. 301
accacggcagcaacu

SEQ ID NO: 3917841 - RNA, 17 nt, Shigella flexneri 2a str. 301
accacggccacagccag

SEQ ID NO: 3917842 - RNA, 20 nt, Shigella flexneri 2a str. 301
accacggcgcauuugcggca

SEQ ID NO: 3917843 - RNA, 11 nt, Shigella flexneri 2a str. 301
accacgggcuu

SEQ ID NO: 3917844 - RNA, 21 nt, Shigella flexneri 2a str. 301
accacguaccacggcauuucc

SEQ ID NO: 3917845 - RNA, 15 nt, Shigella flexneri 2a str. 301
accacguccagagug

SEQ ID NO: 3917846 - RNA, 17 nt, Shigella flexneri 2a str. 301
accacguugacaaacug

SEQ ID NO: 3917847 - RNA, 14 nt, Shigella flexneri 2a str. 301
accacucaccgccg

SEQ ID NO: 3917848 - RNA, 22 nt, Shigella flexneri 2a str. 301
accacugacacaggcagcaauc

SEQ ID NO: 3917849 - RNA, 12 nt, Shigella flexneri 2a str. 301
accacugauaag

SEQ ID NO: 3917850 - RNA, 15 nt, Shigella flexneri 2a str. 301
accacugauggaauu

SEQ ID NO: 3917851 - RNA, 14 nt, Shigella flexneri 2a str. 301
accacugccagauu

SEQ ID NO: 3917852 - RNA, 19 nt, Shigella flexneri 2a str. 301
accacugccagauucucca

SEQ ID NO: 3917853 - RNA, 22 nt, Shigella flexneri 2a str. 301
accacugcgacgcggcgguucu

SEQ ID NO: 3917854 - RNA, 14 nt, Shigella flexneri 2a str. 301
accacugcgcauaa

SEQ ID NO: 3917855 - RNA, 20 nt, Shigella flexneri 2a str. 301
accacugcgcauaauccacu

SEQ ID NO: 3917856 - RNA, 16 nt, Shigella flexneri 2a str. 301
accacuuaauuauuaa

SEQ ID NO: 3917857 - RNA, 21 nt, Shigella flexneri 2a str. 301
accacuuaauuauuaacaaaa

SEQ ID NO: 3917858 - RNA, 13 nt, Shigella flexneri 2a str. 301
accacuucacccg

SEQ ID NO: 3917859 - RNA, 14 nt, Shigella flexneri 2a str. 301
accacuucacccgc

SEQ ID NO: 3917860 - RNA, 15 nt, Shigella flexneri 2a str. 301
accacuucagaaccg

SEQ ID NO: 3917861 - RNA, 13 nt, Shigella flexneri 2a str. 301
accacuucaugcc

SEQ ID NO: 3917862 - RNA, 14 nt, Shigella flexneri 2a str. 301
accacuucggcaaa

SEQ ID NO: 3917863 - RNA, 19 nt, Shigella flexneri 2a str. 301
accacuugcagaccaaggu

SEQ ID NO: 3917864 - RNA, 14 nt, Shigella flexneri 2a str. 301
accacuuuugcucc

SEQ ID NO: 3917865 - RNA, 16 nt, Shigella flexneri 2a str. 301
accagaaacaauaagu

SEQ ID NO: 3917866 - RNA, 19 nt, Shigella flexneri 2a str. 301
accagaaagggaagaacau

SEQ ID NO: 3917867 - RNA, 12 nt, Shigella flexneri 2a str. 301
accagaagagaa

SEQ ID NO: 3917868 - RNA, 14 nt, Shigella flexneri 2a str. 301
accagaaucgccag

SEQ ID NO: 3917869 - RNA, 18 nt, Shigella flexneri 2a str. 301
accagaaucgccagcauc

SEQ ID NO: 3917870 - RNA, 20 nt, Shigella flexneri 2a str. 301
accagaaucgccagcaucgg

SEQ ID NO: 3917871 - RNA, 12 nt, Shigella flexneri 2a str. 301
accagaauuuac

SEQ ID NO: 3917872 - RNA, 14 nt, Shigella flexneri 2a str. 301
accagacagcacau

SEQ ID NO: 3917873 - RNA, 19 nt, Shigella flexneri 2a str. 301
accagacaucguaaagcug

SEQ ID NO: 3917874 - RNA, 17 nt, Shigella flexneri 2a str. 301
accagaccaauggcuuu

SEQ ID NO: 3917875 - RNA, 23 nt, Shigella flexneri 2a str. 301
accagaccggcaaucgcgccaga

SEQ ID NO: 3917876 - RNA, 17 nt, Shigella flexneri 2a str. 301
accagacgcaacagaaa

SEQ ID NO: 3917877 - RNA, 21 nt, Shigella flexneri 2a str. 301
accagacgcgcguccccugcc

SEQ ID NO: 3917878 - RNA, 20 nt, Shigella flexneri 2a str. 301
accagacgugauaaacaucc

SEQ ID NO: 3917879 - RNA, 18 nt, Shigella flexneri 2a str. 301
accagacugugaaucaug

SEQ ID NO: 3917880 - RNA, 22 nt, Shigella flexneri 2a str. 301
accagacugugaaucauggaug

SEQ ID NO: 3917881 - RNA, 23 nt, Shigella flexneri 2a str. 301
accagagauguugaagaagucga

SEQ ID NO: 3917882 - RNA, 20 nt, Shigella flexneri 2a str. 301
accagagcugauacgggagg

SEQ ID NO: 3917883 - RNA, 17 nt, Shigella flexneri 2a str. 301
accagaguaacgggcac

SEQ ID NO: 3917884 - RNA, 22 nt, Shigella flexneri 2a str. 301
accagaguaacgggcacguaaa

SEQ ID NO: 3917885 - RNA, 21 nt, Shigella flexneri 2a str. 301
accagauaagccugcgcgccc

SEQ ID NO: 3917886 - RNA, 18 nt, Shigella flexneri 2a str. 301
accagauaaucaccugcc

SEQ ID NO: 3917887 - RNA, 21 nt, Shigella flexneri 2a str. 301
accagaucuggcgauuauuuu

SEQ ID NO: 3917888 - RNA, 20 nt, Shigella flexneri 2a str. 301
accagaugcucuuuucugaa

SEQ ID NO: 3917889 - RNA, 19 nt, Shigella flexneri 2a str. 301
accagauuaaucagcagau

SEQ ID NO: 3917890 - RNA, 16 nt, Shigella flexneri 2a str. 301
accagauuaauuauug

SEQ ID NO: 3917891 - RNA, 16 nt, Shigella flexneri 2a str. 301
accagauuauaagcca

SEQ ID NO: 3917892 - RNA, 22 nt, Shigella flexneri 2a str. 301
accagauuauaagccaguaaga

SEQ ID NO: 3917893 - RNA, 12 nt, Shigella flexneri 2a str. 301
accagcaaauau

SEQ ID NO: 3917894 - RNA, 15 nt, Shigella flexneri 2a str. 301
accagcacaucauca

SEQ ID NO: 3917895 - RNA, 22 nt, Shigella flexneri 2a str. 301
accagcacaucaucaaagccaa

SEQ ID NO: 3917896 - RNA, 11 nt, Shigella flexneri 2a str. 301
accagcaccag

SEQ ID NO: 3917897 - RNA, 22 nt, Shigella flexneri 2a str. 301
accagcaccagcuccggcaccu

SEQ ID NO: 3917898 - RNA, 10 nt, Shigella flexneri 2a str. 301
accagcagca

SEQ ID NO: 3917899 - RNA, 17 nt, Shigella flexneri 2a str. 301
accagcagcgccggauu

SEQ ID NO: 3917900 - RNA, 13 nt, Shigella flexneri 2a str. 301
accagcagcugcu

SEQ ID NO: 3917901 - RNA, 13 nt, Shigella flexneri 2a str. 301
accagcaguaaac

SEQ ID NO: 3917902 - RNA, 15 nt, Shigella flexneri 2a str. 301
accaucuucuucacu

SEQ ID NO: 3917903 - RNA, 21 nt, Shigella flexneri 2a str. 301
accaucuucuucacuucuuca

SEQ ID NO: 3917904 - RNA, 14 nt, Shigella flexneri 2a str. 301
accaucuuuuuuug

SEQ ID NO: 3917905 - RNA, 14 nt, Shigella flexneri 2a str. 301
accaugacgccgaa

SEQ ID NO: 3917906 - RNA, 19 nt, Shigella flexneri 2a str. 301
accaugcaauuaccgccac

SEQ ID NO: 3917907 - RNA, 14 nt, Shigella flexneri 2a str. 301
accaugcaccaacc

SEQ ID NO: 3917908 - RNA, 22 nt, Shigella flexneri 2a str. 301
accaugccggugaugccgccag

SEQ ID NO: 3917909 - RNA, 18 nt, Shigella flexneri 2a str. 301
accaugcgcaucaucgau

SEQ ID NO: 3917910 - RNA, 18 nt, Shigella flexneri 2a str. 301
accauggcagaagcauuu

SEQ ID NO: 3917911 - RNA, 18 nt, Shigella flexneri 2a str. 301
accauggcucaccagcag

SEQ ID NO: 3917912 - RNA, 16 nt, Shigella flexneri 2a str. 301
accauuaaauccggcg

SEQ ID NO: 3917913 - RNA, 21 nt, Shigella flexneri 2a str. 301
accauuaaucgauaaaccagc

SEQ ID NO: 3917914 - RNA, 21 nt, Shigella flexneri 2a str. 301
accauuacuguauacgggcuu

SEQ ID NO: 3917915 - RNA, 14 nt, Shigella flexneri 2a str. 301
accauuaucaaaca

SEQ ID NO: 3917916 - RNA, 14 nt, Shigella flexneri 2a str. 301
accauuaucaccaa

SEQ ID NO: 3917917 - RNA, 14 nt, Shigella flexneri 2a str. 301
accauucaggcugg

SEQ ID NO: 3917918 - RNA, 17 nt, Shigella flexneri 2a str. 301
accauugaggauugcgc

SEQ ID NO: 3917919 - RNA, 15 nt, Shigella flexneri 2a str. 301
accauugauaaucca

SEQ ID NO: 3917920 - RNA, 13 nt, Shigella flexneri 2a str. 301
accauugccagua

SEQ ID NO: 3917921 - RNA, 17 nt, Shigella flexneri 2a str. 301
accauugcugccgccag

SEQ ID NO: 3917922 - RNA, 21 nt, Shigella flexneri 2a str. 301
accauugcugccgccaguucu

SEQ ID NO: 3917923 - RNA, 21 nt, Shigella flexneri 2a str. 301
accauuggucuuugugccacg

SEQ ID NO: 3917924 - RNA, 22 nt, Shigella flexneri 2a str. 301
accauugguugcgcuucuucca

SEQ ID NO: 3917925 - RNA, 15 nt, Shigella flexneri 2a str. 301
accauuuaaaucaau

SEQ ID NO: 3917926 - RNA, 19 nt, Shigella flexneri 2a str. 301
accauuugugcuggcaaau

SEQ ID NO: 3917927 - RNA, 23 nt, Shigella flexneri 2a str. 301
accauuugugcuggcaaaucagu

SEQ ID NO: 3917928 - RNA, 17 nt, Shigella flexneri 2a str. 301
accauuuugcuguucau

SEQ ID NO: 3917929 - RNA, 16 nt, Shigella flexneri 2a str. 301
accauuuuuaagcgcc

SEQ ID NO: 3917930 - RNA, 18 nt, Shigella flexneri 2a str. 301
accauuuuuuaauucaaa

SEQ ID NO: 3917931 - RNA, 15 nt, Shigella flexneri 2a str. 301
acccaaaaaauagca

SEQ ID NO: 3917932 - RNA, 17 nt, Shigella flexneri 2a str. 301
acccaaaacaaagcccg

SEQ ID NO: 3917933 - RNA, 14 nt, Shigella flexneri 2a str. 301
acccaaccgguaau

SEQ ID NO: 3917934 - RNA, 18 nt, Shigella flexneri 2a str. 301
acccaacguaacaaaacu

SEQ ID NO: 3917935 - RNA, 11 nt, Shigella flexneri 2a str. 301
acccaauccag

SEQ ID NO: 3917936 - RNA, 22 nt, Shigella flexneri 2a str. 301
acccacauguugcgcuucacca

SEQ ID NO: 3917937 - RNA, 22 nt, Shigella flexneri 2a str. 301
acccaccaugccgauggcaaaa

SEQ ID NO: 3917938 - RNA, 20 nt, Shigella flexneri 2a str. 301
acccaccgauuuucagccau

SEQ ID NO: 3917939 - RNA, 12 nt, Shigella flexneri 2a str. 301
acccaccgcagc

SEQ ID NO: 3917940 - RNA, 13 nt, Shigella flexneri 2a str. 301
acccaccgcagcc

SEQ ID NO: 3917941 - RNA, 13 nt, Shigella flexneri 2a str. 301
acccaccgguccu

SEQ ID NO: 3917942 - RNA, 17 nt, Shigella flexneri 2a str. 301
acccacggauagauuuu

SEQ ID NO: 3917943 - RNA, 20 nt, Shigella flexneri 2a str. 301
acccacggauagauuuuuaa

SEQ ID NO: 3917944 - RNA, 14 nt, Shigella flexneri 2a str. 301
acccacugacuucu

SEQ ID NO: 3917945 - RNA, 15 nt, Shigella flexneri 2a str. 301
acccacugcgcagug

SEQ ID NO: 3917946 - RNA, 12 nt, Shigella flexneri 2a str. 301
acccagaacuau

SEQ ID NO: 3917947 - RNA, 23 nt, Shigella flexneri 2a str. 301
acccagaagaaagccggaugauc

SEQ ID NO: 3917948 - RNA, 14 nt, Shigella flexneri 2a str. 301
acccagaugucuuu

SEQ ID NO: 3917949 - RNA, 13 nt, Shigella flexneri 2a str. 301
acccagcagcagc

SEQ ID NO: 3917950 - RNA, 15 nt, Shigella flexneri 2a str. 301
acccagcagcgccac

SEQ ID NO: 3917951 - RNA, 19 nt, Shigella flexneri 2a str. 301
acccagcagcgccgcgccu

SEQ ID NO: 3917952 - RNA, 17 nt, Shigella flexneri 2a str. 301
acccagcgaauccagca

SEQ ID NO: 3917953 - RNA, 23 nt, Shigella flexneri 2a str. 301
acccagcgguaaaauggucagcc

SEQ ID NO: 3917954 - RNA, 20 nt, Shigella flexneri 2a str. 301
acccagcguguugaggaagc

SEQ ID NO: 3917955 - RNA, 17 nt, Shigella flexneri 2a str. 301
acccaggagaugcccga

SEQ ID NO: 3917956 - RNA, 20 nt, Shigella flexneri 2a str. 301
acccagggaaaggauugcga

SEQ ID NO: 3917957 - RNA, 15 nt, Shigella flexneri 2a str. 301
acccagguagacacc

SEQ ID NO: 3917958 - RNA, 22 nt, Shigella flexneri 2a str. 301
acccaguuucaugauauguuuu

SEQ ID NO: 3917959 - RNA, 19 nt, Shigella flexneri 2a str. 301
acccauauuuaaucaguuc

SEQ ID NO: 3917960 - RNA, 18 nt, Shigella flexneri 2a str. 301
acccaucaacaacuggcg

SEQ ID NO: 3917961 - RNA, 19 nt, Shigella flexneri 2a str. 301
acccaucaagcgaaaaugc

SEQ ID NO: 3917962 - RNA, 17 nt, Shigella flexneri 2a str. 301
acccaucgccagauaga

SEQ ID NO: 3917963 - RNA, 15 nt, Shigella flexneri 2a str. 301
acccaugaacaaaau

SEQ ID NO: 3917964 - RNA, 13 nt, Shigella flexneri 2a str. 301
acccaugaagaau

SEQ ID NO: 3917965 - RNA, 22 nt, Shigella flexneri 2a str. 301
acccauguuuaauucacgcagg

SEQ ID NO: 3917966 - RNA, 21 nt, Shigella flexneri 2a str. 301
acccauuuauccagcggcagc

SEQ ID NO: 3917967 - RNA, 21 nt, Shigella flexneri 2a str. 301
accccaaaaagauuaaaaaaa

SEQ ID NO: 3917968 - RNA, 20 nt, Shigella flexneri 2a str. 301
accccaauguagccgcacgc

SEQ ID NO: 3917969 - RNA, 23 nt, Shigella flexneri 2a str. 301
accccaauuaauugccagccguc

SEQ ID NO: 3917970 - RNA, 20 nt, Shigella flexneri 2a str. 301
accccacgauguauccggca

SEQ ID NO: 3917971 - RNA, 11 nt, Shigella flexneri 2a str. 301
accccagcaga

SEQ ID NO: 3917972 - RNA, 18 nt, Shigella flexneri 2a str. 301
accccagcagaauccggu

SEQ ID NO: 3917973 - RNA, 15 nt, Shigella flexneri 2a str. 301
accccagcucuucuc

SEQ ID NO: 3917974 - RNA, 22 nt, Shigella flexneri 2a str. 301
accccaggccgcguaccgcagc

SEQ ID NO: 3917975 - RNA, 16 nt, Shigella flexneri 2a str. 301
accccaggcugugcgc

SEQ ID NO: 3917976 - RNA, 23 nt, Shigella flexneri 2a str. 301
accccagguuuucaacgugucuu

SEQ ID NO: 3917977 - RNA, 22 nt, Shigella flexneri 2a str. 301
accccagugguuucgccagcac

SEQ ID NO: 3917978 - RNA, 19 nt, Shigella flexneri 2a str. 301
accccauggagaaaaugug

SEQ ID NO: 3917979 - RNA, 15 nt, Shigella flexneri 2a str. 301
acccccauccacgca

SEQ ID NO: 3917980 - RNA, 16 nt, Shigella flexneri 2a str. 301
acccccauccacgcau

SEQ ID NO: 3917981 - RNA, 15 nt, Shigella flexneri 2a str. 301
accccgcagcaaccg

SEQ ID NO: 3917982 - RNA, 16 nt, Shigella flexneri 2a str. 301
accccgccagcagaau

SEQ ID NO: 3917983 - RNA, 15 nt, Shigella flexneri 2a str. 301
accccggcccucucc

SEQ ID NO: 3917984 - RNA, 18 nt, Shigella flexneri 2a str. 301
accccgucaccacuucac

SEQ ID NO: 3917985 - RNA, 21 nt, Shigella flexneri 2a str. 301
accccucuauccagcucaucc

SEQ ID NO: 3917986 - RNA, 14 nt, Shigella flexneri 2a str. 301
accccugauaaccg

SEQ ID NO: 3917987 - RNA, 13 nt, Shigella flexneri 2a str. 301
accccugauuuug

SEQ ID NO: 3917988 - RNA, 12 nt, Shigella flexneri 2a str. 301
accccugcggcc

SEQ ID NO: 3917989 - RNA, 18 nt, Shigella flexneri 2a str. 301
accccuguggaacgugcu

SEQ ID NO: 3917990 - RNA, 15 nt, Shigella flexneri 2a str. 301
accccuuccugaaua

SEQ ID NO: 3917991 - RNA, 14 nt, Shigella flexneri 2a str. 301
acccgacaccgccu

SEQ ID NO: 3917992 - RNA, 14 nt, Shigella flexneri 2a str. 301
acccgaccacuucc

SEQ ID NO: 3917993 - RNA, 13 nt, Shigella flexneri 2a str. 301
acccgaucgcuca

SEQ ID NO: 3917994 - RNA, 14 nt, Shigella flexneri 2a str. 301
acccgaugcgcuuu

SEQ ID NO: 3917995 - RNA, 12 nt, Shigella flexneri 2a str. 301
acccgcaacagc

SEQ ID NO: 3917996 - RNA, 19 nt, Shigella flexneri 2a str. 301
acccgcaacauacugcccg

SEQ ID NO: 3917997 - RNA, 13 nt, Shigella flexneri 2a str. 301
acccgcaaucauc

SEQ ID NO: 3917998 - RNA, 14 nt, Shigella flexneri 2a str. 301
acccgcagccagca

SEQ ID NO: 3917999 - RNA, 15 nt, Shigella flexneri 2a str. 301
acccgcagccagcac

SEQ ID NO: 3918000 - RNA, 23 nt, Shigella flexneri 2a str. 301
acccgcagugauugccgcaacgg

SEQ ID NO: 3918001 - RNA, 18 nt, Shigella flexneri 2a str. 301
acccgccacgaaauugag

SEQ ID NO: 3918002 - RNA, 17 nt, Shigella flexneri 2a str. 301
acccgccaugugcuuuu

SEQ ID NO: 3918003 - RNA, 13 nt, Shigella flexneri 2a str. 301
acccgccugauag

SEQ ID NO: 3918004 - RNA, 14 nt, Shigella flexneri 2a str. 301
acccgcgacgcgcu

SEQ ID NO: 3918005 - RNA, 16 nt, Shigella flexneri 2a str. 301
acccgcgacgcgcuuu

SEQ ID NO: 3918006 - RNA, 20 nt, Shigella flexneri 2a str. 301
acccgcucauucguaaacga

SEQ ID NO: 3918007 - RNA, 19 nt, Shigella flexneri 2a str. 301
acccgcugcugacuuugac

SEQ ID NO: 3918008 - RNA, 12 nt, Shigella flexneri 2a str. 301
acccgcuucagu

SEQ ID NO: 3918009 - RNA, 14 nt, Shigella flexneri 2a str. 301
acccgcuuccagaa

SEQ ID NO: 3918010 - RNA, 16 nt, Shigella flexneri 2a str. 301
acccggaccgucuuuu

SEQ ID NO: 3918011 - RNA, 15 nt, Shigella flexneri 2a str. 301
acccggcaucaacca

SEQ ID NO: 3918012 - RNA, 13 nt, Shigella flexneri 2a str. 301
acccggccacagc

SEQ ID NO: 3918013 - RNA, 14 nt, Shigella flexneri 2a str. 301
acccggccacagcg

SEQ ID NO: 3918014 - RNA, 18 nt, Shigella flexneri 2a str. 301
acccggccacagcgccag

SEQ ID NO: 3918015 - RNA, 14 nt, Shigella flexneri 2a str. 301
acccggccugcucc

SEQ ID NO: 3918016 - RNA, 21 nt, Shigella flexneri 2a str. 301
acccggccuguuuauccauca

SEQ ID NO: 3918017 - RNA, 14 nt, Shigella flexneri 2a str. 301
acccggcggcgcgc

SEQ ID NO: 3918018 - RNA, 15 nt, Shigella flexneri 2a str. 301
acccgguaagcauuu

SEQ ID NO: 3918019 - RNA, 20 nt, Shigella flexneri 2a str. 301
acccgguacaucaauaccau

SEQ ID NO: 3918020 - RNA, 19 nt, Shigella flexneri 2a str. 301
acccggucccuucagccac

SEQ ID NO: 3918021 - RNA, 16 nt, Shigella flexneri 2a str. 301
acccguacuucugacc

SEQ ID NO: 3918022 - RNA, 12 nt, Shigella flexneri 2a str. 301
acccgucaccgu

SEQ ID NO: 3918023 - RNA, 19 nt, Shigella flexneri 2a str. 301
acccgucgggcagaaacgg

SEQ ID NO: 3918024 - RNA, 18 nt, Shigella flexneri 2a str. 301
acccguugguuugauagc

SEQ ID NO: 3918025 - RNA, 17 nt, Shigella flexneri 2a str. 301
acccuaacccucucccc

SEQ ID NO: 3918026 - RNA, 21 nt, Shigella flexneri 2a str. 301
acccucacgcauucucuuuuc

SEQ ID NO: 3918027 - RNA, 17 nt, Shigella flexneri 2a str. 301
acccucauucaccaguu

SEQ ID NO: 3918028 - RNA, 21 nt, Shigella flexneri 2a str. 301
acccucgaccaaaugaaacag

SEQ ID NO: 3918029 - RNA, 14 nt, Shigella flexneri 2a str. 301
acccucuccccaag

SEQ ID NO: 3918030 - RNA, 13 nt, Shigella flexneri 2a str. 301
acccucucccgaa

SEQ ID NO: 3918031 - RNA, 23 nt, Shigella flexneri 2a str. 301
acccucucccgaaugaccgcccc

SEQ ID NO: 3918032 - RNA, 18 nt, Shigella flexneri 2a str. 301
acccugaacgccgggcuu

SEQ ID NO: 3918033 - RNA, 15 nt, Shigella flexneri 2a str. 301
acccugaaucaauca

SEQ ID NO: 3918034 - RNA, 13 nt, Shigella flexneri 2a str. 301
acccugacccaga

SEQ ID NO: 3918035 - RNA, 16 nt, Shigella flexneri 2a str. 301
acccugacccagaccg

SEQ ID NO: 3918036 - RNA, 14 nt, Shigella flexneri 2a str. 301
acccugacgaccac

SEQ ID NO: 3918037 - RNA, 11 nt, Shigella flexneri 2a str. 301
acccugaguga

SEQ ID NO: 3918038 - RNA, 18 nt, Shigella flexneri 2a str. 301
acccugagugaauuguuu

SEQ ID NO: 3918039 - RNA, 15 nt, Shigella flexneri 2a str. 301
acccugaguuuucag

SEQ ID NO: 3918040 - RNA, 17 nt, Shigella flexneri 2a str. 301
acccugaguuuucagua

SEQ ID NO: 3918041 - RNA, 14 nt, Shigella flexneri 2a str. 301
acccugcggcugcu

SEQ ID NO: 3918042 - RNA, 23 nt, Shigella flexneri 2a str. 301
acccugcguugucgcagugaagu

SEQ ID NO: 3918043 - RNA, 17 nt, Shigella flexneri 2a str. 301
acccugcucuuucagca

SEQ ID NO: 3918044 - RNA, 15 nt, Shigella flexneri 2a str. 301
acccugguucgcaac

SEQ ID NO: 3918045 - RNA, 17 nt, Shigella flexneri 2a str. 301
acccugguucgcaacgg

SEQ ID NO: 3918046 - RNA, 21 nt, Shigella flexneri 2a str. 301
acccuguguggugagauugcu

SEQ ID NO: 3918047 - RNA, 13 nt, Shigella flexneri 2a str. 301
acccuuacucacu

SEQ ID NO: 3918048 - RNA, 21 nt, Shigella flexneri 2a str. 301
acccuuacucacuaaauuagg

SEQ ID NO: 3918049 - RNA, 17 nt, Shigella flexneri 2a str. 301
acccuucauauuccuga

SEQ ID NO: 3918050 - RNA, 21 nt, Shigella flexneri 2a str. 301
acccuuccuuagcaaaauagc

SEQ ID NO: 3918051 - RNA, 17 nt, Shigella flexneri 2a str. 301
acccuucgucaaucagc

SEQ ID NO: 3918052 - RNA, 18 nt, Shigella flexneri 2a str. 301
acccuucugcacgccagg

SEQ ID NO: 3918053 - RNA, 21 nt, Shigella flexneri 2a str. 301
acccuugaucaccguaaugau

SEQ ID NO: 3918054 - RNA, 13 nt, Shigella flexneri 2a str. 301
acccuugcagaua

SEQ ID NO: 3918055 - RNA, 18 nt, Shigella flexneri 2a str. 301
acccuugccggaugcggc

SEQ ID NO: 3918056 - RNA, 16 nt, Shigella flexneri 2a str. 301
acccuugcguuucuga

SEQ ID NO: 3918057 - RNA, 14 nt, Shigella flexneri 2a str. 301
acccuugugcucaa

SEQ ID NO: 3918058 - RNA, 23 nt, Shigella flexneri 2a str. 301
acccuuucguuaaauucuucuga

SEQ ID NO: 3918059 - RNA, 13 nt, Shigella flexneri 2a str. 301
accgaaaucgcca

SEQ ID NO: 3918060 - RNA, 15 nt, Shigella flexneri 2a str. 301
accgaacaaaacagc

SEQ ID NO: 3918061 - RNA, 12 nt, Shigella flexneri 2a str. 301
accgaacaacaa

SEQ ID NO: 3918062 - RNA, 16 nt, Shigella flexneri 2a str. 301
accgaacaacaagaag

SEQ ID NO: 3918063 - RNA, 13 nt, Shigella flexneri 2a str. 301
accgaacagauca

SEQ ID NO: 3918064 - RNA, 16 nt, Shigella flexneri 2a str. 301
accgaacagaucacgu

SEQ ID NO: 3918065 - RNA, 14 nt, Shigella flexneri 2a str. 301
accgaaccaaaaua

SEQ ID NO: 3918066 - RNA, 18 nt, Shigella flexneri 2a str. 301
accgaacggagucggguc

SEQ ID NO: 3918067 - RNA, 15 nt, Shigella flexneri 2a str. 301
accgacaaauuucau

SEQ ID NO: 3918068 - RNA, 15 nt, Shigella flexneri 2a str. 301
accgacaauccggua

SEQ ID NO: 3918069 - RNA, 18 nt, Shigella flexneri 2a str. 301
accgacauggugcgauua

SEQ ID NO: 3918070 - RNA, 14 nt, Shigella flexneri 2a str. 301
accgaccagaaugu

SEQ ID NO: 3918071 - RNA, 15 nt, Shigella flexneri 2a str. 301
accgaccaucggcac

SEQ ID NO: 3918072 - RNA, 17 nt, Shigella flexneri 2a str. 301
accgacguagccccaau

SEQ ID NO: 3918073 - RNA, 12 nt, Shigella flexneri 2a str. 301
accgagaaaauc

SEQ ID NO: 3918074 - RNA, 15 nt, Shigella flexneri 2a str. 301
accgagaaaaucauc

SEQ ID NO: 3918075 - RNA, 22 nt, Shigella flexneri 2a str. 301
accgagauaaugguuuccagca

SEQ ID NO: 3918076 - RNA, 19 nt, Shigella flexneri 2a str. 301
accgagcagccacugcggc

SEQ ID NO: 3918077 - RNA, 17 nt, Shigella flexneri 2a str. 301
accgaggcauucagcca

SEQ ID NO: 3918078 - RNA, 14 nt, Shigella flexneri 2a str. 301
accgauaaaagccc

SEQ ID NO: 3918079 - RNA, 17 nt, Shigella flexneri 2a str. 301
accgauaaaagcccugg

SEQ ID NO: 3918080 - RNA, 21 nt, Shigella flexneri 2a str. 301
accgauauucgccgcgacaca

SEQ ID NO: 3918081 - RNA, 12 nt, Shigella flexneri 2a str. 301
accgaucaccac

SEQ ID NO: 3918082 - RNA, 17 nt, Shigella flexneri 2a str. 301
accgauccaguggcugu

SEQ ID NO: 3918083 - RNA, 12 nt, Shigella flexneri 2a str. 301
accgauccggca

SEQ ID NO: 3918084 - RNA, 12 nt, Shigella flexneri 2a str. 301
accgaucgccag

SEQ ID NO: 3918085 - RNA, 15 nt, Shigella flexneri 2a str. 301
accgaucgccagcag

SEQ ID NO: 3918086 - RNA, 16 nt, Shigella flexneri 2a str. 301
accgaucgccagcagg

SEQ ID NO: 3918087 - RNA, 17 nt, Shigella flexneri 2a str. 301
accgaucgccagcaggg

SEQ ID NO: 3918088 - RNA, 21 nt, Shigella flexneri 2a str. 301
accgauggcaaacaaacugcg

SEQ ID NO: 3918089 - RNA, 20 nt, Shigella flexneri 2a str. 301
accgauuguaaucacauucg

SEQ ID NO: 3918090 - RNA, 20 nt, Shigella flexneri 2a str. 301
accgauuuucagccaucauc

SEQ ID NO: 3918091 - RNA, 18 nt, Shigella flexneri 2a str. 301
accgcaaaaccaacgccu

SEQ ID NO: 3918092 - RNA, 19 nt, Shigella flexneri 2a str. 301
accgcaagaauucaauaua

SEQ ID NO: 3918093 - RNA, 22 nt, Shigella flexneri 2a str. 301
accgcaaucgaucuguuuauca

SEQ ID NO: 3918094 - RNA, 13 nt, Shigella flexneri 2a str. 301
accgcaccaccag

SEQ ID NO: 3918095 - RNA, 14 nt, Shigella flexneri 2a str. 301
accgcaccaccagc

SEQ ID NO: 3918096 - RNA, 15 nt, Shigella flexneri 2a str. 301
accgcacgcagaauc

SEQ ID NO: 3918097 - RNA, 15 nt, Shigella flexneri 2a str. 301
accgcacgcaggcca

SEQ ID NO: 3918098 - RNA, 13 nt, Shigella flexneri 2a str. 301
accgcaggcuuuu

SEQ ID NO: 3918099 - RNA, 18 nt, Shigella flexneri 2a str. 301
accgcaguaaucggcgaa

SEQ ID NO: 3918100 - RNA, 19 nt, Shigella flexneri 2a str. 301
accgcauacgcagcaucau

SEQ ID NO: 3918101 - RNA, 21 nt, Shigella flexneri 2a str. 301
accgcaucacgacagcaccac

SEQ ID NO: 3918102 - RNA, 13 nt, Shigella flexneri 2a str. 301
accgcaucggcau

SEQ ID NO: 3918103 - RNA, 21 nt, Shigella flexneri 2a str. 301
accuguaacguugcugcgccg

SEQ ID NO: 3918104 - RNA, 15 nt, Shigella flexneri 2a str. 301
accuguaccagcccg

SEQ ID NO: 3918105 - RNA, 12 nt, Shigella flexneri 2a str. 301
accuguccagac

SEQ ID NO: 3918106 - RNA, 14 nt, Shigella flexneri 2a str. 301
accugucgcgucga

SEQ ID NO: 3918107 - RNA, 16 nt, Shigella flexneri 2a str. 301
accugugacagcagcg

SEQ ID NO: 3918108 - RNA, 17 nt, Shigella flexneri 2a str. 301
accugugacagcagcgg

SEQ ID NO: 3918109 - RNA, 16 nt, Shigella flexneri 2a str. 301
accuguggugcaggcg

SEQ ID NO: 3918110 - RNA, 14 nt, Shigella flexneri 2a str. 301
accuguugaaauua

SEQ ID NO: 3918111 - RNA, 12 nt, Shigella flexneri 2a str. 301
accuuaaaacaa

SEQ ID NO: 3918112 - RNA, 13 nt, Shigella flexneri 2a str. 301
accuuaaaacaau

SEQ ID NO: 3918113 - RNA, 16 nt, Shigella flexneri 2a str. 301
accuuacacucaaaua

SEQ ID NO: 3918114 - RNA, 19 nt, Shigella flexneri 2a str. 301
accuuacacucaaauaucu

SEQ ID NO: 3918115 - RNA, 12 nt, Shigella flexneri 2a str. 301
accuuacggcac

SEQ ID NO: 3918116 - RNA, 20 nt, Shigella flexneri 2a str. 301
accuuacggcacuccucuuc

SEQ ID NO: 3918117 - RNA, 21 nt, Shigella flexneri 2a str. 301
accuuacggcacuccucuuca

SEQ ID NO: 3918118 - RNA, 14 nt, Shigella flexneri 2a str. 301
accuuauaacgcuu

SEQ ID NO: 3918119 - RNA, 21 nt, Shigella flexneri 2a str. 301
accuuaucaaucucagcaaga

SEQ ID NO: 3918120 - RNA, 15 nt, Shigella flexneri 2a str. 301
accuuaucgacaugc

SEQ ID NO: 3918121 - RNA, 23 nt, Shigella flexneri 2a str. 301
accuucaacacuggcaaaaucaa

SEQ ID NO: 3918122 - RNA, 20 nt, Shigella flexneri 2a str. 301
accuucacgcgcuccaggag

SEQ ID NO: 3918123 - RNA, 23 nt, Shigella flexneri 2a str. 301
accuucccgucuacaaaaacugc

SEQ ID NO: 3918124 - RNA, 14 nt, Shigella flexneri 2a str. 301
accuucccuauuuc

SEQ ID NO: 3918125 - RNA, 22 nt, Shigella flexneri 2a str. 301
accuuccggcguaccuuugccu

SEQ ID NO: 3918126 - RNA, 14 nt, Shigella flexneri 2a str. 301
accuuccucaauua

SEQ ID NO: 3918127 - RNA, 14 nt, Shigella flexneri 2a str. 301
accuuccuuauuuc

SEQ ID NO: 3918128 - RNA, 15 nt, Shigella flexneri 2a str. 301
accuucgaagaucag

SEQ ID NO: 3918129 - RNA, 19 nt, Shigella flexneri 2a str. 301
accuucgaaugccgcagca

SEQ ID NO: 3918130 - RNA, 19 nt, Shigella flexneri 2a str. 301
accuucugcgcccgcccgc

SEQ ID NO: 3918131 - RNA, 16 nt, Shigella flexneri 2a str. 301
accuucuucagcaaua

SEQ ID NO: 3918132 - RNA, 13 nt, Shigella flexneri 2a str. 301
accuucuuccugc

SEQ ID NO: 3918133 - RNA, 14 nt, Shigella flexneri 2a str. 301
accuucuucuuuca

SEQ ID NO: 3918134 - RNA, 19 nt, Shigella flexneri 2a str. 301
accuugcacucgcagaagc

SEQ ID NO: 3918135 - RNA, 21 nt, Shigella flexneri 2a str. 301
accuugcacucgcagaagcag

SEQ ID NO: 3918136 - RNA, 15 nt, Shigella flexneri 2a str. 301
accuugcauagcuuc

SEQ ID NO: 3918137 - RNA, 17 nt, Shigella flexneri 2a str. 301
accuugcauagcuucga

SEQ ID NO: 3918138 - RNA, 22 nt, Shigella flexneri 2a str. 301
accuugccagugaaaguuuuca

SEQ ID NO: 3918139 - RNA, 14 nt, Shigella flexneri 2a str. 301
accuuguuucugag

SEQ ID NO: 3918140 - RNA, 16 nt, Shigella flexneri 2a str. 301
accuuguuucugagca

SEQ ID NO: 3918141 - RNA, 22 nt, Shigella flexneri 2a str. 301
accuuuccuuguaacgcaucaa

SEQ ID NO: 3918142 - RNA, 14 nt, Shigella flexneri 2a str. 301
accuuugaacugcu

SEQ ID NO: 3918143 - RNA, 22 nt, Shigella flexneri 2a str. 301
accuuugccuuccagcgaugcc

SEQ ID NO: 3918144 - RNA, 18 nt, Shigella flexneri 2a str. 301
accuuuguaugccuggca

SEQ ID NO: 3918145 - RNA, 16 nt, Shigella flexneri 2a str. 301
accuuuuuccagauug

SEQ ID NO: 3918146 - RNA, 20 nt, Shigella flexneri 2a str. 301
accuuuuuccagauugcuua

SEQ ID NO: 3918147 - RNA, 18 nt, Shigella flexneri 2a str. 301
acgaaaaaaauuacucau

SEQ ID NO: 3918148 - RNA, 14 nt, Shigella flexneri 2a str. 301
acgaaaaaucaaua

SEQ ID NO: 3918149 - RNA, 16 nt, Shigella flexneri 2a str. 301
acgaaaccgacugcca

SEQ ID NO: 3918150 - RNA, 21 nt, Shigella flexneri 2a str. 301
acgaaacgccggugaccauca

SEQ ID NO: 3918151 - RNA, 17 nt, Shigella flexneri 2a str. 301
acgaacagcgauugcuu

SEQ ID NO: 3918152 - RNA, 12 nt, Shigella flexneri 2a str. 301
acgaaccagaga

SEQ ID NO: 3918153 - RNA, 18 nt, Shigella flexneri 2a str. 301
acgaaccauaaaaucaca

SEQ ID NO: 3918154 - RNA, 13 nt, Shigella flexneri 2a str. 301
acgaagauuuuac

SEQ ID NO: 3918155 - RNA, 14 nt, Shigella flexneri 2a str. 301
acgaagcgccuucg

SEQ ID NO: 3918156 - RNA, 13 nt, Shigella flexneri 2a str. 301
acgaagcggcugc

SEQ ID NO: 3918157 - RNA, 23 nt, Shigella flexneri 2a str. 301
acgaaggucgaggcaauccguaa

SEQ ID NO: 3918158 - RNA, 14 nt, Shigella flexneri 2a str. 301
acgaauaaaacaga

SEQ ID NO: 3918159 - RNA, 20 nt, Shigella flexneri 2a str. 301
acgaauaaaacagaaaccga

SEQ ID NO: 3918160 - RNA, 17 nt, Shigella flexneri 2a str. 301
acgaaugacugauugcc

SEQ ID NO: 3918161 - RNA, 13 nt, Shigella flexneri 2a str. 301
acgaauuaucacu

SEQ ID NO: 3918162 - RNA, 22 nt, Shigella flexneri 2a str. 301
acgaauugauuuucgaaaaaaa

SEQ ID NO: 3918163 - RNA, 22 nt, Shigella flexneri 2a str. 301
acgaauugcugcgcccgcagcg

SEQ ID NO: 3918164 - RNA, 21 nt, Shigella flexneri 2a str. 301
acgacaaaaauaccaccaaug

SEQ ID NO: 3918165 - RNA, 21 nt, Shigella flexneri 2a str. 301
acgacaaggcaggcaucaaug

SEQ ID NO: 3918166 - RNA, 22 nt, Shigella flexneri 2a str. 301
acgacaaggcaggcaucaauga

SEQ ID NO: 3918167 - RNA, 11 nt, Shigella flexneri 2a str. 301
acgacaaucuc

SEQ ID NO: 3918168 - RNA, 14 nt, Shigella flexneri 2a str. 301
acgacaccacggua

SEQ ID NO: 3918169 - RNA, 12 nt, Shigella flexneri 2a str. 301
acgacaccaucu

SEQ ID NO: 3918170 - RNA, 18 nt, Shigella flexneri 2a str. 301
acgacacucucuucaaca

SEQ ID NO: 3918171 - RNA, 17 nt, Shigella flexneri 2a str. 301
acgacacugcucgcaga

SEQ ID NO: 3918172 - RNA, 12 nt, Shigella flexneri 2a str. 301
acgacaggcaag

SEQ ID NO: 3918173 - RNA, 16 nt, Shigella flexneri 2a str. 301
acgacauggcccagcc

SEQ ID NO: 3918174 - RNA, 14 nt, Shigella flexneri 2a str. 301
acgacaugugccag

SEQ ID NO: 3918175 - RNA, 18 nt, Shigella flexneri 2a str. 301
acgaccaaugacagccag

SEQ ID NO: 3918176 - RNA, 14 nt, Shigella flexneri 2a str. 301
acgaccaccuucaa

SEQ ID NO: 3918177 - RNA, 23 nt, Shigella flexneri 2a str. 301
acgaccacucuuucgacggcauc

SEQ ID NO: 3918178 - RNA, 22 nt, Shigella flexneri 2a str. 301
acgaccagaucggucagugcca

SEQ ID NO: 3918179 - RNA, 19 nt, Shigella flexneri 2a str. 301
acgaccgauugauucccaa

SEQ ID NO: 3918180 - RNA, 18 nt, Shigella flexneri 2a str. 301
acgaccgcaugcgguuua

SEQ ID NO: 3918181 - RNA, 21 nt, Shigella flexneri 2a str. 301
acgaccgcuuuugucggcacu

SEQ ID NO: 3918182 - RNA, 18 nt, Shigella flexneri 2a str. 301
acgaccuccaucgcacca

SEQ ID NO: 3918183 - RNA, 14 nt, Shigella flexneri 2a str. 301
acgacgaagaaacc

SEQ ID NO: 3918184 - RNA, 14 nt, Shigella flexneri 2a str. 301
acgacgacaggcaa

SEQ ID NO: 3918185 - RNA, 15 nt, Shigella flexneri 2a str. 301
acgacgcagaacuga

SEQ ID NO: 3918186 - RNA, 19 nt, Shigella flexneri 2a str. 301
acgacgggauucgaaccug

SEQ ID NO: 3918187 - RNA, 17 nt, Shigella flexneri 2a str. 301
acgacgguaaaccacgc

SEQ ID NO: 3918188 - RNA, 16 nt, Shigella flexneri 2a str. 301
acgacgguuuccaccg

SEQ ID NO: 3918189 - RNA, 17 nt, Shigella flexneri 2a str. 301
acgacguaacggaucaa

SEQ ID NO: 3918190 - RNA, 17 nt, Shigella flexneri 2a str. 301
acgacugccgcucaccu

SEQ ID NO: 3918191 - RNA, 18 nt, Shigella flexneri 2a str. 301
acgacugccgcucaccug

SEQ ID NO: 3918192 - RNA, 14 nt, Shigella flexneri 2a str. 301
acgacuuuuuccau

SEQ ID NO: 3918193 - RNA, 13 nt, Shigella flexneri 2a str. 301
acgagaaaagcca

SEQ ID NO: 3918194 - RNA, 19 nt, Shigella flexneri 2a str. 301
acgagaauuucucgugcca

SEQ ID NO: 3918195 - RNA, 19 nt, Shigella flexneri 2a str. 301
acgagacgguuaaaaacag

SEQ ID NO: 3918196 - RNA, 23 nt, Shigella flexneri 2a str. 301
acgagacgguuaaaaacagccag

SEQ ID NO: 3918197 - RNA, 12 nt, Shigella flexneri 2a str. 301
acgagaucguca

SEQ ID NO: 3918198 - RNA, 18 nt, Shigella flexneri 2a str. 301
acgagcccuucggggcua

SEQ ID NO: 3918199 - RNA, 19 nt, Shigella flexneri 2a str. 301
acgagguccuuuugccgcc

SEQ ID NO: 3918200 - RNA, 13 nt, Shigella flexneri 2a str. 301
acgagucgucgau

SEQ ID NO: 3918201 - RNA, 13 nt, Shigella flexneri 2a str. 301
acgauaagcaccg

SEQ ID NO: 3918202 - RNA, 15 nt, Shigella flexneri 2a str. 301
acgauacagaagcac

SEQ ID NO: 3918203 - RNA, 16 nt, Shigella flexneri 2a str. 301
acgccagaugcggcgu

SEQ ID NO: 3918204 - RNA, 12 nt, Shigella flexneri 2a str. 301
acgccagcagca

SEQ ID NO: 3918205 - RNA, 13 nt, Shigella flexneri 2a str. 301
acgccagguuguu

SEQ ID NO: 3918206 - RNA, 12 nt, Shigella flexneri 2a str. 301
acgccagucacg

SEQ ID NO: 3918207 - RNA, 19 nt, Shigella flexneri 2a str. 301
acgccagugcgccccaggu

SEQ ID NO: 3918208 - RNA, 23 nt, Shigella flexneri 2a str. 301
acgccauacggcuaugaaagaaa

SEQ ID NO: 3918209 - RNA, 19 nt, Shigella flexneri 2a str. 301
acgcccaacuaaaugcugc

SEQ ID NO: 3918210 - RNA, 16 nt, Shigella flexneri 2a str. 301
acgcccaaugcccaga

SEQ ID NO: 3918211 - RNA, 14 nt, Shigella flexneri 2a str. 301
acgcccacggcgug

SEQ ID NO: 3918212 - RNA, 16 nt, Shigella flexneri 2a str. 301
acgcccagcgcuuacc

SEQ ID NO: 3918213 - RNA, 17 nt, Shigella flexneri 2a str. 301
acgcccagcgcuuaccc

SEQ ID NO: 3918214 - RNA, 14 nt, Shigella flexneri 2a str. 301
acgccccaacacaa

SEQ ID NO: 3918215 - RNA, 13 nt, Shigella flexneri 2a str. 301
acgccccacaaac

SEQ ID NO: 3918216 - RNA, 19 nt, Shigella flexneri 2a str. 301
acgccccacagacccaggu

SEQ ID NO: 3918217 - RNA, 15 nt, Shigella flexneri 2a str. 301
acgccccagauugcc

SEQ ID NO: 3918218 - RNA, 13 nt, Shigella flexneri 2a str. 301
acgccccggccuu

SEQ ID NO: 3918219 - RNA, 19 nt, Shigella flexneri 2a str. 301
acgcccgcauaugcgggcg

SEQ ID NO: 3918220 - RNA, 14 nt, Shigella flexneri 2a str. 301
acgcccgccgacca

SEQ ID NO: 3918221 - RNA, 18 nt, Shigella flexneri 2a str. 301
acgcccuacaaggaacgg

SEQ ID NO: 3918222 - RNA, 15 nt, Shigella flexneri 2a str. 301
acgccgaaaccgcgc

SEQ ID NO: 3918223 - RNA, 20 nt, Shigella flexneri 2a str. 301
acgccgaaaccgcgcagcgg

SEQ ID NO: 3918224 - RNA, 19 nt, Shigella flexneri 2a str. 301
acgccgaauaacgcgcagc

SEQ ID NO: 3918225 - RNA, 13 nt, Shigella flexneri 2a str. 301
acgccgaaucagu

SEQ ID NO: 3918226 - RNA, 18 nt, Shigella flexneri 2a str. 301
acgccgacgcccugcgcu

SEQ ID NO: 3918227 - RNA, 19 nt, Shigella flexneri 2a str. 301
acgccgacgggucagcggg

SEQ ID NO: 3918228 - RNA, 19 nt, Shigella flexneri 2a str. 301
acgccgagaauaaaacagg

SEQ ID NO: 3918229 - RNA, 23 nt, Shigella flexneri 2a str. 301
acgccgagaauaaaacaggcagc

SEQ ID NO: 3918230 - RNA, 22 nt, Shigella flexneri 2a str. 301
acgccgagacguuuugccaguu

SEQ ID NO: 3918231 - RNA, 20 nt, Shigella flexneri 2a str. 301
acgccgaggugcucuccacg

SEQ ID NO: 3918232 - RNA, 19 nt, Shigella flexneri 2a str. 301
acgccgauaaucaacgcgc

SEQ ID NO: 3918233 - RNA, 22 nt, Shigella flexneri 2a str. 301
acgccgcaauggcuucauccac

SEQ ID NO: 3918234 - RNA, 17 nt, Shigella flexneri 2a str. 301
acgccgcauccggcaau

SEQ ID NO: 3918235 - RNA, 16 nt, Shigella flexneri 2a str. 301
acgccgcauccggcau

SEQ ID NO: 3918236 - RNA, 17 nt, Shigella flexneri 2a str. 301
acgccgcauccggcauu

SEQ ID NO: 3918237 - RNA, 11 nt, Shigella flexneri 2a str. 301
acgccgccaga

SEQ ID NO: 3918238 - RNA, 14 nt, Shigella flexneri 2a str. 301
acgccgccagacca

SEQ ID NO: 3918239 - RNA, 12 nt, Shigella flexneri 2a str. 301
acgccgccaguu

SEQ ID NO: 3918240 - RNA, 20 nt, Shigella flexneri 2a str. 301
acgccgccguuagcuucagc

SEQ ID NO: 3918241 - RNA, 20 nt, Shigella flexneri 2a str. 301
acgccgcugucuaccagcac

SEQ ID NO: 3918242 - RNA, 21 nt, Shigella flexneri 2a str. 301
acgccgcugucuaccagcacc

SEQ ID NO: 3918243 - RNA, 22 nt, Shigella flexneri 2a str. 301
acgccgcugucuaccagcaccu

SEQ ID NO: 3918244 - RNA, 19 nt, Shigella flexneri 2a str. 301
acgccgcuuuuuuuacguc

SEQ ID NO: 3918245 - RNA, 22 nt, Shigella flexneri 2a str. 301
acgccgcuuuuuuuacgucugc

SEQ ID NO: 3918246 - RNA, 21 nt, Shigella flexneri 2a str. 301
acgccggaugaaaucaccgcu

SEQ ID NO: 3918247 - RNA, 15 nt, Shigella flexneri 2a str. 301
acgccggauuaugug

SEQ ID NO: 3918248 - RNA, 24 nt, Shigella flexneri 2a str. 301
acgccgggaaauuuuuccguuuuc

SEQ ID NO: 3918249 - RNA, 15 nt, Shigella flexneri 2a str. 301
acgccggugaccauc

SEQ ID NO: 3918250 - RNA, 15 nt, Shigella flexneri 2a str. 301
acgccguaaguaagg

SEQ ID NO: 3918251 - RNA, 17 nt, Shigella flexneri 2a str. 301
acgccgucaucacaccg

SEQ ID NO: 3918252 - RNA, 23 nt, Shigella flexneri 2a str. 301
acgccguggaauaauuccgggcg

SEQ ID NO: 3918253 - RNA, 22 nt, Shigella flexneri 2a str. 301
acgccgugggcaugaaacgcgu

SEQ ID NO: 3918254 - RNA, 20 nt, Shigella flexneri 2a str. 301
acgccguuauuaaaaagccu

SEQ ID NO: 3918255 - RNA, 23 nt, Shigella flexneri 2a str. 301
acgccguuggcguaaaucaaacc

SEQ ID NO: 3918256 - RNA, 23 nt, Shigella flexneri 2a str. 301
acgccguuuuuacccagcagcag

SEQ ID NO: 3918257 - RNA, 15 nt, Shigella flexneri 2a str. 301
acgccuaauccagcc

SEQ ID NO: 3918258 - RNA, 16 nt, Shigella flexneri 2a str. 301
acgccuaauccagccu

SEQ ID NO: 3918259 - RNA, 20 nt, Shigella flexneri 2a str. 301
acgccuaauccagccuacaa

SEQ ID NO: 3918260 - RNA, 14 nt, Shigella flexneri 2a str. 301
acgccuaucaccag

SEQ ID NO: 3918261 - RNA, 15 nt, Shigella flexneri 2a str. 301
acgccucguaaugcu

SEQ ID NO: 3918262 - RNA, 12 nt, Shigella flexneri 2a str. 301
acgccugcggcu

SEQ ID NO: 3918263 - RNA, 21 nt, Shigella flexneri 2a str. 301
acgccugcgggcauuucgcuu

SEQ ID NO: 3918264 - RNA, 17 nt, Shigella flexneri 2a str. 301
acgccugcucuuauuac

SEQ ID NO: 3918265 - RNA, 15 nt, Shigella flexneri 2a str. 301
acgccuggaaagugu

SEQ ID NO: 3918266 - RNA, 22 nt, Shigella flexneri 2a str. 301
acgccuggcucaagcaccaucc

SEQ ID NO: 3918267 - RNA, 15 nt, Shigella flexneri 2a str. 301
acgccuuauccgacu

SEQ ID NO: 3918268 - RNA, 19 nt, Shigella flexneri 2a str. 301
acgccuuauccggccuaca

SEQ ID NO: 3918269 - RNA, 20 nt, Shigella flexneri 2a str. 301
acgccuuauccggccuacca

SEQ ID NO: 3918270 - RNA, 17 nt, Shigella flexneri 2a str. 301
acgccuuccgucagcaa

SEQ ID NO: 3918271 - RNA, 18 nt, Shigella flexneri 2a str. 301
acgccuucuuccagcgca

SEQ ID NO: 3918272 - RNA, 19 nt, Shigella flexneri 2a str. 301
acgccuugcggaaauucca

SEQ ID NO: 3918273 - RNA, 23 nt, Shigella flexneri 2a str. 301
acgccuuguuccugcuuggcgcg

SEQ ID NO: 3918274 - RNA, 22 nt, Shigella flexneri 2a str. 301
acgccuuugucgggcaggcuuc

SEQ ID NO: 3918275 - RNA, 13 nt, Shigella flexneri 2a str. 301
acgcgaacaacag

SEQ ID NO: 3918276 - RNA, 21 nt, Shigella flexneri 2a str. 301
acgcgaauaguuuccgcuucu

SEQ ID NO: 3918277 - RNA, 17 nt, Shigella flexneri 2a str. 301
acgcgaccaaaggcgag

SEQ ID NO: 3918278 - RNA, 21 nt, Shigella flexneri 2a str. 301
acgcgaccagcgucgcaucag

SEQ ID NO: 3918279 - RNA, 20 nt, Shigella flexneri 2a str. 301
acgcgaccaucgcggaucag

SEQ ID NO: 3918280 - RNA, 13 nt, Shigella flexneri 2a str. 301
acgcgaccgccgc

SEQ ID NO: 3918281 - RNA, 14 nt, Shigella flexneri 2a str. 301
acgcgaggcgcuaa

SEQ ID NO: 3918282 - RNA, 19 nt, Shigella flexneri 2a str. 301
acgcgauucccagucgcgc

SEQ ID NO: 3918283 - RNA, 17 nt, Shigella flexneri 2a str. 301
acgcgauuucucaucaa

SEQ ID NO: 3918284 - RNA, 19 nt, Shigella flexneri 2a str. 301
acgcgauuucucaucaaau

SEQ ID NO: 3918285 - RNA, 15 nt, Shigella flexneri 2a str. 301
acgcgcaauacaggu

SEQ ID NO: 3918286 - RNA, 16 nt, Shigella flexneri 2a str. 301
acgcgcacaggcgcug

SEQ ID NO: 3918287 - RNA, 18 nt, Shigella flexneri 2a str. 301
acgcgcagcguucauaaa

SEQ ID NO: 3918288 - RNA, 14 nt, Shigella flexneri 2a str. 301
acgcgcauggccgu

SEQ ID NO: 3918289 - RNA, 15 nt, Shigella flexneri 2a str. 301
acgcgccaccgacca

SEQ ID NO: 3918290 - RNA, 17 nt, Shigella flexneri 2a str. 301
acgcgccacgcacgccu

SEQ ID NO: 3918291 - RNA, 16 nt, Shigella flexneri 2a str. 301
acgcgccagcaccgca

SEQ ID NO: 3918292 - RNA, 22 nt, Shigella flexneri 2a str. 301
acgcgccaggaucagaaugcgc

SEQ ID NO: 3918293 - RNA, 22 nt, Shigella flexneri 2a str. 301
acgcgcccguagucggugccau

SEQ ID NO: 3918294 - RNA, 16 nt, Shigella flexneri 2a str. 301
acgcgcuaaucagcuu

SEQ ID NO: 3918295 - RNA, 20 nt, Shigella flexneri 2a str. 301
acgcgcuagccucagguguu

SEQ ID NO: 3918296 - RNA, 13 nt, Shigella flexneri 2a str. 301
acgcgcuagcguc

SEQ ID NO: 3918297 - RNA, 18 nt, Shigella flexneri 2a str. 301
acgcgcuagcuucaggug

SEQ ID NO: 3918298 - RNA, 20 nt, Shigella flexneri 2a str. 301
acgcgcuagcuucagguguu

SEQ ID NO: 3918299 - RNA, 15 nt, Shigella flexneri 2a str. 301
acgcgcuccaggagu

SEQ ID NO: 3918300 - RNA, 16 nt, Shigella flexneri 2a str. 301
acgcggcaacggcuuc

SEQ ID NO: 3918301 - RNA, 18 nt, Shigella flexneri 2a str. 301
acgcggcaacggcuucgc

SEQ ID NO: 3918302 - RNA, 21 nt, Shigella flexneri 2a str. 301
acgcggcaagcgucgcaucag

SEQ ID NO: 3918303 - RNA, 14 nt, Shigella flexneri 2a str. 301
acggaauaaaccca

SEQ ID NO: 3918304 - RNA, 15 nt, Shigella flexneri 2a str. 301
acggacacuccuucc

SEQ ID NO: 3918305 - RNA, 13 nt, Shigella flexneri 2a str. 301
acggacgaccgau

SEQ ID NO: 3918306 - RNA, 23 nt, Shigella flexneri 2a str. 301
acggacguccggugauaucggcc

SEQ ID NO: 3918307 - RNA, 14 nt, Shigella flexneri 2a str. 301
acggacuuccagcg

SEQ ID NO: 3918308 - RNA, 23 nt, Shigella flexneri 2a str. 301
acggagaucgagcgcgagcaggc

SEQ ID NO: 3918309 - RNA, 15 nt, Shigella flexneri 2a str. 301
acggagcaaaaaacc

SEQ ID NO: 3918310 - RNA, 22 nt, Shigella flexneri 2a str. 301
acggagcaggcguuaaaacagg

SEQ ID NO: 3918311 - RNA, 18 nt, Shigella flexneri 2a str. 301
acggagcugccaggccgc

SEQ ID NO: 3918312 - RNA, 20 nt, Shigella flexneri 2a str. 301
acggagcugccaggccgcau

SEQ ID NO: 3918313 - RNA, 15 nt, Shigella flexneri 2a str. 301
acggauagcagaaaa

SEQ ID NO: 3918314 - RNA, 15 nt, Shigella flexneri 2a str. 301
acggauaugauuuaa

SEQ ID NO: 3918315 - RNA, 16 nt, Shigella flexneri 2a str. 301
acggaugacacgcagg

SEQ ID NO: 3918316 - RNA, 22 nt, Shigella flexneri 2a str. 301
acggauugcuuguucgaugccu

SEQ ID NO: 3918317 - RNA, 17 nt, Shigella flexneri 2a str. 301
acggcaaaagaauauca

SEQ ID NO: 3918318 - RNA, 18 nt, Shigella flexneri 2a str. 301
acggcaacacgccuggcu

SEQ ID NO: 3918319 - RNA, 17 nt, Shigella flexneri 2a str. 301
acggcaauucccagaau

SEQ ID NO: 3918320 - RNA, 21 nt, Shigella flexneri 2a str. 301
acggcaccacauucugcaucg

SEQ ID NO: 3918321 - RNA, 17 nt, Shigella flexneri 2a str. 301
acggcacggaaagcagc

SEQ ID NO: 3918322 - RNA, 18 nt, Shigella flexneri 2a str. 301
acggcacggaaagcagca

SEQ ID NO: 3918323 - RNA, 18 nt, Shigella flexneri 2a str. 301
acggcacuccucuucacg

SEQ ID NO: 3918324 - RNA, 21 nt, Shigella flexneri 2a str. 301
acggcagagaaaccacaucaa

SEQ ID NO: 3918325 - RNA, 13 nt, Shigella flexneri 2a str. 301
acggcaucgccau

SEQ ID NO: 3918326 - RNA, 15 nt, Shigella flexneri 2a str. 301
acggcauucugcaca

SEQ ID NO: 3918327 - RNA, 17 nt, Shigella flexneri 2a str. 301
acggcauuuaguggauc

SEQ ID NO: 3918328 - RNA, 16 nt, Shigella flexneri 2a str. 301
acggcauuuccgccaa

SEQ ID NO: 3918329 - RNA, 15 nt, Shigella flexneri 2a str. 301
acggccaaaaucucu

SEQ ID NO: 3918330 - RNA, 16 nt, Shigella flexneri 2a str. 301
acggccacagccagcc

SEQ ID NO: 3918331 - RNA, 13 nt, Shigella flexneri 2a str. 301
acggcccagaccc

SEQ ID NO: 3918332 - RNA, 22 nt, Shigella flexneri 2a str. 301
acggccgcacuuacagcaacgc

SEQ ID NO: 3918333 - RNA, 19 nt, Shigella flexneri 2a str. 301
acggccuucggugcgacaa

SEQ ID NO: 3918334 - RNA, 18 nt, Shigella flexneri 2a str. 301
acggcgaaucaaccgcgc

SEQ ID NO: 3918335 - RNA, 14 nt, Shigella flexneri 2a str. 301
acggcgagccagcg

SEQ ID NO: 3918336 - RNA, 17 nt, Shigella flexneri 2a str. 301
acggcgagccagcgcau

SEQ ID NO: 3918337 - RNA, 15 nt, Shigella flexneri 2a str. 301
acggcgcaccagaau

SEQ ID NO: 3918338 - RNA, 14 nt, Shigella flexneri 2a str. 301
acggcgcagcuuca

SEQ ID NO: 3918339 - RNA, 23 nt, Shigella flexneri 2a str. 301
acggcgcagcuucacaaaggcuu

SEQ ID NO: 3918340 - RNA, 15 nt, Shigella flexneri 2a str. 301
acggcgcaugccuca

SEQ ID NO: 3918341 - RNA, 15 nt, Shigella flexneri 2a str. 301
acggcgcauugccag

SEQ ID NO: 3918342 - RNA, 14 nt, Shigella flexneri 2a str. 301
acggcgcauuugcg

SEQ ID NO: 3918343 - RNA, 16 nt, Shigella flexneri 2a str. 301
acggcgcgguuuccac

SEQ ID NO: 3918344 - RNA, 19 nt, Shigella flexneri 2a str. 301
acggcgcuaaaaagcgccg

SEQ ID NO: 3918345 - RNA, 23 nt, Shigella flexneri 2a str. 301
acggcgcuuuuuuugugccugaa

SEQ ID NO: 3918346 - RNA, 16 nt, Shigella flexneri 2a str. 301
acggcggaaagggccg

SEQ ID NO: 3918347 - RNA, 16 nt, Shigella flexneri 2a str. 301
acggcggcaacauggc

SEQ ID NO: 3918348 - RNA, 14 nt, Shigella flexneri 2a str. 301
acggcguauugcau

SEQ ID NO: 3918349 - RNA, 22 nt, Shigella flexneri 2a str. 301
acggcgucgauugcucaacgcc

SEQ ID NO: 3918350 - RNA, 22 nt, Shigella flexneri 2a str. 301
acggcuaaaaaaagccgccauc

SEQ ID NO: 3918351 - RNA, 14 nt, Shigella flexneri 2a str. 301
acggcuaaagccgu

SEQ ID NO: 3918352 - RNA, 17 nt, Shigella flexneri 2a str. 301
acggcucacgcccauca

SEQ ID NO: 3918353 - RNA, 14 nt, Shigella flexneri 2a str. 301
acggcucagcucug

SEQ ID NO: 3918354 - RNA, 14 nt, Shigella flexneri 2a str. 301
acggcucgcccguu

SEQ ID NO: 3918355 - RNA, 15 nt, Shigella flexneri 2a str. 301
acggcugcauuauga

SEQ ID NO: 3918356 - RNA, 16 nt, Shigella flexneri 2a str. 301
acggcugcuaauauuu

SEQ ID NO: 3918357 - RNA, 18 nt, Shigella flexneri 2a str. 301
acggcugcuucggucagc

SEQ ID NO: 3918358 - RNA, 15 nt, Shigella flexneri 2a str. 301
acggcugggaaauca

SEQ ID NO: 3918359 - RNA, 19 nt, Shigella flexneri 2a str. 301
acggcugggaaaucaccac

SEQ ID NO: 3918360 - RNA, 20 nt, Shigella flexneri 2a str. 301
acggcuucgccuccuguucu

SEQ ID NO: 3918361 - RNA, 13 nt, Shigella flexneri 2a str. 301
acggcuucucggc

SEQ ID NO: 3918362 - RNA, 19 nt, Shigella flexneri 2a str. 301
acggcuugcgcgcaaucag

SEQ ID NO: 3918363 - RNA, 15 nt, Shigella flexneri 2a str. 301
acggcuuugcgcaug

SEQ ID NO: 3918364 - RNA, 21 nt, Shigella flexneri 2a str. 301
acggcuuuggcaaaccgccag

SEQ ID NO: 3918365 - RNA, 18 nt, Shigella flexneri 2a str. 301
acgggaaacucugcuggc

SEQ ID NO: 3918366 - RNA, 20 nt, Shigella flexneri 2a str. 301
acgggagaaacccggccaca

SEQ ID NO: 3918367 - RNA, 16 nt, Shigella flexneri 2a str. 301
acgggcaagccagcau

SEQ ID NO: 3918368 - RNA, 14 nt, Shigella flexneri 2a str. 301
acgggcaaucucau

SEQ ID NO: 3918369 - RNA, 16 nt, Shigella flexneri 2a str. 301
acgggcaccaguaacg

SEQ ID NO: 3918370 - RNA, 13 nt, Shigella flexneri 2a str. 301
acgggcauggugu

SEQ ID NO: 3918371 - RNA, 20 nt, Shigella flexneri 2a str. 301
acgggcgauggaaccacaug

SEQ ID NO: 3918372 - RNA, 22 nt, Shigella flexneri 2a str. 301
acgggcgcgagguaacaucccu

SEQ ID NO: 3918373 - RNA, 17 nt, Shigella flexneri 2a str. 301
acggggugcgguaaaac

SEQ ID NO: 3918374 - RNA, 18 nt, Shigella flexneri 2a str. 301
acggggugcgguaaaacc

SEQ ID NO: 3918375 - RNA, 19 nt, Shigella flexneri 2a str. 301
acgggguugugauuacagg

SEQ ID NO: 3918376 - RNA, 23 nt, Shigella flexneri 2a str. 301
acgggguugugauuacaggaugc

SEQ ID NO: 3918377 - RNA, 19 nt, Shigella flexneri 2a str. 301
acggguaaaacgugccauu

SEQ ID NO: 3918378 - RNA, 21 nt, Shigella flexneri 2a str. 301
acggguacaguuuuccaucag

SEQ ID NO: 3918379 - RNA, 17 nt, Shigella flexneri 2a str. 301
acgggucauaaucagau

SEQ ID NO: 3918380 - RNA, 19 nt, Shigella flexneri 2a str. 301
acgggugagggcguagaga

SEQ ID NO: 3918381 - RNA, 14 nt, Shigella flexneri 2a str. 301
acggguucaagucc

SEQ ID NO: 3918382 - RNA, 18 nt, Shigella flexneri 2a str. 301
acgguaacccagguauuc

SEQ ID NO: 3918383 - RNA, 20 nt, Shigella flexneri 2a str. 301
acgguacgccagaguggauu

SEQ ID NO: 3918384 - RNA, 18 nt, Shigella flexneri 2a str. 301
acgguagccccgcuucag

SEQ ID NO: 3918385 - RNA, 17 nt, Shigella flexneri 2a str. 301
acgguaucuuuccagcc

SEQ ID NO: 3918386 - RNA, 14 nt, Shigella flexneri 2a str. 301
acggucacggcugu

SEQ ID NO: 3918387 - RNA, 21 nt, Shigella flexneri 2a str. 301
acggucaggcuaauaccgucg

SEQ ID NO: 3918388 - RNA, 22 nt, Shigella flexneri 2a str. 301
acggucccucaacaacagucuc

SEQ ID NO: 3918389 - RNA, 13 nt, Shigella flexneri 2a str. 301
acgguccggcauc

SEQ ID NO: 3918390 - RNA, 23 nt, Shigella flexneri 2a str. 301
acgguccgguugcagaguaucca

SEQ ID NO: 3918391 - RNA, 15 nt, Shigella flexneri 2a str. 301
acgguccuuaccaug

SEQ ID NO: 3918392 - RNA, 23 nt, Shigella flexneri 2a str. 301
acggugaaaaaccaaucucccag

SEQ ID NO: 3918393 - RNA, 19 nt, Shigella flexneri 2a str. 301
acggugaacucacacagcg

SEQ ID NO: 3918394 - RNA, 15 nt, Shigella flexneri 2a str. 301
acggugaccagaacu

SEQ ID NO: 3918395 - RNA, 21 nt, Shigella flexneri 2a str. 301
acggugaugaucgcgcugauu

SEQ ID NO: 3918396 - RNA, 12 nt, Shigella flexneri 2a str. 301
acggugcagcug

SEQ ID NO: 3918397 - RNA, 23 nt, Shigella flexneri 2a str. 301
acggugcgcguugcuuauugccg

SEQ ID NO: 3918398 - RNA, 22 nt, Shigella flexneri 2a str. 301
acggugguuaucgucaaccugu

SEQ ID NO: 3918399 - RNA, 22 nt, Shigella flexneri 2a str. 301
acgguguaccggauaaauuuaa

SEQ ID NO: 3918400 - RNA, 18 nt, Shigella flexneri 2a str. 301
acggugucacggugucgg

SEQ ID NO: 3918401 - RNA, 15 nt, Shigella flexneri 2a str. 301
acggugugcggcagg

SEQ ID NO: 3918402 - RNA, 15 nt, Shigella flexneri 2a str. 301
acgguuaaaaacagc

SEQ ID NO: 3918403 - RNA, 19 nt, Shigella flexneri 2a str. 301
acguucugaucuuucuuca

SEQ ID NO: 3918404 - RNA, 17 nt, Shigella flexneri 2a str. 301
acguucuuccuguggau

SEQ ID NO: 3918405 - RNA, 18 nt, Shigella flexneri 2a str. 301
acguugaacugacuguuu

SEQ ID NO: 3918406 - RNA, 22 nt, Shigella flexneri 2a str. 301
acguugagagguaaaaccugac

SEQ ID NO: 3918407 - RNA, 17 nt, Shigella flexneri 2a str. 301
acguugauaaccacggc

SEQ ID NO: 3918408 - RNA, 22 nt, Shigella flexneri 2a str. 301
acguugauuuugucauggcgca

SEQ ID NO: 3918409 - RNA, 20 nt, Shigella flexneri 2a str. 301
acguugcauaaaugccgcaa

SEQ ID NO: 3918410 - RNA, 14 nt, Shigella flexneri 2a str. 301
acguugcgcuuccc

SEQ ID NO: 3918411 - RNA, 23 nt, Shigella flexneri 2a str. 301
acguugcugacuguaggccggau

SEQ ID NO: 3918412 - RNA, 21 nt, Shigella flexneri 2a str. 301
acguugcuguugguucagugg

SEQ ID NO: 3918413 - RNA, 22 nt, Shigella flexneri 2a str. 301
acguugcuucucuugcuggauu

SEQ ID NO: 3918414 - RNA, 17 nt, Shigella flexneri 2a str. 301
acguuggcgcauaacuc

SEQ ID NO: 3918415 - RNA, 15 nt, Shigella flexneri 2a str. 301
acguugucgccgcug

SEQ ID NO: 3918416 - RNA, 23 nt, Shigella flexneri 2a str. 301
acguuguuccggcgcaauucccg

SEQ ID NO: 3918417 - RNA, 22 nt, Shigella flexneri 2a str. 301
acguuguuccuuccagcuggcu

SEQ ID NO: 3918418 - RNA, 17 nt, Shigella flexneri 2a str. 301
acguuuaacacgcucug

SEQ ID NO: 3918419 - RNA, 14 nt, Shigella flexneri 2a str. 301
acguuuacuucgcu

SEQ ID NO: 3918420 - RNA, 17 nt, Shigella flexneri 2a str. 301
acguuucaaacaggcug

SEQ ID NO: 3918421 - RNA, 19 nt, Shigella flexneri 2a str. 301
acguuucaccagcacuucu

SEQ ID NO: 3918422 - RNA, 15 nt, Shigella flexneri 2a str. 301
acguuucuggugugc

SEQ ID NO: 3918423 - RNA, 16 nt, Shigella flexneri 2a str. 301
acguuucuggugugca

SEQ ID NO: 3918424 - RNA, 17 nt, Shigella flexneri 2a str. 301
acguuuggucagaucag

SEQ ID NO: 3918425 - RNA, 13 nt, Shigella flexneri 2a str. 301
acguuuugcugau

SEQ ID NO: 3918426 - RNA, 15 nt, Shigella flexneri 2a str. 301
acguuuugcugaugc

SEQ ID NO: 3918427 - RNA, 14 nt, Shigella flexneri 2a str. 301
acguuuuuacguuc

SEQ ID NO: 3918428 - RNA, 14 nt, Shigella flexneri 2a str. 301
acguuuuucgaaaa

SEQ ID NO: 3918429 - RNA, 16 nt, Shigella flexneri 2a str. 301
acuaaaacuuuauuca

SEQ ID NO: 3918430 - RNA, 23 nt, Shigella flexneri 2a str. 301
acuaaaaucauucgugagcuggu

SEQ ID NO: 3918431 - RNA, 18 nt, Shigella flexneri 2a str. 301
acuaaagccuuuugccag

SEQ ID NO: 3918432 - RNA, 15 nt, Shigella flexneri 2a str. 301
acuaaaugcugcagc

SEQ ID NO: 3918433 - RNA, 19 nt, Shigella flexneri 2a str. 301
acuaacacuucaucacuac

SEQ ID NO: 3918434 - RNA, 16 nt, Shigella flexneri 2a str. 301
acuaacagaacaauaa

SEQ ID NO: 3918435 - RNA, 20 nt, Shigella flexneri 2a str. 301
acuaacuuuacucuuuuuug

SEQ ID NO: 3918436 - RNA, 14 nt, Shigella flexneri 2a str. 301
acuaagauaaucca

SEQ ID NO: 3918437 - RNA, 23 nt, Shigella flexneri 2a str. 301
acuaauccguaaaguuaccugug

SEQ ID NO: 3918438 - RNA, 19 nt, Shigella flexneri 2a str. 301
acuaaucugacaacaccaa

SEQ ID NO: 3918439 - RNA, 17 nt, Shigella flexneri 2a str. 301
acuaccacguaacgacu

SEQ ID NO: 3918440 - RNA, 20 nt, Shigella flexneri 2a str. 301
acuaccauuuguucuuuuuu

SEQ ID NO: 3918441 - RNA, 14 nt, Shigella flexneri 2a str. 301
acuaccggaaccca

SEQ ID NO: 3918442 - RNA, 19 nt, Shigella flexneri 2a str. 301
acuaccggaacccaccgca

SEQ ID NO: 3918443 - RNA, 17 nt, Shigella flexneri 2a str. 301
acuacgacgccaagaaa

SEQ ID NO: 3918444 - RNA, 16 nt, Shigella flexneri 2a str. 301
acuacggcaaaagaau

SEQ ID NO: 3918445 - RNA, 23 nt, Shigella flexneri 2a str. 301
acuacggcuucugacauaaccac

SEQ ID NO: 3918446 - RNA, 21 nt, Shigella flexneri 2a str. 301
acuacgugaucgucuucaacc

SEQ ID NO: 3918447 - RNA, 17 nt, Shigella flexneri 2a str. 301
acuagacgaugaaaaag

SEQ ID NO: 3918448 - RNA, 19 nt, Shigella flexneri 2a str. 301
acuagcucaauaaaagaaa

SEQ ID NO: 3918449 - RNA, 14 nt, Shigella flexneri 2a str. 301
acuauaaaaaaacc

SEQ ID NO: 3918450 - RNA, 19 nt, Shigella flexneri 2a str. 301
acuauacuccugauggucu

SEQ ID NO: 3918451 - RNA, 19 nt, Shigella flexneri 2a str. 301
acuauauucucaaaauaca

SEQ ID NO: 3918452 - RNA, 17 nt, Shigella flexneri 2a str. 301
acuaucauacucauuua

SEQ ID NO: 3918453 - RNA, 19 nt, Shigella flexneri 2a str. 301
acuaucgaaaguuuaccag

SEQ ID NO: 3918454 - RNA, 18 nt, Shigella flexneri 2a str. 301
acuaucgcugagauacuc

SEQ ID NO: 3918455 - RNA, 15 nt, Shigella flexneri 2a str. 301
acuaucuugccgaag

SEQ ID NO: 3918456 - RNA, 14 nt, Shigella flexneri 2a str. 301
acuaugaaaauaaa

SEQ ID NO: 3918457 - RNA, 22 nt, Shigella flexneri 2a str. 301
acuauugacgaaaagcugaaaa

SEQ ID NO: 3918458 - RNA, 15 nt, Shigella flexneri 2a str. 301
acuauuucaauauga

SEQ ID NO: 3918459 - RNA, 17 nt, Shigella flexneri 2a str. 301
acuauuucuuuguagau

SEQ ID NO: 3918460 - RNA, 18 nt, Shigella flexneri 2a str. 301
acucaaaaauaaucaucu

SEQ ID NO: 3918461 - RNA, 13 nt, Shigella flexneri 2a str. 301
acucaaagucgag

SEQ ID NO: 3918462 - RNA, 19 nt, Shigella flexneri 2a str. 301
acucaaauaucuauauaca

SEQ ID NO: 3918463 - RNA, 13 nt, Shigella flexneri 2a str. 301
acucaaaucacgc

SEQ ID NO: 3918464 - RNA, 14 nt, Shigella flexneri 2a str. 301
acucaaccccagcc

SEQ ID NO: 3918465 - RNA, 13 nt, Shigella flexneri 2a str. 301
acucaaccgccac

SEQ ID NO: 3918466 - RNA, 22 nt, Shigella flexneri 2a str. 301
acucaacgguucgccaucaaga

SEQ ID NO: 3918467 - RNA, 17 nt, Shigella flexneri 2a str. 301
acucaacuuuaccuuca

SEQ ID NO: 3918468 - RNA, 12 nt, Shigella flexneri 2a str. 301
acucaaucaggc

SEQ ID NO: 3918469 - RNA, 15 nt, Shigella flexneri 2a str. 301
acucaauggcauccg

SEQ ID NO: 3918470 - RNA, 19 nt, Shigella flexneri 2a str. 301
acucaauggcauccgccac

SEQ ID NO: 3918471 - RNA, 12 nt, Shigella flexneri 2a str. 301
acucacagggcu

SEQ ID NO: 3918472 - RNA, 21 nt, Shigella flexneri 2a str. 301
acucaccagugguaagaggaa

SEQ ID NO: 3918473 - RNA, 17 nt, Shigella flexneri 2a str. 301
acucaccgagcagcaca

SEQ ID NO: 3918474 - RNA, 20 nt, Shigella flexneri 2a str. 301
acucaccgagcagcacaaug

SEQ ID NO: 3918475 - RNA, 23 nt, Shigella flexneri 2a str. 301
acucaccgaugaucgccaucagu

SEQ ID NO: 3918476 - RNA, 19 nt, Shigella flexneri 2a str. 301
acucaccggcguuucacau

SEQ ID NO: 3918477 - RNA, 21 nt, Shigella flexneri 2a str. 301
acucaccuuuuuuguuguuau

SEQ ID NO: 3918478 - RNA, 16 nt, Shigella flexneri 2a str. 301
acucacgaaucgccuc

SEQ ID NO: 3918479 - RNA, 16 nt, Shigella flexneri 2a str. 301
acucacgauuguuaau

SEQ ID NO: 3918480 - RNA, 16 nt, Shigella flexneri 2a str. 301
acucacuguggcgcgu

SEQ ID NO: 3918481 - RNA, 17 nt, Shigella flexneri 2a str. 301
acucagaccaguuuuuu

SEQ ID NO: 3918482 - RNA, 22 nt, Shigella flexneri 2a str. 301
acucagccaaaucccgugaugc

SEQ ID NO: 3918483 - RNA, 17 nt, Shigella flexneri 2a str. 301
acucagcgccugcugca

SEQ ID NO: 3918484 - RNA, 13 nt, Shigella flexneri 2a str. 301
acucagcggcugc

SEQ ID NO: 3918485 - RNA, 17 nt, Shigella flexneri 2a str. 301
acucaggccaaaugaca

SEQ ID NO: 3918486 - RNA, 22 nt, Shigella flexneri 2a str. 301
acucaggccaaaugacauccga

SEQ ID NO: 3918487 - RNA, 19 nt, Shigella flexneri 2a str. 301
acucaggcuggcaagcugc

SEQ ID NO: 3918488 - RNA, 22 nt, Shigella flexneri 2a str. 301
acucaggcuggcaagcugcugu

SEQ ID NO: 3918489 - RNA, 16 nt, Shigella flexneri 2a str. 301
acucauaaauacucca

SEQ ID NO: 3918490 - RNA, 19 nt, Shigella flexneri 2a str. 301
acucaucaacguuuuuuug

SEQ ID NO: 3918491 - RNA, 23 nt, Shigella flexneri 2a str. 301
acucaucaacguuuuuuugcuuu

SEQ ID NO: 3918492 - RNA, 17 nt, Shigella flexneri 2a str. 301
acucaucacuguaggcc

SEQ ID NO: 3918493 - RNA, 17 nt, Shigella flexneri 2a str. 301
acucaucuuauugauca

SEQ ID NO: 3918494 - RNA, 13 nt, Shigella flexneri 2a str. 301
acucauugccagu

SEQ ID NO: 3918495 - RNA, 15 nt, Shigella flexneri 2a str. 301
acucauugccagucc

SEQ ID NO: 3918496 - RNA, 13 nt, Shigella flexneri 2a str. 301
acucauuuacaga

SEQ ID NO: 3918497 - RNA, 14 nt, Shigella flexneri 2a str. 301
acuccaacccggca

SEQ ID NO: 3918498 - RNA, 15 nt, Shigella flexneri 2a str. 301
acuccaacuuacuga

SEQ ID NO: 3918499 - RNA, 12 nt, Shigella flexneri 2a str. 301
acuccagaauac

SEQ ID NO: 3918500 - RNA, 15 nt, Shigella flexneri 2a str. 301
acuccagcagaccag

SEQ ID NO: 3918501 - RNA, 21 nt, Shigella flexneri 2a str. 301
acuccagcagaccagcaaaaa

SEQ ID NO: 3918502 - RNA, 14 nt, Shigella flexneri 2a str. 301
acuccagccagagc

SEQ ID NO: 3918503 - RNA, 17 nt, Shigella flexneri 2a str. 301
acugcaacugacggcau

SEQ ID NO: 3918504 - RNA, 18 nt, Shigella flexneri 2a str. 301
acugcaacugcgcggcaa

SEQ ID NO: 3918505 - RNA, 14 nt, Shigella flexneri 2a str. 301
acugcaaugaccau

SEQ ID NO: 3918506 - RNA, 16 nt, Shigella flexneri 2a str. 301
acugcaggccggaaug

SEQ ID NO: 3918507 - RNA, 20 nt, Shigella flexneri 2a str. 301
acugcaucagcgccuuacca

SEQ ID NO: 3918508 - RNA, 22 nt, Shigella flexneri 2a str. 301
acugccacacaggccauuuccc

SEQ ID NO: 3918509 - RNA, 13 nt, Shigella flexneri 2a str. 301
acugccaccaucc

SEQ ID NO: 3918510 - RNA, 22 nt, Shigella flexneri 2a str. 301
acugccagaauagccgcagcca

SEQ ID NO: 3918511 - RNA, 12 nt, Shigella flexneri 2a str. 301
acugccaggagc

SEQ ID NO: 3918512 - RNA, 21 nt, Shigella flexneri 2a str. 301
acugccaguaaagcagcgaag

SEQ ID NO: 3918513 - RNA, 18 nt, Shigella flexneri 2a str. 301
acugccaguucccccugc

SEQ ID NO: 3918514 - RNA, 12 nt, Shigella flexneri 2a str. 301
acugcccgagaa

SEQ ID NO: 3918515 - RNA, 14 nt, Shigella flexneri 2a str. 301
acugcccgagaaca

SEQ ID NO: 3918516 - RNA, 18 nt, Shigella flexneri 2a str. 301
acugccgaacagaaugca

SEQ ID NO: 3918517 - RNA, 16 nt, Shigella flexneri 2a str. 301
acugccgcacuuugag

SEQ ID NO: 3918518 - RNA, 16 nt, Shigella flexneri 2a str. 301
acugccggacguucgc

SEQ ID NO: 3918519 - RNA, 19 nt, Shigella flexneri 2a str. 301
acugccggacguucgccca

SEQ ID NO: 3918520 - RNA, 19 nt, Shigella flexneri 2a str. 301
acugccggaugcaucgcau

SEQ ID NO: 3918521 - RNA, 15 nt, Shigella flexneri 2a str. 301
acugccggaugcggc

SEQ ID NO: 3918522 - RNA, 15 nt, Shigella flexneri 2a str. 301
acugccguacagaca

SEQ ID NO: 3918523 - RNA, 15 nt, Shigella flexneri 2a str. 301
acugccguacaggca

SEQ ID NO: 3918524 - RNA, 16 nt, Shigella flexneri 2a str. 301
acugccguugcugccg

SEQ ID NO: 3918525 - RNA, 14 nt, Shigella flexneri 2a str. 301
acugccuuaaucaa

SEQ ID NO: 3918526 - RNA, 22 nt, Shigella flexneri 2a str. 301
acugccuuugcccgcaagcugc

SEQ ID NO: 3918527 - RNA, 16 nt, Shigella flexneri 2a str. 301
acugcgaaagcgucag

SEQ ID NO: 3918528 - RNA, 17 nt, Shigella flexneri 2a str. 301
acugcgacguggaucaa

SEQ ID NO: 3918529 - RNA, 14 nt, Shigella flexneri 2a str. 301
acugcgagcaaaau

SEQ ID NO: 3918530 - RNA, 15 nt, Shigella flexneri 2a str. 301
acugcgccacucgau

SEQ ID NO: 3918531 - RNA, 18 nt, Shigella flexneri 2a str. 301
acugcgccagcgucauca

SEQ ID NO: 3918532 - RNA, 18 nt, Shigella flexneri 2a str. 301
acugcgccaucaaugccg

SEQ ID NO: 3918533 - RNA, 21 nt, Shigella flexneri 2a str. 301
acugcgccaucaaugccgcaa

SEQ ID NO: 3918534 - RNA, 17 nt, Shigella flexneri 2a str. 301
acugcgcccgccagcau

SEQ ID NO: 3918535 - RNA, 15 nt, Shigella flexneri 2a str. 301
acugcgccgaagcgc

SEQ ID NO: 3918536 - RNA, 16 nt, Shigella flexneri 2a str. 301
acugcgccgcucagua

SEQ ID NO: 3918537 - RNA, 19 nt, Shigella flexneri 2a str. 301
acugcgccggaaugcgggc

SEQ ID NO: 3918538 - RNA, 19 nt, Shigella flexneri 2a str. 301
acugcgccucaacauacaa

SEQ ID NO: 3918539 - RNA, 20 nt, Shigella flexneri 2a str. 301
acugcgccucgccgcugccu

SEQ ID NO: 3918540 - RNA, 21 nt, Shigella flexneri 2a str. 301
acugcgcgauuaucauuuuac

SEQ ID NO: 3918541 - RNA, 19 nt, Shigella flexneri 2a str. 301
acugcgcgccgccgcugaa

SEQ ID NO: 3918542 - RNA, 15 nt, Shigella flexneri 2a str. 301
acugcgcuaccagga

SEQ ID NO: 3918543 - RNA, 16 nt, Shigella flexneri 2a str. 301
acugcgcugcauuacu

SEQ ID NO: 3918544 - RNA, 22 nt, Shigella flexneri 2a str. 301
acugcggucuaaaucuuccgcc

SEQ ID NO: 3918545 - RNA, 17 nt, Shigella flexneri 2a str. 301
acugcgugcugagcggc

SEQ ID NO: 3918546 - RNA, 14 nt, Shigella flexneri 2a str. 301
acugcguucugucg

SEQ ID NO: 3918547 - RNA, 20 nt, Shigella flexneri 2a str. 301
acugcguuucuggcuuaaac

SEQ ID NO: 3918548 - RNA, 14 nt, Shigella flexneri 2a str. 301
acugcuaucacaau

SEQ ID NO: 3918549 - RNA, 14 nt, Shigella flexneri 2a str. 301
acugcucagcuccu

SEQ ID NO: 3918550 - RNA, 19 nt, Shigella flexneri 2a str. 301
acugcucagcuccucuuuc

SEQ ID NO: 3918551 - RNA, 17 nt, Shigella flexneri 2a str. 301
acugcuccauaauugcc

SEQ ID NO: 3918552 - RNA, 18 nt, Shigella flexneri 2a str. 301
acugcuccggcuuuuuag

SEQ ID NO: 3918553 - RNA, 23 nt, Shigella flexneri 2a str. 301
acugcuccgggaauucguucaga

SEQ ID NO: 3918554 - RNA, 18 nt, Shigella flexneri 2a str. 301
acugcuccuguaugaccc

SEQ ID NO: 3918555 - RNA, 14 nt, Shigella flexneri 2a str. 301
acugcucguucagc

SEQ ID NO: 3918556 - RNA, 16 nt, Shigella flexneri 2a str. 301
acugcucguucagcac

SEQ ID NO: 3918557 - RNA, 13 nt, Shigella flexneri 2a str. 301
acugcugcauccg

SEQ ID NO: 3918558 - RNA, 18 nt, Shigella flexneri 2a str. 301
acugcugcggaauugccg

SEQ ID NO: 3918559 - RNA, 14 nt, Shigella flexneri 2a str. 301
acugcuuaauauua

SEQ ID NO: 3918560 - RNA, 14 nt, Shigella flexneri 2a str. 301
acugcuuacaggcu

SEQ ID NO: 3918561 - RNA, 16 nt, Shigella flexneri 2a str. 301
acugcuuacaggcugg

SEQ ID NO: 3918562 - RNA, 22 nt, Shigella flexneri 2a str. 301
acugcuucaaaaaaauucugaa

SEQ ID NO: 3918563 - RNA, 15 nt, Shigella flexneri 2a str. 301
acugcuugagcgggg

SEQ ID NO: 3918564 - RNA, 17 nt, Shigella flexneri 2a str. 301
acugcuuuuuaaucucc

SEQ ID NO: 3918565 - RNA, 17 nt, Shigella flexneri 2a str. 301
acuggaaaaaguugcac

SEQ ID NO: 3918566 - RNA, 13 nt, Shigella flexneri 2a str. 301
acuggaaaucaaa

SEQ ID NO: 3918567 - RNA, 22 nt, Shigella flexneri 2a str. 301
acuggaacggggcgauuuuguu

SEQ ID NO: 3918568 - RNA, 13 nt, Shigella flexneri 2a str. 301
acuggauagauau

SEQ ID NO: 3918569 - RNA, 16 nt, Shigella flexneri 2a str. 301
acuggcaaaaucaaaa

SEQ ID NO: 3918570 - RNA, 17 nt, Shigella flexneri 2a str. 301
acuggcaacaauggcau

SEQ ID NO: 3918571 - RNA, 14 nt, Shigella flexneri 2a str. 301
acuggcaaccagaa

SEQ ID NO: 3918572 - RNA, 23 nt, Shigella flexneri 2a str. 301
acuggcaauagcggacacuacca

SEQ ID NO: 3918573 - RNA, 23 nt, Shigella flexneri 2a str. 301
acuggcaaucgccagcggcagcu

SEQ ID NO: 3918574 - RNA, 19 nt, Shigella flexneri 2a str. 301
acuggcagcaccgggccaa

SEQ ID NO: 3918575 - RNA, 18 nt, Shigella flexneri 2a str. 301
acuggcagccaggcgcga

SEQ ID NO: 3918576 - RNA, 15 nt, Shigella flexneri 2a str. 301
acuggcauuacggca

SEQ ID NO: 3918577 - RNA, 16 nt, Shigella flexneri 2a str. 301
acuggcccucgucuuu

SEQ ID NO: 3918578 - RNA, 23 nt, Shigella flexneri 2a str. 301
acuggccucuuggcaucuugaac

SEQ ID NO: 3918579 - RNA, 17 nt, Shigella flexneri 2a str. 301
acuggcgcgaauugccg

SEQ ID NO: 3918580 - RNA, 16 nt, Shigella flexneri 2a str. 301
acuggcgcgagccugu

SEQ ID NO: 3918581 - RNA, 17 nt, Shigella flexneri 2a str. 301
acuggcggucaugacga

SEQ ID NO: 3918582 - RNA, 14 nt, Shigella flexneri 2a str. 301
acuggcuaagaagc

SEQ ID NO: 3918583 - RNA, 18 nt, Shigella flexneri 2a str. 301
acuggcuacugucuaaaa

SEQ ID NO: 3918584 - RNA, 14 nt, Shigella flexneri 2a str. 301
acuggcucuuuuuc

SEQ ID NO: 3918585 - RNA, 16 nt, Shigella flexneri 2a str. 301
acuggcugcgugguuu

SEQ ID NO: 3918586 - RNA, 19 nt, Shigella flexneri 2a str. 301
acuggcuguagaagcugac

SEQ ID NO: 3918587 - RNA, 15 nt, Shigella flexneri 2a str. 301
acugggaugaaagug

SEQ ID NO: 3918588 - RNA, 22 nt, Shigella flexneri 2a str. 301
acugggaugugaaaaugaguau

SEQ ID NO: 3918589 - RNA, 18 nt, Shigella flexneri 2a str. 301
acugggcgaagguggcgg

SEQ ID NO: 3918590 - RNA, 13 nt, Shigella flexneri 2a str. 301
acugggcgauuaa

SEQ ID NO: 3918591 - RNA, 16 nt, Shigella flexneri 2a str. 301
acuggggcuggcggca

SEQ ID NO: 3918592 - RNA, 13 nt, Shigella flexneri 2a str. 301
acugguacucaac

SEQ ID NO: 3918593 - RNA, 13 nt, Shigella flexneri 2a str. 301
acugguagugcag

SEQ ID NO: 3918594 - RNA, 15 nt, Shigella flexneri 2a str. 301
acugguccagccccu

SEQ ID NO: 3918595 - RNA, 21 nt, Shigella flexneri 2a str. 301
acuggugacuuuugcccggca

SEQ ID NO: 3918596 - RNA, 23 nt, Shigella flexneri 2a str. 301
acuggugacuuuugcccggcaug

SEQ ID NO: 3918597 - RNA, 17 nt, Shigella flexneri 2a str. 301
acugguggcaggaaaac

SEQ ID NO: 3918598 - RNA, 19 nt, Shigella flexneri 2a str. 301
acugguguugaaaccgcug

SEQ ID NO: 3918599 - RNA, 20 nt, Shigella flexneri 2a str. 301
acugguucccaacaacagcg

SEQ ID NO: 3918600 - RNA, 15 nt, Shigella flexneri 2a str. 301
acugguuuuccugag

SEQ ID NO: 3918601 - RNA, 13 nt, Shigella flexneri 2a str. 301
acuguaccagcaa

SEQ ID NO: 3918602 - RNA, 12 nt, Shigella flexneri 2a str. 301
acuguacgccga

SEQ ID NO: 3918603 - RNA, 14 nt, Shigella flexneri 2a str. 301
acuugccuccagcg

SEQ ID NO: 3918604 - RNA, 14 nt, Shigella flexneri 2a str. 301
acuuggguaacagc

SEQ ID NO: 3918605 - RNA, 22 nt, Shigella flexneri 2a str. 301
acuugucauacaccguuuuaca

SEQ ID NO: 3918606 - RNA, 17 nt, Shigella flexneri 2a str. 301
acuuuaaauucagcauu

SEQ ID NO: 3918607 - RNA, 22 nt, Shigella flexneri 2a str. 301
acuuuaagcugaaaauggcgcu

SEQ ID NO: 3918608 - RNA, 19 nt, Shigella flexneri 2a str. 301
acuuuaauaaucucgccuu

SEQ ID NO: 3918609 - RNA, 13 nt, Shigella flexneri 2a str. 301
acuuuaaucaccu

SEQ ID NO: 3918610 - RNA, 16 nt, Shigella flexneri 2a str. 301
acuuuaaucaccugcc

SEQ ID NO: 3918611 - RNA, 16 nt, Shigella flexneri 2a str. 301
acuuuaauuuugugca

SEQ ID NO: 3918612 - RNA, 20 nt, Shigella flexneri 2a str. 301
acuuuaauuuugugcagcau

SEQ ID NO: 3918613 - RNA, 23 nt, Shigella flexneri 2a str. 301
acuuuaauuuugugcagcaugca

SEQ ID NO: 3918614 - RNA, 16 nt, Shigella flexneri 2a str. 301
acuuuaccgguuucaa

SEQ ID NO: 3918615 - RNA, 21 nt, Shigella flexneri 2a str. 301
acuuuaccgguuucaauccag

SEQ ID NO: 3918616 - RNA, 16 nt, Shigella flexneri 2a str. 301
acuuuacgaccagccg

SEQ ID NO: 3918617 - RNA, 18 nt, Shigella flexneri 2a str. 301
acuuuagcgaaaucuucc

SEQ ID NO: 3918618 - RNA, 17 nt, Shigella flexneri 2a str. 301
acuuuagcgcaaucgca

SEQ ID NO: 3918619 - RNA, 16 nt, Shigella flexneri 2a str. 301
acuuucaacagguuaa

SEQ ID NO: 3918620 - RNA, 17 nt, Shigella flexneri 2a str. 301
acuuucacaaaaauaau

SEQ ID NO: 3918621 - RNA, 16 nt, Shigella flexneri 2a str. 301
acuuucacgcccauaa

SEQ ID NO: 3918622 - RNA, 17 nt, Shigella flexneri 2a str. 301
acuuucacgccgccaaa

SEQ ID NO: 3918623 - RNA, 16 nt, Shigella flexneri 2a str. 301
acuuucagaccgccaa

SEQ ID NO: 3918624 - RNA, 13 nt, Shigella flexneri 2a str. 301
acuuucagcgcag

SEQ ID NO: 3918625 - RNA, 22 nt, Shigella flexneri 2a str. 301
acuuucaguggcuuaucuuccu

SEQ ID NO: 3918626 - RNA, 14 nt, Shigella flexneri 2a str. 301
acuuucaucagcac

SEQ ID NO: 3918627 - RNA, 21 nt, Shigella flexneri 2a str. 301
acuuucaucgcggucagcugc

SEQ ID NO: 3918628 - RNA, 13 nt, Shigella flexneri 2a str. 301
acuuuccagccac

SEQ ID NO: 3918629 - RNA, 16 nt, Shigella flexneri 2a str. 301
acuuuccaucuuuccu

SEQ ID NO: 3918630 - RNA, 21 nt, Shigella flexneri 2a str. 301
acuuuccaugccaucugccag

SEQ ID NO: 3918631 - RNA, 21 nt, Shigella flexneri 2a str. 301
acuuucgagcaauuuuccuug

SEQ ID NO: 3918632 - RNA, 17 nt, Shigella flexneri 2a str. 301
acuuucggugacuucaa

SEQ ID NO: 3918633 - RNA, 13 nt, Shigella flexneri 2a str. 301
acuuucugagauu

SEQ ID NO: 3918634 - RNA, 24 nt, Shigella flexneri 2a str. 301
acuuucugagauucaauuauagua

SEQ ID NO: 3918635 - RNA, 20 nt, Shigella flexneri 2a str. 301
acuuucuggcacgaccuggc

SEQ ID NO: 3918636 - RNA, 22 nt, Shigella flexneri 2a str. 301
acuuucuuuuuguugcgcugaa

SEQ ID NO: 3918637 - RNA, 20 nt, Shigella flexneri 2a str. 301
acuuugaucgcguuuuuugu

SEQ ID NO: 3918638 - RNA, 21 nt, Shigella flexneri 2a str. 301
acuuugucgaucuccgccuga

SEQ ID NO: 3918639 - RNA, 17 nt, Shigella flexneri 2a str. 301
acuuuuaaauugaagag

SEQ ID NO: 3918640 - RNA, 23 nt, Shigella flexneri 2a str. 301
acuuuuacaugcgcgacaaaaau

SEQ ID NO: 3918641 - RNA, 14 nt, Shigella flexneri 2a str. 301
acuuuuauuucacc

SEQ ID NO: 3918642 - RNA, 22 nt, Shigella flexneri 2a str. 301
acuuuucaggcuagccgccagc

SEQ ID NO: 3918643 - RNA, 16 nt, Shigella flexneri 2a str. 301
acuuuucccuacugcu

SEQ ID NO: 3918644 - RNA, 22 nt, Shigella flexneri 2a str. 301
acuuuucccuacugcugacaua

SEQ ID NO: 3918645 - RNA, 16 nt, Shigella flexneri 2a str. 301
acuuuucgcacugcag

SEQ ID NO: 3918646 - RNA, 13 nt, Shigella flexneri 2a str. 301
acuuuugaaugag

SEQ ID NO: 3918647 - RNA, 20 nt, Shigella flexneri 2a str. 301
acuuuugagccaaaaugccu

SEQ ID NO: 3918648 - RNA, 13 nt, Shigella flexneri 2a str. 301
acuuuugcccggc

SEQ ID NO: 3918649 - RNA, 15 nt, Shigella flexneri 2a str. 301
acuuuugcccggcau

SEQ ID NO: 3918650 - RNA, 16 nt, Shigella flexneri 2a str. 301
acuuuuggaccacgga

SEQ ID NO: 3918651 - RNA, 22 nt, Shigella flexneri 2a str. 301
acuuuuggggugcaguucagaa

SEQ ID NO: 3918652 - RNA, 14 nt, Shigella flexneri 2a str. 301
acuuuuguauuuua

SEQ ID NO: 3918653 - RNA, 15 nt, Shigella flexneri 2a str. 301
acuuuuuaacuuuaa

SEQ ID NO: 3918654 - RNA, 22 nt, Shigella flexneri 2a str. 301
acuuuuuccuuaaacaccuggc

SEQ ID NO: 3918655 - RNA, 13 nt, Shigella flexneri 2a str. 301
agaaaaagagcau

SEQ ID NO: 3918656 - RNA, 15 nt, Shigella flexneri 2a str. 301
agaaaacguuucaac

SEQ ID NO: 3918657 - RNA, 23 nt, Shigella flexneri 2a str. 301
agaaaagcgagaguuacagcucu

SEQ ID NO: 3918658 - RNA, 17 nt, Shigella flexneri 2a str. 301
agaaaaucucaauguau

SEQ ID NO: 3918659 - RNA, 21 nt, Shigella flexneri 2a str. 301
agaaaauggccagccagcaga

SEQ ID NO: 3918660 - RNA, 12 nt, Shigella flexneri 2a str. 301
agaaacaaaaaa

SEQ ID NO: 3918661 - RNA, 13 nt, Shigella flexneri 2a str. 301
agaaacaaccuga

SEQ ID NO: 3918662 - RNA, 17 nt, Shigella flexneri 2a str. 301
agaaacacugucaaucg

SEQ ID NO: 3918663 - RNA, 16 nt, Shigella flexneri 2a str. 301
agaaacagucuggagc

SEQ ID NO: 3918664 - RNA, 21 nt, Shigella flexneri 2a str. 301
agaaacagucuggagcaaaaa

SEQ ID NO: 3918665 - RNA, 22 nt, Shigella flexneri 2a str. 301
agaaaccgaugacgcauacgug

SEQ ID NO: 3918666 - RNA, 13 nt, Shigella flexneri 2a str. 301
agaaaccgcuauu

SEQ ID NO: 3918667 - RNA, 20 nt, Shigella flexneri 2a str. 301
agaaaccugauuacgcaccg

SEQ ID NO: 3918668 - RNA, 16 nt, Shigella flexneri 2a str. 301
agaaacgccaucugaa

SEQ ID NO: 3918669 - RNA, 17 nt, Shigella flexneri 2a str. 301
agaaacgcucauaaauu

SEQ ID NO: 3918670 - RNA, 13 nt, Shigella flexneri 2a str. 301
agaaacucaguug

SEQ ID NO: 3918671 - RNA, 11 nt, Shigella flexneri 2a str. 301
agaaagaagcc

SEQ ID NO: 3918672 - RNA, 14 nt, Shigella flexneri 2a str. 301
agaaagagcgucug

SEQ ID NO: 3918673 - RNA, 15 nt, Shigella flexneri 2a str. 301
agaaagagcgucugg

SEQ ID NO: 3918674 - RNA, 19 nt, Shigella flexneri 2a str. 301
agaaagagcgucuggaaga

SEQ ID NO: 3918675 - RNA, 23 nt, Shigella flexneri 2a str. 301
agaaagagcgucuggaagaagua

SEQ ID NO: 3918676 - RNA, 22 nt, Shigella flexneri 2a str. 301
agaaagcaauauugauggaaag

SEQ ID NO: 3918677 - RNA, 16 nt, Shigella flexneri 2a str. 301
agaaagcaaugaaauu

SEQ ID NO: 3918678 - RNA, 12 nt, Shigella flexneri 2a str. 301
agaaagcccugg

SEQ ID NO: 3918679 - RNA, 15 nt, Shigella flexneri 2a str. 301
agaaagcccuggcgc

SEQ ID NO: 3918680 - RNA, 18 nt, Shigella flexneri 2a str. 301
agaaagccggaugaucau

SEQ ID NO: 3918681 - RNA, 17 nt, Shigella flexneri 2a str. 301
agaaagcgccagcaaga

SEQ ID NO: 3918682 - RNA, 14 nt, Shigella flexneri 2a str. 301
agaaagcugcgcag

SEQ ID NO: 3918683 - RNA, 24 nt, Shigella flexneri 2a str. 301
agaaagcugcugaccaccagcacg

SEQ ID NO: 3918684 - RNA, 14 nt, Shigella flexneri 2a str. 301
agaaagggaagaac

SEQ ID NO: 3918685 - RNA, 15 nt, Shigella flexneri 2a str. 301
agaaagggaagaaca

SEQ ID NO: 3918686 - RNA, 22 nt, Shigella flexneri 2a str. 301
agaaaguaacaauagcgaacag

SEQ ID NO: 3918687 - RNA, 23 nt, Shigella flexneri 2a str. 301
agaaaguauauaaaaaacaauau

SEQ ID NO: 3918688 - RNA, 19 nt, Shigella flexneri 2a str. 301
agaaaguugccagauaaau

SEQ ID NO: 3918689 - RNA, 14 nt, Shigella flexneri 2a str. 301
agaaaguuuuucaa

SEQ ID NO: 3918690 - RNA, 15 nt, Shigella flexneri 2a str. 301
agaaauaacgccgga

SEQ ID NO: 3918691 - RNA, 23 nt, Shigella flexneri 2a str. 301
agaaauaccacccgucgggcaga

SEQ ID NO: 3918692 - RNA, 18 nt, Shigella flexneri 2a str. 301
agaaauacuggcuaagaa

SEQ ID NO: 3918693 - RNA, 20 nt, Shigella flexneri 2a str. 301
agaaaucagcuuuggugaaa

SEQ ID NO: 3918694 - RNA, 16 nt, Shigella flexneri 2a str. 301
agaaaucauucaauac

SEQ ID NO: 3918695 - RNA, 17 nt, Shigella flexneri 2a str. 301
agaaaucauucaauacu

SEQ ID NO: 3918696 - RNA, 15 nt, Shigella flexneri 2a str. 301
agaaauccacaaauu

SEQ ID NO: 3918697 - RNA, 23 nt, Shigella flexneri 2a str. 301
agaaauccaggcccgcauuaaaa

SEQ ID NO: 3918698 - RNA, 22 nt, Shigella flexneri 2a str. 301
agaaaucccccagcaucacgcc

SEQ ID NO: 3918699 - RNA, 14 nt, Shigella flexneri 2a str. 301
agaaaugaaaaaau

SEQ ID NO: 3918700 - RNA, 16 nt, Shigella flexneri 2a str. 301
agaaaugccaguaacu

SEQ ID NO: 3918701 - RNA, 17 nt, Shigella flexneri 2a str. 301
agaaauggcccaaaagg

SEQ ID NO: 3918702 - RNA, 15 nt, Shigella flexneri 2a str. 301
agaaaugguaaagaa

SEQ ID NO: 3918703 - RNA, 18 nt, Shigella flexneri 2a str. 301
agaaugccugugcgacag

SEQ ID NO: 3918704 - RNA, 23 nt, Shigella flexneri 2a str. 301
agaaugcgcaacgccguaaguaa

SEQ ID NO: 3918705 - RNA, 19 nt, Shigella flexneri 2a str. 301
agaaugcucgcuggcaggc

SEQ ID NO: 3918706 - RNA, 21 nt, Shigella flexneri 2a str. 301
agaauggacaccagcucagug

SEQ ID NO: 3918707 - RNA, 18 nt, Shigella flexneri 2a str. 301
agaauggcaucagaagga

SEQ ID NO: 3918708 - RNA, 20 nt, Shigella flexneri 2a str. 301
agaauggcaucugauaagcc

SEQ ID NO: 3918709 - RNA, 19 nt, Shigella flexneri 2a str. 301
agaauggcgcacucaaaac

SEQ ID NO: 3918710 - RNA, 20 nt, Shigella flexneri 2a str. 301
agaaugggaugguuuugcuu

SEQ ID NO: 3918711 - RNA, 19 nt, Shigella flexneri 2a str. 301
agaaugguaacaccagagu

SEQ ID NO: 3918712 - RNA, 20 nt, Shigella flexneri 2a str. 301
agaauguuaacgccaauuaa

SEQ ID NO: 3918713 - RNA, 16 nt, Shigella flexneri 2a str. 301
agaauuaaaauaucag

SEQ ID NO: 3918714 - RNA, 13 nt, Shigella flexneri 2a str. 301
agaauuaaucgag

SEQ ID NO: 3918715 - RNA, 18 nt, Shigella flexneri 2a str. 301
agaauuagcguccggcug

SEQ ID NO: 3918716 - RNA, 21 nt, Shigella flexneri 2a str. 301
agaauucaauauauugcagga

SEQ ID NO: 3918717 - RNA, 17 nt, Shigella flexneri 2a str. 301
agaauugauaaaaaaaa

SEQ ID NO: 3918718 - RNA, 18 nt, Shigella flexneri 2a str. 301
agaauuucuuuacugaca

SEQ ID NO: 3918719 - RNA, 17 nt, Shigella flexneri 2a str. 301
agaauuuguaggccgga

SEQ ID NO: 3918720 - RNA, 14 nt, Shigella flexneri 2a str. 301
agaauuuuucacuc

SEQ ID NO: 3918721 - RNA, 17 nt, Shigella flexneri 2a str. 301
agacaaaauccugccag

SEQ ID NO: 3918722 - RNA, 13 nt, Shigella flexneri 2a str. 301
agacaaacagggu

SEQ ID NO: 3918723 - RNA, 23 nt, Shigella flexneri 2a str. 301
agacaaauuguuuaaucaacugc

SEQ ID NO: 3918724 - RNA, 15 nt, Shigella flexneri 2a str. 301
agacaaccaaaauca

SEQ ID NO: 3918725 - RNA, 13 nt, Shigella flexneri 2a str. 301
agacaacccacac

SEQ ID NO: 3918726 - RNA, 12 nt, Shigella flexneri 2a str. 301
agacaacuuccc

SEQ ID NO: 3918727 - RNA, 17 nt, Shigella flexneri 2a str. 301
agacaauaucggcacca

SEQ ID NO: 3918728 - RNA, 14 nt, Shigella flexneri 2a str. 301
agacaaucgccagu

SEQ ID NO: 3918729 - RNA, 12 nt, Shigella flexneri 2a str. 301
agacaauguuug

SEQ ID NO: 3918730 - RNA, 21 nt, Shigella flexneri 2a str. 301
agacaauugauggaaaauugu

SEQ ID NO: 3918731 - RNA, 20 nt, Shigella flexneri 2a str. 301
agacaauuuuucauaaucau

SEQ ID NO: 3918732 - RNA, 13 nt, Shigella flexneri 2a str. 301
agacaccaaggaa

SEQ ID NO: 3918733 - RNA, 19 nt, Shigella flexneri 2a str. 301
agacacccaccauaagccc

SEQ ID NO: 3918734 - RNA, 17 nt, Shigella flexneri 2a str. 301
agacaccccuucauuca

SEQ ID NO: 3918735 - RNA, 20 nt, Shigella flexneri 2a str. 301
agacaccccuucauucaggu

SEQ ID NO: 3918736 - RNA, 18 nt, Shigella flexneri 2a str. 301
agacaccuugcaacuccg

SEQ ID NO: 3918737 - RNA, 21 nt, Shigella flexneri 2a str. 301
agacacgccgccagaccaaua

SEQ ID NO: 3918738 - RNA, 16 nt, Shigella flexneri 2a str. 301
agacacgcugccccug

SEQ ID NO: 3918739 - RNA, 16 nt, Shigella flexneri 2a str. 301
agacacuaacgcgucu

SEQ ID NO: 3918740 - RNA, 16 nt, Shigella flexneri 2a str. 301
agacacuccagagaau

SEQ ID NO: 3918741 - RNA, 19 nt, Shigella flexneri 2a str. 301
agacacuccagagaauuua

SEQ ID NO: 3918742 - RNA, 16 nt, Shigella flexneri 2a str. 301
agacacugacgcgucu

SEQ ID NO: 3918743 - RNA, 13 nt, Shigella flexneri 2a str. 301
agacacuggaaac

SEQ ID NO: 3918744 - RNA, 13 nt, Shigella flexneri 2a str. 301
agacagaaucagg

SEQ ID NO: 3918745 - RNA, 15 nt, Shigella flexneri 2a str. 301
agacagacagccuca

SEQ ID NO: 3918746 - RNA, 17 nt, Shigella flexneri 2a str. 301
agacagacagccucaag

SEQ ID NO: 3918747 - RNA, 15 nt, Shigella flexneri 2a str. 301
agacagaccuggcgc

SEQ ID NO: 3918748 - RNA, 18 nt, Shigella flexneri 2a str. 301
agacagcaaagugccccc

SEQ ID NO: 3918749 - RNA, 15 nt, Shigella flexneri 2a str. 301
agacagcgacucucu

SEQ ID NO: 3918750 - RNA, 14 nt, Shigella flexneri 2a str. 301
agacauaacccagc

SEQ ID NO: 3918751 - RNA, 20 nt, Shigella flexneri 2a str. 301
agacauaaggaaacuccagc

SEQ ID NO: 3918752 - RNA, 21 nt, Shigella flexneri 2a str. 301
agacauaaggaaacuccagcc

SEQ ID NO: 3918753 - RNA, 17 nt, Shigella flexneri 2a str. 301
agacaucaccaguaccg

SEQ ID NO: 3918754 - RNA, 17 nt, Shigella flexneri 2a str. 301
agacaucccagugcaau

SEQ ID NO: 3918755 - RNA, 14 nt, Shigella flexneri 2a str. 301
agacaucgcaggga

SEQ ID NO: 3918756 - RNA, 14 nt, Shigella flexneri 2a str. 301
agacaugguaaaac

SEQ ID NO: 3918757 - RNA, 18 nt, Shigella flexneri 2a str. 301
agacauguggauuaaauu

SEQ ID NO: 3918758 - RNA, 22 nt, Shigella flexneri 2a str. 301
agacauuacguccaucacaauc

SEQ ID NO: 3918759 - RNA, 22 nt, Shigella flexneri 2a str. 301
agaccaaacugcuccuguauga

SEQ ID NO: 3918760 - RNA, 14 nt, Shigella flexneri 2a str. 301
agaccaauccagcc

SEQ ID NO: 3918761 - RNA, 23 nt, Shigella flexneri 2a str. 301
agaccaaucccgccauaacggcu

SEQ ID NO: 3918762 - RNA, 16 nt, Shigella flexneri 2a str. 301
agaccaauccgccagc

SEQ ID NO: 3918763 - RNA, 18 nt, Shigella flexneri 2a str. 301
agaccaauccgccagcca

SEQ ID NO: 3918764 - RNA, 18 nt, Shigella flexneri 2a str. 301
agaccaauggcuuuugcc

SEQ ID NO: 3918765 - RNA, 17 nt, Shigella flexneri 2a str. 301
agaccacucauuuuuuc

SEQ ID NO: 3918766 - RNA, 16 nt, Shigella flexneri 2a str. 301
agaccacuuuccucau

SEQ ID NO: 3918767 - RNA, 18 nt, Shigella flexneri 2a str. 301
agaccagaaacgccacca

SEQ ID NO: 3918768 - RNA, 12 nt, Shigella flexneri 2a str. 301
agaccagcaaaa

SEQ ID NO: 3918769 - RNA, 11 nt, Shigella flexneri 2a str. 301
agaccagcacc

SEQ ID NO: 3918770 - RNA, 19 nt, Shigella flexneri 2a str. 301
agaccaguaaagugcgcuu

SEQ ID NO: 3918771 - RNA, 20 nt, Shigella flexneri 2a str. 301
agaccaguuuuuucaccagc

SEQ ID NO: 3918772 - RNA, 22 nt, Shigella flexneri 2a str. 301
agaccaucaauuggaucugaug

SEQ ID NO: 3918773 - RNA, 17 nt, Shigella flexneri 2a str. 301
agaccauugcaucaucg

SEQ ID NO: 3918774 - RNA, 21 nt, Shigella flexneri 2a str. 301
agaccauuugaucgcuggcag

SEQ ID NO: 3918775 - RNA, 21 nt, Shigella flexneri 2a str. 301
agacccaguuucggcaucagc

SEQ ID NO: 3918776 - RNA, 23 nt, Shigella flexneri 2a str. 301
agacccaguuucggcaucagcag

SEQ ID NO: 3918777 - RNA, 15 nt, Shigella flexneri 2a str. 301
agaccccagguuuuc

SEQ ID NO: 3918778 - RNA, 20 nt, Shigella flexneri 2a str. 301
agaccccagguuuucaacgu

SEQ ID NO: 3918779 - RNA, 13 nt, Shigella flexneri 2a str. 301
agacccgccaccc

SEQ ID NO: 3918780 - RNA, 17 nt, Shigella flexneri 2a str. 301
agaccgauacacaucgu

SEQ ID NO: 3918781 - RNA, 15 nt, Shigella flexneri 2a str. 301
agaccgcagaagccg

SEQ ID NO: 3918782 - RNA, 13 nt, Shigella flexneri 2a str. 301
agaccgcaucacg

SEQ ID NO: 3918783 - RNA, 16 nt, Shigella flexneri 2a str. 301
agaccgcgcuaucagc

SEQ ID NO: 3918784 - RNA, 13 nt, Shigella flexneri 2a str. 301
agaccggcaacca

SEQ ID NO: 3918785 - RNA, 16 nt, Shigella flexneri 2a str. 301
agaccguugcucagaa

SEQ ID NO: 3918786 - RNA, 17 nt, Shigella flexneri 2a str. 301
agaccguugcucagaau

SEQ ID NO: 3918787 - RNA, 20 nt, Shigella flexneri 2a str. 301
agaccuaacuuggcaaagcu

SEQ ID NO: 3918788 - RNA, 15 nt, Shigella flexneri 2a str. 301
agaccugauccggau

SEQ ID NO: 3918789 - RNA, 13 nt, Shigella flexneri 2a str. 301
agaccugcguuca

SEQ ID NO: 3918790 - RNA, 14 nt, Shigella flexneri 2a str. 301
agaccuuaauugcu

SEQ ID NO: 3918791 - RNA, 15 nt, Shigella flexneri 2a str. 301
agaccuucugccaga

SEQ ID NO: 3918792 - RNA, 22 nt, Shigella flexneri 2a str. 301
agaccuuuacggcuugcgcgca

SEQ ID NO: 3918793 - RNA, 18 nt, Shigella flexneri 2a str. 301
agaccuuucgaacccaac

SEQ ID NO: 3918794 - RNA, 20 nt, Shigella flexneri 2a str. 301
agacgaacguuuaauaaaac

SEQ ID NO: 3918795 - RNA, 21 nt, Shigella flexneri 2a str. 301
agacgacggaagaucguugcc

SEQ ID NO: 3918796 - RNA, 15 nt, Shigella flexneri 2a str. 301
agacgagagugacga

SEQ ID NO: 3918797 - RNA, 19 nt, Shigella flexneri 2a str. 301
agacgauagaaccuuccau

SEQ ID NO: 3918798 - RNA, 15 nt, Shigella flexneri 2a str. 301
agacgaugaaaaaga

SEQ ID NO: 3918799 - RNA, 23 nt, Shigella flexneri 2a str. 301
agacgauuacucgccuuucacac

SEQ ID NO: 3918800 - RNA, 14 nt, Shigella flexneri 2a str. 301
agacgcaacagaaa

SEQ ID NO: 3918801 - RNA, 13 nt, Shigella flexneri 2a str. 301
agacgccacaauc

SEQ ID NO: 3918802 - RNA, 21 nt, Shigella flexneri 2a str. 301
agacgccacaaucucacccgc

SEQ ID NO: 3918803 - RNA, 23 nt, Shigella flexneri 2a str. 301
agaggcugaaggcgcuccccugc

SEQ ID NO: 3918804 - RNA, 20 nt, Shigella flexneri 2a str. 301
agagguaaaaccugacaaca

SEQ ID NO: 3918805 - RNA, 23 nt, Shigella flexneri 2a str. 301
agaggugggggauccaguccccc

SEQ ID NO: 3918806 - RNA, 20 nt, Shigella flexneri 2a str. 301
agaguaaagcccgccaucgc

SEQ ID NO: 3918807 - RNA, 19 nt, Shigella flexneri 2a str. 301
agaguaggcuggaucagac

SEQ ID NO: 3918808 - RNA, 14 nt, Shigella flexneri 2a str. 301
agaguaguaauugc

SEQ ID NO: 3918809 - RNA, 17 nt, Shigella flexneri 2a str. 301
agaguauccaugcgcau

SEQ ID NO: 3918810 - RNA, 20 nt, Shigella flexneri 2a str. 301
agaguaugcgcgucagagau

SEQ ID NO: 3918811 - RNA, 18 nt, Shigella flexneri 2a str. 301
agagugacgucauagcag

SEQ ID NO: 3918812 - RNA, 18 nt, Shigella flexneri 2a str. 301
agaguggauuaucuucac

SEQ ID NO: 3918813 - RNA, 16 nt, Shigella flexneri 2a str. 301
agagugguaaaggaga

SEQ ID NO: 3918814 - RNA, 22 nt, Shigella flexneri 2a str. 301
agaguuccggcccuaaacucuu

SEQ ID NO: 3918815 - RNA, 23 nt, Shigella flexneri 2a str. 301
agaguugagcaguccccacauca

SEQ ID NO: 3918816 - RNA, 15 nt, Shigella flexneri 2a str. 301
agaguugcaccagca

SEQ ID NO: 3918817 - RNA, 18 nt, Shigella flexneri 2a str. 301
agaguuucaacaucaucu

SEQ ID NO: 3918818 - RNA, 16 nt, Shigella flexneri 2a str. 301
agaguuuccaggcugg

SEQ ID NO: 3918819 - RNA, 16 nt, Shigella flexneri 2a str. 301
agaguuuuaaacgcag

SEQ ID NO: 3918820 - RNA, 13 nt, Shigella flexneri 2a str. 301
agauaaaaaugaa

SEQ ID NO: 3918821 - RNA, 18 nt, Shigella flexneri 2a str. 301
agauaaaauacacuuuaa

SEQ ID NO: 3918822 - RNA, 15 nt, Shigella flexneri 2a str. 301
agauaaaaugcgaaa

SEQ ID NO: 3918823 - RNA, 14 nt, Shigella flexneri 2a str. 301
agauaaaucacgcu

SEQ ID NO: 3918824 - RNA, 22 nt, Shigella flexneri 2a str. 301
agauaaaucacgcuucacccuu

SEQ ID NO: 3918825 - RNA, 15 nt, Shigella flexneri 2a str. 301
agauaaauuacugcc

SEQ ID NO: 3918826 - RNA, 16 nt, Shigella flexneri 2a str. 301
agauaacccagcagcc

SEQ ID NO: 3918827 - RNA, 20 nt, Shigella flexneri 2a str. 301
agauaagacgcgucaguguc

SEQ ID NO: 3918828 - RNA, 20 nt, Shigella flexneri 2a str. 301
agauaagacgcguuaguguc

SEQ ID NO: 3918829 - RNA, 17 nt, Shigella flexneri 2a str. 301
agauaagauaaauuccu

SEQ ID NO: 3918830 - RNA, 12 nt, Shigella flexneri 2a str. 301
agauaagcaagg

SEQ ID NO: 3918831 - RNA, 22 nt, Shigella flexneri 2a str. 301
agauaagcagcguguugcggag

SEQ ID NO: 3918832 - RNA, 18 nt, Shigella flexneri 2a str. 301
agauaaggcguucacgcc

SEQ ID NO: 3918833 - RNA, 19 nt, Shigella flexneri 2a str. 301
agauaaggugccaauccuu

SEQ ID NO: 3918834 - RNA, 22 nt, Shigella flexneri 2a str. 301
agauaaggugccaauccuucuu

SEQ ID NO: 3918835 - RNA, 16 nt, Shigella flexneri 2a str. 301
agauaauaauguguuc

SEQ ID NO: 3918836 - RNA, 18 nt, Shigella flexneri 2a str. 301
agauaauagauuugcgaa

SEQ ID NO: 3918837 - RNA, 12 nt, Shigella flexneri 2a str. 301
agauaauaggua

SEQ ID NO: 3918838 - RNA, 14 nt, Shigella flexneri 2a str. 301
agauaaucaccugc

SEQ ID NO: 3918839 - RNA, 20 nt, Shigella flexneri 2a str. 301
agauaauccccaaugaccuu

SEQ ID NO: 3918840 - RNA, 14 nt, Shigella flexneri 2a str. 301
agauaauggcuguu

SEQ ID NO: 3918841 - RNA, 15 nt, Shigella flexneri 2a str. 301
agauaauuuuuucuu

SEQ ID NO: 3918842 - RNA, 18 nt, Shigella flexneri 2a str. 301
agauaauuuuuucuucca

SEQ ID NO: 3918843 - RNA, 15 nt, Shigella flexneri 2a str. 301
agauacaaccaaucg

SEQ ID NO: 3918844 - RNA, 15 nt, Shigella flexneri 2a str. 301
agauacagccucuuu

SEQ ID NO: 3918845 - RNA, 12 nt, Shigella flexneri 2a str. 301
agauacaucagc

SEQ ID NO: 3918846 - RNA, 21 nt, Shigella flexneri 2a str. 301
agauacaucgcauaaaacaac

SEQ ID NO: 3918847 - RNA, 18 nt, Shigella flexneri 2a str. 301
agauaccuaacauuuuac

SEQ ID NO: 3918848 - RNA, 13 nt, Shigella flexneri 2a str. 301
agauaccuucuug

SEQ ID NO: 3918849 - RNA, 22 nt, Shigella flexneri 2a str. 301
agauacgaccguuccauucaaa

SEQ ID NO: 3918850 - RNA, 17 nt, Shigella flexneri 2a str. 301
agauacggauucuuaac

SEQ ID NO: 3918851 - RNA, 18 nt, Shigella flexneri 2a str. 301
agauacguuugccagugc

SEQ ID NO: 3918852 - RNA, 11 nt, Shigella flexneri 2a str. 301
agauacugcau

SEQ ID NO: 3918853 - RNA, 20 nt, Shigella flexneri 2a str. 301
agauagcacgacguuucuuu

SEQ ID NO: 3918854 - RNA, 13 nt, Shigella flexneri 2a str. 301
agauagccagcaa

SEQ ID NO: 3918855 - RNA, 19 nt, Shigella flexneri 2a str. 301
agauagccagguuuaccag

SEQ ID NO: 3918856 - RNA, 21 nt, Shigella flexneri 2a str. 301
agauagccagguuuaccagca

SEQ ID NO: 3918857 - RNA, 14 nt, Shigella flexneri 2a str. 301
agauagccugauca

SEQ ID NO: 3918858 - RNA, 21 nt, Shigella flexneri 2a str. 301
agauagcguucuuuaacugcc

SEQ ID NO: 3918859 - RNA, 15 nt, Shigella flexneri 2a str. 301
agauaggcaucagca

SEQ ID NO: 3918860 - RNA, 15 nt, Shigella flexneri 2a str. 301
agauaguugauuaau

SEQ ID NO: 3918861 - RNA, 16 nt, Shigella flexneri 2a str. 301
agauaguuuacugacu

SEQ ID NO: 3918862 - RNA, 21 nt, Shigella flexneri 2a str. 301
agauauaaacggguauuugau

SEQ ID NO: 3918863 - RNA, 21 nt, Shigella flexneri 2a str. 301
agauauaggucacaucaccgc

SEQ ID NO: 3918864 - RNA, 23 nt, Shigella flexneri 2a str. 301
agauaucccgccagcaccagcaa

SEQ ID NO: 3918865 - RNA, 12 nt, Shigella flexneri 2a str. 301
agauaugccagu

SEQ ID NO: 3918866 - RNA, 23 nt, Shigella flexneri 2a str. 301
agauauucgcucgccacuucugc

SEQ ID NO: 3918867 - RNA, 23 nt, Shigella flexneri 2a str. 301
agauauuggggguaauucccugc

SEQ ID NO: 3918868 - RNA, 16 nt, Shigella flexneri 2a str. 301
agauauuucaccagcg

SEQ ID NO: 3918869 - RNA, 15 nt, Shigella flexneri 2a str. 301
agauauuucagagcu

SEQ ID NO: 3918870 - RNA, 21 nt, Shigella flexneri 2a str. 301
agauauuuuuaugcaugaccu

SEQ ID NO: 3918871 - RNA, 14 nt, Shigella flexneri 2a str. 301
agaucaaacucuuu

SEQ ID NO: 3918872 - RNA, 15 nt, Shigella flexneri 2a str. 301
agaucaacacaucca

SEQ ID NO: 3918873 - RNA, 15 nt, Shigella flexneri 2a str. 301
agaucaccugcugga

SEQ ID NO: 3918874 - RNA, 12 nt, Shigella flexneri 2a str. 301
agaucagaccaa

SEQ ID NO: 3918875 - RNA, 13 nt, Shigella flexneri 2a str. 301
agauccagguuac

SEQ ID NO: 3918876 - RNA, 20 nt, Shigella flexneri 2a str. 301
agauccagugcucauccuuc

SEQ ID NO: 3918877 - RNA, 15 nt, Shigella flexneri 2a str. 301
agauccauaaggucc

SEQ ID NO: 3918878 - RNA, 16 nt, Shigella flexneri 2a str. 301
agauccauaagguccu

SEQ ID NO: 3918879 - RNA, 23 nt, Shigella flexneri 2a str. 301
agauccauaagguccuccagcuc

SEQ ID NO: 3918880 - RNA, 17 nt, Shigella flexneri 2a str. 301
agaucccauaaccaaca

SEQ ID NO: 3918881 - RNA, 14 nt, Shigella flexneri 2a str. 301
agaucccuucaccu

SEQ ID NO: 3918882 - RNA, 19 nt, Shigella flexneri 2a str. 301
agauccgccauuucuccuc

SEQ ID NO: 3918883 - RNA, 20 nt, Shigella flexneri 2a str. 301
agauccggaucccaccagac

SEQ ID NO: 3918884 - RNA, 18 nt, Shigella flexneri 2a str. 301
agauccgggcauauuucc

SEQ ID NO: 3918885 - RNA, 13 nt, Shigella flexneri 2a str. 301
agauccugaaauu

SEQ ID NO: 3918886 - RNA, 21 nt, Shigella flexneri 2a str. 301
agauccuggcgaaaacgcccg

SEQ ID NO: 3918887 - RNA, 22 nt, Shigella flexneri 2a str. 301
agauccuguuggccaacccgcg

SEQ ID NO: 3918888 - RNA, 14 nt, Shigella flexneri 2a str. 301
agaucgaucauauu

SEQ ID NO: 3918889 - RNA, 17 nt, Shigella flexneri 2a str. 301
agaucgccccggcaaga

SEQ ID NO: 3918890 - RNA, 16 nt, Shigella flexneri 2a str. 301
agaucgccgcuguaau

SEQ ID NO: 3918891 - RNA, 21 nt, Shigella flexneri 2a str. 301
agaucgcgaccgccuucaguc

SEQ ID NO: 3918892 - RNA, 20 nt, Shigella flexneri 2a str. 301
agaucgcgaugggucgccgc

SEQ ID NO: 3918893 - RNA, 20 nt, Shigella flexneri 2a str. 301
agaucgcuuucccagcgaug

SEQ ID NO: 3918894 - RNA, 14 nt, Shigella flexneri 2a str. 301
agaucggaugacgc

SEQ ID NO: 3918895 - RNA, 15 nt, Shigella flexneri 2a str. 301
agaucggccagcacc

SEQ ID NO: 3918896 - RNA, 15 nt, Shigella flexneri 2a str. 301
agaucgguugccaua

SEQ ID NO: 3918897 - RNA, 18 nt, Shigella flexneri 2a str. 301
agaucguucgcaccaaau

SEQ ID NO: 3918898 - RNA, 22 nt, Shigella flexneri 2a str. 301
agaucguucgcaccaaauccaa

SEQ ID NO: 3918899 - RNA, 20 nt, Shigella flexneri 2a str. 301
agaucucucuugcuaucacc

SEQ ID NO: 3918900 - RNA, 22 nt, Shigella flexneri 2a str. 301
agaucugcuucaggaauauguu

SEQ ID NO: 3918901 - RNA, 22 nt, Shigella flexneri 2a str. 301
agaucuugcgcgaccacgauau

SEQ ID NO: 3918902 - RNA, 16 nt, Shigella flexneri 2a str. 301
agaucuuucacgccca

SEQ ID NO: 3918903 - RNA, 13 nt, Shigella flexneri 2a str. 301
agcaacgcggcgg

SEQ ID NO: 3918904 - RNA, 16 nt, Shigella flexneri 2a str. 301
agcaacuccaucaagc

SEQ ID NO: 3918905 - RNA, 17 nt, Shigella flexneri 2a str. 301
agcaacucgaugcugcc

SEQ ID NO: 3918906 - RNA, 13 nt, Shigella flexneri 2a str. 301
agcaacugacugg

SEQ ID NO: 3918907 - RNA, 20 nt, Shigella flexneri 2a str. 301
agcaacugcgacguggauca

SEQ ID NO: 3918908 - RNA, 11 nt, Shigella flexneri 2a str. 301
agcaacugcgc

SEQ ID NO: 3918909 - RNA, 21 nt, Shigella flexneri 2a str. 301
agcaacuggcgaaucccuugu

SEQ ID NO: 3918910 - RNA, 16 nt, Shigella flexneri 2a str. 301
agcaacuuaaucauca

SEQ ID NO: 3918911 - RNA, 19 nt, Shigella flexneri 2a str. 301
agcaacuuaaucaucaaug

SEQ ID NO: 3918912 - RNA, 13 nt, Shigella flexneri 2a str. 301
agcaagagcaaau

SEQ ID NO: 3918913 - RNA, 14 nt, Shigella flexneri 2a str. 301
agcaagagcaaaua

SEQ ID NO: 3918914 - RNA, 16 nt, Shigella flexneri 2a str. 301
agcaagagcaaauaaa

SEQ ID NO: 3918915 - RNA, 14 nt, Shigella flexneri 2a str. 301
agcaagcauuauau

SEQ ID NO: 3918916 - RNA, 22 nt, Shigella flexneri 2a str. 301
agcaagcauuauauaaugccag

SEQ ID NO: 3918917 - RNA, 18 nt, Shigella flexneri 2a str. 301
agcaagccgucgugaaug

SEQ ID NO: 3918918 - RNA, 21 nt, Shigella flexneri 2a str. 301
agcaagcgcugagacgcgcuu

SEQ ID NO: 3918919 - RNA, 15 nt, Shigella flexneri 2a str. 301
agcaaggaaaaccag

SEQ ID NO: 3918920 - RNA, 15 nt, Shigella flexneri 2a str. 301
agcaaggcaaucugc

SEQ ID NO: 3918921 - RNA, 19 nt, Shigella flexneri 2a str. 301
agcaaggguuuguaggccg

SEQ ID NO: 3918922 - RNA, 18 nt, Shigella flexneri 2a str. 301
agcaagucggcaucgcca

SEQ ID NO: 3918923 - RNA, 19 nt, Shigella flexneri 2a str. 301
agcaagucggcaucgccac

SEQ ID NO: 3918924 - RNA, 16 nt, Shigella flexneri 2a str. 301
agcaagucuucacugc

SEQ ID NO: 3918925 - RNA, 18 nt, Shigella flexneri 2a str. 301
agcaagucuucacugcuc

SEQ ID NO: 3918926 - RNA, 19 nt, Shigella flexneri 2a str. 301
agcaauaaaaacuccgccg

SEQ ID NO: 3918927 - RNA, 16 nt, Shigella flexneri 2a str. 301
agcaauaauuucaaca

SEQ ID NO: 3918928 - RNA, 16 nt, Shigella flexneri 2a str. 301
agcaauagacaguucu

SEQ ID NO: 3918929 - RNA, 20 nt, Shigella flexneri 2a str. 301
agcaauagacaguucuuccu

SEQ ID NO: 3918930 - RNA, 21 nt, Shigella flexneri 2a str. 301
agcaauagccgccauacggaa

SEQ ID NO: 3918931 - RNA, 20 nt, Shigella flexneri 2a str. 301
agcaaucaucccaguggaua

SEQ ID NO: 3918932 - RNA, 18 nt, Shigella flexneri 2a str. 301
agcaauccauaccagcac

SEQ ID NO: 3918933 - RNA, 20 nt, Shigella flexneri 2a str. 301
agcaaucucuucaagcugcu

SEQ ID NO: 3918934 - RNA, 12 nt, Shigella flexneri 2a str. 301
agcaaugagcua

SEQ ID NO: 3918935 - RNA, 14 nt, Shigella flexneri 2a str. 301
agcaaugagcuaug

SEQ ID NO: 3918936 - RNA, 15 nt, Shigella flexneri 2a str. 301
agcaaugaucucaau

SEQ ID NO: 3918937 - RNA, 18 nt, Shigella flexneri 2a str. 301
agcaaugcaggcaccugc

SEQ ID NO: 3918938 - RNA, 17 nt, Shigella flexneri 2a str. 301
agcaaugcgcaucaaag

SEQ ID NO: 3918939 - RNA, 17 nt, Shigella flexneri 2a str. 301
agcaauguaaggugcau

SEQ ID NO: 3918940 - RNA, 14 nt, Shigella flexneri 2a str. 301
agcaauguugaacg

SEQ ID NO: 3918941 - RNA, 19 nt, Shigella flexneri 2a str. 301
agcaauguuucucuggcgc

SEQ ID NO: 3918942 - RNA, 20 nt, Shigella flexneri 2a str. 301
agcaauuccagcgccaguaa

SEQ ID NO: 3918943 - RNA, 15 nt, Shigella flexneri 2a str. 301
agcaauuuacgcuuu

SEQ ID NO: 3918944 - RNA, 14 nt, Shigella flexneri 2a str. 301
agcaauuucuccgc

SEQ ID NO: 3918945 - RNA, 21 nt, Shigella flexneri 2a str. 301
agcaauuugcgcucaauaauc

SEQ ID NO: 3918946 - RNA, 22 nt, Shigella flexneri 2a str. 301
agcaauuuuccuugaaaaagag

SEQ ID NO: 3918947 - RNA, 12 nt, Shigella flexneri 2a str. 301
agcaauuuugcc

SEQ ID NO: 3918948 - RNA, 17 nt, Shigella flexneri 2a str. 301
agcaauuuuuccugguu

SEQ ID NO: 3918949 - RNA, 17 nt, Shigella flexneri 2a str. 301
agcacaaaaauagcccc

SEQ ID NO: 3918950 - RNA, 21 nt, Shigella flexneri 2a str. 301
agcacaaaguggcggcuaccc

SEQ ID NO: 3918951 - RNA, 16 nt, Shigella flexneri 2a str. 301
agcacaauaaucagcc

SEQ ID NO: 3918952 - RNA, 20 nt, Shigella flexneri 2a str. 301
agcacaauaaucagcccaac

SEQ ID NO: 3918953 - RNA, 23 nt, Shigella flexneri 2a str. 301
agcacacauuauaggccugauaa

SEQ ID NO: 3918954 - RNA, 18 nt, Shigella flexneri 2a str. 301
agcacauagcaacuuuua

SEQ ID NO: 3918955 - RNA, 21 nt, Shigella flexneri 2a str. 301
agcacaucacucauaaugaug

SEQ ID NO: 3918956 - RNA, 13 nt, Shigella flexneri 2a str. 301
agcacaucagcca

SEQ ID NO: 3918957 - RNA, 14 nt, Shigella flexneri 2a str. 301
agcacaucagccag

SEQ ID NO: 3918958 - RNA, 14 nt, Shigella flexneri 2a str. 301
agcacaucaucaaa

SEQ ID NO: 3918959 - RNA, 20 nt, Shigella flexneri 2a str. 301
agcacaucuggcgagucacc

SEQ ID NO: 3918960 - RNA, 14 nt, Shigella flexneri 2a str. 301
agcacaugcugaca

SEQ ID NO: 3918961 - RNA, 13 nt, Shigella flexneri 2a str. 301
agcaccaaaagca

SEQ ID NO: 3918962 - RNA, 12 nt, Shigella flexneri 2a str. 301
agcaccagcaac

SEQ ID NO: 3918963 - RNA, 13 nt, Shigella flexneri 2a str. 301
agcaccagcaacg

SEQ ID NO: 3918964 - RNA, 18 nt, Shigella flexneri 2a str. 301
agcaccaggguaaaugca

SEQ ID NO: 3918965 - RNA, 21 nt, Shigella flexneri 2a str. 301
agcaccauccuguuccacugg

SEQ ID NO: 3918966 - RNA, 13 nt, Shigella flexneri 2a str. 301
agcaccaucgcug

SEQ ID NO: 3918967 - RNA, 19 nt, Shigella flexneri 2a str. 301
agcacccagaacgccgaau

SEQ ID NO: 3918968 - RNA, 14 nt, Shigella flexneri 2a str. 301
agcacccagcaauc

SEQ ID NO: 3918969 - RNA, 16 nt, Shigella flexneri 2a str. 301
agcacccugaguuuuc

SEQ ID NO: 3918970 - RNA, 18 nt, Shigella flexneri 2a str. 301
agcaccgcgaauuuuuuc

SEQ ID NO: 3918971 - RNA, 17 nt, Shigella flexneri 2a str. 301
agcaccgcgacaaucag

SEQ ID NO: 3918972 - RNA, 17 nt, Shigella flexneri 2a str. 301
agcaccgcgcuauuuuc

SEQ ID NO: 3918973 - RNA, 22 nt, Shigella flexneri 2a str. 301
agcaccgcgugcgcggcagcca

SEQ ID NO: 3918974 - RNA, 17 nt, Shigella flexneri 2a str. 301
agcaccugcgcaggcau

SEQ ID NO: 3918975 - RNA, 14 nt, Shigella flexneri 2a str. 301
agcacgaccgccau

SEQ ID NO: 3918976 - RNA, 14 nt, Shigella flexneri 2a str. 301
agcacgacuauuau

SEQ ID NO: 3918977 - RNA, 14 nt, Shigella flexneri 2a str. 301
agcacgaucagugc

SEQ ID NO: 3918978 - RNA, 13 nt, Shigella flexneri 2a str. 301
agcacgccagaca

SEQ ID NO: 3918979 - RNA, 22 nt, Shigella flexneri 2a str. 301
agcacgccagacaucaccagua

SEQ ID NO: 3918980 - RNA, 17 nt, Shigella flexneri 2a str. 301
agcacgccccggcggcc

SEQ ID NO: 3918981 - RNA, 16 nt, Shigella flexneri 2a str. 301
agcacgccuggaaagu

SEQ ID NO: 3918982 - RNA, 18 nt, Shigella flexneri 2a str. 301
agcacggauaccgcacgc

SEQ ID NO: 3918983 - RNA, 13 nt, Shigella flexneri 2a str. 301
agcacggcagcaa

SEQ ID NO: 3918984 - RNA, 15 nt, Shigella flexneri 2a str. 301
agcacggcagcaacg

SEQ ID NO: 3918985 - RNA, 18 nt, Shigella flexneri 2a str. 301
agcacgucuuccauugcc

SEQ ID NO: 3918986 - RNA, 14 nt, Shigella flexneri 2a str. 301
agcacguugaacug

SEQ ID NO: 3918987 - RNA, 14 nt, Shigella flexneri 2a str. 301
agcacuaucuugcu

SEQ ID NO: 3918988 - RNA, 15 nt, Shigella flexneri 2a str. 301
agcacuaugacugcc

SEQ ID NO: 3918989 - RNA, 20 nt, Shigella flexneri 2a str. 301
agcacucugacggauaguau

SEQ ID NO: 3918990 - RNA, 22 nt, Shigella flexneri 2a str. 301
agcacugccagaaucaagguga

SEQ ID NO: 3918991 - RNA, 18 nt, Shigella flexneri 2a str. 301
agcacugcgcccgccagc

SEQ ID NO: 3918992 - RNA, 12 nt, Shigella flexneri 2a str. 301
agcacuggggcu

SEQ ID NO: 3918993 - RNA, 14 nt, Shigella flexneri 2a str. 301
agcacuugcagcuc

SEQ ID NO: 3918994 - RNA, 20 nt, Shigella flexneri 2a str. 301
agcacuugcaggaacagugc

SEQ ID NO: 3918995 - RNA, 18 nt, Shigella flexneri 2a str. 301
agcacuuucgccugcggc

SEQ ID NO: 3918996 - RNA, 21 nt, Shigella flexneri 2a str. 301
agcacuuuucgcacugcaggc

SEQ ID NO: 3918997 - RNA, 15 nt, Shigella flexneri 2a str. 301
agcagaaaaagaagc

SEQ ID NO: 3918998 - RNA, 13 nt, Shigella flexneri 2a str. 301
agcagaaagcgga

SEQ ID NO: 3918999 - RNA, 13 nt, Shigella flexneri 2a str. 301
agcagaacaucag

SEQ ID NO: 3919000 - RNA, 14 nt, Shigella flexneri 2a str. 301
agcagaaccgccau

SEQ ID NO: 3919001 - RNA, 13 nt, Shigella flexneri 2a str. 301
agcagacaaccca

SEQ ID NO: 3919002 - RNA, 17 nt, Shigella flexneri 2a str. 301
agcagacaacccacaca

SEQ ID NO: 3919003 - RNA, 13 nt, Shigella flexneri 2a str. 301
agcagaccagcaa

SEQ ID NO: 3919004 - RNA, 21 nt, Shigella flexneri 2a str. 301
agcaucgcaacaugcuggccu

SEQ ID NO: 3919005 - RNA, 13 nt, Shigella flexneri 2a str. 301
agcaucgcaucaa

SEQ ID NO: 3919006 - RNA, 19 nt, Shigella flexneri 2a str. 301
agcaucgcauccggcacuu

SEQ ID NO: 3919007 - RNA, 16 nt, Shigella flexneri 2a str. 301
agcaucgcccccaucg

SEQ ID NO: 3919008 - RNA, 22 nt, Shigella flexneri 2a str. 301
agcaucggcagcgccagcgaag

SEQ ID NO: 3919009 - RNA, 21 nt, Shigella flexneri 2a str. 301
agcaucggugaggaucaccag

SEQ ID NO: 3919010 - RNA, 14 nt, Shigella flexneri 2a str. 301
agcaucgucaucag

SEQ ID NO: 3919011 - RNA, 16 nt, Shigella flexneri 2a str. 301
agcaucgucaucagcu

SEQ ID NO: 3919012 - RNA, 20 nt, Shigella flexneri 2a str. 301
agcaucgucaucagcuccau

SEQ ID NO: 3919013 - RNA, 14 nt, Shigella flexneri 2a str. 301
agcaucugguaacc

SEQ ID NO: 3919014 - RNA, 22 nt, Shigella flexneri 2a str. 301
agcaucuguucuuuuaacgcau

SEQ ID NO: 3919015 - RNA, 16 nt, Shigella flexneri 2a str. 301
agcaucuuaucacgau

SEQ ID NO: 3919016 - RNA, 14 nt, Shigella flexneri 2a str. 301
agcaucuuccagcg

SEQ ID NO: 3919017 - RNA, 13 nt, Shigella flexneri 2a str. 301
agcaugaaaugaa

SEQ ID NO: 3919018 - RNA, 18 nt, Shigella flexneri 2a str. 301
agcaugaaaugaaaauca

SEQ ID NO: 3919019 - RNA, 22 nt, Shigella flexneri 2a str. 301
agcaugaaaugaaaaucaccau

SEQ ID NO: 3919020 - RNA, 21 nt, Shigella flexneri 2a str. 301
agcaugacuaccggggacagg

SEQ ID NO: 3919021 - RNA, 24 nt, Shigella flexneri 2a str. 301
agcaugauauucacagggaauagc

SEQ ID NO: 3919022 - RNA, 21 nt, Shigella flexneri 2a str. 301
agcaugaucagcgcauagaga

SEQ ID NO: 3919023 - RNA, 19 nt, Shigella flexneri 2a str. 301
agcaugcauaacagauaaa

SEQ ID NO: 3919024 - RNA, 12 nt, Shigella flexneri 2a str. 301
agcaugcuggcu

SEQ ID NO: 3919025 - RNA, 18 nt, Shigella flexneri 2a str. 301
agcauggcuucuuccccg

SEQ ID NO: 3919026 - RNA, 23 nt, Shigella flexneri 2a str. 301
agcauggcuucuuccccggauga

SEQ ID NO: 3919027 - RNA, 17 nt, Shigella flexneri 2a str. 301
agcauguguaaccgcuu

SEQ ID NO: 3919028 - RNA, 17 nt, Shigella flexneri 2a str. 301
agcauuaaggcaagaaa

SEQ ID NO: 3919029 - RNA, 16 nt, Shigella flexneri 2a str. 301
agcauuaaugcgccca

SEQ ID NO: 3919030 - RNA, 18 nt, Shigella flexneri 2a str. 301
agcauuacccagauaaua

SEQ ID NO: 3919031 - RNA, 19 nt, Shigella flexneri 2a str. 301
agcauuacuuucggugacu

SEQ ID NO: 3919032 - RNA, 13 nt, Shigella flexneri 2a str. 301
agcauuauuuuua

SEQ ID NO: 3919033 - RNA, 22 nt, Shigella flexneri 2a str. 301
agcauuauuuuuaaacaucaaa

SEQ ID NO: 3919034 - RNA, 20 nt, Shigella flexneri 2a str. 301
agcauucagacacgccgcca

SEQ ID NO: 3919035 - RNA, 12 nt, Shigella flexneri 2a str. 301
agcauucaguua

SEQ ID NO: 3919036 - RNA, 14 nt, Shigella flexneri 2a str. 301
agcauuccagauac

SEQ ID NO: 3919037 - RNA, 14 nt, Shigella flexneri 2a str. 301
agcauucgcgcaca

SEQ ID NO: 3919038 - RNA, 21 nt, Shigella flexneri 2a str. 301
agcauugaugcguuagaugau

SEQ ID NO: 3919039 - RNA, 22 nt, Shigella flexneri 2a str. 301
agcauugccgccccggcucgcg

SEQ ID NO: 3919040 - RNA, 18 nt, Shigella flexneri 2a str. 301
agcauugcgccugcaggu

SEQ ID NO: 3919041 - RNA, 21 nt, Shigella flexneri 2a str. 301
agcauuggguaaaauggccga

SEQ ID NO: 3919042 - RNA, 23 nt, Shigella flexneri 2a str. 301
agcauuucaaaacggucacggcu

SEQ ID NO: 3919043 - RNA, 20 nt, Shigella flexneri 2a str. 301
agcauuuccuuaaaagugag

SEQ ID NO: 3919044 - RNA, 13 nt, Shigella flexneri 2a str. 301
agcauuucgcgau

SEQ ID NO: 3919045 - RNA, 16 nt, Shigella flexneri 2a str. 301
agcauuuucauccauu

SEQ ID NO: 3919046 - RNA, 20 nt, Shigella flexneri 2a str. 301
agcauuuucauccauuacca

SEQ ID NO: 3919047 - RNA, 12 nt, Shigella flexneri 2a str. 301
agccaaaaauga

SEQ ID NO: 3919048 - RNA, 17 nt, Shigella flexneri 2a str. 301
agccaaaacugcacugg

SEQ ID NO: 3919049 - RNA, 20 nt, Shigella flexneri 2a str. 301
agccaaacgcccagcuaauc

SEQ ID NO: 3919050 - RNA, 21 nt, Shigella flexneri 2a str. 301
agccaaagggcuggcaaugac

SEQ ID NO: 3919051 - RNA, 14 nt, Shigella flexneri 2a str. 301
agccaaauaaaauc

SEQ ID NO: 3919052 - RNA, 13 nt, Shigella flexneri 2a str. 301
agccaaaucaucc

SEQ ID NO: 3919053 - RNA, 13 nt, Shigella flexneri 2a str. 301
agccaaauccagc

SEQ ID NO: 3919054 - RNA, 16 nt, Shigella flexneri 2a str. 301
agccaaauccagcgca

SEQ ID NO: 3919055 - RNA, 19 nt, Shigella flexneri 2a str. 301
agccaaauccagcgccaca

SEQ ID NO: 3919056 - RNA, 13 nt, Shigella flexneri 2a str. 301
agccaacagcagc

SEQ ID NO: 3919057 - RNA, 19 nt, Shigella flexneri 2a str. 301
agccaacagcagccacacc

SEQ ID NO: 3919058 - RNA, 20 nt, Shigella flexneri 2a str. 301
agccaacagcagccacacca

SEQ ID NO: 3919059 - RNA, 22 nt, Shigella flexneri 2a str. 301
agccaacgaugaugacguaauc

SEQ ID NO: 3919060 - RNA, 20 nt, Shigella flexneri 2a str. 301
agccaacggcucaacgucuu

SEQ ID NO: 3919061 - RNA, 23 nt, Shigella flexneri 2a str. 301
agccaacguuucuggaaguaauc

SEQ ID NO: 3919062 - RNA, 17 nt, Shigella flexneri 2a str. 301
agccaacuuaccgccgg

SEQ ID NO: 3919063 - RNA, 12 nt, Shigella flexneri 2a str. 301
agccaagcaugu

SEQ ID NO: 3919064 - RNA, 20 nt, Shigella flexneri 2a str. 301
agccaagcgccgccucagcc

SEQ ID NO: 3919065 - RNA, 16 nt, Shigella flexneri 2a str. 301
agccaaucccggaagc

SEQ ID NO: 3919066 - RNA, 19 nt, Shigella flexneri 2a str. 301
agccaauuaacgaaaucuc

SEQ ID NO: 3919067 - RNA, 15 nt, Shigella flexneri 2a str. 301
agccaauugccauau

SEQ ID NO: 3919068 - RNA, 17 nt, Shigella flexneri 2a str. 301
agccacaauaaacgcgc

SEQ ID NO: 3919069 - RNA, 18 nt, Shigella flexneri 2a str. 301
agccacaaucgcagcgca

SEQ ID NO: 3919070 - RNA, 14 nt, Shigella flexneri 2a str. 301
agccacaccacuuu

SEQ ID NO: 3919071 - RNA, 15 nt, Shigella flexneri 2a str. 301
agccacaccuggugc

SEQ ID NO: 3919072 - RNA, 13 nt, Shigella flexneri 2a str. 301
agccacauagacg

SEQ ID NO: 3919073 - RNA, 18 nt, Shigella flexneri 2a str. 301
agccaccacaauugacca

SEQ ID NO: 3919074 - RNA, 17 nt, Shigella flexneri 2a str. 301
agccaccacgccaagaa

SEQ ID NO: 3919075 - RNA, 16 nt, Shigella flexneri 2a str. 301
agccaccacuugcagc

SEQ ID NO: 3919076 - RNA, 17 nt, Shigella flexneri 2a str. 301
agccaccagguucaaca

SEQ ID NO: 3919077 - RNA, 13 nt, Shigella flexneri 2a str. 301
agccaccaucccg

SEQ ID NO: 3919078 - RNA, 13 nt, Shigella flexneri 2a str. 301
agccaccgccagc

SEQ ID NO: 3919079 - RNA, 20 nt, Shigella flexneri 2a str. 301
agccaccuggcugcguuuuc

SEQ ID NO: 3919080 - RNA, 18 nt, Shigella flexneri 2a str. 301
agccacgaugauagccau

SEQ ID NO: 3919081 - RNA, 18 nt, Shigella flexneri 2a str. 301
agccacggcuccagcaau

SEQ ID NO: 3919082 - RNA, 21 nt, Shigella flexneri 2a str. 301
agccacuucuuccagcggcag

SEQ ID NO: 3919083 - RNA, 19 nt, Shigella flexneri 2a str. 301
agccagaccacccguaauc

SEQ ID NO: 3919084 - RNA, 20 nt, Shigella flexneri 2a str. 301
agccagagaagcgacuugug

SEQ ID NO: 3919085 - RNA, 15 nt, Shigella flexneri 2a str. 301
agccagcaccaggcu

SEQ ID NO: 3919086 - RNA, 17 nt, Shigella flexneri 2a str. 301
agccagcagagcaaaaa

SEQ ID NO: 3919087 - RNA, 15 nt, Shigella flexneri 2a str. 301
agccagcagcgaauc

SEQ ID NO: 3919088 - RNA, 12 nt, Shigella flexneri 2a str. 301
agccagccaacg

SEQ ID NO: 3919089 - RNA, 14 nt, Shigella flexneri 2a str. 301
agccagccagaauc

SEQ ID NO: 3919090 - RNA, 15 nt, Shigella flexneri 2a str. 301
agccagccccacagc

SEQ ID NO: 3919091 - RNA, 17 nt, Shigella flexneri 2a str. 301
agccagccccacagcag

SEQ ID NO: 3919092 - RNA, 16 nt, Shigella flexneri 2a str. 301
agccagcggcggcaca

SEQ ID NO: 3919093 - RNA, 19 nt, Shigella flexneri 2a str. 301
agccaggaaccaccgaugc

SEQ ID NO: 3919094 - RNA, 17 nt, Shigella flexneri 2a str. 301
agccaggacgcagucca

SEQ ID NO: 3919095 - RNA, 15 nt, Shigella flexneri 2a str. 301
agccaggcacgccgc

SEQ ID NO: 3919096 - RNA, 18 nt, Shigella flexneri 2a str. 301
agccagguuuaccagcag

SEQ ID NO: 3919097 - RNA, 17 nt, Shigella flexneri 2a str. 301
agccaguucgagaaaaa

SEQ ID NO: 3919098 - RNA, 16 nt, Shigella flexneri 2a str. 301
agccaguuuuucuuuu

SEQ ID NO: 3919099 - RNA, 17 nt, Shigella flexneri 2a str. 301
agccaguuuuucuuuuu

SEQ ID NO: 3919100 - RNA, 13 nt, Shigella flexneri 2a str. 301
agccauaaagaaa

SEQ ID NO: 3919101 - RNA, 22 nt, Shigella flexneri 2a str. 301
agccauaaagaaaucaccugcc

SEQ ID NO: 3919102 - RNA, 22 nt, Shigella flexneri 2a str. 301
agccauaaucacucuuccccgc

SEQ ID NO: 3919103 - RNA, 15 nt, Shigella flexneri 2a str. 301
agccaucaaucccau

SEQ ID NO: 3919104 - RNA, 22 nt, Shigella flexneri 2a str. 301
agccugccauuggcaggcucug

SEQ ID NO: 3919105 - RNA, 19 nt, Shigella flexneri 2a str. 301
agccugcuguccggcgaga

SEQ ID NO: 3919106 - RNA, 16 nt, Shigella flexneri 2a str. 301
agccuggcuaagccac

SEQ ID NO: 3919107 - RNA, 15 nt, Shigella flexneri 2a str. 301
agccuguaccacaac

SEQ ID NO: 3919108 - RNA, 17 nt, Shigella flexneri 2a str. 301
agccuguaccacaaccu

SEQ ID NO: 3919109 - RNA, 18 nt, Shigella flexneri 2a str. 301
agccuguccacacccaga

SEQ ID NO: 3919110 - RNA, 19 nt, Shigella flexneri 2a str. 301
agccugugucaggccggca

SEQ ID NO: 3919111 - RNA, 14 nt, Shigella flexneri 2a str. 301
agccuucagugccg

SEQ ID NO: 3919112 - RNA, 21 nt, Shigella flexneri 2a str. 301
agccuucgccuuucaguucaa

SEQ ID NO: 3919113 - RNA, 22 nt, Shigella flexneri 2a str. 301
agccuucgcgcaaccaacggcc

SEQ ID NO: 3919114 - RNA, 21 nt, Shigella flexneri 2a str. 301
agccuucggacguuugccaug

SEQ ID NO: 3919115 - RNA, 13 nt, Shigella flexneri 2a str. 301
agccuugccagau

SEQ ID NO: 3919116 - RNA, 14 nt, Shigella flexneri 2a str. 301
agccuugcgugccu

SEQ ID NO: 3919117 - RNA, 12 nt, Shigella flexneri 2a str. 301
agccuuucacuu

SEQ ID NO: 3919118 - RNA, 22 nt, Shigella flexneri 2a str. 301
agccuuucacuucggucaccgu

SEQ ID NO: 3919119 - RNA, 12 nt, Shigella flexneri 2a str. 301
agccuuucgcaa

SEQ ID NO: 3919120 - RNA, 15 nt, Shigella flexneri 2a str. 301
agccuuuuucagccg

SEQ ID NO: 3919121 - RNA, 18 nt, Shigella flexneri 2a str. 301
agccuuuuucagccgcaa

SEQ ID NO: 3919122 - RNA, 19 nt, Shigella flexneri 2a str. 301
agcgaaacauacaggcuaa

SEQ ID NO: 3919123 - RNA, 16 nt, Shigella flexneri 2a str. 301
agcgaagcgaacaucg

SEQ ID NO: 3919124 - RNA, 17 nt, Shigella flexneri 2a str. 301
agcgaagcgaacaucga

SEQ ID NO: 3919125 - RNA, 14 nt, Shigella flexneri 2a str. 301
agcgaagcgugauu

SEQ ID NO: 3919126 - RNA, 15 nt, Shigella flexneri 2a str. 301
agcgaaggaucaccc

SEQ ID NO: 3919127 - RNA, 15 nt, Shigella flexneri 2a str. 301
agcgaauccagcaug

SEQ ID NO: 3919128 - RNA, 23 nt, Shigella flexneri 2a str. 301
agcgaauccagcaugcucaccac

SEQ ID NO: 3919129 - RNA, 14 nt, Shigella flexneri 2a str. 301
agcgaaugaaagaa

SEQ ID NO: 3919130 - RNA, 16 nt, Shigella flexneri 2a str. 301
agcgaaugugccguaa

SEQ ID NO: 3919131 - RNA, 12 nt, Shigella flexneri 2a str. 301
agcgaauuuuuc

SEQ ID NO: 3919132 - RNA, 23 nt, Shigella flexneri 2a str. 301
agcgacaccucccagcgcgguga

SEQ ID NO: 3919133 - RNA, 21 nt, Shigella flexneri 2a str. 301
agcgaccauacagcagcaacg

SEQ ID NO: 3919134 - RNA, 21 nt, Shigella flexneri 2a str. 301
agcgacgggcgacaaacgcug

SEQ ID NO: 3919135 - RNA, 22 nt, Shigella flexneri 2a str. 301
agcgacuaccacguaacgacug

SEQ ID NO: 3919136 - RNA, 16 nt, Shigella flexneri 2a str. 301
agcgacucucugagcc

SEQ ID NO: 3919137 - RNA, 19 nt, Shigella flexneri 2a str. 301
agcgacuucuucccaccau

SEQ ID NO: 3919138 - RNA, 19 nt, Shigella flexneri 2a str. 301
agcgacuugucgcccguca

SEQ ID NO: 3919139 - RNA, 16 nt, Shigella flexneri 2a str. 301
agcgagcuggcgcuga

SEQ ID NO: 3919140 - RNA, 18 nt, Shigella flexneri 2a str. 301
agcgagcuggcgcugaua

SEQ ID NO: 3919141 - RNA, 21 nt, Shigella flexneri 2a str. 301
agcgagggagaaaacccggcc

SEQ ID NO: 3919142 - RNA, 14 nt, Shigella flexneri 2a str. 301
agcgaguugaucac

SEQ ID NO: 3919143 - RNA, 12 nt, Shigella flexneri 2a str. 301
agcgaguuuuuc

SEQ ID NO: 3919144 - RNA, 15 nt, Shigella flexneri 2a str. 301
agcgauaauuuaugc

SEQ ID NO: 3919145 - RNA, 19 nt, Shigella flexneri 2a str. 301
agcgauacaucaucacugc

SEQ ID NO: 3919146 - RNA, 22 nt, Shigella flexneri 2a str. 301
agcgauauccagugccagaaug

SEQ ID NO: 3919147 - RNA, 22 nt, Shigella flexneri 2a str. 301
agcgaucauuagcccaauaauc

SEQ ID NO: 3919148 - RNA, 19 nt, Shigella flexneri 2a str. 301
agcgaugcccagugaccaa

SEQ ID NO: 3919149 - RNA, 11 nt, Shigella flexneri 2a str. 301
agcgaugcugc

SEQ ID NO: 3919150 - RNA, 22 nt, Shigella flexneri 2a str. 301
agcgaugguacuucaaucgcca

SEQ ID NO: 3919151 - RNA, 15 nt, Shigella flexneri 2a str. 301
agcgauggugguggg

SEQ ID NO: 3919152 - RNA, 23 nt, Shigella flexneri 2a str. 301
agcgaugguggugggggaaggau

SEQ ID NO: 3919153 - RNA, 18 nt, Shigella flexneri 2a str. 301
agcgauuaccauuucacc

SEQ ID NO: 3919154 - RNA, 21 nt, Shigella flexneri 2a str. 301
agcgauucccguuuauggucg

SEQ ID NO: 3919155 - RNA, 16 nt, Shigella flexneri 2a str. 301
agcgauuuaugauauu

SEQ ID NO: 3919156 - RNA, 20 nt, Shigella flexneri 2a str. 301
agcgauuuguaggccugaua

SEQ ID NO: 3919157 - RNA, 20 nt, Shigella flexneri 2a str. 301
agcgcaaaauaccagcaauu

SEQ ID NO: 3919158 - RNA, 17 nt, Shigella flexneri 2a str. 301
agcgcaaaggccagcaa

SEQ ID NO: 3919159 - RNA, 19 nt, Shigella flexneri 2a str. 301
agcgcaaaggccagcaauc

SEQ ID NO: 3919160 - RNA, 15 nt, Shigella flexneri 2a str. 301
agcgcaaauugcugg

SEQ ID NO: 3919161 - RNA, 14 nt, Shigella flexneri 2a str. 301
agcgcaaucaccac

SEQ ID NO: 3919162 - RNA, 22 nt, Shigella flexneri 2a str. 301
agcgcaauccaccauuggcgca

SEQ ID NO: 3919163 - RNA, 14 nt, Shigella flexneri 2a str. 301
agcgcaccaauuca

SEQ ID NO: 3919164 - RNA, 12 nt, Shigella flexneri 2a str. 301
agcgcaccagaa

SEQ ID NO: 3919165 - RNA, 17 nt, Shigella flexneri 2a str. 301
agcgcaccagaaacaau

SEQ ID NO: 3919166 - RNA, 20 nt, Shigella flexneri 2a str. 301
agcgcaccugaucagcaauc

SEQ ID NO: 3919167 - RNA, 16 nt, Shigella flexneri 2a str. 301
agcgcagauagcccgg

SEQ ID NO: 3919168 - RNA, 13 nt, Shigella flexneri 2a str. 301
agcgcagcgcauc

SEQ ID NO: 3919169 - RNA, 15 nt, Shigella flexneri 2a str. 301
agcgcagcgcaucag

SEQ ID NO: 3919170 - RNA, 21 nt, Shigella flexneri 2a str. 301
agcgcaggaaagauaagcgaa

SEQ ID NO: 3919171 - RNA, 15 nt, Shigella flexneri 2a str. 301
agcgcagucaccagc

SEQ ID NO: 3919172 - RNA, 18 nt, Shigella flexneri 2a str. 301
agcgcagucaccagcauc

SEQ ID NO: 3919173 - RNA, 15 nt, Shigella flexneri 2a str. 301
agcgcauaagccacc

SEQ ID NO: 3919174 - RNA, 16 nt, Shigella flexneri 2a str. 301
agcgcauaagccaccu

SEQ ID NO: 3919175 - RNA, 17 nt, Shigella flexneri 2a str. 301
agcgcauaagccaccuc

SEQ ID NO: 3919176 - RNA, 21 nt, Shigella flexneri 2a str. 301
agcgcaucaggcaaucuuguu

SEQ ID NO: 3919177 - RNA, 22 nt, Shigella flexneri 2a str. 301
agcgcaucaggcauuacggauc

SEQ ID NO: 3919178 - RNA, 13 nt, Shigella flexneri 2a str. 301
agcgcauccggca

SEQ ID NO: 3919179 - RNA, 21 nt, Shigella flexneri 2a str. 301
agcgcauccggcaccagcgca

SEQ ID NO: 3919180 - RNA, 19 nt, Shigella flexneri 2a str. 301
agcgcauggcguccgucau

SEQ ID NO: 3919181 - RNA, 19 nt, Shigella flexneri 2a str. 301
agcgcauuuccaagauuaa

SEQ ID NO: 3919182 - RNA, 20 nt, Shigella flexneri 2a str. 301
agcgccaccacaaaagcggu

SEQ ID NO: 3919183 - RNA, 22 nt, Shigella flexneri 2a str. 301
agcgccaccacaaaagcgguga

SEQ ID NO: 3919184 - RNA, 16 nt, Shigella flexneri 2a str. 301
agcgccaccaccagca

SEQ ID NO: 3919185 - RNA, 17 nt, Shigella flexneri 2a str. 301
agcgccaccaccagcac

SEQ ID NO: 3919186 - RNA, 20 nt, Shigella flexneri 2a str. 301
agcgccaccaccagcacacu

SEQ ID NO: 3919187 - RNA, 23 nt, Shigella flexneri 2a str. 301
agcgccaccagcgccgcgccacu

SEQ ID NO: 3919188 - RNA, 14 nt, Shigella flexneri 2a str. 301
agcgccaccgguuu

SEQ ID NO: 3919189 - RNA, 21 nt, Shigella flexneri 2a str. 301
agcgccacgcuguucgcaacc

SEQ ID NO: 3919190 - RNA, 17 nt, Shigella flexneri 2a str. 301
agcgccacgggcaauaa

SEQ ID NO: 3919191 - RNA, 14 nt, Shigella flexneri 2a str. 301
agcgccagaaggga

SEQ ID NO: 3919192 - RNA, 16 nt, Shigella flexneri 2a str. 301
agcgccagaagggaca

SEQ ID NO: 3919193 - RNA, 20 nt, Shigella flexneri 2a str. 301
agcgccagaaguugcucaag

SEQ ID NO: 3919194 - RNA, 21 nt, Shigella flexneri 2a str. 301
agcgccagaaguugcucaagc

SEQ ID NO: 3919195 - RNA, 17 nt, Shigella flexneri 2a str. 301
agcgccagacaaaccac

SEQ ID NO: 3919196 - RNA, 23 nt, Shigella flexneri 2a str. 301
agcgccagauaugaucgaaaaug

SEQ ID NO: 3919197 - RNA, 22 nt, Shigella flexneri 2a str. 301
agcgccagcaagagcaaauaaa

SEQ ID NO: 3919198 - RNA, 12 nt, Shigella flexneri 2a str. 301
agcgccagcaug

SEQ ID NO: 3919199 - RNA, 15 nt, Shigella flexneri 2a str. 301
agcgccagccauuca

SEQ ID NO: 3919200 - RNA, 13 nt, Shigella flexneri 2a str. 301
agcgccagcgaag

SEQ ID NO: 3919201 - RNA, 19 nt, Shigella flexneri 2a str. 301
agcgccagcgaagccagcu

SEQ ID NO: 3919202 - RNA, 19 nt, Shigella flexneri 2a str. 301
agcgccagggcaugguacc

SEQ ID NO: 3919203 - RNA, 16 nt, Shigella flexneri 2a str. 301
agcgccaguuuuuguu

SEQ ID NO: 3919204 - RNA, 15 nt, Shigella flexneri 2a str. 301
agcgugacuggcagg

SEQ ID NO: 3919205 - RNA, 19 nt, Shigella flexneri 2a str. 301
agcgugccaggcgcgcuuc

SEQ ID NO: 3919206 - RNA, 23 nt, Shigella flexneri 2a str. 301
agcgugcucucaaauaucugccg

SEQ ID NO: 3919207 - RNA, 11 nt, Shigella flexneri 2a str. 301
agcgugcuggu

SEQ ID NO: 3919208 - RNA, 14 nt, Shigella flexneri 2a str. 301
agcguggucauggc

SEQ ID NO: 3919209 - RNA, 20 nt, Shigella flexneri 2a str. 301
agcguggugauaccagacca

SEQ ID NO: 3919210 - RNA, 22 nt, Shigella flexneri 2a str. 301
agcguguaaaaagauaaacggc

SEQ ID NO: 3919211 - RNA, 20 nt, Shigella flexneri 2a str. 301
agcguguuaaugcccaucag

SEQ ID NO: 3919212 - RNA, 13 nt, Shigella flexneri 2a str. 301
agcguuaccggcu

SEQ ID NO: 3919213 - RNA, 16 nt, Shigella flexneri 2a str. 301
agcguuacuucaccuu

SEQ ID NO: 3919214 - RNA, 17 nt, Shigella flexneri 2a str. 301
agcguucaaaacggcug

SEQ ID NO: 3919215 - RNA, 23 nt, Shigella flexneri 2a str. 301
agcguucagugaucgccugcaug

SEQ ID NO: 3919216 - RNA, 19 nt, Shigella flexneri 2a str. 301
agcguuccacgugcggccg

SEQ ID NO: 3919217 - RNA, 20 nt, Shigella flexneri 2a str. 301
agcguuccauaauggcgcga

SEQ ID NO: 3919218 - RNA, 17 nt, Shigella flexneri 2a str. 301
agcguuccauugggcug

SEQ ID NO: 3919219 - RNA, 17 nt, Shigella flexneri 2a str. 301
agcguucgccaaaccca

SEQ ID NO: 3919220 - RNA, 18 nt, Shigella flexneri 2a str. 301
agcguucuuuaacugccg

SEQ ID NO: 3919221 - RNA, 14 nt, Shigella flexneri 2a str. 301
agcguugcgccuga

SEQ ID NO: 3919222 - RNA, 14 nt, Shigella flexneri 2a str. 301
agcguugcgccugu

SEQ ID NO: 3919223 - RNA, 15 nt, Shigella flexneri 2a str. 301
agcguuguaacaauc

SEQ ID NO: 3919224 - RNA, 12 nt, Shigella flexneri 2a str. 301
agcguuucaaca

SEQ ID NO: 3919225 - RNA, 18 nt, Shigella flexneri 2a str. 301
agcguuucaacaaacgau

SEQ ID NO: 3919226 - RNA, 22 nt, Shigella flexneri 2a str. 301
agcguuuccagcaccaguucac

SEQ ID NO: 3919227 - RNA, 14 nt, Shigella flexneri 2a str. 301
agcguuuccagcca

SEQ ID NO: 3919228 - RNA, 13 nt, Shigella flexneri 2a str. 301
agcguuuucucaa

SEQ ID NO: 3919229 - RNA, 22 nt, Shigella flexneri 2a str. 301
agcguuuuuucaucggcaguuu

SEQ ID NO: 3919230 - RNA, 20 nt, Shigella flexneri 2a str. 301
agcuaaacagcccaaucauc

SEQ ID NO: 3919231 - RNA, 13 nt, Shigella flexneri 2a str. 301
agcuaaaucacac

SEQ ID NO: 3919232 - RNA, 14 nt, Shigella flexneri 2a str. 301
agcuaaucaucauc

SEQ ID NO: 3919233 - RNA, 23 nt, Shigella flexneri 2a str. 301
agcuaauuuuuguuguuuaaaug

SEQ ID NO: 3919234 - RNA, 15 nt, Shigella flexneri 2a str. 301
agcuaccacgccgau

SEQ ID NO: 3919235 - RNA, 19 nt, Shigella flexneri 2a str. 301
agcuauaaaccugcuggcg

SEQ ID NO: 3919236 - RNA, 13 nt, Shigella flexneri 2a str. 301
agcuauaacguug

SEQ ID NO: 3919237 - RNA, 20 nt, Shigella flexneri 2a str. 301
agcuauauuuugccggacgc

SEQ ID NO: 3919238 - RNA, 21 nt, Shigella flexneri 2a str. 301
agcuauguuugaaccagauau

SEQ ID NO: 3919239 - RNA, 19 nt, Shigella flexneri 2a str. 301
agcucaaacgaaugcaggc

SEQ ID NO: 3919240 - RNA, 13 nt, Shigella flexneri 2a str. 301
agcucaacgcgug

SEQ ID NO: 3919241 - RNA, 22 nt, Shigella flexneri 2a str. 301
agcucacaaauacgcuuuuucc

SEQ ID NO: 3919242 - RNA, 12 nt, Shigella flexneri 2a str. 301
agcucagugacc

SEQ ID NO: 3919243 - RNA, 16 nt, Shigella flexneri 2a str. 301
agcucaguuaacggca

SEQ ID NO: 3919244 - RNA, 23 nt, Shigella flexneri 2a str. 301
agcucaguugguuagagcacauc

SEQ ID NO: 3919245 - RNA, 19 nt, Shigella flexneri 2a str. 301
agcucauaaccguccaguu

SEQ ID NO: 3919246 - RNA, 22 nt, Shigella flexneri 2a str. 301
agcucaucaagcuguucuuccc

SEQ ID NO: 3919247 - RNA, 11 nt, Shigella flexneri 2a str. 301
agcucaucguu

SEQ ID NO: 3919248 - RNA, 18 nt, Shigella flexneri 2a str. 301
agcucaucguuacgccca

SEQ ID NO: 3919249 - RNA, 15 nt, Shigella flexneri 2a str. 301
agcucaucuaaugca

SEQ ID NO: 3919250 - RNA, 19 nt, Shigella flexneri 2a str. 301
agcucaugggcuuucauca

SEQ ID NO: 3919251 - RNA, 18 nt, Shigella flexneri 2a str. 301
agcuccacaagaaugccu

SEQ ID NO: 3919252 - RNA, 21 nt, Shigella flexneri 2a str. 301
agcuccacaagaaugccugcc

SEQ ID NO: 3919253 - RNA, 16 nt, Shigella flexneri 2a str. 301
agcuccagccgcuccc

SEQ ID NO: 3919254 - RNA, 14 nt, Shigella flexneri 2a str. 301
agcuccagguccuc

SEQ ID NO: 3919255 - RNA, 18 nt, Shigella flexneri 2a str. 301
agcuccauccaccagccc

SEQ ID NO: 3919256 - RNA, 13 nt, Shigella flexneri 2a str. 301
agcucccaggcuc

SEQ ID NO: 3919257 - RNA, 15 nt, Shigella flexneri 2a str. 301
agcuccguccagcca

SEQ ID NO: 3919258 - RNA, 22 nt, Shigella flexneri 2a str. 301
agcuccguccagccaccgcgug

SEQ ID NO: 3919259 - RNA, 18 nt, Shigella flexneri 2a str. 301
agcuccucgaguccuucc

SEQ ID NO: 3919260 - RNA, 23 nt, Shigella flexneri 2a str. 301
agcuccucgaguccuuccagguc

SEQ ID NO: 3919261 - RNA, 17 nt, Shigella flexneri 2a str. 301
agcuccucuuucaucuc

SEQ ID NO: 3919262 - RNA, 18 nt, Shigella flexneri 2a str. 301
agcucgcaagccacgccg

SEQ ID NO: 3919263 - RNA, 16 nt, Shigella flexneri 2a str. 301
agcucgcuucaucugc

SEQ ID NO: 3919264 - RNA, 14 nt, Shigella flexneri 2a str. 301
agcucggauaaggc

SEQ ID NO: 3919265 - RNA, 18 nt, Shigella flexneri 2a str. 301
agcucucagacgauuacu

SEQ ID NO: 3919266 - RNA, 17 nt, Shigella flexneri 2a str. 301
agcucucuuccaguucg

SEQ ID NO: 3919267 - RNA, 16 nt, Shigella flexneri 2a str. 301
agcucugauauucccg

SEQ ID NO: 3919268 - RNA, 18 nt, Shigella flexneri 2a str. 301
agcucugguguggagugc

SEQ ID NO: 3919269 - RNA, 14 nt, Shigella flexneri 2a str. 301
agcucuucuucacu

SEQ ID NO: 3919270 - RNA, 22 nt, Shigella flexneri 2a str. 301
agcucuucuucacucucaccac

SEQ ID NO: 3919271 - RNA, 15 nt, Shigella flexneri 2a str. 301
agcucuuucgacagc

SEQ ID NO: 3919272 - RNA, 19 nt, Shigella flexneri 2a str. 301
agcucuuucgacagcgauu

SEQ ID NO: 3919273 - RNA, 23 nt, Shigella flexneri 2a str. 301
agcucuuuuaacuuacgcgucag

SEQ ID NO: 3919274 - RNA, 16 nt, Shigella flexneri 2a str. 301
agcucuuuuccagcca

SEQ ID NO: 3919275 - RNA, 18 nt, Shigella flexneri 2a str. 301
agcugaaaauggcgcugu

SEQ ID NO: 3919276 - RNA, 17 nt, Shigella flexneri 2a str. 301
agcugaagcucguuguu

SEQ ID NO: 3919277 - RNA, 18 nt, Shigella flexneri 2a str. 301
agcugaagcucguuguuu

SEQ ID NO: 3919278 - RNA, 22 nt, Shigella flexneri 2a str. 301
agcugaauaucacgggcgcgga

SEQ ID NO: 3919279 - RNA, 21 nt, Shigella flexneri 2a str. 301
agcugaauuucaucaccagcu

SEQ ID NO: 3919280 - RNA, 18 nt, Shigella flexneri 2a str. 301
agcugaugauuaacagca

SEQ ID NO: 3919281 - RNA, 16 nt, Shigella flexneri 2a str. 301
agcugauuucuggcgg

SEQ ID NO: 3919282 - RNA, 22 nt, Shigella flexneri 2a str. 301
agcugcauccgggguucgaauc

SEQ ID NO: 3919283 - RNA, 23 nt, Shigella flexneri 2a str. 301
agcugcauuucauauucaaaauc

SEQ ID NO: 3919284 - RNA, 12 nt, Shigella flexneri 2a str. 301
agcugcccggcu

SEQ ID NO: 3919285 - RNA, 14 nt, Shigella flexneri 2a str. 301
agcugccgccaggc

SEQ ID NO: 3919286 - RNA, 19 nt, Shigella flexneri 2a str. 301
agcugccuguacggcagug

SEQ ID NO: 3919287 - RNA, 17 nt, Shigella flexneri 2a str. 301
agcugcgcguuaucuac

SEQ ID NO: 3919288 - RNA, 22 nt, Shigella flexneri 2a str. 301
agcugcggauccugagcaaaca

SEQ ID NO: 3919289 - RNA, 16 nt, Shigella flexneri 2a str. 301
agcugcucccagcgca

SEQ ID NO: 3919290 - RNA, 17 nt, Shigella flexneri 2a str. 301
agcugcucccagcgcau

SEQ ID NO: 3919291 - RNA, 19 nt, Shigella flexneri 2a str. 301
agcugcucgcgagaacggc

SEQ ID NO: 3919292 - RNA, 14 nt, Shigella flexneri 2a str. 301
agcugcucgcggug

SEQ ID NO: 3919293 - RNA, 17 nt, Shigella flexneri 2a str. 301
agcuggcagaaguuguc

SEQ ID NO: 3919294 - RNA, 21 nt, Shigella flexneri 2a str. 301
agcuggcaucgcaaacaugcc

SEQ ID NO: 3919295 - RNA, 16 nt, Shigella flexneri 2a str. 301
agcuggcgauauuauc

SEQ ID NO: 3919296 - RNA, 19 nt, Shigella flexneri 2a str. 301
agcuggcucgacaaaauga

SEQ ID NO: 3919297 - RNA, 22 nt, Shigella flexneri 2a str. 301
agcugggccguuguucucgacg

SEQ ID NO: 3919298 - RNA, 20 nt, Shigella flexneri 2a str. 301
agcugggcgauuuucuacuu

SEQ ID NO: 3919299 - RNA, 14 nt, Shigella flexneri 2a str. 301
agcugggcgguggc

SEQ ID NO: 3919300 - RNA, 15 nt, Shigella flexneri 2a str. 301
agcuggguacgaaaa

SEQ ID NO: 3919301 - RNA, 11 nt, Shigella flexneri 2a str. 301
agcugguaacc

SEQ ID NO: 3919302 - RNA, 14 nt, Shigella flexneri 2a str. 301
agcuggucugaauc

SEQ ID NO: 3919303 - RNA, 16 nt, Shigella flexneri 2a str. 301
agcuggucugaaucaa

SEQ ID NO: 3919304 - RNA, 21 nt, Shigella flexneri 2a str. 301
aggauaaaaaagggugcugca

SEQ ID NO: 3919305 - RNA, 15 nt, Shigella flexneri 2a str. 301
aggauacuuaucugg

SEQ ID NO: 3919306 - RNA, 22 nt, Shigella flexneri 2a str. 301
aggauaggcuucuauaccaaug

SEQ ID NO: 3919307 - RNA, 21 nt, Shigella flexneri 2a str. 301
aggauaugcaucaugaaaacc

SEQ ID NO: 3919308 - RNA, 21 nt, Shigella flexneri 2a str. 301
aggauauguaagcagaaaagc

SEQ ID NO: 3919309 - RNA, 23 nt, Shigella flexneri 2a str. 301
aggauauguaagcagaaaagcca

SEQ ID NO: 3919310 - RNA, 13 nt, Shigella flexneri 2a str. 301
aggaucagaauuc

SEQ ID NO: 3919311 - RNA, 17 nt, Shigella flexneri 2a str. 301
aggaucggugcugccag

SEQ ID NO: 3919312 - RNA, 22 nt, Shigella flexneri 2a str. 301
aggaucuggcuugccagcaggg

SEQ ID NO: 3919313 - RNA, 21 nt, Shigella flexneri 2a str. 301
aggaugcacucgcauccucuu

SEQ ID NO: 3919314 - RNA, 13 nt, Shigella flexneri 2a str. 301
aggaugcagaaac

SEQ ID NO: 3919315 - RNA, 23 nt, Shigella flexneri 2a str. 301
aggaugcugcaauaaaauaucuu

SEQ ID NO: 3919316 - RNA, 14 nt, Shigella flexneri 2a str. 301
aggauggccgggca

SEQ ID NO: 3919317 - RNA, 20 nt, Shigella flexneri 2a str. 301
aggaugggcaacgcgcaugg

SEQ ID NO: 3919318 - RNA, 16 nt, Shigella flexneri 2a str. 301
aggauguuccggcaaa

SEQ ID NO: 3919319 - RNA, 18 nt, Shigella flexneri 2a str. 301
aggauguuccggcaaagu

SEQ ID NO: 3919320 - RNA, 14 nt, Shigella flexneri 2a str. 301
aggauuagccggau

SEQ ID NO: 3919321 - RNA, 12 nt, Shigella flexneri 2a str. 301
aggauuucauuu

SEQ ID NO: 3919322 - RNA, 12 nt, Shigella flexneri 2a str. 301
aggcaaaccagu

SEQ ID NO: 3919323 - RNA, 15 nt, Shigella flexneri 2a str. 301
aggcaaacgaaaucu

SEQ ID NO: 3919324 - RNA, 23 nt, Shigella flexneri 2a str. 301
aggcaaacugucuaauggugaac

SEQ ID NO: 3919325 - RNA, 19 nt, Shigella flexneri 2a str. 301
aggcaaagaguugccccuc

SEQ ID NO: 3919326 - RNA, 18 nt, Shigella flexneri 2a str. 301
aggcaacaugaaacagaa

SEQ ID NO: 3919327 - RNA, 21 nt, Shigella flexneri 2a str. 301
aggcaacaugaaacagaaaau

SEQ ID NO: 3919328 - RNA, 19 nt, Shigella flexneri 2a str. 301
aggcaacgaccagaaaugc

SEQ ID NO: 3919329 - RNA, 21 nt, Shigella flexneri 2a str. 301
aggcaagccgcuaacagcagc

SEQ ID NO: 3919330 - RNA, 22 nt, Shigella flexneri 2a str. 301
aggcaagccgcuaacagcagca

SEQ ID NO: 3919331 - RNA, 17 nt, Shigella flexneri 2a str. 301
aggcaauauuuaaauau

SEQ ID NO: 3919332 - RNA, 18 nt, Shigella flexneri 2a str. 301
aggcaaucgagcccagau

SEQ ID NO: 3919333 - RNA, 18 nt, Shigella flexneri 2a str. 301
aggcaauuggcgcaucau

SEQ ID NO: 3919334 - RNA, 14 nt, Shigella flexneri 2a str. 301
aggcacaacugcga

SEQ ID NO: 3919335 - RNA, 14 nt, Shigella flexneri 2a str. 301
aggcacaccgccgc

SEQ ID NO: 3919336 - RNA, 14 nt, Shigella flexneri 2a str. 301
aggcaccagccccu

SEQ ID NO: 3919337 - RNA, 17 nt, Shigella flexneri 2a str. 301
aggcaccagccccugga

SEQ ID NO: 3919338 - RNA, 13 nt, Shigella flexneri 2a str. 301
aggcaccuggaaa

SEQ ID NO: 3919339 - RNA, 11 nt, Shigella flexneri 2a str. 301
aggcaccuucg

SEQ ID NO: 3919340 - RNA, 15 nt, Shigella flexneri 2a str. 301
aggcagaagcgcgug

SEQ ID NO: 3919341 - RNA, 19 nt, Shigella flexneri 2a str. 301
aggcagcaaucacugccag

SEQ ID NO: 3919342 - RNA, 15 nt, Shigella flexneri 2a str. 301
aggcaggcaucaaug

SEQ ID NO: 3919343 - RNA, 18 nt, Shigella flexneri 2a str. 301
aggcagguuaaugaccca

SEQ ID NO: 3919344 - RNA, 22 nt, Shigella flexneri 2a str. 301
aggcaguaaaccgucagcacca

SEQ ID NO: 3919345 - RNA, 16 nt, Shigella flexneri 2a str. 301
aggcaucagacaaaug

SEQ ID NO: 3919346 - RNA, 21 nt, Shigella flexneri 2a str. 301
aggcaucagaucccaauucau

SEQ ID NO: 3919347 - RNA, 20 nt, Shigella flexneri 2a str. 301
aggcaucagcaauuguaaau

SEQ ID NO: 3919348 - RNA, 17 nt, Shigella flexneri 2a str. 301
aggcaucccgcaccagc

SEQ ID NO: 3919349 - RNA, 16 nt, Shigella flexneri 2a str. 301
aggcaucugcgcauaa

SEQ ID NO: 3919350 - RNA, 16 nt, Shigella flexneri 2a str. 301
aggcaucuucuucauu

SEQ ID NO: 3919351 - RNA, 15 nt, Shigella flexneri 2a str. 301
aggcaugaugcgcca

SEQ ID NO: 3919352 - RNA, 17 nt, Shigella flexneri 2a str. 301
aggcaugggucacucag

SEQ ID NO: 3919353 - RNA, 19 nt, Shigella flexneri 2a str. 301
aggcauucagauaauaggu

SEQ ID NO: 3919354 - RNA, 17 nt, Shigella flexneri 2a str. 301
aggcauuggcaaauuua

SEQ ID NO: 3919355 - RNA, 12 nt, Shigella flexneri 2a str. 301
aggcauugugcu

SEQ ID NO: 3919356 - RNA, 15 nt, Shigella flexneri 2a str. 301
aggcauuuuuaucac

SEQ ID NO: 3919357 - RNA, 19 nt, Shigella flexneri 2a str. 301
aggccaaaaaacagccccu

SEQ ID NO: 3919358 - RNA, 17 nt, Shigella flexneri 2a str. 301
aggccaaauccuuccag

SEQ ID NO: 3919359 - RNA, 13 nt, Shigella flexneri 2a str. 301
aggccaacggccc

SEQ ID NO: 3919360 - RNA, 18 nt, Shigella flexneri 2a str. 301
aggccaaucagcaauaaa

SEQ ID NO: 3919361 - RNA, 15 nt, Shigella flexneri 2a str. 301
aggccagauaagacg

SEQ ID NO: 3919362 - RNA, 17 nt, Shigella flexneri 2a str. 301
aggccagcaauccccag

SEQ ID NO: 3919363 - RNA, 12 nt, Shigella flexneri 2a str. 301
aggccagccaga

SEQ ID NO: 3919364 - RNA, 16 nt, Shigella flexneri 2a str. 301
aggccaucacauccug

SEQ ID NO: 3919365 - RNA, 22 nt, Shigella flexneri 2a str. 301
aggccauguuuaccaucugcgc

SEQ ID NO: 3919366 - RNA, 20 nt, Shigella flexneri 2a str. 301
aggccauuuuuucgauaauc

SEQ ID NO: 3919367 - RNA, 23 nt, Shigella flexneri 2a str. 301
aggccauuuuuucgauaaucaaa

SEQ ID NO: 3919368 - RNA, 23 nt, Shigella flexneri 2a str. 301
aggcccaacuguugauccaggag

SEQ ID NO: 3919369 - RNA, 16 nt, Shigella flexneri 2a str. 301
aggcccgcccccgggc

SEQ ID NO: 3919370 - RNA, 14 nt, Shigella flexneri 2a str. 301
aggccgacagcagg

SEQ ID NO: 3919371 - RNA, 16 nt, Shigella flexneri 2a str. 301
aggccgacagcaggcu

SEQ ID NO: 3919372 - RNA, 23 nt, Shigella flexneri 2a str. 301
aggccgccaguguuggcgucaga

SEQ ID NO: 3919373 - RNA, 22 nt, Shigella flexneri 2a str. 301
aggccgccgucaucacgcaggc

SEQ ID NO: 3919374 - RNA, 19 nt, Shigella flexneri 2a str. 301
aggccgcguaccgcagcaa

SEQ ID NO: 3919375 - RNA, 14 nt, Shigella flexneri 2a str. 301
aggccgcuuucuga

SEQ ID NO: 3919376 - RNA, 14 nt, Shigella flexneri 2a str. 301
aggccggagccagc

SEQ ID NO: 3919377 - RNA, 14 nt, Shigella flexneri 2a str. 301
aggccguauccggc

SEQ ID NO: 3919378 - RNA, 15 nt, Shigella flexneri 2a str. 301
aggccguauccggca

SEQ ID NO: 3919379 - RNA, 18 nt, Shigella flexneri 2a str. 301
aggccguccgcucaagaa

SEQ ID NO: 3919380 - RNA, 21 nt, Shigella flexneri 2a str. 301
aggccguggaucacaucgccg

SEQ ID NO: 3919381 - RNA, 21 nt, Shigella flexneri 2a str. 301
aggccuacaaaaucuauugca

SEQ ID NO: 3919382 - RNA, 14 nt, Shigella flexneri 2a str. 301
aggccuacaacucc

SEQ ID NO: 3919383 - RNA, 19 nt, Shigella flexneri 2a str. 301
aggccuacaacuccguuga

SEQ ID NO: 3919384 - RNA, 19 nt, Shigella flexneri 2a str. 301
aggccuacaaguccguuga

SEQ ID NO: 3919385 - RNA, 20 nt, Shigella flexneri 2a str. 301
aggccuacauuggugccgga

SEQ ID NO: 3919386 - RNA, 23 nt, Shigella flexneri 2a str. 301
aggccugagaagcgcaacgcauc

SEQ ID NO: 3919387 - RNA, 12 nt, Shigella flexneri 2a str. 301
aggccuucgccu

SEQ ID NO: 3919388 - RNA, 17 nt, Shigella flexneri 2a str. 301
aggcgaaaggcuggcgg

SEQ ID NO: 3919389 - RNA, 13 nt, Shigella flexneri 2a str. 301
aggcgaacaugcg

SEQ ID NO: 3919390 - RNA, 19 nt, Shigella flexneri 2a str. 301
aggcgaacauuccgguuau

SEQ ID NO: 3919391 - RNA, 21 nt, Shigella flexneri 2a str. 301
aggcgacauaucauuuugcug

SEQ ID NO: 3919392 - RNA, 21 nt, Shigella flexneri 2a str. 301
aggcgaccguuuucaccaguu

SEQ ID NO: 3919393 - RNA, 19 nt, Shigella flexneri 2a str. 301
aggcgacuaauacaccauc

SEQ ID NO: 3919394 - RNA, 20 nt, Shigella flexneri 2a str. 301
aggcgacuaauacaccauca

SEQ ID NO: 3919395 - RNA, 13 nt, Shigella flexneri 2a str. 301
aggcgagaaucaa

SEQ ID NO: 3919396 - RNA, 18 nt, Shigella flexneri 2a str. 301
aggcgaggggaccgcccc

SEQ ID NO: 3919397 - RNA, 14 nt, Shigella flexneri 2a str. 301
aggcgaucuucccg

SEQ ID NO: 3919398 - RNA, 22 nt, Shigella flexneri 2a str. 301
aggcgcaacauauuccgcaccu

SEQ ID NO: 3919399 - RNA, 21 nt, Shigella flexneri 2a str. 301
aggcgcaauguugcgggggcu

SEQ ID NO: 3919400 - RNA, 20 nt, Shigella flexneri 2a str. 301
aggcgcacgccgacaaagau

SEQ ID NO: 3919401 - RNA, 21 nt, Shigella flexneri 2a str. 301
aggcgcacugauucaugaacu

SEQ ID NO: 3919402 - RNA, 13 nt, Shigella flexneri 2a str. 301
aggcgcagaacuu

SEQ ID NO: 3919403 - RNA, 21 nt, Shigella flexneri 2a str. 301
aggcgcauaagcguaaaaccu

SEQ ID NO: 3919404 - RNA, 13 nt, Shigella flexneri 2a str. 301
agguaaaaccuga

SEQ ID NO: 3919405 - RNA, 14 nt, Shigella flexneri 2a str. 301
agguaaacagaaau

SEQ ID NO: 3919406 - RNA, 12 nt, Shigella flexneri 2a str. 301
agguaacaggga

SEQ ID NO: 3919407 - RNA, 23 nt, Shigella flexneri 2a str. 301
agguaacgucgguuucaucacau

SEQ ID NO: 3919408 - RNA, 18 nt, Shigella flexneri 2a str. 301
agguaagauguucuaucu

SEQ ID NO: 3919409 - RNA, 13 nt, Shigella flexneri 2a str. 301
agguaagcaaagg

SEQ ID NO: 3919410 - RNA, 20 nt, Shigella flexneri 2a str. 301
agguaaggauaaaaaagggu

SEQ ID NO: 3919411 - RNA, 22 nt, Shigella flexneri 2a str. 301
agguaaugaauggacuccaccg

SEQ ID NO: 3919412 - RNA, 14 nt, Shigella flexneri 2a str. 301
agguacaaagccaa

SEQ ID NO: 3919413 - RNA, 23 nt, Shigella flexneri 2a str. 301
agguacaaccgcaaagguugcug

SEQ ID NO: 3919414 - RNA, 23 nt, Shigella flexneri 2a str. 301
agguacgguacugaaaccugaac

SEQ ID NO: 3919415 - RNA, 15 nt, Shigella flexneri 2a str. 301
agguacuguaacgcu

SEQ ID NO: 3919416 - RNA, 22 nt, Shigella flexneri 2a str. 301
agguagacaccaaggaacugug

SEQ ID NO: 3919417 - RNA, 22 nt, Shigella flexneri 2a str. 301
agguaguggucaggauuauguu

SEQ ID NO: 3919418 - RNA, 20 nt, Shigella flexneri 2a str. 301
agguauaccgaaaucgccau

SEQ ID NO: 3919419 - RNA, 15 nt, Shigella flexneri 2a str. 301
agguaucgcacugau

SEQ ID NO: 3919420 - RNA, 18 nt, Shigella flexneri 2a str. 301
agguaucgcgaaaaaaaa

SEQ ID NO: 3919421 - RNA, 13 nt, Shigella flexneri 2a str. 301
agguauuuuguca

SEQ ID NO: 3919422 - RNA, 15 nt, Shigella flexneri 2a str. 301
aggucaaagaaucaa

SEQ ID NO: 3919423 - RNA, 16 nt, Shigella flexneri 2a str. 301
aggucaaccuagccuu

SEQ ID NO: 3919424 - RNA, 18 nt, Shigella flexneri 2a str. 301
aggucacccaacaugccg

SEQ ID NO: 3919425 - RNA, 13 nt, Shigella flexneri 2a str. 301
aggucagagagcc

SEQ ID NO: 3919426 - RNA, 17 nt, Shigella flexneri 2a str. 301
aggucagagagccagcc

SEQ ID NO: 3919427 - RNA, 20 nt, Shigella flexneri 2a str. 301
aggucagcaggagcagcccc

SEQ ID NO: 3919428 - RNA, 22 nt, Shigella flexneri 2a str. 301
aggucagcaggagcagccccug

SEQ ID NO: 3919429 - RNA, 19 nt, Shigella flexneri 2a str. 301
aggucagcgccuggcugca

SEQ ID NO: 3919430 - RNA, 23 nt, Shigella flexneri 2a str. 301
aggucaggccguaaucacuguca

SEQ ID NO: 3919431 - RNA, 17 nt, Shigella flexneri 2a str. 301
aggucagucaguggcag

SEQ ID NO: 3919432 - RNA, 17 nt, Shigella flexneri 2a str. 301
aggucaucacaucccag

SEQ ID NO: 3919433 - RNA, 18 nt, Shigella flexneri 2a str. 301
aggucaugugucgccgca

SEQ ID NO: 3919434 - RNA, 16 nt, Shigella flexneri 2a str. 301
aggucauuaaaccgcu

SEQ ID NO: 3919435 - RNA, 17 nt, Shigella flexneri 2a str. 301
agguccggauggcaaac

SEQ ID NO: 3919436 - RNA, 20 nt, Shigella flexneri 2a str. 301
agguccuccuguaccuucac

SEQ ID NO: 3919437 - RNA, 14 nt, Shigella flexneri 2a str. 301
aggucgacagcagc

SEQ ID NO: 3919438 - RNA, 15 nt, Shigella flexneri 2a str. 301
aggucgacagcagcc

SEQ ID NO: 3919439 - RNA, 22 nt, Shigella flexneri 2a str. 301
aggucgagaacaacggcgaggu

SEQ ID NO: 3919440 - RNA, 15 nt, Shigella flexneri 2a str. 301
aggucgaucagcuga

SEQ ID NO: 3919441 - RNA, 19 nt, Shigella flexneri 2a str. 301
aggucgaucagcugacaac

SEQ ID NO: 3919442 - RNA, 21 nt, Shigella flexneri 2a str. 301
aggucgcccggauuacagcuc

SEQ ID NO: 3919443 - RNA, 22 nt, Shigella flexneri 2a str. 301
aggucgguccgucaagaucggc

SEQ ID NO: 3919444 - RNA, 13 nt, Shigella flexneri 2a str. 301
aggucgugccaga

SEQ ID NO: 3919445 - RNA, 14 nt, Shigella flexneri 2a str. 301
aggucgugccagaa

SEQ ID NO: 3919446 - RNA, 20 nt, Shigella flexneri 2a str. 301
aggucuuugacgucgaaacu

SEQ ID NO: 3919447 - RNA, 14 nt, Shigella flexneri 2a str. 301
aggugaaauugucg

SEQ ID NO: 3919448 - RNA, 17 nt, Shigella flexneri 2a str. 301
aggugacacuucauuaa

SEQ ID NO: 3919449 - RNA, 21 nt, Shigella flexneri 2a str. 301
aggugacacuucauuaaccac

SEQ ID NO: 3919450 - RNA, 18 nt, Shigella flexneri 2a str. 301
aggugacgcgggcagcag

SEQ ID NO: 3919451 - RNA, 20 nt, Shigella flexneri 2a str. 301
aggugagggcuuaaaugaca

SEQ ID NO: 3919452 - RNA, 18 nt, Shigella flexneri 2a str. 301
aggugagucgcaaaacuc

SEQ ID NO: 3919453 - RNA, 20 nt, Shigella flexneri 2a str. 301
aggugcagcccguaagcaaa

SEQ ID NO: 3919454 - RNA, 18 nt, Shigella flexneri 2a str. 301
aggugcaucggggaauug

SEQ ID NO: 3919455 - RNA, 16 nt, Shigella flexneri 2a str. 301
aggugccuuaccacuc

SEQ ID NO: 3919456 - RNA, 17 nt, Shigella flexneri 2a str. 301
aggugcucaaugagcac

SEQ ID NO: 3919457 - RNA, 20 nt, Shigella flexneri 2a str. 301
aggugcucauuugauugccg

SEQ ID NO: 3919458 - RNA, 17 nt, Shigella flexneri 2a str. 301
agguggccgagaggcug

SEQ ID NO: 3919459 - RNA, 15 nt, Shigella flexneri 2a str. 301
aggugguagcugccc

SEQ ID NO: 3919460 - RNA, 15 nt, Shigella flexneri 2a str. 301
aggugucacaugcag

SEQ ID NO: 3919461 - RNA, 21 nt, Shigella flexneri 2a str. 301
aggugucacaugcagcgccug

SEQ ID NO: 3919462 - RNA, 21 nt, Shigella flexneri 2a str. 301
aggugugaaaccuuuaugcag

SEQ ID NO: 3919463 - RNA, 19 nt, Shigella flexneri 2a str. 301
aggugugggcaaucacuuu

SEQ ID NO: 3919464 - RNA, 23 nt, Shigella flexneri 2a str. 301
aggugugggcaaucacuuugucg

SEQ ID NO: 3919465 - RNA, 21 nt, Shigella flexneri 2a str. 301
agguuaacucccccuuucuga

SEQ ID NO: 3919466 - RNA, 13 nt, Shigella flexneri 2a str. 301
agguuaauauuuu

SEQ ID NO: 3919467 - RNA, 17 nt, Shigella flexneri 2a str. 301
agguuaauauuuucgcc

SEQ ID NO: 3919468 - RNA, 12 nt, Shigella flexneri 2a str. 301
agguuaaugcug

SEQ ID NO: 3919469 - RNA, 22 nt, Shigella flexneri 2a str. 301
agguuaaugcuguuccagacca

SEQ ID NO: 3919470 - RNA, 21 nt, Shigella flexneri 2a str. 301
agguuacgcaccagauaagca

SEQ ID NO: 3919471 - RNA, 17 nt, Shigella flexneri 2a str. 301
agguuagaauaaacaaa

SEQ ID NO: 3919472 - RNA, 17 nt, Shigella flexneri 2a str. 301
agguuccaauauugguc

SEQ ID NO: 3919473 - RNA, 20 nt, Shigella flexneri 2a str. 301
agguucucucagucuuuccc

SEQ ID NO: 3919474 - RNA, 16 nt, Shigella flexneri 2a str. 301
agguucuuugcugccg

SEQ ID NO: 3919475 - RNA, 15 nt, Shigella flexneri 2a str. 301
agguugaacccuuuc

SEQ ID NO: 3919476 - RNA, 16 nt, Shigella flexneri 2a str. 301
agguuggaucaacagg

SEQ ID NO: 3919477 - RNA, 20 nt, Shigella flexneri 2a str. 301
agguuguagauuuugcagau

SEQ ID NO: 3919478 - RNA, 19 nt, Shigella flexneri 2a str. 301
agguuguggcauuagauau

SEQ ID NO: 3919479 - RNA, 17 nt, Shigella flexneri 2a str. 301
agguuguuaaccaccag

SEQ ID NO: 3919480 - RNA, 23 nt, Shigella flexneri 2a str. 301
agguuguuaaccaccaguaaauu

SEQ ID NO: 3919481 - RNA, 14 nt, Shigella flexneri 2a str. 301
agguuuaaacagag

SEQ ID NO: 3919482 - RNA, 15 nt, Shigella flexneri 2a str. 301
agguuuaccagcagc

SEQ ID NO: 3919483 - RNA, 18 nt, Shigella flexneri 2a str. 301
agguuucacguaccagau

SEQ ID NO: 3919484 - RNA, 16 nt, Shigella flexneri 2a str. 301
agguuucccgccguaa

SEQ ID NO: 3919485 - RNA, 13 nt, Shigella flexneri 2a str. 301
agguuuccggguc

SEQ ID NO: 3919486 - RNA, 11 nt, Shigella flexneri 2a str. 301
agguuucugcc

SEQ ID NO: 3919487 - RNA, 19 nt, Shigella flexneri 2a str. 301
agguuucuuuuuaaagaga

SEQ ID NO: 3919488 - RNA, 13 nt, Shigella flexneri 2a str. 301
agguuuuccuuca

SEQ ID NO: 3919489 - RNA, 19 nt, Shigella flexneri 2a str. 301
agguuuucuuucaccucuu

SEQ ID NO: 3919490 - RNA, 22 nt, Shigella flexneri 2a str. 301
agguuuuguugcccagcgcauc

SEQ ID NO: 3919491 - RNA, 16 nt, Shigella flexneri 2a str. 301
agguuuuucagcugcc

SEQ ID NO: 3919492 - RNA, 12 nt, Shigella flexneri 2a str. 301
agguuuuuuccu

SEQ ID NO: 3919493 - RNA, 12 nt, Shigella flexneri 2a str. 301
aguaaaaaagaa

SEQ ID NO: 3919494 - RNA, 14 nt, Shigella flexneri 2a str. 301
aguaaaaaagaagg

SEQ ID NO: 3919495 - RNA, 23 nt, Shigella flexneri 2a str. 301
aguaaaaaagaaggaaaauacag

SEQ ID NO: 3919496 - RNA, 19 nt, Shigella flexneri 2a str. 301
aguaaaaggucugaaagau

SEQ ID NO: 3919497 - RNA, 18 nt, Shigella flexneri 2a str. 301
aguaaaccgucagcacca

SEQ ID NO: 3919498 - RNA, 21 nt, Shigella flexneri 2a str. 301
aguaaacgccgagcuggaaca

SEQ ID NO: 3919499 - RNA, 18 nt, Shigella flexneri 2a str. 301
aguaaagcgcgucaccac

SEQ ID NO: 3919500 - RNA, 19 nt, Shigella flexneri 2a str. 301
aguaaagcgcgucaccacc

SEQ ID NO: 3919501 - RNA, 13 nt, Shigella flexneri 2a str. 301
aguaaauccauaa

SEQ ID NO: 3919502 - RNA, 20 nt, Shigella flexneri 2a str. 301
aguaaaucguccguuugcgu

SEQ ID NO: 3919503 - RNA, 17 nt, Shigella flexneri 2a str. 301
aguaaauggugauauca

SEQ ID NO: 3919504 - RNA, 15 nt, Shigella flexneri 2a str. 301
aguaugcgcgucaga

SEQ ID NO: 3919505 - RNA, 16 nt, Shigella flexneri 2a str. 301
aguauuaagccaguuc

SEQ ID NO: 3919506 - RNA, 20 nt, Shigella flexneri 2a str. 301
aguauucaggucagcggcca

SEQ ID NO: 3919507 - RNA, 23 nt, Shigella flexneri 2a str. 301
aguauuuuuaaccguauuuuggu

SEQ ID NO: 3919508 - RNA, 19 nt, Shigella flexneri 2a str. 301
agucaaaagccuccgaccg

SEQ ID NO: 3919509 - RNA, 17 nt, Shigella flexneri 2a str. 301
agucaacgucauuaucu

SEQ ID NO: 3919510 - RNA, 15 nt, Shigella flexneri 2a str. 301
agucaaucauccaua

SEQ ID NO: 3919511 - RNA, 14 nt, Shigella flexneri 2a str. 301
agucaaugaaauua

SEQ ID NO: 3919512 - RNA, 23 nt, Shigella flexneri 2a str. 301
agucaaugaaauuacuuuccauc

SEQ ID NO: 3919513 - RNA, 15 nt, Shigella flexneri 2a str. 301
agucaauuaaaaaau

SEQ ID NO: 3919514 - RNA, 14 nt, Shigella flexneri 2a str. 301
agucacaaacauca

SEQ ID NO: 3919515 - RNA, 16 nt, Shigella flexneri 2a str. 301
agucacaccagcgaug

SEQ ID NO: 3919516 - RNA, 14 nt, Shigella flexneri 2a str. 301
agucaccagcauca

SEQ ID NO: 3919517 - RNA, 17 nt, Shigella flexneri 2a str. 301
agucaccgcccagugca

SEQ ID NO: 3919518 - RNA, 16 nt, Shigella flexneri 2a str. 301
agucaccugcggugca

SEQ ID NO: 3919519 - RNA, 13 nt, Shigella flexneri 2a str. 301
agucacuuuacga

SEQ ID NO: 3919520 - RNA, 19 nt, Shigella flexneri 2a str. 301
agucacuuuacgaccagcc

SEQ ID NO: 3919521 - RNA, 15 nt, Shigella flexneri 2a str. 301
agucacuuuuuuccg

SEQ ID NO: 3919522 - RNA, 23 nt, Shigella flexneri 2a str. 301
agucagaaacuguaauugagaac

SEQ ID NO: 3919523 - RNA, 22 nt, Shigella flexneri 2a str. 301
agucagacccugcucuuucagc

SEQ ID NO: 3919524 - RNA, 22 nt, Shigella flexneri 2a str. 301
agucagaugccucguuggucag

SEQ ID NO: 3919525 - RNA, 15 nt, Shigella flexneri 2a str. 301
agucagcccaacaaa

SEQ ID NO: 3919526 - RNA, 16 nt, Shigella flexneri 2a str. 301
agucagcgaacaccag

SEQ ID NO: 3919527 - RNA, 16 nt, Shigella flexneri 2a str. 301
agucaggcgcgcggug

SEQ ID NO: 3919528 - RNA, 17 nt, Shigella flexneri 2a str. 301
agucagucucaagggag

SEQ ID NO: 3919529 - RNA, 21 nt, Shigella flexneri 2a str. 301
agucaguguuaucaaaucacc

SEQ ID NO: 3919530 - RNA, 17 nt, Shigella flexneri 2a str. 301
agucauaaccaguccau

SEQ ID NO: 3919531 - RNA, 14 nt, Shigella flexneri 2a str. 301
agucauauuucugu

SEQ ID NO: 3919532 - RNA, 16 nt, Shigella flexneri 2a str. 301
agucauauuucuguuu

SEQ ID NO: 3919533 - RNA, 15 nt, Shigella flexneri 2a str. 301
agucaucagucugag

SEQ ID NO: 3919534 - RNA, 13 nt, Shigella flexneri 2a str. 301
agucaucaucagg

SEQ ID NO: 3919535 - RNA, 13 nt, Shigella flexneri 2a str. 301
agucauccggcgu

SEQ ID NO: 3919536 - RNA, 19 nt, Shigella flexneri 2a str. 301
agucaucgcuuucggaaag

SEQ ID NO: 3919537 - RNA, 14 nt, Shigella flexneri 2a str. 301
agucaugaaauaua

SEQ ID NO: 3919538 - RNA, 16 nt, Shigella flexneri 2a str. 301
agucaugcgagaagca

SEQ ID NO: 3919539 - RNA, 20 nt, Shigella flexneri 2a str. 301
agucauuaccugaaaaaaca

SEQ ID NO: 3919540 - RNA, 21 nt, Shigella flexneri 2a str. 301
agucauuaccugaaaaaacaa

SEQ ID NO: 3919541 - RNA, 15 nt, Shigella flexneri 2a str. 301
agucauuccggcccc

SEQ ID NO: 3919542 - RNA, 13 nt, Shigella flexneri 2a str. 301
agucauuccuuca

SEQ ID NO: 3919543 - RNA, 15 nt, Shigella flexneri 2a str. 301
aguccaaaagguccu

SEQ ID NO: 3919544 - RNA, 16 nt, Shigella flexneri 2a str. 301
aguccaaaagguccuu

SEQ ID NO: 3919545 - RNA, 22 nt, Shigella flexneri 2a str. 301
aguccagacuccgagaaucaua

SEQ ID NO: 3919546 - RNA, 24 nt, Shigella flexneri 2a str. 301
aguccagccccgcgcggcgcaggc

SEQ ID NO: 3919547 - RNA, 15 nt, Shigella flexneri 2a str. 301
aguccagcgccugaa

SEQ ID NO: 3919548 - RNA, 17 nt, Shigella flexneri 2a str. 301
aguccagcgccugaaau

SEQ ID NO: 3919549 - RNA, 21 nt, Shigella flexneri 2a str. 301
aguccagcugccguccccauc

SEQ ID NO: 3919550 - RNA, 16 nt, Shigella flexneri 2a str. 301
aguccaggcugcaaag

SEQ ID NO: 3919551 - RNA, 19 nt, Shigella flexneri 2a str. 301
aguccaggcugcaaagucu

SEQ ID NO: 3919552 - RNA, 20 nt, Shigella flexneri 2a str. 301
aguccaugucgguacagagc

SEQ ID NO: 3919553 - RNA, 12 nt, Shigella flexneri 2a str. 301
agucccaguuca

SEQ ID NO: 3919554 - RNA, 18 nt, Shigella flexneri 2a str. 301
agucccggcaagauucca

SEQ ID NO: 3919555 - RNA, 18 nt, Shigella flexneri 2a str. 301
agucccguacccagcaag

SEQ ID NO: 3919556 - RNA, 12 nt, Shigella flexneri 2a str. 301
aguccgguaaug

SEQ ID NO: 3919557 - RNA, 21 nt, Shigella flexneri 2a str. 301
aguccguuauggcgugagcug

SEQ ID NO: 3919558 - RNA, 22 nt, Shigella flexneri 2a str. 301
aguccuacacacgccagugcgc

SEQ ID NO: 3919559 - RNA, 21 nt, Shigella flexneri 2a str. 301
aguccugaccgucaccccauu

SEQ ID NO: 3919560 - RNA, 16 nt, Shigella flexneri 2a str. 301
aguccugagucagaaa

SEQ ID NO: 3919561 - RNA, 17 nt, Shigella flexneri 2a str. 301
aguccuguugucuuucc

SEQ ID NO: 3919562 - RNA, 18 nt, Shigella flexneri 2a str. 301
aguccuguugucuuucca

SEQ ID NO: 3919563 - RNA, 22 nt, Shigella flexneri 2a str. 301
agucgaauggcaucuacgcucu

SEQ ID NO: 3919564 - RNA, 23 nt, Shigella flexneri 2a str. 301
agucgauaacgaccuugcaauaa

SEQ ID NO: 3919565 - RNA, 22 nt, Shigella flexneri 2a str. 301
agucgaugaugcagccagugau

SEQ ID NO: 3919566 - RNA, 23 nt, Shigella flexneri 2a str. 301
agucgcaacggcuuuggcaaacc

SEQ ID NO: 3919567 - RNA, 16 nt, Shigella flexneri 2a str. 301
agucgcacacaacaga

SEQ ID NO: 3919568 - RNA, 18 nt, Shigella flexneri 2a str. 301
agucgcccauuuugccac

SEQ ID NO: 3919569 - RNA, 17 nt, Shigella flexneri 2a str. 301
agucgccggcggauuca

SEQ ID NO: 3919570 - RNA, 15 nt, Shigella flexneri 2a str. 301
agucgccugcuuuau

SEQ ID NO: 3919571 - RNA, 20 nt, Shigella flexneri 2a str. 301
agucgcgcaauugccagaca

SEQ ID NO: 3919572 - RNA, 21 nt, Shigella flexneri 2a str. 301
agucgcgcucaucagcggcga

SEQ ID NO: 3919573 - RNA, 23 nt, Shigella flexneri 2a str. 301
agucgcgguccgggccgcaaacc

SEQ ID NO: 3919574 - RNA, 16 nt, Shigella flexneri 2a str. 301
agucgcuugcaggauc

SEQ ID NO: 3919575 - RNA, 22 nt, Shigella flexneri 2a str. 301
agucgguauaaauagcggcugu

SEQ ID NO: 3919576 - RNA, 13 nt, Shigella flexneri 2a str. 301
agucggucacagu

SEQ ID NO: 3919577 - RNA, 15 nt, Shigella flexneri 2a str. 301
agucguagaccgggc

SEQ ID NO: 3919578 - RNA, 16 nt, Shigella flexneri 2a str. 301
agucguaggccugaua

SEQ ID NO: 3919579 - RNA, 22 nt, Shigella flexneri 2a str. 301
agucgucugucgggaacacuuu

SEQ ID NO: 3919580 - RNA, 17 nt, Shigella flexneri 2a str. 301
agucguucaaccacuuc

SEQ ID NO: 3919581 - RNA, 21 nt, Shigella flexneri 2a str. 301
agucugaaugccgcuaccgcc

SEQ ID NO: 3919582 - RNA, 20 nt, Shigella flexneri 2a str. 301
agucugaccucuucuaccac

SEQ ID NO: 3919583 - RNA, 12 nt, Shigella flexneri 2a str. 301
agucugcauuuu

SEQ ID NO: 3919584 - RNA, 14 nt, Shigella flexneri 2a str. 301
agucugcauuuucu

SEQ ID NO: 3919585 - RNA, 21 nt, Shigella flexneri 2a str. 301
agucuuaaaggggugaaaaaa

SEQ ID NO: 3919586 - RNA, 14 nt, Shigella flexneri 2a str. 301
agucuucaucaucc

SEQ ID NO: 3919587 - RNA, 22 nt, Shigella flexneri 2a str. 301
agucuucaucauccucuucagc

SEQ ID NO: 3919588 - RNA, 12 nt, Shigella flexneri 2a str. 301
agucuucccagc

SEQ ID NO: 3919589 - RNA, 13 nt, Shigella flexneri 2a str. 301
agucuugcuggau

SEQ ID NO: 3919590 - RNA, 24 nt, Shigella flexneri 2a str. 301
agucuugcuggaugccagcgaaga

SEQ ID NO: 3919591 - RNA, 16 nt, Shigella flexneri 2a str. 301
agucuuuccccguuga

SEQ ID NO: 3919592 - RNA, 21 nt, Shigella flexneri 2a str. 301
agucuuuguauuuauuuucag

SEQ ID NO: 3919593 - RNA, 17 nt, Shigella flexneri 2a str. 301
agucuuuuuucaacuuu

SEQ ID NO: 3919594 - RNA, 18 nt, Shigella flexneri 2a str. 301
agugaaaaccggacugaa

SEQ ID NO: 3919595 - RNA, 19 nt, Shigella flexneri 2a str. 301
agugaaaauucuccggcgu

SEQ ID NO: 3919596 - RNA, 13 nt, Shigella flexneri 2a str. 301
agugaaauuaaac

SEQ ID NO: 3919597 - RNA, 14 nt, Shigella flexneri 2a str. 301
agugaaauuaaacu

SEQ ID NO: 3919598 - RNA, 15 nt, Shigella flexneri 2a str. 301
agugaaauuuugggc

SEQ ID NO: 3919599 - RNA, 23 nt, Shigella flexneri 2a str. 301
agugaaggcaaacuucucgccau

SEQ ID NO: 3919600 - RNA, 20 nt, Shigella flexneri 2a str. 301
agugacccgcagccagcacu

SEQ ID NO: 3919601 - RNA, 22 nt, Shigella flexneri 2a str. 301
agugaccgaaccuguuuucacc

SEQ ID NO: 3919602 - RNA, 14 nt, Shigella flexneri 2a str. 301
agugacucacgaau

SEQ ID NO: 3919603 - RNA, 13 nt, Shigella flexneri 2a str. 301
agugacugggugc

SEQ ID NO: 3919604 - RNA, 15 nt, Shigella flexneri 2a str. 301
agugagaauuuuuca

SEQ ID NO: 3919605 - RNA, 17 nt, Shigella flexneri 2a str. 301
agugagauaccaguuga

SEQ ID NO: 3919606 - RNA, 14 nt, Shigella flexneri 2a str. 301
agugagcacugaau

SEQ ID NO: 3919607 - RNA, 16 nt, Shigella flexneri 2a str. 301
agugagugaaauuuug

SEQ ID NO: 3919608 - RNA, 18 nt, Shigella flexneri 2a str. 301
agugaugaaaacgaaggc

SEQ ID NO: 3919609 - RNA, 18 nt, Shigella flexneri 2a str. 301
agugaugccauacuucau

SEQ ID NO: 3919610 - RNA, 13 nt, Shigella flexneri 2a str. 301
agugaugcgcagg

SEQ ID NO: 3919611 - RNA, 22 nt, Shigella flexneri 2a str. 301
agugaugguggugggggaagga

SEQ ID NO: 3919612 - RNA, 15 nt, Shigella flexneri 2a str. 301
agugauuaacagcgc

SEQ ID NO: 3919613 - RNA, 17 nt, Shigella flexneri 2a str. 301
agugauugcuugccccu

SEQ ID NO: 3919614 - RNA, 13 nt, Shigella flexneri 2a str. 301
agugcaaauccac

SEQ ID NO: 3919615 - RNA, 14 nt, Shigella flexneri 2a str. 301
agugcaaaugccag

SEQ ID NO: 3919616 - RNA, 16 nt, Shigella flexneri 2a str. 301
agugcaaaugccagau

SEQ ID NO: 3919617 - RNA, 22 nt, Shigella flexneri 2a str. 301
agugcaaaugccagauaagaca

SEQ ID NO: 3919618 - RNA, 18 nt, Shigella flexneri 2a str. 301
agugcaaucaguggugua

SEQ ID NO: 3919619 - RNA, 15 nt, Shigella flexneri 2a str. 301
agugcagcaugcacc

SEQ ID NO: 3919620 - RNA, 19 nt, Shigella flexneri 2a str. 301
agugcagcaugcacccuca

SEQ ID NO: 3919621 - RNA, 12 nt, Shigella flexneri 2a str. 301
agugcagcgaag

SEQ ID NO: 3919622 - RNA, 22 nt, Shigella flexneri 2a str. 301
agugcaggcaccagccccugga

SEQ ID NO: 3919623 - RNA, 17 nt, Shigella flexneri 2a str. 301
agugccaaaaaaauaag

SEQ ID NO: 3919624 - RNA, 14 nt, Shigella flexneri 2a str. 301
agugccaaagccag

SEQ ID NO: 3919625 - RNA, 22 nt, Shigella flexneri 2a str. 301
agugccaugccaaucagcagaa

SEQ ID NO: 3919626 - RNA, 18 nt, Shigella flexneri 2a str. 301
agugcccgaccacuucau

SEQ ID NO: 3919627 - RNA, 14 nt, Shigella flexneri 2a str. 301
agugccgaagaaca

SEQ ID NO: 3919628 - RNA, 19 nt, Shigella flexneri 2a str. 301
agugccgcccaccacucga

SEQ ID NO: 3919629 - RNA, 21 nt, Shigella flexneri 2a str. 301
agugccggauguuugcauccg

SEQ ID NO: 3919630 - RNA, 17 nt, Shigella flexneri 2a str. 301
agugccgguggaagggc

SEQ ID NO: 3919631 - RNA, 18 nt, Shigella flexneri 2a str. 301
agugccgguggaagggcu

SEQ ID NO: 3919632 - RNA, 14 nt, Shigella flexneri 2a str. 301
agugccgucagcag

SEQ ID NO: 3919633 - RNA, 15 nt, Shigella flexneri 2a str. 301
agugccguuccagcc

SEQ ID NO: 3919634 - RNA, 16 nt, Shigella flexneri 2a str. 301
agugccguuccagcca

SEQ ID NO: 3919635 - RNA, 15 nt, Shigella flexneri 2a str. 301
agugcgcaacaaaac

SEQ ID NO: 3919636 - RNA, 22 nt, Shigella flexneri 2a str. 301
agugcgcguuuuuuaugccgga

SEQ ID NO: 3919637 - RNA, 20 nt, Shigella flexneri 2a str. 301
agugcggcgagcaucgccca

SEQ ID NO: 3919638 - RNA, 16 nt, Shigella flexneri 2a str. 301
agugcgguaaauuuuu

SEQ ID NO: 3919639 - RNA, 16 nt, Shigella flexneri 2a str. 301
agugcguaagcgcgga

SEQ ID NO: 3919640 - RNA, 15 nt, Shigella flexneri 2a str. 301
agugcguaucaauag

SEQ ID NO: 3919641 - RNA, 20 nt, Shigella flexneri 2a str. 301
agugcgucaucggcggcaga

SEQ ID NO: 3919642 - RNA, 13 nt, Shigella flexneri 2a str. 301
agugcugaagguu

SEQ ID NO: 3919643 - RNA, 16 nt, Shigella flexneri 2a str. 301
agugcugccaucuucu

SEQ ID NO: 3919644 - RNA, 18 nt, Shigella flexneri 2a str. 301
agugcugcuuuugcuucu

SEQ ID NO: 3919645 - RNA, 22 nt, Shigella flexneri 2a str. 301
agugcuucgcggacaucgucca

SEQ ID NO: 3919646 - RNA, 18 nt, Shigella flexneri 2a str. 301
agugcuuucugaacugaa

SEQ ID NO: 3919647 - RNA, 18 nt, Shigella flexneri 2a str. 301
aguggaaaaauaacaaau

SEQ ID NO: 3919648 - RNA, 15 nt, Shigella flexneri 2a str. 301
aguggacgaacaguu

SEQ ID NO: 3919649 - RNA, 14 nt, Shigella flexneri 2a str. 301
aguggacggcugau

SEQ ID NO: 3919650 - RNA, 19 nt, Shigella flexneri 2a str. 301
aguggaguccagcgccuga

SEQ ID NO: 3919651 - RNA, 20 nt, Shigella flexneri 2a str. 301
aguggaucccagaagaauau

SEQ ID NO: 3919652 - RNA, 14 nt, Shigella flexneri 2a str. 301
aguggauuaucuuc

SEQ ID NO: 3919653 - RNA, 15 nt, Shigella flexneri 2a str. 301
aguggcaaccagcag

SEQ ID NO: 3919654 - RNA, 17 nt, Shigella flexneri 2a str. 301
aguggcagcaaaucaug

SEQ ID NO: 3919655 - RNA, 17 nt, Shigella flexneri 2a str. 301
aguggcgcagagccuga

SEQ ID NO: 3919656 - RNA, 11 nt, Shigella flexneri 2a str. 301
aguggcgcauc

SEQ ID NO: 3919657 - RNA, 18 nt, Shigella flexneri 2a str. 301
aguggcuauuuaccaaua

SEQ ID NO: 3919658 - RNA, 17 nt, Shigella flexneri 2a str. 301
aguggcucaggcucuca

SEQ ID NO: 3919659 - RNA, 19 nt, Shigella flexneri 2a str. 301
aguggcugcguuucaugua

SEQ ID NO: 3919660 - RNA, 15 nt, Shigella flexneri 2a str. 301
agugggauucaccaa

SEQ ID NO: 3919661 - RNA, 18 nt, Shigella flexneri 2a str. 301
aguggggcggagaugcgg

SEQ ID NO: 3919662 - RNA, 15 nt, Shigella flexneri 2a str. 301
aguggguuguaucaa

SEQ ID NO: 3919663 - RNA, 18 nt, Shigella flexneri 2a str. 301
agugguaagaggaauuga

SEQ ID NO: 3919664 - RNA, 14 nt, Shigella flexneri 2a str. 301
aguggugaaaaaaa

SEQ ID NO: 3919665 - RNA, 21 nt, Shigella flexneri 2a str. 301
agugguuagccggauaaacaa

SEQ ID NO: 3919666 - RNA, 18 nt, Shigella flexneri 2a str. 301
agugguuucgccagcacc

SEQ ID NO: 3919667 - RNA, 12 nt, Shigella flexneri 2a str. 301
aguguaaaacag

SEQ ID NO: 3919668 - RNA, 13 nt, Shigella flexneri 2a str. 301
aguguaaaauucu

SEQ ID NO: 3919669 - RNA, 14 nt, Shigella flexneri 2a str. 301
aguguccagcggca

SEQ ID NO: 3919670 - RNA, 21 nt, Shigella flexneri 2a str. 301
aguguccgccaauuucaucac

SEQ ID NO: 3919671 - RNA, 18 nt, Shigella flexneri 2a str. 301
agugugaauaccgcugcc

SEQ ID NO: 3919672 - RNA, 13 nt, Shigella flexneri 2a str. 301
aguguggccagag

SEQ ID NO: 3919673 - RNA, 22 nt, Shigella flexneri 2a str. 301
aguguggccagagugcguucac

SEQ ID NO: 3919674 - RNA, 12 nt, Shigella flexneri 2a str. 301
aguguggcggcu

SEQ ID NO: 3919675 - RNA, 19 nt, Shigella flexneri 2a str. 301
agugugggaaaaauuguuu

SEQ ID NO: 3919676 - RNA, 16 nt, Shigella flexneri 2a str. 301
aguguguauacggcaa

SEQ ID NO: 3919677 - RNA, 22 nt, Shigella flexneri 2a str. 301
aguguucauaaagagguggggg

SEQ ID NO: 3919678 - RNA, 15 nt, Shigella flexneri 2a str. 301
aguguuggcgucaga

SEQ ID NO: 3919679 - RNA, 16 nt, Shigella flexneri 2a str. 301
aguguuucggucugau

SEQ ID NO: 3919680 - RNA, 20 nt, Shigella flexneri 2a str. 301
aguuaaaauucaagacauca

SEQ ID NO: 3919681 - RNA, 19 nt, Shigella flexneri 2a str. 301
aguuaaacuuucauaaaca

SEQ ID NO: 3919682 - RNA, 22 nt, Shigella flexneri 2a str. 301
aguuaaccaaaaauuuccacaa

SEQ ID NO: 3919683 - RNA, 23 nt, Shigella flexneri 2a str. 301
aguuaagcccaguucagcggcug

SEQ ID NO: 3919684 - RNA, 18 nt, Shigella flexneri 2a str. 301
aguuaauccacagcaaug

SEQ ID NO: 3919685 - RNA, 23 nt, Shigella flexneri 2a str. 301
aguuaauucugagagcaugaaau

SEQ ID NO: 3919686 - RNA, 13 nt, Shigella flexneri 2a str. 301
aguuacacaucau

SEQ ID NO: 3919687 - RNA, 13 nt, Shigella flexneri 2a str. 301
aguuacagcucuc

SEQ ID NO: 3919688 - RNA, 18 nt, Shigella flexneri 2a str. 301
aguuaccagcggccggau

SEQ ID NO: 3919689 - RNA, 16 nt, Shigella flexneri 2a str. 301
aguuacccagccugca

SEQ ID NO: 3919690 - RNA, 16 nt, Shigella flexneri 2a str. 301
aguuacgugcugcgca

SEQ ID NO: 3919691 - RNA, 18 nt, Shigella flexneri 2a str. 301
aguuacugccaucuuccg

SEQ ID NO: 3919692 - RNA, 16 nt, Shigella flexneri 2a str. 301
aguuagagccagggau

SEQ ID NO: 3919693 - RNA, 14 nt, Shigella flexneri 2a str. 301
aguuagaggcacau

SEQ ID NO: 3919694 - RNA, 14 nt, Shigella flexneri 2a str. 301
aguuagaguagcca

SEQ ID NO: 3919695 - RNA, 19 nt, Shigella flexneri 2a str. 301
aguuagcaaggauguggcu

SEQ ID NO: 3919696 - RNA, 22 nt, Shigella flexneri 2a str. 301
aguuaguccacacgccaggcca

SEQ ID NO: 3919697 - RNA, 17 nt, Shigella flexneri 2a str. 301
aguuagucgcuuucauu

SEQ ID NO: 3919698 - RNA, 22 nt, Shigella flexneri 2a str. 301
aguuaguguuaaccaacggcga

SEQ ID NO: 3919699 - RNA, 13 nt, Shigella flexneri 2a str. 301
aguuaucaagcca

SEQ ID NO: 3919700 - RNA, 22 nt, Shigella flexneri 2a str. 301
aguuauuaaaacgauaguggcu

SEQ ID NO: 3919701 - RNA, 22 nt, Shigella flexneri 2a str. 301
aguuauuacaaucccgcuuaca

SEQ ID NO: 3919702 - RNA, 11 nt, Shigella flexneri 2a str. 301
aguuauucauu

SEQ ID NO: 3919703 - RNA, 15 nt, Shigella flexneri 2a str. 301
aguuauugcgcugcu

SEQ ID NO: 3919704 - RNA, 13 nt, Shigella flexneri 2a str. 301
auaaaacagggcg

SEQ ID NO: 3919705 - RNA, 10 nt, Shigella flexneri 2a str. 301
auaaaacauc

SEQ ID NO: 3919706 - RNA, 19 nt, Shigella flexneri 2a str. 301
auaaaacgcagucuuccca

SEQ ID NO: 3919707 - RNA, 21 nt, Shigella flexneri 2a str. 301
auaaaacgcagucuucccagc

SEQ ID NO: 3919708 - RNA, 12 nt, Shigella flexneri 2a str. 301
auaaaacuuccc

SEQ ID NO: 3919709 - RNA, 16 nt, Shigella flexneri 2a str. 301
auaaaagaaaaaauga

SEQ ID NO: 3919710 - RNA, 17 nt, Shigella flexneri 2a str. 301
auaaaagcccugggcac

SEQ ID NO: 3919711 - RNA, 19 nt, Shigella flexneri 2a str. 301
auaaaaggcaccuggaaau

SEQ ID NO: 3919712 - RNA, 22 nt, Shigella flexneri 2a str. 301
auaaaaucuauuauuauuuuug

SEQ ID NO: 3919713 - RNA, 18 nt, Shigella flexneri 2a str. 301
auaaaaugauuucgcaac

SEQ ID NO: 3919714 - RNA, 19 nt, Shigella flexneri 2a str. 301
auaaaauggccguaauaga

SEQ ID NO: 3919715 - RNA, 13 nt, Shigella flexneri 2a str. 301
auaaaauuaacga

SEQ ID NO: 3919716 - RNA, 14 nt, Shigella flexneri 2a str. 301
auaaaauuauccag

SEQ ID NO: 3919717 - RNA, 15 nt, Shigella flexneri 2a str. 301
auaaaauucauucaa

SEQ ID NO: 3919718 - RNA, 17 nt, Shigella flexneri 2a str. 301
auaaaauucauucaauu

SEQ ID NO: 3919719 - RNA, 18 nt, Shigella flexneri 2a str. 301
auaaaauucuccagcgcc

SEQ ID NO: 3919720 - RNA, 22 nt, Shigella flexneri 2a str. 301
auaaacaaagcgcacuuugcca

SEQ ID NO: 3919721 - RNA, 20 nt, Shigella flexneri 2a str. 301
auaaacaaccccaucgcguu

SEQ ID NO: 3919722 - RNA, 12 nt, Shigella flexneri 2a str. 301
auaaacaacgag

SEQ ID NO: 3919723 - RNA, 16 nt, Shigella flexneri 2a str. 301
auaaacaccagcaaua

SEQ ID NO: 3919724 - RNA, 17 nt, Shigella flexneri 2a str. 301
auaaacaccagcaauaa

SEQ ID NO: 3919725 - RNA, 18 nt, Shigella flexneri 2a str. 301
auaaacaccagcaauaau

SEQ ID NO: 3919726 - RNA, 11 nt, Shigella flexneri 2a str. 301
auaaacagcag

SEQ ID NO: 3919727 - RNA, 12 nt, Shigella flexneri 2a str. 301
auaaacagcagg

SEQ ID NO: 3919728 - RNA, 15 nt, Shigella flexneri 2a str. 301
auaaacagcguaaau

SEQ ID NO: 3919729 - RNA, 14 nt, Shigella flexneri 2a str. 301
auaaacagggcuuu

SEQ ID NO: 3919730 - RNA, 19 nt, Shigella flexneri 2a str. 301
auaaacaguuucgccaggg

SEQ ID NO: 3919731 - RNA, 20 nt, Shigella flexneri 2a str. 301
auaaacaguuucgccagggu

SEQ ID NO: 3919732 - RNA, 23 nt, Shigella flexneri 2a str. 301
auaaacaucagcuauucuuauaa

SEQ ID NO: 3919733 - RNA, 23 nt, Shigella flexneri 2a str. 301
auaaacauccaccgccacgccga

SEQ ID NO: 3919734 - RNA, 19 nt, Shigella flexneri 2a str. 301
auaaacaucgggacaugau

SEQ ID NO: 3919735 - RNA, 16 nt, Shigella flexneri 2a str. 301
auaaaccacgcaauaa

SEQ ID NO: 3919736 - RNA, 16 nt, Shigella flexneri 2a str. 301
auaaaccagcaaccaa

SEQ ID NO: 3919737 - RNA, 20 nt, Shigella flexneri 2a str. 301
auaaaccgcucgugggcauc

SEQ ID NO: 3919738 - RNA, 18 nt, Shigella flexneri 2a str. 301
auaaaccugcuggcgcac

SEQ ID NO: 3919739 - RNA, 20 nt, Shigella flexneri 2a str. 301
auaaacgaaucugcaaaucu

SEQ ID NO: 3919740 - RNA, 22 nt, Shigella flexneri 2a str. 301
auaaacgccagguucaucaauu

SEQ ID NO: 3919741 - RNA, 19 nt, Shigella flexneri 2a str. 301
auaaacgccauauucugau

SEQ ID NO: 3919742 - RNA, 21 nt, Shigella flexneri 2a str. 301
auaaacgccgucaucacaccg

SEQ ID NO: 3919743 - RNA, 20 nt, Shigella flexneri 2a str. 301
auaaacgcgaccgccgccaa

SEQ ID NO: 3919744 - RNA, 20 nt, Shigella flexneri 2a str. 301
auaaacgguuucagcagcgg

SEQ ID NO: 3919745 - RNA, 22 nt, Shigella flexneri 2a str. 301
auaaacguacauccaugcacuc

SEQ ID NO: 3919746 - RNA, 17 nt, Shigella flexneri 2a str. 301
auaaacucaaucaggcu

SEQ ID NO: 3919747 - RNA, 15 nt, Shigella flexneri 2a str. 301
auaaacucaccaaau

SEQ ID NO: 3919748 - RNA, 16 nt, Shigella flexneri 2a str. 301
auaaacucaugggucu

SEQ ID NO: 3919749 - RNA, 16 nt, Shigella flexneri 2a str. 301
auaaacuccugcacgc

SEQ ID NO: 3919750 - RNA, 20 nt, Shigella flexneri 2a str. 301
auaaacucucuauuccacca

SEQ ID NO: 3919751 - RNA, 16 nt, Shigella flexneri 2a str. 301
auaaacugagccaaac

SEQ ID NO: 3919752 - RNA, 21 nt, Shigella flexneri 2a str. 301
auaaacuuuucccuacugcug

SEQ ID NO: 3919753 - RNA, 13 nt, Shigella flexneri 2a str. 301
auaaagaaaaucu

SEQ ID NO: 3919754 - RNA, 22 nt, Shigella flexneri 2a str. 301
auaaagacguuaacuacaauca

SEQ ID NO: 3919755 - RNA, 22 nt, Shigella flexneri 2a str. 301
auaaagcacugucuaacaacau

SEQ ID NO: 3919756 - RNA, 15 nt, Shigella flexneri 2a str. 301
auaaagcagccuauu

SEQ ID NO: 3919757 - RNA, 21 nt, Shigella flexneri 2a str. 301
auaaagcccccuguuugucua

SEQ ID NO: 3919758 - RNA, 23 nt, Shigella flexneri 2a str. 301
auaaagccugcuucaaacgcuga

SEQ ID NO: 3919759 - RNA, 14 nt, Shigella flexneri 2a str. 301
auaaagcgaggcua

SEQ ID NO: 3919760 - RNA, 15 nt, Shigella flexneri 2a str. 301
auaaagcgguuuuca

SEQ ID NO: 3919761 - RNA, 22 nt, Shigella flexneri 2a str. 301
auaaagcguuuaucaauuaacu

SEQ ID NO: 3919762 - RNA, 17 nt, Shigella flexneri 2a str. 301
auaaagcugaucacaua

SEQ ID NO: 3919763 - RNA, 18 nt, Shigella flexneri 2a str. 301
auaaaggucgacagcagc

SEQ ID NO: 3919764 - RNA, 16 nt, Shigella flexneri 2a str. 301
auaaauaagaugcgag

SEQ ID NO: 3919765 - RNA, 22 nt, Shigella flexneri 2a str. 301
auaaauaauaagagcguccaga

SEQ ID NO: 3919766 - RNA, 18 nt, Shigella flexneri 2a str. 301
auaaauacagcguuaaaa

SEQ ID NO: 3919767 - RNA, 23 nt, Shigella flexneri 2a str. 301
auaaauagauccaggaacagaag

SEQ ID NO: 3919768 - RNA, 15 nt, Shigella flexneri 2a str. 301
auaaauauauaaaaa

SEQ ID NO: 3919769 - RNA, 20 nt, Shigella flexneri 2a str. 301
auaaauauauaaaaaaacaa

SEQ ID NO: 3919770 - RNA, 15 nt, Shigella flexneri 2a str. 301
auaaauaucaaagac

SEQ ID NO: 3919771 - RNA, 19 nt, Shigella flexneri 2a str. 301
auaaauauggugaaaguaa

SEQ ID NO: 3919772 - RNA, 20 nt, Shigella flexneri 2a str. 301
auaaauauggugaaaguaaa

SEQ ID NO: 3919773 - RNA, 17 nt, Shigella flexneri 2a str. 301
auaaauccaacaacaca

SEQ ID NO: 3919774 - RNA, 22 nt, Shigella flexneri 2a str. 301
auaaauccaacaacacauucaa

SEQ ID NO: 3919775 - RNA, 10 nt, Shigella flexneri 2a str. 301
auaaaucccg

SEQ ID NO: 3919776 - RNA, 14 nt, Shigella flexneri 2a str. 301
auaaaucuccauuu

SEQ ID NO: 3919777 - RNA, 15 nt, Shigella flexneri 2a str. 301
auaaaugccgcaaug

SEQ ID NO: 3919778 - RNA, 16 nt, Shigella flexneri 2a str. 301
auaaauuucugccauu

SEQ ID NO: 3919779 - RNA, 21 nt, Shigella flexneri 2a str. 301
auaaauuucugccauuuugcu

SEQ ID NO: 3919780 - RNA, 23 nt, Shigella flexneri 2a str. 301
auaaauuucugccauuuugcuuu

SEQ ID NO: 3919781 - RNA, 16 nt, Shigella flexneri 2a str. 301
auaacaccgauuuugu

SEQ ID NO: 3919782 - RNA, 23 nt, Shigella flexneri 2a str. 301
auaacaccgauuuuguaaaagaa

SEQ ID NO: 3919783 - RNA, 23 nt, Shigella flexneri 2a str. 301
auaacagaaugcgggcgaaaaca

SEQ ID NO: 3919784 - RNA, 18 nt, Shigella flexneri 2a str. 301
auaacagcccgccaacca

SEQ ID NO: 3919785 - RNA, 13 nt, Shigella flexneri 2a str. 301
auaacaucgccag

SEQ ID NO: 3919786 - RNA, 10 nt, Shigella flexneri 2a str. 301
auaaccaaau

SEQ ID NO: 3919787 - RNA, 15 nt, Shigella flexneri 2a str. 301
auaaccauauaugau

SEQ ID NO: 3919788 - RNA, 15 nt, Shigella flexneri 2a str. 301
auaaccaucagcugu

SEQ ID NO: 3919789 - RNA, 14 nt, Shigella flexneri 2a str. 301
auaacccagcgcac

SEQ ID NO: 3919790 - RNA, 15 nt, Shigella flexneri 2a str. 301
auaacccagggguca

SEQ ID NO: 3919791 - RNA, 14 nt, Shigella flexneri 2a str. 301
auaacccccuccuu

SEQ ID NO: 3919792 - RNA, 21 nt, Shigella flexneri 2a str. 301
auaacccgcuguaaaugcugc

SEQ ID NO: 3919793 - RNA, 12 nt, Shigella flexneri 2a str. 301
auaaccgagcau

SEQ ID NO: 3919794 - RNA, 21 nt, Shigella flexneri 2a str. 301
auaaccgcaucaacagugcca

SEQ ID NO: 3919795 - RNA, 23 nt, Shigella flexneri 2a str. 301
auaaccgcugcaaaaaauugcgu

SEQ ID NO: 3919796 - RNA, 21 nt, Shigella flexneri 2a str. 301
auaaccggcaagcaaauacuu

SEQ ID NO: 3919797 - RNA, 23 nt, Shigella flexneri 2a str. 301
auaaccguaauaguuauagccgu

SEQ ID NO: 3919798 - RNA, 19 nt, Shigella flexneri 2a str. 301
auaaccgucagcgcaugau

SEQ ID NO: 3919799 - RNA, 12 nt, Shigella flexneri 2a str. 301
auaaccuauugu

SEQ ID NO: 3919800 - RNA, 16 nt, Shigella flexneri 2a str. 301
auaaccugaaagccga

SEQ ID NO: 3919801 - RNA, 17 nt, Shigella flexneri 2a str. 301
auaaccugugcaccaga

SEQ ID NO: 3919802 - RNA, 18 nt, Shigella flexneri 2a str. 301
auaaccugugcaccagaa

SEQ ID NO: 3919803 - RNA, 11 nt, Shigella flexneri 2a str. 301
auaaccuucaa

SEQ ID NO: 3919804 - RNA, 19 nt, Shigella flexneri 2a str. 301
auaauuccggcuuggugug

SEQ ID NO: 3919805 - RNA, 23 nt, Shigella flexneri 2a str. 301
auaauuccucccguuaugaucag

SEQ ID NO: 3919806 - RNA, 16 nt, Shigella flexneri 2a str. 301
auaauugccagcuugc

SEQ ID NO: 3919807 - RNA, 15 nt, Shigella flexneri 2a str. 301
auaauugcgaugcca

SEQ ID NO: 3919808 - RNA, 16 nt, Shigella flexneri 2a str. 301
auaauugcgaugccag

SEQ ID NO: 3919809 - RNA, 21 nt, Shigella flexneri 2a str. 301
auaauuguuccguuauuaugc

SEQ ID NO: 3919810 - RNA, 21 nt, Shigella flexneri 2a str. 301
auaauuuaugccugauacgca

SEQ ID NO: 3919811 - RNA, 14 nt, Shigella flexneri 2a str. 301
auaauuugugacga

SEQ ID NO: 3919812 - RNA, 13 nt, Shigella flexneri 2a str. 301
auaauuuuaaaua

SEQ ID NO: 3919813 - RNA, 20 nt, Shigella flexneri 2a str. 301
auaauuuucgguaaugacuc

SEQ ID NO: 3919814 - RNA, 21 nt, Shigella flexneri 2a str. 301
auaauuuucgguaaugacucc

SEQ ID NO: 3919815 - RNA, 14 nt, Shigella flexneri 2a str. 301
auaauuuuuucuuc

SEQ ID NO: 3919816 - RNA, 15 nt, Shigella flexneri 2a str. 301
auacaaauagccaau

SEQ ID NO: 3919817 - RNA, 18 nt, Shigella flexneri 2a str. 301
auacaaccagauaaccau

SEQ ID NO: 3919818 - RNA, 12 nt, Shigella flexneri 2a str. 301
auacaacccacc

SEQ ID NO: 3919819 - RNA, 20 nt, Shigella flexneri 2a str. 301
auacaacugccgcgccugaa

SEQ ID NO: 3919820 - RNA, 22 nt, Shigella flexneri 2a str. 301
auacaagagauaugaauaugaa

SEQ ID NO: 3919821 - RNA, 15 nt, Shigella flexneri 2a str. 301
auacacgaggcauau

SEQ ID NO: 3919822 - RNA, 20 nt, Shigella flexneri 2a str. 301
auacacgcccgucaugccgu

SEQ ID NO: 3919823 - RNA, 17 nt, Shigella flexneri 2a str. 301
auacacgccgugggcau

SEQ ID NO: 3919824 - RNA, 17 nt, Shigella flexneri 2a str. 301
auacacuauaaaauaac

SEQ ID NO: 3919825 - RNA, 18 nt, Shigella flexneri 2a str. 301
auacacuucacacacuuu

SEQ ID NO: 3919826 - RNA, 18 nt, Shigella flexneri 2a str. 301
auacagaugcugcucuuc

SEQ ID NO: 3919827 - RNA, 15 nt, Shigella flexneri 2a str. 301
auacagcaauggaaa

SEQ ID NO: 3919828 - RNA, 17 nt, Shigella flexneri 2a str. 301
auacagcaauggaaaaa

SEQ ID NO: 3919829 - RNA, 15 nt, Shigella flexneri 2a str. 301
auacagccaaaucau

SEQ ID NO: 3919830 - RNA, 20 nt, Shigella flexneri 2a str. 301
auacagcccagacaaaugaa

SEQ ID NO: 3919831 - RNA, 12 nt, Shigella flexneri 2a str. 301
auacagccgaag

SEQ ID NO: 3919832 - RNA, 17 nt, Shigella flexneri 2a str. 301
auacagcggacagccau

SEQ ID NO: 3919833 - RNA, 15 nt, Shigella flexneri 2a str. 301
auacagcucagguuc

SEQ ID NO: 3919834 - RNA, 18 nt, Shigella flexneri 2a str. 301
auacagcucaugggcuuu

SEQ ID NO: 3919835 - RNA, 23 nt, Shigella flexneri 2a str. 301
auacaggaacagccacuggugag

SEQ ID NO: 3919836 - RNA, 21 nt, Shigella flexneri 2a str. 301
auacaggggccaguuccgccg

SEQ ID NO: 3919837 - RNA, 19 nt, Shigella flexneri 2a str. 301
auacagguuucaaugcaca

SEQ ID NO: 3919838 - RNA, 12 nt, Shigella flexneri 2a str. 301
auacaguuuuug

SEQ ID NO: 3919839 - RNA, 16 nt, Shigella flexneri 2a str. 301
auacauagaaacucau

SEQ ID NO: 3919840 - RNA, 18 nt, Shigella flexneri 2a str. 301
auacauagaaacucauau

SEQ ID NO: 3919841 - RNA, 22 nt, Shigella flexneri 2a str. 301
auacauagcgccucuuuauaaa

SEQ ID NO: 3919842 - RNA, 15 nt, Shigella flexneri 2a str. 301
auacaucagcgacaa

SEQ ID NO: 3919843 - RNA, 22 nt, Shigella flexneri 2a str. 301
auacaucgcgcuuaucgccagc

SEQ ID NO: 3919844 - RNA, 17 nt, Shigella flexneri 2a str. 301
auacaucuucaucaucc

SEQ ID NO: 3919845 - RNA, 21 nt, Shigella flexneri 2a str. 301
auacauguacauggugcacau

SEQ ID NO: 3919846 - RNA, 14 nt, Shigella flexneri 2a str. 301
auacauucagaauu

SEQ ID NO: 3919847 - RNA, 18 nt, Shigella flexneri 2a str. 301
auacauuccacuuucagc

SEQ ID NO: 3919848 - RNA, 21 nt, Shigella flexneri 2a str. 301
auaccaaaaucaucaauugcc

SEQ ID NO: 3919849 - RNA, 14 nt, Shigella flexneri 2a str. 301
auaccaaugauugg

SEQ ID NO: 3919850 - RNA, 12 nt, Shigella flexneri 2a str. 301
auaccacacccg

SEQ ID NO: 3919851 - RNA, 16 nt, Shigella flexneri 2a str. 301
auaccacccgcaguga

SEQ ID NO: 3919852 - RNA, 17 nt, Shigella flexneri 2a str. 301
auaccacgccaucaacg

SEQ ID NO: 3919853 - RNA, 16 nt, Shigella flexneri 2a str. 301
auaccacuuccagcag

SEQ ID NO: 3919854 - RNA, 17 nt, Shigella flexneri 2a str. 301
auaccacuuccagcaga

SEQ ID NO: 3919855 - RNA, 18 nt, Shigella flexneri 2a str. 301
auaccagcccgucucagc

SEQ ID NO: 3919856 - RNA, 20 nt, Shigella flexneri 2a str. 301
auaccaguccacccacguua

SEQ ID NO: 3919857 - RNA, 16 nt, Shigella flexneri 2a str. 301
auaccaucacaccucg

SEQ ID NO: 3919858 - RNA, 22 nt, Shigella flexneri 2a str. 301
auaccauccggcauaaacgcua

SEQ ID NO: 3919859 - RNA, 12 nt, Shigella flexneri 2a str. 301
auacccaaaaaa

SEQ ID NO: 3919860 - RNA, 15 nt, Shigella flexneri 2a str. 301
auacccaaaaaauag

SEQ ID NO: 3919861 - RNA, 19 nt, Shigella flexneri 2a str. 301
auacccaaaaaauagcaaa

SEQ ID NO: 3919862 - RNA, 19 nt, Shigella flexneri 2a str. 301
auacccaacguaacaaaac

SEQ ID NO: 3919863 - RNA, 20 nt, Shigella flexneri 2a str. 301
auacccaacguaacaaaacu

SEQ ID NO: 3919864 - RNA, 17 nt, Shigella flexneri 2a str. 301
auacccaccgguccuaa

SEQ ID NO: 3919865 - RNA, 12 nt, Shigella flexneri 2a str. 301
auacccagcacc

SEQ ID NO: 3919866 - RNA, 17 nt, Shigella flexneri 2a str. 301
auacccaguuucaugau

SEQ ID NO: 3919867 - RNA, 16 nt, Shigella flexneri 2a str. 301
auaccccgccagcaga

SEQ ID NO: 3919868 - RNA, 20 nt, Shigella flexneri 2a str. 301
auacccgcauucgccgcugg

SEQ ID NO: 3919869 - RNA, 17 nt, Shigella flexneri 2a str. 301
auacccgccaaaccacu

SEQ ID NO: 3919870 - RNA, 16 nt, Shigella flexneri 2a str. 301
auaccgaaaucgccau

SEQ ID NO: 3919871 - RNA, 20 nt, Shigella flexneri 2a str. 301
auaccgaacauaccaccgac

SEQ ID NO: 3919872 - RNA, 17 nt, Shigella flexneri 2a str. 301
auaccgaaccaaaauag

SEQ ID NO: 3919873 - RNA, 15 nt, Shigella flexneri 2a str. 301
auaccgauaucgcca

SEQ ID NO: 3919874 - RNA, 13 nt, Shigella flexneri 2a str. 301
auaccgaucaccg

SEQ ID NO: 3919875 - RNA, 16 nt, Shigella flexneri 2a str. 301
auaccgccgccagcaa

SEQ ID NO: 3919876 - RNA, 15 nt, Shigella flexneri 2a str. 301
auaccgcgaaucaua

SEQ ID NO: 3919877 - RNA, 19 nt, Shigella flexneri 2a str. 301
auaccggacacacuucauu

SEQ ID NO: 3919878 - RNA, 22 nt, Shigella flexneri 2a str. 301
auaccggagacgguuauauuua

SEQ ID NO: 3919879 - RNA, 16 nt, Shigella flexneri 2a str. 301
auaccggaucgcaucg

SEQ ID NO: 3919880 - RNA, 21 nt, Shigella flexneri 2a str. 301
auaccggcgucccaucggcaa

SEQ ID NO: 3919881 - RNA, 19 nt, Shigella flexneri 2a str. 301
auaccgucagcgaucagca

SEQ ID NO: 3919882 - RNA, 20 nt, Shigella flexneri 2a str. 301
auaccgucagcgaucagcau

SEQ ID NO: 3919883 - RNA, 13 nt, Shigella flexneri 2a str. 301
auaccuaaaaaau

SEQ ID NO: 3919884 - RNA, 14 nt, Shigella flexneri 2a str. 301
auaccuaaaagcac

SEQ ID NO: 3919885 - RNA, 23 nt, Shigella flexneri 2a str. 301
auaccugaguggcaauagaauaa

SEQ ID NO: 3919886 - RNA, 19 nt, Shigella flexneri 2a str. 301
auaccugauuaaacggguc

SEQ ID NO: 3919887 - RNA, 17 nt, Shigella flexneri 2a str. 301
auaccuggcgcagcugc

SEQ ID NO: 3919888 - RNA, 15 nt, Shigella flexneri 2a str. 301
auaccugguccuuca

SEQ ID NO: 3919889 - RNA, 16 nt, Shigella flexneri 2a str. 301
auaccuuacacucaaa

SEQ ID NO: 3919890 - RNA, 22 nt, Shigella flexneri 2a str. 301
auaccuucacagaaggccagga

SEQ ID NO: 3919891 - RNA, 17 nt, Shigella flexneri 2a str. 301
auacgaccguuccauuc

SEQ ID NO: 3919892 - RNA, 17 nt, Shigella flexneri 2a str. 301
auacgaucaaccaccgu

SEQ ID NO: 3919893 - RNA, 22 nt, Shigella flexneri 2a str. 301
auacgcaccgggcuuccggcaa

SEQ ID NO: 3919894 - RNA, 18 nt, Shigella flexneri 2a str. 301
auacgcauaugcaucaga

SEQ ID NO: 3919895 - RNA, 15 nt, Shigella flexneri 2a str. 301
auacgccccacagac

SEQ ID NO: 3919896 - RNA, 14 nt, Shigella flexneri 2a str. 301
auacgccucacagg

SEQ ID NO: 3919897 - RNA, 15 nt, Shigella flexneri 2a str. 301
auacgucaucccaac

SEQ ID NO: 3919898 - RNA, 16 nt, Shigella flexneri 2a str. 301
auacguccaccccagc

SEQ ID NO: 3919899 - RNA, 18 nt, Shigella flexneri 2a str. 301
auacguuucaccagcacu

SEQ ID NO: 3919900 - RNA, 17 nt, Shigella flexneri 2a str. 301
auacucagcgccugcug

SEQ ID NO: 3919901 - RNA, 19 nt, Shigella flexneri 2a str. 301
auacucuuugacaacauca

SEQ ID NO: 3919902 - RNA, 22 nt, Shigella flexneri 2a str. 301
auacucuuugacaacaucaucu

SEQ ID NO: 3919903 - RNA, 17 nt, Shigella flexneri 2a str. 301
auacucuuugguauuca

SEQ ID NO: 3919904 - RNA, 20 nt, Shigella flexneri 2a str. 301
auaguuggcccgauagaaac

SEQ ID NO: 3919905 - RNA, 11 nt, Shigella flexneri 2a str. 301
auauaaaaaac

SEQ ID NO: 3919906 - RNA, 15 nt, Shigella flexneri 2a str. 301
auauaaagcaucaau

SEQ ID NO: 3919907 - RNA, 16 nt, Shigella flexneri 2a str. 301
auauaaagcugaucac

SEQ ID NO: 3919908 - RNA, 17 nt, Shigella flexneri 2a str. 301
auauaacagucauacaa

SEQ ID NO: 3919909 - RNA, 14 nt, Shigella flexneri 2a str. 301
auauaaugcaacau

SEQ ID NO: 3919910 - RNA, 16 nt, Shigella flexneri 2a str. 301
auauaauugaccagau

SEQ ID NO: 3919911 - RNA, 13 nt, Shigella flexneri 2a str. 301
auauacaaucaca

SEQ ID NO: 3919912 - RNA, 19 nt, Shigella flexneri 2a str. 301
auauacauaaagucuuucu

SEQ ID NO: 3919913 - RNA, 15 nt, Shigella flexneri 2a str. 301
auauacccuucucag

SEQ ID NO: 3919914 - RNA, 23 nt, Shigella flexneri 2a str. 301
auauaccgccgccagcaacauca

SEQ ID NO: 3919915 - RNA, 19 nt, Shigella flexneri 2a str. 301
auauaccucagcagacuga

SEQ ID NO: 3919916 - RNA, 21 nt, Shigella flexneri 2a str. 301
auauaccuuccgguuucaaau

SEQ ID NO: 3919917 - RNA, 17 nt, Shigella flexneri 2a str. 301
auauacgccaucgccag

SEQ ID NO: 3919918 - RNA, 22 nt, Shigella flexneri 2a str. 301
auauacgccaucgccagcagcc

SEQ ID NO: 3919919 - RNA, 14 nt, Shigella flexneri 2a str. 301
auauagauaucaau

SEQ ID NO: 3919920 - RNA, 13 nt, Shigella flexneri 2a str. 301
auauagauaucau

SEQ ID NO: 3919921 - RNA, 22 nt, Shigella flexneri 2a str. 301
auauaguagaucuugauuuacu

SEQ ID NO: 3919922 - RNA, 17 nt, Shigella flexneri 2a str. 301
auauauaaaaaaacaau

SEQ ID NO: 3919923 - RNA, 18 nt, Shigella flexneri 2a str. 301
auauauaauuaaaaauag

SEQ ID NO: 3919924 - RNA, 20 nt, Shigella flexneri 2a str. 301
auauauccccccaugaaaua

SEQ ID NO: 3919925 - RNA, 19 nt, Shigella flexneri 2a str. 301
auauauccguggcuuuuua

SEQ ID NO: 3919926 - RNA, 22 nt, Shigella flexneri 2a str. 301
auauauuccuuacucauaaaua

SEQ ID NO: 3919927 - RNA, 21 nt, Shigella flexneri 2a str. 301
auauauucguuacuggcaugu

SEQ ID NO: 3919928 - RNA, 19 nt, Shigella flexneri 2a str. 301
auauauugcaaucaucuug

SEQ ID NO: 3919929 - RNA, 17 nt, Shigella flexneri 2a str. 301
auauauugcugaaauaa

SEQ ID NO: 3919930 - RNA, 16 nt, Shigella flexneri 2a str. 301
auauauuuuuaaauau

SEQ ID NO: 3919931 - RNA, 17 nt, Shigella flexneri 2a str. 301
auaucaaacaguggugc

SEQ ID NO: 3919932 - RNA, 19 nt, Shigella flexneri 2a str. 301
auaucaacaauacgcaccg

SEQ ID NO: 3919933 - RNA, 17 nt, Shigella flexneri 2a str. 301
auaucaaccaguugugc

SEQ ID NO: 3919934 - RNA, 19 nt, Shigella flexneri 2a str. 301
auaucaacguaauggaugc

SEQ ID NO: 3919935 - RNA, 14 nt, Shigella flexneri 2a str. 301
auaucaagcaugau

SEQ ID NO: 3919936 - RNA, 21 nt, Shigella flexneri 2a str. 301
auaucacucggggcuuuucuc

SEQ ID NO: 3919937 - RNA, 22 nt, Shigella flexneri 2a str. 301
auaucagugauauauuuuuaaa

SEQ ID NO: 3919938 - RNA, 12 nt, Shigella flexneri 2a str. 301
auaucaucauuu

SEQ ID NO: 3919939 - RNA, 13 nt, Shigella flexneri 2a str. 301
auaucauuaaagu

SEQ ID NO: 3919940 - RNA, 18 nt, Shigella flexneri 2a str. 301
auauccaccgcguucagc

SEQ ID NO: 3919941 - RNA, 22 nt, Shigella flexneri 2a str. 301
auauccaccuccagcuccgcca

SEQ ID NO: 3919942 - RNA, 19 nt, Shigella flexneri 2a str. 301
auauccagauccagcaccu

SEQ ID NO: 3919943 - RNA, 16 nt, Shigella flexneri 2a str. 301
auauccagauggcuau

SEQ ID NO: 3919944 - RNA, 13 nt, Shigella flexneri 2a str. 301
auauccagcgaua

SEQ ID NO: 3919945 - RNA, 16 nt, Shigella flexneri 2a str. 301
auauccagcgccgagg

SEQ ID NO: 3919946 - RNA, 19 nt, Shigella flexneri 2a str. 301
auauccagcgccgagguug

SEQ ID NO: 3919947 - RNA, 12 nt, Shigella flexneri 2a str. 301
auauccaggcua

SEQ ID NO: 3919948 - RNA, 18 nt, Shigella flexneri 2a str. 301
auauccguagugaaaaag

SEQ ID NO: 3919949 - RNA, 20 nt, Shigella flexneri 2a str. 301
auauccucaguugucugaau

SEQ ID NO: 3919950 - RNA, 20 nt, Shigella flexneri 2a str. 301
auauccucauuucauugucc

SEQ ID NO: 3919951 - RNA, 12 nt, Shigella flexneri 2a str. 301
auauccugcgcu

SEQ ID NO: 3919952 - RNA, 19 nt, Shigella flexneri 2a str. 301
auauccugcgcuuccugca

SEQ ID NO: 3919953 - RNA, 22 nt, Shigella flexneri 2a str. 301
auauccugcgcuuccugcaacg

SEQ ID NO: 3919954 - RNA, 19 nt, Shigella flexneri 2a str. 301
auaucgacgaaccauuucg

SEQ ID NO: 3919955 - RNA, 21 nt, Shigella flexneri 2a str. 301
auaucgacgaaccauuucgau

SEQ ID NO: 3919956 - RNA, 22 nt, Shigella flexneri 2a str. 301
auaucgcauaccauccaggaga

SEQ ID NO: 3919957 - RNA, 17 nt, Shigella flexneri 2a str. 301
auaucgccauuaaacaa

SEQ ID NO: 3919958 - RNA, 19 nt, Shigella flexneri 2a str. 301
auaucgccauuaaacaacc

SEQ ID NO: 3919959 - RNA, 19 nt, Shigella flexneri 2a str. 301
auaucgcugucgccauccc

SEQ ID NO: 3919960 - RNA, 14 nt, Shigella flexneri 2a str. 301
auaucggcaccagc

SEQ ID NO: 3919961 - RNA, 18 nt, Shigella flexneri 2a str. 301
auaucggcaccagcgcag

SEQ ID NO: 3919962 - RNA, 14 nt, Shigella flexneri 2a str. 301
auaucggcauugcu

SEQ ID NO: 3919963 - RNA, 19 nt, Shigella flexneri 2a str. 301
auaucggccaucuguucug

SEQ ID NO: 3919964 - RNA, 19 nt, Shigella flexneri 2a str. 301
auaucggcccggcuuucuu

SEQ ID NO: 3919965 - RNA, 15 nt, Shigella flexneri 2a str. 301
auaucuccauucuga

SEQ ID NO: 3919966 - RNA, 13 nt, Shigella flexneri 2a str. 301
auaucuccucugc

SEQ ID NO: 3919967 - RNA, 21 nt, Shigella flexneri 2a str. 301
auaucugccagauaauggcug

SEQ ID NO: 3919968 - RNA, 22 nt, Shigella flexneri 2a str. 301
auaucugcuccguaaaacucag

SEQ ID NO: 3919969 - RNA, 22 nt, Shigella flexneri 2a str. 301
auaucuuauagacuaaauuuca

SEQ ID NO: 3919970 - RNA, 11 nt, Shigella flexneri 2a str. 301
auaucuucccg

SEQ ID NO: 3919971 - RNA, 17 nt, Shigella flexneri 2a str. 301
auaucuuucauauucaa

SEQ ID NO: 3919972 - RNA, 23 nt, Shigella flexneri 2a str. 301
auaucuuucccuuucgauaagac

SEQ ID NO: 3919973 - RNA, 20 nt, Shigella flexneri 2a str. 301
auaucuuucugccaccagua

SEQ ID NO: 3919974 - RNA, 21 nt, Shigella flexneri 2a str. 301
auaugaaauccggcaccuguc

SEQ ID NO: 3919975 - RNA, 21 nt, Shigella flexneri 2a str. 301
auaugaccauugguaauggga

SEQ ID NO: 3919976 - RNA, 20 nt, Shigella flexneri 2a str. 301
auaugagcgauuuuuuauag

SEQ ID NO: 3919977 - RNA, 17 nt, Shigella flexneri 2a str. 301
auaugauaauuauuaua

SEQ ID NO: 3919978 - RNA, 14 nt, Shigella flexneri 2a str. 301
auaugauucuuacu

SEQ ID NO: 3919979 - RNA, 14 nt, Shigella flexneri 2a str. 301
auaugauuuaaaaa

SEQ ID NO: 3919980 - RNA, 22 nt, Shigella flexneri 2a str. 301
auaugcacaugaugauggcuau

SEQ ID NO: 3919981 - RNA, 16 nt, Shigella flexneri 2a str. 301
auaugcagcagccagu

SEQ ID NO: 3919982 - RNA, 14 nt, Shigella flexneri 2a str. 301
auaugcauaaaccg

SEQ ID NO: 3919983 - RNA, 22 nt, Shigella flexneri 2a str. 301
auaugccagccccagcgucagc

SEQ ID NO: 3919984 - RNA, 20 nt, Shigella flexneri 2a str. 301
auaugccguaaaaguacaga

SEQ ID NO: 3919985 - RNA, 21 nt, Shigella flexneri 2a str. 301
auaugcgccgacggcgcuacc

SEQ ID NO: 3919986 - RNA, 19 nt, Shigella flexneri 2a str. 301
auaugcgggcguuuugcuu

SEQ ID NO: 3919987 - RNA, 18 nt, Shigella flexneri 2a str. 301
auauggaagaaacgcuua

SEQ ID NO: 3919988 - RNA, 14 nt, Shigella flexneri 2a str. 301
auauggagcaaaag

SEQ ID NO: 3919989 - RNA, 18 nt, Shigella flexneri 2a str. 301
auauggccguuuucccca

SEQ ID NO: 3919990 - RNA, 16 nt, Shigella flexneri 2a str. 301
auauggcucugcggcg

SEQ ID NO: 3919991 - RNA, 18 nt, Shigella flexneri 2a str. 301
auauggggcagaugggcu

SEQ ID NO: 3919992 - RNA, 13 nt, Shigella flexneri 2a str. 301
auaugggugcaau

SEQ ID NO: 3919993 - RNA, 14 nt, Shigella flexneri 2a str. 301
auauggugaaagua

SEQ ID NO: 3919994 - RNA, 16 nt, Shigella flexneri 2a str. 301
auauguaagcagaaaa

SEQ ID NO: 3919995 - RNA, 17 nt, Shigella flexneri 2a str. 301
auauguaagcagaaaag

SEQ ID NO: 3919996 - RNA, 15 nt, Shigella flexneri 2a str. 301
auaugucguuauaua

SEQ ID NO: 3919997 - RNA, 17 nt, Shigella flexneri 2a str. 301
auaugucguuauauaaa

SEQ ID NO: 3919998 - RNA, 21 nt, Shigella flexneri 2a str. 301
auaugucuuuuuuccagcaca

SEQ ID NO: 3919999 - RNA, 14 nt, Shigella flexneri 2a str. 301
auaugugaaauuua

SEQ ID NO: 3920000 - RNA, 15 nt, Shigella flexneri 2a str. 301
auaugugaaauuuau

SEQ ID NO: 3920001 - RNA, 13 nt, Shigella flexneri 2a str. 301
auauguucagaaa

SEQ ID NO: 3920002 - RNA, 16 nt, Shigella flexneri 2a str. 301
auauguucccgcgccu

SEQ ID NO: 3920003 - RNA, 19 nt, Shigella flexneri 2a str. 301
auauuaaggguaaaaggau

SEQ ID NO: 3920004 - RNA, 21 nt, Shigella flexneri 2a str. 301
aucaacuggcaaccagaagag

SEQ ID NO: 3920005 - RNA, 22 nt, Shigella flexneri 2a str. 301
aucaacuuuguucugaaucacg

SEQ ID NO: 3920006 - RNA, 15 nt, Shigella flexneri 2a str. 301
aucaagaaugcucgc

SEQ ID NO: 3920007 - RNA, 20 nt, Shigella flexneri 2a str. 301
aucaagacaugauguuuuaa

SEQ ID NO: 3920008 - RNA, 23 nt, Shigella flexneri 2a str. 301
aucaagcaaggccagguuuucuu

SEQ ID NO: 3920009 - RNA, 13 nt, Shigella flexneri 2a str. 301
aucaagcacaauc

SEQ ID NO: 3920010 - RNA, 19 nt, Shigella flexneri 2a str. 301
aucaagccccagcaggaug

SEQ ID NO: 3920011 - RNA, 20 nt, Shigella flexneri 2a str. 301
aucaagcccugguaacugcc

SEQ ID NO: 3920012 - RNA, 21 nt, Shigella flexneri 2a str. 301
aucaagcccugguaacugcca

SEQ ID NO: 3920013 - RNA, 20 nt, Shigella flexneri 2a str. 301
aucaagcgccgaguaaaaaa

SEQ ID NO: 3920014 - RNA, 14 nt, Shigella flexneri 2a str. 301
aucaagcugugccu

SEQ ID NO: 3920015 - RNA, 19 nt, Shigella flexneri 2a str. 301
aucaaggcauauaccacac

SEQ ID NO: 3920016 - RNA, 14 nt, Shigella flexneri 2a str. 301
aucaagucauugau

SEQ ID NO: 3920017 - RNA, 14 nt, Shigella flexneri 2a str. 301
aucaaguugauuuu

SEQ ID NO: 3920018 - RNA, 22 nt, Shigella flexneri 2a str. 301
aucaauaacagcgcaaucaccg

SEQ ID NO: 3920019 - RNA, 23 nt, Shigella flexneri 2a str. 301
aucaauacaggcgacgaguugcu

SEQ ID NO: 3920020 - RNA, 13 nt, Shigella flexneri 2a str. 301
aucaauaccagcc

SEQ ID NO: 3920021 - RNA, 23 nt, Shigella flexneri 2a str. 301
aucaauaccugguccuucaucuu

SEQ ID NO: 3920022 - RNA, 22 nt, Shigella flexneri 2a str. 301
aucaauagcaacugauuuauag

SEQ ID NO: 3920023 - RNA, 20 nt, Shigella flexneri 2a str. 301
aucaauagcuaacgaaagaa

SEQ ID NO: 3920024 - RNA, 18 nt, Shigella flexneri 2a str. 301
aucaauagugaacugacu

SEQ ID NO: 3920025 - RNA, 15 nt, Shigella flexneri 2a str. 301
aucaauauccaccgg

SEQ ID NO: 3920026 - RNA, 12 nt, Shigella flexneri 2a str. 301
aucaauauuaag

SEQ ID NO: 3920027 - RNA, 15 nt, Shigella flexneri 2a str. 301
aucaauauuuucaau

SEQ ID NO: 3920028 - RNA, 17 nt, Shigella flexneri 2a str. 301
aucaauauuuucaaucu

SEQ ID NO: 3920029 - RNA, 22 nt, Shigella flexneri 2a str. 301
aucaaucacccguuuucuccau

SEQ ID NO: 3920030 - RNA, 16 nt, Shigella flexneri 2a str. 301
aucaaucaccgcuuca

SEQ ID NO: 3920031 - RNA, 13 nt, Shigella flexneri 2a str. 301
aucaauccaaaca

SEQ ID NO: 3920032 - RNA, 17 nt, Shigella flexneri 2a str. 301
aucaaucgcaaucuggc

SEQ ID NO: 3920033 - RNA, 13 nt, Shigella flexneri 2a str. 301
aucaaucgccccu

SEQ ID NO: 3920034 - RNA, 16 nt, Shigella flexneri 2a str. 301
aucaaucucagcgaug

SEQ ID NO: 3920035 - RNA, 18 nt, Shigella flexneri 2a str. 301
aucaaucuuuacacacaa

SEQ ID NO: 3920036 - RNA, 12 nt, Shigella flexneri 2a str. 301
aucaaugaccug

SEQ ID NO: 3920037 - RNA, 16 nt, Shigella flexneri 2a str. 301
aucaaugaugaacgcc

SEQ ID NO: 3920038 - RNA, 13 nt, Shigella flexneri 2a str. 301
aucaaugccagca

SEQ ID NO: 3920039 - RNA, 21 nt, Shigella flexneri 2a str. 301
aucaaugccgcaacuuuagcc

SEQ ID NO: 3920040 - RNA, 16 nt, Shigella flexneri 2a str. 301
aucaauggaugcaauc

SEQ ID NO: 3920041 - RNA, 20 nt, Shigella flexneri 2a str. 301
aucaauggaugcaaucacaa

SEQ ID NO: 3920042 - RNA, 18 nt, Shigella flexneri 2a str. 301
aucaauggcugcaaagca

SEQ ID NO: 3920043 - RNA, 22 nt, Shigella flexneri 2a str. 301
aucaaugugcugagaacaagau

SEQ ID NO: 3920044 - RNA, 22 nt, Shigella flexneri 2a str. 301
aucaauucggaaauaaucaccu

SEQ ID NO: 3920045 - RNA, 15 nt, Shigella flexneri 2a str. 301
aucaauugcaggaag

SEQ ID NO: 3920046 - RNA, 20 nt, Shigella flexneri 2a str. 301
aucaauugcguuaaaaucag

SEQ ID NO: 3920047 - RNA, 12 nt, Shigella flexneri 2a str. 301
aucaauuucaca

SEQ ID NO: 3920048 - RNA, 13 nt, Shigella flexneri 2a str. 301
aucaauuucacag

SEQ ID NO: 3920049 - RNA, 23 nt, Shigella flexneri 2a str. 301
aucaauuuccggcuuaccaaaua

SEQ ID NO: 3920050 - RNA, 17 nt, Shigella flexneri 2a str. 301
aucacaauagaaauauu

SEQ ID NO: 3920051 - RNA, 18 nt, Shigella flexneri 2a str. 301
aucacaaucggcuuucac

SEQ ID NO: 3920052 - RNA, 23 nt, Shigella flexneri 2a str. 301
aucacaaucggcuuucaccgccu

SEQ ID NO: 3920053 - RNA, 20 nt, Shigella flexneri 2a str. 301
aucacaauuacugagagaaa

SEQ ID NO: 3920054 - RNA, 19 nt, Shigella flexneri 2a str. 301
aucacaccaguccagcgcc

SEQ ID NO: 3920055 - RNA, 12 nt, Shigella flexneri 2a str. 301
aucacaccgcga

SEQ ID NO: 3920056 - RNA, 19 nt, Shigella flexneri 2a str. 301
aucacaccgcgaucuucca

SEQ ID NO: 3920057 - RNA, 20 nt, Shigella flexneri 2a str. 301
aucacaccgcgaucuuccac

SEQ ID NO: 3920058 - RNA, 17 nt, Shigella flexneri 2a str. 301
aucacagcaguccagcg

SEQ ID NO: 3920059 - RNA, 17 nt, Shigella flexneri 2a str. 301
aucacaguuaagcaaua

SEQ ID NO: 3920060 - RNA, 18 nt, Shigella flexneri 2a str. 301
aucacaucaaauccccac

SEQ ID NO: 3920061 - RNA, 15 nt, Shigella flexneri 2a str. 301
aucacaucagcgcau

SEQ ID NO: 3920062 - RNA, 12 nt, Shigella flexneri 2a str. 301
aucacauccagc

SEQ ID NO: 3920063 - RNA, 16 nt, Shigella flexneri 2a str. 301
aucacaucccagcaga

SEQ ID NO: 3920064 - RNA, 20 nt, Shigella flexneri 2a str. 301
aucacauccggcaauauuca

SEQ ID NO: 3920065 - RNA, 12 nt, Shigella flexneri 2a str. 301
aucacaucgccg

SEQ ID NO: 3920066 - RNA, 17 nt, Shigella flexneri 2a str. 301
aucacaucgcgcucgua

SEQ ID NO: 3920067 - RNA, 18 nt, Shigella flexneri 2a str. 301
aucaccaacgauuuuuuc

SEQ ID NO: 3920068 - RNA, 22 nt, Shigella flexneri 2a str. 301
aucaccaauacgcauaugcauc

SEQ ID NO: 3920069 - RNA, 22 nt, Shigella flexneri 2a str. 301
aucaccaccaacgcacacaugc

SEQ ID NO: 3920070 - RNA, 18 nt, Shigella flexneri 2a str. 301
aucaccagaaguaucguu

SEQ ID NO: 3920071 - RNA, 15 nt, Shigella flexneri 2a str. 301
aucaccagauugaac

SEQ ID NO: 3920072 - RNA, 12 nt, Shigella flexneri 2a str. 301
aucaccagcgca

SEQ ID NO: 3920073 - RNA, 16 nt, Shigella flexneri 2a str. 301
aucaccauaaaucaga

SEQ ID NO: 3920074 - RNA, 16 nt, Shigella flexneri 2a str. 301
aucaccaucagcagca

SEQ ID NO: 3920075 - RNA, 16 nt, Shigella flexneri 2a str. 301
aucaccaugauuucug

SEQ ID NO: 3920076 - RNA, 17 nt, Shigella flexneri 2a str. 301
aucaccccgcccgauaa

SEQ ID NO: 3920077 - RNA, 23 nt, Shigella flexneri 2a str. 301
aucacccgugagaacugcugcau

SEQ ID NO: 3920078 - RNA, 17 nt, Shigella flexneri 2a str. 301
aucaccgcacggcgagu

SEQ ID NO: 3920079 - RNA, 20 nt, Shigella flexneri 2a str. 301
aucaccgccacuaccaucag

SEQ ID NO: 3920080 - RNA, 22 nt, Shigella flexneri 2a str. 301
aucaccgccacuaccaucaggu

SEQ ID NO: 3920081 - RNA, 15 nt, Shigella flexneri 2a str. 301
aucaccguaacgaac

SEQ ID NO: 3920082 - RNA, 17 nt, Shigella flexneri 2a str. 301
aucaccguucagcuugc

SEQ ID NO: 3920083 - RNA, 19 nt, Shigella flexneri 2a str. 301
aucaccguuuaggcgucac

SEQ ID NO: 3920084 - RNA, 19 nt, Shigella flexneri 2a str. 301
aucaccuccagcgaaggau

SEQ ID NO: 3920085 - RNA, 11 nt, Shigella flexneri 2a str. 301
aucaccucuuc

SEQ ID NO: 3920086 - RNA, 16 nt, Shigella flexneri 2a str. 301
aucaccucuuuuucca

SEQ ID NO: 3920087 - RNA, 22 nt, Shigella flexneri 2a str. 301
aucaccucuuuuuccacuucca

SEQ ID NO: 3920088 - RNA, 16 nt, Shigella flexneri 2a str. 301
aucaccugaugcccgu

SEQ ID NO: 3920089 - RNA, 19 nt, Shigella flexneri 2a str. 301
aucaccugauugaccgcca

SEQ ID NO: 3920090 - RNA, 19 nt, Shigella flexneri 2a str. 301
aucaccugcauacaaauaa

SEQ ID NO: 3920091 - RNA, 14 nt, Shigella flexneri 2a str. 301
aucaccugcuggac

SEQ ID NO: 3920092 - RNA, 21 nt, Shigella flexneri 2a str. 301
aucacgaagcccauuucagua

SEQ ID NO: 3920093 - RNA, 16 nt, Shigella flexneri 2a str. 301
aucacgaucucgccag

SEQ ID NO: 3920094 - RNA, 14 nt, Shigella flexneri 2a str. 301
aucacgaugcuaaa

SEQ ID NO: 3920095 - RNA, 17 nt, Shigella flexneri 2a str. 301
aucacgaugcuaaaaac

SEQ ID NO: 3920096 - RNA, 18 nt, Shigella flexneri 2a str. 301
aucacgcaaccacaacgc

SEQ ID NO: 3920097 - RNA, 17 nt, Shigella flexneri 2a str. 301
aucacgcagcaagccgu

SEQ ID NO: 3920098 - RNA, 13 nt, Shigella flexneri 2a str. 301
aucacgcaucacc

SEQ ID NO: 3920099 - RNA, 13 nt, Shigella flexneri 2a str. 301
aucacgcaucacu

SEQ ID NO: 3920100 - RNA, 17 nt, Shigella flexneri 2a str. 301
aucacgcaucgcgaaau

SEQ ID NO: 3920101 - RNA, 20 nt, Shigella flexneri 2a str. 301
aucacgccaauaccgcccag

SEQ ID NO: 3920102 - RNA, 14 nt, Shigella flexneri 2a str. 301
aucacgcccgccag

SEQ ID NO: 3920103 - RNA, 16 nt, Shigella flexneri 2a str. 301
aucacgcgaccaucgc

SEQ ID NO: 3920104 - RNA, 12 nt, Shigella flexneri 2a str. 301
aucauaauggcu

SEQ ID NO: 3920105 - RNA, 14 nt, Shigella flexneri 2a str. 301
aucauaauggcugc

SEQ ID NO: 3920106 - RNA, 15 nt, Shigella flexneri 2a str. 301
aucauacugaacuua

SEQ ID NO: 3920107 - RNA, 12 nt, Shigella flexneri 2a str. 301
aucauacugauu

SEQ ID NO: 3920108 - RNA, 16 nt, Shigella flexneri 2a str. 301
aucauagacuucccuc

SEQ ID NO: 3920109 - RNA, 18 nt, Shigella flexneri 2a str. 301
aucauagcgaauaauccc

SEQ ID NO: 3920110 - RNA, 21 nt, Shigella flexneri 2a str. 301
aucauagcgaauaaucccggc

SEQ ID NO: 3920111 - RNA, 11 nt, Shigella flexneri 2a str. 301
aucauauuaaa

SEQ ID NO: 3920112 - RNA, 13 nt, Shigella flexneri 2a str. 301
aucauauuaaauu

SEQ ID NO: 3920113 - RNA, 17 nt, Shigella flexneri 2a str. 301
aucauauugcucuggau

SEQ ID NO: 3920114 - RNA, 14 nt, Shigella flexneri 2a str. 301
aucauauuguuccc

SEQ ID NO: 3920115 - RNA, 14 nt, Shigella flexneri 2a str. 301
aucaucaaaauuaa

SEQ ID NO: 3920116 - RNA, 16 nt, Shigella flexneri 2a str. 301
aucaucaaacuuuaau

SEQ ID NO: 3920117 - RNA, 17 nt, Shigella flexneri 2a str. 301
aucaucaauaccagccc

SEQ ID NO: 3920118 - RNA, 18 nt, Shigella flexneri 2a str. 301
aucaucaauaccagcccg

SEQ ID NO: 3920119 - RNA, 20 nt, Shigella flexneri 2a str. 301
aucaucaauaccagcccguc

SEQ ID NO: 3920120 - RNA, 20 nt, Shigella flexneri 2a str. 301
aucaucaauugccacuucgu

SEQ ID NO: 3920121 - RNA, 15 nt, Shigella flexneri 2a str. 301
aucaucacgcaucac

SEQ ID NO: 3920122 - RNA, 19 nt, Shigella flexneri 2a str. 301
aucaucacgccaauaccgc

SEQ ID NO: 3920123 - RNA, 13 nt, Shigella flexneri 2a str. 301
aucaucagcaaac

SEQ ID NO: 3920124 - RNA, 19 nt, Shigella flexneri 2a str. 301
aucaucaggggcagcacca

SEQ ID NO: 3920125 - RNA, 22 nt, Shigella flexneri 2a str. 301
aucaucaggggcagcaccauca

SEQ ID NO: 3920126 - RNA, 12 nt, Shigella flexneri 2a str. 301
aucaucaucgcg

SEQ ID NO: 3920127 - RNA, 14 nt, Shigella flexneri 2a str. 301
aucaucauuauuaa

SEQ ID NO: 3920128 - RNA, 15 nt, Shigella flexneri 2a str. 301
aucaucauuuuuuca

SEQ ID NO: 3920129 - RNA, 20 nt, Shigella flexneri 2a str. 301
aucauccacccgcagcaagc

SEQ ID NO: 3920130 - RNA, 19 nt, Shigella flexneri 2a str. 301
aucauccaccuuaaaacaa

SEQ ID NO: 3920131 - RNA, 20 nt, Shigella flexneri 2a str. 301
aucauccaccuuaaaacaau

SEQ ID NO: 3920132 - RNA, 13 nt, Shigella flexneri 2a str. 301
aucauccagaccg

SEQ ID NO: 3920133 - RNA, 18 nt, Shigella flexneri 2a str. 301
aucauccagaccgcucag

SEQ ID NO: 3920134 - RNA, 23 nt, Shigella flexneri 2a str. 301
aucauccagaccgcucagcuccu

SEQ ID NO: 3920135 - RNA, 12 nt, Shigella flexneri 2a str. 301
aucauccagcac

SEQ ID NO: 3920136 - RNA, 19 nt, Shigella flexneri 2a str. 301
aucauccaugauaauuccg

SEQ ID NO: 3920137 - RNA, 17 nt, Shigella flexneri 2a str. 301
aucauccccguaucuuc

SEQ ID NO: 3920138 - RNA, 21 nt, Shigella flexneri 2a str. 301
aucauccgcucccuggcccau

SEQ ID NO: 3920139 - RNA, 16 nt, Shigella flexneri 2a str. 301
aucauccggcaccuuu

SEQ ID NO: 3920140 - RNA, 22 nt, Shigella flexneri 2a str. 301
aucauccugcggcagcuccagc

SEQ ID NO: 3920141 - RNA, 20 nt, Shigella flexneri 2a str. 301
aucauccuuuuggcuaaucg

SEQ ID NO: 3920142 - RNA, 14 nt, Shigella flexneri 2a str. 301
aucaucgaccccag

SEQ ID NO: 3920143 - RNA, 23 nt, Shigella flexneri 2a str. 301
aucaucgccgucacgguaauaac

SEQ ID NO: 3920144 - RNA, 15 nt, Shigella flexneri 2a str. 301
aucaucggcaaacau

SEQ ID NO: 3920145 - RNA, 22 nt, Shigella flexneri 2a str. 301
aucaucgggcugagauuuauga

SEQ ID NO: 3920146 - RNA, 21 nt, Shigella flexneri 2a str. 301
aucaucgguaccgccagcagg

SEQ ID NO: 3920147 - RNA, 14 nt, Shigella flexneri 2a str. 301
aucaucggucagcg

SEQ ID NO: 3920148 - RNA, 20 nt, Shigella flexneri 2a str. 301
aucaucggucagcguugcca

SEQ ID NO: 3920149 - RNA, 12 nt, Shigella flexneri 2a str. 301
aucaucgucacc

SEQ ID NO: 3920150 - RNA, 16 nt, Shigella flexneri 2a str. 301
aucaucuauccggcau

SEQ ID NO: 3920151 - RNA, 22 nt, Shigella flexneri 2a str. 301
aucaucuggcugugauccauuc

SEQ ID NO: 3920152 - RNA, 22 nt, Shigella flexneri 2a str. 301
aucaucuuccgguagaugccag

SEQ ID NO: 3920153 - RNA, 15 nt, Shigella flexneri 2a str. 301
aucaugacgggcaag

SEQ ID NO: 3920154 - RNA, 15 nt, Shigella flexneri 2a str. 301
aucaugauucacagu

SEQ ID NO: 3920155 - RNA, 16 nt, Shigella flexneri 2a str. 301
aucaugcaauaaauau

SEQ ID NO: 3920156 - RNA, 18 nt, Shigella flexneri 2a str. 301
aucaugcaguaccagaua

SEQ ID NO: 3920157 - RNA, 17 nt, Shigella flexneri 2a str. 301
aucaugccaaaaauaau

SEQ ID NO: 3920158 - RNA, 22 nt, Shigella flexneri 2a str. 301
aucaugccgaucgucugggcau

SEQ ID NO: 3920159 - RNA, 22 nt, Shigella flexneri 2a str. 301
aucaugcucagaugccugaugc

SEQ ID NO: 3920160 - RNA, 22 nt, Shigella flexneri 2a str. 301
aucaugcugccgggcaaucgcc

SEQ ID NO: 3920161 - RNA, 14 nt, Shigella flexneri 2a str. 301
aucauggaagcaga

SEQ ID NO: 3920162 - RNA, 17 nt, Shigella flexneri 2a str. 301
aucauggcauccuguuu

SEQ ID NO: 3920163 - RNA, 20 nt, Shigella flexneri 2a str. 301
aucauggcgaugagaaucag

SEQ ID NO: 3920164 - RNA, 14 nt, Shigella flexneri 2a str. 301
aucauggcucagau

SEQ ID NO: 3920165 - RNA, 22 nt, Shigella flexneri 2a str. 301
aucaugguaucgggcaguuuac

SEQ ID NO: 3920166 - RNA, 20 nt, Shigella flexneri 2a str. 301
aucaugguuuauuucccaga

SEQ ID NO: 3920167 - RNA, 19 nt, Shigella flexneri 2a str. 301
aucaugucgcccacgccag

SEQ ID NO: 3920168 - RNA, 20 nt, Shigella flexneri 2a str. 301
aucaugucgcccacgccaga

SEQ ID NO: 3920169 - RNA, 20 nt, Shigella flexneri 2a str. 301
aucauguggacgaggggaga

SEQ ID NO: 3920170 - RNA, 13 nt, Shigella flexneri 2a str. 301
aucauuacgccag

SEQ ID NO: 3920171 - RNA, 22 nt, Shigella flexneri 2a str. 301
aucauuaguaccuuccuuauuu

SEQ ID NO: 3920172 - RNA, 15 nt, Shigella flexneri 2a str. 301
aucauucaccagccc

SEQ ID NO: 3920173 - RNA, 13 nt, Shigella flexneri 2a str. 301
aucauucccauuu

SEQ ID NO: 3920174 - RNA, 21 nt, Shigella flexneri 2a str. 301
aucauucccauuuauuuuucc

SEQ ID NO: 3920175 - RNA, 23 nt, Shigella flexneri 2a str. 301
aucauucgccgguuccagcuuca

SEQ ID NO: 3920176 - RNA, 20 nt, Shigella flexneri 2a str. 301
aucauugccgguuggcgacu

SEQ ID NO: 3920177 - RNA, 23 nt, Shigella flexneri 2a str. 301
aucauugcgugguuuuugcugac

SEQ ID NO: 3920178 - RNA, 23 nt, Shigella flexneri 2a str. 301
aucauuuuacguugcauuuccau

SEQ ID NO: 3920179 - RNA, 18 nt, Shigella flexneri 2a str. 301
aucauuuuuucccauuac

SEQ ID NO: 3920180 - RNA, 17 nt, Shigella flexneri 2a str. 301
auccaacugauuuucau

SEQ ID NO: 3920181 - RNA, 21 nt, Shigella flexneri 2a str. 301
auccaagucaacgucauuauc

SEQ ID NO: 3920182 - RNA, 20 nt, Shigella flexneri 2a str. 301
auccacaacgugggccuggc

SEQ ID NO: 3920183 - RNA, 15 nt, Shigella flexneri 2a str. 301
auccacagcaaugca

SEQ ID NO: 3920184 - RNA, 15 nt, Shigella flexneri 2a str. 301
auccaccagcaugaa

SEQ ID NO: 3920185 - RNA, 14 nt, Shigella flexneri 2a str. 301
auccaccagcccca

SEQ ID NO: 3920186 - RNA, 14 nt, Shigella flexneri 2a str. 301
auccaccagugacu

SEQ ID NO: 3920187 - RNA, 23 nt, Shigella flexneri 2a str. 301
auccaccauuggcgcauagccgu

SEQ ID NO: 3920188 - RNA, 13 nt, Shigella flexneri 2a str. 301
auccacccgcagc

SEQ ID NO: 3920189 - RNA, 14 nt, Shigella flexneri 2a str. 301
auccacccgcagcc

SEQ ID NO: 3920190 - RNA, 19 nt, Shigella flexneri 2a str. 301
auccaccgaaauaaucaga

SEQ ID NO: 3920191 - RNA, 17 nt, Shigella flexneri 2a str. 301
auccaccgccacgccga

SEQ ID NO: 3920192 - RNA, 18 nt, Shigella flexneri 2a str. 301
auccaccgccacgccgag

SEQ ID NO: 3920193 - RNA, 14 nt, Shigella flexneri 2a str. 301
auccaccgcguuca

SEQ ID NO: 3920194 - RNA, 22 nt, Shigella flexneri 2a str. 301
auccacggugcuuugacgaugc

SEQ ID NO: 3920195 - RNA, 22 nt, Shigella flexneri 2a str. 301
auccacguugugguaaagcggc

SEQ ID NO: 3920196 - RNA, 21 nt, Shigella flexneri 2a str. 301
auccacugccugucacggcgc

SEQ ID NO: 3920197 - RNA, 17 nt, Shigella flexneri 2a str. 301
auccacugucaaaucca

SEQ ID NO: 3920198 - RNA, 19 nt, Shigella flexneri 2a str. 301
auccacugucaaauccaga

SEQ ID NO: 3920199 - RNA, 23 nt, Shigella flexneri 2a str. 301
auccacuuuuggcccgacgauga

SEQ ID NO: 3920200 - RNA, 14 nt, Shigella flexneri 2a str. 301
auccagacugcuca

SEQ ID NO: 3920201 - RNA, 11 nt, Shigella flexneri 2a str. 301
auccagaucac

SEQ ID NO: 3920202 - RNA, 23 nt, Shigella flexneri 2a str. 301
auccagauggcuauaaucacuca

SEQ ID NO: 3920203 - RNA, 21 nt, Shigella flexneri 2a str. 301
auccagauuuauaaaagaaaa

SEQ ID NO: 3920204 - RNA, 19 nt, Shigella flexneri 2a str. 301
auccgccaguuuguagcca

SEQ ID NO: 3920205 - RNA, 14 nt, Shigella flexneri 2a str. 301
auccgccauuucuc

SEQ ID NO: 3920206 - RNA, 16 nt, Shigella flexneri 2a str. 301
auccgccauuucuccu

SEQ ID NO: 3920207 - RNA, 18 nt, Shigella flexneri 2a str. 301
auccgcccucuuccacau

SEQ ID NO: 3920208 - RNA, 18 nt, Shigella flexneri 2a str. 301
auccgcgguaucgccguc

SEQ ID NO: 3920209 - RNA, 19 nt, Shigella flexneri 2a str. 301
auccgcgucauugacgcug

SEQ ID NO: 3920210 - RNA, 22 nt, Shigella flexneri 2a str. 301
auccgcucacugauaagauggu

SEQ ID NO: 3920211 - RNA, 16 nt, Shigella flexneri 2a str. 301
auccgcuggcccauca

SEQ ID NO: 3920212 - RNA, 20 nt, Shigella flexneri 2a str. 301
auccgcuggcccaucagaau

SEQ ID NO: 3920213 - RNA, 23 nt, Shigella flexneri 2a str. 301
auccgcuucaggaauaagacaau

SEQ ID NO: 3920214 - RNA, 19 nt, Shigella flexneri 2a str. 301
auccgcuucgguauauuuc

SEQ ID NO: 3920215 - RNA, 18 nt, Shigella flexneri 2a str. 301
auccgcuuucgguuuuuc

SEQ ID NO: 3920216 - RNA, 18 nt, Shigella flexneri 2a str. 301
auccggauucaaaccuaa

SEQ ID NO: 3920217 - RNA, 16 nt, Shigella flexneri 2a str. 301
auccggcaagaucacc

SEQ ID NO: 3920218 - RNA, 16 nt, Shigella flexneri 2a str. 301
auccggcaaguuguau

SEQ ID NO: 3920219 - RNA, 18 nt, Shigella flexneri 2a str. 301
auccggcaauaagcaacg

SEQ ID NO: 3920220 - RNA, 16 nt, Shigella flexneri 2a str. 301
auccggcacauuucac

SEQ ID NO: 3920221 - RNA, 22 nt, Shigella flexneri 2a str. 301
auccggcaccuuuucaucaggu

SEQ ID NO: 3920222 - RNA, 14 nt, Shigella flexneri 2a str. 301
auccggcaggcggg

SEQ ID NO: 3920223 - RNA, 23 nt, Shigella flexneri 2a str. 301
auccggcaucguuugcugccuuc

SEQ ID NO: 3920224 - RNA, 20 nt, Shigella flexneri 2a str. 301
auccggcauuugagcaggau

SEQ ID NO: 3920225 - RNA, 14 nt, Shigella flexneri 2a str. 301
auccggccuacgau

SEQ ID NO: 3920226 - RNA, 13 nt, Shigella flexneri 2a str. 301
auccggccuuccu

SEQ ID NO: 3920227 - RNA, 19 nt, Shigella flexneri 2a str. 301
auccggcuauauugcagga

SEQ ID NO: 3920228 - RNA, 15 nt, Shigella flexneri 2a str. 301
auccggcucguaauc

SEQ ID NO: 3920229 - RNA, 22 nt, Shigella flexneri 2a str. 301
auccggucuaccgauccggcac

SEQ ID NO: 3920230 - RNA, 20 nt, Shigella flexneri 2a str. 301
auccggugccuuaccgcuug

SEQ ID NO: 3920231 - RNA, 18 nt, Shigella flexneri 2a str. 301
auccgguuuacccgcuug

SEQ ID NO: 3920232 - RNA, 14 nt, Shigella flexneri 2a str. 301
auccgguuuacgca

SEQ ID NO: 3920233 - RNA, 18 nt, Shigella flexneri 2a str. 301
auccguaaagcccauacc

SEQ ID NO: 3920234 - RNA, 17 nt, Shigella flexneri 2a str. 301
auccgucacuucaggau

SEQ ID NO: 3920235 - RNA, 21 nt, Shigella flexneri 2a str. 301
auccgucagcgaguugaucac

SEQ ID NO: 3920236 - RNA, 20 nt, Shigella flexneri 2a str. 301
auccguccuacgaaucccgc

SEQ ID NO: 3920237 - RNA, 22 nt, Shigella flexneri 2a str. 301
auccgugguggcagccagccau

SEQ ID NO: 3920238 - RNA, 13 nt, Shigella flexneri 2a str. 301
auccguuucccug

SEQ ID NO: 3920239 - RNA, 15 nt, Shigella flexneri 2a str. 301
auccguuucucuguu

SEQ ID NO: 3920240 - RNA, 20 nt, Shigella flexneri 2a str. 301
auccguuuugugguguuuuu

SEQ ID NO: 3920241 - RNA, 14 nt, Shigella flexneri 2a str. 301
auccuaccaaagaa

SEQ ID NO: 3920242 - RNA, 15 nt, Shigella flexneri 2a str. 301
auccuauauagcccc

SEQ ID NO: 3920243 - RNA, 16 nt, Shigella flexneri 2a str. 301
auccucaguugucuga

SEQ ID NO: 3920244 - RNA, 14 nt, Shigella flexneri 2a str. 301
auccucuauauuuc

SEQ ID NO: 3920245 - RNA, 20 nt, Shigella flexneri 2a str. 301
auccucuaucuguuugccag

SEQ ID NO: 3920246 - RNA, 20 nt, Shigella flexneri 2a str. 301
auccucuucaagaauacugu

SEQ ID NO: 3920247 - RNA, 12 nt, Shigella flexneri 2a str. 301
auccucuucagc

SEQ ID NO: 3920248 - RNA, 20 nt, Shigella flexneri 2a str. 301
auccucuuuacgcaaaauca

SEQ ID NO: 3920249 - RNA, 23 nt, Shigella flexneri 2a str. 301
auccugaagacgccucgcauuuu

SEQ ID NO: 3920250 - RNA, 22 nt, Shigella flexneri 2a str. 301
auccugacgagcuuucuuauuu

SEQ ID NO: 3920251 - RNA, 14 nt, Shigella flexneri 2a str. 301
auccugagcagcca

SEQ ID NO: 3920252 - RNA, 15 nt, Shigella flexneri 2a str. 301
auccugauacagacc

SEQ ID NO: 3920253 - RNA, 23 nt, Shigella flexneri 2a str. 301
auccugauagcacgucacggacu

SEQ ID NO: 3920254 - RNA, 14 nt, Shigella flexneri 2a str. 301
auccugaucaagca

SEQ ID NO: 3920255 - RNA, 13 nt, Shigella flexneri 2a str. 301
auccugcacuuuc

SEQ ID NO: 3920256 - RNA, 13 nt, Shigella flexneri 2a str. 301
auccugcagugcg

SEQ ID NO: 3920257 - RNA, 12 nt, Shigella flexneri 2a str. 301
auccugccgcag

SEQ ID NO: 3920258 - RNA, 17 nt, Shigella flexneri 2a str. 301
auccugcggcagcucca

SEQ ID NO: 3920259 - RNA, 20 nt, Shigella flexneri 2a str. 301
auccugcugcacgcccugau

SEQ ID NO: 3920260 - RNA, 16 nt, Shigella flexneri 2a str. 301
auccuggacuuuaaac

SEQ ID NO: 3920261 - RNA, 15 nt, Shigella flexneri 2a str. 301
auccuggauuuccuc

SEQ ID NO: 3920262 - RNA, 13 nt, Shigella flexneri 2a str. 301
auccuggcacagc

SEQ ID NO: 3920263 - RNA, 22 nt, Shigella flexneri 2a str. 301
auccuggcgaaaacgcccggca

SEQ ID NO: 3920264 - RNA, 21 nt, Shigella flexneri 2a str. 301
auccuggggguucaucaccac

SEQ ID NO: 3920265 - RNA, 18 nt, Shigella flexneri 2a str. 301
auccuggugguacgcgua

SEQ ID NO: 3920266 - RNA, 17 nt, Shigella flexneri 2a str. 301
auccugguuauuucacu

SEQ ID NO: 3920267 - RNA, 17 nt, Shigella flexneri 2a str. 301
auccuguuaagaagggc

SEQ ID NO: 3920268 - RNA, 20 nt, Shigella flexneri 2a str. 301
auccuguugcguuaagccau

SEQ ID NO: 3920269 - RNA, 18 nt, Shigella flexneri 2a str. 301
auccuguuuuuaagugau

SEQ ID NO: 3920270 - RNA, 17 nt, Shigella flexneri 2a str. 301
auccuucacuuuugcca

SEQ ID NO: 3920271 - RNA, 18 nt, Shigella flexneri 2a str. 301
auccuucacuuuugccag

SEQ ID NO: 3920272 - RNA, 13 nt, Shigella flexneri 2a str. 301
auccuuccagcuc

SEQ ID NO: 3920273 - RNA, 20 nt, Shigella flexneri 2a str. 301
auccuucuguggacugauuu

SEQ ID NO: 3920274 - RNA, 19 nt, Shigella flexneri 2a str. 301
auccuugcuaaccaacaau

SEQ ID NO: 3920275 - RNA, 16 nt, Shigella flexneri 2a str. 301
auccuuuaccggaugu

SEQ ID NO: 3920276 - RNA, 17 nt, Shigella flexneri 2a str. 301
aucgaacagaccaaacu

SEQ ID NO: 3920277 - RNA, 14 nt, Shigella flexneri 2a str. 301
aucgaacagcagca

SEQ ID NO: 3920278 - RNA, 16 nt, Shigella flexneri 2a str. 301
aucgaacuucccgccg

SEQ ID NO: 3920279 - RNA, 19 nt, Shigella flexneri 2a str. 301
aucgaacuucccgccgugg

SEQ ID NO: 3920280 - RNA, 18 nt, Shigella flexneri 2a str. 301
aucgacagaacggauauc

SEQ ID NO: 3920281 - RNA, 15 nt, Shigella flexneri 2a str. 301
aucgacagacgccag

SEQ ID NO: 3920282 - RNA, 13 nt, Shigella flexneri 2a str. 301
aucgacaucaacg

SEQ ID NO: 3920283 - RNA, 22 nt, Shigella flexneri 2a str. 301
aucgaccaggccaucagcagcg

SEQ ID NO: 3920284 - RNA, 11 nt, Shigella flexneri 2a str. 301
aucgacgauga

SEQ ID NO: 3920285 - RNA, 21 nt, Shigella flexneri 2a str. 301
aucgacgccagucugaccaua

SEQ ID NO: 3920286 - RNA, 14 nt, Shigella flexneri 2a str. 301
aucgacguucugcc

SEQ ID NO: 3920287 - RNA, 13 nt, Shigella flexneri 2a str. 301
aucgacugcaaac

SEQ ID NO: 3920288 - RNA, 12 nt, Shigella flexneri 2a str. 301
aucgagaaucag

SEQ ID NO: 3920289 - RNA, 23 nt, Shigella flexneri 2a str. 301
aucgagagaauggggucagcagg

SEQ ID NO: 3920290 - RNA, 17 nt, Shigella flexneri 2a str. 301
aucgagauugucggcag

SEQ ID NO: 3920291 - RNA, 16 nt, Shigella flexneri 2a str. 301
aucgagccgauuaaaa

SEQ ID NO: 3920292 - RNA, 13 nt, Shigella flexneri 2a str. 301
aucgagcgccguu

SEQ ID NO: 3920293 - RNA, 23 nt, Shigella flexneri 2a str. 301
aucgagcuuaauguuaaccaucu

SEQ ID NO: 3920294 - RNA, 14 nt, Shigella flexneri 2a str. 301
aucgaggaaaacca

SEQ ID NO: 3920295 - RNA, 18 nt, Shigella flexneri 2a str. 301
aucgaggccauauuucac

SEQ ID NO: 3920296 - RNA, 15 nt, Shigella flexneri 2a str. 301
aucgauaaacggcac

SEQ ID NO: 3920297 - RNA, 20 nt, Shigella flexneri 2a str. 301
aucgauaaucucuacaccau

SEQ ID NO: 3920298 - RNA, 23 nt, Shigella flexneri 2a str. 301
aucgauaugaccauugguaaugg

SEQ ID NO: 3920299 - RNA, 18 nt, Shigella flexneri 2a str. 301
aucgaucauauuuccuuc

SEQ ID NO: 3920300 - RNA, 19 nt, Shigella flexneri 2a str. 301
aucgaugggauauaacccu

SEQ ID NO: 3920301 - RNA, 18 nt, Shigella flexneri 2a str. 301
aucgcaaaccagacgcgc

SEQ ID NO: 3920302 - RNA, 21 nt, Shigella flexneri 2a str. 301
aucgcaaauugacuacaccau

SEQ ID NO: 3920303 - RNA, 19 nt, Shigella flexneri 2a str. 301
aucgcaauaccggcaaaga

SEQ ID NO: 3920304 - RNA, 17 nt, Shigella flexneri 2a str. 301
aucgggagagauaagau

SEQ ID NO: 3920305 - RNA, 17 nt, Shigella flexneri 2a str. 301
aucgggauaucgccggu

SEQ ID NO: 3920306 - RNA, 14 nt, Shigella flexneri 2a str. 301
aucgggcaacugcu

SEQ ID NO: 3920307 - RNA, 16 nt, Shigella flexneri 2a str. 301
aucgggcacagcggug

SEQ ID NO: 3920308 - RNA, 18 nt, Shigella flexneri 2a str. 301
aucgggcagcaucgccag

SEQ ID NO: 3920309 - RNA, 22 nt, Shigella flexneri 2a str. 301
aucgggcagcaucgccaggaug

SEQ ID NO: 3920310 - RNA, 20 nt, Shigella flexneri 2a str. 301
aucgggcgauuuugcuuuug

SEQ ID NO: 3920311 - RNA, 22 nt, Shigella flexneri 2a str. 301
aucgggcuauuuuuauugugcc

SEQ ID NO: 3920312 - RNA, 19 nt, Shigella flexneri 2a str. 301
aucggggauaagaauaucg

SEQ ID NO: 3920313 - RNA, 15 nt, Shigella flexneri 2a str. 301
aucgggucaccugcc

SEQ ID NO: 3920314 - RNA, 13 nt, Shigella flexneri 2a str. 301
aucgggugaaguu

SEQ ID NO: 3920315 - RNA, 22 nt, Shigella flexneri 2a str. 301
aucgguaccgccagcaggaacg

SEQ ID NO: 3920316 - RNA, 15 nt, Shigella flexneri 2a str. 301
aucgguaugcaacau

SEQ ID NO: 3920317 - RNA, 15 nt, Shigella flexneri 2a str. 301
aucgguauuuccauu

SEQ ID NO: 3920318 - RNA, 15 nt, Shigella flexneri 2a str. 301
aucggugcaaaugcc

SEQ ID NO: 3920319 - RNA, 16 nt, Shigella flexneri 2a str. 301
aucggugcaaaugcca

SEQ ID NO: 3920320 - RNA, 18 nt, Shigella flexneri 2a str. 301
aucggugcacuccgccac

SEQ ID NO: 3920321 - RNA, 23 nt, Shigella flexneri 2a str. 301
aucggugggcugacauuaucaga

SEQ ID NO: 3920322 - RNA, 20 nt, Shigella flexneri 2a str. 301
aucgguguguccauccauac

SEQ ID NO: 3920323 - RNA, 21 nt, Shigella flexneri 2a str. 301
aucgguuuguaagcgggcaau

SEQ ID NO: 3920324 - RNA, 16 nt, Shigella flexneri 2a str. 301
aucgguuuugcggcgu

SEQ ID NO: 3920325 - RNA, 14 nt, Shigella flexneri 2a str. 301
aucguaauacccuu

SEQ ID NO: 3920326 - RNA, 15 nt, Shigella flexneri 2a str. 301
aucguacucaccaga

SEQ ID NO: 3920327 - RNA, 21 nt, Shigella flexneri 2a str. 301
aucguaguuuuugcccaucau

SEQ ID NO: 3920328 - RNA, 14 nt, Shigella flexneri 2a str. 301
aucguauccggcau

SEQ ID NO: 3920329 - RNA, 15 nt, Shigella flexneri 2a str. 301
aucguauccggcauu

SEQ ID NO: 3920330 - RNA, 21 nt, Shigella flexneri 2a str. 301
aucguauugguacauaacaca

SEQ ID NO: 3920331 - RNA, 14 nt, Shigella flexneri 2a str. 301
aucguauuucagac

SEQ ID NO: 3920332 - RNA, 18 nt, Shigella flexneri 2a str. 301
aucgucaggaucagccau

SEQ ID NO: 3920333 - RNA, 22 nt, Shigella flexneri 2a str. 301
aucgucaguagcgcaaucacca

SEQ ID NO: 3920334 - RNA, 13 nt, Shigella flexneri 2a str. 301
aucgucaguucac

SEQ ID NO: 3920335 - RNA, 16 nt, Shigella flexneri 2a str. 301
aucgucaguuuuucac

SEQ ID NO: 3920336 - RNA, 18 nt, Shigella flexneri 2a str. 301
aucguccacgucaucaaa

SEQ ID NO: 3920337 - RNA, 16 nt, Shigella flexneri 2a str. 301
aucguccacuugaaaa

SEQ ID NO: 3920338 - RNA, 17 nt, Shigella flexneri 2a str. 301
aucguccacuugaaaau

SEQ ID NO: 3920339 - RNA, 19 nt, Shigella flexneri 2a str. 301
aucguccacuugaaaauua

SEQ ID NO: 3920340 - RNA, 21 nt, Shigella flexneri 2a str. 301
aucguccgauuaaaaacccug

SEQ ID NO: 3920341 - RNA, 15 nt, Shigella flexneri 2a str. 301
aucgucgccagacca

SEQ ID NO: 3920342 - RNA, 19 nt, Shigella flexneri 2a str. 301
aucgucgcggucgccguca

SEQ ID NO: 3920343 - RNA, 17 nt, Shigella flexneri 2a str. 301
aucgucggaauggcauc

SEQ ID NO: 3920344 - RNA, 17 nt, Shigella flexneri 2a str. 301
aucgucugcgccaccac

SEQ ID NO: 3920345 - RNA, 18 nt, Shigella flexneri 2a str. 301
aucgucugcgccaccaca

SEQ ID NO: 3920346 - RNA, 20 nt, Shigella flexneri 2a str. 301
aucgucugcgccaccacaac

SEQ ID NO: 3920347 - RNA, 20 nt, Shigella flexneri 2a str. 301
aucgucuucaaccgcaguga

SEQ ID NO: 3920348 - RNA, 14 nt, Shigella flexneri 2a str. 301
aucgugaaaaauca

SEQ ID NO: 3920349 - RNA, 12 nt, Shigella flexneri 2a str. 301
aucgugaaacaa

SEQ ID NO: 3920350 - RNA, 23 nt, Shigella flexneri 2a str. 301
aucgugacaauaauacccagcac

SEQ ID NO: 3920351 - RNA, 18 nt, Shigella flexneri 2a str. 301
aucgugcaaauucaauau

SEQ ID NO: 3920352 - RNA, 20 nt, Shigella flexneri 2a str. 301
aucguggccaugaccgccgc

SEQ ID NO: 3920353 - RNA, 21 nt, Shigella flexneri 2a str. 301
aucguguggauaauccauccc

SEQ ID NO: 3920354 - RNA, 20 nt, Shigella flexneri 2a str. 301
aucguuaaauucuaauguua

SEQ ID NO: 3920355 - RNA, 16 nt, Shigella flexneri 2a str. 301
aucguuaauuaacgcg

SEQ ID NO: 3920356 - RNA, 23 nt, Shigella flexneri 2a str. 301
aucguuacgccccgguuucucuu

SEQ ID NO: 3920357 - RNA, 17 nt, Shigella flexneri 2a str. 301
aucguuacucuuaucaa

SEQ ID NO: 3920358 - RNA, 14 nt, Shigella flexneri 2a str. 301
aucguuaucaccaa

SEQ ID NO: 3920359 - RNA, 22 nt, Shigella flexneri 2a str. 301
aucguucugugccgucugcccc

SEQ ID NO: 3920360 - RNA, 23 nt, Shigella flexneri 2a str. 301
aucguugcgaucgaccugcgccu

SEQ ID NO: 3920361 - RNA, 17 nt, Shigella flexneri 2a str. 301
aucuaaaugccacugaa

SEQ ID NO: 3920362 - RNA, 21 nt, Shigella flexneri 2a str. 301
aucuaaccauuauuaaauuua

SEQ ID NO: 3920363 - RNA, 16 nt, Shigella flexneri 2a str. 301
aucuaagaucccugcc

SEQ ID NO: 3920364 - RNA, 20 nt, Shigella flexneri 2a str. 301
aucuaagccgcgagaauaug

SEQ ID NO: 3920365 - RNA, 19 nt, Shigella flexneri 2a str. 301
aucuaauguuggugugaca

SEQ ID NO: 3920366 - RNA, 15 nt, Shigella flexneri 2a str. 301
aucuaccgccagcca

SEQ ID NO: 3920367 - RNA, 18 nt, Shigella flexneri 2a str. 301
aucuaccguuacggcugg

SEQ ID NO: 3920368 - RNA, 19 nt, Shigella flexneri 2a str. 301
aucuacgcucucuucaaac

SEQ ID NO: 3920369 - RNA, 20 nt, Shigella flexneri 2a str. 301
aucuacgguggaacauuuac

SEQ ID NO: 3920370 - RNA, 16 nt, Shigella flexneri 2a str. 301
aucuagcgggaucugc

SEQ ID NO: 3920371 - RNA, 14 nt, Shigella flexneri 2a str. 301
aucuauccggcaua

SEQ ID NO: 3920372 - RNA, 14 nt, Shigella flexneri 2a str. 301
aucuaugguuuuuu

SEQ ID NO: 3920373 - RNA, 20 nt, Shigella flexneri 2a str. 301
aucuaugucgcauccggcaa

SEQ ID NO: 3920374 - RNA, 17 nt, Shigella flexneri 2a str. 301
aucuauuauuauuuuug

SEQ ID NO: 3920375 - RNA, 20 nt, Shigella flexneri 2a str. 301
aucuauucaccgcaucaaua

SEQ ID NO: 3920376 - RNA, 17 nt, Shigella flexneri 2a str. 301
aucuauucauuuauguu

SEQ ID NO: 3920377 - RNA, 14 nt, Shigella flexneri 2a str. 301
aucucaaccgcuuc

SEQ ID NO: 3920378 - RNA, 13 nt, Shigella flexneri 2a str. 301
aucucaauauuag

SEQ ID NO: 3920379 - RNA, 16 nt, Shigella flexneri 2a str. 301
aucucaauuuucacuu

SEQ ID NO: 3920380 - RNA, 20 nt, Shigella flexneri 2a str. 301
aucucaccgaucaucacgau

SEQ ID NO: 3920381 - RNA, 16 nt, Shigella flexneri 2a str. 301
aucucagauaaaugca

SEQ ID NO: 3920382 - RNA, 13 nt, Shigella flexneri 2a str. 301
aucucauccauca

SEQ ID NO: 3920383 - RNA, 14 nt, Shigella flexneri 2a str. 301
aucucauccaucaa

SEQ ID NO: 3920384 - RNA, 13 nt, Shigella flexneri 2a str. 301
aucucaucuucca

SEQ ID NO: 3920385 - RNA, 16 nt, Shigella flexneri 2a str. 301
aucuccacagucaggc

SEQ ID NO: 3920386 - RNA, 22 nt, Shigella flexneri 2a str. 301
aucuccagaucuuuuugcgcaa

SEQ ID NO: 3920387 - RNA, 16 nt, Shigella flexneri 2a str. 301
aucuccagcuauaacg

SEQ ID NO: 3920388 - RNA, 16 nt, Shigella flexneri 2a str. 301
aucuccauucugagug

SEQ ID NO: 3920389 - RNA, 12 nt, Shigella flexneri 2a str. 301
aucuccauuuca

SEQ ID NO: 3920390 - RNA, 19 nt, Shigella flexneri 2a str. 301
aucucccuguaucccagau

SEQ ID NO: 3920391 - RNA, 21 nt, Shigella flexneri 2a str. 301
aucucccuguaucccaguucg

SEQ ID NO: 3920392 - RNA, 22 nt, Shigella flexneri 2a str. 301
aucuccggcgguaaaugcucau

SEQ ID NO: 3920393 - RNA, 17 nt, Shigella flexneri 2a str. 301
aucuccguuaaaggcaa

SEQ ID NO: 3920394 - RNA, 18 nt, Shigella flexneri 2a str. 301
aucuccugccaauacaaa

SEQ ID NO: 3920395 - RNA, 22 nt, Shigella flexneri 2a str. 301
aucuccugccaauacaaaauuu

SEQ ID NO: 3920396 - RNA, 13 nt, Shigella flexneri 2a str. 301
aucuccuugcugg

SEQ ID NO: 3920397 - RNA, 21 nt, Shigella flexneri 2a str. 301
aucucgccagagagcggagca

SEQ ID NO: 3920398 - RNA, 20 nt, Shigella flexneri 2a str. 301
aucucgccguggaugggacu

SEQ ID NO: 3920399 - RNA, 19 nt, Shigella flexneri 2a str. 301
aucucgcucaaaaauccag

SEQ ID NO: 3920400 - RNA, 23 nt, Shigella flexneri 2a str. 301
aucucggggcuuauuaacuuccc

SEQ ID NO: 3920401 - RNA, 22 nt, Shigella flexneri 2a str. 301
aucucgguggaaaauagcauaa

SEQ ID NO: 3920402 - RNA, 13 nt, Shigella flexneri 2a str. 301
aucucgucagcau

SEQ ID NO: 3920403 - RNA, 17 nt, Shigella flexneri 2a str. 301
aucucguggucaauauu

SEQ ID NO: 3920404 - RNA, 15 nt, Shigella flexneri 2a str. 301
aucuucuugcagcuu

SEQ ID NO: 3920405 - RNA, 16 nt, Shigella flexneri 2a str. 301
aucuugaaaccagaca

SEQ ID NO: 3920406 - RNA, 21 nt, Shigella flexneri 2a str. 301
aucuugauaccaaaauggcgc

SEQ ID NO: 3920407 - RNA, 15 nt, Shigella flexneri 2a str. 301
aucuugcgaccgcuc

SEQ ID NO: 3920408 - RNA, 19 nt, Shigella flexneri 2a str. 301
aucuugcuucugacuauau

SEQ ID NO: 3920409 - RNA, 20 nt, Shigella flexneri 2a str. 301
aucuuuaaaaaaagcauuua

SEQ ID NO: 3920410 - RNA, 24 nt, Shigella flexneri 2a str. 301
aucuuuacugauaauuuuuucacu

SEQ ID NO: 3920411 - RNA, 16 nt, Shigella flexneri 2a str. 301
aucuuuaucaaucacc

SEQ ID NO: 3920412 - RNA, 17 nt, Shigella flexneri 2a str. 301
aucuuuaucaaucaccg

SEQ ID NO: 3920413 - RNA, 14 nt, Shigella flexneri 2a str. 301
aucuuucacgccca

SEQ ID NO: 3920414 - RNA, 16 nt, Shigella flexneri 2a str. 301
aucuuucagaaucagg

SEQ ID NO: 3920415 - RNA, 13 nt, Shigella flexneri 2a str. 301
aucuuuccagccc

SEQ ID NO: 3920416 - RNA, 18 nt, Shigella flexneri 2a str. 301
aucuuuccggcagaagca

SEQ ID NO: 3920417 - RNA, 17 nt, Shigella flexneri 2a str. 301
aucuuucugcgcaucuu

SEQ ID NO: 3920418 - RNA, 15 nt, Shigella flexneri 2a str. 301
aucuuugaaaucacg

SEQ ID NO: 3920419 - RNA, 16 nt, Shigella flexneri 2a str. 301
aucuuugacugaaauu

SEQ ID NO: 3920420 - RNA, 17 nt, Shigella flexneri 2a str. 301
aucuuugacugaaauuu

SEQ ID NO: 3920421 - RNA, 18 nt, Shigella flexneri 2a str. 301
aucuuugacugaaauuua

SEQ ID NO: 3920422 - RNA, 21 nt, Shigella flexneri 2a str. 301
aucuuugauugaagaaaucag

SEQ ID NO: 3920423 - RNA, 23 nt, Shigella flexneri 2a str. 301
aucuuugccagaucgccugccgc

SEQ ID NO: 3920424 - RNA, 18 nt, Shigella flexneri 2a str. 301
aucuuuugucaugacuac

SEQ ID NO: 3920425 - RNA, 19 nt, Shigella flexneri 2a str. 301
aucuuuuugggguuuuaau

SEQ ID NO: 3920426 - RNA, 23 nt, Shigella flexneri 2a str. 301
aucuuuuugggguuuuaauuccu

SEQ ID NO: 3920427 - RNA, 18 nt, Shigella flexneri 2a str. 301
augaaaaaaccagaaagg

SEQ ID NO: 3920428 - RNA, 22 nt, Shigella flexneri 2a str. 301
augaaaaaaccagaaagggaag

SEQ ID NO: 3920429 - RNA, 14 nt, Shigella flexneri 2a str. 301
augaaaacgccgga

SEQ ID NO: 3920430 - RNA, 20 nt, Shigella flexneri 2a str. 301
augaaaacgccggagugaaa

SEQ ID NO: 3920431 - RNA, 13 nt, Shigella flexneri 2a str. 301
augaaaacgcuga

SEQ ID NO: 3920432 - RNA, 20 nt, Shigella flexneri 2a str. 301
augaaaauaaccauauauga

SEQ ID NO: 3920433 - RNA, 17 nt, Shigella flexneri 2a str. 301
augaaacaggggcugga

SEQ ID NO: 3920434 - RNA, 22 nt, Shigella flexneri 2a str. 301
augaaacaggggcuggaagaug

SEQ ID NO: 3920435 - RNA, 17 nt, Shigella flexneri 2a str. 301
augaaaggucauugggg

SEQ ID NO: 3920436 - RNA, 12 nt, Shigella flexneri 2a str. 301
augaaauaaaaa

SEQ ID NO: 3920437 - RNA, 10 nt, Shigella flexneri 2a str. 301
augaaauuca

SEQ ID NO: 3920438 - RNA, 15 nt, Shigella flexneri 2a str. 301
augaaauuuagcgcc

SEQ ID NO: 3920439 - RNA, 15 nt, Shigella flexneri 2a str. 301
augaacaaaauucca

SEQ ID NO: 3920440 - RNA, 14 nt, Shigella flexneri 2a str. 301
augaacaaagcgca

SEQ ID NO: 3920441 - RNA, 16 nt, Shigella flexneri 2a str. 301
augaacacgaucucac

SEQ ID NO: 3920442 - RNA, 14 nt, Shigella flexneri 2a str. 301
augaaccugccgcc

SEQ ID NO: 3920443 - RNA, 13 nt, Shigella flexneri 2a str. 301
augaacgccuggg

SEQ ID NO: 3920444 - RNA, 13 nt, Shigella flexneri 2a str. 301
augaagaacugga

SEQ ID NO: 3920445 - RNA, 13 nt, Shigella flexneri 2a str. 301
augaaguccacgc

SEQ ID NO: 3920446 - RNA, 14 nt, Shigella flexneri 2a str. 301
augaaguccacgcg

SEQ ID NO: 3920447 - RNA, 16 nt, Shigella flexneri 2a str. 301
augaagucugccguug

SEQ ID NO: 3920448 - RNA, 19 nt, Shigella flexneri 2a str. 301
augaauaaaauucuccagc

SEQ ID NO: 3920449 - RNA, 20 nt, Shigella flexneri 2a str. 301
augaauaaaauucuccagcg

SEQ ID NO: 3920450 - RNA, 23 nt, Shigella flexneri 2a str. 301
augaauaccaagucucaagagug

SEQ ID NO: 3920451 - RNA, 20 nt, Shigella flexneri 2a str. 301
augaauauauaauuaaaaau

SEQ ID NO: 3920452 - RNA, 21 nt, Shigella flexneri 2a str. 301
augaauaucaagaucaucaaa

SEQ ID NO: 3920453 - RNA, 14 nt, Shigella flexneri 2a str. 301
augaaucaccacag

SEQ ID NO: 3920454 - RNA, 14 nt, Shigella flexneri 2a str. 301
augaaugauaaaau

SEQ ID NO: 3920455 - RNA, 22 nt, Shigella flexneri 2a str. 301
augaaugaugcggcgcuuucag

SEQ ID NO: 3920456 - RNA, 14 nt, Shigella flexneri 2a str. 301
augaaugcaaggcu

SEQ ID NO: 3920457 - RNA, 16 nt, Shigella flexneri 2a str. 301
augaaugcaaggcuca

SEQ ID NO: 3920458 - RNA, 17 nt, Shigella flexneri 2a str. 301
augaauguuuuccugcu

SEQ ID NO: 3920459 - RNA, 21 nt, Shigella flexneri 2a str. 301
augaauuacacgaugcaagag

SEQ ID NO: 3920460 - RNA, 11 nt, Shigella flexneri 2a str. 301
augaauuacuu

SEQ ID NO: 3920461 - RNA, 19 nt, Shigella flexneri 2a str. 301
augacaaacgcaaaacugc

SEQ ID NO: 3920462 - RNA, 20 nt, Shigella flexneri 2a str. 301
augacaacuuucaucagcac

SEQ ID NO: 3920463 - RNA, 17 nt, Shigella flexneri 2a str. 301
augacaagguugauauu

SEQ ID NO: 3920464 - RNA, 14 nt, Shigella flexneri 2a str. 301
augacacaucaccu

SEQ ID NO: 3920465 - RNA, 21 nt, Shigella flexneri 2a str. 301
augacacaucaccuccagcga

SEQ ID NO: 3920466 - RNA, 14 nt, Shigella flexneri 2a str. 301
augacagccagcaa

SEQ ID NO: 3920467 - RNA, 15 nt, Shigella flexneri 2a str. 301
augacagccagcaag

SEQ ID NO: 3920468 - RNA, 22 nt, Shigella flexneri 2a str. 301
augacauucacgcugucggcac

SEQ ID NO: 3920469 - RNA, 12 nt, Shigella flexneri 2a str. 301
augacauugaug

SEQ ID NO: 3920470 - RNA, 12 nt, Shigella flexneri 2a str. 301
augaccacucau

SEQ ID NO: 3920471 - RNA, 20 nt, Shigella flexneri 2a str. 301
augaccagugaggaugcggg

SEQ ID NO: 3920472 - RNA, 15 nt, Shigella flexneri 2a str. 301
augaccccagguauc

SEQ ID NO: 3920473 - RNA, 18 nt, Shigella flexneri 2a str. 301
augaccgaggcgcggcga

SEQ ID NO: 3920474 - RNA, 13 nt, Shigella flexneri 2a str. 301
augaccgcgcugg

SEQ ID NO: 3920475 - RNA, 18 nt, Shigella flexneri 2a str. 301
augaccgggcgcggcugu

SEQ ID NO: 3920476 - RNA, 18 nt, Shigella flexneri 2a str. 301
augacgaucgcagaaaaa

SEQ ID NO: 3920477 - RNA, 22 nt, Shigella flexneri 2a str. 301
augacgccaccagcgguuuuug

SEQ ID NO: 3920478 - RNA, 13 nt, Shigella flexneri 2a str. 301
augacgcccugug

SEQ ID NO: 3920479 - RNA, 22 nt, Shigella flexneri 2a str. 301
augacggucaucaccuccagcc

SEQ ID NO: 3920480 - RNA, 14 nt, Shigella flexneri 2a str. 301
augacguaucaccg

SEQ ID NO: 3920481 - RNA, 19 nt, Shigella flexneri 2a str. 301
augacguccuguacuguuu

SEQ ID NO: 3920482 - RNA, 17 nt, Shigella flexneri 2a str. 301
augacguuaauaaaauu

SEQ ID NO: 3920483 - RNA, 23 nt, Shigella flexneri 2a str. 301
augacuagcgccauaauaaucau

SEQ ID NO: 3920484 - RNA, 22 nt, Shigella flexneri 2a str. 301
augacuccaacuuacugauagu

SEQ ID NO: 3920485 - RNA, 14 nt, Shigella flexneri 2a str. 301
augacuccagcgcc

SEQ ID NO: 3920486 - RNA, 22 nt, Shigella flexneri 2a str. 301
augacuugccgcaaaacccagg

SEQ ID NO: 3920487 - RNA, 17 nt, Shigella flexneri 2a str. 301
augacuuuaugcugaag

SEQ ID NO: 3920488 - RNA, 20 nt, Shigella flexneri 2a str. 301
augacuuuguacuuggccgu

SEQ ID NO: 3920489 - RNA, 22 nt, Shigella flexneri 2a str. 301
augagaauaaucaccuuuaacc

SEQ ID NO: 3920490 - RNA, 14 nt, Shigella flexneri 2a str. 301
augagaauaccgaa

SEQ ID NO: 3920491 - RNA, 16 nt, Shigella flexneri 2a str. 301
augagagaaaaucaca

SEQ ID NO: 3920492 - RNA, 14 nt, Shigella flexneri 2a str. 301
augagauauuuaaa

SEQ ID NO: 3920493 - RNA, 19 nt, Shigella flexneri 2a str. 301
augagauauuuaaaugauu

SEQ ID NO: 3920494 - RNA, 19 nt, Shigella flexneri 2a str. 301
augagauauuucagagcuu

SEQ ID NO: 3920495 - RNA, 17 nt, Shigella flexneri 2a str. 301
augagcaguuugguuaa

SEQ ID NO: 3920496 - RNA, 21 nt, Shigella flexneri 2a str. 301
augagcgauuuuuuauaguac

SEQ ID NO: 3920497 - RNA, 12 nt, Shigella flexneri 2a str. 301
augaguacagcg

SEQ ID NO: 3920498 - RNA, 21 nt, Shigella flexneri 2a str. 301
augaguacugaugaauaaaua

SEQ ID NO: 3920499 - RNA, 18 nt, Shigella flexneri 2a str. 301
augagugccaaaaaaaua

SEQ ID NO: 3920500 - RNA, 19 nt, Shigella flexneri 2a str. 301
augagugccaaaaaaauaa

SEQ ID NO: 3920501 - RNA, 15 nt, Shigella flexneri 2a str. 301
augaguuaagaagau

SEQ ID NO: 3920502 - RNA, 14 nt, Shigella flexneri 2a str. 301
augaguuccacugg

SEQ ID NO: 3920503 - RNA, 15 nt, Shigella flexneri 2a str. 301
augaguuccacuggu

SEQ ID NO: 3920504 - RNA, 19 nt, Shigella flexneri 2a str. 301
augccagcacagaucgcac

SEQ ID NO: 3920505 - RNA, 14 nt, Shigella flexneri 2a str. 301
augccagcgaagaa

SEQ ID NO: 3920506 - RNA, 19 nt, Shigella flexneri 2a str. 301
augccagcuuucaccugcg

SEQ ID NO: 3920507 - RNA, 18 nt, Shigella flexneri 2a str. 301
augccagucaaugaaauu

SEQ ID NO: 3920508 - RNA, 20 nt, Shigella flexneri 2a str. 301
augccauaacgcgucucaug

SEQ ID NO: 3920509 - RNA, 23 nt, Shigella flexneri 2a str. 301
augccaucauggcgaugagaauc

SEQ ID NO: 3920510 - RNA, 13 nt, Shigella flexneri 2a str. 301
augccauccgcau

SEQ ID NO: 3920511 - RNA, 22 nt, Shigella flexneri 2a str. 301
augccaucgcauagcgcaauaa

SEQ ID NO: 3920512 - RNA, 15 nt, Shigella flexneri 2a str. 301
augccauuggcauaa

SEQ ID NO: 3920513 - RNA, 18 nt, Shigella flexneri 2a str. 301
augccauuuccagcgcuu

SEQ ID NO: 3920514 - RNA, 12 nt, Shigella flexneri 2a str. 301
augccauuuucc

SEQ ID NO: 3920515 - RNA, 15 nt, Shigella flexneri 2a str. 301
augcccaucacuauc

SEQ ID NO: 3920516 - RNA, 19 nt, Shigella flexneri 2a str. 301
augccccauugcaacgugg

SEQ ID NO: 3920517 - RNA, 12 nt, Shigella flexneri 2a str. 301
augcccccagca

SEQ ID NO: 3920518 - RNA, 21 nt, Shigella flexneri 2a str. 301
augcccccucacaugaguugc

SEQ ID NO: 3920519 - RNA, 21 nt, Shigella flexneri 2a str. 301
augccccuguaucaugcagua

SEQ ID NO: 3920520 - RNA, 15 nt, Shigella flexneri 2a str. 301
augcccgaugaccuu

SEQ ID NO: 3920521 - RNA, 19 nt, Shigella flexneri 2a str. 301
augcccgccgugcugccag

SEQ ID NO: 3920522 - RNA, 16 nt, Shigella flexneri 2a str. 301
augcccgguauuugcc

SEQ ID NO: 3920523 - RNA, 20 nt, Shigella flexneri 2a str. 301
augcccggucgcuccggcua

SEQ ID NO: 3920524 - RNA, 13 nt, Shigella flexneri 2a str. 301
augccgacgaugu

SEQ ID NO: 3920525 - RNA, 20 nt, Shigella flexneri 2a str. 301
augccgacgauguuagcggc

SEQ ID NO: 3920526 - RNA, 22 nt, Shigella flexneri 2a str. 301
augccgacgauguuagcggcga

SEQ ID NO: 3920527 - RNA, 14 nt, Shigella flexneri 2a str. 301
augccgaguggcau

SEQ ID NO: 3920528 - RNA, 19 nt, Shigella flexneri 2a str. 301
augccgauaaauacagcgu

SEQ ID NO: 3920529 - RNA, 22 nt, Shigella flexneri 2a str. 301
augccgaucaauuucacaguaa

SEQ ID NO: 3920530 - RNA, 19 nt, Shigella flexneri 2a str. 301
augccgauuguauacgcug

SEQ ID NO: 3920531 - RNA, 14 nt, Shigella flexneri 2a str. 301
augccgcagcaccc

SEQ ID NO: 3920532 - RNA, 21 nt, Shigella flexneri 2a str. 301
augccgcagcggcgauuucuu

SEQ ID NO: 3920533 - RNA, 18 nt, Shigella flexneri 2a str. 301
augccgccgcagaaaaag

SEQ ID NO: 3920534 - RNA, 22 nt, Shigella flexneri 2a str. 301
augccgccguagaaaaugccca

SEQ ID NO: 3920535 - RNA, 20 nt, Shigella flexneri 2a str. 301
augccgcguggccuggaauu

SEQ ID NO: 3920536 - RNA, 12 nt, Shigella flexneri 2a str. 301
augccggaagcu

SEQ ID NO: 3920537 - RNA, 14 nt, Shigella flexneri 2a str. 301
augccggaaucaga

SEQ ID NO: 3920538 - RNA, 23 nt, Shigella flexneri 2a str. 301
augccggagucgcauuaacagcc

SEQ ID NO: 3920539 - RNA, 15 nt, Shigella flexneri 2a str. 301
augccggaugcggag

SEQ ID NO: 3920540 - RNA, 16 nt, Shigella flexneri 2a str. 301
augccggaugcggaga

SEQ ID NO: 3920541 - RNA, 16 nt, Shigella flexneri 2a str. 301
augccggaugcggcgu

SEQ ID NO: 3920542 - RNA, 18 nt, Shigella flexneri 2a str. 301
augccggaugcggcguaa

SEQ ID NO: 3920543 - RNA, 17 nt, Shigella flexneri 2a str. 301
augccggaugcggcgug

SEQ ID NO: 3920544 - RNA, 16 nt, Shigella flexneri 2a str. 301
augccggcaucaaacg

SEQ ID NO: 3920545 - RNA, 23 nt, Shigella flexneri 2a str. 301
augccggccagcgccaccaccag

SEQ ID NO: 3920546 - RNA, 21 nt, Shigella flexneri 2a str. 301
augccggguaauuucauuaaa

SEQ ID NO: 3920547 - RNA, 11 nt, Shigella flexneri 2a str. 301
augccggugau

SEQ ID NO: 3920548 - RNA, 16 nt, Shigella flexneri 2a str. 301
augccgguggugaccu

SEQ ID NO: 3920549 - RNA, 16 nt, Shigella flexneri 2a str. 301
augccgguuaauacgc

SEQ ID NO: 3920550 - RNA, 18 nt, Shigella flexneri 2a str. 301
augccgguuccugcaucg

SEQ ID NO: 3920551 - RNA, 15 nt, Shigella flexneri 2a str. 301
augccguaaaaguac

SEQ ID NO: 3920552 - RNA, 21 nt, Shigella flexneri 2a str. 301
augccgucaccagcaucaaca

SEQ ID NO: 3920553 - RNA, 21 nt, Shigella flexneri 2a str. 301
augccgugcagcacggagaga

SEQ ID NO: 3920554 - RNA, 16 nt, Shigella flexneri 2a str. 301
augccguuauacaucg

SEQ ID NO: 3920555 - RNA, 24 nt, Shigella flexneri 2a str. 301
augccguuguucuacgugagagau

SEQ ID NO: 3920556 - RNA, 16 nt, Shigella flexneri 2a str. 301
augccguuugcugcau

SEQ ID NO: 3920557 - RNA, 18 nt, Shigella flexneri 2a str. 301
augccuaccaaaccugca

SEQ ID NO: 3920558 - RNA, 17 nt, Shigella flexneri 2a str. 301
augccucguuggucagc

SEQ ID NO: 3920559 - RNA, 13 nt, Shigella flexneri 2a str. 301
augccucuccugu

SEQ ID NO: 3920560 - RNA, 18 nt, Shigella flexneri 2a str. 301
augccucuuucauccgau

SEQ ID NO: 3920561 - RNA, 16 nt, Shigella flexneri 2a str. 301
augccugaugcggcgu

SEQ ID NO: 3920562 - RNA, 16 nt, Shigella flexneri 2a str. 301
augccuggcaaugcgc

SEQ ID NO: 3920563 - RNA, 14 nt, Shigella flexneri 2a str. 301
augccuuguuugau

SEQ ID NO: 3920564 - RNA, 18 nt, Shigella flexneri 2a str. 301
augccuuguuugaucauc

SEQ ID NO: 3920565 - RNA, 19 nt, Shigella flexneri 2a str. 301
augccuuguuugaucaucg

SEQ ID NO: 3920566 - RNA, 13 nt, Shigella flexneri 2a str. 301
augccuuucucag

SEQ ID NO: 3920567 - RNA, 14 nt, Shigella flexneri 2a str. 301
augcgaaaaaaaag

SEQ ID NO: 3920568 - RNA, 14 nt, Shigella flexneri 2a str. 301
augcgaaugccaau

SEQ ID NO: 3920569 - RNA, 14 nt, Shigella flexneri 2a str. 301
augcgacaacagaa

SEQ ID NO: 3920570 - RNA, 14 nt, Shigella flexneri 2a str. 301
augcgacaacuggc

SEQ ID NO: 3920571 - RNA, 13 nt, Shigella flexneri 2a str. 301
augcgacacuguu

SEQ ID NO: 3920572 - RNA, 19 nt, Shigella flexneri 2a str. 301
augcgaccauaugaauaua

SEQ ID NO: 3920573 - RNA, 15 nt, Shigella flexneri 2a str. 301
augcgacccaugcac

SEQ ID NO: 3920574 - RNA, 20 nt, Shigella flexneri 2a str. 301
augcgacguaaaaacuacaa

SEQ ID NO: 3920575 - RNA, 17 nt, Shigella flexneri 2a str. 301
augcgaugcauccggca

SEQ ID NO: 3920576 - RNA, 16 nt, Shigella flexneri 2a str. 301
augcgauggagugaga

SEQ ID NO: 3920577 - RNA, 22 nt, Shigella flexneri 2a str. 301
augcgcaaccguaaacgaucau

SEQ ID NO: 3920578 - RNA, 22 nt, Shigella flexneri 2a str. 301
augcgcaguugcagcaagccau

SEQ ID NO: 3920579 - RNA, 20 nt, Shigella flexneri 2a str. 301
augcgcaucaaagccaggca

SEQ ID NO: 3920580 - RNA, 23 nt, Shigella flexneri 2a str. 301
augcgcaucaaagccaggcagaa

SEQ ID NO: 3920581 - RNA, 16 nt, Shigella flexneri 2a str. 301
augcgcauuaagccau

SEQ ID NO: 3920582 - RNA, 21 nt, Shigella flexneri 2a str. 301
augcgcauugccagagugaaa

SEQ ID NO: 3920583 - RNA, 12 nt, Shigella flexneri 2a str. 301
augcgccagacu

SEQ ID NO: 3920584 - RNA, 15 nt, Shigella flexneri 2a str. 301
augcgccagguaacg

SEQ ID NO: 3920585 - RNA, 12 nt, Shigella flexneri 2a str. 301
augcgcccagcg

SEQ ID NO: 3920586 - RNA, 15 nt, Shigella flexneri 2a str. 301
augcgcgacaaaaau

SEQ ID NO: 3920587 - RNA, 12 nt, Shigella flexneri 2a str. 301
augcgcgucaga

SEQ ID NO: 3920588 - RNA, 18 nt, Shigella flexneri 2a str. 301
augcgcuaaauguuuagu

SEQ ID NO: 3920589 - RNA, 18 nt, Shigella flexneri 2a str. 301
augcgcuacgcucaucag

SEQ ID NO: 3920590 - RNA, 19 nt, Shigella flexneri 2a str. 301
augcgcucccguaauuccg

SEQ ID NO: 3920591 - RNA, 19 nt, Shigella flexneri 2a str. 301
augcgcuccucgccguuaa

SEQ ID NO: 3920592 - RNA, 13 nt, Shigella flexneri 2a str. 301
augcgcugggcaa

SEQ ID NO: 3920593 - RNA, 13 nt, Shigella flexneri 2a str. 301
augcgcuuccugc

SEQ ID NO: 3920594 - RNA, 16 nt, Shigella flexneri 2a str. 301
augcgcuuuaucgccg

SEQ ID NO: 3920595 - RNA, 20 nt, Shigella flexneri 2a str. 301
augcgcuuuaucgccgcugg

SEQ ID NO: 3920596 - RNA, 13 nt, Shigella flexneri 2a str. 301
augcggcggacgu

SEQ ID NO: 3920597 - RNA, 16 nt, Shigella flexneri 2a str. 301
augcggcgugaaugcc

SEQ ID NO: 3920598 - RNA, 13 nt, Shigella flexneri 2a str. 301
augcgggcgguaa

SEQ ID NO: 3920599 - RNA, 19 nt, Shigella flexneri 2a str. 301
augcggggugcaucgcccu

SEQ ID NO: 3920600 - RNA, 18 nt, Shigella flexneri 2a str. 301
augcgggucaggccagga

SEQ ID NO: 3920601 - RNA, 16 nt, Shigella flexneri 2a str. 301
augcgggugaacgcgu

SEQ ID NO: 3920602 - RNA, 20 nt, Shigella flexneri 2a str. 301
augcgguacugcgacgacgu

SEQ ID NO: 3920603 - RNA, 17 nt, Shigella flexneri 2a str. 301
augcgguuaaaccgaaa

SEQ ID NO: 3920604 - RNA, 17 nt, Shigella flexneri 2a str. 301
auggcgcccaucggcgc

SEQ ID NO: 3920605 - RNA, 16 nt, Shigella flexneri 2a str. 301
auggcgcgaaaacaac

SEQ ID NO: 3920606 - RNA, 14 nt, Shigella flexneri 2a str. 301
auggcgcgccaccu

SEQ ID NO: 3920607 - RNA, 14 nt, Shigella flexneri 2a str. 301
auggcggaucacgc

SEQ ID NO: 3920608 - RNA, 19 nt, Shigella flexneri 2a str. 301
auggcggaucacgcuguuu

SEQ ID NO: 3920609 - RNA, 21 nt, Shigella flexneri 2a str. 301
auggcggcaguauagcggcau

SEQ ID NO: 3920610 - RNA, 24 nt, Shigella flexneri 2a str. 301
auggcggcggcuuuuacgagcauc

SEQ ID NO: 3920611 - RNA, 11 nt, Shigella flexneri 2a str. 301
auggcggcugg

SEQ ID NO: 3920612 - RNA, 19 nt, Shigella flexneri 2a str. 301
auggcguucgcaacaccgu

SEQ ID NO: 3920613 - RNA, 21 nt, Shigella flexneri 2a str. 301
auggcguugucggcagauaac

SEQ ID NO: 3920614 - RNA, 20 nt, Shigella flexneri 2a str. 301
auggcuaaaguacguaaaac

SEQ ID NO: 3920615 - RNA, 13 nt, Shigella flexneri 2a str. 301
auggcuccgggug

SEQ ID NO: 3920616 - RNA, 22 nt, Shigella flexneri 2a str. 301
auggcuccgggugugacaacaa

SEQ ID NO: 3920617 - RNA, 21 nt, Shigella flexneri 2a str. 301
auggcucugauugauucaggg

SEQ ID NO: 3920618 - RNA, 19 nt, Shigella flexneri 2a str. 301
auggcugaaagcgccggga

SEQ ID NO: 3920619 - RNA, 20 nt, Shigella flexneri 2a str. 301
auggcugaaagcgccgggaa

SEQ ID NO: 3920620 - RNA, 23 nt, Shigella flexneri 2a str. 301
auggcugccuuuuuuacaggugu

SEQ ID NO: 3920621 - RNA, 16 nt, Shigella flexneri 2a str. 301
auggcuggcagaugcu

SEQ ID NO: 3920622 - RNA, 20 nt, Shigella flexneri 2a str. 301
auggcuggcuauacacaagg

SEQ ID NO: 3920623 - RNA, 20 nt, Shigella flexneri 2a str. 301
auggcuguuuucagcaccag

SEQ ID NO: 3920624 - RNA, 18 nt, Shigella flexneri 2a str. 301
auggcuucauccaccgau

SEQ ID NO: 3920625 - RNA, 15 nt, Shigella flexneri 2a str. 301
auggcuucuuccccg

SEQ ID NO: 3920626 - RNA, 19 nt, Shigella flexneri 2a str. 301
auggcuuuagggcuggcuu

SEQ ID NO: 3920627 - RNA, 14 nt, Shigella flexneri 2a str. 301
auggcuuugcccuu

SEQ ID NO: 3920628 - RNA, 22 nt, Shigella flexneri 2a str. 301
augggauaucgauguccugacg

SEQ ID NO: 3920629 - RNA, 20 nt, Shigella flexneri 2a str. 301
augggcgaauaaaaagccua

SEQ ID NO: 3920630 - RNA, 13 nt, Shigella flexneri 2a str. 301
auggguaugugac

SEQ ID NO: 3920631 - RNA, 17 nt, Shigella flexneri 2a str. 301
auggguuaacaucaugu

SEQ ID NO: 3920632 - RNA, 16 nt, Shigella flexneri 2a str. 301
augguaggccggauaa

SEQ ID NO: 3920633 - RNA, 21 nt, Shigella flexneri 2a str. 301
augguaugcgaagguggcgga

SEQ ID NO: 3920634 - RNA, 17 nt, Shigella flexneri 2a str. 301
auggucaacauucccug

SEQ ID NO: 3920635 - RNA, 22 nt, Shigella flexneri 2a str. 301
auggucaaugauuucugccagc

SEQ ID NO: 3920636 - RNA, 14 nt, Shigella flexneri 2a str. 301
auggucagcuucac

SEQ ID NO: 3920637 - RNA, 19 nt, Shigella flexneri 2a str. 301
auggucagcuucaccuucc

SEQ ID NO: 3920638 - RNA, 17 nt, Shigella flexneri 2a str. 301
auggucauuccagucug

SEQ ID NO: 3920639 - RNA, 17 nt, Shigella flexneri 2a str. 301
auggucgccccggaacg

SEQ ID NO: 3920640 - RNA, 18 nt, Shigella flexneri 2a str. 301
auggucuauugcgcuaaa

SEQ ID NO: 3920641 - RNA, 16 nt, Shigella flexneri 2a str. 301
auggucuguaccacca

SEQ ID NO: 3920642 - RNA, 18 nt, Shigella flexneri 2a str. 301
auggugcaccgauugccg

SEQ ID NO: 3920643 - RNA, 14 nt, Shigella flexneri 2a str. 301
augguggagauaaa

SEQ ID NO: 3920644 - RNA, 18 nt, Shigella flexneri 2a str. 301
augguggagauaaacucc

SEQ ID NO: 3920645 - RNA, 20 nt, Shigella flexneri 2a str. 301
augguggagauaaacuccac

SEQ ID NO: 3920646 - RNA, 22 nt, Shigella flexneri 2a str. 301
augguggcccggauucagauug

SEQ ID NO: 3920647 - RNA, 20 nt, Shigella flexneri 2a str. 301
augguggccgccacgcguga

SEQ ID NO: 3920648 - RNA, 13 nt, Shigella flexneri 2a str. 301
auggugguggggg

SEQ ID NO: 3920649 - RNA, 14 nt, Shigella flexneri 2a str. 301
auggugguggggga

SEQ ID NO: 3920650 - RNA, 19 nt, Shigella flexneri 2a str. 301
augguggugggggaaggau

SEQ ID NO: 3920651 - RNA, 17 nt, Shigella flexneri 2a str. 301
augguguucaggcauag

SEQ ID NO: 3920652 - RNA, 14 nt, Shigella flexneri 2a str. 301
augguguuuuccac

SEQ ID NO: 3920653 - RNA, 12 nt, Shigella flexneri 2a str. 301
augguuaacaug

SEQ ID NO: 3920654 - RNA, 17 nt, Shigella flexneri 2a str. 301
augguuacuuuuuaugu

SEQ ID NO: 3920655 - RNA, 20 nt, Shigella flexneri 2a str. 301
augguuagccuguaauguca

SEQ ID NO: 3920656 - RNA, 19 nt, Shigella flexneri 2a str. 301
augguugaacggauauuuu

SEQ ID NO: 3920657 - RNA, 17 nt, Shigella flexneri 2a str. 301
augguuguaauccaccu

SEQ ID NO: 3920658 - RNA, 16 nt, Shigella flexneri 2a str. 301
augguugucacugcau

SEQ ID NO: 3920659 - RNA, 22 nt, Shigella flexneri 2a str. 301
augguuucacggcaccagccau

SEQ ID NO: 3920660 - RNA, 16 nt, Shigella flexneri 2a str. 301
augguuuucaauuauc

SEQ ID NO: 3920661 - RNA, 12 nt, Shigella flexneri 2a str. 301
auguaaaaauac

SEQ ID NO: 3920662 - RNA, 14 nt, Shigella flexneri 2a str. 301
auguaaaaauacug

SEQ ID NO: 3920663 - RNA, 19 nt, Shigella flexneri 2a str. 301
auguaaaaggcgcuaaaaa

SEQ ID NO: 3920664 - RNA, 14 nt, Shigella flexneri 2a str. 301
auguaaauaacaga

SEQ ID NO: 3920665 - RNA, 16 nt, Shigella flexneri 2a str. 301
auguaagaugaaauag

SEQ ID NO: 3920666 - RNA, 18 nt, Shigella flexneri 2a str. 301
auguaagcagaaaagcca

SEQ ID NO: 3920667 - RNA, 21 nt, Shigella flexneri 2a str. 301
auguaauuaagcgcaaaggcc

SEQ ID NO: 3920668 - RNA, 17 nt, Shigella flexneri 2a str. 301
auguacauggugcacau

SEQ ID NO: 3920669 - RNA, 23 nt, Shigella flexneri 2a str. 301
auguacaugucgcuguuucugga

SEQ ID NO: 3920670 - RNA, 19 nt, Shigella flexneri 2a str. 301
auguacucguaauauugcg

SEQ ID NO: 3920671 - RNA, 14 nt, Shigella flexneri 2a str. 301
auguagcgcugcaa

SEQ ID NO: 3920672 - RNA, 24 nt, Shigella flexneri 2a str. 301
auguagcgcugcaaaccacgguuc

SEQ ID NO: 3920673 - RNA, 14 nt, Shigella flexneri 2a str. 301
auguagcucaccuu

SEQ ID NO: 3920674 - RNA, 21 nt, Shigella flexneri 2a str. 301
auguaggguacagcacgauga

SEQ ID NO: 3920675 - RNA, 19 nt, Shigella flexneri 2a str. 301
augucacugcuuuggcucu

SEQ ID NO: 3920676 - RNA, 15 nt, Shigella flexneri 2a str. 301
augucagcaaucacc

SEQ ID NO: 3920677 - RNA, 20 nt, Shigella flexneri 2a str. 301
augucauaagcaucccuuua

SEQ ID NO: 3920678 - RNA, 24 nt, Shigella flexneri 2a str. 301
augucaucagcauucucaucacca

SEQ ID NO: 3920679 - RNA, 16 nt, Shigella flexneri 2a str. 301
augucaucaucgccac

SEQ ID NO: 3920680 - RNA, 14 nt, Shigella flexneri 2a str. 301
auguccauuauuuc

SEQ ID NO: 3920681 - RNA, 21 nt, Shigella flexneri 2a str. 301
auguccguuggauaagcggua

SEQ ID NO: 3920682 - RNA, 16 nt, Shigella flexneri 2a str. 301
auguccugcggacagu

SEQ ID NO: 3920683 - RNA, 14 nt, Shigella flexneri 2a str. 301
auguccuuucaggg

SEQ ID NO: 3920684 - RNA, 20 nt, Shigella flexneri 2a str. 301
auguccuuuuaccacuacau

SEQ ID NO: 3920685 - RNA, 21 nt, Shigella flexneri 2a str. 301
augucgagugaauaauugagg

SEQ ID NO: 3920686 - RNA, 18 nt, Shigella flexneri 2a str. 301
augucgcucaaugugcug

SEQ ID NO: 3920687 - RNA, 18 nt, Shigella flexneri 2a str. 301
augucgcuguuucuggac

SEQ ID NO: 3920688 - RNA, 21 nt, Shigella flexneri 2a str. 301
augucgcuuccauugagaaag

SEQ ID NO: 3920689 - RNA, 16 nt, Shigella flexneri 2a str. 301
augucggaugcggcgu

SEQ ID NO: 3920690 - RNA, 17 nt, Shigella flexneri 2a str. 301
augucggaugcggcgug

SEQ ID NO: 3920691 - RNA, 20 nt, Shigella flexneri 2a str. 301
augucggcagugauuuuccc

SEQ ID NO: 3920692 - RNA, 15 nt, Shigella flexneri 2a str. 301
augucgguuguacaa

SEQ ID NO: 3920693 - RNA, 19 nt, Shigella flexneri 2a str. 301
augucgguuguacaaaaaa

SEQ ID NO: 3920694 - RNA, 16 nt, Shigella flexneri 2a str. 301
augucugaucggcaau

SEQ ID NO: 3920695 - RNA, 12 nt, Shigella flexneri 2a str. 301
augucuggaacg

SEQ ID NO: 3920696 - RNA, 14 nt, Shigella flexneri 2a str. 301
augugacagagcca

SEQ ID NO: 3920697 - RNA, 14 nt, Shigella flexneri 2a str. 301
augugacgcugucu

SEQ ID NO: 3920698 - RNA, 18 nt, Shigella flexneri 2a str. 301
augugacuggaaaucaaa

SEQ ID NO: 3920699 - RNA, 14 nt, Shigella flexneri 2a str. 301
augugauaaugccg

SEQ ID NO: 3920700 - RNA, 13 nt, Shigella flexneri 2a str. 301
augugauccauca

SEQ ID NO: 3920701 - RNA, 14 nt, Shigella flexneri 2a str. 301
augugcaguuccug

SEQ ID NO: 3920702 - RNA, 18 nt, Shigella flexneri 2a str. 301
augugcaguuccugcaac

SEQ ID NO: 3920703 - RNA, 22 nt, Shigella flexneri 2a str. 301
augugccagcgauuuugccagc

SEQ ID NO: 3920704 - RNA, 22 nt, Shigella flexneri 2a str. 301
auuaacgguugcggcuuaccaa

SEQ ID NO: 3920705 - RNA, 13 nt, Shigella flexneri 2a str. 301
auuaacguaucaa

SEQ ID NO: 3920706 - RNA, 20 nt, Shigella flexneri 2a str. 301
auuaacugcgcgauuaucau

SEQ ID NO: 3920707 - RNA, 20 nt, Shigella flexneri 2a str. 301
auuaacuuaauaaacaucag

SEQ ID NO: 3920708 - RNA, 13 nt, Shigella flexneri 2a str. 301
auuaacuuuucau

SEQ ID NO: 3920709 - RNA, 18 nt, Shigella flexneri 2a str. 301
auuaagccaugaaugaug

SEQ ID NO: 3920710 - RNA, 21 nt, Shigella flexneri 2a str. 301
auuaagccaugaaugauguaa

SEQ ID NO: 3920711 - RNA, 17 nt, Shigella flexneri 2a str. 301
auuaagcgcaaaggcca

SEQ ID NO: 3920712 - RNA, 16 nt, Shigella flexneri 2a str. 301
auuaaggcaagaaaau

SEQ ID NO: 3920713 - RNA, 17 nt, Shigella flexneri 2a str. 301
auuaaggcaagaaaauu

SEQ ID NO: 3920714 - RNA, 17 nt, Shigella flexneri 2a str. 301
auuaaggguaaaaggau

SEQ ID NO: 3920715 - RNA, 14 nt, Shigella flexneri 2a str. 301
auuaaucagcagau

SEQ ID NO: 3920716 - RNA, 15 nt, Shigella flexneri 2a str. 301
auuaaucaucauuaa

SEQ ID NO: 3920717 - RNA, 21 nt, Shigella flexneri 2a str. 301
auuaaucccugcuucggucag

SEQ ID NO: 3920718 - RNA, 20 nt, Shigella flexneri 2a str. 301
auuaaucgauaaaccagcaa

SEQ ID NO: 3920719 - RNA, 11 nt, Shigella flexneri 2a str. 301
auuaaugacau

SEQ ID NO: 3920720 - RNA, 21 nt, Shigella flexneri 2a str. 301
auuaaugacauucaggccgcc

SEQ ID NO: 3920721 - RNA, 21 nt, Shigella flexneri 2a str. 301
auuaaugcgcccagcgucagc

SEQ ID NO: 3920722 - RNA, 22 nt, Shigella flexneri 2a str. 301
auuaauugcaacgcccaucaac

SEQ ID NO: 3920723 - RNA, 23 nt, Shigella flexneri 2a str. 301
auuaauugcaacgcccaucaaca

SEQ ID NO: 3920724 - RNA, 17 nt, Shigella flexneri 2a str. 301
auuacacaaauccagca

SEQ ID NO: 3920725 - RNA, 13 nt, Shigella flexneri 2a str. 301
auuacacagccac

SEQ ID NO: 3920726 - RNA, 14 nt, Shigella flexneri 2a str. 301
auuacacagccaca

SEQ ID NO: 3920727 - RNA, 17 nt, Shigella flexneri 2a str. 301
auuacacccuuaaucaa

SEQ ID NO: 3920728 - RNA, 20 nt, Shigella flexneri 2a str. 301
auuacacgcgacauaaaacc

SEQ ID NO: 3920729 - RNA, 14 nt, Shigella flexneri 2a str. 301
auuacagagguuuu

SEQ ID NO: 3920730 - RNA, 17 nt, Shigella flexneri 2a str. 301
auuacagagguuuuaug

SEQ ID NO: 3920731 - RNA, 18 nt, Shigella flexneri 2a str. 301
auuacagagguuuuauga

SEQ ID NO: 3920732 - RNA, 19 nt, Shigella flexneri 2a str. 301
auuacagcgcauugcuaau

SEQ ID NO: 3920733 - RNA, 18 nt, Shigella flexneri 2a str. 301
auuacaggcaguaaccaa

SEQ ID NO: 3920734 - RNA, 13 nt, Shigella flexneri 2a str. 301
auuacauaacacu

SEQ ID NO: 3920735 - RNA, 20 nt, Shigella flexneri 2a str. 301
auuacaucgcgaagaaagcg

SEQ ID NO: 3920736 - RNA, 19 nt, Shigella flexneri 2a str. 301
auuaccaacgugcucacca

SEQ ID NO: 3920737 - RNA, 17 nt, Shigella flexneri 2a str. 301
auuaccaacucaucgcc

SEQ ID NO: 3920738 - RNA, 19 nt, Shigella flexneri 2a str. 301
auuaccaauaucaaauaaa

SEQ ID NO: 3920739 - RNA, 12 nt, Shigella flexneri 2a str. 301
auuaccauuuca

SEQ ID NO: 3920740 - RNA, 16 nt, Shigella flexneri 2a str. 301
auuacccauauccaga

SEQ ID NO: 3920741 - RNA, 20 nt, Shigella flexneri 2a str. 301
auuacccguugcaauacuuc

SEQ ID NO: 3920742 - RNA, 21 nt, Shigella flexneri 2a str. 301
auuaccgaacaacaagaagcg

SEQ ID NO: 3920743 - RNA, 22 nt, Shigella flexneri 2a str. 301
auuaccgaugugaacccugauu

SEQ ID NO: 3920744 - RNA, 21 nt, Shigella flexneri 2a str. 301
auuaccgcaccaccagcagcu

SEQ ID NO: 3920745 - RNA, 18 nt, Shigella flexneri 2a str. 301
auuaccguuaaaaccauc

SEQ ID NO: 3920746 - RNA, 19 nt, Shigella flexneri 2a str. 301
auuaccguuaaaaccaucg

SEQ ID NO: 3920747 - RNA, 19 nt, Shigella flexneri 2a str. 301
auuaccugaaaaaacaaau

SEQ ID NO: 3920748 - RNA, 23 nt, Shigella flexneri 2a str. 301
auuaccuuauaacgcuuauaaau

SEQ ID NO: 3920749 - RNA, 13 nt, Shigella flexneri 2a str. 301
auuaccuuaucaa

SEQ ID NO: 3920750 - RNA, 22 nt, Shigella flexneri 2a str. 301
auuaccuuaucaaucucagcaa

SEQ ID NO: 3920751 - RNA, 13 nt, Shigella flexneri 2a str. 301
auuaccuucaaca

SEQ ID NO: 3920752 - RNA, 14 nt, Shigella flexneri 2a str. 301
auuaccuucaacac

SEQ ID NO: 3920753 - RNA, 14 nt, Shigella flexneri 2a str. 301
auuaccuuccucaa

SEQ ID NO: 3920754 - RNA, 19 nt, Shigella flexneri 2a str. 301
auuaccuuuuuacccaugg

SEQ ID NO: 3920755 - RNA, 14 nt, Shigella flexneri 2a str. 301
auuaccuuuuuucc

SEQ ID NO: 3920756 - RNA, 15 nt, Shigella flexneri 2a str. 301
auuaccuuuuuuccc

SEQ ID NO: 3920757 - RNA, 11 nt, Shigella flexneri 2a str. 301
auuacgcgccc

SEQ ID NO: 3920758 - RNA, 20 nt, Shigella flexneri 2a str. 301
auuacgcucacugcaaaaca

SEQ ID NO: 3920759 - RNA, 21 nt, Shigella flexneri 2a str. 301
auuacgcucggcaaagcgcug

SEQ ID NO: 3920760 - RNA, 18 nt, Shigella flexneri 2a str. 301
auuacgcuguucaucccg

SEQ ID NO: 3920761 - RNA, 17 nt, Shigella flexneri 2a str. 301
auuacggaucuuuucuu

SEQ ID NO: 3920762 - RNA, 22 nt, Shigella flexneri 2a str. 301
auuacguggguaggaucacaag

SEQ ID NO: 3920763 - RNA, 19 nt, Shigella flexneri 2a str. 301
auuacguggguaggaucag

SEQ ID NO: 3920764 - RNA, 20 nt, Shigella flexneri 2a str. 301
auuacguggguaggaucaga

SEQ ID NO: 3920765 - RNA, 13 nt, Shigella flexneri 2a str. 301
auuacuacgguaa

SEQ ID NO: 3920766 - RNA, 14 nt, Shigella flexneri 2a str. 301
auuacuacgguaau

SEQ ID NO: 3920767 - RNA, 16 nt, Shigella flexneri 2a str. 301
auuacucaacagguaa

SEQ ID NO: 3920768 - RNA, 12 nt, Shigella flexneri 2a str. 301
auuacucagcaa

SEQ ID NO: 3920769 - RNA, 16 nt, Shigella flexneri 2a str. 301
auuacugacaauuugc

SEQ ID NO: 3920770 - RNA, 12 nt, Shigella flexneri 2a str. 301
auuacugagaac

SEQ ID NO: 3920771 - RNA, 23 nt, Shigella flexneri 2a str. 301
auuacugagauggcuucauccca

SEQ ID NO: 3920772 - RNA, 22 nt, Shigella flexneri 2a str. 301
auuacugagcaauugcucauag

SEQ ID NO: 3920773 - RNA, 12 nt, Shigella flexneri 2a str. 301
auuacugauugc

SEQ ID NO: 3920774 - RNA, 16 nt, Shigella flexneri 2a str. 301
auuacugcugcggaau

SEQ ID NO: 3920775 - RNA, 15 nt, Shigella flexneri 2a str. 301
auuacuggcgauugu

SEQ ID NO: 3920776 - RNA, 15 nt, Shigella flexneri 2a str. 301
auuacuuaacgucaa

SEQ ID NO: 3920777 - RNA, 21 nt, Shigella flexneri 2a str. 301
auuacuucuugaugcggauaa

SEQ ID NO: 3920778 - RNA, 14 nt, Shigella flexneri 2a str. 301
auuacuuuauuuau

SEQ ID NO: 3920779 - RNA, 15 nt, Shigella flexneri 2a str. 301
auuacuuuauuuaua

SEQ ID NO: 3920780 - RNA, 20 nt, Shigella flexneri 2a str. 301
auuagacgaacguuuaauaa

SEQ ID NO: 3920781 - RNA, 12 nt, Shigella flexneri 2a str. 301
auuagacuauuu

SEQ ID NO: 3920782 - RNA, 16 nt, Shigella flexneri 2a str. 301
auuagauaaaaaugaa

SEQ ID NO: 3920783 - RNA, 17 nt, Shigella flexneri 2a str. 301
auuagcaauauuuuuau

SEQ ID NO: 3920784 - RNA, 17 nt, Shigella flexneri 2a str. 301
auuagcacgauuuugua

SEQ ID NO: 3920785 - RNA, 15 nt, Shigella flexneri 2a str. 301
auuagcacuuuucgu

SEQ ID NO: 3920786 - RNA, 14 nt, Shigella flexneri 2a str. 301
auuagcagcaugau

SEQ ID NO: 3920787 - RNA, 22 nt, Shigella flexneri 2a str. 301
auuagcaucgcgauggcaagcg

SEQ ID NO: 3920788 - RNA, 16 nt, Shigella flexneri 2a str. 301
auuagcauugaugcgu

SEQ ID NO: 3920789 - RNA, 14 nt, Shigella flexneri 2a str. 301
auuagcccaauaau

SEQ ID NO: 3920790 - RNA, 22 nt, Shigella flexneri 2a str. 301
auuagcccaauaaucaccguga

SEQ ID NO: 3920791 - RNA, 19 nt, Shigella flexneri 2a str. 301
auuagcccgguagcaugaa

SEQ ID NO: 3920792 - RNA, 20 nt, Shigella flexneri 2a str. 301
auuagccgguaaaucaccag

SEQ ID NO: 3920793 - RNA, 19 nt, Shigella flexneri 2a str. 301
auuagccugaauauccaga

SEQ ID NO: 3920794 - RNA, 20 nt, Shigella flexneri 2a str. 301
auuagcgaccgaacagauca

SEQ ID NO: 3920795 - RNA, 22 nt, Shigella flexneri 2a str. 301
auuagcgcuaucaaagggcacc

SEQ ID NO: 3920796 - RNA, 22 nt, Shigella flexneri 2a str. 301
auuagcguccggcugccagcca

SEQ ID NO: 3920797 - RNA, 22 nt, Shigella flexneri 2a str. 301
auuagcuucgccgaggauuuac

SEQ ID NO: 3920798 - RNA, 20 nt, Shigella flexneri 2a str. 301
auuagcuuuaauccaucgac

SEQ ID NO: 3920799 - RNA, 20 nt, Shigella flexneri 2a str. 301
auuagggaucaucuuaacuu

SEQ ID NO: 3920800 - RNA, 17 nt, Shigella flexneri 2a str. 301
auuagugcugcuggaag

SEQ ID NO: 3920801 - RNA, 23 nt, Shigella flexneri 2a str. 301
auuaguggcaaccacaaccgccg

SEQ ID NO: 3920802 - RNA, 18 nt, Shigella flexneri 2a str. 301
auuaguguguauauacug

SEQ ID NO: 3920803 - RNA, 17 nt, Shigella flexneri 2a str. 301
auuauaucgcucucuuu

SEQ ID NO: 3920804 - RNA, 16 nt, Shigella flexneri 2a str. 301
auucauaauugcgaug

SEQ ID NO: 3920805 - RNA, 19 nt, Shigella flexneri 2a str. 301
auucauacccugaaucaau

SEQ ID NO: 3920806 - RNA, 15 nt, Shigella flexneri 2a str. 301
auucauagaggaaug

SEQ ID NO: 3920807 - RNA, 15 nt, Shigella flexneri 2a str. 301
auucauaugcgccag

SEQ ID NO: 3920808 - RNA, 17 nt, Shigella flexneri 2a str. 301
auucauccguuucccug

SEQ ID NO: 3920809 - RNA, 16 nt, Shigella flexneri 2a str. 301
auucaucgccuucuug

SEQ ID NO: 3920810 - RNA, 14 nt, Shigella flexneri 2a str. 301
auucaucuccagca

SEQ ID NO: 3920811 - RNA, 17 nt, Shigella flexneri 2a str. 301
auucaugaacacacccg

SEQ ID NO: 3920812 - RNA, 18 nt, Shigella flexneri 2a str. 301
auucauggcauuuucucg

SEQ ID NO: 3920813 - RNA, 16 nt, Shigella flexneri 2a str. 301
auucauggugaauauc

SEQ ID NO: 3920814 - RNA, 14 nt, Shigella flexneri 2a str. 301
auucauuaaaacug

SEQ ID NO: 3920815 - RNA, 15 nt, Shigella flexneri 2a str. 301
auucauuacucaacg

SEQ ID NO: 3920816 - RNA, 23 nt, Shigella flexneri 2a str. 301
auucauucacgcuaucuuucaac

SEQ ID NO: 3920817 - RNA, 18 nt, Shigella flexneri 2a str. 301
auucauuugaauaguuaa

SEQ ID NO: 3920818 - RNA, 17 nt, Shigella flexneri 2a str. 301
auucauuugcaucaacg

SEQ ID NO: 3920819 - RNA, 13 nt, Shigella flexneri 2a str. 301
auucauuuugcug

SEQ ID NO: 3920820 - RNA, 19 nt, Shigella flexneri 2a str. 301
auucauuuugcuggaaaag

SEQ ID NO: 3920821 - RNA, 18 nt, Shigella flexneri 2a str. 301
auuccaccgaaacuuuua

SEQ ID NO: 3920822 - RNA, 19 nt, Shigella flexneri 2a str. 301
auuccagcauacgcugcca

SEQ ID NO: 3920823 - RNA, 15 nt, Shigella flexneri 2a str. 301
auuccagugccgcau

SEQ ID NO: 3920824 - RNA, 24 nt, Shigella flexneri 2a str. 301
auuccaguuaucgcgauacaccag

SEQ ID NO: 3920825 - RNA, 11 nt, Shigella flexneri 2a str. 301
auuccauccug

SEQ ID NO: 3920826 - RNA, 15 nt, Shigella flexneri 2a str. 301
auuccauuucccuga

SEQ ID NO: 3920827 - RNA, 22 nt, Shigella flexneri 2a str. 301
auuccauuucccugacaaauca

SEQ ID NO: 3920828 - RNA, 21 nt, Shigella flexneri 2a str. 301
auucccagcaccuguugugcg

SEQ ID NO: 3920829 - RNA, 13 nt, Shigella flexneri 2a str. 301
auucccauuuauu

SEQ ID NO: 3920830 - RNA, 22 nt, Shigella flexneri 2a str. 301
auucccccuuugaccagccagu

SEQ ID NO: 3920831 - RNA, 19 nt, Shigella flexneri 2a str. 301
auuccccggucagcagcac

SEQ ID NO: 3920832 - RNA, 22 nt, Shigella flexneri 2a str. 301
auucccgagcugcucgucagcc

SEQ ID NO: 3920833 - RNA, 15 nt, Shigella flexneri 2a str. 301
auucccgcagcucca

SEQ ID NO: 3920834 - RNA, 16 nt, Shigella flexneri 2a str. 301
auucccgccagaugau

SEQ ID NO: 3920835 - RNA, 19 nt, Shigella flexneri 2a str. 301
auucccgcgaacuaaacaa

SEQ ID NO: 3920836 - RNA, 17 nt, Shigella flexneri 2a str. 301
auucccgggcacacuua

SEQ ID NO: 3920837 - RNA, 22 nt, Shigella flexneri 2a str. 301
auucccugcagucaccugcccu

SEQ ID NO: 3920838 - RNA, 24 nt, Shigella flexneri 2a str. 301
auucccugcagucaccugcccucc

SEQ ID NO: 3920839 - RNA, 15 nt, Shigella flexneri 2a str. 301
auucccuugcucugg

SEQ ID NO: 3920840 - RNA, 15 nt, Shigella flexneri 2a str. 301
auuccgccaccugcg

SEQ ID NO: 3920841 - RNA, 23 nt, Shigella flexneri 2a str. 301
auuccgccaccugcgaacuguaa

SEQ ID NO: 3920842 - RNA, 15 nt, Shigella flexneri 2a str. 301
auuccgccaguugcg

SEQ ID NO: 3920843 - RNA, 18 nt, Shigella flexneri 2a str. 301
auuccgcgugaaaugcca

SEQ ID NO: 3920844 - RNA, 19 nt, Shigella flexneri 2a str. 301
auuccgcgugaaaugccaa

SEQ ID NO: 3920845 - RNA, 20 nt, Shigella flexneri 2a str. 301
auuccggcuuguucaucacc

SEQ ID NO: 3920846 - RNA, 22 nt, Shigella flexneri 2a str. 301
auuccggcuuguucaucaccau

SEQ ID NO: 3920847 - RNA, 21 nt, Shigella flexneri 2a str. 301
auuccggugcugcgucaguug

SEQ ID NO: 3920848 - RNA, 14 nt, Shigella flexneri 2a str. 301
auuccguuucucca

SEQ ID NO: 3920849 - RNA, 15 nt, Shigella flexneri 2a str. 301
auuccuaucgaugaa

SEQ ID NO: 3920850 - RNA, 16 nt, Shigella flexneri 2a str. 301
auuccuaugcaacaac

SEQ ID NO: 3920851 - RNA, 13 nt, Shigella flexneri 2a str. 301
auuccucauggau

SEQ ID NO: 3920852 - RNA, 23 nt, Shigella flexneri 2a str. 301
auuccugacguaacgaccaccac

SEQ ID NO: 3920853 - RNA, 16 nt, Shigella flexneri 2a str. 301
auuccuuaugguucac

SEQ ID NO: 3920854 - RNA, 18 nt, Shigella flexneri 2a str. 301
auuccuuucccuauuuuu

SEQ ID NO: 3920855 - RNA, 22 nt, Shigella flexneri 2a str. 301
auuccuuucccuauuuuuucgu

SEQ ID NO: 3920856 - RNA, 21 nt, Shigella flexneri 2a str. 301
auucgaaaccacccaccgcac

SEQ ID NO: 3920857 - RNA, 12 nt, Shigella flexneri 2a str. 301
auucgaaaucug

SEQ ID NO: 3920858 - RNA, 16 nt, Shigella flexneri 2a str. 301
auucgacgcgcgcaca

SEQ ID NO: 3920859 - RNA, 15 nt, Shigella flexneri 2a str. 301
auucgauacauucag

SEQ ID NO: 3920860 - RNA, 19 nt, Shigella flexneri 2a str. 301
auucgauacauucagaauu

SEQ ID NO: 3920861 - RNA, 12 nt, Shigella flexneri 2a str. 301
auucgauauaau

SEQ ID NO: 3920862 - RNA, 16 nt, Shigella flexneri 2a str. 301
auucgauucacauuua

SEQ ID NO: 3920863 - RNA, 20 nt, Shigella flexneri 2a str. 301
auucgauucacauuuaaaca

SEQ ID NO: 3920864 - RNA, 22 nt, Shigella flexneri 2a str. 301
auucgccagaccuaccaucucc

SEQ ID NO: 3920865 - RNA, 16 nt, Shigella flexneri 2a str. 301
auucgcugcugcggcg

SEQ ID NO: 3920866 - RNA, 21 nt, Shigella flexneri 2a str. 301
auucgcuuccucaaccacuuu

SEQ ID NO: 3920867 - RNA, 15 nt, Shigella flexneri 2a str. 301
auucgcuuucacuca

SEQ ID NO: 3920868 - RNA, 21 nt, Shigella flexneri 2a str. 301
auucggaaauaaucaccugau

SEQ ID NO: 3920869 - RNA, 19 nt, Shigella flexneri 2a str. 301
auucggauugcuauuuaac

SEQ ID NO: 3920870 - RNA, 16 nt, Shigella flexneri 2a str. 301
auucggcaagauaaau

SEQ ID NO: 3920871 - RNA, 13 nt, Shigella flexneri 2a str. 301
auucggccaguaa

SEQ ID NO: 3920872 - RNA, 15 nt, Shigella flexneri 2a str. 301
auucguauuuaaaac

SEQ ID NO: 3920873 - RNA, 20 nt, Shigella flexneri 2a str. 301
auucgucguauagaucacuu

SEQ ID NO: 3920874 - RNA, 14 nt, Shigella flexneri 2a str. 301
auucgugagcuggu

SEQ ID NO: 3920875 - RNA, 21 nt, Shigella flexneri 2a str. 301
auucguucagacgcucugcgg

SEQ ID NO: 3920876 - RNA, 23 nt, Shigella flexneri 2a str. 301
auucguucuucagacuccugaag

SEQ ID NO: 3920877 - RNA, 18 nt, Shigella flexneri 2a str. 301
auucguugguaaugacuc

SEQ ID NO: 3920878 - RNA, 13 nt, Shigella flexneri 2a str. 301
auucuaagugaua

SEQ ID NO: 3920879 - RNA, 17 nt, Shigella flexneri 2a str. 301
auucuaccguuggccug

SEQ ID NO: 3920880 - RNA, 24 nt, Shigella flexneri 2a str. 301
auucuacuuugcgagucugcucca

SEQ ID NO: 3920881 - RNA, 23 nt, Shigella flexneri 2a str. 301
auucuauacaaacuuaccgccgc

SEQ ID NO: 3920882 - RNA, 19 nt, Shigella flexneri 2a str. 301
auucuaucgcccccucuuc

SEQ ID NO: 3920883 - RNA, 16 nt, Shigella flexneri 2a str. 301
auucucaaaauacagu

SEQ ID NO: 3920884 - RNA, 20 nt, Shigella flexneri 2a str. 301
auucucaaaauacaguagaa

SEQ ID NO: 3920885 - RNA, 18 nt, Shigella flexneri 2a str. 301
auucucaauaaaaggaaa

SEQ ID NO: 3920886 - RNA, 17 nt, Shigella flexneri 2a str. 301
auucucaauaucaucau

SEQ ID NO: 3920887 - RNA, 15 nt, Shigella flexneri 2a str. 301
auucucagugguugu

SEQ ID NO: 3920888 - RNA, 13 nt, Shigella flexneri 2a str. 301
auucuccagcgcc

SEQ ID NO: 3920889 - RNA, 20 nt, Shigella flexneri 2a str. 301
auucucccucaucauuugaa

SEQ ID NO: 3920890 - RNA, 17 nt, Shigella flexneri 2a str. 301
auucuccggcaggaaau

SEQ ID NO: 3920891 - RNA, 18 nt, Shigella flexneri 2a str. 301
auucucuauuucacccgc

SEQ ID NO: 3920892 - RNA, 23 nt, Shigella flexneri 2a str. 301
auucucuuuucacgcaauaccug

SEQ ID NO: 3920893 - RNA, 22 nt, Shigella flexneri 2a str. 301
auucugacugucagaugcggcu

SEQ ID NO: 3920894 - RNA, 16 nt, Shigella flexneri 2a str. 301
auucugagagcaugaa

SEQ ID NO: 3920895 - RNA, 14 nt, Shigella flexneri 2a str. 301
auucugauaugcag

SEQ ID NO: 3920896 - RNA, 13 nt, Shigella flexneri 2a str. 301
auucugauccugc

SEQ ID NO: 3920897 - RNA, 16 nt, Shigella flexneri 2a str. 301
auucugauccugcacu

SEQ ID NO: 3920898 - RNA, 19 nt, Shigella flexneri 2a str. 301
auucugcuggccuggcugg

SEQ ID NO: 3920899 - RNA, 16 nt, Shigella flexneri 2a str. 301
auucuggccacuucug

SEQ ID NO: 3920900 - RNA, 17 nt, Shigella flexneri 2a str. 301
auucuggcggcaauaac

SEQ ID NO: 3920901 - RNA, 13 nt, Shigella flexneri 2a str. 301
auucuggcguuaa

SEQ ID NO: 3920902 - RNA, 21 nt, Shigella flexneri 2a str. 301
auucuguguaaaugccuuucu

SEQ ID NO: 3920903 - RNA, 12 nt, Shigella flexneri 2a str. 301
auucuguuuuau

SEQ ID NO: 3920904 - RNA, 19 nt, Shigella flexneri 2a str. 301
auugcgcuaaaaaguuccu

SEQ ID NO: 3920905 - RNA, 19 nt, Shigella flexneri 2a str. 301
auugcgcuggcaccgcaga

SEQ ID NO: 3920906 - RNA, 16 nt, Shigella flexneri 2a str. 301
auugcggaacggcagc

SEQ ID NO: 3920907 - RNA, 14 nt, Shigella flexneri 2a str. 301
auugcgggccaaag

SEQ ID NO: 3920908 - RNA, 15 nt, Shigella flexneri 2a str. 301
auugcgggccaggaa

SEQ ID NO: 3920909 - RNA, 22 nt, Shigella flexneri 2a str. 301
auugcguaaccagacggcguaa

SEQ ID NO: 3920910 - RNA, 16 nt, Shigella flexneri 2a str. 301
auugcguaaucuuuuc

SEQ ID NO: 3920911 - RNA, 15 nt, Shigella flexneri 2a str. 301
auugcgugucccacu

SEQ ID NO: 3920912 - RNA, 14 nt, Shigella flexneri 2a str. 301
auugcuagcggguu

SEQ ID NO: 3920913 - RNA, 17 nt, Shigella flexneri 2a str. 301
auugcuauuuccaccuc

SEQ ID NO: 3920914 - RNA, 12 nt, Shigella flexneri 2a str. 301
auugcucaaagu

SEQ ID NO: 3920915 - RNA, 12 nt, Shigella flexneri 2a str. 301
auugcuccaucc

SEQ ID NO: 3920916 - RNA, 13 nt, Shigella flexneri 2a str. 301
auugcuccaucca

SEQ ID NO: 3920917 - RNA, 12 nt, Shigella flexneri 2a str. 301
auugcugaaaua

SEQ ID NO: 3920918 - RNA, 14 nt, Shigella flexneri 2a str. 301
auugcugacgcaaa

SEQ ID NO: 3920919 - RNA, 11 nt, Shigella flexneri 2a str. 301
auugcugccag

SEQ ID NO: 3920920 - RNA, 14 nt, Shigella flexneri 2a str. 301
auugcugguauaaa

SEQ ID NO: 3920921 - RNA, 22 nt, Shigella flexneri 2a str. 301
auugcugguauaaaauagcaau

SEQ ID NO: 3920922 - RNA, 23 nt, Shigella flexneri 2a str. 301
auugcugguauaaaauagcaaua

SEQ ID NO: 3920923 - RNA, 17 nt, Shigella flexneri 2a str. 301
auugcuguaaauugccg

SEQ ID NO: 3920924 - RNA, 21 nt, Shigella flexneri 2a str. 301
auugcuuugguaaauggcuga

SEQ ID NO: 3920925 - RNA, 20 nt, Shigella flexneri 2a str. 301
auugcuuuuaccauacugga

SEQ ID NO: 3920926 - RNA, 21 nt, Shigella flexneri 2a str. 301
auugcuuuuuuccauaagccc

SEQ ID NO: 3920927 - RNA, 13 nt, Shigella flexneri 2a str. 301
auuggaauacaua

SEQ ID NO: 3920928 - RNA, 14 nt, Shigella flexneri 2a str. 301
auuggaauacauau

SEQ ID NO: 3920929 - RNA, 16 nt, Shigella flexneri 2a str. 301
auuggaauacauauau

SEQ ID NO: 3920930 - RNA, 18 nt, Shigella flexneri 2a str. 301
auuggacgguaaaaagaa

SEQ ID NO: 3920931 - RNA, 16 nt, Shigella flexneri 2a str. 301
auuggaguaucaccau

SEQ ID NO: 3920932 - RNA, 13 nt, Shigella flexneri 2a str. 301
auuggcacgccga

SEQ ID NO: 3920933 - RNA, 14 nt, Shigella flexneri 2a str. 301
auuggcacgccgac

SEQ ID NO: 3920934 - RNA, 19 nt, Shigella flexneri 2a str. 301
auuggcacgccgacaucuu

SEQ ID NO: 3920935 - RNA, 19 nt, Shigella flexneri 2a str. 301
auuggcagagcgaucaacc

SEQ ID NO: 3920936 - RNA, 16 nt, Shigella flexneri 2a str. 301
auuggcauaaauaaua

SEQ ID NO: 3920937 - RNA, 18 nt, Shigella flexneri 2a str. 301
auuggcaucaucagcgga

SEQ ID NO: 3920938 - RNA, 17 nt, Shigella flexneri 2a str. 301
auuggcggcguccugga

SEQ ID NO: 3920939 - RNA, 23 nt, Shigella flexneri 2a str. 301
auuggcggcguccuggaacuggu

SEQ ID NO: 3920940 - RNA, 14 nt, Shigella flexneri 2a str. 301
auuggcugggguac

SEQ ID NO: 3920941 - RNA, 16 nt, Shigella flexneri 2a str. 301
auugggcgaaagaaaa

SEQ ID NO: 3920942 - RNA, 15 nt, Shigella flexneri 2a str. 301
auugggguuacgacc

SEQ ID NO: 3920943 - RNA, 14 nt, Shigella flexneri 2a str. 301
auuggguauucauu

SEQ ID NO: 3920944 - RNA, 18 nt, Shigella flexneri 2a str. 301
auugguacauaacacaau

SEQ ID NO: 3920945 - RNA, 15 nt, Shigella flexneri 2a str. 301
auugguagacgcacc

SEQ ID NO: 3920946 - RNA, 15 nt, Shigella flexneri 2a str. 301
auugguccaucuuuu

SEQ ID NO: 3920947 - RNA, 14 nt, Shigella flexneri 2a str. 301
auuggucuggaacu

SEQ ID NO: 3920948 - RNA, 22 nt, Shigella flexneri 2a str. 301
auuggucuggaacuggcugcca

SEQ ID NO: 3920949 - RNA, 22 nt, Shigella flexneri 2a str. 301
auugguugcgcuucuuccagca

SEQ ID NO: 3920950 - RNA, 14 nt, Shigella flexneri 2a str. 301
auugguuucgucgu

SEQ ID NO: 3920951 - RNA, 14 nt, Shigella flexneri 2a str. 301
auuguaaucuauug

SEQ ID NO: 3920952 - RNA, 16 nt, Shigella flexneri 2a str. 301
auuguagaaaaucuca

SEQ ID NO: 3920953 - RNA, 20 nt, Shigella flexneri 2a str. 301
auugucauucgccugacgca

SEQ ID NO: 3920954 - RNA, 17 nt, Shigella flexneri 2a str. 301
auugucgcagaagccac

SEQ ID NO: 3920955 - RNA, 23 nt, Shigella flexneri 2a str. 301
auugucgccgcuaacaucgucgg

SEQ ID NO: 3920956 - RNA, 24 nt, Shigella flexneri 2a str. 301
auugucgguggcgggcaagcggcg

SEQ ID NO: 3920957 - RNA, 21 nt, Shigella flexneri 2a str. 301
auugucuaugaacacgaucuc

SEQ ID NO: 3920958 - RNA, 23 nt, Shigella flexneri 2a str. 301
auugucuuaaaccggacaauaaa

SEQ ID NO: 3920959 - RNA, 15 nt, Shigella flexneri 2a str. 301
auugugcgccauuuu

SEQ ID NO: 3920960 - RNA, 21 nt, Shigella flexneri 2a str. 301
auugugcggcgguaucgucgg

SEQ ID NO: 3920961 - RNA, 22 nt, Shigella flexneri 2a str. 301
auugugcucacuacggcucagu

SEQ ID NO: 3920962 - RNA, 14 nt, Shigella flexneri 2a str. 301
auuguuaaucacau

SEQ ID NO: 3920963 - RNA, 18 nt, Shigella flexneri 2a str. 301
auuguuauaccaguccac

SEQ ID NO: 3920964 - RNA, 16 nt, Shigella flexneri 2a str. 301
auuguuauaucaauua

SEQ ID NO: 3920965 - RNA, 19 nt, Shigella flexneri 2a str. 301
auuguuauaucaauuauua

SEQ ID NO: 3920966 - RNA, 14 nt, Shigella flexneri 2a str. 301
auuguucugcgcug

SEQ ID NO: 3920967 - RNA, 21 nt, Shigella flexneri 2a str. 301
auuguucuguaugccggauaa

SEQ ID NO: 3920968 - RNA, 16 nt, Shigella flexneri 2a str. 301
auuguugauaaggaaa

SEQ ID NO: 3920969 - RNA, 22 nt, Shigella flexneri 2a str. 301
auuguugauaaggaaauucagc

SEQ ID NO: 3920970 - RNA, 13 nt, Shigella flexneri 2a str. 301
auuguugaugagc

SEQ ID NO: 3920971 - RNA, 19 nt, Shigella flexneri 2a str. 301
auuguugcccgcgccucaa

SEQ ID NO: 3920972 - RNA, 15 nt, Shigella flexneri 2a str. 301
auuguuuaaucaacu

SEQ ID NO: 3920973 - RNA, 19 nt, Shigella flexneri 2a str. 301
auuguuugcaaaaucaaau

SEQ ID NO: 3920974 - RNA, 14 nt, Shigella flexneri 2a str. 301
auuguuugucauga

SEQ ID NO: 3920975 - RNA, 12 nt, Shigella flexneri 2a str. 301
auuuaaaaagaa

SEQ ID NO: 3920976 - RNA, 13 nt, Shigella flexneri 2a str. 301
auuuaaaaagaaa

SEQ ID NO: 3920977 - RNA, 11 nt, Shigella flexneri 2a str. 301
auuuaaaacca

SEQ ID NO: 3920978 - RNA, 20 nt, Shigella flexneri 2a str. 301
auuuaaaaccacuacccaua

SEQ ID NO: 3920979 - RNA, 21 nt, Shigella flexneri 2a str. 301
auuuaaagcggccagauuuac

SEQ ID NO: 3920980 - RNA, 22 nt, Shigella flexneri 2a str. 301
auuuaaaucaaacggugguugu

SEQ ID NO: 3920981 - RNA, 12 nt, Shigella flexneri 2a str. 301
auuuaacaccau

SEQ ID NO: 3920982 - RNA, 13 nt, Shigella flexneri 2a str. 301
auuuaacagcaaa

SEQ ID NO: 3920983 - RNA, 18 nt, Shigella flexneri 2a str. 301
auuuaaccaacaauaaaa

SEQ ID NO: 3920984 - RNA, 13 nt, Shigella flexneri 2a str. 301
auuuaacccugcg

SEQ ID NO: 3920985 - RNA, 18 nt, Shigella flexneri 2a str. 301
auuuaacccuucaagaau

SEQ ID NO: 3920986 - RNA, 16 nt, Shigella flexneri 2a str. 301
auuuaaccugagcuug

SEQ ID NO: 3920987 - RNA, 16 nt, Shigella flexneri 2a str. 301
auuuaacgauaaauaa

SEQ ID NO: 3920988 - RNA, 23 nt, Shigella flexneri 2a str. 301
auuuaauaagaauaagcuauaaa

SEQ ID NO: 3920989 - RNA, 15 nt, Shigella flexneri 2a str. 301
auuuaauaauaagua

SEQ ID NO: 3920990 - RNA, 15 nt, Shigella flexneri 2a str. 301
auuuacaaaucuuua

SEQ ID NO: 3920991 - RNA, 22 nt, Shigella flexneri 2a str. 301
auuuacaagcguuuacccaaac

SEQ ID NO: 3920992 - RNA, 16 nt, Shigella flexneri 2a str. 301
auuuacaauaaccauu

SEQ ID NO: 3920993 - RNA, 22 nt, Shigella flexneri 2a str. 301
auuuacagccugccagcaugca

SEQ ID NO: 3920994 - RNA, 20 nt, Shigella flexneri 2a str. 301
auuuacagucugcucccuuu

SEQ ID NO: 3920995 - RNA, 16 nt, Shigella flexneri 2a str. 301
auuuaccggcagguga

SEQ ID NO: 3920996 - RNA, 20 nt, Shigella flexneri 2a str. 301
auuuaccggcaggugacugg

SEQ ID NO: 3920997 - RNA, 20 nt, Shigella flexneri 2a str. 301
auuuacgccgcauccggcaa

SEQ ID NO: 3920998 - RNA, 16 nt, Shigella flexneri 2a str. 301
auuuacgugaagaugc

SEQ ID NO: 3920999 - RNA, 15 nt, Shigella flexneri 2a str. 301
auuuacguucuuaca

SEQ ID NO: 3921000 - RNA, 17 nt, Shigella flexneri 2a str. 301
auuuacguuuuaaaccu

SEQ ID NO: 3921001 - RNA, 19 nt, Shigella flexneri 2a str. 301
auuuacguuuuaaaccuac

SEQ ID NO: 3921002 - RNA, 15 nt, Shigella flexneri 2a str. 301
auuuacuauuauuuu

SEQ ID NO: 3921003 - RNA, 21 nt, Shigella flexneri 2a str. 301
auuuacucucaucaauaccug

SEQ ID NO: 3921004 - RNA, 16 nt, Shigella flexneri 2a str. 301
auuucuuuaucaccaa

SEQ ID NO: 3921005 - RNA, 21 nt, Shigella flexneri 2a str. 301
auuugaaaugugguuucacuu

SEQ ID NO: 3921006 - RNA, 17 nt, Shigella flexneri 2a str. 301
auuugaggaagcugccu

SEQ ID NO: 3921007 - RNA, 20 nt, Shigella flexneri 2a str. 301
auuugaggaguuuaauaaau

SEQ ID NO: 3921008 - RNA, 21 nt, Shigella flexneri 2a str. 301
auuugaggaguuuaauaaauu

SEQ ID NO: 3921009 - RNA, 16 nt, Shigella flexneri 2a str. 301
auuugaucaaauacuu

SEQ ID NO: 3921010 - RNA, 17 nt, Shigella flexneri 2a str. 301
auuugauuucacacaua

SEQ ID NO: 3921011 - RNA, 14 nt, Shigella flexneri 2a str. 301
auuugcaaaguucc

SEQ ID NO: 3921012 - RNA, 17 nt, Shigella flexneri 2a str. 301
auuugcauacccagaac

SEQ ID NO: 3921013 - RNA, 22 nt, Shigella flexneri 2a str. 301
auuugcaucaacgaucagcgug

SEQ ID NO: 3921014 - RNA, 16 nt, Shigella flexneri 2a str. 301
auuugccccuguugaa

SEQ ID NO: 3921015 - RNA, 19 nt, Shigella flexneri 2a str. 301
auuugccgcagcaguugcc

SEQ ID NO: 3921016 - RNA, 18 nt, Shigella flexneri 2a str. 301
auuugcgccgcaucgcca

SEQ ID NO: 3921017 - RNA, 23 nt, Shigella flexneri 2a str. 301
auuugcgcgacguugcuucucuu

SEQ ID NO: 3921018 - RNA, 21 nt, Shigella flexneri 2a str. 301
auuugcgcucaauaaucaauc

SEQ ID NO: 3921019 - RNA, 22 nt, Shigella flexneri 2a str. 301
auuugcggaaguaguucaucaa

SEQ ID NO: 3921020 - RNA, 18 nt, Shigella flexneri 2a str. 301
auuugcuuuucauacaau

SEQ ID NO: 3921021 - RNA, 21 nt, Shigella flexneri 2a str. 301
auuuggcauaucgccguacau

SEQ ID NO: 3921022 - RNA, 19 nt, Shigella flexneri 2a str. 301
auuuggcugagugaaucag

SEQ ID NO: 3921023 - RNA, 20 nt, Shigella flexneri 2a str. 301
auuuggcugccgagcaaauc

SEQ ID NO: 3921024 - RNA, 16 nt, Shigella flexneri 2a str. 301
auuugguggggcuugc

SEQ ID NO: 3921025 - RNA, 11 nt, Shigella flexneri 2a str. 301
auuuguaauuu

SEQ ID NO: 3921026 - RNA, 16 nt, Shigella flexneri 2a str. 301
auuuguagcuguugcu

SEQ ID NO: 3921027 - RNA, 22 nt, Shigella flexneri 2a str. 301
auuuguagcuguugcugaagaa

SEQ ID NO: 3921028 - RNA, 17 nt, Shigella flexneri 2a str. 301
auuuguaggccugauaa

SEQ ID NO: 3921029 - RNA, 18 nt, Shigella flexneri 2a str. 301
auuuguaguuugauaauu

SEQ ID NO: 3921030 - RNA, 15 nt, Shigella flexneri 2a str. 301
auuuguccacgccgc

SEQ ID NO: 3921031 - RNA, 22 nt, Shigella flexneri 2a str. 301
auuugucgccaacuucaugacc

SEQ ID NO: 3921032 - RNA, 16 nt, Shigella flexneri 2a str. 301
auuugugcacgugcca

SEQ ID NO: 3921033 - RNA, 22 nt, Shigella flexneri 2a str. 301
auuugugcuggcaaaucagugg

SEQ ID NO: 3921034 - RNA, 17 nt, Shigella flexneri 2a str. 301
auuuguggugaagccac

SEQ ID NO: 3921035 - RNA, 12 nt, Shigella flexneri 2a str. 301
auuugugucaga

SEQ ID NO: 3921036 - RNA, 22 nt, Shigella flexneri 2a str. 301
auuuguucucuucugcuuugcc

SEQ ID NO: 3921037 - RNA, 23 nt, Shigella flexneri 2a str. 301
auuuuaaacgucaacccuuuauc

SEQ ID NO: 3921038 - RNA, 21 nt, Shigella flexneri 2a str. 301
auuuuaaauuuccucuuguca

SEQ ID NO: 3921039 - RNA, 15 nt, Shigella flexneri 2a str. 301
auuuuaauaaaucac

SEQ ID NO: 3921040 - RNA, 12 nt, Shigella flexneri 2a str. 301
auuuuaccguca

SEQ ID NO: 3921041 - RNA, 20 nt, Shigella flexneri 2a str. 301
auuuuaggaugcugcaauaa

SEQ ID NO: 3921042 - RNA, 22 nt, Shigella flexneri 2a str. 301
auuuucaaaauaucgacauuca

SEQ ID NO: 3921043 - RNA, 23 nt, Shigella flexneri 2a str. 301
auuuucaaaauaucgacauucaa

SEQ ID NO: 3921044 - RNA, 18 nt, Shigella flexneri 2a str. 301
auuuucaccagcaucgcc

SEQ ID NO: 3921045 - RNA, 18 nt, Shigella flexneri 2a str. 301
auuuucagcgugcccacg

SEQ ID NO: 3921046 - RNA, 22 nt, Shigella flexneri 2a str. 301
auuuucagcgugcccacguuca

SEQ ID NO: 3921047 - RNA, 16 nt, Shigella flexneri 2a str. 301
auuuucaggucugcaa

SEQ ID NO: 3921048 - RNA, 14 nt, Shigella flexneri 2a str. 301
auuuucauccugca

SEQ ID NO: 3921049 - RNA, 21 nt, Shigella flexneri 2a str. 301
auuuucauugccgcaucgaau

SEQ ID NO: 3921050 - RNA, 16 nt, Shigella flexneri 2a str. 301
auuuuccaaaauaaaa

SEQ ID NO: 3921051 - RNA, 15 nt, Shigella flexneri 2a str. 301
auuuuccggguucuc

SEQ ID NO: 3921052 - RNA, 22 nt, Shigella flexneri 2a str. 301
auuuuccgugaagaauuugccc

SEQ ID NO: 3921053 - RNA, 14 nt, Shigella flexneri 2a str. 301
auuuuccuccagca

SEQ ID NO: 3921054 - RNA, 18 nt, Shigella flexneri 2a str. 301
auuuuccuccagcagcac

SEQ ID NO: 3921055 - RNA, 17 nt, Shigella flexneri 2a str. 301
auuuucuauuuugcauu

SEQ ID NO: 3921056 - RNA, 21 nt, Shigella flexneri 2a str. 301
auuuucucgugccgccagcac

SEQ ID NO: 3921057 - RNA, 15 nt, Shigella flexneri 2a str. 301
auuuucugcccauuu

SEQ ID NO: 3921058 - RNA, 19 nt, Shigella flexneri 2a str. 301
auuuucugcgcauuuccca

SEQ ID NO: 3921059 - RNA, 14 nt, Shigella flexneri 2a str. 301
auuuucuucauucg

SEQ ID NO: 3921060 - RNA, 18 nt, Shigella flexneri 2a str. 301
auuuugaagucuuuuuuc

SEQ ID NO: 3921061 - RNA, 21 nt, Shigella flexneri 2a str. 301
auuuugacucggcucauuauu

SEQ ID NO: 3921062 - RNA, 18 nt, Shigella flexneri 2a str. 301
auuuugacuuuuacagcu

SEQ ID NO: 3921063 - RNA, 20 nt, Shigella flexneri 2a str. 301
auuuugacuuuuacagcuua

SEQ ID NO: 3921064 - RNA, 23 nt, Shigella flexneri 2a str. 301
auuuugagggaaacggagcaaaa

SEQ ID NO: 3921065 - RNA, 14 nt, Shigella flexneri 2a str. 301
auuuugcaaggcuu

SEQ ID NO: 3921066 - RNA, 16 nt, Shigella flexneri 2a str. 301
auuuugcagaucgcca

SEQ ID NO: 3921067 - RNA, 20 nt, Shigella flexneri 2a str. 301
auuuugcaucguccacuuga

SEQ ID NO: 3921068 - RNA, 13 nt, Shigella flexneri 2a str. 301
auuuugccaguua

SEQ ID NO: 3921069 - RNA, 20 nt, Shigella flexneri 2a str. 301
auuuugcccggacauugcgc

SEQ ID NO: 3921070 - RNA, 21 nt, Shigella flexneri 2a str. 301
auuuugcgacccguuuacggc

SEQ ID NO: 3921071 - RNA, 17 nt, Shigella flexneri 2a str. 301
auuuugcugauauuuau

SEQ ID NO: 3921072 - RNA, 17 nt, Shigella flexneri 2a str. 301
auuuugcugaucggcaa

SEQ ID NO: 3921073 - RNA, 16 nt, Shigella flexneri 2a str. 301
auuuugcuggaaaagu

SEQ ID NO: 3921074 - RNA, 18 nt, Shigella flexneri 2a str. 301
auuuugcugugcuuuaca

SEQ ID NO: 3921075 - RNA, 15 nt, Shigella flexneri 2a str. 301
auuuugcuuccggca

SEQ ID NO: 3921076 - RNA, 23 nt, Shigella flexneri 2a str. 301
auuuugcuuccggcaagcaaaug

SEQ ID NO: 3921077 - RNA, 22 nt, Shigella flexneri 2a str. 301
auuuuggguauagauugaugag

SEQ ID NO: 3921078 - RNA, 14 nt, Shigella flexneri 2a str. 301
auuuuguaaaagaa

SEQ ID NO: 3921079 - RNA, 15 nt, Shigella flexneri 2a str. 301
auuuuguaaaagaag

SEQ ID NO: 3921080 - RNA, 16 nt, Shigella flexneri 2a str. 301
auuuugugauauguau

SEQ ID NO: 3921081 - RNA, 20 nt, Shigella flexneri 2a str. 301
auuuugugauauguaugaag

SEQ ID NO: 3921082 - RNA, 23 nt, Shigella flexneri 2a str. 301
auuuugugcagcaugcacccuca

SEQ ID NO: 3921083 - RNA, 23 nt, Shigella flexneri 2a str. 301
auuuuuaacuucgcguucugugg

SEQ ID NO: 3921084 - RNA, 22 nt, Shigella flexneri 2a str. 301
auuuuuaucucaaaaauuacuc

SEQ ID NO: 3921085 - RNA, 21 nt, Shigella flexneri 2a str. 301
auuuuuaugccggaucaggcg

SEQ ID NO: 3921086 - RNA, 18 nt, Shigella flexneri 2a str. 301
auuuuucaauauccaaca

SEQ ID NO: 3921087 - RNA, 18 nt, Shigella flexneri 2a str. 301
auuuuucacccuucaauc

SEQ ID NO: 3921088 - RNA, 17 nt, Shigella flexneri 2a str. 301
auuuuucacuuaaugaa

SEQ ID NO: 3921089 - RNA, 16 nt, Shigella flexneri 2a str. 301
auuuuuccagcauuuc

SEQ ID NO: 3921090 - RNA, 17 nt, Shigella flexneri 2a str. 301
auuuuucugcacuacgc

SEQ ID NO: 3921091 - RNA, 14 nt, Shigella flexneri 2a str. 301
auuuuugugaagaa

SEQ ID NO: 3921092 - RNA, 18 nt, Shigella flexneri 2a str. 301
auuuuugugaagaauaaa

SEQ ID NO: 3921093 - RNA, 23 nt, Shigella flexneri 2a str. 301
auuuuuuaacugacuuucguuug

SEQ ID NO: 3921094 - RNA, 13 nt, Shigella flexneri 2a str. 301
auuuuuuauagua

SEQ ID NO: 3921095 - RNA, 21 nt, Shigella flexneri 2a str. 301
auuuuuuauuguccgguuuaa

SEQ ID NO: 3921096 - RNA, 22 nt, Shigella flexneri 2a str. 301
auuuuuucacauguucauuuau

SEQ ID NO: 3921097 - RNA, 16 nt, Shigella flexneri 2a str. 301
auuuuuuccagcgcau

SEQ ID NO: 3921098 - RNA, 12 nt, Shigella flexneri 2a str. 301
auuuuuucccau

SEQ ID NO: 3921099 - RNA, 15 nt, Shigella flexneri 2a str. 301
auuuuuugaaguauu

SEQ ID NO: 3921100 - RNA, 19 nt, Shigella flexneri 2a str. 301
auuuuuugaucaaucugcu

SEQ ID NO: 3921101 - RNA, 20 nt, Shigella flexneri 2a str. 301
auuuuuugcucauaaaauca

SEQ ID NO: 3921102 - RNA, 18 nt, Shigella flexneri 2a str. 301
auuuuuuuauugauaaac

SEQ ID NO: 3921103 - RNA, 21 nt, Shigella flexneri 2a str. 301
caaacaguuucugcagcucca

SEQ ID NO: 3921104 - RNA, 20 nt, Shigella flexneri 2a str. 301
caaacaucaugccggccagc

SEQ ID NO: 3921105 - RNA, 17 nt, Shigella flexneri 2a str. 301
caaacaucggcuuauuc

SEQ ID NO: 3921106 - RNA, 14 nt, Shigella flexneri 2a str. 301
caaacauggaaacc

SEQ ID NO: 3921107 - RNA, 18 nt, Shigella flexneri 2a str. 301
caaacauggaaaccauca

SEQ ID NO: 3921108 - RNA, 19 nt, Shigella flexneri 2a str. 301
caaacauugcugccagaaa

SEQ ID NO: 3921109 - RNA, 17 nt, Shigella flexneri 2a str. 301
caaaccaacgcuguccg

SEQ ID NO: 3921110 - RNA, 14 nt, Shigella flexneri 2a str. 301
caaaccacugcgcc

SEQ ID NO: 3921111 - RNA, 17 nt, Shigella flexneri 2a str. 301
caaacccgaccaccauu

SEQ ID NO: 3921112 - RNA, 14 nt, Shigella flexneri 2a str. 301
caaacccugaguga

SEQ ID NO: 3921113 - RNA, 15 nt, Shigella flexneri 2a str. 301
caaaccgacugccug

SEQ ID NO: 3921114 - RNA, 22 nt, Shigella flexneri 2a str. 301
caaaccucagaguuaaccugaa

SEQ ID NO: 3921115 - RNA, 22 nt, Shigella flexneri 2a str. 301
caaacgacacugcucgcagaaa

SEQ ID NO: 3921116 - RNA, 23 nt, Shigella flexneri 2a str. 301
caaacgacgggccaguuucauag

SEQ ID NO: 3921117 - RNA, 15 nt, Shigella flexneri 2a str. 301
caaacgauaaaagug

SEQ ID NO: 3921118 - RNA, 17 nt, Shigella flexneri 2a str. 301
caaacgauucaaaagau

SEQ ID NO: 3921119 - RNA, 15 nt, Shigella flexneri 2a str. 301
caaacgcaaaacugc

SEQ ID NO: 3921120 - RNA, 18 nt, Shigella flexneri 2a str. 301
caaacgcaaaacugccug

SEQ ID NO: 3921121 - RNA, 15 nt, Shigella flexneri 2a str. 301
caaacgcaucgccaa

SEQ ID NO: 3921122 - RNA, 16 nt, Shigella flexneri 2a str. 301
caaacgcccguccauc

SEQ ID NO: 3921123 - RNA, 23 nt, Shigella flexneri 2a str. 301
caaacgccggaugcaaaaaaaau

SEQ ID NO: 3921124 - RNA, 18 nt, Shigella flexneri 2a str. 301
caaacgccuagaugcuca

SEQ ID NO: 3921125 - RNA, 19 nt, Shigella flexneri 2a str. 301
caaacgcugacauauuuuu

SEQ ID NO: 3921126 - RNA, 22 nt, Shigella flexneri 2a str. 301
caaacggaucgcguaaggcuuc

SEQ ID NO: 3921127 - RNA, 21 nt, Shigella flexneri 2a str. 301
caaacggcgcuuccagcaaau

SEQ ID NO: 3921128 - RNA, 13 nt, Shigella flexneri 2a str. 301
caaacggcuggaa

SEQ ID NO: 3921129 - RNA, 14 nt, Shigella flexneri 2a str. 301
caaacgguuguagc

SEQ ID NO: 3921130 - RNA, 22 nt, Shigella flexneri 2a str. 301
caaacgugacauucugacuggu

SEQ ID NO: 3921131 - RNA, 22 nt, Shigella flexneri 2a str. 301
caaacgugagcgguuucgccuc

SEQ ID NO: 3921132 - RNA, 13 nt, Shigella flexneri 2a str. 301
caaacuaucccag

SEQ ID NO: 3921133 - RNA, 17 nt, Shigella flexneri 2a str. 301
caaacuaucuguguaau

SEQ ID NO: 3921134 - RNA, 13 nt, Shigella flexneri 2a str. 301
caaacucaccauc

SEQ ID NO: 3921135 - RNA, 19 nt, Shigella flexneri 2a str. 301
caaacugaguggaguccag

SEQ ID NO: 3921136 - RNA, 21 nt, Shigella flexneri 2a str. 301
caaacugauuuagcaucagcg

SEQ ID NO: 3921137 - RNA, 19 nt, Shigella flexneri 2a str. 301
caaacugguauugagcgac

SEQ ID NO: 3921138 - RNA, 22 nt, Shigella flexneri 2a str. 301
caaacugguauugagcgaccgc

SEQ ID NO: 3921139 - RNA, 21 nt, Shigella flexneri 2a str. 301
caaacugguguugaaaccgcu

SEQ ID NO: 3921140 - RNA, 16 nt, Shigella flexneri 2a str. 301
caaacuucgucacagc

SEQ ID NO: 3921141 - RNA, 19 nt, Shigella flexneri 2a str. 301
caaacuucucgccaucaaa

SEQ ID NO: 3921142 - RNA, 21 nt, Shigella flexneri 2a str. 301
caaacuugaacuuaucaucag

SEQ ID NO: 3921143 - RNA, 20 nt, Shigella flexneri 2a str. 301
caaacuugauagaacaaaag

SEQ ID NO: 3921144 - RNA, 22 nt, Shigella flexneri 2a str. 301
caaacuugauagaacaaaagac

SEQ ID NO: 3921145 - RNA, 13 nt, Shigella flexneri 2a str. 301
caaacuuuuaaau

SEQ ID NO: 3921146 - RNA, 17 nt, Shigella flexneri 2a str. 301
caaagaaauccacaaau

SEQ ID NO: 3921147 - RNA, 18 nt, Shigella flexneri 2a str. 301
caaagaaccaacgcugcc

SEQ ID NO: 3921148 - RNA, 12 nt, Shigella flexneri 2a str. 301
caaagacaaauu

SEQ ID NO: 3921149 - RNA, 18 nt, Shigella flexneri 2a str. 301
caaagacguuaaaaaagg

SEQ ID NO: 3921150 - RNA, 15 nt, Shigella flexneri 2a str. 301
caaagagagaagcca

SEQ ID NO: 3921151 - RNA, 19 nt, Shigella flexneri 2a str. 301
caaagagcuuucauuucaa

SEQ ID NO: 3921152 - RNA, 15 nt, Shigella flexneri 2a str. 301
caaagcaccacuccu

SEQ ID NO: 3921153 - RNA, 16 nt, Shigella flexneri 2a str. 301
caaagcagaguugcug

SEQ ID NO: 3921154 - RNA, 13 nt, Shigella flexneri 2a str. 301
caaagcagggcug

SEQ ID NO: 3921155 - RNA, 16 nt, Shigella flexneri 2a str. 301
caaagcagggcuggca

SEQ ID NO: 3921156 - RNA, 21 nt, Shigella flexneri 2a str. 301
caaagcauucguaaugaaugu

SEQ ID NO: 3921157 - RNA, 15 nt, Shigella flexneri 2a str. 301
caaagccaacagcag

SEQ ID NO: 3921158 - RNA, 13 nt, Shigella flexneri 2a str. 301
caaagcccaucac

SEQ ID NO: 3921159 - RNA, 23 nt, Shigella flexneri 2a str. 301
caaagcgcacuuuacuggucugu

SEQ ID NO: 3921160 - RNA, 22 nt, Shigella flexneri 2a str. 301
caaagcgcacuuugucaaaaau

SEQ ID NO: 3921161 - RNA, 13 nt, Shigella flexneri 2a str. 301
caaagcgcagccg

SEQ ID NO: 3921162 - RNA, 17 nt, Shigella flexneri 2a str. 301
caaagcguuuugccagu

SEQ ID NO: 3921163 - RNA, 21 nt, Shigella flexneri 2a str. 301
caaagcucauugcggcaacaa

SEQ ID NO: 3921164 - RNA, 23 nt, Shigella flexneri 2a str. 301
caaagcucuuuugacgcccccaa

SEQ ID NO: 3921165 - RNA, 15 nt, Shigella flexneri 2a str. 301
caaagcugcuuuucc

SEQ ID NO: 3921166 - RNA, 17 nt, Shigella flexneri 2a str. 301
caaagcuguaucccagc

SEQ ID NO: 3921167 - RNA, 18 nt, Shigella flexneri 2a str. 301
caaagcuguaucccagcc

SEQ ID NO: 3921168 - RNA, 18 nt, Shigella flexneri 2a str. 301
caaagcugucaccaauca

SEQ ID NO: 3921169 - RNA, 18 nt, Shigella flexneri 2a str. 301
caaaggcacaacugcgac

SEQ ID NO: 3921170 - RNA, 19 nt, Shigella flexneri 2a str. 301
caaaggccagcaaucccca

SEQ ID NO: 3921171 - RNA, 14 nt, Shigella flexneri 2a str. 301
caaaggccagccag

SEQ ID NO: 3921172 - RNA, 16 nt, Shigella flexneri 2a str. 301
caaaggcgugaacuuc

SEQ ID NO: 3921173 - RNA, 18 nt, Shigella flexneri 2a str. 301
caaagggggcgacauuua

SEQ ID NO: 3921174 - RNA, 19 nt, Shigella flexneri 2a str. 301
caaagggggcgacauuuag

SEQ ID NO: 3921175 - RNA, 17 nt, Shigella flexneri 2a str. 301
caaagguaauggucagu

SEQ ID NO: 3921176 - RNA, 22 nt, Shigella flexneri 2a str. 301
caaagguaauggucaguacgcc

SEQ ID NO: 3921177 - RNA, 22 nt, Shigella flexneri 2a str. 301
caaaggugaagguugucaucaa

SEQ ID NO: 3921178 - RNA, 18 nt, Shigella flexneri 2a str. 301
caaaguacggacgcggca

SEQ ID NO: 3921179 - RNA, 19 nt, Shigella flexneri 2a str. 301
caaagugaauacagaacag

SEQ ID NO: 3921180 - RNA, 19 nt, Shigella flexneri 2a str. 301
caaagugauauccaccgcg

SEQ ID NO: 3921181 - RNA, 17 nt, Shigella flexneri 2a str. 301
caaagugcaucucaccg

SEQ ID NO: 3921182 - RNA, 20 nt, Shigella flexneri 2a str. 301
caaagugccuguguuuaugc

SEQ ID NO: 3921183 - RNA, 22 nt, Shigella flexneri 2a str. 301
caaagugcgcguuuuuuaugcc

SEQ ID NO: 3921184 - RNA, 20 nt, Shigella flexneri 2a str. 301
caaaguggaugaucgcggca

SEQ ID NO: 3921185 - RNA, 13 nt, Shigella flexneri 2a str. 301
caaaguuugcacc

SEQ ID NO: 3921186 - RNA, 20 nt, Shigella flexneri 2a str. 301
caaaguuugugaucuuuuuc

SEQ ID NO: 3921187 - RNA, 12 nt, Shigella flexneri 2a str. 301
caaauaaaacau

SEQ ID NO: 3921188 - RNA, 12 nt, Shigella flexneri 2a str. 301
caaauaaauacc

SEQ ID NO: 3921189 - RNA, 21 nt, Shigella flexneri 2a str. 301
caaauaaccgguauuacucca

SEQ ID NO: 3921190 - RNA, 17 nt, Shigella flexneri 2a str. 301
caaauacccaaaaaaua

SEQ ID NO: 3921191 - RNA, 20 nt, Shigella flexneri 2a str. 301
caaauacccaaaaaauagca

SEQ ID NO: 3921192 - RNA, 22 nt, Shigella flexneri 2a str. 301
caaauaccggacacacuucauu

SEQ ID NO: 3921193 - RNA, 16 nt, Shigella flexneri 2a str. 301
caaauacugacuggca

SEQ ID NO: 3921194 - RNA, 14 nt, Shigella flexneri 2a str. 301
caaauacuucaaua

SEQ ID NO: 3921195 - RNA, 16 nt, Shigella flexneri 2a str. 301
caaauacuucaauaua

SEQ ID NO: 3921196 - RNA, 20 nt, Shigella flexneri 2a str. 301
caaauacuuuuuccaguaga

SEQ ID NO: 3921197 - RNA, 16 nt, Shigella flexneri 2a str. 301
caaauagagcgccgga

SEQ ID NO: 3921198 - RNA, 19 nt, Shigella flexneri 2a str. 301
caaauagagcgccggaaau

SEQ ID NO: 3921199 - RNA, 16 nt, Shigella flexneri 2a str. 301
caaauagccagcagag

SEQ ID NO: 3921200 - RNA, 15 nt, Shigella flexneri 2a str. 301
caaauagccugccag

SEQ ID NO: 3921201 - RNA, 16 nt, Shigella flexneri 2a str. 301
caaauagccugccaga

SEQ ID NO: 3921202 - RNA, 12 nt, Shigella flexneri 2a str. 301
caacagugaaau

SEQ ID NO: 3921203 - RNA, 13 nt, Shigella flexneri 2a str. 301
caacaguucaugg

SEQ ID NO: 3921204 - RNA, 12 nt, Shigella flexneri 2a str. 301
caacauaaagcc

SEQ ID NO: 3921205 - RNA, 13 nt, Shigella flexneri 2a str. 301
caacauaaccuga

SEQ ID NO: 3921206 - RNA, 14 nt, Shigella flexneri 2a str. 301
caacauaacgcauc

SEQ ID NO: 3921207 - RNA, 17 nt, Shigella flexneri 2a str. 301
caacauacugcuccaua

SEQ ID NO: 3921208 - RNA, 18 nt, Shigella flexneri 2a str. 301
caacauacuguaacugcg

SEQ ID NO: 3921209 - RNA, 21 nt, Shigella flexneri 2a str. 301
caacaucaaauuacagcaccu

SEQ ID NO: 3921210 - RNA, 12 nt, Shigella flexneri 2a str. 301
caacaucaucuu

SEQ ID NO: 3921211 - RNA, 20 nt, Shigella flexneri 2a str. 301
caacauccgggcgaacuggc

SEQ ID NO: 3921212 - RNA, 18 nt, Shigella flexneri 2a str. 301
caacaucgaaaacgccac

SEQ ID NO: 3921213 - RNA, 15 nt, Shigella flexneri 2a str. 301
caacaucgcauucga

SEQ ID NO: 3921214 - RNA, 15 nt, Shigella flexneri 2a str. 301
caacaugaaaauaac

SEQ ID NO: 3921215 - RNA, 18 nt, Shigella flexneri 2a str. 301
caacaugaaacagaaaau

SEQ ID NO: 3921216 - RNA, 21 nt, Shigella flexneri 2a str. 301
caacaugacuaaucugacaac

SEQ ID NO: 3921217 - RNA, 15 nt, Shigella flexneri 2a str. 301
caacaugcagcccag

SEQ ID NO: 3921218 - RNA, 12 nt, Shigella flexneri 2a str. 301
caacaugccgaa

SEQ ID NO: 3921219 - RNA, 12 nt, Shigella flexneri 2a str. 301
caacaugccgag

SEQ ID NO: 3921220 - RNA, 19 nt, Shigella flexneri 2a str. 301
caacaugucagcaaucacc

SEQ ID NO: 3921221 - RNA, 11 nt, Shigella flexneri 2a str. 301
caacauucaga

SEQ ID NO: 3921222 - RNA, 22 nt, Shigella flexneri 2a str. 301
caacauucccugcaccggugca

SEQ ID NO: 3921223 - RNA, 13 nt, Shigella flexneri 2a str. 301
caacauuuccccc

SEQ ID NO: 3921224 - RNA, 21 nt, Shigella flexneri 2a str. 301
caacauuucccccuuccugcu

SEQ ID NO: 3921225 - RNA, 20 nt, Shigella flexneri 2a str. 301
caacauuuugaauuagcacg

SEQ ID NO: 3921226 - RNA, 14 nt, Shigella flexneri 2a str. 301
caaccaacgccagc

SEQ ID NO: 3921227 - RNA, 16 nt, Shigella flexneri 2a str. 301
caaccaacgccagcag

SEQ ID NO: 3921228 - RNA, 20 nt, Shigella flexneri 2a str. 301
caaccaauucuccaaugccg

SEQ ID NO: 3921229 - RNA, 19 nt, Shigella flexneri 2a str. 301
caaccacaaucucgcgccc

SEQ ID NO: 3921230 - RNA, 14 nt, Shigella flexneri 2a str. 301
caaccacacccaca

SEQ ID NO: 3921231 - RNA, 12 nt, Shigella flexneri 2a str. 301
caaccacauuca

SEQ ID NO: 3921232 - RNA, 17 nt, Shigella flexneri 2a str. 301
caaccaccggcaccacu

SEQ ID NO: 3921233 - RNA, 15 nt, Shigella flexneri 2a str. 301
caaccacuacgugau

SEQ ID NO: 3921234 - RNA, 20 nt, Shigella flexneri 2a str. 301
caaccacuacgugaucgucu

SEQ ID NO: 3921235 - RNA, 15 nt, Shigella flexneri 2a str. 301
caaccacucaccgcu

SEQ ID NO: 3921236 - RNA, 18 nt, Shigella flexneri 2a str. 301
caaccacuuuaucgagaa

SEQ ID NO: 3921237 - RNA, 19 nt, Shigella flexneri 2a str. 301
caaccacuuuaucgagaau

SEQ ID NO: 3921238 - RNA, 16 nt, Shigella flexneri 2a str. 301
caaccagaaagaugca

SEQ ID NO: 3921239 - RNA, 18 nt, Shigella flexneri 2a str. 301
caaccagaaagaugcauc

SEQ ID NO: 3921240 - RNA, 14 nt, Shigella flexneri 2a str. 301
caaccagacgaaau

SEQ ID NO: 3921241 - RNA, 18 nt, Shigella flexneri 2a str. 301
caaccagauaaccaucgc

SEQ ID NO: 3921242 - RNA, 20 nt, Shigella flexneri 2a str. 301
caaccagcaccgaaauauua

SEQ ID NO: 3921243 - RNA, 16 nt, Shigella flexneri 2a str. 301
caaccagcccaugaau

SEQ ID NO: 3921244 - RNA, 14 nt, Shigella flexneri 2a str. 301
caaccagcgucagc

SEQ ID NO: 3921245 - RNA, 21 nt, Shigella flexneri 2a str. 301
caaccagcuucaacgauucaa

SEQ ID NO: 3921246 - RNA, 22 nt, Shigella flexneri 2a str. 301
caaccaguuacgugcugcgcag

SEQ ID NO: 3921247 - RNA, 19 nt, Shigella flexneri 2a str. 301
caaccauccgucauccaua

SEQ ID NO: 3921248 - RNA, 20 nt, Shigella flexneri 2a str. 301
caaccauccgucauccauac

SEQ ID NO: 3921249 - RNA, 21 nt, Shigella flexneri 2a str. 301
caaccaugguuucgaacgcca

SEQ ID NO: 3921250 - RNA, 18 nt, Shigella flexneri 2a str. 301
caaccauuugugcuggca

SEQ ID NO: 3921251 - RNA, 19 nt, Shigella flexneri 2a str. 301
caacccagcggaugaccca

SEQ ID NO: 3921252 - RNA, 12 nt, Shigella flexneri 2a str. 301
caaccccagcca

SEQ ID NO: 3921253 - RNA, 13 nt, Shigella flexneri 2a str. 301
caaccccaucgcg

SEQ ID NO: 3921254 - RNA, 22 nt, Shigella flexneri 2a str. 301
caaccccgcacggugcaccgca

SEQ ID NO: 3921255 - RNA, 16 nt, Shigella flexneri 2a str. 301
caacccggcgaaagag

SEQ ID NO: 3921256 - RNA, 17 nt, Shigella flexneri 2a str. 301
caacccggcgaaagagc

SEQ ID NO: 3921257 - RNA, 20 nt, Shigella flexneri 2a str. 301
caacccggcgaaagagcugg

SEQ ID NO: 3921258 - RNA, 20 nt, Shigella flexneri 2a str. 301
caacccgugagucuccuuua

SEQ ID NO: 3921259 - RNA, 22 nt, Shigella flexneri 2a str. 301
caacccuaaagcacccagcaau

SEQ ID NO: 3921260 - RNA, 12 nt, Shigella flexneri 2a str. 301
caacccugcccu

SEQ ID NO: 3921261 - RNA, 16 nt, Shigella flexneri 2a str. 301
caacccuuuccagcgc

SEQ ID NO: 3921262 - RNA, 20 nt, Shigella flexneri 2a str. 301
caacccuuuccagcgccgcg

SEQ ID NO: 3921263 - RNA, 18 nt, Shigella flexneri 2a str. 301
caaccgaacccagcaggu

SEQ ID NO: 3921264 - RNA, 15 nt, Shigella flexneri 2a str. 301
caaccgcaaaugauu

SEQ ID NO: 3921265 - RNA, 15 nt, Shigella flexneri 2a str. 301
caaccgccauccgcg

SEQ ID NO: 3921266 - RNA, 16 nt, Shigella flexneri 2a str. 301
caaccgcccugcggcu

SEQ ID NO: 3921267 - RNA, 14 nt, Shigella flexneri 2a str. 301
caaccgcgacuggg

SEQ ID NO: 3921268 - RNA, 20 nt, Shigella flexneri 2a str. 301
caaccggcacaauaucuuuu

SEQ ID NO: 3921269 - RNA, 19 nt, Shigella flexneri 2a str. 301
caaccguaaacgaucaucg

SEQ ID NO: 3921270 - RNA, 19 nt, Shigella flexneri 2a str. 301
caaccguccuccguauccu

SEQ ID NO: 3921271 - RNA, 23 nt, Shigella flexneri 2a str. 301
caaccguccuccguauccuguca

SEQ ID NO: 3921272 - RNA, 20 nt, Shigella flexneri 2a str. 301
caaccgucguggucgugauc

SEQ ID NO: 3921273 - RNA, 17 nt, Shigella flexneri 2a str. 301
caaccguucggaaaaau

SEQ ID NO: 3921274 - RNA, 19 nt, Shigella flexneri 2a str. 301
caaccguuugauugaaaaa

SEQ ID NO: 3921275 - RNA, 17 nt, Shigella flexneri 2a str. 301
caaccuacaaacguugc

SEQ ID NO: 3921276 - RNA, 14 nt, Shigella flexneri 2a str. 301
caaccucuucuuuu

SEQ ID NO: 3921277 - RNA, 13 nt, Shigella flexneri 2a str. 301
caaccugcuggaa

SEQ ID NO: 3921278 - RNA, 14 nt, Shigella flexneri 2a str. 301
caaccugcuuuaaa

SEQ ID NO: 3921279 - RNA, 20 nt, Shigella flexneri 2a str. 301
caaccuucuucuuucaguac

SEQ ID NO: 3921280 - RNA, 21 nt, Shigella flexneri 2a str. 301
caaccuucuucuuucaguacg

SEQ ID NO: 3921281 - RNA, 20 nt, Shigella flexneri 2a str. 301
caaccuuguuucugagcaug

SEQ ID NO: 3921282 - RNA, 21 nt, Shigella flexneri 2a str. 301
caaccuuuuccauugccgcag

SEQ ID NO: 3921283 - RNA, 12 nt, Shigella flexneri 2a str. 301
caacgaagaaaa

SEQ ID NO: 3921284 - RNA, 13 nt, Shigella flexneri 2a str. 301
caacgaagaaaac

SEQ ID NO: 3921285 - RNA, 21 nt, Shigella flexneri 2a str. 301
caacgacaccguuaaauaacu

SEQ ID NO: 3921286 - RNA, 22 nt, Shigella flexneri 2a str. 301
caacgacauacucagcgccugc

SEQ ID NO: 3921287 - RNA, 12 nt, Shigella flexneri 2a str. 301
caacgacccagc

SEQ ID NO: 3921288 - RNA, 23 nt, Shigella flexneri 2a str. 301
caacgacgcugaugucagcacuu

SEQ ID NO: 3921289 - RNA, 16 nt, Shigella flexneri 2a str. 301
caacgacggccaguug

SEQ ID NO: 3921290 - RNA, 18 nt, Shigella flexneri 2a str. 301
caacgacguaccaacuga

SEQ ID NO: 3921291 - RNA, 14 nt, Shigella flexneri 2a str. 301
caacgacugcgagc

SEQ ID NO: 3921292 - RNA, 15 nt, Shigella flexneri 2a str. 301
caacgagcugcccgc

SEQ ID NO: 3921293 - RNA, 20 nt, Shigella flexneri 2a str. 301
caacgagcugcccgcugcga

SEQ ID NO: 3921294 - RNA, 19 nt, Shigella flexneri 2a str. 301
caacgaugacaucgcagca

SEQ ID NO: 3921295 - RNA, 23 nt, Shigella flexneri 2a str. 301
caacgcaaaaaggccauccugac

SEQ ID NO: 3921296 - RNA, 22 nt, Shigella flexneri 2a str. 301
caacgcaauauccgccacuucu

SEQ ID NO: 3921297 - RNA, 16 nt, Shigella flexneri 2a str. 301
caacgcaauccccucu

SEQ ID NO: 3921298 - RNA, 18 nt, Shigella flexneri 2a str. 301
caacgcaucgcugcgcuu

SEQ ID NO: 3921299 - RNA, 14 nt, Shigella flexneri 2a str. 301
caacgccagcagca

SEQ ID NO: 3921300 - RNA, 16 nt, Shigella flexneri 2a str. 301
caacgccagcagcagc

SEQ ID NO: 3921301 - RNA, 16 nt, Shigella flexneri 2a str. 301
caacgcccaucaacau

SEQ ID NO: 3921302 - RNA, 15 nt, Shigella flexneri 2a str. 301
caagaauuaaaauau

SEQ ID NO: 3921303 - RNA, 16 nt, Shigella flexneri 2a str. 301
caagaauuaaaauauc

SEQ ID NO: 3921304 - RNA, 21 nt, Shigella flexneri 2a str. 301
caagacaucaauaaacaauga

SEQ ID NO: 3921305 - RNA, 18 nt, Shigella flexneri 2a str. 301
caagaccaauccgccagc

SEQ ID NO: 3921306 - RNA, 17 nt, Shigella flexneri 2a str. 301
caagacgaaaaaugaau

SEQ ID NO: 3921307 - RNA, 19 nt, Shigella flexneri 2a str. 301
caagacgucgcgaauggcc

SEQ ID NO: 3921308 - RNA, 16 nt, Shigella flexneri 2a str. 301
caagagacugcuggcu

SEQ ID NO: 3921309 - RNA, 15 nt, Shigella flexneri 2a str. 301
caagagcaaauaaaa

SEQ ID NO: 3921310 - RNA, 23 nt, Shigella flexneri 2a str. 301
caagaggguuauuuguucagcaa

SEQ ID NO: 3921311 - RNA, 14 nt, Shigella flexneri 2a str. 301
caagagguaaauuu

SEQ ID NO: 3921312 - RNA, 20 nt, Shigella flexneri 2a str. 301
caagauagcgcguugcgcca

SEQ ID NO: 3921313 - RNA, 21 nt, Shigella flexneri 2a str. 301
caagauauuucaccagcgcac

SEQ ID NO: 3921314 - RNA, 18 nt, Shigella flexneri 2a str. 301
caagaucagcauccauau

SEQ ID NO: 3921315 - RNA, 14 nt, Shigella flexneri 2a str. 301
caagaucauacuga

SEQ ID NO: 3921316 - RNA, 15 nt, Shigella flexneri 2a str. 301
caagauccugauacu

SEQ ID NO: 3921317 - RNA, 16 nt, Shigella flexneri 2a str. 301
caagaucgcccugagg

SEQ ID NO: 3921318 - RNA, 15 nt, Shigella flexneri 2a str. 301
caagaucgcgcauca

SEQ ID NO: 3921319 - RNA, 18 nt, Shigella flexneri 2a str. 301
caagaucgcgcaucagcu

SEQ ID NO: 3921320 - RNA, 18 nt, Shigella flexneri 2a str. 301
caagaucgcucaucagcu

SEQ ID NO: 3921321 - RNA, 17 nt, Shigella flexneri 2a str. 301
caagauuaaaagugauu

SEQ ID NO: 3921322 - RNA, 15 nt, Shigella flexneri 2a str. 301
caagauuagcgacga

SEQ ID NO: 3921323 - RNA, 17 nt, Shigella flexneri 2a str. 301
caagauugauccccgcu

SEQ ID NO: 3921324 - RNA, 23 nt, Shigella flexneri 2a str. 301
caagauugauccccgcuuccugc

SEQ ID NO: 3921325 - RNA, 23 nt, Shigella flexneri 2a str. 301
caagcaaggccagguuuucuuuc

SEQ ID NO: 3921326 - RNA, 16 nt, Shigella flexneri 2a str. 301
caagcacaugcugaca

SEQ ID NO: 3921327 - RNA, 15 nt, Shigella flexneri 2a str. 301
caagcaccauccugu

SEQ ID NO: 3921328 - RNA, 13 nt, Shigella flexneri 2a str. 301
caagcagagagac

SEQ ID NO: 3921329 - RNA, 23 nt, Shigella flexneri 2a str. 301
caagcaucguuguuacaacauca

SEQ ID NO: 3921330 - RNA, 20 nt, Shigella flexneri 2a str. 301
caagcauuaaggcaagaaaa

SEQ ID NO: 3921331 - RNA, 22 nt, Shigella flexneri 2a str. 301
caagccacaauaaacgcgcagg

SEQ ID NO: 3921332 - RNA, 19 nt, Shigella flexneri 2a str. 301
caagccaggacgcagucca

SEQ ID NO: 3921333 - RNA, 21 nt, Shigella flexneri 2a str. 301
caagccaucguuaauuaacgc

SEQ ID NO: 3921334 - RNA, 14 nt, Shigella flexneri 2a str. 301
caagcccagccccc

SEQ ID NO: 3921335 - RNA, 16 nt, Shigella flexneri 2a str. 301
caagccccagcaggau

SEQ ID NO: 3921336 - RNA, 22 nt, Shigella flexneri 2a str. 301
caagccgaauaacggcucaaac

SEQ ID NO: 3921337 - RNA, 23 nt, Shigella flexneri 2a str. 301
caagccgaauaacggcucaaacu

SEQ ID NO: 3921338 - RNA, 20 nt, Shigella flexneri 2a str. 301
caagccgcuaacagcagcag

SEQ ID NO: 3921339 - RNA, 22 nt, Shigella flexneri 2a str. 301
caagccgcuaacagcagcagcg

SEQ ID NO: 3921340 - RNA, 15 nt, Shigella flexneri 2a str. 301
caagcgcagcgcccc

SEQ ID NO: 3921341 - RNA, 19 nt, Shigella flexneri 2a str. 301
caagcgcugagacgcgcuu

SEQ ID NO: 3921342 - RNA, 23 nt, Shigella flexneri 2a str. 301
caagcggcauccagguuucuucc

SEQ ID NO: 3921343 - RNA, 23 nt, Shigella flexneri 2a str. 301
caagcgggguaaaugccaucagg

SEQ ID NO: 3921344 - RNA, 19 nt, Shigella flexneri 2a str. 301
caagcgucgcaucaggcau

SEQ ID NO: 3921345 - RNA, 21 nt, Shigella flexneri 2a str. 301
caagcgucgcaucaggcaugg

SEQ ID NO: 3921346 - RNA, 14 nt, Shigella flexneri 2a str. 301
caagcguugcuuca

SEQ ID NO: 3921347 - RNA, 17 nt, Shigella flexneri 2a str. 301
caagcguuucaucuuca

SEQ ID NO: 3921348 - RNA, 19 nt, Shigella flexneri 2a str. 301
caagcuaacgaacgcagug

SEQ ID NO: 3921349 - RNA, 18 nt, Shigella flexneri 2a str. 301
caagcuccggcuuuuuac

SEQ ID NO: 3921350 - RNA, 15 nt, Shigella flexneri 2a str. 301
caagcucgcagagau

SEQ ID NO: 3921351 - RNA, 16 nt, Shigella flexneri 2a str. 301
caagcucgccaccauu

SEQ ID NO: 3921352 - RNA, 22 nt, Shigella flexneri 2a str. 301
caagcuuacguuacccagcacg

SEQ ID NO: 3921353 - RNA, 23 nt, Shigella flexneri 2a str. 301
caagcuuacguuacccagcacgg

SEQ ID NO: 3921354 - RNA, 14 nt, Shigella flexneri 2a str. 301
caaggaaauaacgu

SEQ ID NO: 3921355 - RNA, 21 nt, Shigella flexneri 2a str. 301
caaggaagccugacagggaag

SEQ ID NO: 3921356 - RNA, 16 nt, Shigella flexneri 2a str. 301
caaggaaggcguaaag

SEQ ID NO: 3921357 - RNA, 16 nt, Shigella flexneri 2a str. 301
caaggccaauccagcc

SEQ ID NO: 3921358 - RNA, 20 nt, Shigella flexneri 2a str. 301
caaggcgaggggaccgcccc

SEQ ID NO: 3921359 - RNA, 21 nt, Shigella flexneri 2a str. 301
caaggcgaggggaccgccccu

SEQ ID NO: 3921360 - RNA, 22 nt, Shigella flexneri 2a str. 301
caaggcgaggggaccgccccug

SEQ ID NO: 3921361 - RNA, 20 nt, Shigella flexneri 2a str. 301
caaggcgcggguuucaacau

SEQ ID NO: 3921362 - RNA, 21 nt, Shigella flexneri 2a str. 301
caaggcgcggguuucaacauu

SEQ ID NO: 3921363 - RNA, 21 nt, Shigella flexneri 2a str. 301
caaggcugucgcaaauccgcu

SEQ ID NO: 3921364 - RNA, 22 nt, Shigella flexneri 2a str. 301
caaggcuuuaauauccggugca

SEQ ID NO: 3921365 - RNA, 16 nt, Shigella flexneri 2a str. 301
caagggugagggagga

SEQ ID NO: 3921366 - RNA, 17 nt, Shigella flexneri 2a str. 301
caagggugagggaggau

SEQ ID NO: 3921367 - RNA, 15 nt, Shigella flexneri 2a str. 301
caagggugccgggaa

SEQ ID NO: 3921368 - RNA, 20 nt, Shigella flexneri 2a str. 301
caagguaucgguugcuggau

SEQ ID NO: 3921369 - RNA, 20 nt, Shigella flexneri 2a str. 301
caaggugauugccuuuuucg

SEQ ID NO: 3921370 - RNA, 23 nt, Shigella flexneri 2a str. 301
caaggugugggcaaucacuuugu

SEQ ID NO: 3921371 - RNA, 18 nt, Shigella flexneri 2a str. 301
caaguaauaauaucucca

SEQ ID NO: 3921372 - RNA, 19 nt, Shigella flexneri 2a str. 301
caaguaauucauucacgcu

SEQ ID NO: 3921373 - RNA, 12 nt, Shigella flexneri 2a str. 301
caaguacggcaa

SEQ ID NO: 3921374 - RNA, 15 nt, Shigella flexneri 2a str. 301
caaguauucacucug

SEQ ID NO: 3921375 - RNA, 20 nt, Shigella flexneri 2a str. 301
caagucaacgucauuaucug

SEQ ID NO: 3921376 - RNA, 17 nt, Shigella flexneri 2a str. 301
caagucgaaccuugguc

SEQ ID NO: 3921377 - RNA, 17 nt, Shigella flexneri 2a str. 301
caagucggcaucgccac

SEQ ID NO: 3921378 - RNA, 20 nt, Shigella flexneri 2a str. 301
caagucgugaaaucugaaau

SEQ ID NO: 3921379 - RNA, 16 nt, Shigella flexneri 2a str. 301
caagucuucacugcuc

SEQ ID NO: 3921380 - RNA, 15 nt, Shigella flexneri 2a str. 301
caagugagucggcuu

SEQ ID NO: 3921381 - RNA, 20 nt, Shigella flexneri 2a str. 301
caagugagucggcuuuuuug

SEQ ID NO: 3921382 - RNA, 18 nt, Shigella flexneri 2a str. 301
caaguguggccgccagug

SEQ ID NO: 3921383 - RNA, 15 nt, Shigella flexneri 2a str. 301
caaguugauuuuucg

SEQ ID NO: 3921384 - RNA, 12 nt, Shigella flexneri 2a str. 301
caauaaacuggc

SEQ ID NO: 3921385 - RNA, 12 nt, Shigella flexneri 2a str. 301
caauaaauuccc

SEQ ID NO: 3921386 - RNA, 15 nt, Shigella flexneri 2a str. 301
caauaaauuccccgc

SEQ ID NO: 3921387 - RNA, 18 nt, Shigella flexneri 2a str. 301
caauaaauuccccgcagg

SEQ ID NO: 3921388 - RNA, 14 nt, Shigella flexneri 2a str. 301
caauaaauugcgau

SEQ ID NO: 3921389 - RNA, 16 nt, Shigella flexneri 2a str. 301
caauaacaauacuuau

SEQ ID NO: 3921390 - RNA, 18 nt, Shigella flexneri 2a str. 301
caauaacccgcuguaaau

SEQ ID NO: 3921391 - RNA, 12 nt, Shigella flexneri 2a str. 301
caauaacgccau

SEQ ID NO: 3921392 - RNA, 12 nt, Shigella flexneri 2a str. 301
caauaacgcuuu

SEQ ID NO: 3921393 - RNA, 12 nt, Shigella flexneri 2a str. 301
caauaacuccau

SEQ ID NO: 3921394 - RNA, 18 nt, Shigella flexneri 2a str. 301
caauaagauaacccugca

SEQ ID NO: 3921395 - RNA, 14 nt, Shigella flexneri 2a str. 301
caauaauaucuuuu

SEQ ID NO: 3921396 - RNA, 19 nt, Shigella flexneri 2a str. 301
caauaauauuacuucgcgu

SEQ ID NO: 3921397 - RNA, 13 nt, Shigella flexneri 2a str. 301
caauaaucaccgu

SEQ ID NO: 3921398 - RNA, 23 nt, Shigella flexneri 2a str. 301
caauaaucucuuuacccagcgga

SEQ ID NO: 3921399 - RNA, 14 nt, Shigella flexneri 2a str. 301
caauaaucugauuu

SEQ ID NO: 3921400 - RNA, 14 nt, Shigella flexneri 2a str. 301
caauaauggccuuu

SEQ ID NO: 3921401 - RNA, 19 nt, Shigella flexneri 2a str. 301
caauuacugagagaaaaaa

SEQ ID NO: 3921402 - RNA, 20 nt, Shigella flexneri 2a str. 301
caauuacugcauugaauuuc

SEQ ID NO: 3921403 - RNA, 21 nt, Shigella flexneri 2a str. 301
caauuacugcauugaauuucu

SEQ ID NO: 3921404 - RNA, 14 nt, Shigella flexneri 2a str. 301
caauuagauuuaau

SEQ ID NO: 3921405 - RNA, 14 nt, Shigella flexneri 2a str. 301
caauuagcuuuaau

SEQ ID NO: 3921406 - RNA, 23 nt, Shigella flexneri 2a str. 301
caauuagugggauucaccaaucg

SEQ ID NO: 3921407 - RNA, 22 nt, Shigella flexneri 2a str. 301
caauuaucuggaauuccuuucc

SEQ ID NO: 3921408 - RNA, 22 nt, Shigella flexneri 2a str. 301
caauuauuaaccuggucgcuga

SEQ ID NO: 3921409 - RNA, 20 nt, Shigella flexneri 2a str. 301
caauucaauuaauucuccgc

SEQ ID NO: 3921410 - RNA, 23 nt, Shigella flexneri 2a str. 301
caauucacacagugaaucucuua

SEQ ID NO: 3921411 - RNA, 18 nt, Shigella flexneri 2a str. 301
caauucacgaauauuucc

SEQ ID NO: 3921412 - RNA, 20 nt, Shigella flexneri 2a str. 301
caauucacgaauauuucccg

SEQ ID NO: 3921413 - RNA, 17 nt, Shigella flexneri 2a str. 301
caauucaguacguucac

SEQ ID NO: 3921414 - RNA, 15 nt, Shigella flexneri 2a str. 301
caauucauuccuuga

SEQ ID NO: 3921415 - RNA, 17 nt, Shigella flexneri 2a str. 301
caauuccagcaagccac

SEQ ID NO: 3921416 - RNA, 20 nt, Shigella flexneri 2a str. 301
caauuccagcaagccacugg

SEQ ID NO: 3921417 - RNA, 14 nt, Shigella flexneri 2a str. 301
caauuccagcgcca

SEQ ID NO: 3921418 - RNA, 21 nt, Shigella flexneri 2a str. 301
caauuccauuucccugacaaa

SEQ ID NO: 3921419 - RNA, 23 nt, Shigella flexneri 2a str. 301
caauucccggaccgucaucuucc

SEQ ID NO: 3921420 - RNA, 13 nt, Shigella flexneri 2a str. 301
caauuccugacgu

SEQ ID NO: 3921421 - RNA, 16 nt, Shigella flexneri 2a str. 301
caauuccuucugggcg

SEQ ID NO: 3921422 - RNA, 23 nt, Shigella flexneri 2a str. 301
caauucgcguaguaaagccuuca

SEQ ID NO: 3921423 - RNA, 20 nt, Shigella flexneri 2a str. 301
caauucgcgucggcgucagc

SEQ ID NO: 3921424 - RNA, 15 nt, Shigella flexneri 2a str. 301
caauucuaaauguuc

SEQ ID NO: 3921425 - RNA, 20 nt, Shigella flexneri 2a str. 301
caauugaagaauaucuucug

SEQ ID NO: 3921426 - RNA, 15 nt, Shigella flexneri 2a str. 301
caauugacaguuuau

SEQ ID NO: 3921427 - RNA, 15 nt, Shigella flexneri 2a str. 301
caauugaccaguaau

SEQ ID NO: 3921428 - RNA, 16 nt, Shigella flexneri 2a str. 301
caauugaccaguaaua

SEQ ID NO: 3921429 - RNA, 17 nt, Shigella flexneri 2a str. 301
caauugccccccauaac

SEQ ID NO: 3921430 - RNA, 16 nt, Shigella flexneri 2a str. 301
caauugcgggccaaag

SEQ ID NO: 3921431 - RNA, 19 nt, Shigella flexneri 2a str. 301
caauugcugugccggaagg

SEQ ID NO: 3921432 - RNA, 19 nt, Shigella flexneri 2a str. 301
caauuguucugcgcugaaa

SEQ ID NO: 3921433 - RNA, 21 nt, Shigella flexneri 2a str. 301
caauuuaccgaccucaacaaa

SEQ ID NO: 3921434 - RNA, 13 nt, Shigella flexneri 2a str. 301
caauuuaucagac

SEQ ID NO: 3921435 - RNA, 19 nt, Shigella flexneri 2a str. 301
caauuucccgcguccgcuc

SEQ ID NO: 3921436 - RNA, 14 nt, Shigella flexneri 2a str. 301
caauuucccgcuca

SEQ ID NO: 3921437 - RNA, 22 nt, Shigella flexneri 2a str. 301
caauuucuucugguuucaguaa

SEQ ID NO: 3921438 - RNA, 14 nt, Shigella flexneri 2a str. 301
caauuugcaauuuu

SEQ ID NO: 3921439 - RNA, 16 nt, Shigella flexneri 2a str. 301
caauuugcccaccggu

SEQ ID NO: 3921440 - RNA, 13 nt, Shigella flexneri 2a str. 301
caauuugcccaug

SEQ ID NO: 3921441 - RNA, 20 nt, Shigella flexneri 2a str. 301
caauuugcuuaagccgcucu

SEQ ID NO: 3921442 - RNA, 21 nt, Shigella flexneri 2a str. 301
caauuugcuucuggcuggcgc

SEQ ID NO: 3921443 - RNA, 14 nt, Shigella flexneri 2a str. 301
caauuuuaccgcaa

SEQ ID NO: 3921444 - RNA, 19 nt, Shigella flexneri 2a str. 301
caauuuuaccuagcacugu

SEQ ID NO: 3921445 - RNA, 17 nt, Shigella flexneri 2a str. 301
caauuuuguaggccgga

SEQ ID NO: 3921446 - RNA, 20 nt, Shigella flexneri 2a str. 301
caauuuugucauuacuuaca

SEQ ID NO: 3921447 - RNA, 17 nt, Shigella flexneri 2a str. 301
caauuuuucaucggcaa

SEQ ID NO: 3921448 - RNA, 16 nt, Shigella flexneri 2a str. 301
cacaaaaaccgcugau

SEQ ID NO: 3921449 - RNA, 13 nt, Shigella flexneri 2a str. 301
cacaaaaauaauu

SEQ ID NO: 3921450 - RNA, 17 nt, Shigella flexneri 2a str. 301
cacaaaaauagccccaa

SEQ ID NO: 3921451 - RNA, 19 nt, Shigella flexneri 2a str. 301
cacaaaacacucuucaaca

SEQ ID NO: 3921452 - RNA, 13 nt, Shigella flexneri 2a str. 301
cacaaaaccugcc

SEQ ID NO: 3921453 - RNA, 14 nt, Shigella flexneri 2a str. 301
cacaaaagacgaua

SEQ ID NO: 3921454 - RNA, 14 nt, Shigella flexneri 2a str. 301
cacaaacagcgccu

SEQ ID NO: 3921455 - RNA, 12 nt, Shigella flexneri 2a str. 301
cacaaacaucau

SEQ ID NO: 3921456 - RNA, 20 nt, Shigella flexneri 2a str. 301
cacaaacgaauuaucacucu

SEQ ID NO: 3921457 - RNA, 15 nt, Shigella flexneri 2a str. 301
cacaaacgccgugca

SEQ ID NO: 3921458 - RNA, 18 nt, Shigella flexneri 2a str. 301
cacaaacucuuuuccgga

SEQ ID NO: 3921459 - RNA, 19 nt, Shigella flexneri 2a str. 301
cacaaagcuguaucccagc

SEQ ID NO: 3921460 - RNA, 21 nt, Shigella flexneri 2a str. 301
cacaaagcuguaucccagccc

SEQ ID NO: 3921461 - RNA, 19 nt, Shigella flexneri 2a str. 301
cacaaaggcgcgaagcugg

SEQ ID NO: 3921462 - RNA, 16 nt, Shigella flexneri 2a str. 301
cacaaaguaaacaaua

SEQ ID NO: 3921463 - RNA, 17 nt, Shigella flexneri 2a str. 301
cacaaauacgcuuuuuc

SEQ ID NO: 3921464 - RNA, 18 nt, Shigella flexneri 2a str. 301
cacaaauacgcuuuuucc

SEQ ID NO: 3921465 - RNA, 16 nt, Shigella flexneri 2a str. 301
cacaaauagccagcag

SEQ ID NO: 3921466 - RNA, 16 nt, Shigella flexneri 2a str. 301
cacaaauccagcaccg

SEQ ID NO: 3921467 - RNA, 12 nt, Shigella flexneri 2a str. 301
cacaacaggcua

SEQ ID NO: 3921468 - RNA, 21 nt, Shigella flexneri 2a str. 301
cacaacauccgaggacagcau

SEQ ID NO: 3921469 - RNA, 18 nt, Shigella flexneri 2a str. 301
cacaacauucccaucagu

SEQ ID NO: 3921470 - RNA, 21 nt, Shigella flexneri 2a str. 301
cacaacauucccaucaguagc

SEQ ID NO: 3921471 - RNA, 14 nt, Shigella flexneri 2a str. 301
cacaaccacuuugu

SEQ ID NO: 3921472 - RNA, 14 nt, Shigella flexneri 2a str. 301
cacaacgcuuucaa

SEQ ID NO: 3921473 - RNA, 16 nt, Shigella flexneri 2a str. 301
cacaacgcuuucaaca

SEQ ID NO: 3921474 - RNA, 22 nt, Shigella flexneri 2a str. 301
cacaacugcgaccguacaacca

SEQ ID NO: 3921475 - RNA, 23 nt, Shigella flexneri 2a str. 301
cacaacugcgaccguacaaccaa

SEQ ID NO: 3921476 - RNA, 23 nt, Shigella flexneri 2a str. 301
cacaacuucgcgaacacccgacg

SEQ ID NO: 3921477 - RNA, 13 nt, Shigella flexneri 2a str. 301
cacaagaaauaua

SEQ ID NO: 3921478 - RNA, 18 nt, Shigella flexneri 2a str. 301
cacaagaaguaacaacug

SEQ ID NO: 3921479 - RNA, 18 nt, Shigella flexneri 2a str. 301
cacaagacuguaaauacu

SEQ ID NO: 3921480 - RNA, 17 nt, Shigella flexneri 2a str. 301
cacaagcauuaaggcaa

SEQ ID NO: 3921481 - RNA, 21 nt, Shigella flexneri 2a str. 301
cacaagccaggacgcagucca

SEQ ID NO: 3921482 - RNA, 13 nt, Shigella flexneri 2a str. 301
cacaagcuccggc

SEQ ID NO: 3921483 - RNA, 17 nt, Shigella flexneri 2a str. 301
cacaaggccauugacgc

SEQ ID NO: 3921484 - RNA, 20 nt, Shigella flexneri 2a str. 301
cacaaguaaaaggagauaaa

SEQ ID NO: 3921485 - RNA, 22 nt, Shigella flexneri 2a str. 301
cacaaguugucccauacuugca

SEQ ID NO: 3921486 - RNA, 21 nt, Shigella flexneri 2a str. 301
cacaaguuguuuacaguauga

SEQ ID NO: 3921487 - RNA, 19 nt, Shigella flexneri 2a str. 301
cacaauacugaucaucauu

SEQ ID NO: 3921488 - RNA, 15 nt, Shigella flexneri 2a str. 301
cacaaucaaauccug

SEQ ID NO: 3921489 - RNA, 17 nt, Shigella flexneri 2a str. 301
cacaaucccuuaguaac

SEQ ID NO: 3921490 - RNA, 22 nt, Shigella flexneri 2a str. 301
cacaaucgcagcgcaagcugaa

SEQ ID NO: 3921491 - RNA, 20 nt, Shigella flexneri 2a str. 301
cacaaucggcuuucaccgcc

SEQ ID NO: 3921492 - RNA, 21 nt, Shigella flexneri 2a str. 301
cacaaucggcuuucaccgccu

SEQ ID NO: 3921493 - RNA, 19 nt, Shigella flexneri 2a str. 301
cacaaucucacccgcuuca

SEQ ID NO: 3921494 - RNA, 23 nt, Shigella flexneri 2a str. 301
cacaaucugauaauccagacuau

SEQ ID NO: 3921495 - RNA, 20 nt, Shigella flexneri 2a str. 301
cacaaugcaauaauguggcc

SEQ ID NO: 3921496 - RNA, 13 nt, Shigella flexneri 2a str. 301
cacaaugccugau

SEQ ID NO: 3921497 - RNA, 15 nt, Shigella flexneri 2a str. 301
cacaaugccugaugc

SEQ ID NO: 3921498 - RNA, 20 nt, Shigella flexneri 2a str. 301
cacaaugccugaugcgacgc

SEQ ID NO: 3921499 - RNA, 19 nt, Shigella flexneri 2a str. 301
cacaaugccugaugcgcuu

SEQ ID NO: 3921500 - RNA, 15 nt, Shigella flexneri 2a str. 301
cacaucaucaucgcg

SEQ ID NO: 3921501 - RNA, 17 nt, Shigella flexneri 2a str. 301
cacaucauccggcaccu

SEQ ID NO: 3921502 - RNA, 20 nt, Shigella flexneri 2a str. 301
cacaucauccugacccagca

SEQ ID NO: 3921503 - RNA, 15 nt, Shigella flexneri 2a str. 301
cacauccacaaugcg

SEQ ID NO: 3921504 - RNA, 16 nt, Shigella flexneri 2a str. 301
cacauccaguggcaga

SEQ ID NO: 3921505 - RNA, 18 nt, Shigella flexneri 2a str. 301
cacaucccagcagagauc

SEQ ID NO: 3921506 - RNA, 11 nt, Shigella flexneri 2a str. 301
cacauccggcc

SEQ ID NO: 3921507 - RNA, 21 nt, Shigella flexneri 2a str. 301
cacauccggccaguaagcagu

SEQ ID NO: 3921508 - RNA, 19 nt, Shigella flexneri 2a str. 301
cacauccguccuccguauc

SEQ ID NO: 3921509 - RNA, 15 nt, Shigella flexneri 2a str. 301
cacaucgcugugcug

SEQ ID NO: 3921510 - RNA, 19 nt, Shigella flexneri 2a str. 301
cacaucuaccgccagccag

SEQ ID NO: 3921511 - RNA, 22 nt, Shigella flexneri 2a str. 301
cacaugaauucgacuuucucug

SEQ ID NO: 3921512 - RNA, 15 nt, Shigella flexneri 2a str. 301
cacaugaguugcugg

SEQ ID NO: 3921513 - RNA, 22 nt, Shigella flexneri 2a str. 301
cacaugcaacgucaucaccggc

SEQ ID NO: 3921514 - RNA, 19 nt, Shigella flexneri 2a str. 301
cacaugcaagucgaacggu

SEQ ID NO: 3921515 - RNA, 19 nt, Shigella flexneri 2a str. 301
cacaugccgcgcgguauau

SEQ ID NO: 3921516 - RNA, 13 nt, Shigella flexneri 2a str. 301
cacaugcugacau

SEQ ID NO: 3921517 - RNA, 18 nt, Shigella flexneri 2a str. 301
cacaugcuggaaccacag

SEQ ID NO: 3921518 - RNA, 19 nt, Shigella flexneri 2a str. 301
cacaugcuggaaccacagc

SEQ ID NO: 3921519 - RNA, 10 nt, Shigella flexneri 2a str. 301
cacauguugc

SEQ ID NO: 3921520 - RNA, 20 nt, Shigella flexneri 2a str. 301
cacauguuguacaugcugcu

SEQ ID NO: 3921521 - RNA, 21 nt, Shigella flexneri 2a str. 301
cacauguuguacaugcugcuu

SEQ ID NO: 3921522 - RNA, 19 nt, Shigella flexneri 2a str. 301
cacauuacaccguacuccc

SEQ ID NO: 3921523 - RNA, 20 nt, Shigella flexneri 2a str. 301
cacauuacaccguacucccg

SEQ ID NO: 3921524 - RNA, 18 nt, Shigella flexneri 2a str. 301
cacauuacugcuugcucu

SEQ ID NO: 3921525 - RNA, 19 nt, Shigella flexneri 2a str. 301
cacauuacugcuugcucug

SEQ ID NO: 3921526 - RNA, 13 nt, Shigella flexneri 2a str. 301
cacauuagauaaa

SEQ ID NO: 3921527 - RNA, 14 nt, Shigella flexneri 2a str. 301
cacauuaucaaacg

SEQ ID NO: 3921528 - RNA, 16 nt, Shigella flexneri 2a str. 301
cacauuccagaugugc

SEQ ID NO: 3921529 - RNA, 13 nt, Shigella flexneri 2a str. 301
cacauucgccgcc

SEQ ID NO: 3921530 - RNA, 22 nt, Shigella flexneri 2a str. 301
cacauucugcaucgcgcugaac

SEQ ID NO: 3921531 - RNA, 24 nt, Shigella flexneri 2a str. 301
cacauucugcaucgcgcugaacau

SEQ ID NO: 3921532 - RNA, 23 nt, Shigella flexneri 2a str. 301
cacauugauggcgcuuucguuuu

SEQ ID NO: 3921533 - RNA, 20 nt, Shigella flexneri 2a str. 301
cacauuggacaggcucuuga

SEQ ID NO: 3921534 - RNA, 13 nt, Shigella flexneri 2a str. 301
cacauuucaauca

SEQ ID NO: 3921535 - RNA, 14 nt, Shigella flexneri 2a str. 301
cacauuuuccauca

SEQ ID NO: 3921536 - RNA, 11 nt, Shigella flexneri 2a str. 301
cacauuuuuaa

SEQ ID NO: 3921537 - RNA, 18 nt, Shigella flexneri 2a str. 301
caccaaacugauuuagca

SEQ ID NO: 3921538 - RNA, 23 nt, Shigella flexneri 2a str. 301
caccaaagaugucaccauuggca

SEQ ID NO: 3921539 - RNA, 14 nt, Shigella flexneri 2a str. 301
caccaaaggcacaa

SEQ ID NO: 3921540 - RNA, 13 nt, Shigella flexneri 2a str. 301
caccaacaaauag

SEQ ID NO: 3921541 - RNA, 14 nt, Shigella flexneri 2a str. 301
caccaaccgcggua

SEQ ID NO: 3921542 - RNA, 20 nt, Shigella flexneri 2a str. 301
caccaacgauuuuuuccgca

SEQ ID NO: 3921543 - RNA, 15 nt, Shigella flexneri 2a str. 301
caccaaggaacugug

SEQ ID NO: 3921544 - RNA, 23 nt, Shigella flexneri 2a str. 301
caccaauaccgcccaccaccagc

SEQ ID NO: 3921545 - RNA, 13 nt, Shigella flexneri 2a str. 301
caccaauacgcau

SEQ ID NO: 3921546 - RNA, 18 nt, Shigella flexneri 2a str. 301
caccaauacgcauaugca

SEQ ID NO: 3921547 - RNA, 15 nt, Shigella flexneri 2a str. 301
caccaauagcccaug

SEQ ID NO: 3921548 - RNA, 23 nt, Shigella flexneri 2a str. 301
caccaaucaacaauugcgggcca

SEQ ID NO: 3921549 - RNA, 13 nt, Shigella flexneri 2a str. 301
caccaaucagcgg

SEQ ID NO: 3921550 - RNA, 23 nt, Shigella flexneri 2a str. 301
caccaaucgaaaaugcuccuuuu

SEQ ID NO: 3921551 - RNA, 18 nt, Shigella flexneri 2a str. 301
caccaaucgucaaugccg

SEQ ID NO: 3921552 - RNA, 22 nt, Shigella flexneri 2a str. 301
caccaaugaaagccccaccagc

SEQ ID NO: 3921553 - RNA, 18 nt, Shigella flexneri 2a str. 301
caccaauggcuggccugg

SEQ ID NO: 3921554 - RNA, 15 nt, Shigella flexneri 2a str. 301
caccaauugccggau

SEQ ID NO: 3921555 - RNA, 22 nt, Shigella flexneri 2a str. 301
caccacaaacucuuuuccggaa

SEQ ID NO: 3921556 - RNA, 13 nt, Shigella flexneri 2a str. 301
caccacaauugac

SEQ ID NO: 3921557 - RNA, 20 nt, Shigella flexneri 2a str. 301
caccacagacaaucgccagu

SEQ ID NO: 3921558 - RNA, 12 nt, Shigella flexneri 2a str. 301
caccacaggccu

SEQ ID NO: 3921559 - RNA, 12 nt, Shigella flexneri 2a str. 301
caccaccaaaaa

SEQ ID NO: 3921560 - RNA, 13 nt, Shigella flexneri 2a str. 301
caccaccagacgc

SEQ ID NO: 3921561 - RNA, 13 nt, Shigella flexneri 2a str. 301
caccaccagcacc

SEQ ID NO: 3921562 - RNA, 14 nt, Shigella flexneri 2a str. 301
caccaccagcaccg

SEQ ID NO: 3921563 - RNA, 14 nt, Shigella flexneri 2a str. 301
caccaccagcgaaa

SEQ ID NO: 3921564 - RNA, 22 nt, Shigella flexneri 2a str. 301
caccacccguacuucugaccag

SEQ ID NO: 3921565 - RNA, 20 nt, Shigella flexneri 2a str. 301
caccaccgacggacccgccg

SEQ ID NO: 3921566 - RNA, 20 nt, Shigella flexneri 2a str. 301
caccaccgauauugccaccu

SEQ ID NO: 3921567 - RNA, 15 nt, Shigella flexneri 2a str. 301
caccaccgcaaaaua

SEQ ID NO: 3921568 - RNA, 20 nt, Shigella flexneri 2a str. 301
caccaccgcaaucgccagua

SEQ ID NO: 3921569 - RNA, 20 nt, Shigella flexneri 2a str. 301
caccaccgcaguaaucggcg

SEQ ID NO: 3921570 - RNA, 21 nt, Shigella flexneri 2a str. 301
caccaccgcccguuccaccgc

SEQ ID NO: 3921571 - RNA, 17 nt, Shigella flexneri 2a str. 301
caccaccggcauccauu

SEQ ID NO: 3921572 - RNA, 18 nt, Shigella flexneri 2a str. 301
caccaccuaacccgcuac

SEQ ID NO: 3921573 - RNA, 14 nt, Shigella flexneri 2a str. 301
caccaccugccaga

SEQ ID NO: 3921574 - RNA, 19 nt, Shigella flexneri 2a str. 301
caccaccuggcuugccggg

SEQ ID NO: 3921575 - RNA, 22 nt, Shigella flexneri 2a str. 301
caccaccugggugagcgucauc

SEQ ID NO: 3921576 - RNA, 14 nt, Shigella flexneri 2a str. 301
caccacgaaaacag

SEQ ID NO: 3921577 - RNA, 17 nt, Shigella flexneri 2a str. 301
caccacgaccacgaacg

SEQ ID NO: 3921578 - RNA, 14 nt, Shigella flexneri 2a str. 301
caccacgccaagaa

SEQ ID NO: 3921579 - RNA, 18 nt, Shigella flexneri 2a str. 301
caccacgcugcaugggga

SEQ ID NO: 3921580 - RNA, 19 nt, Shigella flexneri 2a str. 301
caccacugaauaacauuau

SEQ ID NO: 3921581 - RNA, 14 nt, Shigella flexneri 2a str. 301
caccacugccagau

SEQ ID NO: 3921582 - RNA, 22 nt, Shigella flexneri 2a str. 301
caccacuggcgauauugccgcg

SEQ ID NO: 3921583 - RNA, 17 nt, Shigella flexneri 2a str. 301
caccacuucacccgccg

SEQ ID NO: 3921584 - RNA, 11 nt, Shigella flexneri 2a str. 301
caccacuuccc

SEQ ID NO: 3921585 - RNA, 16 nt, Shigella flexneri 2a str. 301
caccacuuuugcucca

SEQ ID NO: 3921586 - RNA, 11 nt, Shigella flexneri 2a str. 301
caccagaauac

SEQ ID NO: 3921587 - RNA, 15 nt, Shigella flexneri 2a str. 301
caccagaaucgccag

SEQ ID NO: 3921588 - RNA, 17 nt, Shigella flexneri 2a str. 301
caccagaaucgccagca

SEQ ID NO: 3921589 - RNA, 19 nt, Shigella flexneri 2a str. 301
caccagaaucgccagcauc

SEQ ID NO: 3921590 - RNA, 19 nt, Shigella flexneri 2a str. 301
caccagacaucccagugca

SEQ ID NO: 3921591 - RNA, 14 nt, Shigella flexneri 2a str. 301
caccagaccugaaa

SEQ ID NO: 3921592 - RNA, 15 nt, Shigella flexneri 2a str. 301
caccagagugaccgc

SEQ ID NO: 3921593 - RNA, 14 nt, Shigella flexneri 2a str. 301
caccagaucguaau

SEQ ID NO: 3921594 - RNA, 17 nt, Shigella flexneri 2a str. 301
caccagauggcuuucca

SEQ ID NO: 3921595 - RNA, 22 nt, Shigella flexneri 2a str. 301
caccagauugugaaucgccugg

SEQ ID NO: 3921596 - RNA, 16 nt, Shigella flexneri 2a str. 301
caccagcaaauccagc

SEQ ID NO: 3921597 - RNA, 20 nt, Shigella flexneri 2a str. 301
caccagcaacaagccagucc

SEQ ID NO: 3921598 - RNA, 13 nt, Shigella flexneri 2a str. 301
caccagcaacagc

SEQ ID NO: 3921599 - RNA, 18 nt, Shigella flexneri 2a str. 301
caccagcaauaaugccag

SEQ ID NO: 3921600 - RNA, 18 nt, Shigella flexneri 2a str. 301
cacccucgaccaaaugaa

SEQ ID NO: 3921601 - RNA, 19 nt, Shigella flexneri 2a str. 301
cacccugacgaccacccag

SEQ ID NO: 3921602 - RNA, 20 nt, Shigella flexneri 2a str. 301
cacccuuuucugccgcuuca

SEQ ID NO: 3921603 - RNA, 22 nt, Shigella flexneri 2a str. 301
caccgaaaacgugguccacauc

SEQ ID NO: 3921604 - RNA, 18 nt, Shigella flexneri 2a str. 301
caccgaaaguggaaacac

SEQ ID NO: 3921605 - RNA, 18 nt, Shigella flexneri 2a str. 301
caccgaaguuaugccagu

SEQ ID NO: 3921606 - RNA, 23 nt, Shigella flexneri 2a str. 301
caccgaccaucccaccaccagca

SEQ ID NO: 3921607 - RNA, 15 nt, Shigella flexneri 2a str. 301
caccgaccaucggca

SEQ ID NO: 3921608 - RNA, 23 nt, Shigella flexneri 2a str. 301
caccgagauaaugguuuccagca

SEQ ID NO: 3921609 - RNA, 15 nt, Shigella flexneri 2a str. 301
caccgaggcauucag

SEQ ID NO: 3921610 - RNA, 17 nt, Shigella flexneri 2a str. 301
caccgaggcauucagcc

SEQ ID NO: 3921611 - RNA, 22 nt, Shigella flexneri 2a str. 301
caccgagucgucugucgggaac

SEQ ID NO: 3921612 - RNA, 14 nt, Shigella flexneri 2a str. 301
caccgaguucuuca

SEQ ID NO: 3921613 - RNA, 22 nt, Shigella flexneri 2a str. 301
caccgauauugccaccugccgg

SEQ ID NO: 3921614 - RNA, 16 nt, Shigella flexneri 2a str. 301
caccgaugcacagcac

SEQ ID NO: 3921615 - RNA, 20 nt, Shigella flexneri 2a str. 301
caccgauuuuguaaaagaag

SEQ ID NO: 3921616 - RNA, 22 nt, Shigella flexneri 2a str. 301
caccgauuuuguaaaagaaggc

SEQ ID NO: 3921617 - RNA, 23 nt, Shigella flexneri 2a str. 301
caccgcaaaauagguaucguaau

SEQ ID NO: 3921618 - RNA, 14 nt, Shigella flexneri 2a str. 301
caccgcaaacugcc

SEQ ID NO: 3921619 - RNA, 20 nt, Shigella flexneri 2a str. 301
caccgcaagccaaauacauu

SEQ ID NO: 3921620 - RNA, 15 nt, Shigella flexneri 2a str. 301
caccgcacagaccau

SEQ ID NO: 3921621 - RNA, 17 nt, Shigella flexneri 2a str. 301
caccgcacagaccauca

SEQ ID NO: 3921622 - RNA, 14 nt, Shigella flexneri 2a str. 301
caccgcaccacacc

SEQ ID NO: 3921623 - RNA, 17 nt, Shigella flexneri 2a str. 301
caccgcaccuaaaaauu

SEQ ID NO: 3921624 - RNA, 12 nt, Shigella flexneri 2a str. 301
caccgcagaagc

SEQ ID NO: 3921625 - RNA, 18 nt, Shigella flexneri 2a str. 301
caccgcagagaucgcccc

SEQ ID NO: 3921626 - RNA, 19 nt, Shigella flexneri 2a str. 301
caccgcagagaucgccccg

SEQ ID NO: 3921627 - RNA, 18 nt, Shigella flexneri 2a str. 301
caccgcagcaucgucauc

SEQ ID NO: 3921628 - RNA, 12 nt, Shigella flexneri 2a str. 301
caccgcagccgc

SEQ ID NO: 3921629 - RNA, 15 nt, Shigella flexneri 2a str. 301
caccgcaucaauauu

SEQ ID NO: 3921630 - RNA, 17 nt, Shigella flexneri 2a str. 301
caccgcauugagggcau

SEQ ID NO: 3921631 - RNA, 13 nt, Shigella flexneri 2a str. 301
caccgccaccacc

SEQ ID NO: 3921632 - RNA, 17 nt, Shigella flexneri 2a str. 301
caccgccacgcccuccu

SEQ ID NO: 3921633 - RNA, 13 nt, Shigella flexneri 2a str. 301
caccgccacgccg

SEQ ID NO: 3921634 - RNA, 17 nt, Shigella flexneri 2a str. 301
caccgccagcaucggcg

SEQ ID NO: 3921635 - RNA, 22 nt, Shigella flexneri 2a str. 301
caccgccagcaucggcggcgua

SEQ ID NO: 3921636 - RNA, 14 nt, Shigella flexneri 2a str. 301
caccgcccagagaa

SEQ ID NO: 3921637 - RNA, 14 nt, Shigella flexneri 2a str. 301
caccgcccagugca

SEQ ID NO: 3921638 - RNA, 20 nt, Shigella flexneri 2a str. 301
caccgcccuccgguccgccg

SEQ ID NO: 3921639 - RNA, 15 nt, Shigella flexneri 2a str. 301
caccgccgacuguca

SEQ ID NO: 3921640 - RNA, 14 nt, Shigella flexneri 2a str. 301
caccgccgccgcca

SEQ ID NO: 3921641 - RNA, 15 nt, Shigella flexneri 2a str. 301
caccgccgccgccac

SEQ ID NO: 3921642 - RNA, 17 nt, Shigella flexneri 2a str. 301
caccgccgccgcuucug

SEQ ID NO: 3921643 - RNA, 18 nt, Shigella flexneri 2a str. 301
caccgccuaccauaauca

SEQ ID NO: 3921644 - RNA, 21 nt, Shigella flexneri 2a str. 301
caccgcgacaaucagguaagc

SEQ ID NO: 3921645 - RNA, 18 nt, Shigella flexneri 2a str. 301
caccgcgaggccuaacac

SEQ ID NO: 3921646 - RNA, 15 nt, Shigella flexneri 2a str. 301
caccgcgaucuucca

SEQ ID NO: 3921647 - RNA, 16 nt, Shigella flexneri 2a str. 301
caccgcgaucuuccac

SEQ ID NO: 3921648 - RNA, 19 nt, Shigella flexneri 2a str. 301
caccgcgaucuuccacgcc

SEQ ID NO: 3921649 - RNA, 16 nt, Shigella flexneri 2a str. 301
caccgcggaacgcacu

SEQ ID NO: 3921650 - RNA, 13 nt, Shigella flexneri 2a str. 301
caccgcguagcau

SEQ ID NO: 3921651 - RNA, 21 nt, Shigella flexneri 2a str. 301
caccgcgugagaacaccaccu

SEQ ID NO: 3921652 - RNA, 22 nt, Shigella flexneri 2a str. 301
caccgcguucagcagcucauca

SEQ ID NO: 3921653 - RNA, 13 nt, Shigella flexneri 2a str. 301
caccgcuccaucg

SEQ ID NO: 3921654 - RNA, 18 nt, Shigella flexneri 2a str. 301
caccgcuucaacagcggc

SEQ ID NO: 3921655 - RNA, 20 nt, Shigella flexneri 2a str. 301
caccgcuucacucccugccc

SEQ ID NO: 3921656 - RNA, 23 nt, Shigella flexneri 2a str. 301
caccggaacaacccagcggauga

SEQ ID NO: 3921657 - RNA, 19 nt, Shigella flexneri 2a str. 301
caccggauaauuccggcuu

SEQ ID NO: 3921658 - RNA, 23 nt, Shigella flexneri 2a str. 301
caccggaugcguucgcaccaccg

SEQ ID NO: 3921659 - RNA, 23 nt, Shigella flexneri 2a str. 301
caccggcaaugaucgcacccgcg

SEQ ID NO: 3921660 - RNA, 13 nt, Shigella flexneri 2a str. 301
caccggcaccacu

SEQ ID NO: 3921661 - RNA, 17 nt, Shigella flexneri 2a str. 301
caccggcgacccgcgac

SEQ ID NO: 3921662 - RNA, 18 nt, Shigella flexneri 2a str. 301
caccggcguucccguccg

SEQ ID NO: 3921663 - RNA, 19 nt, Shigella flexneri 2a str. 301
caccgggcagacgugacca

SEQ ID NO: 3921664 - RNA, 15 nt, Shigella flexneri 2a str. 301
caccgggccgaugcg

SEQ ID NO: 3921665 - RNA, 22 nt, Shigella flexneri 2a str. 301
caccgguacaaacaucauccag

SEQ ID NO: 3921666 - RNA, 19 nt, Shigella flexneri 2a str. 301
caccgguuuaccggccagc

SEQ ID NO: 3921667 - RNA, 17 nt, Shigella flexneri 2a str. 301
caccguauugcgccggu

SEQ ID NO: 3921668 - RNA, 18 nt, Shigella flexneri 2a str. 301
caccgucaaacacagcac

SEQ ID NO: 3921669 - RNA, 15 nt, Shigella flexneri 2a str. 301
caccgucaccccugu

SEQ ID NO: 3921670 - RNA, 15 nt, Shigella flexneri 2a str. 301
caccgucacuucuuc

SEQ ID NO: 3921671 - RNA, 18 nt, Shigella flexneri 2a str. 301
caccgucagccugacgga

SEQ ID NO: 3921672 - RNA, 22 nt, Shigella flexneri 2a str. 301
caccgucaucgacaaaaacccu

SEQ ID NO: 3921673 - RNA, 15 nt, Shigella flexneri 2a str. 301
caccgucgccuucau

SEQ ID NO: 3921674 - RNA, 18 nt, Shigella flexneri 2a str. 301
caccgugauccgccgcug

SEQ ID NO: 3921675 - RNA, 17 nt, Shigella flexneri 2a str. 301
caccgugauucacguuc

SEQ ID NO: 3921676 - RNA, 20 nt, Shigella flexneri 2a str. 301
caccgugcauuucucacuuu

SEQ ID NO: 3921677 - RNA, 22 nt, Shigella flexneri 2a str. 301
caccgugcuucgccuuacucac

SEQ ID NO: 3921678 - RNA, 15 nt, Shigella flexneri 2a str. 301
caccguguucaugac

SEQ ID NO: 3921679 - RNA, 22 nt, Shigella flexneri 2a str. 301
caccguguucaugaccgugauc

SEQ ID NO: 3921680 - RNA, 15 nt, Shigella flexneri 2a str. 301
caccguuaaauaacu

SEQ ID NO: 3921681 - RNA, 14 nt, Shigella flexneri 2a str. 301
caccguuauccuga

SEQ ID NO: 3921682 - RNA, 17 nt, Shigella flexneri 2a str. 301
caccguuucuacaagca

SEQ ID NO: 3921683 - RNA, 21 nt, Shigella flexneri 2a str. 301
caccguuucuacaagcagaga

SEQ ID NO: 3921684 - RNA, 15 nt, Shigella flexneri 2a str. 301
caccguuucugccgu

SEQ ID NO: 3921685 - RNA, 18 nt, Shigella flexneri 2a str. 301
caccuaauaacucuccuc

SEQ ID NO: 3921686 - RNA, 12 nt, Shigella flexneri 2a str. 301
caccuacagcca

SEQ ID NO: 3921687 - RNA, 16 nt, Shigella flexneri 2a str. 301
caccuauguggaaaca

SEQ ID NO: 3921688 - RNA, 19 nt, Shigella flexneri 2a str. 301
caccucaggaaaagcaaaa

SEQ ID NO: 3921689 - RNA, 18 nt, Shigella flexneri 2a str. 301
caccucaguacccgcguu

SEQ ID NO: 3921690 - RNA, 20 nt, Shigella flexneri 2a str. 301
caccucaucaccacagacaa

SEQ ID NO: 3921691 - RNA, 21 nt, Shigella flexneri 2a str. 301
caccucaucaccacagacaaa

SEQ ID NO: 3921692 - RNA, 18 nt, Shigella flexneri 2a str. 301
caccuccacgcccagcgc

SEQ ID NO: 3921693 - RNA, 19 nt, Shigella flexneri 2a str. 301
caccuccagcuccgccagc

SEQ ID NO: 3921694 - RNA, 20 nt, Shigella flexneri 2a str. 301
caccucccgucgcccacacc

SEQ ID NO: 3921695 - RNA, 13 nt, Shigella flexneri 2a str. 301
caccucucgcccg

SEQ ID NO: 3921696 - RNA, 19 nt, Shigella flexneri 2a str. 301
caccucugucgaugcgcuc

SEQ ID NO: 3921697 - RNA, 14 nt, Shigella flexneri 2a str. 301
caccucuuuuucca

SEQ ID NO: 3921698 - RNA, 19 nt, Shigella flexneri 2a str. 301
caccugaaauggucgcccc

SEQ ID NO: 3921699 - RNA, 20 nt, Shigella flexneri 2a str. 301
caccugaaauggucgccccg

SEQ ID NO: 3921700 - RNA, 20 nt, Shigella flexneri 2a str. 301
cacgccuuuuuucacuaugu

SEQ ID NO: 3921701 - RNA, 17 nt, Shigella flexneri 2a str. 301
cacgcgauacuuuuuca

SEQ ID NO: 3921702 - RNA, 17 nt, Shigella flexneri 2a str. 301
cacgcgauuuugccagu

SEQ ID NO: 3921703 - RNA, 15 nt, Shigella flexneri 2a str. 301
cacgcgccacgcacg

SEQ ID NO: 3921704 - RNA, 14 nt, Shigella flexneri 2a str. 301
cacgcgcuccagga

SEQ ID NO: 3921705 - RNA, 23 nt, Shigella flexneri 2a str. 301
cacgcggucaauggucagcgcca

SEQ ID NO: 3921706 - RNA, 18 nt, Shigella flexneri 2a str. 301
cacgcuaauaccggaugc

SEQ ID NO: 3921707 - RNA, 13 nt, Shigella flexneri 2a str. 301
cacgcuaccuuga

SEQ ID NO: 3921708 - RNA, 16 nt, Shigella flexneri 2a str. 301
cacgcucaaagacgcg

SEQ ID NO: 3921709 - RNA, 16 nt, Shigella flexneri 2a str. 301
cacgcucacucaucac

SEQ ID NO: 3921710 - RNA, 19 nt, Shigella flexneri 2a str. 301
cacgcucacucaucacucc

SEQ ID NO: 3921711 - RNA, 22 nt, Shigella flexneri 2a str. 301
cacgcucacucaucacuccccg

SEQ ID NO: 3921712 - RNA, 13 nt, Shigella flexneri 2a str. 301
cacgcucccagca

SEQ ID NO: 3921713 - RNA, 16 nt, Shigella flexneri 2a str. 301
cacgcucccagcagag

SEQ ID NO: 3921714 - RNA, 19 nt, Shigella flexneri 2a str. 301
cacgcucgcgguuggcaau

SEQ ID NO: 3921715 - RNA, 13 nt, Shigella flexneri 2a str. 301
cacgcucuguucu

SEQ ID NO: 3921716 - RNA, 14 nt, Shigella flexneri 2a str. 301
cacgcucuguucug

SEQ ID NO: 3921717 - RNA, 17 nt, Shigella flexneri 2a str. 301
cacgcucuguucugcgc

SEQ ID NO: 3921718 - RNA, 13 nt, Shigella flexneri 2a str. 301
cacgcugccccug

SEQ ID NO: 3921719 - RNA, 14 nt, Shigella flexneri 2a str. 301
cacgcugcucaucu

SEQ ID NO: 3921720 - RNA, 18 nt, Shigella flexneri 2a str. 301
cacgcuguagccgccguc

SEQ ID NO: 3921721 - RNA, 19 nt, Shigella flexneri 2a str. 301
cacgcuguagccgccgucg

SEQ ID NO: 3921722 - RNA, 13 nt, Shigella flexneri 2a str. 301
cacgcugucggca

SEQ ID NO: 3921723 - RNA, 22 nt, Shigella flexneri 2a str. 301
cacgcugucuggcgucuccugc

SEQ ID NO: 3921724 - RNA, 19 nt, Shigella flexneri 2a str. 301
cacgcuuaauugaaccuaa

SEQ ID NO: 3921725 - RNA, 22 nt, Shigella flexneri 2a str. 301
cacgcuuuacaauauccagcgc

SEQ ID NO: 3921726 - RNA, 17 nt, Shigella flexneri 2a str. 301
cacggaaagcagcauac

SEQ ID NO: 3921727 - RNA, 18 nt, Shigella flexneri 2a str. 301
cacggaaaggcaacauga

SEQ ID NO: 3921728 - RNA, 23 nt, Shigella flexneri 2a str. 301
cacggaaaggcaacaugaaacag

SEQ ID NO: 3921729 - RNA, 18 nt, Shigella flexneri 2a str. 301
cacggaaucaccgccacg

SEQ ID NO: 3921730 - RNA, 17 nt, Shigella flexneri 2a str. 301
cacggagauauccagcg

SEQ ID NO: 3921731 - RNA, 19 nt, Shigella flexneri 2a str. 301
cacggaguugaccagcucc

SEQ ID NO: 3921732 - RNA, 21 nt, Shigella flexneri 2a str. 301
cacggaucaggcggcucaccu

SEQ ID NO: 3921733 - RNA, 18 nt, Shigella flexneri 2a str. 301
cacggcaacacgccuggc

SEQ ID NO: 3921734 - RNA, 13 nt, Shigella flexneri 2a str. 301
cacggcagcaacu

SEQ ID NO: 3921735 - RNA, 18 nt, Shigella flexneri 2a str. 301
cacggcauaagccguccc

SEQ ID NO: 3921736 - RNA, 14 nt, Shigella flexneri 2a str. 301
cacggcaugaaagc

SEQ ID NO: 3921737 - RNA, 20 nt, Shigella flexneri 2a str. 301
cacggccacagccagccaac

SEQ ID NO: 3921738 - RNA, 13 nt, Shigella flexneri 2a str. 301
cacggccacucug

SEQ ID NO: 3921739 - RNA, 13 nt, Shigella flexneri 2a str. 301
cacggcgauacca

SEQ ID NO: 3921740 - RNA, 23 nt, Shigella flexneri 2a str. 301
cacggcguggcaucaauaccgcg

SEQ ID NO: 3921741 - RNA, 18 nt, Shigella flexneri 2a str. 301
cacggcuaccguugcggc

SEQ ID NO: 3921742 - RNA, 21 nt, Shigella flexneri 2a str. 301
cacgggcaauuuucgccaucu

SEQ ID NO: 3921743 - RNA, 22 nt, Shigella flexneri 2a str. 301
cacgggccgagugccuugcuga

SEQ ID NO: 3921744 - RNA, 13 nt, Shigella flexneri 2a str. 301
cacggguuuccca

SEQ ID NO: 3921745 - RNA, 14 nt, Shigella flexneri 2a str. 301
cacgguaaugacuc

SEQ ID NO: 3921746 - RNA, 23 nt, Shigella flexneri 2a str. 301
cacgguauuaggcauauccuaua

SEQ ID NO: 3921747 - RNA, 23 nt, Shigella flexneri 2a str. 301
cacggugaagaagcggaaaucac

SEQ ID NO: 3921748 - RNA, 19 nt, Shigella flexneri 2a str. 301
cacggugcuccagugcgcu

SEQ ID NO: 3921749 - RNA, 13 nt, Shigella flexneri 2a str. 301
cacggugucggua

SEQ ID NO: 3921750 - RNA, 15 nt, Shigella flexneri 2a str. 301
cacgguuacgcuacc

SEQ ID NO: 3921751 - RNA, 13 nt, Shigella flexneri 2a str. 301
cacgguucuccac

SEQ ID NO: 3921752 - RNA, 15 nt, Shigella flexneri 2a str. 301
cacgguuuuuccagc

SEQ ID NO: 3921753 - RNA, 22 nt, Shigella flexneri 2a str. 301
cacguaacgacugacuuucggc

SEQ ID NO: 3921754 - RNA, 17 nt, Shigella flexneri 2a str. 301
cacguaccaaaacacca

SEQ ID NO: 3921755 - RNA, 15 nt, Shigella flexneri 2a str. 301
cacguaccagaugca

SEQ ID NO: 3921756 - RNA, 19 nt, Shigella flexneri 2a str. 301
cacguaccagaugcaucac

SEQ ID NO: 3921757 - RNA, 22 nt, Shigella flexneri 2a str. 301
cacguaccaugcgcaucaucga

SEQ ID NO: 3921758 - RNA, 13 nt, Shigella flexneri 2a str. 301
cacguaggccuga

SEQ ID NO: 3921759 - RNA, 17 nt, Shigella flexneri 2a str. 301
cacguauaaacaucuuu

SEQ ID NO: 3921760 - RNA, 15 nt, Shigella flexneri 2a str. 301
cacgucaucagcaau

SEQ ID NO: 3921761 - RNA, 13 nt, Shigella flexneri 2a str. 301
cacgucauccccc

SEQ ID NO: 3921762 - RNA, 22 nt, Shigella flexneri 2a str. 301
cacguccccuggggagugaccu

SEQ ID NO: 3921763 - RNA, 20 nt, Shigella flexneri 2a str. 301
cacguccgguggcauccgca

SEQ ID NO: 3921764 - RNA, 20 nt, Shigella flexneri 2a str. 301
cacgucgucaggcaaccgcu

SEQ ID NO: 3921765 - RNA, 11 nt, Shigella flexneri 2a str. 301
cacgucugaag

SEQ ID NO: 3921766 - RNA, 18 nt, Shigella flexneri 2a str. 301
cacgucuuaauguaaugc

SEQ ID NO: 3921767 - RNA, 18 nt, Shigella flexneri 2a str. 301
cacgucuuugccgcgcuc

SEQ ID NO: 3921768 - RNA, 22 nt, Shigella flexneri 2a str. 301
cacguuagaaacaaaaaaaccg

SEQ ID NO: 3921769 - RNA, 21 nt, Shigella flexneri 2a str. 301
cacguucaaaacggugaucaa

SEQ ID NO: 3921770 - RNA, 19 nt, Shigella flexneri 2a str. 301
cacguucaaucuggugaug

SEQ ID NO: 3921771 - RNA, 17 nt, Shigella flexneri 2a str. 301
cacguucaucccacucu

SEQ ID NO: 3921772 - RNA, 23 nt, Shigella flexneri 2a str. 301
cacguuccuggaaccagugaaua

SEQ ID NO: 3921773 - RNA, 14 nt, Shigella flexneri 2a str. 301
cacguucggcggau

SEQ ID NO: 3921774 - RNA, 16 nt, Shigella flexneri 2a str. 301
cacguugagagguaaa

SEQ ID NO: 3921775 - RNA, 20 nt, Shigella flexneri 2a str. 301
cacguugcugcggcguuccc

SEQ ID NO: 3921776 - RNA, 19 nt, Shigella flexneri 2a str. 301
cacguuguuaaugcgcuga

SEQ ID NO: 3921777 - RNA, 16 nt, Shigella flexneri 2a str. 301
cacguuuaacacgcuc

SEQ ID NO: 3921778 - RNA, 15 nt, Shigella flexneri 2a str. 301
cacguuucacugccg

SEQ ID NO: 3921779 - RNA, 15 nt, Shigella flexneri 2a str. 301
cacguuuugcggaug

SEQ ID NO: 3921780 - RNA, 15 nt, Shigella flexneri 2a str. 301
cacguuuugcugaug

SEQ ID NO: 3921781 - RNA, 16 nt, Shigella flexneri 2a str. 301
cacuaaagccugcuuu

SEQ ID NO: 3921782 - RNA, 19 nt, Shigella flexneri 2a str. 301
cacuaacagaacaauaaua

SEQ ID NO: 3921783 - RNA, 21 nt, Shigella flexneri 2a str. 301
cacuaaccguuucuaauauua

SEQ ID NO: 3921784 - RNA, 11 nt, Shigella flexneri 2a str. 301
cacuaacgaca

SEQ ID NO: 3921785 - RNA, 15 nt, Shigella flexneri 2a str. 301
cacuaacgcauugaa

SEQ ID NO: 3921786 - RNA, 20 nt, Shigella flexneri 2a str. 301
cacuaacgcauugaacucuu

SEQ ID NO: 3921787 - RNA, 18 nt, Shigella flexneri 2a str. 301
cacuaacgcgucuuaucu

SEQ ID NO: 3921788 - RNA, 12 nt, Shigella flexneri 2a str. 301
cacuacacccca

SEQ ID NO: 3921789 - RNA, 20 nt, Shigella flexneri 2a str. 301
cacuaccauaaaaaaacaca

SEQ ID NO: 3921790 - RNA, 16 nt, Shigella flexneri 2a str. 301
cacuaccggaacccac

SEQ ID NO: 3921791 - RNA, 15 nt, Shigella flexneri 2a str. 301
cacuaccuucuuccc

SEQ ID NO: 3921792 - RNA, 15 nt, Shigella flexneri 2a str. 301
cacuacucugaccca

SEQ ID NO: 3921793 - RNA, 20 nt, Shigella flexneri 2a str. 301
cacuaucccaacaacucuuc

SEQ ID NO: 3921794 - RNA, 22 nt, Shigella flexneri 2a str. 301
cacuaucccaacaacucuuccu

SEQ ID NO: 3921795 - RNA, 17 nt, Shigella flexneri 2a str. 301
cacuaucgaaaguuuac

SEQ ID NO: 3921796 - RNA, 21 nt, Shigella flexneri 2a str. 301
cacuaucuugcuucugacuau

SEQ ID NO: 3921797 - RNA, 15 nt, Shigella flexneri 2a str. 301
cacuaugaaaauaaa

SEQ ID NO: 3921798 - RNA, 13 nt, Shigella flexneri 2a str. 301
cacuaugacugcc

SEQ ID NO: 3921799 - RNA, 15 nt, Shigella flexneri 2a str. 301
cacuauuauauucug

SEQ ID NO: 3921800 - RNA, 21 nt, Shigella flexneri 2a str. 301
cacuuaacccauuacaagccc

SEQ ID NO: 3921801 - RNA, 13 nt, Shigella flexneri 2a str. 301
cacuuaaugaauc

SEQ ID NO: 3921802 - RNA, 19 nt, Shigella flexneri 2a str. 301
cacuuaauuauuaacaaaa

SEQ ID NO: 3921803 - RNA, 15 nt, Shigella flexneri 2a str. 301
cacuucaauauuaau

SEQ ID NO: 3921804 - RNA, 17 nt, Shigella flexneri 2a str. 301
cacuucacggcugcuaa

SEQ ID NO: 3921805 - RNA, 20 nt, Shigella flexneri 2a str. 301
cacuucauacggcacuuuca

SEQ ID NO: 3921806 - RNA, 20 nt, Shigella flexneri 2a str. 301
cacuucauagugcgcggugu

SEQ ID NO: 3921807 - RNA, 12 nt, Shigella flexneri 2a str. 301
cacuucaucaag

SEQ ID NO: 3921808 - RNA, 15 nt, Shigella flexneri 2a str. 301
cacuucaucaagcaa

SEQ ID NO: 3921809 - RNA, 23 nt, Shigella flexneri 2a str. 301
cacuucaucacuaccuucuuccc

SEQ ID NO: 3921810 - RNA, 19 nt, Shigella flexneri 2a str. 301
cacuucauccggauacagc

SEQ ID NO: 3921811 - RNA, 16 nt, Shigella flexneri 2a str. 301
cacuucaucgucauaa

SEQ ID NO: 3921812 - RNA, 20 nt, Shigella flexneri 2a str. 301
cacuuccaccacuuccugcu

SEQ ID NO: 3921813 - RNA, 16 nt, Shigella flexneri 2a str. 301
cacuuccaccagcaac

SEQ ID NO: 3921814 - RNA, 14 nt, Shigella flexneri 2a str. 301
cacuuccaccagcg

SEQ ID NO: 3921815 - RNA, 17 nt, Shigella flexneri 2a str. 301
cacuuccaccagcggcu

SEQ ID NO: 3921816 - RNA, 15 nt, Shigella flexneri 2a str. 301
cacuuccagcggcca

SEQ ID NO: 3921817 - RNA, 23 nt, Shigella flexneri 2a str. 301
cacuucgcgcaaccaguccuccg

SEQ ID NO: 3921818 - RNA, 19 nt, Shigella flexneri 2a str. 301
cacuucguucuguuugcag

SEQ ID NO: 3921819 - RNA, 19 nt, Shigella flexneri 2a str. 301
cacuucuccgguuugcgga

SEQ ID NO: 3921820 - RNA, 11 nt, Shigella flexneri 2a str. 301
cacuucugccu

SEQ ID NO: 3921821 - RNA, 12 nt, Shigella flexneri 2a str. 301
cacuucugccuc

SEQ ID NO: 3921822 - RNA, 14 nt, Shigella flexneri 2a str. 301
cacuucuucagcca

SEQ ID NO: 3921823 - RNA, 16 nt, Shigella flexneri 2a str. 301
cacuucuucagccagu

SEQ ID NO: 3921824 - RNA, 12 nt, Shigella flexneri 2a str. 301
cacuucuuccuu

SEQ ID NO: 3921825 - RNA, 20 nt, Shigella flexneri 2a str. 301
cacuugaccaacuucagcaa

SEQ ID NO: 3921826 - RNA, 12 nt, Shigella flexneri 2a str. 301
cacuugcagacc

SEQ ID NO: 3921827 - RNA, 19 nt, Shigella flexneri 2a str. 301
cacuugcagcucauauucc

SEQ ID NO: 3921828 - RNA, 22 nt, Shigella flexneri 2a str. 301
cacuugcagucggcuuucucau

SEQ ID NO: 3921829 - RNA, 21 nt, Shigella flexneri 2a str. 301
cacuuggguaacagcccaaua

SEQ ID NO: 3921830 - RNA, 20 nt, Shigella flexneri 2a str. 301
cacuuguucucgcgcuucau

SEQ ID NO: 3921831 - RNA, 18 nt, Shigella flexneri 2a str. 301
cacuuuacgaccagccga

SEQ ID NO: 3921832 - RNA, 11 nt, Shigella flexneri 2a str. 301
cacuuuacugg

SEQ ID NO: 3921833 - RNA, 17 nt, Shigella flexneri 2a str. 301
cacuuucaaauccggcc

SEQ ID NO: 3921834 - RNA, 14 nt, Shigella flexneri 2a str. 301
cacuuuccccggca

SEQ ID NO: 3921835 - RNA, 12 nt, Shigella flexneri 2a str. 301
cacuuucgcggc

SEQ ID NO: 3921836 - RNA, 17 nt, Shigella flexneri 2a str. 301
cacuuucucgacaucca

SEQ ID NO: 3921837 - RNA, 12 nt, Shigella flexneri 2a str. 301
cacuuucugcgc

SEQ ID NO: 3921838 - RNA, 16 nt, Shigella flexneri 2a str. 301
cacuuugaucugcguc

SEQ ID NO: 3921839 - RNA, 23 nt, Shigella flexneri 2a str. 301
cacuuugccgucagccacuucuu

SEQ ID NO: 3921840 - RNA, 17 nt, Shigella flexneri 2a str. 301
cacuuugcgcucgcugg

SEQ ID NO: 3921841 - RNA, 17 nt, Shigella flexneri 2a str. 301
cacuuugugucagcgcc

SEQ ID NO: 3921842 - RNA, 22 nt, Shigella flexneri 2a str. 301
cacuuuuauuaacucagcauua

SEQ ID NO: 3921843 - RNA, 15 nt, Shigella flexneri 2a str. 301
cacuuuuauuucacc

SEQ ID NO: 3921844 - RNA, 15 nt, Shigella flexneri 2a str. 301
cacuuuugaaaucaa

SEQ ID NO: 3921845 - RNA, 19 nt, Shigella flexneri 2a str. 301
cacuuuuucgaacgcugca

SEQ ID NO: 3921846 - RNA, 22 nt, Shigella flexneri 2a str. 301
cacuuuuugcucaacccuuucc

SEQ ID NO: 3921847 - RNA, 20 nt, Shigella flexneri 2a str. 301
cagaaaaaaaguagggcuga

SEQ ID NO: 3921848 - RNA, 14 nt, Shigella flexneri 2a str. 301
cagaaaaagaagcc

SEQ ID NO: 3921849 - RNA, 15 nt, Shigella flexneri 2a str. 301
cagaaaaagaagccg

SEQ ID NO: 3921850 - RNA, 13 nt, Shigella flexneri 2a str. 301
cagaaaaagagca

SEQ ID NO: 3921851 - RNA, 23 nt, Shigella flexneri 2a str. 301
cagaaaaagagcaucagcagugc

SEQ ID NO: 3921852 - RNA, 19 nt, Shigella flexneri 2a str. 301
cagaaaacucacgccugaa

SEQ ID NO: 3921853 - RNA, 13 nt, Shigella flexneri 2a str. 301
cagaaaagaaccu

SEQ ID NO: 3921854 - RNA, 17 nt, Shigella flexneri 2a str. 301
cagaaaagagacgcuga

SEQ ID NO: 3921855 - RNA, 18 nt, Shigella flexneri 2a str. 301
cagaaaauggcacaaugg

SEQ ID NO: 3921856 - RNA, 23 nt, Shigella flexneri 2a str. 301
cagaaaauuacggauuacaugga

SEQ ID NO: 3921857 - RNA, 17 nt, Shigella flexneri 2a str. 301
cagaaacaaacgcaaaa

SEQ ID NO: 3921858 - RNA, 16 nt, Shigella flexneri 2a str. 301
cagaaacaguuguaaa

SEQ ID NO: 3921859 - RNA, 16 nt, Shigella flexneri 2a str. 301
cagaaaccaaagcggu

SEQ ID NO: 3921860 - RNA, 23 nt, Shigella flexneri 2a str. 301
cagaaaccugauuacgcaccggg

SEQ ID NO: 3921861 - RNA, 19 nt, Shigella flexneri 2a str. 301
cagaaacgccaucucuuua

SEQ ID NO: 3921862 - RNA, 16 nt, Shigella flexneri 2a str. 301
cagaaacgcucauaaa

SEQ ID NO: 3921863 - RNA, 19 nt, Shigella flexneri 2a str. 301
cagaaacggauaaucaugc

SEQ ID NO: 3921864 - RNA, 20 nt, Shigella flexneri 2a str. 301
cagaaagcccgaaucaguaa

SEQ ID NO: 3921865 - RNA, 16 nt, Shigella flexneri 2a str. 301
cagaaagggaagaaca

SEQ ID NO: 3921866 - RNA, 20 nt, Shigella flexneri 2a str. 301
cagaaagggggaguuaaccu

SEQ ID NO: 3921867 - RNA, 20 nt, Shigella flexneri 2a str. 301
cagaaagucauggcaaacug

SEQ ID NO: 3921868 - RNA, 19 nt, Shigella flexneri 2a str. 301
cagaaagugaguuuugcau

SEQ ID NO: 3921869 - RNA, 18 nt, Shigella flexneri 2a str. 301
cagaaauagaaagugacu

SEQ ID NO: 3921870 - RNA, 23 nt, Shigella flexneri 2a str. 301
cagaaauagaaagugacugcugg

SEQ ID NO: 3921871 - RNA, 13 nt, Shigella flexneri 2a str. 301
cagaaaucagcuu

SEQ ID NO: 3921872 - RNA, 17 nt, Shigella flexneri 2a str. 301
cagaaaucggccuucca

SEQ ID NO: 3921873 - RNA, 13 nt, Shigella flexneri 2a str. 301
cagaaaugaaaaa

SEQ ID NO: 3921874 - RNA, 16 nt, Shigella flexneri 2a str. 301
cagaaaugaaaaaaua

SEQ ID NO: 3921875 - RNA, 18 nt, Shigella flexneri 2a str. 301
cagaaauggcccaaaagg

SEQ ID NO: 3921876 - RNA, 20 nt, Shigella flexneri 2a str. 301
cagaaauggcccaaaaggca

SEQ ID NO: 3921877 - RNA, 20 nt, Shigella flexneri 2a str. 301
cagaaaugguaaagaaggca

SEQ ID NO: 3921878 - RNA, 18 nt, Shigella flexneri 2a str. 301
cagaaauucguaauccau

SEQ ID NO: 3921879 - RNA, 19 nt, Shigella flexneri 2a str. 301
cagaaauugucuccaccaa

SEQ ID NO: 3921880 - RNA, 18 nt, Shigella flexneri 2a str. 301
cagaaauuuggcuccucu

SEQ ID NO: 3921881 - RNA, 19 nt, Shigella flexneri 2a str. 301
cagaaauuuggcuccucug

SEQ ID NO: 3921882 - RNA, 12 nt, Shigella flexneri 2a str. 301
cagaacaacccg

SEQ ID NO: 3921883 - RNA, 14 nt, Shigella flexneri 2a str. 301
cagaacaccauaau

SEQ ID NO: 3921884 - RNA, 22 nt, Shigella flexneri 2a str. 301
cagaacacuguuaccgcugcug

SEQ ID NO: 3921885 - RNA, 17 nt, Shigella flexneri 2a str. 301
cagaacagcuacagcau

SEQ ID NO: 3921886 - RNA, 14 nt, Shigella flexneri 2a str. 301
cagaacagugccau

SEQ ID NO: 3921887 - RNA, 20 nt, Shigella flexneri 2a str. 301
cagaaccagggaaaaaagcc

SEQ ID NO: 3921888 - RNA, 14 nt, Shigella flexneri 2a str. 301
cagaaccgccauca

SEQ ID NO: 3921889 - RNA, 15 nt, Shigella flexneri 2a str. 301
cagaaccgcuucuuc

SEQ ID NO: 3921890 - RNA, 20 nt, Shigella flexneri 2a str. 301
cagaaccguaccaaaaugac

SEQ ID NO: 3921891 - RNA, 21 nt, Shigella flexneri 2a str. 301
cagaacgcgccuuaaaaacca

SEQ ID NO: 3921892 - RNA, 17 nt, Shigella flexneri 2a str. 301
cagaacgcuuucgcaca

SEQ ID NO: 3921893 - RNA, 16 nt, Shigella flexneri 2a str. 301
cagaacguaaacgcag

SEQ ID NO: 3921894 - RNA, 16 nt, Shigella flexneri 2a str. 301
cagaacuaaaaucggu

SEQ ID NO: 3921895 - RNA, 13 nt, Shigella flexneri 2a str. 301
cagaacuucgcua

SEQ ID NO: 3921896 - RNA, 22 nt, Shigella flexneri 2a str. 301
cagaacuucgcuaacaaucuca

SEQ ID NO: 3921897 - RNA, 16 nt, Shigella flexneri 2a str. 301
cagaacuucugguaac

SEQ ID NO: 3921898 - RNA, 15 nt, Shigella flexneri 2a str. 301
cagaagacgcuccag

SEQ ID NO: 3921899 - RNA, 17 nt, Shigella flexneri 2a str. 301
cagaagacgcuccagug

SEQ ID NO: 3921900 - RNA, 19 nt, Shigella flexneri 2a str. 301
cagacgaauaaaacagaaa

SEQ ID NO: 3921901 - RNA, 13 nt, Shigella flexneri 2a str. 301
cagacgagggaaa

SEQ ID NO: 3921902 - RNA, 22 nt, Shigella flexneri 2a str. 301
cagacgauuacucgccuuucac

SEQ ID NO: 3921903 - RNA, 18 nt, Shigella flexneri 2a str. 301
cagacgcaguacgccacc

SEQ ID NO: 3921904 - RNA, 19 nt, Shigella flexneri 2a str. 301
cagacgcaguacgccaccu

SEQ ID NO: 3921905 - RNA, 17 nt, Shigella flexneri 2a str. 301
cagacgcucguuaaaac

SEQ ID NO: 3921906 - RNA, 21 nt, Shigella flexneri 2a str. 301
cagacgcugaaucaacaggcg

SEQ ID NO: 3921907 - RNA, 19 nt, Shigella flexneri 2a str. 301
cagacgcuuacguuuacgc

SEQ ID NO: 3921908 - RNA, 22 nt, Shigella flexneri 2a str. 301
cagacgcuuacguuuacgcauc

SEQ ID NO: 3921909 - RNA, 12 nt, Shigella flexneri 2a str. 301
cagacggcagaa

SEQ ID NO: 3921910 - RNA, 12 nt, Shigella flexneri 2a str. 301
cagacggccaaa

SEQ ID NO: 3921911 - RNA, 18 nt, Shigella flexneri 2a str. 301
cagacggguacaguuuuc

SEQ ID NO: 3921912 - RNA, 16 nt, Shigella flexneri 2a str. 301
cagacggucagcgaga

SEQ ID NO: 3921913 - RNA, 15 nt, Shigella flexneri 2a str. 301
cagacguucuuccug

SEQ ID NO: 3921914 - RNA, 15 nt, Shigella flexneri 2a str. 301
cagacguugauaacc

SEQ ID NO: 3921915 - RNA, 13 nt, Shigella flexneri 2a str. 301
cagacguuuuuuc

SEQ ID NO: 3921916 - RNA, 16 nt, Shigella flexneri 2a str. 301
cagacguuuuuucugc

SEQ ID NO: 3921917 - RNA, 22 nt, Shigella flexneri 2a str. 301
cagacuaauuuuucccucuuca

SEQ ID NO: 3921918 - RNA, 13 nt, Shigella flexneri 2a str. 301
cagacucaacagg

SEQ ID NO: 3921919 - RNA, 21 nt, Shigella flexneri 2a str. 301
cagacucauauaaaaaccggu

SEQ ID NO: 3921920 - RNA, 16 nt, Shigella flexneri 2a str. 301
cagacucucauuuuuc

SEQ ID NO: 3921921 - RNA, 21 nt, Shigella flexneri 2a str. 301
cagacucuuuuucgaaccaca

SEQ ID NO: 3921922 - RNA, 23 nt, Shigella flexneri 2a str. 301
cagacucuuuuucgaaccacaaa

SEQ ID NO: 3921923 - RNA, 16 nt, Shigella flexneri 2a str. 301
cagacugaauacgcuc

SEQ ID NO: 3921924 - RNA, 21 nt, Shigella flexneri 2a str. 301
cagacugaucaucgcccaguu

SEQ ID NO: 3921925 - RNA, 22 nt, Shigella flexneri 2a str. 301
cagacugaugugauccaucagg

SEQ ID NO: 3921926 - RNA, 15 nt, Shigella flexneri 2a str. 301
cagacuggagcacug

SEQ ID NO: 3921927 - RNA, 16 nt, Shigella flexneri 2a str. 301
cagacuggauugccag

SEQ ID NO: 3921928 - RNA, 14 nt, Shigella flexneri 2a str. 301
cagacuguagauga

SEQ ID NO: 3921929 - RNA, 15 nt, Shigella flexneri 2a str. 301
cagacuuuuugcggc

SEQ ID NO: 3921930 - RNA, 22 nt, Shigella flexneri 2a str. 301
cagacuuuuugcggcagcaaug

SEQ ID NO: 3921931 - RNA, 18 nt, Shigella flexneri 2a str. 301
cagagaaagaaacgccau

SEQ ID NO: 3921932 - RNA, 19 nt, Shigella flexneri 2a str. 301
cagagaaagcaaaaauaaa

SEQ ID NO: 3921933 - RNA, 22 nt, Shigella flexneri 2a str. 301
cagagaaagcaaaaauaaaugc

SEQ ID NO: 3921934 - RNA, 19 nt, Shigella flexneri 2a str. 301
cagagaacgaccaucagcu

SEQ ID NO: 3921935 - RNA, 18 nt, Shigella flexneri 2a str. 301
cagagaacuggcggcaaa

SEQ ID NO: 3921936 - RNA, 14 nt, Shigella flexneri 2a str. 301
cagagaagcaccgc

SEQ ID NO: 3921937 - RNA, 22 nt, Shigella flexneri 2a str. 301
cagagaaucgggaaauaacauc

SEQ ID NO: 3921938 - RNA, 21 nt, Shigella flexneri 2a str. 301
cagagaauuuagcaaccaaaa

SEQ ID NO: 3921939 - RNA, 18 nt, Shigella flexneri 2a str. 301
cagagacgcacugcuuga

SEQ ID NO: 3921940 - RNA, 22 nt, Shigella flexneri 2a str. 301
cagagacgcacugcuugaagcg

SEQ ID NO: 3921941 - RNA, 23 nt, Shigella flexneri 2a str. 301
cagagagacguucgcguacugcu

SEQ ID NO: 3921942 - RNA, 22 nt, Shigella flexneri 2a str. 301
cagagagccagccccacagcag

SEQ ID NO: 3921943 - RNA, 18 nt, Shigella flexneri 2a str. 301
cagagagcuuauccagca

SEQ ID NO: 3921944 - RNA, 22 nt, Shigella flexneri 2a str. 301
cagagauacaggccaccgccua

SEQ ID NO: 3921945 - RNA, 15 nt, Shigella flexneri 2a str. 301
cagagauagaacugc

SEQ ID NO: 3921946 - RNA, 19 nt, Shigella flexneri 2a str. 301
cagagauagaacugcauug

SEQ ID NO: 3921947 - RNA, 20 nt, Shigella flexneri 2a str. 301
cagagauagaacugcauugu

SEQ ID NO: 3921948 - RNA, 13 nt, Shigella flexneri 2a str. 301
cagagaucuuuca

SEQ ID NO: 3921949 - RNA, 13 nt, Shigella flexneri 2a str. 301
cagagauuacuuu

SEQ ID NO: 3921950 - RNA, 17 nt, Shigella flexneri 2a str. 301
cagagauuugcuccagc

SEQ ID NO: 3921951 - RNA, 19 nt, Shigella flexneri 2a str. 301
cagagauuugcuccagcga

SEQ ID NO: 3921952 - RNA, 21 nt, Shigella flexneri 2a str. 301
cagagcaaaaaucgacagcag

SEQ ID NO: 3921953 - RNA, 17 nt, Shigella flexneri 2a str. 301
cagagcaccaucgcuga

SEQ ID NO: 3921954 - RNA, 15 nt, Shigella flexneri 2a str. 301
cagagcagcaacaag

SEQ ID NO: 3921955 - RNA, 23 nt, Shigella flexneri 2a str. 301
cagagcaucaguuaacggcacca

SEQ ID NO: 3921956 - RNA, 23 nt, Shigella flexneri 2a str. 301
cagagcaucgguaucuucccagc

SEQ ID NO: 3921957 - RNA, 15 nt, Shigella flexneri 2a str. 301
cagagccgacgccag

SEQ ID NO: 3921958 - RNA, 22 nt, Shigella flexneri 2a str. 301
cagagcgauauccagugccaga

SEQ ID NO: 3921959 - RNA, 16 nt, Shigella flexneri 2a str. 301
cagagcgaucaaccca

SEQ ID NO: 3921960 - RNA, 20 nt, Shigella flexneri 2a str. 301
cagagcugaauaucacgggc

SEQ ID NO: 3921961 - RNA, 23 nt, Shigella flexneri 2a str. 301
cagagcugcguuugaaauaccag

SEQ ID NO: 3921962 - RNA, 22 nt, Shigella flexneri 2a str. 301
cagagcuuuguugcgcugaagu

SEQ ID NO: 3921963 - RNA, 18 nt, Shigella flexneri 2a str. 301
cagagggcaaauucuuca

SEQ ID NO: 3921964 - RNA, 14 nt, Shigella flexneri 2a str. 301
cagaggucuuuucu

SEQ ID NO: 3921965 - RNA, 13 nt, Shigella flexneri 2a str. 301
cagaguauccaaa

SEQ ID NO: 3921966 - RNA, 17 nt, Shigella flexneri 2a str. 301
cagagugaaaaugccuc

SEQ ID NO: 3921967 - RNA, 18 nt, Shigella flexneri 2a str. 301
cagagugaaaaugccuca

SEQ ID NO: 3921968 - RNA, 18 nt, Shigella flexneri 2a str. 301
cagaguggauuaucuuca

SEQ ID NO: 3921969 - RNA, 18 nt, Shigella flexneri 2a str. 301
cagaguuguaccagcaau

SEQ ID NO: 3921970 - RNA, 20 nt, Shigella flexneri 2a str. 301
cagaguuguaccagcaauuu

SEQ ID NO: 3921971 - RNA, 20 nt, Shigella flexneri 2a str. 301
cagauaaaaugcgaaaaaaa

SEQ ID NO: 3921972 - RNA, 15 nt, Shigella flexneri 2a str. 301
cagauaaaucacgcu

SEQ ID NO: 3921973 - RNA, 18 nt, Shigella flexneri 2a str. 301
cagauaaaucacgcuuca

SEQ ID NO: 3921974 - RNA, 15 nt, Shigella flexneri 2a str. 301
cagauaaaucauaau

SEQ ID NO: 3921975 - RNA, 20 nt, Shigella flexneri 2a str. 301
cagauaaaucauaauaaaga

SEQ ID NO: 3921976 - RNA, 14 nt, Shigella flexneri 2a str. 301
cagauaaccaucgc

SEQ ID NO: 3921977 - RNA, 17 nt, Shigella flexneri 2a str. 301
cagauaacccagcagcc

SEQ ID NO: 3921978 - RNA, 14 nt, Shigella flexneri 2a str. 301
cagauaagacacug

SEQ ID NO: 3921979 - RNA, 23 nt, Shigella flexneri 2a str. 301
cagauaagacgcgucagugucuu

SEQ ID NO: 3921980 - RNA, 23 nt, Shigella flexneri 2a str. 301
cagauaagacgcguuagugucuu

SEQ ID NO: 3921981 - RNA, 14 nt, Shigella flexneri 2a str. 301
cagauaauagguaa

SEQ ID NO: 3921982 - RNA, 18 nt, Shigella flexneri 2a str. 301
cagauaauauuuaucuuc

SEQ ID NO: 3921983 - RNA, 15 nt, Shigella flexneri 2a str. 301
cagauaaucaccugc

SEQ ID NO: 3921984 - RNA, 21 nt, Shigella flexneri 2a str. 301
cagauaauccccaaugaccuu

SEQ ID NO: 3921985 - RNA, 14 nt, Shigella flexneri 2a str. 301
cagauaaugagaaa

SEQ ID NO: 3921986 - RNA, 21 nt, Shigella flexneri 2a str. 301
cagauaaugcccgaugaccuu

SEQ ID NO: 3921987 - RNA, 16 nt, Shigella flexneri 2a str. 301
cagauacaaccaaucg

SEQ ID NO: 3921988 - RNA, 17 nt, Shigella flexneri 2a str. 301
cagauacgaccguucca

SEQ ID NO: 3921989 - RNA, 23 nt, Shigella flexneri 2a str. 301
cagauagagcgccugcagacggc

SEQ ID NO: 3921990 - RNA, 15 nt, Shigella flexneri 2a str. 301
cagauagcaacagca

SEQ ID NO: 3921991 - RNA, 13 nt, Shigella flexneri 2a str. 301
cagauagcccgga

SEQ ID NO: 3921992 - RNA, 14 nt, Shigella flexneri 2a str. 301
cagauaguuaccgu

SEQ ID NO: 3921993 - RNA, 14 nt, Shigella flexneri 2a str. 301
cagauaguuagucu

SEQ ID NO: 3921994 - RNA, 23 nt, Shigella flexneri 2a str. 301
cagauaguucgcgaucgcgccag

SEQ ID NO: 3921995 - RNA, 18 nt, Shigella flexneri 2a str. 301
cagauaguugauuaauuu

SEQ ID NO: 3921996 - RNA, 15 nt, Shigella flexneri 2a str. 301
cagauauucaugcag

SEQ ID NO: 3921997 - RNA, 21 nt, Shigella flexneri 2a str. 301
cagauauucguucagauaggc

SEQ ID NO: 3921998 - RNA, 14 nt, Shigella flexneri 2a str. 301
cagauauugauuga

SEQ ID NO: 3921999 - RNA, 16 nt, Shigella flexneri 2a str. 301
cagcaagagcaaauaa

SEQ ID NO: 3922000 - RNA, 17 nt, Shigella flexneri 2a str. 301
cagcaagagcaaauaaa

SEQ ID NO: 3922001 - RNA, 18 nt, Shigella flexneri 2a str. 301
cagcaagagcaaauaaaa

SEQ ID NO: 3922002 - RNA, 12 nt, Shigella flexneri 2a str. 301
cagcaagccacu

SEQ ID NO: 3922003 - RNA, 16 nt, Shigella flexneri 2a str. 301
cagcaagccacuggcg

SEQ ID NO: 3922004 - RNA, 15 nt, Shigella flexneri 2a str. 301
cagcaaggaaaacca

SEQ ID NO: 3922005 - RNA, 18 nt, Shigella flexneri 2a str. 301
cagcaagggcaucguaau

SEQ ID NO: 3922006 - RNA, 20 nt, Shigella flexneri 2a str. 301
cagcaaggggcugaugccgg

SEQ ID NO: 3922007 - RNA, 19 nt, Shigella flexneri 2a str. 301
cagcaaggguucaccggug

SEQ ID NO: 3922008 - RNA, 20 nt, Shigella flexneri 2a str. 301
cagcaaggguucaccgguga

SEQ ID NO: 3922009 - RNA, 18 nt, Shigella flexneri 2a str. 301
cagcaauaaucagauggc

SEQ ID NO: 3922010 - RNA, 22 nt, Shigella flexneri 2a str. 301
cagcaauaaucagauggcggcu

SEQ ID NO: 3922011 - RNA, 18 nt, Shigella flexneri 2a str. 301
cagcaauacguuucauau

SEQ ID NO: 3922012 - RNA, 12 nt, Shigella flexneri 2a str. 301
cagcaaucacug

SEQ ID NO: 3922013 - RNA, 14 nt, Shigella flexneri 2a str. 301
cagcaaucccaaaa

SEQ ID NO: 3922014 - RNA, 15 nt, Shigella flexneri 2a str. 301
cagcaaucccaaaau

SEQ ID NO: 3922015 - RNA, 13 nt, Shigella flexneri 2a str. 301
cagcaauccccag

SEQ ID NO: 3922016 - RNA, 19 nt, Shigella flexneri 2a str. 301
cagcaauccccagacaaaa

SEQ ID NO: 3922017 - RNA, 18 nt, Shigella flexneri 2a str. 301
cagcaaucgcgccagccg

SEQ ID NO: 3922018 - RNA, 21 nt, Shigella flexneri 2a str. 301
cagcaaucugaagccgcaccu

SEQ ID NO: 3922019 - RNA, 17 nt, Shigella flexneri 2a str. 301
cagcaaugcaggcaccu

SEQ ID NO: 3922020 - RNA, 13 nt, Shigella flexneri 2a str. 301
cagcaauggaaaa

SEQ ID NO: 3922021 - RNA, 16 nt, Shigella flexneri 2a str. 301
cagcaauguuucucug

SEQ ID NO: 3922022 - RNA, 19 nt, Shigella flexneri 2a str. 301
cagcaauuguaaaucuuug

SEQ ID NO: 3922023 - RNA, 22 nt, Shigella flexneri 2a str. 301
cagcaauuuaugaggaugcaga

SEQ ID NO: 3922024 - RNA, 15 nt, Shigella flexneri 2a str. 301
cagcacacauaagag

SEQ ID NO: 3922025 - RNA, 21 nt, Shigella flexneri 2a str. 301
cagcacaccacaucgccgacc

SEQ ID NO: 3922026 - RNA, 15 nt, Shigella flexneri 2a str. 301
cagcacacuguaagc

SEQ ID NO: 3922027 - RNA, 19 nt, Shigella flexneri 2a str. 301
cagcacauaacucauacug

SEQ ID NO: 3922028 - RNA, 22 nt, Shigella flexneri 2a str. 301
cagcacauaacucauacugagc

SEQ ID NO: 3922029 - RNA, 15 nt, Shigella flexneri 2a str. 301
cagcacaucagccag

SEQ ID NO: 3922030 - RNA, 19 nt, Shigella flexneri 2a str. 301
cagcacaucagccagaugc

SEQ ID NO: 3922031 - RNA, 15 nt, Shigella flexneri 2a str. 301
cagcacaucaucaaa

SEQ ID NO: 3922032 - RNA, 14 nt, Shigella flexneri 2a str. 301
cagcaccaccgccc

SEQ ID NO: 3922033 - RNA, 16 nt, Shigella flexneri 2a str. 301
cagcaccaccgcccgu

SEQ ID NO: 3922034 - RNA, 13 nt, Shigella flexneri 2a str. 301
cagcaccacuucc

SEQ ID NO: 3922035 - RNA, 12 nt, Shigella flexneri 2a str. 301
cagcaccagaga

SEQ ID NO: 3922036 - RNA, 13 nt, Shigella flexneri 2a str. 301
cagcaccagcaac

SEQ ID NO: 3922037 - RNA, 14 nt, Shigella flexneri 2a str. 301
cagcaccagcaacg

SEQ ID NO: 3922038 - RNA, 14 nt, Shigella flexneri 2a str. 301
cagcaccagcuccg

SEQ ID NO: 3922039 - RNA, 18 nt, Shigella flexneri 2a str. 301
cagcaccagcuccggcac

SEQ ID NO: 3922040 - RNA, 17 nt, Shigella flexneri 2a str. 301
cagcaccaucccgcuaa

SEQ ID NO: 3922041 - RNA, 21 nt, Shigella flexneri 2a str. 301
cagcaccgcacagaccaucaa

SEQ ID NO: 3922042 - RNA, 15 nt, Shigella flexneri 2a str. 301
cagcaccgcagagau

SEQ ID NO: 3922043 - RNA, 16 nt, Shigella flexneri 2a str. 301
cagcaccguaccggca

SEQ ID NO: 3922044 - RNA, 15 nt, Shigella flexneri 2a str. 301
cagcaccugcuugaa

SEQ ID NO: 3922045 - RNA, 14 nt, Shigella flexneri 2a str. 301
cagcaccuuuugcu

SEQ ID NO: 3922046 - RNA, 14 nt, Shigella flexneri 2a str. 301
cagcacgccccggc

SEQ ID NO: 3922047 - RNA, 15 nt, Shigella flexneri 2a str. 301
cagcacgccccggcg

SEQ ID NO: 3922048 - RNA, 14 nt, Shigella flexneri 2a str. 301
cagcacgcugaaca

SEQ ID NO: 3922049 - RNA, 23 nt, Shigella flexneri 2a str. 301
cagcacgcuuuucagugccaggu

SEQ ID NO: 3922050 - RNA, 13 nt, Shigella flexneri 2a str. 301
cagcacggagaga

SEQ ID NO: 3922051 - RNA, 14 nt, Shigella flexneri 2a str. 301
cagcacggagagac

SEQ ID NO: 3922052 - RNA, 13 nt, Shigella flexneri 2a str. 301
cagcacggucagg

SEQ ID NO: 3922053 - RNA, 23 nt, Shigella flexneri 2a str. 301
cagcacgucgccuuuuacggcuu

SEQ ID NO: 3922054 - RNA, 13 nt, Shigella flexneri 2a str. 301
cagcacguuaauc

SEQ ID NO: 3922055 - RNA, 17 nt, Shigella flexneri 2a str. 301
cagcacguuaaucaaau

SEQ ID NO: 3922056 - RNA, 16 nt, Shigella flexneri 2a str. 301
cagcacuggugcugua

SEQ ID NO: 3922057 - RNA, 22 nt, Shigella flexneri 2a str. 301
cagcacuggugcuguaaaacca

SEQ ID NO: 3922058 - RNA, 19 nt, Shigella flexneri 2a str. 301
cagcacuuaucucuuccgc

SEQ ID NO: 3922059 - RNA, 15 nt, Shigella flexneri 2a str. 301
cagcacuuccagcuc

SEQ ID NO: 3922060 - RNA, 19 nt, Shigella flexneri 2a str. 301
cagcagaaccgccaucaug

SEQ ID NO: 3922061 - RNA, 11 nt, Shigella flexneri 2a str. 301
cagcagaccag

SEQ ID NO: 3922062 - RNA, 15 nt, Shigella flexneri 2a str. 301
cagcagaccagcaaa

SEQ ID NO: 3922063 - RNA, 19 nt, Shigella flexneri 2a str. 301
cagcagagauacaggccac

SEQ ID NO: 3922064 - RNA, 16 nt, Shigella flexneri 2a str. 301
cagcagagcaugguua

SEQ ID NO: 3922065 - RNA, 15 nt, Shigella flexneri 2a str. 301
cagcagauaugccag

SEQ ID NO: 3922066 - RNA, 16 nt, Shigella flexneri 2a str. 301
cagcagauaugccagu

SEQ ID NO: 3922067 - RNA, 21 nt, Shigella flexneri 2a str. 301
cagcagauauugccccacacc

SEQ ID NO: 3922068 - RNA, 17 nt, Shigella flexneri 2a str. 301
cagcagauuaaccgcuu

SEQ ID NO: 3922069 - RNA, 15 nt, Shigella flexneri 2a str. 301
cagcagcaccaccgc

SEQ ID NO: 3922070 - RNA, 14 nt, Shigella flexneri 2a str. 301
cagcagcagacagc

SEQ ID NO: 3922071 - RNA, 21 nt, Shigella flexneri 2a str. 301
cagcagcagccgguauccagc

SEQ ID NO: 3922072 - RNA, 18 nt, Shigella flexneri 2a str. 301
cagcagccacaccaauca

SEQ ID NO: 3922073 - RNA, 23 nt, Shigella flexneri 2a str. 301
cagcagccacaccaaucaacaau

SEQ ID NO: 3922074 - RNA, 22 nt, Shigella flexneri 2a str. 301
cagcagcccugccggaacgugc

SEQ ID NO: 3922075 - RNA, 19 nt, Shigella flexneri 2a str. 301
cagcagccgcgcuuucuuc

SEQ ID NO: 3922076 - RNA, 23 nt, Shigella flexneri 2a str. 301
cagcagccugcgcuucuuuuuac

SEQ ID NO: 3922077 - RNA, 13 nt, Shigella flexneri 2a str. 301
cagcagcgcaauu

SEQ ID NO: 3922078 - RNA, 13 nt, Shigella flexneri 2a str. 301
cagcagcgccgca

SEQ ID NO: 3922079 - RNA, 13 nt, Shigella flexneri 2a str. 301
cagcagcgccgcg

SEQ ID NO: 3922080 - RNA, 22 nt, Shigella flexneri 2a str. 301
cagcaggauguuccggcaaagu

SEQ ID NO: 3922081 - RNA, 23 nt, Shigella flexneri 2a str. 301
cagcaggauuugcgguagcgggc

SEQ ID NO: 3922082 - RNA, 14 nt, Shigella flexneri 2a str. 301
cagcaggccaagau

SEQ ID NO: 3922083 - RNA, 23 nt, Shigella flexneri 2a str. 301
cagcaggcgaugaaaaaccguau

SEQ ID NO: 3922084 - RNA, 19 nt, Shigella flexneri 2a str. 301
cagcagggcaaacagcacg

SEQ ID NO: 3922085 - RNA, 17 nt, Shigella flexneri 2a str. 301
cagcaggucaccgaaau

SEQ ID NO: 3922086 - RNA, 16 nt, Shigella flexneri 2a str. 301
cagcagguccccgagc

SEQ ID NO: 3922087 - RNA, 18 nt, Shigella flexneri 2a str. 301
cagcaguaaaccacccac

SEQ ID NO: 3922088 - RNA, 22 nt, Shigella flexneri 2a str. 301
cagcaguaaaccacccaccagc

SEQ ID NO: 3922089 - RNA, 16 nt, Shigella flexneri 2a str. 301
cagcaguaaaccgcuc

SEQ ID NO: 3922090 - RNA, 21 nt, Shigella flexneri 2a str. 301
cagcaguacgccgagaauaaa

SEQ ID NO: 3922091 - RNA, 16 nt, Shigella flexneri 2a str. 301
cagcaguucacgcagc

SEQ ID NO: 3922092 - RNA, 15 nt, Shigella flexneri 2a str. 301
cagcaguucagucag

SEQ ID NO: 3922093 - RNA, 18 nt, Shigella flexneri 2a str. 301
cagcaguucgcccgcuuc

SEQ ID NO: 3922094 - RNA, 14 nt, Shigella flexneri 2a str. 301
cagcaguugccagu

SEQ ID NO: 3922095 - RNA, 15 nt, Shigella flexneri 2a str. 301
cagcaguugccaguc

SEQ ID NO: 3922096 - RNA, 21 nt, Shigella flexneri 2a str. 301
cagcaguuguuuaauggcaaa

SEQ ID NO: 3922097 - RNA, 21 nt, Shigella flexneri 2a str. 301
cagcaguuuuaccgacgcgcu

SEQ ID NO: 3922098 - RNA, 22 nt, Shigella flexneri 2a str. 301
cagcaguuuuuccccugccaga

SEQ ID NO: 3922099 - RNA, 22 nt, Shigella flexneri 2a str. 301
cagcccaaucaucgcggcacac

SEQ ID NO: 3922100 - RNA, 19 nt, Shigella flexneri 2a str. 301
cagcccacugguuuucuug

SEQ ID NO: 3922101 - RNA, 14 nt, Shigella flexneri 2a str. 301
cagcccagacaaau

SEQ ID NO: 3922102 - RNA, 16 nt, Shigella flexneri 2a str. 301
cagcccagcaucagac

SEQ ID NO: 3922103 - RNA, 18 nt, Shigella flexneri 2a str. 301
cagcccagcccugaacca

SEQ ID NO: 3922104 - RNA, 18 nt, Shigella flexneri 2a str. 301
cagcccagcggaaauuac

SEQ ID NO: 3922105 - RNA, 21 nt, Shigella flexneri 2a str. 301
cagcccauuggcgagauaucg

SEQ ID NO: 3922106 - RNA, 22 nt, Shigella flexneri 2a str. 301
cagcccauuggcgagauaucga

SEQ ID NO: 3922107 - RNA, 14 nt, Shigella flexneri 2a str. 301
cagccccacagcag

SEQ ID NO: 3922108 - RNA, 12 nt, Shigella flexneri 2a str. 301
cagccccagcac

SEQ ID NO: 3922109 - RNA, 13 nt, Shigella flexneri 2a str. 301
cagccccagcacu

SEQ ID NO: 3922110 - RNA, 16 nt, Shigella flexneri 2a str. 301
cagccccaggauugau

SEQ ID NO: 3922111 - RNA, 21 nt, Shigella flexneri 2a str. 301
cagccccgaaaaagagccagu

SEQ ID NO: 3922112 - RNA, 20 nt, Shigella flexneri 2a str. 301
cagccccgccgggaucugga

SEQ ID NO: 3922113 - RNA, 15 nt, Shigella flexneri 2a str. 301
cagccccgcgcggcg

SEQ ID NO: 3922114 - RNA, 14 nt, Shigella flexneri 2a str. 301
cagccccgguuuuu

SEQ ID NO: 3922115 - RNA, 17 nt, Shigella flexneri 2a str. 301
cagccccugcgccagcg

SEQ ID NO: 3922116 - RNA, 18 nt, Shigella flexneri 2a str. 301
cagcccgaucggcuggca

SEQ ID NO: 3922117 - RNA, 14 nt, Shigella flexneri 2a str. 301
cagcccgccgccau

SEQ ID NO: 3922118 - RNA, 14 nt, Shigella flexneri 2a str. 301
cagcccggcggcgu

SEQ ID NO: 3922119 - RNA, 20 nt, Shigella flexneri 2a str. 301
cagcccgucucagcgccgcu

SEQ ID NO: 3922120 - RNA, 13 nt, Shigella flexneri 2a str. 301
cagcccugccagg

SEQ ID NO: 3922121 - RNA, 14 nt, Shigella flexneri 2a str. 301
cagcccugccaggu

SEQ ID NO: 3922122 - RNA, 16 nt, Shigella flexneri 2a str. 301
cagccgaacagcgcca

SEQ ID NO: 3922123 - RNA, 20 nt, Shigella flexneri 2a str. 301
cagccgacaaugccacaaac

SEQ ID NO: 3922124 - RNA, 17 nt, Shigella flexneri 2a str. 301
cagccgaccauugccag

SEQ ID NO: 3922125 - RNA, 16 nt, Shigella flexneri 2a str. 301
cagccgaccgcugucc

SEQ ID NO: 3922126 - RNA, 16 nt, Shigella flexneri 2a str. 301
cagccgacgaauugac

SEQ ID NO: 3922127 - RNA, 19 nt, Shigella flexneri 2a str. 301
cagccgcaaaccuggcaac

SEQ ID NO: 3922128 - RNA, 20 nt, Shigella flexneri 2a str. 301
cagccgcaaaccuggcaaca

SEQ ID NO: 3922129 - RNA, 16 nt, Shigella flexneri 2a str. 301
cagccgcacuuuuuaa

SEQ ID NO: 3922130 - RNA, 16 nt, Shigella flexneri 2a str. 301
cagccgccgcuccuca

SEQ ID NO: 3922131 - RNA, 13 nt, Shigella flexneri 2a str. 301
cagccgcgcgcuu

SEQ ID NO: 3922132 - RNA, 13 nt, Shigella flexneri 2a str. 301
cagccgcgucuga

SEQ ID NO: 3922133 - RNA, 22 nt, Shigella flexneri 2a str. 301
cagccgcuaacuuccugcuggc

SEQ ID NO: 3922134 - RNA, 18 nt, Shigella flexneri 2a str. 301
cagccgcuuuugcgcgua

SEQ ID NO: 3922135 - RNA, 14 nt, Shigella flexneri 2a str. 301
cagccggaauaauc

SEQ ID NO: 3922136 - RNA, 15 nt, Shigella flexneri 2a str. 301
cagccggacccacac

SEQ ID NO: 3922137 - RNA, 21 nt, Shigella flexneri 2a str. 301
cagccggacccacacccccgc

SEQ ID NO: 3922138 - RNA, 15 nt, Shigella flexneri 2a str. 301
cagccggagguguuc

SEQ ID NO: 3922139 - RNA, 13 nt, Shigella flexneri 2a str. 301
cagccgggaugaa

SEQ ID NO: 3922140 - RNA, 18 nt, Shigella flexneri 2a str. 301
cagccgggaugaaaggca

SEQ ID NO: 3922141 - RNA, 22 nt, Shigella flexneri 2a str. 301
cagccggguaagaaaagcugca

SEQ ID NO: 3922142 - RNA, 17 nt, Shigella flexneri 2a str. 301
cagccgguauccagcgc

SEQ ID NO: 3922143 - RNA, 17 nt, Shigella flexneri 2a str. 301
cagccgucugcgcgcgu

SEQ ID NO: 3922144 - RNA, 13 nt, Shigella flexneri 2a str. 301
cagccgugcccaa

SEQ ID NO: 3922145 - RNA, 21 nt, Shigella flexneri 2a str. 301
cagccguuuaccccagucagg

SEQ ID NO: 3922146 - RNA, 15 nt, Shigella flexneri 2a str. 301
cagccuaccagaccg

SEQ ID NO: 3922147 - RNA, 19 nt, Shigella flexneri 2a str. 301
cagccuauaacgaaacccg

SEQ ID NO: 3922148 - RNA, 20 nt, Shigella flexneri 2a str. 301
cagccucaagcacccgccgc

SEQ ID NO: 3922149 - RNA, 16 nt, Shigella flexneri 2a str. 301
cagccucccagccauu

SEQ ID NO: 3922150 - RNA, 12 nt, Shigella flexneri 2a str. 301
cagccucugccg

SEQ ID NO: 3922151 - RNA, 13 nt, Shigella flexneri 2a str. 301
cagccucugccgc

SEQ ID NO: 3922152 - RNA, 19 nt, Shigella flexneri 2a str. 301
cagccugacagcacgcccc

SEQ ID NO: 3922153 - RNA, 22 nt, Shigella flexneri 2a str. 301
cagccugaccgcacaccccggc

SEQ ID NO: 3922154 - RNA, 11 nt, Shigella flexneri 2a str. 301
cagccugagcg

SEQ ID NO: 3922155 - RNA, 15 nt, Shigella flexneri 2a str. 301
cagccugcacgaccg

SEQ ID NO: 3922156 - RNA, 21 nt, Shigella flexneri 2a str. 301
cagccuggcggaaagccagaa

SEQ ID NO: 3922157 - RNA, 17 nt, Shigella flexneri 2a str. 301
cagccugugccugagcc

SEQ ID NO: 3922158 - RNA, 14 nt, Shigella flexneri 2a str. 301
cagccuuaaacuca

SEQ ID NO: 3922159 - RNA, 17 nt, Shigella flexneri 2a str. 301
cagccuuaacaagauau

SEQ ID NO: 3922160 - RNA, 15 nt, Shigella flexneri 2a str. 301
cagccuuaccggaga

SEQ ID NO: 3922161 - RNA, 23 nt, Shigella flexneri 2a str. 301
cagccuucacgauagccacgcuc

SEQ ID NO: 3922162 - RNA, 19 nt, Shigella flexneri 2a str. 301
cagccuucauucaggcauu

SEQ ID NO: 3922163 - RNA, 13 nt, Shigella flexneri 2a str. 301
cagccuucgccac

SEQ ID NO: 3922164 - RNA, 15 nt, Shigella flexneri 2a str. 301
cagccuugcgugccu

SEQ ID NO: 3922165 - RNA, 14 nt, Shigella flexneri 2a str. 301
cagccuuucucaga

SEQ ID NO: 3922166 - RNA, 18 nt, Shigella flexneri 2a str. 301
cagccuuucucagagacu

SEQ ID NO: 3922167 - RNA, 12 nt, Shigella flexneri 2a str. 301
cagccuuuuucu

SEQ ID NO: 3922168 - RNA, 13 nt, Shigella flexneri 2a str. 301
cagccuuuuucuc

SEQ ID NO: 3922169 - RNA, 22 nt, Shigella flexneri 2a str. 301
cagcgaaaaagucccuucccag

SEQ ID NO: 3922170 - RNA, 19 nt, Shigella flexneri 2a str. 301
cagcgaaaaucaaccauac

SEQ ID NO: 3922171 - RNA, 22 nt, Shigella flexneri 2a str. 301
cagcgaaauacagguccccgcu

SEQ ID NO: 3922172 - RNA, 20 nt, Shigella flexneri 2a str. 301
cagcgaaaucaccgccacca

SEQ ID NO: 3922173 - RNA, 15 nt, Shigella flexneri 2a str. 301
cagcgaacaccagca

SEQ ID NO: 3922174 - RNA, 23 nt, Shigella flexneri 2a str. 301
cagcgaacaccagcaguaaacca

SEQ ID NO: 3922175 - RNA, 23 nt, Shigella flexneri 2a str. 301
cagcgaaccguugaggauggcgu

SEQ ID NO: 3922176 - RNA, 24 nt, Shigella flexneri 2a str. 301
cagcgaagcauucagacacgccgc

SEQ ID NO: 3922177 - RNA, 22 nt, Shigella flexneri 2a str. 301
cagcgaagccagcucccacagu

SEQ ID NO: 3922178 - RNA, 22 nt, Shigella flexneri 2a str. 301
cagcgaagcccacgccgcccag

SEQ ID NO: 3922179 - RNA, 21 nt, Shigella flexneri 2a str. 301
cagcgaaucagcccagcccug

SEQ ID NO: 3922180 - RNA, 14 nt, Shigella flexneri 2a str. 301
cagcgaauccagca

SEQ ID NO: 3922181 - RNA, 15 nt, Shigella flexneri 2a str. 301
cagcgaauccguucu

SEQ ID NO: 3922182 - RNA, 21 nt, Shigella flexneri 2a str. 301
cagcgacaagaugguggucau

SEQ ID NO: 3922183 - RNA, 11 nt, Shigella flexneri 2a str. 301
cagcgacacca

SEQ ID NO: 3922184 - RNA, 14 nt, Shigella flexneri 2a str. 301
cagcgacaccagcc

SEQ ID NO: 3922185 - RNA, 17 nt, Shigella flexneri 2a str. 301
cagcgacaccagccauc

SEQ ID NO: 3922186 - RNA, 24 nt, Shigella flexneri 2a str. 301
cagcgacggaugacacgcaggcgu

SEQ ID NO: 3922187 - RNA, 16 nt, Shigella flexneri 2a str. 301
cagcgacuucuuccca

SEQ ID NO: 3922188 - RNA, 21 nt, Shigella flexneri 2a str. 301
cagcgacuucuucccaccaua

SEQ ID NO: 3922189 - RNA, 20 nt, Shigella flexneri 2a str. 301
cagcgagaagucggcuuuua

SEQ ID NO: 3922190 - RNA, 13 nt, Shigella flexneri 2a str. 301
cagcgagccggau

SEQ ID NO: 3922191 - RNA, 22 nt, Shigella flexneri 2a str. 301
cagcgagcuggcgcugauaaau

SEQ ID NO: 3922192 - RNA, 17 nt, Shigella flexneri 2a str. 301
cagcgaguucaggcgcu

SEQ ID NO: 3922193 - RNA, 12 nt, Shigella flexneri 2a str. 301
cagcgaguugau

SEQ ID NO: 3922194 - RNA, 13 nt, Shigella flexneri 2a str. 301
cagcgauaaaaau

SEQ ID NO: 3922195 - RNA, 20 nt, Shigella flexneri 2a str. 301
cagcgauauccagcgauacc

SEQ ID NO: 3922196 - RNA, 21 nt, Shigella flexneri 2a str. 301
cagcgaucugcaccuggcgca

SEQ ID NO: 3922197 - RNA, 20 nt, Shigella flexneri 2a str. 301
cagcgaucuuucgcggcagg

SEQ ID NO: 3922198 - RNA, 20 nt, Shigella flexneri 2a str. 301
cagcgaugacuguacagauc

SEQ ID NO: 3922199 - RNA, 17 nt, Shigella flexneri 2a str. 301
cagcgucagcauaaaaa

SEQ ID NO: 3922200 - RNA, 23 nt, Shigella flexneri 2a str. 301
cagcgucagcauaaaaauauuga

SEQ ID NO: 3922201 - RNA, 14 nt, Shigella flexneri 2a str. 301
cagcgucagcauca

SEQ ID NO: 3922202 - RNA, 12 nt, Shigella flexneri 2a str. 301
cagcgucaucaa

SEQ ID NO: 3922203 - RNA, 12 nt, Shigella flexneri 2a str. 301
cagcgucaucau

SEQ ID NO: 3922204 - RNA, 13 nt, Shigella flexneri 2a str. 301
cagcguccgggaa

SEQ ID NO: 3922205 - RNA, 14 nt, Shigella flexneri 2a str. 301
cagcguccgggaaa

SEQ ID NO: 3922206 - RNA, 16 nt, Shigella flexneri 2a str. 301
cagcgucgcacccggc

SEQ ID NO: 3922207 - RNA, 17 nt, Shigella flexneri 2a str. 301
cagcgucgcacccggca

SEQ ID NO: 3922208 - RNA, 18 nt, Shigella flexneri 2a str. 301
cagcgucgcaucaggcau

SEQ ID NO: 3922209 - RNA, 17 nt, Shigella flexneri 2a str. 301
cagcgucgcaucuggca

SEQ ID NO: 3922210 - RNA, 17 nt, Shigella flexneri 2a str. 301
cagcgucggacuaaaua

SEQ ID NO: 3922211 - RNA, 13 nt, Shigella flexneri 2a str. 301
cagcgucgguuuc

SEQ ID NO: 3922212 - RNA, 22 nt, Shigella flexneri 2a str. 301
cagcgucgugaaacgcgucuga

SEQ ID NO: 3922213 - RNA, 23 nt, Shigella flexneri 2a str. 301
cagcgucucacuaucgcugagau

SEQ ID NO: 3922214 - RNA, 14 nt, Shigella flexneri 2a str. 301
cagcgucucauacc

SEQ ID NO: 3922215 - RNA, 15 nt, Shigella flexneri 2a str. 301
cagcgucuucugguu

SEQ ID NO: 3922216 - RNA, 15 nt, Shigella flexneri 2a str. 301
cagcgugaacugggc

SEQ ID NO: 3922217 - RNA, 14 nt, Shigella flexneri 2a str. 301
cagcgugacuggca

SEQ ID NO: 3922218 - RNA, 18 nt, Shigella flexneri 2a str. 301
cagcgugcucucaaauau

SEQ ID NO: 3922219 - RNA, 17 nt, Shigella flexneri 2a str. 301
cagcguggcaucgggca

SEQ ID NO: 3922220 - RNA, 22 nt, Shigella flexneri 2a str. 301
cagcguguuaaugcccaucagu

SEQ ID NO: 3922221 - RNA, 15 nt, Shigella flexneri 2a str. 301
cagcguguugaggaa

SEQ ID NO: 3922222 - RNA, 21 nt, Shigella flexneri 2a str. 301
cagcguguugcggagcuuguu

SEQ ID NO: 3922223 - RNA, 22 nt, Shigella flexneri 2a str. 301
cagcguucauaaauacagagca

SEQ ID NO: 3922224 - RNA, 15 nt, Shigella flexneri 2a str. 301
cagcguuccccagaa

SEQ ID NO: 3922225 - RNA, 23 nt, Shigella flexneri 2a str. 301
cagcguugaaugcaugcccggca

SEQ ID NO: 3922226 - RNA, 19 nt, Shigella flexneri 2a str. 301
cagcguugcccccugaagc

SEQ ID NO: 3922227 - RNA, 20 nt, Shigella flexneri 2a str. 301
cagcguugcccccugaagca

SEQ ID NO: 3922228 - RNA, 22 nt, Shigella flexneri 2a str. 301
cagcguugcccccugaagcagu

SEQ ID NO: 3922229 - RNA, 13 nt, Shigella flexneri 2a str. 301
cagcguuuccagc

SEQ ID NO: 3922230 - RNA, 16 nt, Shigella flexneri 2a str. 301
cagcguuuccagcacc

SEQ ID NO: 3922231 - RNA, 17 nt, Shigella flexneri 2a str. 301
cagcguuuccagcacca

SEQ ID NO: 3922232 - RNA, 14 nt, Shigella flexneri 2a str. 301
cagcuaauggcugc

SEQ ID NO: 3922233 - RNA, 15 nt, Shigella flexneri 2a str. 301
cagcuaauggcugcg

SEQ ID NO: 3922234 - RNA, 22 nt, Shigella flexneri 2a str. 301
cagcucaaccagauucggcgca

SEQ ID NO: 3922235 - RNA, 20 nt, Shigella flexneri 2a str. 301
cagcucaaucaacuccauua

SEQ ID NO: 3922236 - RNA, 13 nt, Shigella flexneri 2a str. 301
cagcucagugacc

SEQ ID NO: 3922237 - RNA, 22 nt, Shigella flexneri 2a str. 301
cagcucaucaagcuguucuucc

SEQ ID NO: 3922238 - RNA, 20 nt, Shigella flexneri 2a str. 301
cagcucauccauaaauaccu

SEQ ID NO: 3922239 - RNA, 15 nt, Shigella flexneri 2a str. 301
cagcucaugggcuuu

SEQ ID NO: 3922240 - RNA, 19 nt, Shigella flexneri 2a str. 301
cagcuccaccgauuuugag

SEQ ID NO: 3922241 - RNA, 16 nt, Shigella flexneri 2a str. 301
cagcuccagcagaccc

SEQ ID NO: 3922242 - RNA, 11 nt, Shigella flexneri 2a str. 301
cagcuccagcc

SEQ ID NO: 3922243 - RNA, 22 nt, Shigella flexneri 2a str. 301
cagcucccccaaaguuaaggug

SEQ ID NO: 3922244 - RNA, 22 nt, Shigella flexneri 2a str. 301
cagcuccgccagcuccgggcug

SEQ ID NO: 3922245 - RNA, 13 nt, Shigella flexneri 2a str. 301
cagcuccggcacc

SEQ ID NO: 3922246 - RNA, 13 nt, Shigella flexneri 2a str. 301
cagcucgcugcca

SEQ ID NO: 3922247 - RNA, 18 nt, Shigella flexneri 2a str. 301
cagcucggauaaggcuuc

SEQ ID NO: 3922248 - RNA, 16 nt, Shigella flexneri 2a str. 301
cagcucgugcagaaca

SEQ ID NO: 3922249 - RNA, 16 nt, Shigella flexneri 2a str. 301
cagcucgugucgggaa

SEQ ID NO: 3922250 - RNA, 22 nt, Shigella flexneri 2a str. 301
cagcucugcugucaccgaagcg

SEQ ID NO: 3922251 - RNA, 21 nt, Shigella flexneri 2a str. 301
cagcucuuccuucagcucccg

SEQ ID NO: 3922252 - RNA, 13 nt, Shigella flexneri 2a str. 301
cagcucuucucaa

SEQ ID NO: 3922253 - RNA, 14 nt, Shigella flexneri 2a str. 301
cagcucuucucaac

SEQ ID NO: 3922254 - RNA, 19 nt, Shigella flexneri 2a str. 301
cagcucuucucaacgugga

SEQ ID NO: 3922255 - RNA, 20 nt, Shigella flexneri 2a str. 301
cagcugacaaucgcugcggc

SEQ ID NO: 3922256 - RNA, 14 nt, Shigella flexneri 2a str. 301
cagcugacuuccag

SEQ ID NO: 3922257 - RNA, 18 nt, Shigella flexneri 2a str. 301
cagcugccagacccggca

SEQ ID NO: 3922258 - RNA, 18 nt, Shigella flexneri 2a str. 301
cagcugccgaaccacuga

SEQ ID NO: 3922259 - RNA, 16 nt, Shigella flexneri 2a str. 301
cagcugccgacgccag

SEQ ID NO: 3922260 - RNA, 17 nt, Shigella flexneri 2a str. 301
cagcugccgacgccagu

SEQ ID NO: 3922261 - RNA, 15 nt, Shigella flexneri 2a str. 301
cagcugccgccaggc

SEQ ID NO: 3922262 - RNA, 18 nt, Shigella flexneri 2a str. 301
cagcugccgccaggcuuc

SEQ ID NO: 3922263 - RNA, 22 nt, Shigella flexneri 2a str. 301
cagcugcgcgcgaacugucggu

SEQ ID NO: 3922264 - RNA, 16 nt, Shigella flexneri 2a str. 301
cagcugcgcguuaucu

SEQ ID NO: 3922265 - RNA, 12 nt, Shigella flexneri 2a str. 301
cagcugcgugcc

SEQ ID NO: 3922266 - RNA, 20 nt, Shigella flexneri 2a str. 301
cagcugcgugccuaauuccg

SEQ ID NO: 3922267 - RNA, 20 nt, Shigella flexneri 2a str. 301
cagcugcucauagcggcugc

SEQ ID NO: 3922268 - RNA, 13 nt, Shigella flexneri 2a str. 301
cagcugcucccag

SEQ ID NO: 3922269 - RNA, 14 nt, Shigella flexneri 2a str. 301
cagcugcucccagc

SEQ ID NO: 3922270 - RNA, 14 nt, Shigella flexneri 2a str. 301
cagcugggcgauuu

SEQ ID NO: 3922271 - RNA, 16 nt, Shigella flexneri 2a str. 301
cagcuggugauccacg

SEQ ID NO: 3922272 - RNA, 16 nt, Shigella flexneri 2a str. 301
cagcugguuauuuucu

SEQ ID NO: 3922273 - RNA, 18 nt, Shigella flexneri 2a str. 301
cagcuguccauaccggac

SEQ ID NO: 3922274 - RNA, 19 nt, Shigella flexneri 2a str. 301
cagcuguccgauuuguucu

SEQ ID NO: 3922275 - RNA, 16 nt, Shigella flexneri 2a str. 301
cagcuuaaucaccagc

SEQ ID NO: 3922276 - RNA, 16 nt, Shigella flexneri 2a str. 301
cagcuuagaaaucgac

SEQ ID NO: 3922277 - RNA, 14 nt, Shigella flexneri 2a str. 301
cagcuuagcgccuu

SEQ ID NO: 3922278 - RNA, 18 nt, Shigella flexneri 2a str. 301
cagcuuaguccgcgacgu

SEQ ID NO: 3922279 - RNA, 19 nt, Shigella flexneri 2a str. 301
cagcuuaugccuguccucu

SEQ ID NO: 3922280 - RNA, 21 nt, Shigella flexneri 2a str. 301
cagcuuauuagggaucaucuu

SEQ ID NO: 3922281 - RNA, 22 nt, Shigella flexneri 2a str. 301
cagcuuauuagggaucaucuua

SEQ ID NO: 3922282 - RNA, 16 nt, Shigella flexneri 2a str. 301
cagcuuauuucuguga

SEQ ID NO: 3922283 - RNA, 22 nt, Shigella flexneri 2a str. 301
cagcuucacaaaggcuugcugc

SEQ ID NO: 3922284 - RNA, 16 nt, Shigella flexneri 2a str. 301
cagcuucaccuuccag

SEQ ID NO: 3922285 - RNA, 18 nt, Shigella flexneri 2a str. 301
cagcuucaccuuccagua

SEQ ID NO: 3922286 - RNA, 19 nt, Shigella flexneri 2a str. 301
cagcuucacgcgccagcuu

SEQ ID NO: 3922287 - RNA, 13 nt, Shigella flexneri 2a str. 301
cagcuucacggaa

SEQ ID NO: 3922288 - RNA, 14 nt, Shigella flexneri 2a str. 301
cagcuucacuuuca

SEQ ID NO: 3922289 - RNA, 13 nt, Shigella flexneri 2a str. 301
cagcuucagauua

SEQ ID NO: 3922290 - RNA, 13 nt, Shigella flexneri 2a str. 301
cagcuucagauug

SEQ ID NO: 3922291 - RNA, 16 nt, Shigella flexneri 2a str. 301
cagcuucagcgcgucg

SEQ ID NO: 3922292 - RNA, 22 nt, Shigella flexneri 2a str. 301
cagcuuccaggcaaucagcaau

SEQ ID NO: 3922293 - RNA, 16 nt, Shigella flexneri 2a str. 301
cagcuuccaucaacau

SEQ ID NO: 3922294 - RNA, 16 nt, Shigella flexneri 2a str. 301
cagcuucccaaagauc

SEQ ID NO: 3922295 - RNA, 16 nt, Shigella flexneri 2a str. 301
cagcuucgaggccgga

SEQ ID NO: 3922296 - RNA, 16 nt, Shigella flexneri 2a str. 301
cagcuugccgcgcucu

SEQ ID NO: 3922297 - RNA, 16 nt, Shigella flexneri 2a str. 301
cagcuugcgauccugc

SEQ ID NO: 3922298 - RNA, 16 nt, Shigella flexneri 2a str. 301
cagcuugcuuuccagc

SEQ ID NO: 3922299 - RNA, 22 nt, Shigella flexneri 2a str. 301
caggccaauagugcggcauggu

SEQ ID NO: 3922300 - RNA, 14 nt, Shigella flexneri 2a str. 301
caggccaccaggcc

SEQ ID NO: 3922301 - RNA, 20 nt, Shigella flexneri 2a str. 301
caggccacgaaucagcaccg

SEQ ID NO: 3922302 - RNA, 15 nt, Shigella flexneri 2a str. 301
caggccagauagcca

SEQ ID NO: 3922303 - RNA, 23 nt, Shigella flexneri 2a str. 301
caggccagauagccaauuacgca

SEQ ID NO: 3922304 - RNA, 17 nt, Shigella flexneri 2a str. 301
caggccaggauuacgcu

SEQ ID NO: 3922305 - RNA, 14 nt, Shigella flexneri 2a str. 301
caggccaucacauc

SEQ ID NO: 3922306 - RNA, 16 nt, Shigella flexneri 2a str. 301
caggccauguuuacca

SEQ ID NO: 3922307 - RNA, 16 nt, Shigella flexneri 2a str. 301
caggcccagcgguguc

SEQ ID NO: 3922308 - RNA, 14 nt, Shigella flexneri 2a str. 301
caggcccgcauaga

SEQ ID NO: 3922309 - RNA, 15 nt, Shigella flexneri 2a str. 301
caggcccgcauuaaa

SEQ ID NO: 3922310 - RNA, 22 nt, Shigella flexneri 2a str. 301
caggcccgccagcgccugggaa

SEQ ID NO: 3922311 - RNA, 13 nt, Shigella flexneri 2a str. 301
caggcccugcugu

SEQ ID NO: 3922312 - RNA, 13 nt, Shigella flexneri 2a str. 301
caggccgccugca

SEQ ID NO: 3922313 - RNA, 18 nt, Shigella flexneri 2a str. 301
caggccggagccagccgu

SEQ ID NO: 3922314 - RNA, 14 nt, Shigella flexneri 2a str. 301
caggccguggauca

SEQ ID NO: 3922315 - RNA, 16 nt, Shigella flexneri 2a str. 301
caggccuaacacaugc

SEQ ID NO: 3922316 - RNA, 17 nt, Shigella flexneri 2a str. 301
caggccuacaaguccgu

SEQ ID NO: 3922317 - RNA, 18 nt, Shigella flexneri 2a str. 301
caggccuacaaguccguu

SEQ ID NO: 3922318 - RNA, 21 nt, Shigella flexneri 2a str. 301
caggccuacaagucugugcug

SEQ ID NO: 3922319 - RNA, 19 nt, Shigella flexneri 2a str. 301
caggccuacauuuucuccg

SEQ ID NO: 3922320 - RNA, 18 nt, Shigella flexneri 2a str. 301
caggccuacgugaggcau

SEQ ID NO: 3922321 - RNA, 19 nt, Shigella flexneri 2a str. 301
caggccuauugacgcuguu

SEQ ID NO: 3922322 - RNA, 22 nt, Shigella flexneri 2a str. 301
caggccugauaagacgcgcagc

SEQ ID NO: 3922323 - RNA, 16 nt, Shigella flexneri 2a str. 301
caggccuggguaaaaa

SEQ ID NO: 3922324 - RNA, 14 nt, Shigella flexneri 2a str. 301
caggcgacauauca

SEQ ID NO: 3922325 - RNA, 20 nt, Shigella flexneri 2a str. 301
caggcgaccguuuucaccag

SEQ ID NO: 3922326 - RNA, 18 nt, Shigella flexneri 2a str. 301
caggcgagaucggcaggc

SEQ ID NO: 3922327 - RNA, 17 nt, Shigella flexneri 2a str. 301
caggcgcaacccgugaa

SEQ ID NO: 3922328 - RNA, 18 nt, Shigella flexneri 2a str. 301
caggcgcagauacagccu

SEQ ID NO: 3922329 - RNA, 22 nt, Shigella flexneri 2a str. 301
caggcgcgaauggaaagcccgc

SEQ ID NO: 3922330 - RNA, 13 nt, Shigella flexneri 2a str. 301
caggcgcgccugg

SEQ ID NO: 3922331 - RNA, 14 nt, Shigella flexneri 2a str. 301
caggcgcgccuggu

SEQ ID NO: 3922332 - RNA, 16 nt, Shigella flexneri 2a str. 301
caggcgcucauaacca

SEQ ID NO: 3922333 - RNA, 13 nt, Shigella flexneri 2a str. 301
caggcgcugaaag

SEQ ID NO: 3922334 - RNA, 15 nt, Shigella flexneri 2a str. 301
caggcgcugaaagaa

SEQ ID NO: 3922335 - RNA, 19 nt, Shigella flexneri 2a str. 301
caggcgcugauagguuuca

SEQ ID NO: 3922336 - RNA, 23 nt, Shigella flexneri 2a str. 301
caggcgcugcauaucucccagua

SEQ ID NO: 3922337 - RNA, 20 nt, Shigella flexneri 2a str. 301
caggcgcuggguaaagagcg

SEQ ID NO: 3922338 - RNA, 13 nt, Shigella flexneri 2a str. 301
caggcgcuuggcu

SEQ ID NO: 3922339 - RNA, 21 nt, Shigella flexneri 2a str. 301
caggcgcuugucgucccaggc

SEQ ID NO: 3922340 - RNA, 22 nt, Shigella flexneri 2a str. 301
caggcgcuugucgucccaggca

SEQ ID NO: 3922341 - RNA, 20 nt, Shigella flexneri 2a str. 301
caggcggauugcuucugcuu

SEQ ID NO: 3922342 - RNA, 21 nt, Shigella flexneri 2a str. 301
caggcggauugcuucugcuuc

SEQ ID NO: 3922343 - RNA, 22 nt, Shigella flexneri 2a str. 301
caggcggcuaugcuggagaaga

SEQ ID NO: 3922344 - RNA, 16 nt, Shigella flexneri 2a str. 301
caggcggcuucgcauc

SEQ ID NO: 3922345 - RNA, 20 nt, Shigella flexneri 2a str. 301
caggcguaacacucgugcgu

SEQ ID NO: 3922346 - RNA, 15 nt, Shigella flexneri 2a str. 301
caggcguucugccug

SEQ ID NO: 3922347 - RNA, 20 nt, Shigella flexneri 2a str. 301
caggcguuuguaacccacca

SEQ ID NO: 3922348 - RNA, 22 nt, Shigella flexneri 2a str. 301
caggcguuuguaacccaccaug

SEQ ID NO: 3922349 - RNA, 15 nt, Shigella flexneri 2a str. 301
caggcuaaagaaaac

SEQ ID NO: 3922350 - RNA, 14 nt, Shigella flexneri 2a str. 301
caggcuacucccag

SEQ ID NO: 3922351 - RNA, 14 nt, Shigella flexneri 2a str. 301
caggcuacuuuucc

SEQ ID NO: 3922352 - RNA, 19 nt, Shigella flexneri 2a str. 301
caggcuagccgccagccgg

SEQ ID NO: 3922353 - RNA, 17 nt, Shigella flexneri 2a str. 301
caggcuaucgaacaugc

SEQ ID NO: 3922354 - RNA, 17 nt, Shigella flexneri 2a str. 301
caggcucagaagacgcu

SEQ ID NO: 3922355 - RNA, 15 nt, Shigella flexneri 2a str. 301
caggcucauaccuuc

SEQ ID NO: 3922356 - RNA, 22 nt, Shigella flexneri 2a str. 301
caggcucauaccuuccacuuuc

SEQ ID NO: 3922357 - RNA, 15 nt, Shigella flexneri 2a str. 301
caggcuccuguagcu

SEQ ID NO: 3922358 - RNA, 20 nt, Shigella flexneri 2a str. 301
caggcuccuguagcuggaaa

SEQ ID NO: 3922359 - RNA, 16 nt, Shigella flexneri 2a str. 301
caggcucgccgccgcu

SEQ ID NO: 3922360 - RNA, 17 nt, Shigella flexneri 2a str. 301
caggcucgccgccgcug

SEQ ID NO: 3922361 - RNA, 18 nt, Shigella flexneri 2a str. 301
caggcucucauuuuucag

SEQ ID NO: 3922362 - RNA, 13 nt, Shigella flexneri 2a str. 301
caggcucuuuaaa

SEQ ID NO: 3922363 - RNA, 23 nt, Shigella flexneri 2a str. 301
caggcugaacaacaguuuuaucu

SEQ ID NO: 3922364 - RNA, 19 nt, Shigella flexneri 2a str. 301
caggcugcaaagucugggc

SEQ ID NO: 3922365 - RNA, 13 nt, Shigella flexneri 2a str. 301
caggcugcacugg

SEQ ID NO: 3922366 - RNA, 17 nt, Shigella flexneri 2a str. 301
caggcugcgaguccugu

SEQ ID NO: 3922367 - RNA, 23 nt, Shigella flexneri 2a str. 301
caggcugguaacagugcaccgga

SEQ ID NO: 3922368 - RNA, 12 nt, Shigella flexneri 2a str. 301
caggcugguggu

SEQ ID NO: 3922369 - RNA, 12 nt, Shigella flexneri 2a str. 301
caggcuguguuu

SEQ ID NO: 3922370 - RNA, 22 nt, Shigella flexneri 2a str. 301
caggcuugcugaugcacgcaga

SEQ ID NO: 3922371 - RNA, 23 nt, Shigella flexneri 2a str. 301
caggcuuuauucugacgccacca

SEQ ID NO: 3922372 - RNA, 13 nt, Shigella flexneri 2a str. 301
caggcuuuccguc

SEQ ID NO: 3922373 - RNA, 18 nt, Shigella flexneri 2a str. 301
cagggaaaaaagccccgu

SEQ ID NO: 3922374 - RNA, 23 nt, Shigella flexneri 2a str. 301
cagggaacauuucuuaugggcca

SEQ ID NO: 3922375 - RNA, 15 nt, Shigella flexneri 2a str. 301
cagggaaugaggauc

SEQ ID NO: 3922376 - RNA, 16 nt, Shigella flexneri 2a str. 301
cagggagucuugcugg

SEQ ID NO: 3922377 - RNA, 20 nt, Shigella flexneri 2a str. 301
cagggagucuugcuggaugc

SEQ ID NO: 3922378 - RNA, 18 nt, Shigella flexneri 2a str. 301
cagggaucauccacccgc

SEQ ID NO: 3922379 - RNA, 21 nt, Shigella flexneri 2a str. 301
cagggaucucuuccagugccu

SEQ ID NO: 3922380 - RNA, 19 nt, Shigella flexneri 2a str. 301
cagggaugaagugaagaug

SEQ ID NO: 3922381 - RNA, 17 nt, Shigella flexneri 2a str. 301
cagggcaaaauuucccc

SEQ ID NO: 3922382 - RNA, 21 nt, Shigella flexneri 2a str. 301
cagggcaaacucugagagauc

SEQ ID NO: 3922383 - RNA, 22 nt, Shigella flexneri 2a str. 301
cagggcaaugcgggugcaauca

SEQ ID NO: 3922384 - RNA, 21 nt, Shigella flexneri 2a str. 301
cagggccaucgcgguuaaucg

SEQ ID NO: 3922385 - RNA, 21 nt, Shigella flexneri 2a str. 301
cagggccgcgaaucuccagau

SEQ ID NO: 3922386 - RNA, 16 nt, Shigella flexneri 2a str. 301
cagggccuccugcagc

SEQ ID NO: 3922387 - RNA, 20 nt, Shigella flexneri 2a str. 301
cagggccucuccuuuaccac

SEQ ID NO: 3922388 - RNA, 23 nt, Shigella flexneri 2a str. 301
cagggccucuccuuuaccacucu

SEQ ID NO: 3922389 - RNA, 18 nt, Shigella flexneri 2a str. 301
cagggcgaauucuugccu

SEQ ID NO: 3922390 - RNA, 15 nt, Shigella flexneri 2a str. 301
cagggcgauaucuuu

SEQ ID NO: 3922391 - RNA, 16 nt, Shigella flexneri 2a str. 301
cagggcgcggaaaugg

SEQ ID NO: 3922392 - RNA, 12 nt, Shigella flexneri 2a str. 301
cagggcggcagg

SEQ ID NO: 3922393 - RNA, 21 nt, Shigella flexneri 2a str. 301
cagggcguacuggcgguuuuc

SEQ ID NO: 3922394 - RNA, 14 nt, Shigella flexneri 2a str. 301
cagggcgucaccgg

SEQ ID NO: 3922395 - RNA, 22 nt, Shigella flexneri 2a str. 301
cagggcuuucgcaauaaucauc

SEQ ID NO: 3922396 - RNA, 17 nt, Shigella flexneri 2a str. 301
caggggcagcaccauca

SEQ ID NO: 3922397 - RNA, 14 nt, Shigella flexneri 2a str. 301
caggggcuggaaga

SEQ ID NO: 3922398 - RNA, 16 nt, Shigella flexneri 2a str. 301
caguagacucaagcag

SEQ ID NO: 3922399 - RNA, 19 nt, Shigella flexneri 2a str. 301
caguagcauccccggcaac

SEQ ID NO: 3922400 - RNA, 16 nt, Shigella flexneri 2a str. 301
caguagccaugcauaa

SEQ ID NO: 3922401 - RNA, 18 nt, Shigella flexneri 2a str. 301
caguagccaugcauaaug

SEQ ID NO: 3922402 - RNA, 15 nt, Shigella flexneri 2a str. 301
caguagccuuuaucu

SEQ ID NO: 3922403 - RNA, 22 nt, Shigella flexneri 2a str. 301
caguagcgcaaucaccaccacg

SEQ ID NO: 3922404 - RNA, 13 nt, Shigella flexneri 2a str. 301
caguagcgggcgu

SEQ ID NO: 3922405 - RNA, 16 nt, Shigella flexneri 2a str. 301
caguagucgauaacga

SEQ ID NO: 3922406 - RNA, 14 nt, Shigella flexneri 2a str. 301
caguagugguaacg

SEQ ID NO: 3922407 - RNA, 21 nt, Shigella flexneri 2a str. 301
caguagugguaacgcacacau

SEQ ID NO: 3922408 - RNA, 14 nt, Shigella flexneri 2a str. 301
caguauacgccaca

SEQ ID NO: 3922409 - RNA, 15 nt, Shigella flexneri 2a str. 301
caguauacgccacau

SEQ ID NO: 3922410 - RNA, 13 nt, Shigella flexneri 2a str. 301
caguauagcggca

SEQ ID NO: 3922411 - RNA, 15 nt, Shigella flexneri 2a str. 301
caguaucgauuuucc

SEQ ID NO: 3922412 - RNA, 15 nt, Shigella flexneri 2a str. 301
caguaucggcaaggu

SEQ ID NO: 3922413 - RNA, 13 nt, Shigella flexneri 2a str. 301
caguaucugaauc

SEQ ID NO: 3922414 - RNA, 15 nt, Shigella flexneri 2a str. 301
cagucaaucauccau

SEQ ID NO: 3922415 - RNA, 16 nt, Shigella flexneri 2a str. 301
cagucaccagcaucag

SEQ ID NO: 3922416 - RNA, 15 nt, Shigella flexneri 2a str. 301
cagucaccugcccuc

SEQ ID NO: 3922417 - RNA, 16 nt, Shigella flexneri 2a str. 301
cagucacgacaaagac

SEQ ID NO: 3922418 - RNA, 22 nt, Shigella flexneri 2a str. 301
cagucacgacaaagacaucaaa

SEQ ID NO: 3922419 - RNA, 23 nt, Shigella flexneri 2a str. 301
cagucacggcgcgguugcggguu

SEQ ID NO: 3922420 - RNA, 17 nt, Shigella flexneri 2a str. 301
cagucagcgaacaccag

SEQ ID NO: 3922421 - RNA, 23 nt, Shigella flexneri 2a str. 301
cagucaggcgauuguuuagaucc

SEQ ID NO: 3922422 - RNA, 12 nt, Shigella flexneri 2a str. 301
cagucaggcugu

SEQ ID NO: 3922423 - RNA, 19 nt, Shigella flexneri 2a str. 301
cagucauaaccaguccauu

SEQ ID NO: 3922424 - RNA, 20 nt, Shigella flexneri 2a str. 301
cagucauaaccaguccauua

SEQ ID NO: 3922425 - RNA, 20 nt, Shigella flexneri 2a str. 301
cagucaucacuuucagaccg

SEQ ID NO: 3922426 - RNA, 19 nt, Shigella flexneri 2a str. 301
caguccaccugaccugcga

SEQ ID NO: 3922427 - RNA, 12 nt, Shigella flexneri 2a str. 301
caguccaucggc

SEQ ID NO: 3922428 - RNA, 18 nt, Shigella flexneri 2a str. 301
caguccauuaccgauaga

SEQ ID NO: 3922429 - RNA, 14 nt, Shigella flexneri 2a str. 301
cagucccaggcaga

SEQ ID NO: 3922430 - RNA, 17 nt, Shigella flexneri 2a str. 301
cagucccaggcagaagc

SEQ ID NO: 3922431 - RNA, 23 nt, Shigella flexneri 2a str. 301
caguccccacaucacuccaucca

SEQ ID NO: 3922432 - RNA, 14 nt, Shigella flexneri 2a str. 301
caguccccacgcca

SEQ ID NO: 3922433 - RNA, 19 nt, Shigella flexneri 2a str. 301
caguccccucgccccuccg

SEQ ID NO: 3922434 - RNA, 15 nt, Shigella flexneri 2a str. 301
caguccgccuucaac

SEQ ID NO: 3922435 - RNA, 21 nt, Shigella flexneri 2a str. 301
caguccgcucgccgcagagau

SEQ ID NO: 3922436 - RNA, 15 nt, Shigella flexneri 2a str. 301
cagucgcacgccugg

SEQ ID NO: 3922437 - RNA, 16 nt, Shigella flexneri 2a str. 301
cagucgccagcgccag

SEQ ID NO: 3922438 - RNA, 20 nt, Shigella flexneri 2a str. 301
cagucgccagcgccagcgcu

SEQ ID NO: 3922439 - RNA, 12 nt, Shigella flexneri 2a str. 301
cagucgcccccg

SEQ ID NO: 3922440 - RNA, 16 nt, Shigella flexneri 2a str. 301
cagucgcgacgcugac

SEQ ID NO: 3922441 - RNA, 23 nt, Shigella flexneri 2a str. 301
cagucgcguagguaaucauauug

SEQ ID NO: 3922442 - RNA, 20 nt, Shigella flexneri 2a str. 301
cagucgcuguauuuugcguu

SEQ ID NO: 3922443 - RNA, 23 nt, Shigella flexneri 2a str. 301
cagucgguauaaauagcggcugu

SEQ ID NO: 3922444 - RNA, 15 nt, Shigella flexneri 2a str. 301
cagucgucaucccag

SEQ ID NO: 3922445 - RNA, 16 nt, Shigella flexneri 2a str. 301
cagucgucaucccagu

SEQ ID NO: 3922446 - RNA, 16 nt, Shigella flexneri 2a str. 301
cagucuagcccgaugg

SEQ ID NO: 3922447 - RNA, 23 nt, Shigella flexneri 2a str. 301
cagucucaaaccggcuccagaua

SEQ ID NO: 3922448 - RNA, 13 nt, Shigella flexneri 2a str. 301
cagucugcucccu

SEQ ID NO: 3922449 - RNA, 14 nt, Shigella flexneri 2a str. 301
cagucugcucccuu

SEQ ID NO: 3922450 - RNA, 14 nt, Shigella flexneri 2a str. 301
cagucuggagcaaa

SEQ ID NO: 3922451 - RNA, 17 nt, Shigella flexneri 2a str. 301
cagucuggcuucgcugu

SEQ ID NO: 3922452 - RNA, 21 nt, Shigella flexneri 2a str. 301
cagucuuaaaggggugaaaaa

SEQ ID NO: 3922453 - RNA, 14 nt, Shigella flexneri 2a str. 301
cagucuucaucauc

SEQ ID NO: 3922454 - RNA, 23 nt, Shigella flexneri 2a str. 301
cagucuuccaucacaaagugggg

SEQ ID NO: 3922455 - RNA, 14 nt, Shigella flexneri 2a str. 301
cagucuucccagcc

SEQ ID NO: 3922456 - RNA, 15 nt, Shigella flexneri 2a str. 301
cagucuucccagccc

SEQ ID NO: 3922457 - RNA, 16 nt, Shigella flexneri 2a str. 301
cagucuucccagcccc

SEQ ID NO: 3922458 - RNA, 13 nt, Shigella flexneri 2a str. 301
cagucuuccugcg

SEQ ID NO: 3922459 - RNA, 15 nt, Shigella flexneri 2a str. 301
cagucuuccugcggc

SEQ ID NO: 3922460 - RNA, 22 nt, Shigella flexneri 2a str. 301
cagucuuugccguuggcggcgu

SEQ ID NO: 3922461 - RNA, 13 nt, Shigella flexneri 2a str. 301
cagugaaaguuuu

SEQ ID NO: 3922462 - RNA, 21 nt, Shigella flexneri 2a str. 301
cagugaacaauuaacguauca

SEQ ID NO: 3922463 - RNA, 21 nt, Shigella flexneri 2a str. 301
cagugaagucgggcagaaugc

SEQ ID NO: 3922464 - RNA, 16 nt, Shigella flexneri 2a str. 301
cagugacauucaccuc

SEQ ID NO: 3922465 - RNA, 16 nt, Shigella flexneri 2a str. 301
cagugaccaucuucca

SEQ ID NO: 3922466 - RNA, 20 nt, Shigella flexneri 2a str. 301
cagugaccgaaccuguuuuc

SEQ ID NO: 3922467 - RNA, 16 nt, Shigella flexneri 2a str. 301
cagugaccuuaaucag

SEQ ID NO: 3922468 - RNA, 20 nt, Shigella flexneri 2a str. 301
cagugacuuccgucccagcc

SEQ ID NO: 3922469 - RNA, 23 nt, Shigella flexneri 2a str. 301
cagugagauaccaguugaucaaa

SEQ ID NO: 3922470 - RNA, 15 nt, Shigella flexneri 2a str. 301
cagugaguguggcgu

SEQ ID NO: 3922471 - RNA, 20 nt, Shigella flexneri 2a str. 301
cagugauauauuuuuaaaua

SEQ ID NO: 3922472 - RNA, 22 nt, Shigella flexneri 2a str. 301
cagugauauauuuuuaaauaua

SEQ ID NO: 3922473 - RNA, 12 nt, Shigella flexneri 2a str. 301
cagugaucgccu

SEQ ID NO: 3922474 - RNA, 20 nt, Shigella flexneri 2a str. 301
cagugaucgugugccaccag

SEQ ID NO: 3922475 - RNA, 23 nt, Shigella flexneri 2a str. 301
cagugaugaaaacgaaggccgga

SEQ ID NO: 3922476 - RNA, 15 nt, Shigella flexneri 2a str. 301
cagugcaaaugccag

SEQ ID NO: 3922477 - RNA, 18 nt, Shigella flexneri 2a str. 301
cagugcaauaccauggcu

SEQ ID NO: 3922478 - RNA, 16 nt, Shigella flexneri 2a str. 301
cagugcaccggacacu

SEQ ID NO: 3922479 - RNA, 22 nt, Shigella flexneri 2a str. 301
cagugcacgaaccagagacaga

SEQ ID NO: 3922480 - RNA, 18 nt, Shigella flexneri 2a str. 301
cagugcagcgccuuuugu

SEQ ID NO: 3922481 - RNA, 17 nt, Shigella flexneri 2a str. 301
cagugcaggcaccagcc

SEQ ID NO: 3922482 - RNA, 18 nt, Shigella flexneri 2a str. 301
cagugcaggcaccagccc

SEQ ID NO: 3922483 - RNA, 14 nt, Shigella flexneri 2a str. 301
cagugcauccagca

SEQ ID NO: 3922484 - RNA, 17 nt, Shigella flexneri 2a str. 301
cagugcauccagcagcc

SEQ ID NO: 3922485 - RNA, 15 nt, Shigella flexneri 2a str. 301
cagugccaaagccag

SEQ ID NO: 3922486 - RNA, 16 nt, Shigella flexneri 2a str. 301
cagugccagcaccacu

SEQ ID NO: 3922487 - RNA, 22 nt, Shigella flexneri 2a str. 301
cagugccagguagucacgguag

SEQ ID NO: 3922488 - RNA, 18 nt, Shigella flexneri 2a str. 301
cagugcccgaccacuuca

SEQ ID NO: 3922489 - RNA, 19 nt, Shigella flexneri 2a str. 301
cagugcccggcccggagga

SEQ ID NO: 3922490 - RNA, 17 nt, Shigella flexneri 2a str. 301
cagugccgcaccgacac

SEQ ID NO: 3922491 - RNA, 15 nt, Shigella flexneri 2a str. 301
cagugccgcauugac

SEQ ID NO: 3922492 - RNA, 18 nt, Shigella flexneri 2a str. 301
cagugccggaugauucac

SEQ ID NO: 3922493 - RNA, 16 nt, Shigella flexneri 2a str. 301
cagugccguuccagcc

SEQ ID NO: 3922494 - RNA, 22 nt, Shigella flexneri 2a str. 301
cagugccucacgaucacagcag

SEQ ID NO: 3922495 - RNA, 21 nt, Shigella flexneri 2a str. 301
cagugccugcauaaacgccgu

SEQ ID NO: 3922496 - RNA, 20 nt, Shigella flexneri 2a str. 301
cagugccugcgccaccguuu

SEQ ID NO: 3922497 - RNA, 19 nt, Shigella flexneri 2a str. 301
cagugcggauaccaccagu

SEQ ID NO: 3922498 - RNA, 16 nt, Shigella flexneri 2a str. 301
caguuuccgcgccggc

SEQ ID NO: 3922499 - RNA, 11 nt, Shigella flexneri 2a str. 301
caguuucugau

SEQ ID NO: 3922500 - RNA, 14 nt, Shigella flexneri 2a str. 301
caguuucugcagcu

SEQ ID NO: 3922501 - RNA, 15 nt, Shigella flexneri 2a str. 301
caguuucugcagcuc

SEQ ID NO: 3922502 - RNA, 21 nt, Shigella flexneri 2a str. 301
caguuucuuaccuacuugcuc

SEQ ID NO: 3922503 - RNA, 17 nt, Shigella flexneri 2a str. 301
caguuugagauugaaaa

SEQ ID NO: 3922504 - RNA, 16 nt, Shigella flexneri 2a str. 301
caguuugccgaacagc

SEQ ID NO: 3922505 - RNA, 17 nt, Shigella flexneri 2a str. 301
caguuugcucaaaucca

SEQ ID NO: 3922506 - RNA, 16 nt, Shigella flexneri 2a str. 301
caguuugucuucaaug

SEQ ID NO: 3922507 - RNA, 18 nt, Shigella flexneri 2a str. 301
caguuuguucagcugcgu

SEQ ID NO: 3922508 - RNA, 24 nt, Shigella flexneri 2a str. 301
caguuuucgcaccgcguuuagcgu

SEQ ID NO: 3922509 - RNA, 23 nt, Shigella flexneri 2a str. 301
caguuuugcguuugcccgcaauc

SEQ ID NO: 3922510 - RNA, 13 nt, Shigella flexneri 2a str. 301
caguuuugugccc

SEQ ID NO: 3922511 - RNA, 17 nt, Shigella flexneri 2a str. 301
caguuuuuaauuuucgu

SEQ ID NO: 3922512 - RNA, 16 nt, Shigella flexneri 2a str. 301
caguuuuucuuuuuca

SEQ ID NO: 3922513 - RNA, 21 nt, Shigella flexneri 2a str. 301
caguuuuugcaaucagauaaa

SEQ ID NO: 3922514 - RNA, 22 nt, Shigella flexneri 2a str. 301
cauaaaaaugcccgauaagcaa

SEQ ID NO: 3922515 - RNA, 13 nt, Shigella flexneri 2a str. 301
cauaaaacgcuua

SEQ ID NO: 3922516 - RNA, 20 nt, Shigella flexneri 2a str. 301
cauaaaaggcaccuggaaau

SEQ ID NO: 3922517 - RNA, 20 nt, Shigella flexneri 2a str. 301
cauaaacaacgagcuucagc

SEQ ID NO: 3922518 - RNA, 13 nt, Shigella flexneri 2a str. 301
cauaaacagcagg

SEQ ID NO: 3922519 - RNA, 10 nt, Shigella flexneri 2a str. 301
cauaaacagg

SEQ ID NO: 3922520 - RNA, 21 nt, Shigella flexneri 2a str. 301
cauaaacgccgucaucacacc

SEQ ID NO: 3922521 - RNA, 22 nt, Shigella flexneri 2a str. 301
cauaaagaaaucaccugccgga

SEQ ID NO: 3922522 - RNA, 16 nt, Shigella flexneri 2a str. 301
cauaaagucuuucuua

SEQ ID NO: 3922523 - RNA, 15 nt, Shigella flexneri 2a str. 301
cauaaauacagagca

SEQ ID NO: 3922524 - RNA, 16 nt, Shigella flexneri 2a str. 301
cauaaaucagaucgac

SEQ ID NO: 3922525 - RNA, 18 nt, Shigella flexneri 2a str. 301
cauaaauccaacaacaca

SEQ ID NO: 3922526 - RNA, 22 nt, Shigella flexneri 2a str. 301
cauaaaucucagcccgaugaua

SEQ ID NO: 3922527 - RNA, 20 nt, Shigella flexneri 2a str. 301
cauaaauuccggcuuguuca

SEQ ID NO: 3922528 - RNA, 20 nt, Shigella flexneri 2a str. 301
cauaaauuucacgucacgcu

SEQ ID NO: 3922529 - RNA, 21 nt, Shigella flexneri 2a str. 301
cauaacacaauaccuucugcg

SEQ ID NO: 3922530 - RNA, 11 nt, Shigella flexneri 2a str. 301
cauaacagaau

SEQ ID NO: 3922531 - RNA, 14 nt, Shigella flexneri 2a str. 301
cauaacagauaaau

SEQ ID NO: 3922532 - RNA, 17 nt, Shigella flexneri 2a str. 301
cauaaccacucaccgcc

SEQ ID NO: 3922533 - RNA, 18 nt, Shigella flexneri 2a str. 301
cauaaccacucaccgccg

SEQ ID NO: 3922534 - RNA, 13 nt, Shigella flexneri 2a str. 301
cauaaccagucca

SEQ ID NO: 3922535 - RNA, 14 nt, Shigella flexneri 2a str. 301
cauaaccccaccag

SEQ ID NO: 3922536 - RNA, 16 nt, Shigella flexneri 2a str. 301
cauaaccccaccagca

SEQ ID NO: 3922537 - RNA, 22 nt, Shigella flexneri 2a str. 301
cauaaccgcgaccacaguauca

SEQ ID NO: 3922538 - RNA, 21 nt, Shigella flexneri 2a str. 301
cauaacgccaauucauuccuu

SEQ ID NO: 3922539 - RNA, 18 nt, Shigella flexneri 2a str. 301
cauaacgccgguauuuuu

SEQ ID NO: 3922540 - RNA, 20 nt, Shigella flexneri 2a str. 301
cauaacgccgguauuuuuau

SEQ ID NO: 3922541 - RNA, 14 nt, Shigella flexneri 2a str. 301
cauaacgccugcuc

SEQ ID NO: 3922542 - RNA, 14 nt, Shigella flexneri 2a str. 301
cauaacgcgucuca

SEQ ID NO: 3922543 - RNA, 15 nt, Shigella flexneri 2a str. 301
cauaacucaccauca

SEQ ID NO: 3922544 - RNA, 15 nt, Shigella flexneri 2a str. 301
cauaacucauacuga

SEQ ID NO: 3922545 - RNA, 15 nt, Shigella flexneri 2a str. 301
cauaacuccccgaga

SEQ ID NO: 3922546 - RNA, 19 nt, Shigella flexneri 2a str. 301
cauaacucuccuguuuaau

SEQ ID NO: 3922547 - RNA, 16 nt, Shigella flexneri 2a str. 301
cauaacugccggaugc

SEQ ID NO: 3922548 - RNA, 20 nt, Shigella flexneri 2a str. 301
cauaagagauggaaugagca

SEQ ID NO: 3922549 - RNA, 19 nt, Shigella flexneri 2a str. 301
cauaagcccagaacaaaua

SEQ ID NO: 3922550 - RNA, 23 nt, Shigella flexneri 2a str. 301
cauaaggaaacucucaaaacaac

SEQ ID NO: 3922551 - RNA, 19 nt, Shigella flexneri 2a str. 301
cauaagguccuccagcucc

SEQ ID NO: 3922552 - RNA, 14 nt, Shigella flexneri 2a str. 301
cauaaggugggagg

SEQ ID NO: 3922553 - RNA, 18 nt, Shigella flexneri 2a str. 301
cauaauaaagaugccauu

SEQ ID NO: 3922554 - RNA, 19 nt, Shigella flexneri 2a str. 301
cauaauauauaaagauuca

SEQ ID NO: 3922555 - RNA, 15 nt, Shigella flexneri 2a str. 301
cauaauaugaccuga

SEQ ID NO: 3922556 - RNA, 12 nt, Shigella flexneri 2a str. 301
cauaaucaauac

SEQ ID NO: 3922557 - RNA, 20 nt, Shigella flexneri 2a str. 301
cauaaucauuacaaccgcug

SEQ ID NO: 3922558 - RNA, 16 nt, Shigella flexneri 2a str. 301
cauaauccacuuucuu

SEQ ID NO: 3922559 - RNA, 17 nt, Shigella flexneri 2a str. 301
cauaaucuguuucaucu

SEQ ID NO: 3922560 - RNA, 22 nt, Shigella flexneri 2a str. 301
cauaaugauggggucacagguu

SEQ ID NO: 3922561 - RNA, 14 nt, Shigella flexneri 2a str. 301
cauaaugcaaaaug

SEQ ID NO: 3922562 - RNA, 21 nt, Shigella flexneri 2a str. 301
cauaaugccugaugcgacgcu

SEQ ID NO: 3922563 - RNA, 15 nt, Shigella flexneri 2a str. 301
cauaaugcugacaaa

SEQ ID NO: 3922564 - RNA, 17 nt, Shigella flexneri 2a str. 301
cauaauggcugccgaug

SEQ ID NO: 3922565 - RNA, 22 nt, Shigella flexneri 2a str. 301
cauaaugguggaguggcccagg

SEQ ID NO: 3922566 - RNA, 19 nt, Shigella flexneri 2a str. 301
cauaaugugcgcacauugc

SEQ ID NO: 3922567 - RNA, 18 nt, Shigella flexneri 2a str. 301
cauaauguugcugccuug

SEQ ID NO: 3922568 - RNA, 13 nt, Shigella flexneri 2a str. 301
cauacaacgccau

SEQ ID NO: 3922569 - RNA, 13 nt, Shigella flexneri 2a str. 301
cauacaccagcgg

SEQ ID NO: 3922570 - RNA, 15 nt, Shigella flexneri 2a str. 301
cauacagacacccac

SEQ ID NO: 3922571 - RNA, 22 nt, Shigella flexneri 2a str. 301
cauacagaucgugcaucuccug

SEQ ID NO: 3922572 - RNA, 15 nt, Shigella flexneri 2a str. 301
cauacagaugcugcu

SEQ ID NO: 3922573 - RNA, 20 nt, Shigella flexneri 2a str. 301
cauacagcuuuuacagccaa

SEQ ID NO: 3922574 - RNA, 17 nt, Shigella flexneri 2a str. 301
cauacauaaaaaagccg

SEQ ID NO: 3922575 - RNA, 20 nt, Shigella flexneri 2a str. 301
cauacaugguuugaucgcua

SEQ ID NO: 3922576 - RNA, 22 nt, Shigella flexneri 2a str. 301
cauacaugguuugaucgcuaag

SEQ ID NO: 3922577 - RNA, 21 nt, Shigella flexneri 2a str. 301
cauacccaacguaacaaaacu

SEQ ID NO: 3922578 - RNA, 21 nt, Shigella flexneri 2a str. 301
cauacccgcaacauacugccc

SEQ ID NO: 3922579 - RNA, 17 nt, Shigella flexneri 2a str. 301
cauaccgucgccagacg

SEQ ID NO: 3922580 - RNA, 20 nt, Shigella flexneri 2a str. 301
cauaccgugguacguuaaag

SEQ ID NO: 3922581 - RNA, 20 nt, Shigella flexneri 2a str. 301
cauaccuaaaagcacgccag

SEQ ID NO: 3922582 - RNA, 21 nt, Shigella flexneri 2a str. 301
cauaccuaaaagcacgccaga

SEQ ID NO: 3922583 - RNA, 16 nt, Shigella flexneri 2a str. 301
cauaccuaccugcagu

SEQ ID NO: 3922584 - RNA, 18 nt, Shigella flexneri 2a str. 301
cauaccuccgcaauaugc

SEQ ID NO: 3922585 - RNA, 17 nt, Shigella flexneri 2a str. 301
cauaccugaguggcaau

SEQ ID NO: 3922586 - RNA, 22 nt, Shigella flexneri 2a str. 301
cauaccuuccacuuucacgccc

SEQ ID NO: 3922587 - RNA, 20 nt, Shigella flexneri 2a str. 301
cauacgcggcagaaugguuu

SEQ ID NO: 3922588 - RNA, 19 nt, Shigella flexneri 2a str. 301
cauacgcguaaaacagcca

SEQ ID NO: 3922589 - RNA, 16 nt, Shigella flexneri 2a str. 301
cauacgguuuaccgag

SEQ ID NO: 3922590 - RNA, 16 nt, Shigella flexneri 2a str. 301
cauacguacaaacgcu

SEQ ID NO: 3922591 - RNA, 15 nt, Shigella flexneri 2a str. 301
cauacguugcauaaa

SEQ ID NO: 3922592 - RNA, 17 nt, Shigella flexneri 2a str. 301
cauacguuucaccagca

SEQ ID NO: 3922593 - RNA, 14 nt, Shigella flexneri 2a str. 301
cauacucuccucca

SEQ ID NO: 3922594 - RNA, 17 nt, Shigella flexneri 2a str. 301
cauacucuuucccggca

SEQ ID NO: 3922595 - RNA, 19 nt, Shigella flexneri 2a str. 301
cauacucuuucccggcaau

SEQ ID NO: 3922596 - RNA, 23 nt, Shigella flexneri 2a str. 301
cauacuggauuucauucguacca

SEQ ID NO: 3922597 - RNA, 22 nt, Shigella flexneri 2a str. 301
cauacugucuccacuauaaaaa

SEQ ID NO: 3922598 - RNA, 12 nt, Shigella flexneri 2a str. 301
caucaccauagc

SEQ ID NO: 3922599 - RNA, 13 nt, Shigella flexneri 2a str. 301
caucaccaucagg

SEQ ID NO: 3922600 - RNA, 17 nt, Shigella flexneri 2a str. 301
caucacccaacaauaac

SEQ ID NO: 3922601 - RNA, 20 nt, Shigella flexneri 2a str. 301
caucaccgaugcccucaaua

SEQ ID NO: 3922602 - RNA, 14 nt, Shigella flexneri 2a str. 301
caucaccgcaccac

SEQ ID NO: 3922603 - RNA, 21 nt, Shigella flexneri 2a str. 301
caucaccgcaccacaccugau

SEQ ID NO: 3922604 - RNA, 17 nt, Shigella flexneri 2a str. 301
caucaccgcgaggccua

SEQ ID NO: 3922605 - RNA, 17 nt, Shigella flexneri 2a str. 301
caucaccuuccacauau

SEQ ID NO: 3922606 - RNA, 18 nt, Shigella flexneri 2a str. 301
caucacgaaaaucauucg

SEQ ID NO: 3922607 - RNA, 15 nt, Shigella flexneri 2a str. 301
caucacgcccgcuuu

SEQ ID NO: 3922608 - RNA, 15 nt, Shigella flexneri 2a str. 301
caucacgcgcaucug

SEQ ID NO: 3922609 - RNA, 19 nt, Shigella flexneri 2a str. 301
caucacgguugagggcaaa

SEQ ID NO: 3922610 - RNA, 23 nt, Shigella flexneri 2a str. 301
caucacgguugagggcaaacacc

SEQ ID NO: 3922611 - RNA, 15 nt, Shigella flexneri 2a str. 301
caucacuaucgccau

SEQ ID NO: 3922612 - RNA, 14 nt, Shigella flexneri 2a str. 301
caucacuccacacc

SEQ ID NO: 3922613 - RNA, 16 nt, Shigella flexneri 2a str. 301
caucacuccauccagc

SEQ ID NO: 3922614 - RNA, 17 nt, Shigella flexneri 2a str. 301
caucacuccauccagca

SEQ ID NO: 3922615 - RNA, 19 nt, Shigella flexneri 2a str. 301
caucacuccauccagcaac

SEQ ID NO: 3922616 - RNA, 16 nt, Shigella flexneri 2a str. 301
caucacugcaaauacc

SEQ ID NO: 3922617 - RNA, 23 nt, Shigella flexneri 2a str. 301
caucacugcaaauacccaaaaaa

SEQ ID NO: 3922618 - RNA, 13 nt, Shigella flexneri 2a str. 301
caucacugccagg

SEQ ID NO: 3922619 - RNA, 14 nt, Shigella flexneri 2a str. 301
caucacuuccagua

SEQ ID NO: 3922620 - RNA, 21 nt, Shigella flexneri 2a str. 301
caucacuuucggugacagaaa

SEQ ID NO: 3922621 - RNA, 13 nt, Shigella flexneri 2a str. 301
caucagaacguaa

SEQ ID NO: 3922622 - RNA, 21 nt, Shigella flexneri 2a str. 301
caucagaccuucgcuaucaaa

SEQ ID NO: 3922623 - RNA, 14 nt, Shigella flexneri 2a str. 301
caucagaggaauga

SEQ ID NO: 3922624 - RNA, 14 nt, Shigella flexneri 2a str. 301
caucagaggcgaac

SEQ ID NO: 3922625 - RNA, 22 nt, Shigella flexneri 2a str. 301
caucagaggcgaaccgcuguca

SEQ ID NO: 3922626 - RNA, 17 nt, Shigella flexneri 2a str. 301
caucagauaaucgccau

SEQ ID NO: 3922627 - RNA, 16 nt, Shigella flexneri 2a str. 301
caucagcagaaucgca

SEQ ID NO: 3922628 - RNA, 11 nt, Shigella flexneri 2a str. 301
caucagcagca

SEQ ID NO: 3922629 - RNA, 12 nt, Shigella flexneri 2a str. 301
caucagcagcaa

SEQ ID NO: 3922630 - RNA, 18 nt, Shigella flexneri 2a str. 301
caucagcauaaucaccag

SEQ ID NO: 3922631 - RNA, 23 nt, Shigella flexneri 2a str. 301
caucagcaucggugaggaucacc

SEQ ID NO: 3922632 - RNA, 15 nt, Shigella flexneri 2a str. 301
caucagcaugacaaa

SEQ ID NO: 3922633 - RNA, 18 nt, Shigella flexneri 2a str. 301
caucagcaugacaaaaaa

SEQ ID NO: 3922634 - RNA, 22 nt, Shigella flexneri 2a str. 301
caucagcaugacaaaaaagcca

SEQ ID NO: 3922635 - RNA, 13 nt, Shigella flexneri 2a str. 301
caucagcauucuc

SEQ ID NO: 3922636 - RNA, 18 nt, Shigella flexneri 2a str. 301
caucagcgccaccagcgc

SEQ ID NO: 3922637 - RNA, 12 nt, Shigella flexneri 2a str. 301
caucagcggcac

SEQ ID NO: 3922638 - RNA, 19 nt, Shigella flexneri 2a str. 301
caucagcggcgaagccuaa

SEQ ID NO: 3922639 - RNA, 20 nt, Shigella flexneri 2a str. 301
caucagcgguaaaacgccca

SEQ ID NO: 3922640 - RNA, 15 nt, Shigella flexneri 2a str. 301
caucagcgucgguuu

SEQ ID NO: 3922641 - RNA, 13 nt, Shigella flexneri 2a str. 301
caucagcuccggu

SEQ ID NO: 3922642 - RNA, 12 nt, Shigella flexneri 2a str. 301
caucagcugcca

SEQ ID NO: 3922643 - RNA, 23 nt, Shigella flexneri 2a str. 301
caucagcugccagggcacugaua

SEQ ID NO: 3922644 - RNA, 11 nt, Shigella flexneri 2a str. 301
caucaggaaac

SEQ ID NO: 3922645 - RNA, 14 nt, Shigella flexneri 2a str. 301
caucaggaaacccg

SEQ ID NO: 3922646 - RNA, 17 nt, Shigella flexneri 2a str. 301
caucaggaaacccgcca

SEQ ID NO: 3922647 - RNA, 21 nt, Shigella flexneri 2a str. 301
caucaggacgaauacaagaga

SEQ ID NO: 3922648 - RNA, 21 nt, Shigella flexneri 2a str. 301
caucaggaguuucucgccaga

SEQ ID NO: 3922649 - RNA, 20 nt, Shigella flexneri 2a str. 301
caucaggaugacaaacuuga

SEQ ID NO: 3922650 - RNA, 22 nt, Shigella flexneri 2a str. 301
caucaggcaaucucugguuugu

SEQ ID NO: 3922651 - RNA, 12 nt, Shigella flexneri 2a str. 301
caucaggcaaug

SEQ ID NO: 3922652 - RNA, 20 nt, Shigella flexneri 2a str. 301
caucaggcagucugcgcccu

SEQ ID NO: 3922653 - RNA, 21 nt, Shigella flexneri 2a str. 301
caucaggcaucgugcaccaau

SEQ ID NO: 3922654 - RNA, 22 nt, Shigella flexneri 2a str. 301
caucaggcaucgugcaccaauu

SEQ ID NO: 3922655 - RNA, 14 nt, Shigella flexneri 2a str. 301
caucaggcaucugc

SEQ ID NO: 3922656 - RNA, 19 nt, Shigella flexneri 2a str. 301
caucaggcauuuuuaucac

SEQ ID NO: 3922657 - RNA, 17 nt, Shigella flexneri 2a str. 301
caucaggccuacaaaau

SEQ ID NO: 3922658 - RNA, 12 nt, Shigella flexneri 2a str. 301
caucagggcgcu

SEQ ID NO: 3922659 - RNA, 18 nt, Shigella flexneri 2a str. 301
caucagggcggccgccag

SEQ ID NO: 3922660 - RNA, 16 nt, Shigella flexneri 2a str. 301
caucaggggcagcacc

SEQ ID NO: 3922661 - RNA, 18 nt, Shigella flexneri 2a str. 301
caucaggggcagcaccau

SEQ ID NO: 3922662 - RNA, 17 nt, Shigella flexneri 2a str. 301
caucaguagcauccccg

SEQ ID NO: 3922663 - RNA, 20 nt, Shigella flexneri 2a str. 301
caucagucucaaaccggcuc

SEQ ID NO: 3922664 - RNA, 21 nt, Shigella flexneri 2a str. 301
caucaguugaugaaucugcuu

SEQ ID NO: 3922665 - RNA, 17 nt, Shigella flexneri 2a str. 301
caucaguuucaaauggc

SEQ ID NO: 3922666 - RNA, 15 nt, Shigella flexneri 2a str. 301
caucauaaccgagca

SEQ ID NO: 3922667 - RNA, 14 nt, Shigella flexneri 2a str. 301
caucauaauaauug

SEQ ID NO: 3922668 - RNA, 22 nt, Shigella flexneri 2a str. 301
caucauacccaacguaacaaaa

SEQ ID NO: 3922669 - RNA, 21 nt, Shigella flexneri 2a str. 301
caucauacgauggccaaccau

SEQ ID NO: 3922670 - RNA, 19 nt, Shigella flexneri 2a str. 301
caucauagacuucccuccc

SEQ ID NO: 3922671 - RNA, 20 nt, Shigella flexneri 2a str. 301
caucauaucacccuuuucug

SEQ ID NO: 3922672 - RNA, 16 nt, Shigella flexneri 2a str. 301
caucaucagaaaugcc

SEQ ID NO: 3922673 - RNA, 19 nt, Shigella flexneri 2a str. 301
caucaucagaaaugccagu

SEQ ID NO: 3922674 - RNA, 13 nt, Shigella flexneri 2a str. 301
caucaucagauuc

SEQ ID NO: 3922675 - RNA, 20 nt, Shigella flexneri 2a str. 301
caucaucaggaacaucccuu

SEQ ID NO: 3922676 - RNA, 19 nt, Shigella flexneri 2a str. 301
caucauccccguaucuuca

SEQ ID NO: 3922677 - RNA, 19 nt, Shigella flexneri 2a str. 301
caucauccggcaccuuuuc

SEQ ID NO: 3922678 - RNA, 20 nt, Shigella flexneri 2a str. 301
caucauccggcaccuuuuca

SEQ ID NO: 3922679 - RNA, 19 nt, Shigella flexneri 2a str. 301
caucauccugacccagcaa

SEQ ID NO: 3922680 - RNA, 15 nt, Shigella flexneri 2a str. 301
caucaucgcagauuu

SEQ ID NO: 3922681 - RNA, 16 nt, Shigella flexneri 2a str. 301
caucaucgccccgcuc

SEQ ID NO: 3922682 - RNA, 17 nt, Shigella flexneri 2a str. 301
caucaucgccccgcuca

SEQ ID NO: 3922683 - RNA, 23 nt, Shigella flexneri 2a str. 301
caucaucgcuuugugcuggaaag

SEQ ID NO: 3922684 - RNA, 17 nt, Shigella flexneri 2a str. 301
caucaugaauauauaau

SEQ ID NO: 3922685 - RNA, 20 nt, Shigella flexneri 2a str. 301
caucaugcucagaugccuga

SEQ ID NO: 3922686 - RNA, 23 nt, Shigella flexneri 2a str. 301
caucaugcucagaugccugaugc

SEQ ID NO: 3922687 - RNA, 16 nt, Shigella flexneri 2a str. 301
caucaugcugccgggc

SEQ ID NO: 3922688 - RNA, 22 nt, Shigella flexneri 2a str. 301
caucauggcgaugagaaucagu

SEQ ID NO: 3922689 - RNA, 20 nt, Shigella flexneri 2a str. 301
caucaugucgcccacgccag

SEQ ID NO: 3922690 - RNA, 14 nt, Shigella flexneri 2a str. 301
caucauucccgccc

SEQ ID NO: 3922691 - RNA, 24 nt, Shigella flexneri 2a str. 301
caucauucgccgcuuaccauaacg

SEQ ID NO: 3922692 - RNA, 13 nt, Shigella flexneri 2a str. 301
caucauugcaguc

SEQ ID NO: 3922693 - RNA, 17 nt, Shigella flexneri 2a str. 301
caucauuuaaaaagaaa

SEQ ID NO: 3922694 - RNA, 17 nt, Shigella flexneri 2a str. 301
caucauuuuuucaccaa

SEQ ID NO: 3922695 - RNA, 18 nt, Shigella flexneri 2a str. 301
cauccaaaucgcccagca

SEQ ID NO: 3922696 - RNA, 19 nt, Shigella flexneri 2a str. 301
cauccaaaucgcccagcaa

SEQ ID NO: 3922697 - RNA, 14 nt, Shigella flexneri 2a str. 301
cauccaacaauagu

SEQ ID NO: 3922698 - RNA, 13 nt, Shigella flexneri 2a str. 301
caucgccagaaau

SEQ ID NO: 3922699 - RNA, 23 nt, Shigella flexneri 2a str. 301
caucgccagaacuacccgguucg

SEQ ID NO: 3922700 - RNA, 15 nt, Shigella flexneri 2a str. 301
caucgccagcagcca

SEQ ID NO: 3922701 - RNA, 21 nt, Shigella flexneri 2a str. 301
caucgccagcgaauuccaguu

SEQ ID NO: 3922702 - RNA, 16 nt, Shigella flexneri 2a str. 301
caucgccagcucaagg

SEQ ID NO: 3922703 - RNA, 20 nt, Shigella flexneri 2a str. 301
caucgccauaauaagcgcca

SEQ ID NO: 3922704 - RNA, 21 nt, Shigella flexneri 2a str. 301
caucgcccaguugaucaccag

SEQ ID NO: 3922705 - RNA, 23 nt, Shigella flexneri 2a str. 301
caucgcccaguugaucaccagug

SEQ ID NO: 3922706 - RNA, 14 nt, Shigella flexneri 2a str. 301
caucgcccugaugg

SEQ ID NO: 3922707 - RNA, 21 nt, Shigella flexneri 2a str. 301
caucgcccugauggcgcgcca

SEQ ID NO: 3922708 - RNA, 23 nt, Shigella flexneri 2a str. 301
caucgcccugauggcgcgccacc

SEQ ID NO: 3922709 - RNA, 23 nt, Shigella flexneri 2a str. 301
caucgccgguaaaaaugcgcagu

SEQ ID NO: 3922710 - RNA, 18 nt, Shigella flexneri 2a str. 301
caucgccugaucgcgcag

SEQ ID NO: 3922711 - RNA, 19 nt, Shigella flexneri 2a str. 301
caucgccugaucgcgcagu

SEQ ID NO: 3922712 - RNA, 16 nt, Shigella flexneri 2a str. 301
caucgccuuccagcga

SEQ ID NO: 3922713 - RNA, 14 nt, Shigella flexneri 2a str. 301
caucgccuucuuga

SEQ ID NO: 3922714 - RNA, 15 nt, Shigella flexneri 2a str. 301
caucgcgaccaauca

SEQ ID NO: 3922715 - RNA, 15 nt, Shigella flexneri 2a str. 301
caucgcgccaacaaa

SEQ ID NO: 3922716 - RNA, 19 nt, Shigella flexneri 2a str. 301
caucgcgcccaaaccaccc

SEQ ID NO: 3922717 - RNA, 18 nt, Shigella flexneri 2a str. 301
caucgcgcccgccgccau

SEQ ID NO: 3922718 - RNA, 13 nt, Shigella flexneri 2a str. 301
caucgcgcuggug

SEQ ID NO: 3922719 - RNA, 23 nt, Shigella flexneri 2a str. 301
caucgcgcuuaucgccagcgcca

SEQ ID NO: 3922720 - RNA, 16 nt, Shigella flexneri 2a str. 301
caucgcggucagcugc

SEQ ID NO: 3922721 - RNA, 15 nt, Shigella flexneri 2a str. 301
caucgcuacaccaau

SEQ ID NO: 3922722 - RNA, 20 nt, Shigella flexneri 2a str. 301
caucgcuacaccaaucguca

SEQ ID NO: 3922723 - RNA, 23 nt, Shigella flexneri 2a str. 301
caucgcugauuucaccaucuuca

SEQ ID NO: 3922724 - RNA, 19 nt, Shigella flexneri 2a str. 301
caucgcuucaugcccgcca

SEQ ID NO: 3922725 - RNA, 19 nt, Shigella flexneri 2a str. 301
caucggauugcuccugcuc

SEQ ID NO: 3922726 - RNA, 22 nt, Shigella flexneri 2a str. 301
caucggcaaucacaucaccaua

SEQ ID NO: 3922727 - RNA, 20 nt, Shigella flexneri 2a str. 301
caucggcagcgccaaucgcu

SEQ ID NO: 3922728 - RNA, 22 nt, Shigella flexneri 2a str. 301
caucggcauacagcgacagacg

SEQ ID NO: 3922729 - RNA, 13 nt, Shigella flexneri 2a str. 301
caucggcaucaaa

SEQ ID NO: 3922730 - RNA, 15 nt, Shigella flexneri 2a str. 301
caucggcauuaaucu

SEQ ID NO: 3922731 - RNA, 14 nt, Shigella flexneri 2a str. 301
caucggcgcuggcg

SEQ ID NO: 3922732 - RNA, 12 nt, Shigella flexneri 2a str. 301
caucggcggcgu

SEQ ID NO: 3922733 - RNA, 20 nt, Shigella flexneri 2a str. 301
caucggcggugaccagcagc

SEQ ID NO: 3922734 - RNA, 21 nt, Shigella flexneri 2a str. 301
caucggcggugaccagcagca

SEQ ID NO: 3922735 - RNA, 19 nt, Shigella flexneri 2a str. 301
caucggcuaaaccaucagg

SEQ ID NO: 3922736 - RNA, 20 nt, Shigella flexneri 2a str. 301
caucggcuuauucauaucaa

SEQ ID NO: 3922737 - RNA, 23 nt, Shigella flexneri 2a str. 301
caucggcuuuggcaaauggcgcu

SEQ ID NO: 3922738 - RNA, 13 nt, Shigella flexneri 2a str. 301
caucgggugcagu

SEQ ID NO: 3922739 - RNA, 15 nt, Shigella flexneri 2a str. 301
caucgguauaaccaa

SEQ ID NO: 3922740 - RNA, 19 nt, Shigella flexneri 2a str. 301
caucggugaggaucaccag

SEQ ID NO: 3922741 - RNA, 20 nt, Shigella flexneri 2a str. 301
caucggugaggaucaccagu

SEQ ID NO: 3922742 - RNA, 15 nt, Shigella flexneri 2a str. 301
caucggugcuggccu

SEQ ID NO: 3922743 - RNA, 13 nt, Shigella flexneri 2a str. 301
caucgguuugcgc

SEQ ID NO: 3922744 - RNA, 13 nt, Shigella flexneri 2a str. 301
caucguaaagcug

SEQ ID NO: 3922745 - RNA, 15 nt, Shigella flexneri 2a str. 301
caucguauuucagac

SEQ ID NO: 3922746 - RNA, 16 nt, Shigella flexneri 2a str. 301
caucguauuucagacc

SEQ ID NO: 3922747 - RNA, 23 nt, Shigella flexneri 2a str. 301
caucgucaggggcauuuucaagu

SEQ ID NO: 3922748 - RNA, 15 nt, Shigella flexneri 2a str. 301
caucguccagcagca

SEQ ID NO: 3922749 - RNA, 23 nt, Shigella flexneri 2a str. 301
caucgucggccuuaaugcccacg

SEQ ID NO: 3922750 - RNA, 13 nt, Shigella flexneri 2a str. 301
caucgucuccaga

SEQ ID NO: 3922751 - RNA, 12 nt, Shigella flexneri 2a str. 301
caucgugcacca

SEQ ID NO: 3922752 - RNA, 19 nt, Shigella flexneri 2a str. 301
caucgugcucgcuuuccau

SEQ ID NO: 3922753 - RNA, 20 nt, Shigella flexneri 2a str. 301
caucguugacauuugcuuuu

SEQ ID NO: 3922754 - RNA, 19 nt, Shigella flexneri 2a str. 301
caucuacccgaugcaaaaa

SEQ ID NO: 3922755 - RNA, 17 nt, Shigella flexneri 2a str. 301
caucuaccgccagccag

SEQ ID NO: 3922756 - RNA, 17 nt, Shigella flexneri 2a str. 301
caucuacgcucucuuca

SEQ ID NO: 3922757 - RNA, 22 nt, Shigella flexneri 2a str. 301
caucuauagugaggcuauucca

SEQ ID NO: 3922758 - RNA, 15 nt, Shigella flexneri 2a str. 301
caucuauuauuguuu

SEQ ID NO: 3922759 - RNA, 20 nt, Shigella flexneri 2a str. 301
caucucaacuuucuuggcac

SEQ ID NO: 3922760 - RNA, 15 nt, Shigella flexneri 2a str. 301
caucucauccaucaa

SEQ ID NO: 3922761 - RNA, 14 nt, Shigella flexneri 2a str. 301
caucuccacaguca

SEQ ID NO: 3922762 - RNA, 19 nt, Shigella flexneri 2a str. 301
caucuccacagucaggcug

SEQ ID NO: 3922763 - RNA, 14 nt, Shigella flexneri 2a str. 301
caucuccagcugcu

SEQ ID NO: 3922764 - RNA, 23 nt, Shigella flexneri 2a str. 301
caucuccugcaacagguugcgcu

SEQ ID NO: 3922765 - RNA, 16 nt, Shigella flexneri 2a str. 301
caucuccuuacugccc

SEQ ID NO: 3922766 - RNA, 23 nt, Shigella flexneri 2a str. 301
caucuccuuacugcccccggcgu

SEQ ID NO: 3922767 - RNA, 17 nt, Shigella flexneri 2a str. 301
caucucgcgcucuucuu

SEQ ID NO: 3922768 - RNA, 18 nt, Shigella flexneri 2a str. 301
caucucgcgcucuucuuc

SEQ ID NO: 3922769 - RNA, 20 nt, Shigella flexneri 2a str. 301
caucucgcgcucuucuucgc

SEQ ID NO: 3922770 - RNA, 19 nt, Shigella flexneri 2a str. 301
caucucgcucaaaaaucca

SEQ ID NO: 3922771 - RNA, 16 nt, Shigella flexneri 2a str. 301
caucucuacagcgccc

SEQ ID NO: 3922772 - RNA, 22 nt, Shigella flexneri 2a str. 301
caucucugcaacgucuucccga

SEQ ID NO: 3922773 - RNA, 17 nt, Shigella flexneri 2a str. 301
caucucuucacgcuuug

SEQ ID NO: 3922774 - RNA, 14 nt, Shigella flexneri 2a str. 301
caucucuuccggca

SEQ ID NO: 3922775 - RNA, 22 nt, Shigella flexneri 2a str. 301
caucucuucuucaagccaggcu

SEQ ID NO: 3922776 - RNA, 23 nt, Shigella flexneri 2a str. 301
caucugaaacucgcguaaaucca

SEQ ID NO: 3922777 - RNA, 11 nt, Shigella flexneri 2a str. 301
caucugcccca

SEQ ID NO: 3922778 - RNA, 14 nt, Shigella flexneri 2a str. 301
caucugccccauug

SEQ ID NO: 3922779 - RNA, 17 nt, Shigella flexneri 2a str. 301
caucugccggaaccagc

SEQ ID NO: 3922780 - RNA, 16 nt, Shigella flexneri 2a str. 301
caucugccugauccug

SEQ ID NO: 3922781 - RNA, 13 nt, Shigella flexneri 2a str. 301
caucugcgccgcc

SEQ ID NO: 3922782 - RNA, 14 nt, Shigella flexneri 2a str. 301
caucugcgccgcca

SEQ ID NO: 3922783 - RNA, 16 nt, Shigella flexneri 2a str. 301
caucugcgccgccaau

SEQ ID NO: 3922784 - RNA, 17 nt, Shigella flexneri 2a str. 301
caucugcguggcgcgcg

SEQ ID NO: 3922785 - RNA, 20 nt, Shigella flexneri 2a str. 301
caucugcguggcgcgcguca

SEQ ID NO: 3922786 - RNA, 12 nt, Shigella flexneri 2a str. 301
caucugcuucaa

SEQ ID NO: 3922787 - RNA, 19 nt, Shigella flexneri 2a str. 301
caucugcuuuuaaccgcuu

SEQ ID NO: 3922788 - RNA, 13 nt, Shigella flexneri 2a str. 301
caucugcuuuuug

SEQ ID NO: 3922789 - RNA, 15 nt, Shigella flexneri 2a str. 301
caucuggcugacggu

SEQ ID NO: 3922790 - RNA, 23 nt, Shigella flexneri 2a str. 301
caucugucaguggacgauaagca

SEQ ID NO: 3922791 - RNA, 21 nt, Shigella flexneri 2a str. 301
caucuguucugccguccagcc

SEQ ID NO: 3922792 - RNA, 14 nt, Shigella flexneri 2a str. 301
caucuguucuuuua

SEQ ID NO: 3922793 - RNA, 17 nt, Shigella flexneri 2a str. 301
caucuuauugaucaucc

SEQ ID NO: 3922794 - RNA, 15 nt, Shigella flexneri 2a str. 301
caucuucaacugcca

SEQ ID NO: 3922795 - RNA, 19 nt, Shigella flexneri 2a str. 301
caucuucacacugaugaca

SEQ ID NO: 3922796 - RNA, 21 nt, Shigella flexneri 2a str. 301
caucuucacuguccgucagac

SEQ ID NO: 3922797 - RNA, 18 nt, Shigella flexneri 2a str. 301
caucuuccaccuggaacc

SEQ ID NO: 3922798 - RNA, 14 nt, Shigella flexneri 2a str. 301
cauggccuguguua

SEQ ID NO: 3922799 - RNA, 16 nt, Shigella flexneri 2a str. 301
cauggcgaauggcacg

SEQ ID NO: 3922800 - RNA, 16 nt, Shigella flexneri 2a str. 301
cauggcgcagcgauuc

SEQ ID NO: 3922801 - RNA, 17 nt, Shigella flexneri 2a str. 301
cauggcgcgacauggcg

SEQ ID NO: 3922802 - RNA, 17 nt, Shigella flexneri 2a str. 301
cauggcggcagcgugcc

SEQ ID NO: 3922803 - RNA, 21 nt, Shigella flexneri 2a str. 301
cauggcugacugucgcagcca

SEQ ID NO: 3922804 - RNA, 20 nt, Shigella flexneri 2a str. 301
caugggagaacgaugcugcu

SEQ ID NO: 3922805 - RNA, 19 nt, Shigella flexneri 2a str. 301
cauggggaugcugaaaaga

SEQ ID NO: 3922806 - RNA, 20 nt, Shigella flexneri 2a str. 301
caugggucacucaggccaaa

SEQ ID NO: 3922807 - RNA, 19 nt, Shigella flexneri 2a str. 301
caugggugccagauacaaa

SEQ ID NO: 3922808 - RNA, 15 nt, Shigella flexneri 2a str. 301
caugguaaaaccgac

SEQ ID NO: 3922809 - RNA, 13 nt, Shigella flexneri 2a str. 301
cauggugcacauu

SEQ ID NO: 3922810 - RNA, 23 nt, Shigella flexneri 2a str. 301
cauggugcacauugcggacuucc

SEQ ID NO: 3922811 - RNA, 13 nt, Shigella flexneri 2a str. 301
cauggugucacca

SEQ ID NO: 3922812 - RNA, 15 nt, Shigella flexneri 2a str. 301
cauggugucugauga

SEQ ID NO: 3922813 - RNA, 14 nt, Shigella flexneri 2a str. 301
caugguguucagau

SEQ ID NO: 3922814 - RNA, 21 nt, Shigella flexneri 2a str. 301
caugguuggccaucguaugau

SEQ ID NO: 3922815 - RNA, 17 nt, Shigella flexneri 2a str. 301
caugguuugcauccaca

SEQ ID NO: 3922816 - RNA, 21 nt, Shigella flexneri 2a str. 301
caugguuuggaucuguugcug

SEQ ID NO: 3922817 - RNA, 20 nt, Shigella flexneri 2a str. 301
cauguaccguugcugccagu

SEQ ID NO: 3922818 - RNA, 20 nt, Shigella flexneri 2a str. 301
cauguacgcguucaaucaaa

SEQ ID NO: 3922819 - RNA, 17 nt, Shigella flexneri 2a str. 301
cauguagccgcuuuuuc

SEQ ID NO: 3922820 - RNA, 18 nt, Shigella flexneri 2a str. 301
cauguagccgcuuuuucu

SEQ ID NO: 3922821 - RNA, 23 nt, Shigella flexneri 2a str. 301
cauguaggaguugcggcuguaau

SEQ ID NO: 3922822 - RNA, 11 nt, Shigella flexneri 2a str. 301
caugucaucaa

SEQ ID NO: 3922823 - RNA, 12 nt, Shigella flexneri 2a str. 301
cauguccagcuu

SEQ ID NO: 3922824 - RNA, 15 nt, Shigella flexneri 2a str. 301
cauguccgcggccuu

SEQ ID NO: 3922825 - RNA, 17 nt, Shigella flexneri 2a str. 301
caugucgguacagagca

SEQ ID NO: 3922826 - RNA, 20 nt, Shigella flexneri 2a str. 301
caugucgguuguacaaaaaa

SEQ ID NO: 3922827 - RNA, 22 nt, Shigella flexneri 2a str. 301
caugucgguuguacaaaaaaug

SEQ ID NO: 3922828 - RNA, 19 nt, Shigella flexneri 2a str. 301
caugugggcugccccagcc

SEQ ID NO: 3922829 - RNA, 16 nt, Shigella flexneri 2a str. 301
cauguuaaauuccggc

SEQ ID NO: 3922830 - RNA, 18 nt, Shigella flexneri 2a str. 301
cauguuaaauuccggcuc

SEQ ID NO: 3922831 - RNA, 13 nt, Shigella flexneri 2a str. 301
cauguucaaaaaa

SEQ ID NO: 3922832 - RNA, 12 nt, Shigella flexneri 2a str. 301
cauguucaucaa

SEQ ID NO: 3922833 - RNA, 18 nt, Shigella flexneri 2a str. 301
cauguuccugccagucuu

SEQ ID NO: 3922834 - RNA, 15 nt, Shigella flexneri 2a str. 301
cauguugaucgccac

SEQ ID NO: 3922835 - RNA, 13 nt, Shigella flexneri 2a str. 301
cauguugccuggg

SEQ ID NO: 3922836 - RNA, 16 nt, Shigella flexneri 2a str. 301
cauguugcgcagaguu

SEQ ID NO: 3922837 - RNA, 14 nt, Shigella flexneri 2a str. 301
cauguugcugaccu

SEQ ID NO: 3922838 - RNA, 15 nt, Shigella flexneri 2a str. 301
cauguugcugaccuu

SEQ ID NO: 3922839 - RNA, 18 nt, Shigella flexneri 2a str. 301
cauguuguacaugcugcu

SEQ ID NO: 3922840 - RNA, 18 nt, Shigella flexneri 2a str. 301
cauguuuaccaucugcgc

SEQ ID NO: 3922841 - RNA, 20 nt, Shigella flexneri 2a str. 301
cauuaaaacugauacgucau

SEQ ID NO: 3922842 - RNA, 16 nt, Shigella flexneri 2a str. 301
cauuaaaauucuuacg

SEQ ID NO: 3922843 - RNA, 15 nt, Shigella flexneri 2a str. 301
cauuaaacaccagua

SEQ ID NO: 3922844 - RNA, 15 nt, Shigella flexneri 2a str. 301
cauuaaaguuaucgc

SEQ ID NO: 3922845 - RNA, 14 nt, Shigella flexneri 2a str. 301
cauuaaauccugaa

SEQ ID NO: 3922846 - RNA, 20 nt, Shigella flexneri 2a str. 301
cauuaaauccugaaaccaua

SEQ ID NO: 3922847 - RNA, 22 nt, Shigella flexneri 2a str. 301
cauuaaauccugaaaccauagc

SEQ ID NO: 3922848 - RNA, 16 nt, Shigella flexneri 2a str. 301
cauuaacaggccaaau

SEQ ID NO: 3922849 - RNA, 18 nt, Shigella flexneri 2a str. 301
cauuaacaggugucacau

SEQ ID NO: 3922850 - RNA, 15 nt, Shigella flexneri 2a str. 301
cauuaaccaaccacc

SEQ ID NO: 3922851 - RNA, 15 nt, Shigella flexneri 2a str. 301
cauuaaccagccacu

SEQ ID NO: 3922852 - RNA, 22 nt, Shigella flexneri 2a str. 301
cauuaaccagccacugcgccau

SEQ ID NO: 3922853 - RNA, 22 nt, Shigella flexneri 2a str. 301
cauuaaccgugcgggcaucauc

SEQ ID NO: 3922854 - RNA, 19 nt, Shigella flexneri 2a str. 301
cauuaaccguuuacgucau

SEQ ID NO: 3922855 - RNA, 17 nt, Shigella flexneri 2a str. 301
cauuaacgccccaauca

SEQ ID NO: 3922856 - RNA, 18 nt, Shigella flexneri 2a str. 301
cauuaagaacuccagccc

SEQ ID NO: 3922857 - RNA, 13 nt, Shigella flexneri 2a str. 301
cauuaagaugcau

SEQ ID NO: 3922858 - RNA, 21 nt, Shigella flexneri 2a str. 301
cauuaagauuaccuuccucaa

SEQ ID NO: 3922859 - RNA, 19 nt, Shigella flexneri 2a str. 301
cauuaagggugaucagccc

SEQ ID NO: 3922860 - RNA, 17 nt, Shigella flexneri 2a str. 301
cauuaaggucauaucuu

SEQ ID NO: 3922861 - RNA, 21 nt, Shigella flexneri 2a str. 301
cauuaaucgauaaaccagcaa

SEQ ID NO: 3922862 - RNA, 16 nt, Shigella flexneri 2a str. 301
cauuaaucugcucggc

SEQ ID NO: 3922863 - RNA, 20 nt, Shigella flexneri 2a str. 301
cauuaaugcacuuccagcgg

SEQ ID NO: 3922864 - RNA, 12 nt, Shigella flexneri 2a str. 301
cauuacaacaag

SEQ ID NO: 3922865 - RNA, 17 nt, Shigella flexneri 2a str. 301
cauuacaagaaucaugc

SEQ ID NO: 3922866 - RNA, 16 nt, Shigella flexneri 2a str. 301
cauuacaagcccgcug

SEQ ID NO: 3922867 - RNA, 18 nt, Shigella flexneri 2a str. 301
cauuacaagcccgcugcc

SEQ ID NO: 3922868 - RNA, 19 nt, Shigella flexneri 2a str. 301
cauuacaccaauaccgccc

SEQ ID NO: 3922869 - RNA, 13 nt, Shigella flexneri 2a str. 301
cauuacagcgacu

SEQ ID NO: 3922870 - RNA, 14 nt, Shigella flexneri 2a str. 301
cauuaccacgauuu

SEQ ID NO: 3922871 - RNA, 22 nt, Shigella flexneri 2a str. 301
cauuacccaggaagaccugcag

SEQ ID NO: 3922872 - RNA, 14 nt, Shigella flexneri 2a str. 301
cauuaccgaacaac

SEQ ID NO: 3922873 - RNA, 15 nt, Shigella flexneri 2a str. 301
cauuaccgaacaaca

SEQ ID NO: 3922874 - RNA, 17 nt, Shigella flexneri 2a str. 301
cauuacgccagucacgg

SEQ ID NO: 3922875 - RNA, 14 nt, Shigella flexneri 2a str. 301
cauuacgcgccccu

SEQ ID NO: 3922876 - RNA, 24 nt, Shigella flexneri 2a str. 301
cauuacuacgguaauacaaccugc

SEQ ID NO: 3922877 - RNA, 15 nt, Shigella flexneri 2a str. 301
cauuacuuacacauc

SEQ ID NO: 3922878 - RNA, 17 nt, Shigella flexneri 2a str. 301
cauuagccauugagaua

SEQ ID NO: 3922879 - RNA, 11 nt, Shigella flexneri 2a str. 301
cauuagcccaa

SEQ ID NO: 3922880 - RNA, 15 nt, Shigella flexneri 2a str. 301
cauuaggccauuuga

SEQ ID NO: 3922881 - RNA, 13 nt, Shigella flexneri 2a str. 301
cauuagucacaaa

SEQ ID NO: 3922882 - RNA, 14 nt, Shigella flexneri 2a str. 301
cauuagugauuaac

SEQ ID NO: 3922883 - RNA, 18 nt, Shigella flexneri 2a str. 301
cauuauauaaugccaggc

SEQ ID NO: 3922884 - RNA, 14 nt, Shigella flexneri 2a str. 301
cauuaucaaacgug

SEQ ID NO: 3922885 - RNA, 23 nt, Shigella flexneri 2a str. 301
cauuaucacaucagcgcauuuac

SEQ ID NO: 3922886 - RNA, 12 nt, Shigella flexneri 2a str. 301
cauuauccagcg

SEQ ID NO: 3922887 - RNA, 18 nt, Shigella flexneri 2a str. 301
cauuaugagugaugugcu

SEQ ID NO: 3922888 - RNA, 20 nt, Shigella flexneri 2a str. 301
cauuauuaaacagacaguaa

SEQ ID NO: 3922889 - RNA, 16 nt, Shigella flexneri 2a str. 301
cauuauuaaauuuaau

SEQ ID NO: 3922890 - RNA, 21 nt, Shigella flexneri 2a str. 301
cauuauuaaauuuaauaauaa

SEQ ID NO: 3922891 - RNA, 15 nt, Shigella flexneri 2a str. 301
cauuauucaggcacu

SEQ ID NO: 3922892 - RNA, 22 nt, Shigella flexneri 2a str. 301
cauuauucauuguucucccaua

SEQ ID NO: 3922893 - RNA, 14 nt, Shigella flexneri 2a str. 301
cauuauugcgcaca

SEQ ID NO: 3922894 - RNA, 12 nt, Shigella flexneri 2a str. 301
cauucaaacaug

SEQ ID NO: 3922895 - RNA, 19 nt, Shigella flexneri 2a str. 301
cauucaacuuaagucucca

SEQ ID NO: 3922896 - RNA, 17 nt, Shigella flexneri 2a str. 301
cauucaagauugcagga

SEQ ID NO: 3922897 - RNA, 21 nt, Shigella flexneri 2a str. 301
cauucaauacucgcacuaucg

SEQ ID NO: 3922898 - RNA, 23 nt, Shigella flexneri 2a str. 301
cauuucaaucaucucucgcauca

SEQ ID NO: 3922899 - RNA, 16 nt, Shigella flexneri 2a str. 301
cauuucacucacgccg

SEQ ID NO: 3922900 - RNA, 20 nt, Shigella flexneri 2a str. 301
cauuucagaaaguauauaaa

SEQ ID NO: 3922901 - RNA, 19 nt, Shigella flexneri 2a str. 301
cauuucauauucaaaaucc

SEQ ID NO: 3922902 - RNA, 17 nt, Shigella flexneri 2a str. 301
cauuucaucggcuagua

SEQ ID NO: 3922903 - RNA, 15 nt, Shigella flexneri 2a str. 301
cauuuccaagauuaa

SEQ ID NO: 3922904 - RNA, 15 nt, Shigella flexneri 2a str. 301
cauuucccagcaaga

SEQ ID NO: 3922905 - RNA, 16 nt, Shigella flexneri 2a str. 301
cauuucccccuuccug

SEQ ID NO: 3922906 - RNA, 17 nt, Shigella flexneri 2a str. 301
cauuucccccuuccugc

SEQ ID NO: 3922907 - RNA, 16 nt, Shigella flexneri 2a str. 301
cauuucccggaauaau

SEQ ID NO: 3922908 - RNA, 17 nt, Shigella flexneri 2a str. 301
cauuuccgcugauucaa

SEQ ID NO: 3922909 - RNA, 14 nt, Shigella flexneri 2a str. 301
cauuucgucuucau

SEQ ID NO: 3922910 - RNA, 23 nt, Shigella flexneri 2a str. 301
cauuucgugcggguaaccagcca

SEQ ID NO: 3922911 - RNA, 19 nt, Shigella flexneri 2a str. 301
cauuucuccagcaguucua

SEQ ID NO: 3922912 - RNA, 19 nt, Shigella flexneri 2a str. 301
cauuucucgguauuacaau

SEQ ID NO: 3922913 - RNA, 21 nt, Shigella flexneri 2a str. 301
cauuucugcgcaacuuguugu

SEQ ID NO: 3922914 - RNA, 14 nt, Shigella flexneri 2a str. 301
cauuugauucacaa

SEQ ID NO: 3922915 - RNA, 14 nt, Shigella flexneri 2a str. 301
cauuugcaccgauu

SEQ ID NO: 3922916 - RNA, 23 nt, Shigella flexneri 2a str. 301
cauuugcacugaaugccggaugc

SEQ ID NO: 3922917 - RNA, 21 nt, Shigella flexneri 2a str. 301
cauuugccgggguugugagca

SEQ ID NO: 3922918 - RNA, 16 nt, Shigella flexneri 2a str. 301
cauuugcuccagacgc

SEQ ID NO: 3922919 - RNA, 19 nt, Shigella flexneri 2a str. 301
cauuugcuccagacgccag

SEQ ID NO: 3922920 - RNA, 19 nt, Shigella flexneri 2a str. 301
cauuugcuugccggaagca

SEQ ID NO: 3922921 - RNA, 15 nt, Shigella flexneri 2a str. 301
cauuugugacauuaa

SEQ ID NO: 3922922 - RNA, 13 nt, Shigella flexneri 2a str. 301
cauuuguucuuuu

SEQ ID NO: 3922923 - RNA, 19 nt, Shigella flexneri 2a str. 301
cauuuuacguugcauuucc

SEQ ID NO: 3922924 - RNA, 21 nt, Shigella flexneri 2a str. 301
cauuuucauccauuaccaguc

SEQ ID NO: 3922925 - RNA, 21 nt, Shigella flexneri 2a str. 301
cauuuucucgcgaaccgccug

SEQ ID NO: 3922926 - RNA, 23 nt, Shigella flexneri 2a str. 301
cauuuucucgcgaaccgccuggc

SEQ ID NO: 3922927 - RNA, 23 nt, Shigella flexneri 2a str. 301
cauuuucucgcggacugccuggc

SEQ ID NO: 3922928 - RNA, 17 nt, Shigella flexneri 2a str. 301
cauuuucugcccauuua

SEQ ID NO: 3922929 - RNA, 19 nt, Shigella flexneri 2a str. 301
cauuuugagggaaacggag

SEQ ID NO: 3922930 - RNA, 15 nt, Shigella flexneri 2a str. 301
cauuuugcacauucc

SEQ ID NO: 3922931 - RNA, 18 nt, Shigella flexneri 2a str. 301
cauuuuggacaaugcagu

SEQ ID NO: 3922932 - RNA, 15 nt, Shigella flexneri 2a str. 301
cauuuuguuauuuau

SEQ ID NO: 3922933 - RNA, 22 nt, Shigella flexneri 2a str. 301
cauuuuuacuccuuagcaacag

SEQ ID NO: 3922934 - RNA, 15 nt, Shigella flexneri 2a str. 301
cauuuuuacugcgcg

SEQ ID NO: 3922935 - RNA, 15 nt, Shigella flexneri 2a str. 301
cauuuuucacugcgg

SEQ ID NO: 3922936 - RNA, 16 nt, Shigella flexneri 2a str. 301
cauuuuucagacguuc

SEQ ID NO: 3922937 - RNA, 20 nt, Shigella flexneri 2a str. 301
cauuuuucagcguuccccag

SEQ ID NO: 3922938 - RNA, 22 nt, Shigella flexneri 2a str. 301
cauuuuuucacauguucauuua

SEQ ID NO: 3922939 - RNA, 12 nt, Shigella flexneri 2a str. 301
ccaaaaaaauaa

SEQ ID NO: 3922940 - RNA, 20 nt, Shigella flexneri 2a str. 301
ccaaaaagaaccugaacgcc

SEQ ID NO: 3922941 - RNA, 14 nt, Shigella flexneri 2a str. 301
ccaaaacagcgaca

SEQ ID NO: 3922942 - RNA, 12 nt, Shigella flexneri 2a str. 301
ccaaaaccgcuc

SEQ ID NO: 3922943 - RNA, 13 nt, Shigella flexneri 2a str. 301
ccaaaagguccuu

SEQ ID NO: 3922944 - RNA, 13 nt, Shigella flexneri 2a str. 301
ccaaaauaaaaau

SEQ ID NO: 3922945 - RNA, 23 nt, Shigella flexneri 2a str. 301
ccaaaauugguuucagccggauc

SEQ ID NO: 3922946 - RNA, 11 nt, Shigella flexneri 2a str. 301
ccaaacagcag

SEQ ID NO: 3922947 - RNA, 16 nt, Shigella flexneri 2a str. 301
ccaaaccgacugccug

SEQ ID NO: 3922948 - RNA, 12 nt, Shigella flexneri 2a str. 301
ccaaaccugcac

SEQ ID NO: 3922949 - RNA, 23 nt, Shigella flexneri 2a str. 301
ccaaacgccggaugcaaaaaaaa

SEQ ID NO: 3922950 - RNA, 15 nt, Shigella flexneri 2a str. 301
ccaaacgcucccugc

SEQ ID NO: 3922951 - RNA, 17 nt, Shigella flexneri 2a str. 301
ccaaacgcucccugcca

SEQ ID NO: 3922952 - RNA, 17 nt, Shigella flexneri 2a str. 301
ccaaacguggucgccag

SEQ ID NO: 3922953 - RNA, 19 nt, Shigella flexneri 2a str. 301
ccaaacuggaacugaaagg

SEQ ID NO: 3922954 - RNA, 15 nt, Shigella flexneri 2a str. 301
ccaaacuuaacacug

SEQ ID NO: 3922955 - RNA, 13 nt, Shigella flexneri 2a str. 301
ccaaagaaaucag

SEQ ID NO: 3922956 - RNA, 21 nt, Shigella flexneri 2a str. 301
ccaaagaccaggaaacccaac

SEQ ID NO: 3922957 - RNA, 16 nt, Shigella flexneri 2a str. 301
ccaaagcagaguugcu

SEQ ID NO: 3922958 - RNA, 16 nt, Shigella flexneri 2a str. 301
ccaaagccuuucacuu

SEQ ID NO: 3922959 - RNA, 22 nt, Shigella flexneri 2a str. 301
ccaaaggcgaguucaaucaacu

SEQ ID NO: 3922960 - RNA, 22 nt, Shigella flexneri 2a str. 301
ccaaaguacggacgcggcauuu

SEQ ID NO: 3922961 - RNA, 21 nt, Shigella flexneri 2a str. 301
ccaaagugacacaaucaaauc

SEQ ID NO: 3922962 - RNA, 17 nt, Shigella flexneri 2a str. 301
ccaaauacauugauaua

SEQ ID NO: 3922963 - RNA, 18 nt, Shigella flexneri 2a str. 301
ccaaauauccgcgcuaag

SEQ ID NO: 3922964 - RNA, 20 nt, Shigella flexneri 2a str. 301
ccaaaucauccagaccgcuc

SEQ ID NO: 3922965 - RNA, 19 nt, Shigella flexneri 2a str. 301
ccaaauccuuccagcucca

SEQ ID NO: 3922966 - RNA, 21 nt, Shigella flexneri 2a str. 301
ccaaaucgauaaaacuucccg

SEQ ID NO: 3922967 - RNA, 19 nt, Shigella flexneri 2a str. 301
ccaaaucgccauauccgca

SEQ ID NO: 3922968 - RNA, 18 nt, Shigella flexneri 2a str. 301
ccaaaucgcugcugcuca

SEQ ID NO: 3922969 - RNA, 16 nt, Shigella flexneri 2a str. 301
ccaaaugucaccagcc

SEQ ID NO: 3922970 - RNA, 15 nt, Shigella flexneri 2a str. 301
ccaaauuuaaacgac

SEQ ID NO: 3922971 - RNA, 20 nt, Shigella flexneri 2a str. 301
ccaaauuuggugcucaguuu

SEQ ID NO: 3922972 - RNA, 14 nt, Shigella flexneri 2a str. 301
ccaacaaauagaga

SEQ ID NO: 3922973 - RNA, 22 nt, Shigella flexneri 2a str. 301
ccaacaaauggaaggucacgcc

SEQ ID NO: 3922974 - RNA, 14 nt, Shigella flexneri 2a str. 301
ccaacaauaaaauu

SEQ ID NO: 3922975 - RNA, 17 nt, Shigella flexneri 2a str. 301
ccaacaauagugccgca

SEQ ID NO: 3922976 - RNA, 17 nt, Shigella flexneri 2a str. 301
ccaacaaugcaaaauag

SEQ ID NO: 3922977 - RNA, 16 nt, Shigella flexneri 2a str. 301
ccaacaauugucgcca

SEQ ID NO: 3922978 - RNA, 15 nt, Shigella flexneri 2a str. 301
ccaacagcgacauca

SEQ ID NO: 3922979 - RNA, 17 nt, Shigella flexneri 2a str. 301
ccaacaucgaaaacgcc

SEQ ID NO: 3922980 - RNA, 22 nt, Shigella flexneri 2a str. 301
ccaacaucgaaaacgccaccgc

SEQ ID NO: 3922981 - RNA, 21 nt, Shigella flexneri 2a str. 301
ccaacauucgagaagcccaua

SEQ ID NO: 3922982 - RNA, 20 nt, Shigella flexneri 2a str. 301
ccaaccacaugaucauucac

SEQ ID NO: 3922983 - RNA, 23 nt, Shigella flexneri 2a str. 301
ccaaccacggaguugaccagcuc

SEQ ID NO: 3922984 - RNA, 13 nt, Shigella flexneri 2a str. 301
ccaaccagcugac

SEQ ID NO: 3922985 - RNA, 14 nt, Shigella flexneri 2a str. 301
ccaaccauccccau

SEQ ID NO: 3922986 - RNA, 13 nt, Shigella flexneri 2a str. 301
ccaaccgccaccg

SEQ ID NO: 3922987 - RNA, 16 nt, Shigella flexneri 2a str. 301
ccaaccgcccugcggc

SEQ ID NO: 3922988 - RNA, 23 nt, Shigella flexneri 2a str. 301
ccaaccgcggcacguuccugcau

SEQ ID NO: 3922989 - RNA, 15 nt, Shigella flexneri 2a str. 301
ccaaccggcacaaua

SEQ ID NO: 3922990 - RNA, 16 nt, Shigella flexneri 2a str. 301
ccaaccggcacaauau

SEQ ID NO: 3922991 - RNA, 21 nt, Shigella flexneri 2a str. 301
ccaaccguggcguaaaucauc

SEQ ID NO: 3922992 - RNA, 14 nt, Shigella flexneri 2a str. 301
ccaaccuugcgccu

SEQ ID NO: 3922993 - RNA, 16 nt, Shigella flexneri 2a str. 301
ccaaccuuguuucuga

SEQ ID NO: 3922994 - RNA, 22 nt, Shigella flexneri 2a str. 301
ccaacgccccguaaaucgucag

SEQ ID NO: 3922995 - RNA, 15 nt, Shigella flexneri 2a str. 301
ccaacguaacaaaac

SEQ ID NO: 3922996 - RNA, 23 nt, Shigella flexneri 2a str. 301
ccaacguucaccacgacuucugu

SEQ ID NO: 3922997 - RNA, 19 nt, Shigella flexneri 2a str. 301
ccaacguucguacugcccu

SEQ ID NO: 3922998 - RNA, 18 nt, Shigella flexneri 2a str. 301
ccacaguugaucagccag

SEQ ID NO: 3922999 - RNA, 17 nt, Shigella flexneri 2a str. 301
ccacaguuucagcccca

SEQ ID NO: 3923000 - RNA, 14 nt, Shigella flexneri 2a str. 301
ccacaguuucauau

SEQ ID NO: 3923001 - RNA, 23 nt, Shigella flexneri 2a str. 301
ccacaguuucauaucugccagau

SEQ ID NO: 3923002 - RNA, 19 nt, Shigella flexneri 2a str. 301
ccacaguuuuacugcagcc

SEQ ID NO: 3923003 - RNA, 15 nt, Shigella flexneri 2a str. 301
ccacaucaaucccuu

SEQ ID NO: 3923004 - RNA, 23 nt, Shigella flexneri 2a str. 301
ccacaucacuccauccagcaaca

SEQ ID NO: 3923005 - RNA, 12 nt, Shigella flexneri 2a str. 301
ccacaucagcgg

SEQ ID NO: 3923006 - RNA, 23 nt, Shigella flexneri 2a str. 301
ccacauccagcuuuuuaaucgcc

SEQ ID NO: 3923007 - RNA, 13 nt, Shigella flexneri 2a str. 301
ccacauccagugg

SEQ ID NO: 3923008 - RNA, 21 nt, Shigella flexneri 2a str. 301
ccacauccggcauauuaacca

SEQ ID NO: 3923009 - RNA, 13 nt, Shigella flexneri 2a str. 301
ccacauccggccu

SEQ ID NO: 3923010 - RNA, 16 nt, Shigella flexneri 2a str. 301
ccacauccggccuaua

SEQ ID NO: 3923011 - RNA, 13 nt, Shigella flexneri 2a str. 301
ccacauccggcuu

SEQ ID NO: 3923012 - RNA, 23 nt, Shigella flexneri 2a str. 301
ccacaucgguuugcgcagcuuug

SEQ ID NO: 3923013 - RNA, 15 nt, Shigella flexneri 2a str. 301
ccacaucuaccgcca

SEQ ID NO: 3923014 - RNA, 17 nt, Shigella flexneri 2a str. 301
ccacaugccugcauaaa

SEQ ID NO: 3923015 - RNA, 16 nt, Shigella flexneri 2a str. 301
ccacauuagauaaaaa

SEQ ID NO: 3923016 - RNA, 21 nt, Shigella flexneri 2a str. 301
ccacauuagauaaaaaugaag

SEQ ID NO: 3923017 - RNA, 23 nt, Shigella flexneri 2a str. 301
ccacauucagccguaacucaucc

SEQ ID NO: 3923018 - RNA, 15 nt, Shigella flexneri 2a str. 301
ccacauugcaucuga

SEQ ID NO: 3923019 - RNA, 15 nt, Shigella flexneri 2a str. 301
ccaccaaacugcgcc

SEQ ID NO: 3923020 - RNA, 14 nt, Shigella flexneri 2a str. 301
ccaccaaagauguc

SEQ ID NO: 3923021 - RNA, 13 nt, Shigella flexneri 2a str. 301
ccaccaauaauga

SEQ ID NO: 3923022 - RNA, 21 nt, Shigella flexneri 2a str. 301
ccaccaaugacguuaauaaaa

SEQ ID NO: 3923023 - RNA, 21 nt, Shigella flexneri 2a str. 301
ccaccacagacaaucgccagu

SEQ ID NO: 3923024 - RNA, 17 nt, Shigella flexneri 2a str. 301
ccaccacaucgcaaaau

SEQ ID NO: 3923025 - RNA, 14 nt, Shigella flexneri 2a str. 301
ccaccaccaccugc

SEQ ID NO: 3923026 - RNA, 12 nt, Shigella flexneri 2a str. 301
ccaccaccagac

SEQ ID NO: 3923027 - RNA, 17 nt, Shigella flexneri 2a str. 301
ccaccaccagcaauaau

SEQ ID NO: 3923028 - RNA, 14 nt, Shigella flexneri 2a str. 301
ccaccacccagcgc

SEQ ID NO: 3923029 - RNA, 13 nt, Shigella flexneri 2a str. 301
ccaccacgccaag

SEQ ID NO: 3923030 - RNA, 14 nt, Shigella flexneri 2a str. 301
ccaccacgccaaga

SEQ ID NO: 3923031 - RNA, 13 nt, Shigella flexneri 2a str. 301
ccaccacgcugua

SEQ ID NO: 3923032 - RNA, 13 nt, Shigella flexneri 2a str. 301
ccaccacugcaau

SEQ ID NO: 3923033 - RNA, 16 nt, Shigella flexneri 2a str. 301
ccaccagaaucgccag

SEQ ID NO: 3923034 - RNA, 17 nt, Shigella flexneri 2a str. 301
ccaccagaaucgccagc

SEQ ID NO: 3923035 - RNA, 19 nt, Shigella flexneri 2a str. 301
ccaccagaaucgccagcau

SEQ ID NO: 3923036 - RNA, 21 nt, Shigella flexneri 2a str. 301
ccaccagaaucgccagcaucg

SEQ ID NO: 3923037 - RNA, 23 nt, Shigella flexneri 2a str. 301
ccaccagacaaccgcucaacaaa

SEQ ID NO: 3923038 - RNA, 19 nt, Shigella flexneri 2a str. 301
ccaccagauggcuuuccac

SEQ ID NO: 3923039 - RNA, 16 nt, Shigella flexneri 2a str. 301
ccaccagcaacagcgc

SEQ ID NO: 3923040 - RNA, 13 nt, Shigella flexneri 2a str. 301
ccaccagcaccag

SEQ ID NO: 3923041 - RNA, 19 nt, Shigella flexneri 2a str. 301
ccaccagcaugaucagcgc

SEQ ID NO: 3923042 - RNA, 23 nt, Shigella flexneri 2a str. 301
ccaccagccccagaauucacgca

SEQ ID NO: 3923043 - RNA, 19 nt, Shigella flexneri 2a str. 301
ccaccagcggaauaucaga

SEQ ID NO: 3923044 - RNA, 13 nt, Shigella flexneri 2a str. 301
ccaccaggaacgc

SEQ ID NO: 3923045 - RNA, 16 nt, Shigella flexneri 2a str. 301
ccaccagguucaacag

SEQ ID NO: 3923046 - RNA, 23 nt, Shigella flexneri 2a str. 301
ccaccaguaccucuucgcuggca

SEQ ID NO: 3923047 - RNA, 9 nt, Shigella flexneri 2a str. 301
ccaccaguc

SEQ ID NO: 3923048 - RNA, 13 nt, Shigella flexneri 2a str. 301
ccaccaguccuuc

SEQ ID NO: 3923049 - RNA, 17 nt, Shigella flexneri 2a str. 301
ccaccaguccuucuacc

SEQ ID NO: 3923050 - RNA, 21 nt, Shigella flexneri 2a str. 301
ccaccagugcaggcaccagcc

SEQ ID NO: 3923051 - RNA, 17 nt, Shigella flexneri 2a str. 301
ccaccaguggacggcug

SEQ ID NO: 3923052 - RNA, 14 nt, Shigella flexneri 2a str. 301
ccaccauaagcccg

SEQ ID NO: 3923053 - RNA, 21 nt, Shigella flexneri 2a str. 301
ccaccauauucgccaccgcgc

SEQ ID NO: 3923054 - RNA, 22 nt, Shigella flexneri 2a str. 301
ccaccaugcuaauagcugcgcc

SEQ ID NO: 3923055 - RNA, 18 nt, Shigella flexneri 2a str. 301
ccaccauguucacugccg

SEQ ID NO: 3923056 - RNA, 18 nt, Shigella flexneri 2a str. 301
ccaccauuuugcuguuca

SEQ ID NO: 3923057 - RNA, 15 nt, Shigella flexneri 2a str. 301
ccacccaacgccacu

SEQ ID NO: 3923058 - RNA, 14 nt, Shigella flexneri 2a str. 301
ccacccagcagcgc

SEQ ID NO: 3923059 - RNA, 13 nt, Shigella flexneri 2a str. 301
ccacccagcaucu

SEQ ID NO: 3923060 - RNA, 20 nt, Shigella flexneri 2a str. 301
ccacccauguugaucgccac

SEQ ID NO: 3923061 - RNA, 14 nt, Shigella flexneri 2a str. 301
ccacccauuuuaau

SEQ ID NO: 3923062 - RNA, 22 nt, Shigella flexneri 2a str. 301
ccaccccacgauguauccggca

SEQ ID NO: 3923063 - RNA, 18 nt, Shigella flexneri 2a str. 301
ccaccccagacuuccccg

SEQ ID NO: 3923064 - RNA, 15 nt, Shigella flexneri 2a str. 301
ccacccgcagcaagc

SEQ ID NO: 3923065 - RNA, 17 nt, Shigella flexneri 2a str. 301
ccacccgcagcaagcgu

SEQ ID NO: 3923066 - RNA, 15 nt, Shigella flexneri 2a str. 301
ccacccugacgacca

SEQ ID NO: 3923067 - RNA, 13 nt, Shigella flexneri 2a str. 301
ccaccgaccaggc

SEQ ID NO: 3923068 - RNA, 17 nt, Shigella flexneri 2a str. 301
ccaccgacgcagucaug

SEQ ID NO: 3923069 - RNA, 16 nt, Shigella flexneri 2a str. 301
ccaccgaugaagaacu

SEQ ID NO: 3923070 - RNA, 16 nt, Shigella flexneri 2a str. 301
ccaccgaugaucaaca

SEQ ID NO: 3923071 - RNA, 16 nt, Shigella flexneri 2a str. 301
ccaccgauuuugagaa

SEQ ID NO: 3923072 - RNA, 21 nt, Shigella flexneri 2a str. 301
ccaccgcaauaaccaucagcu

SEQ ID NO: 3923073 - RNA, 16 nt, Shigella flexneri 2a str. 301
ccaccgcacuucuucc

SEQ ID NO: 3923074 - RNA, 12 nt, Shigella flexneri 2a str. 301
ccaccgcccguu

SEQ ID NO: 3923075 - RNA, 22 nt, Shigella flexneri 2a str. 301
ccaccgcgcguuugaucgacag

SEQ ID NO: 3923076 - RNA, 13 nt, Shigella flexneri 2a str. 301
ccaccgcucugcg

SEQ ID NO: 3923077 - RNA, 18 nt, Shigella flexneri 2a str. 301
ccaccggcaaucugcugg

SEQ ID NO: 3923078 - RNA, 16 nt, Shigella flexneri 2a str. 301
ccaccgguuuauuauu

SEQ ID NO: 3923079 - RNA, 18 nt, Shigella flexneri 2a str. 301
ccaccguuucuacaagca

SEQ ID NO: 3923080 - RNA, 15 nt, Shigella flexneri 2a str. 301
ccaccuacaccggca

SEQ ID NO: 3923081 - RNA, 18 nt, Shigella flexneri 2a str. 301
ccaccucauuaagaugca

SEQ ID NO: 3923082 - RNA, 20 nt, Shigella flexneri 2a str. 301
ccaccuccacgcccagcgca

SEQ ID NO: 3923083 - RNA, 22 nt, Shigella flexneri 2a str. 301
ccaccucccgucgcccacacca

SEQ ID NO: 3923084 - RNA, 23 nt, Shigella flexneri 2a str. 301
ccaccugaaauggucgccccgga

SEQ ID NO: 3923085 - RNA, 15 nt, Shigella flexneri 2a str. 301
ccaccugaccugcga

SEQ ID NO: 3923086 - RNA, 18 nt, Shigella flexneri 2a str. 301
ccaccugauugcugcugc

SEQ ID NO: 3923087 - RNA, 21 nt, Shigella flexneri 2a str. 301
ccaccuggccugggaucauca

SEQ ID NO: 3923088 - RNA, 12 nt, Shigella flexneri 2a str. 301
ccacgaaacugc

SEQ ID NO: 3923089 - RNA, 12 nt, Shigella flexneri 2a str. 301
ccacgaccgcag

SEQ ID NO: 3923090 - RNA, 16 nt, Shigella flexneri 2a str. 301
ccacgacguguuccug

SEQ ID NO: 3923091 - RNA, 15 nt, Shigella flexneri 2a str. 301
ccacgacuucugugg

SEQ ID NO: 3923092 - RNA, 12 nt, Shigella flexneri 2a str. 301
ccacgcaauaaa

SEQ ID NO: 3923093 - RNA, 18 nt, Shigella flexneri 2a str. 301
ccacgcacgccugcaucu

SEQ ID NO: 3923094 - RNA, 18 nt, Shigella flexneri 2a str. 301
ccacgccaauguguuuau

SEQ ID NO: 3923095 - RNA, 12 nt, Shigella flexneri 2a str. 301
ccacgccacagc

SEQ ID NO: 3923096 - RNA, 22 nt, Shigella flexneri 2a str. 301
ccacgccauagcggagcaauuu

SEQ ID NO: 3923097 - RNA, 24 nt, Shigella flexneri 2a str. 301
ccacgccgauaaucaacgcgccgc

SEQ ID NO: 3923098 - RNA, 12 nt, Shigella flexneri 2a str. 301
ccagacaaauga

SEQ ID NO: 3923099 - RNA, 23 nt, Shigella flexneri 2a str. 301
ccagacaaucgaaaaagaaucga

SEQ ID NO: 3923100 - RNA, 15 nt, Shigella flexneri 2a str. 301
ccagacacaguucuu

SEQ ID NO: 3923101 - RNA, 22 nt, Shigella flexneri 2a str. 301
ccagacacaguucuucaaaaau

SEQ ID NO: 3923102 - RNA, 15 nt, Shigella flexneri 2a str. 301
ccagacaccgcugcu

SEQ ID NO: 3923103 - RNA, 19 nt, Shigella flexneri 2a str. 301
ccagacagcacauuucaga

SEQ ID NO: 3923104 - RNA, 16 nt, Shigella flexneri 2a str. 301
ccagacaucaccagua

SEQ ID NO: 3923105 - RNA, 19 nt, Shigella flexneri 2a str. 301
ccagacaucaccaguaccg

SEQ ID NO: 3923106 - RNA, 22 nt, Shigella flexneri 2a str. 301
ccagacaucaccaguaccgcca

SEQ ID NO: 3923107 - RNA, 13 nt, Shigella flexneri 2a str. 301
ccagacaucccag

SEQ ID NO: 3923108 - RNA, 19 nt, Shigella flexneri 2a str. 301
ccagacauguggauuaaau

SEQ ID NO: 3923109 - RNA, 22 nt, Shigella flexneri 2a str. 301
ccagacauuauaaauucuggcc

SEQ ID NO: 3923110 - RNA, 15 nt, Shigella flexneri 2a str. 301
ccagaccaaacagca

SEQ ID NO: 3923111 - RNA, 14 nt, Shigella flexneri 2a str. 301
ccagaccaauagaa

SEQ ID NO: 3923112 - RNA, 20 nt, Shigella flexneri 2a str. 301
ccagacccaguuuugcgcgu

SEQ ID NO: 3923113 - RNA, 17 nt, Shigella flexneri 2a str. 301
ccagacccggcaagccu

SEQ ID NO: 3923114 - RNA, 20 nt, Shigella flexneri 2a str. 301
ccagaccggcaaucgcgcca

SEQ ID NO: 3923115 - RNA, 20 nt, Shigella flexneri 2a str. 301
ccagaccguggucagaaaag

SEQ ID NO: 3923116 - RNA, 12 nt, Shigella flexneri 2a str. 301
ccagaccugaau

SEQ ID NO: 3923117 - RNA, 16 nt, Shigella flexneri 2a str. 301
ccagaccugagcaucg

SEQ ID NO: 3923118 - RNA, 20 nt, Shigella flexneri 2a str. 301
ccagaccugcguucagcagu

SEQ ID NO: 3923119 - RNA, 15 nt, Shigella flexneri 2a str. 301
ccagaccuuaucaca

SEQ ID NO: 3923120 - RNA, 14 nt, Shigella flexneri 2a str. 301
ccagacgaauaaaa

SEQ ID NO: 3923121 - RNA, 16 nt, Shigella flexneri 2a str. 301
ccagacgagagugacg

SEQ ID NO: 3923122 - RNA, 16 nt, Shigella flexneri 2a str. 301
ccagacgcaacagaaa

SEQ ID NO: 3923123 - RNA, 22 nt, Shigella flexneri 2a str. 301
ccagacgcaacagaaacgccau

SEQ ID NO: 3923124 - RNA, 15 nt, Shigella flexneri 2a str. 301
ccagacgcagcaagg

SEQ ID NO: 3923125 - RNA, 20 nt, Shigella flexneri 2a str. 301
ccagacgccagaugcggcgu

SEQ ID NO: 3923126 - RNA, 13 nt, Shigella flexneri 2a str. 301
ccagacgccagcc

SEQ ID NO: 3923127 - RNA, 17 nt, Shigella flexneri 2a str. 301
ccagacgccagccacag

SEQ ID NO: 3923128 - RNA, 17 nt, Shigella flexneri 2a str. 301
ccagacgcgcagcuuca

SEQ ID NO: 3923129 - RNA, 18 nt, Shigella flexneri 2a str. 301
ccagacgcgcagcuucac

SEQ ID NO: 3923130 - RNA, 19 nt, Shigella flexneri 2a str. 301
ccagacgcgcagcuucacu

SEQ ID NO: 3923131 - RNA, 20 nt, Shigella flexneri 2a str. 301
ccagacgcgcagcuucacuu

SEQ ID NO: 3923132 - RNA, 22 nt, Shigella flexneri 2a str. 301
ccagacgcgcguccccugcccg

SEQ ID NO: 3923133 - RNA, 14 nt, Shigella flexneri 2a str. 301
ccagacgggcauuu

SEQ ID NO: 3923134 - RNA, 19 nt, Shigella flexneri 2a str. 301
ccagacguccggcgcugca

SEQ ID NO: 3923135 - RNA, 16 nt, Shigella flexneri 2a str. 301
ccagacguuucgccag

SEQ ID NO: 3923136 - RNA, 16 nt, Shigella flexneri 2a str. 301
ccagacucaacaggcc

SEQ ID NO: 3923137 - RNA, 21 nt, Shigella flexneri 2a str. 301
ccagacucgccagacgcaucg

SEQ ID NO: 3923138 - RNA, 18 nt, Shigella flexneri 2a str. 301
ccagacugcacauggcgg

SEQ ID NO: 3923139 - RNA, 14 nt, Shigella flexneri 2a str. 301
ccagacugcucagc

SEQ ID NO: 3923140 - RNA, 17 nt, Shigella flexneri 2a str. 301
ccagacuggagcacugc

SEQ ID NO: 3923141 - RNA, 15 nt, Shigella flexneri 2a str. 301
ccagagaauauuaac

SEQ ID NO: 3923142 - RNA, 14 nt, Shigella flexneri 2a str. 301
ccagagagaagcug

SEQ ID NO: 3923143 - RNA, 19 nt, Shigella flexneri 2a str. 301
ccagagagcggagcaauga

SEQ ID NO: 3923144 - RNA, 14 nt, Shigella flexneri 2a str. 301
ccagagccaccaac

SEQ ID NO: 3923145 - RNA, 16 nt, Shigella flexneri 2a str. 301
ccagagugaccgccaa

SEQ ID NO: 3923146 - RNA, 15 nt, Shigella flexneri 2a str. 301
ccagauaaauauuau

SEQ ID NO: 3923147 - RNA, 17 nt, Shigella flexneri 2a str. 301
ccagauaaauauuauug

SEQ ID NO: 3923148 - RNA, 17 nt, Shigella flexneri 2a str. 301
ccagauaaggcguucac

SEQ ID NO: 3923149 - RNA, 22 nt, Shigella flexneri 2a str. 301
ccagauaauauugauauccgca

SEQ ID NO: 3923150 - RNA, 18 nt, Shigella flexneri 2a str. 301
ccagauaaucaccugccu

SEQ ID NO: 3923151 - RNA, 18 nt, Shigella flexneri 2a str. 301
ccagauaaugagaaacac

SEQ ID NO: 3923152 - RNA, 17 nt, Shigella flexneri 2a str. 301
ccagauacaaaaaaggc

SEQ ID NO: 3923153 - RNA, 22 nt, Shigella flexneri 2a str. 301
ccagauagaacaucucuuccca

SEQ ID NO: 3923154 - RNA, 19 nt, Shigella flexneri 2a str. 301
ccagauagagccgguuuug

SEQ ID NO: 3923155 - RNA, 15 nt, Shigella flexneri 2a str. 301
ccagauagccagguu

SEQ ID NO: 3923156 - RNA, 20 nt, Shigella flexneri 2a str. 301
ccagauauuuuucaauccgc

SEQ ID NO: 3923157 - RNA, 15 nt, Shigella flexneri 2a str. 301
ccagaucagcuucac

SEQ ID NO: 3923158 - RNA, 17 nt, Shigella flexneri 2a str. 301
ccagaucccauaaccaa

SEQ ID NO: 3923159 - RNA, 18 nt, Shigella flexneri 2a str. 301
ccagauccugauccugca

SEQ ID NO: 3923160 - RNA, 14 nt, Shigella flexneri 2a str. 301
ccagaucgccugcc

SEQ ID NO: 3923161 - RNA, 15 nt, Shigella flexneri 2a str. 301
ccagaucgccugccg

SEQ ID NO: 3923162 - RNA, 18 nt, Shigella flexneri 2a str. 301
ccagaucgccugccgcca

SEQ ID NO: 3923163 - RNA, 20 nt, Shigella flexneri 2a str. 301
ccagaucgcucaucugcugc

SEQ ID NO: 3923164 - RNA, 17 nt, Shigella flexneri 2a str. 301
ccagaucggacuucaug

SEQ ID NO: 3923165 - RNA, 15 nt, Shigella flexneri 2a str. 301
ccagaucggucagug

SEQ ID NO: 3923166 - RNA, 18 nt, Shigella flexneri 2a str. 301
ccagauggcuuugcccuu

SEQ ID NO: 3923167 - RNA, 15 nt, Shigella flexneri 2a str. 301
ccagauguugucuca

SEQ ID NO: 3923168 - RNA, 18 nt, Shigella flexneri 2a str. 301
ccagauguugucucagau

SEQ ID NO: 3923169 - RNA, 21 nt, Shigella flexneri 2a str. 301
ccagauguugucucagcuuca

SEQ ID NO: 3923170 - RNA, 16 nt, Shigella flexneri 2a str. 301
ccagauuaaucagcag

SEQ ID NO: 3923171 - RNA, 20 nt, Shigella flexneri 2a str. 301
ccagauugccgauauaaacc

SEQ ID NO: 3923172 - RNA, 21 nt, Shigella flexneri 2a str. 301
ccagauugugaaucgccugga

SEQ ID NO: 3923173 - RNA, 18 nt, Shigella flexneri 2a str. 301
ccagauuuauaaaagaaa

SEQ ID NO: 3923174 - RNA, 18 nt, Shigella flexneri 2a str. 301
ccagauuuuucaguauuu

SEQ ID NO: 3923175 - RNA, 14 nt, Shigella flexneri 2a str. 301
ccagcaaacaggug

SEQ ID NO: 3923176 - RNA, 14 nt, Shigella flexneri 2a str. 301
ccagcaaauccagc

SEQ ID NO: 3923177 - RNA, 14 nt, Shigella flexneri 2a str. 301
ccagcaaaucccag

SEQ ID NO: 3923178 - RNA, 13 nt, Shigella flexneri 2a str. 301
ccagcaacaaaua

SEQ ID NO: 3923179 - RNA, 20 nt, Shigella flexneri 2a str. 301
ccagcaacaaauaaccgccu

SEQ ID NO: 3923180 - RNA, 14 nt, Shigella flexneri 2a str. 301
ccagcaacaacagc

SEQ ID NO: 3923181 - RNA, 16 nt, Shigella flexneri 2a str. 301
ccagcaacaacagcgc

SEQ ID NO: 3923182 - RNA, 17 nt, Shigella flexneri 2a str. 301
ccagcaacaacagcgcg

SEQ ID NO: 3923183 - RNA, 15 nt, Shigella flexneri 2a str. 301
ccagcaacaagccag

SEQ ID NO: 3923184 - RNA, 17 nt, Shigella flexneri 2a str. 301
ccagcaacacaaacgaa

SEQ ID NO: 3923185 - RNA, 15 nt, Shigella flexneri 2a str. 301
ccagcaacagcgccg

SEQ ID NO: 3923186 - RNA, 19 nt, Shigella flexneri 2a str. 301
ccagcaaccaaugccacca

SEQ ID NO: 3923187 - RNA, 21 nt, Shigella flexneri 2a str. 301
ccagcaaccaaugccaccagg

SEQ ID NO: 3923188 - RNA, 15 nt, Shigella flexneri 2a str. 301
ccagcaacugauaaa

SEQ ID NO: 3923189 - RNA, 18 nt, Shigella flexneri 2a str. 301
ccagcaacugauggccca

SEQ ID NO: 3923190 - RNA, 13 nt, Shigella flexneri 2a str. 301
ccagcaagaacca

SEQ ID NO: 3923191 - RNA, 23 nt, Shigella flexneri 2a str. 301
ccagcaagaaccaugcaauuacc

SEQ ID NO: 3923192 - RNA, 16 nt, Shigella flexneri 2a str. 301
ccagcaagagcaaaua

SEQ ID NO: 3923193 - RNA, 23 nt, Shigella flexneri 2a str. 301
ccagcaagagcaaauaaaacauc

SEQ ID NO: 3923194 - RNA, 17 nt, Shigella flexneri 2a str. 301
ccagcaauaacaacacg

SEQ ID NO: 3923195 - RNA, 22 nt, Shigella flexneri 2a str. 301
ccagcaauaauagcauccacca

SEQ ID NO: 3923196 - RNA, 16 nt, Shigella flexneri 2a str. 301
ccagcaauaaugccag

SEQ ID NO: 3923197 - RNA, 14 nt, Shigella flexneri 2a str. 301
ccagcaauccccag

SEQ ID NO: 3923198 - RNA, 13 nt, Shigella flexneri 2a str. 301
ccagcgcauggcg

SEQ ID NO: 3923199 - RNA, 17 nt, Shigella flexneri 2a str. 301
ccagcgccaguaauucu

SEQ ID NO: 3923200 - RNA, 21 nt, Shigella flexneri 2a str. 301
ccagcgccaguuuuuguuucu

SEQ ID NO: 3923201 - RNA, 15 nt, Shigella flexneri 2a str. 301
ccagcgccaucucuu

SEQ ID NO: 3923202 - RNA, 19 nt, Shigella flexneri 2a str. 301
ccagcgccgacagcagccc

SEQ ID NO: 3923203 - RNA, 18 nt, Shigella flexneri 2a str. 301
ccagcgccgccagaauca

SEQ ID NO: 3923204 - RNA, 13 nt, Shigella flexneri 2a str. 301
ccagcgccgcgcc

SEQ ID NO: 3923205 - RNA, 13 nt, Shigella flexneri 2a str. 301
ccagcgccuggcu

SEQ ID NO: 3923206 - RNA, 19 nt, Shigella flexneri 2a str. 301
ccagcgccuggcugauuaa

SEQ ID NO: 3923207 - RNA, 13 nt, Shigella flexneri 2a str. 301
ccagcgccuggga

SEQ ID NO: 3923208 - RNA, 19 nt, Shigella flexneri 2a str. 301
ccagcgcgaggaucacgca

SEQ ID NO: 3923209 - RNA, 14 nt, Shigella flexneri 2a str. 301
ccagcgcgccgcca

SEQ ID NO: 3923210 - RNA, 12 nt, Shigella flexneri 2a str. 301
ccagcgcgcgca

SEQ ID NO: 3923211 - RNA, 20 nt, Shigella flexneri 2a str. 301
ccagcgcguaaauaucggca

SEQ ID NO: 3923212 - RNA, 14 nt, Shigella flexneri 2a str. 301
ccagcgcguucugu

SEQ ID NO: 3923213 - RNA, 22 nt, Shigella flexneri 2a str. 301
ccagcggaauucccgcuucuuc

SEQ ID NO: 3923214 - RNA, 14 nt, Shigella flexneri 2a str. 301
ccagcggagaaacu

SEQ ID NO: 3923215 - RNA, 20 nt, Shigella flexneri 2a str. 301
ccagcggagaaacuucugcc

SEQ ID NO: 3923216 - RNA, 21 nt, Shigella flexneri 2a str. 301
ccagcggagaaacuucugccg

SEQ ID NO: 3923217 - RNA, 22 nt, Shigella flexneri 2a str. 301
ccagcggagaaacuucugccgg

SEQ ID NO: 3923218 - RNA, 14 nt, Shigella flexneri 2a str. 301
ccagcggcagcucg

SEQ ID NO: 3923219 - RNA, 18 nt, Shigella flexneri 2a str. 301
ccagcggcgggauuuuuu

SEQ ID NO: 3923220 - RNA, 19 nt, Shigella flexneri 2a str. 301
ccagcgguaaagcggcgcu

SEQ ID NO: 3923221 - RNA, 23 nt, Shigella flexneri 2a str. 301
ccagcgguggugacugguuuuuc

SEQ ID NO: 3923222 - RNA, 21 nt, Shigella flexneri 2a str. 301
ccagcgguucacuccacuggc

SEQ ID NO: 3923223 - RNA, 23 nt, Shigella flexneri 2a str. 301
ccagcgguucacuccacuggcug

SEQ ID NO: 3923224 - RNA, 23 nt, Shigella flexneri 2a str. 301
ccagcguaaauccugacgcuggg

SEQ ID NO: 3923225 - RNA, 21 nt, Shigella flexneri 2a str. 301
ccagcguaccaugauccugca

SEQ ID NO: 3923226 - RNA, 14 nt, Shigella flexneri 2a str. 301
ccagcguacccuga

SEQ ID NO: 3923227 - RNA, 18 nt, Shigella flexneri 2a str. 301
ccagcguagugaaggcaa

SEQ ID NO: 3923228 - RNA, 16 nt, Shigella flexneri 2a str. 301
ccagcgucacccagac

SEQ ID NO: 3923229 - RNA, 15 nt, Shigella flexneri 2a str. 301
ccagcgucagccaga

SEQ ID NO: 3923230 - RNA, 23 nt, Shigella flexneri 2a str. 301
ccagcgucaucauagacuucccu

SEQ ID NO: 3923231 - RNA, 18 nt, Shigella flexneri 2a str. 301
ccagcgucgcaucaggca

SEQ ID NO: 3923232 - RNA, 18 nt, Shigella flexneri 2a str. 301
ccagcgucgcauccgaca

SEQ ID NO: 3923233 - RNA, 13 nt, Shigella flexneri 2a str. 301
ccagcguggagag

SEQ ID NO: 3923234 - RNA, 15 nt, Shigella flexneri 2a str. 301
ccagcguggcaugac

SEQ ID NO: 3923235 - RNA, 13 nt, Shigella flexneri 2a str. 301
ccagcguggucau

SEQ ID NO: 3923236 - RNA, 19 nt, Shigella flexneri 2a str. 301
ccagcguguugaggaagcg

SEQ ID NO: 3923237 - RNA, 17 nt, Shigella flexneri 2a str. 301
ccagcguguugccgcuu

SEQ ID NO: 3923238 - RNA, 17 nt, Shigella flexneri 2a str. 301
ccagcguuaucccaucc

SEQ ID NO: 3923239 - RNA, 15 nt, Shigella flexneri 2a str. 301
ccagcguugagcccu

SEQ ID NO: 3923240 - RNA, 22 nt, Shigella flexneri 2a str. 301
ccagcguugauguuccuccucg

SEQ ID NO: 3923241 - RNA, 18 nt, Shigella flexneri 2a str. 301
ccagcguuuccagcacca

SEQ ID NO: 3923242 - RNA, 12 nt, Shigella flexneri 2a str. 301
ccagcucaaacg

SEQ ID NO: 3923243 - RNA, 18 nt, Shigella flexneri 2a str. 301
ccagcucaaggcgguaaa

SEQ ID NO: 3923244 - RNA, 14 nt, Shigella flexneri 2a str. 301
ccagcucagugacc

SEQ ID NO: 3923245 - RNA, 23 nt, Shigella flexneri 2a str. 301
ccagcucagugaccgaaccuguu

SEQ ID NO: 3923246 - RNA, 16 nt, Shigella flexneri 2a str. 301
ccagcuccagcagacc

SEQ ID NO: 3923247 - RNA, 12 nt, Shigella flexneri 2a str. 301
ccagcuccagcc

SEQ ID NO: 3923248 - RNA, 19 nt, Shigella flexneri 2a str. 301
ccagcuccccacgauugau

SEQ ID NO: 3923249 - RNA, 18 nt, Shigella flexneri 2a str. 301
ccagcuccguccagccac

SEQ ID NO: 3923250 - RNA, 13 nt, Shigella flexneri 2a str. 301
ccagcucgcgcca

SEQ ID NO: 3923251 - RNA, 14 nt, Shigella flexneri 2a str. 301
ccagcucuucuuca

SEQ ID NO: 3923252 - RNA, 23 nt, Shigella flexneri 2a str. 301
ccagcucuucuucacucucacca

SEQ ID NO: 3923253 - RNA, 22 nt, Shigella flexneri 2a str. 301
ccagcugacguagcaguucacc

SEQ ID NO: 3923254 - RNA, 17 nt, Shigella flexneri 2a str. 301
ccagcugccguccccau

SEQ ID NO: 3923255 - RNA, 20 nt, Shigella flexneri 2a str. 301
ccagcugcucauagcggcug

SEQ ID NO: 3923256 - RNA, 18 nt, Shigella flexneri 2a str. 301
ccagcugcucgcgagaac

SEQ ID NO: 3923257 - RNA, 12 nt, Shigella flexneri 2a str. 301
ccagcugucaaa

SEQ ID NO: 3923258 - RNA, 15 nt, Shigella flexneri 2a str. 301
ccagcuucagauuca

SEQ ID NO: 3923259 - RNA, 11 nt, Shigella flexneri 2a str. 301
ccagcuugaag

SEQ ID NO: 3923260 - RNA, 17 nt, Shigella flexneri 2a str. 301
ccagcuugcuuuccagc

SEQ ID NO: 3923261 - RNA, 19 nt, Shigella flexneri 2a str. 301
ccagcuuugcgccucgcca

SEQ ID NO: 3923262 - RNA, 16 nt, Shigella flexneri 2a str. 301
ccaggaaccugugaca

SEQ ID NO: 3923263 - RNA, 18 nt, Shigella flexneri 2a str. 301
ccaggaacuccagaucca

SEQ ID NO: 3923264 - RNA, 18 nt, Shigella flexneri 2a str. 301
ccaggaauuugguccuga

SEQ ID NO: 3923265 - RNA, 20 nt, Shigella flexneri 2a str. 301
ccaggacaaucacauccgga

SEQ ID NO: 3923266 - RNA, 23 nt, Shigella flexneri 2a str. 301
ccaggacaaucacauccggaucg

SEQ ID NO: 3923267 - RNA, 16 nt, Shigella flexneri 2a str. 301
ccaggacgcaguccag

SEQ ID NO: 3923268 - RNA, 13 nt, Shigella flexneri 2a str. 301
ccaggagaugccc

SEQ ID NO: 3923269 - RNA, 16 nt, Shigella flexneri 2a str. 301
ccaggagcuccagguc

SEQ ID NO: 3923270 - RNA, 21 nt, Shigella flexneri 2a str. 301
ccaggaucuuuugucaugacu

SEQ ID NO: 3923271 - RNA, 20 nt, Shigella flexneri 2a str. 301
ccaggauugauagaaauauc

SEQ ID NO: 3923272 - RNA, 13 nt, Shigella flexneri 2a str. 301
ccaggcaaaccag

SEQ ID NO: 3923273 - RNA, 18 nt, Shigella flexneri 2a str. 301
ccaggcaccgcacuggcu

SEQ ID NO: 3923274 - RNA, 22 nt, Shigella flexneri 2a str. 301
ccaggcagaagcgcgugcuaac

SEQ ID NO: 3923275 - RNA, 19 nt, Shigella flexneri 2a str. 301
ccaggcagauuuuuuaacu

SEQ ID NO: 3923276 - RNA, 21 nt, Shigella flexneri 2a str. 301
ccaggcaucagcaacacgcug

SEQ ID NO: 3923277 - RNA, 18 nt, Shigella flexneri 2a str. 301
ccaggccaaauccuucca

SEQ ID NO: 3923278 - RNA, 16 nt, Shigella flexneri 2a str. 301
ccaggccagcgcaacu

SEQ ID NO: 3923279 - RNA, 19 nt, Shigella flexneri 2a str. 301
ccaggccaguucuucuuca

SEQ ID NO: 3923280 - RNA, 16 nt, Shigella flexneri 2a str. 301
ccaggcgagaucggca

SEQ ID NO: 3923281 - RNA, 16 nt, Shigella flexneri 2a str. 301
ccaggcgcgaauggaa

SEQ ID NO: 3923282 - RNA, 19 nt, Shigella flexneri 2a str. 301
ccaggcggauaauuucacu

SEQ ID NO: 3923283 - RNA, 14 nt, Shigella flexneri 2a str. 301
ccaggcguucugcc

SEQ ID NO: 3923284 - RNA, 15 nt, Shigella flexneri 2a str. 301
ccaggcguucugccu

SEQ ID NO: 3923285 - RNA, 17 nt, Shigella flexneri 2a str. 301
ccaggcguucugccugg

SEQ ID NO: 3923286 - RNA, 14 nt, Shigella flexneri 2a str. 301
ccaggcucgccgcc

SEQ ID NO: 3923287 - RNA, 16 nt, Shigella flexneri 2a str. 301
ccaggcucgccgccgc

SEQ ID NO: 3923288 - RNA, 23 nt, Shigella flexneri 2a str. 301
ccaggcugcgaacgguuuucacg

SEQ ID NO: 3923289 - RNA, 15 nt, Shigella flexneri 2a str. 301
ccagggauaaagccc

SEQ ID NO: 3923290 - RNA, 22 nt, Shigella flexneri 2a str. 301
ccagggaucgggucaccgccga

SEQ ID NO: 3923291 - RNA, 17 nt, Shigella flexneri 2a str. 301
ccaggguuuuauuauuc

SEQ ID NO: 3923292 - RNA, 15 nt, Shigella flexneri 2a str. 301
ccagguaacgaagau

SEQ ID NO: 3923293 - RNA, 18 nt, Shigella flexneri 2a str. 301
ccagguacgcaggcggcu

SEQ ID NO: 3923294 - RNA, 21 nt, Shigella flexneri 2a str. 301
ccagguauucggugugcagcg

SEQ ID NO: 3923295 - RNA, 21 nt, Shigella flexneri 2a str. 301
ccaggucaucauugcagucau

SEQ ID NO: 3923296 - RNA, 17 nt, Shigella flexneri 2a str. 301
ccaggucgcauccggca

SEQ ID NO: 3923297 - RNA, 17 nt, Shigella flexneri 2a str. 301
ccaggugagauccggga

SEQ ID NO: 3923298 - RNA, 15 nt, Shigella flexneri 2a str. 301
ccaguuugccuucac

SEQ ID NO: 3923299 - RNA, 11 nt, Shigella flexneri 2a str. 301
ccaguuugcgu

SEQ ID NO: 3923300 - RNA, 17 nt, Shigella flexneri 2a str. 301
ccaguuuguucagcugc

SEQ ID NO: 3923301 - RNA, 21 nt, Shigella flexneri 2a str. 301
ccaguuuugccagucagcucc

SEQ ID NO: 3923302 - RNA, 18 nt, Shigella flexneri 2a str. 301
ccaguuuuuacgcccgug

SEQ ID NO: 3923303 - RNA, 20 nt, Shigella flexneri 2a str. 301
ccaguuuuucgucaacauac

SEQ ID NO: 3923304 - RNA, 18 nt, Shigella flexneri 2a str. 301
ccaguuuuucuuuuucaa

SEQ ID NO: 3923305 - RNA, 21 nt, Shigella flexneri 2a str. 301
ccauaaaaggcaccuggaaau

SEQ ID NO: 3923306 - RNA, 21 nt, Shigella flexneri 2a str. 301
ccauaaaaugcaccuuacuca

SEQ ID NO: 3923307 - RNA, 22 nt, Shigella flexneri 2a str. 301
ccauaaagacguuaacuacaau

SEQ ID NO: 3923308 - RNA, 17 nt, Shigella flexneri 2a str. 301
ccauaaagggaauaaau

SEQ ID NO: 3923309 - RNA, 18 nt, Shigella flexneri 2a str. 301
ccauaaauccaacaacac

SEQ ID NO: 3923310 - RNA, 20 nt, Shigella flexneri 2a str. 301
ccauaaauccaacaacacau

SEQ ID NO: 3923311 - RNA, 22 nt, Shigella flexneri 2a str. 301
ccauaaauugcuguaaauucuc

SEQ ID NO: 3923312 - RNA, 18 nt, Shigella flexneri 2a str. 301
ccauaaccugugcaccag

SEQ ID NO: 3923313 - RNA, 19 nt, Shigella flexneri 2a str. 301
ccauaacggaggcuucuuu

SEQ ID NO: 3923314 - RNA, 22 nt, Shigella flexneri 2a str. 301
ccauaagaguagcccgauacgc

SEQ ID NO: 3923315 - RNA, 23 nt, Shigella flexneri 2a str. 301
ccauaagcccagaacaaauaaau

SEQ ID NO: 3923316 - RNA, 14 nt, Shigella flexneri 2a str. 301
ccauaauaagcgcc

SEQ ID NO: 3923317 - RNA, 21 nt, Shigella flexneri 2a str. 301
ccauaaucacucuuccccgcu

SEQ ID NO: 3923318 - RNA, 15 nt, Shigella flexneri 2a str. 301
ccauaauggacguuu

SEQ ID NO: 3923319 - RNA, 19 nt, Shigella flexneri 2a str. 301
ccauaauuacgcuguucau

SEQ ID NO: 3923320 - RNA, 16 nt, Shigella flexneri 2a str. 301
ccauacagacacccac

SEQ ID NO: 3923321 - RNA, 13 nt, Shigella flexneri 2a str. 301
ccauacagcagca

SEQ ID NO: 3923322 - RNA, 19 nt, Shigella flexneri 2a str. 301
ccauacaguguccaaccaa

SEQ ID NO: 3923323 - RNA, 21 nt, Shigella flexneri 2a str. 301
ccauacauaaaaaagccgggg

SEQ ID NO: 3923324 - RNA, 16 nt, Shigella flexneri 2a str. 301
ccauacaucuucauca

SEQ ID NO: 3923325 - RNA, 18 nt, Shigella flexneri 2a str. 301
ccauacauguacauggug

SEQ ID NO: 3923326 - RNA, 20 nt, Shigella flexneri 2a str. 301
ccauaccacuuccagcagac

SEQ ID NO: 3923327 - RNA, 16 nt, Shigella flexneri 2a str. 301
ccauaccagcacauaa

SEQ ID NO: 3923328 - RNA, 14 nt, Shigella flexneri 2a str. 301
ccauaccaugcacc

SEQ ID NO: 3923329 - RNA, 14 nt, Shigella flexneri 2a str. 301
ccauacccagcauc

SEQ ID NO: 3923330 - RNA, 17 nt, Shigella flexneri 2a str. 301
ccauacccgcaacauac

SEQ ID NO: 3923331 - RNA, 17 nt, Shigella flexneri 2a str. 301
ccauaccggcugcaaac

SEQ ID NO: 3923332 - RNA, 13 nt, Shigella flexneri 2a str. 301
ccauaccugcaca

SEQ ID NO: 3923333 - RNA, 15 nt, Shigella flexneri 2a str. 301
ccauaccugcacaaa

SEQ ID NO: 3923334 - RNA, 22 nt, Shigella flexneri 2a str. 301
ccauaccugcacaaauagccag

SEQ ID NO: 3923335 - RNA, 16 nt, Shigella flexneri 2a str. 301
ccauacgggcaugugu

SEQ ID NO: 3923336 - RNA, 21 nt, Shigella flexneri 2a str. 301
ccauacugacuaucaucgccg

SEQ ID NO: 3923337 - RNA, 21 nt, Shigella flexneri 2a str. 301
ccauagcaucccaauacccgc

SEQ ID NO: 3923338 - RNA, 16 nt, Shigella flexneri 2a str. 301
ccauagcgauguauuu

SEQ ID NO: 3923339 - RNA, 20 nt, Shigella flexneri 2a str. 301
ccauaguguguuccucugcu

SEQ ID NO: 3923340 - RNA, 22 nt, Shigella flexneri 2a str. 301
ccauaguguguuccucugcucc

SEQ ID NO: 3923341 - RNA, 18 nt, Shigella flexneri 2a str. 301
ccauaguuaucggugugu

SEQ ID NO: 3923342 - RNA, 19 nt, Shigella flexneri 2a str. 301
ccauauacgccaucgccag

SEQ ID NO: 3923343 - RNA, 20 nt, Shigella flexneri 2a str. 301
ccauauagccccauaaacua

SEQ ID NO: 3923344 - RNA, 20 nt, Shigella flexneri 2a str. 301
ccauaucuaugguuuuuucu

SEQ ID NO: 3923345 - RNA, 17 nt, Shigella flexneri 2a str. 301
ccauauggcccaucauc

SEQ ID NO: 3923346 - RNA, 18 nt, Shigella flexneri 2a str. 301
ccauauggcccaucaucu

SEQ ID NO: 3923347 - RNA, 20 nt, Shigella flexneri 2a str. 301
ccauauucguuaucguacca

SEQ ID NO: 3923348 - RNA, 19 nt, Shigella flexneri 2a str. 301
ccauauuucuccauuagca

SEQ ID NO: 3923349 - RNA, 21 nt, Shigella flexneri 2a str. 301
ccauauuuugaaucggcggcg

SEQ ID NO: 3923350 - RNA, 12 nt, Shigella flexneri 2a str. 301
ccaucaaccacu

SEQ ID NO: 3923351 - RNA, 19 nt, Shigella flexneri 2a str. 301
ccaucaacgccaucgccag

SEQ ID NO: 3923352 - RNA, 14 nt, Shigella flexneri 2a str. 301
ccaucaacuucucg

SEQ ID NO: 3923353 - RNA, 15 nt, Shigella flexneri 2a str. 301
ccaucaacuucucgc

SEQ ID NO: 3923354 - RNA, 23 nt, Shigella flexneri 2a str. 301
ccaucaaguagcagguaaucugc

SEQ ID NO: 3923355 - RNA, 23 nt, Shigella flexneri 2a str. 301
ccaucaaucacuuugcgcucgcu

SEQ ID NO: 3923356 - RNA, 13 nt, Shigella flexneri 2a str. 301
ccaucaauugcuc

SEQ ID NO: 3923357 - RNA, 15 nt, Shigella flexneri 2a str. 301
ccaucacaaaguggg

SEQ ID NO: 3923358 - RNA, 17 nt, Shigella flexneri 2a str. 301
ccaucacauccugauag

SEQ ID NO: 3923359 - RNA, 13 nt, Shigella flexneri 2a str. 301
ccaucaccgcgag

SEQ ID NO: 3923360 - RNA, 13 nt, Shigella flexneri 2a str. 301
ccaucaccucuuc

SEQ ID NO: 3923361 - RNA, 14 nt, Shigella flexneri 2a str. 301
ccaucaccucuuca

SEQ ID NO: 3923362 - RNA, 18 nt, Shigella flexneri 2a str. 301
ccaucacuaaggguaaaa

SEQ ID NO: 3923363 - RNA, 14 nt, Shigella flexneri 2a str. 301
ccaucacuaccuga

SEQ ID NO: 3923364 - RNA, 16 nt, Shigella flexneri 2a str. 301
ccaucacuaucgccau

SEQ ID NO: 3923365 - RNA, 12 nt, Shigella flexneri 2a str. 301
ccaucacuucau

SEQ ID NO: 3923366 - RNA, 12 nt, Shigella flexneri 2a str. 301
ccaucagcagca

SEQ ID NO: 3923367 - RNA, 15 nt, Shigella flexneri 2a str. 301
ccaucagcagcaaca

SEQ ID NO: 3923368 - RNA, 12 nt, Shigella flexneri 2a str. 301
ccaucagcagcg

SEQ ID NO: 3923369 - RNA, 23 nt, Shigella flexneri 2a str. 301
ccaucaggcagauacaaccaauc

SEQ ID NO: 3923370 - RNA, 15 nt, Shigella flexneri 2a str. 301
ccaucaggcguuugu

SEQ ID NO: 3923371 - RNA, 20 nt, Shigella flexneri 2a str. 301
ccaucagggcggccgccaga

SEQ ID NO: 3923372 - RNA, 23 nt, Shigella flexneri 2a str. 301
ccaucagguaauaggcaggcauc

SEQ ID NO: 3923373 - RNA, 16 nt, Shigella flexneri 2a str. 301
ccaucaguacgcauuc

SEQ ID NO: 3923374 - RNA, 18 nt, Shigella flexneri 2a str. 301
ccaucaguugaugaaucu

SEQ ID NO: 3923375 - RNA, 22 nt, Shigella flexneri 2a str. 301
ccaucauaucacccuuuucugc

SEQ ID NO: 3923376 - RNA, 19 nt, Shigella flexneri 2a str. 301
ccaucauaugcgccagcgg

SEQ ID NO: 3923377 - RNA, 16 nt, Shigella flexneri 2a str. 301
ccaucaucgcuuucag

SEQ ID NO: 3923378 - RNA, 12 nt, Shigella flexneri 2a str. 301
ccaucaucggca

SEQ ID NO: 3923379 - RNA, 16 nt, Shigella flexneri 2a str. 301
ccaucaucggcaaaca

SEQ ID NO: 3923380 - RNA, 22 nt, Shigella flexneri 2a str. 301
ccaucaugcacacuaucgcuua

SEQ ID NO: 3923381 - RNA, 15 nt, Shigella flexneri 2a str. 301
ccaucauucgccgcu

SEQ ID NO: 3923382 - RNA, 14 nt, Shigella flexneri 2a str. 301
ccauccacagggug

SEQ ID NO: 3923383 - RNA, 18 nt, Shigella flexneri 2a str. 301
ccauccagcaacaacagc

SEQ ID NO: 3923384 - RNA, 21 nt, Shigella flexneri 2a str. 301
ccauccaggagauauugcugc

SEQ ID NO: 3923385 - RNA, 14 nt, Shigella flexneri 2a str. 301
ccauccagugaaac

SEQ ID NO: 3923386 - RNA, 15 nt, Shigella flexneri 2a str. 301
ccauccauuuuucac

SEQ ID NO: 3923387 - RNA, 18 nt, Shigella flexneri 2a str. 301
ccauccauuuuucacgca

SEQ ID NO: 3923388 - RNA, 17 nt, Shigella flexneri 2a str. 301
ccaucccgcucuguaag

SEQ ID NO: 3923389 - RNA, 16 nt, Shigella flexneri 2a str. 301
ccaucccuaccgcccg

SEQ ID NO: 3923390 - RNA, 13 nt, Shigella flexneri 2a str. 301
ccauccgaguugu

SEQ ID NO: 3923391 - RNA, 16 nt, Shigella flexneri 2a str. 301
ccauccgcccacacca

SEQ ID NO: 3923392 - RNA, 13 nt, Shigella flexneri 2a str. 301
ccauccggcagca

SEQ ID NO: 3923393 - RNA, 22 nt, Shigella flexneri 2a str. 301
ccauccggcgaauuaccagcca

SEQ ID NO: 3923394 - RNA, 20 nt, Shigella flexneri 2a str. 301
ccauccgggaucacaucaua

SEQ ID NO: 3923395 - RNA, 15 nt, Shigella flexneri 2a str. 301
ccauccgucauccau

SEQ ID NO: 3923396 - RNA, 18 nt, Shigella flexneri 2a str. 301
ccaucgaaccaucggcuu

SEQ ID NO: 3923397 - RNA, 16 nt, Shigella flexneri 2a str. 301
ccaucgacgaaauggu

SEQ ID NO: 3923398 - RNA, 19 nt, Shigella flexneri 2a str. 301
ccauuucccugacaaauca

SEQ ID NO: 3923399 - RNA, 17 nt, Shigella flexneri 2a str. 301
ccauuucggcgugcugu

SEQ ID NO: 3923400 - RNA, 12 nt, Shigella flexneri 2a str. 301
ccauuucugcca

SEQ ID NO: 3923401 - RNA, 19 nt, Shigella flexneri 2a str. 301
ccauuucugccagugcugc

SEQ ID NO: 3923402 - RNA, 14 nt, Shigella flexneri 2a str. 301
ccauuucugcugcc

SEQ ID NO: 3923403 - RNA, 17 nt, Shigella flexneri 2a str. 301
ccauuucuucuccggca

SEQ ID NO: 3923404 - RNA, 17 nt, Shigella flexneri 2a str. 301
ccauuuucgcuggcaga

SEQ ID NO: 3923405 - RNA, 19 nt, Shigella flexneri 2a str. 301
ccauuuugccgguucccaa

SEQ ID NO: 3923406 - RNA, 17 nt, Shigella flexneri 2a str. 301
ccauuuuuaauaauacu

SEQ ID NO: 3923407 - RNA, 11 nt, Shigella flexneri 2a str. 301
ccauuuuucag

SEQ ID NO: 3923408 - RNA, 12 nt, Shigella flexneri 2a str. 301
ccauuuuuucgu

SEQ ID NO: 3923409 - RNA, 13 nt, Shigella flexneri 2a str. 301
cccaaaaggcagc

SEQ ID NO: 3923410 - RNA, 18 nt, Shigella flexneri 2a str. 301
cccaaaccacccagcagc

SEQ ID NO: 3923411 - RNA, 15 nt, Shigella flexneri 2a str. 301
cccaacaacagcgcg

SEQ ID NO: 3923412 - RNA, 17 nt, Shigella flexneri 2a str. 301
cccaacaacagcgcgcu

SEQ ID NO: 3923413 - RNA, 22 nt, Shigella flexneri 2a str. 301
cccaaccgauaaccacgcucag

SEQ ID NO: 3923414 - RNA, 19 nt, Shigella flexneri 2a str. 301
cccaaccgcccugcggcug

SEQ ID NO: 3923415 - RNA, 23 nt, Shigella flexneri 2a str. 301
cccaaccuuguuucugagcauga

SEQ ID NO: 3923416 - RNA, 23 nt, Shigella flexneri 2a str. 301
cccaacgcaaagagagaagccag

SEQ ID NO: 3923417 - RNA, 15 nt, Shigella flexneri 2a str. 301
cccaacgcagcaaca

SEQ ID NO: 3923418 - RNA, 14 nt, Shigella flexneri 2a str. 301
cccaacguaacaaa

SEQ ID NO: 3923419 - RNA, 15 nt, Shigella flexneri 2a str. 301
cccaacguaacaaaa

SEQ ID NO: 3923420 - RNA, 18 nt, Shigella flexneri 2a str. 301
cccaacgugaccaguacc

SEQ ID NO: 3923421 - RNA, 23 nt, Shigella flexneri 2a str. 301
cccaaggcgaggggaccgccccu

SEQ ID NO: 3923422 - RNA, 22 nt, Shigella flexneri 2a str. 301
cccaauacgauuaacgccagac

SEQ ID NO: 3923423 - RNA, 20 nt, Shigella flexneri 2a str. 301
cccaaucucaccaaucgaaa

SEQ ID NO: 3923424 - RNA, 11 nt, Shigella flexneri 2a str. 301
cccaaugaccu

SEQ ID NO: 3923425 - RNA, 13 nt, Shigella flexneri 2a str. 301
cccaaugaccuuu

SEQ ID NO: 3923426 - RNA, 16 nt, Shigella flexneri 2a str. 301
cccaauguucguccau

SEQ ID NO: 3923427 - RNA, 15 nt, Shigella flexneri 2a str. 301
cccacaaccggcggg

SEQ ID NO: 3923428 - RNA, 13 nt, Shigella flexneri 2a str. 301
cccacaacgaccu

SEQ ID NO: 3923429 - RNA, 20 nt, Shigella flexneri 2a str. 301
cccacagacccagguagaca

SEQ ID NO: 3923430 - RNA, 13 nt, Shigella flexneri 2a str. 301
cccacagcucugc

SEQ ID NO: 3923431 - RNA, 14 nt, Shigella flexneri 2a str. 301
cccacagcucugcu

SEQ ID NO: 3923432 - RNA, 22 nt, Shigella flexneri 2a str. 301
cccacagcucuugcuccacaag

SEQ ID NO: 3923433 - RNA, 20 nt, Shigella flexneri 2a str. 301
cccacaguuucagccccauc

SEQ ID NO: 3923434 - RNA, 19 nt, Shigella flexneri 2a str. 301
cccacaguuucauaucugc

SEQ ID NO: 3923435 - RNA, 12 nt, Shigella flexneri 2a str. 301
cccacauccaug

SEQ ID NO: 3923436 - RNA, 14 nt, Shigella flexneri 2a str. 301
cccaccaccagcaa

SEQ ID NO: 3923437 - RNA, 20 nt, Shigella flexneri 2a str. 301
cccaccaccggcauccauuc

SEQ ID NO: 3923438 - RNA, 14 nt, Shigella flexneri 2a str. 301
cccaccagcaaaua

SEQ ID NO: 3923439 - RNA, 13 nt, Shigella flexneri 2a str. 301
cccaccagcgccg

SEQ ID NO: 3923440 - RNA, 14 nt, Shigella flexneri 2a str. 301
cccaccagcugaug

SEQ ID NO: 3923441 - RNA, 15 nt, Shigella flexneri 2a str. 301
cccaccccggcccuc

SEQ ID NO: 3923442 - RNA, 13 nt, Shigella flexneri 2a str. 301
cccaccgcaauaa

SEQ ID NO: 3923443 - RNA, 14 nt, Shigella flexneri 2a str. 301
cccaccugcggcac

SEQ ID NO: 3923444 - RNA, 16 nt, Shigella flexneri 2a str. 301
cccacgaccgcagcau

SEQ ID NO: 3923445 - RNA, 23 nt, Shigella flexneri 2a str. 301
cccacgauugaucucguugauca

SEQ ID NO: 3923446 - RNA, 15 nt, Shigella flexneri 2a str. 301
cccacgccagccugc

SEQ ID NO: 3923447 - RNA, 20 nt, Shigella flexneri 2a str. 301
cccacggauagauuuuuaau

SEQ ID NO: 3923448 - RNA, 13 nt, Shigella flexneri 2a str. 301
cccacggcgguaa

SEQ ID NO: 3923449 - RNA, 12 nt, Shigella flexneri 2a str. 301
cccacuccagcu

SEQ ID NO: 3923450 - RNA, 19 nt, Shigella flexneri 2a str. 301
cccacugcucaaucaucac

SEQ ID NO: 3923451 - RNA, 18 nt, Shigella flexneri 2a str. 301
cccacugugggauugcuu

SEQ ID NO: 3923452 - RNA, 19 nt, Shigella flexneri 2a str. 301
cccacuuuuauuucacccc

SEQ ID NO: 3923453 - RNA, 13 nt, Shigella flexneri 2a str. 301
cccagaacaaaua

SEQ ID NO: 3923454 - RNA, 17 nt, Shigella flexneri 2a str. 301
cccagaacaacccggcg

SEQ ID NO: 3923455 - RNA, 21 nt, Shigella flexneri 2a str. 301
cccagaagcuuuccaucggag

SEQ ID NO: 3923456 - RNA, 18 nt, Shigella flexneri 2a str. 301
cccagaauguuaacgcca

SEQ ID NO: 3923457 - RNA, 17 nt, Shigella flexneri 2a str. 301
cccagaauucacgcacu

SEQ ID NO: 3923458 - RNA, 16 nt, Shigella flexneri 2a str. 301
cccagacacaguucuu

SEQ ID NO: 3923459 - RNA, 14 nt, Shigella flexneri 2a str. 301
cccagaccaccgac

SEQ ID NO: 3923460 - RNA, 22 nt, Shigella flexneri 2a str. 301
cccagaccuaacuuggcaaagc

SEQ ID NO: 3923461 - RNA, 18 nt, Shigella flexneri 2a str. 301
cccagaccugcguucagc

SEQ ID NO: 3923462 - RNA, 16 nt, Shigella flexneri 2a str. 301
cccagacguuucgcca

SEQ ID NO: 3923463 - RNA, 17 nt, Shigella flexneri 2a str. 301
cccagacguuucgccag

SEQ ID NO: 3923464 - RNA, 20 nt, Shigella flexneri 2a str. 301
cccagacguuucgccagccg

SEQ ID NO: 3923465 - RNA, 16 nt, Shigella flexneri 2a str. 301
cccagauagcaacagc

SEQ ID NO: 3923466 - RNA, 21 nt, Shigella flexneri 2a str. 301
cccagaugccagaauccccac

SEQ ID NO: 3923467 - RNA, 16 nt, Shigella flexneri 2a str. 301
cccagcacuucgcugg

SEQ ID NO: 3923468 - RNA, 21 nt, Shigella flexneri 2a str. 301
cccagcacuuuucgcacugca

SEQ ID NO: 3923469 - RNA, 12 nt, Shigella flexneri 2a str. 301
cccagcagagau

SEQ ID NO: 3923470 - RNA, 15 nt, Shigella flexneri 2a str. 301
cccagcaucacgccc

SEQ ID NO: 3923471 - RNA, 16 nt, Shigella flexneri 2a str. 301
cccagcaucugcaugg

SEQ ID NO: 3923472 - RNA, 16 nt, Shigella flexneri 2a str. 301
cccagccagacgccag

SEQ ID NO: 3923473 - RNA, 22 nt, Shigella flexneri 2a str. 301
cccagccagacgccagccacag

SEQ ID NO: 3923474 - RNA, 15 nt, Shigella flexneri 2a str. 301
cccagccagucacuu

SEQ ID NO: 3923475 - RNA, 22 nt, Shigella flexneri 2a str. 301
cccagccagucacuucacaguu

SEQ ID NO: 3923476 - RNA, 13 nt, Shigella flexneri 2a str. 301
cccagcccagcgc

SEQ ID NO: 3923477 - RNA, 14 nt, Shigella flexneri 2a str. 301
cccagcccccagca

SEQ ID NO: 3923478 - RNA, 16 nt, Shigella flexneri 2a str. 301
cccagccuaagccauu

SEQ ID NO: 3923479 - RNA, 14 nt, Shigella flexneri 2a str. 301
cccagccuuuccug

SEQ ID NO: 3923480 - RNA, 17 nt, Shigella flexneri 2a str. 301
cccagccuuuccugcaa

SEQ ID NO: 3923481 - RNA, 17 nt, Shigella flexneri 2a str. 301
cccagcgaagcaaacca

SEQ ID NO: 3923482 - RNA, 19 nt, Shigella flexneri 2a str. 301
cccagcgaauccagcaugc

SEQ ID NO: 3923483 - RNA, 15 nt, Shigella flexneri 2a str. 301
cccagcgcgaucgca

SEQ ID NO: 3923484 - RNA, 21 nt, Shigella flexneri 2a str. 301
cccagcgcgaucgcaccacca

SEQ ID NO: 3923485 - RNA, 19 nt, Shigella flexneri 2a str. 301
cccagcgcggugacgcaca

SEQ ID NO: 3923486 - RNA, 20 nt, Shigella flexneri 2a str. 301
cccagcgcggugacgcacag

SEQ ID NO: 3923487 - RNA, 14 nt, Shigella flexneri 2a str. 301
cccagcggaaaaua

SEQ ID NO: 3923488 - RNA, 17 nt, Shigella flexneri 2a str. 301
cccagcguugcacaugu

SEQ ID NO: 3923489 - RNA, 15 nt, Shigella flexneri 2a str. 301
cccagcucuucucaa

SEQ ID NO: 3923490 - RNA, 13 nt, Shigella flexneri 2a str. 301
cccaggcagaagc

SEQ ID NO: 3923491 - RNA, 16 nt, Shigella flexneri 2a str. 301
cccaggcugugcgcca

SEQ ID NO: 3923492 - RNA, 19 nt, Shigella flexneri 2a str. 301
cccaggcuuaauugcgcaa

SEQ ID NO: 3923493 - RNA, 21 nt, Shigella flexneri 2a str. 301
cccaggcuucaggugcccaac

SEQ ID NO: 3923494 - RNA, 22 nt, Shigella flexneri 2a str. 301
cccagguauucggugugcagcg

SEQ ID NO: 3923495 - RNA, 20 nt, Shigella flexneri 2a str. 301
cccagguuucaaugccgccg

SEQ ID NO: 3923496 - RNA, 15 nt, Shigella flexneri 2a str. 301
cccaguagacagcaa

SEQ ID NO: 3923497 - RNA, 16 nt, Shigella flexneri 2a str. 301
cccaguagacgagccg

SEQ ID NO: 3923498 - RNA, 15 nt, Shigella flexneri 2a str. 301
cccagucgucauccc

SEQ ID NO: 3923499 - RNA, 14 nt, Shigella flexneri 2a str. 301
cccgaaugaccgcc

SEQ ID NO: 3923500 - RNA, 13 nt, Shigella flexneri 2a str. 301
cccgaccaccauu

SEQ ID NO: 3923501 - RNA, 19 nt, Shigella flexneri 2a str. 301
cccgacgauaccgccgcac

SEQ ID NO: 3923502 - RNA, 13 nt, Shigella flexneri 2a str. 301
cccgagaaaaaua

SEQ ID NO: 3923503 - RNA, 16 nt, Shigella flexneri 2a str. 301
cccgagcucaauacaa

SEQ ID NO: 3923504 - RNA, 14 nt, Shigella flexneri 2a str. 301
cccgauaaccgcaa

SEQ ID NO: 3923505 - RNA, 14 nt, Shigella flexneri 2a str. 301
cccgauacgcuugc

SEQ ID NO: 3923506 - RNA, 21 nt, Shigella flexneri 2a str. 301
cccgaucgccaucaugcacac

SEQ ID NO: 3923507 - RNA, 14 nt, Shigella flexneri 2a str. 301
cccgaucgcucaua

SEQ ID NO: 3923508 - RNA, 22 nt, Shigella flexneri 2a str. 301
cccgaugaccuugucaugcagc

SEQ ID NO: 3923509 - RNA, 23 nt, Shigella flexneri 2a str. 301
cccgaugaccuugucaugcagcu

SEQ ID NO: 3923510 - RNA, 14 nt, Shigella flexneri 2a str. 301
cccgaugccagcac

SEQ ID NO: 3923511 - RNA, 11 nt, Shigella flexneri 2a str. 301
cccgauggcuu

SEQ ID NO: 3923512 - RNA, 17 nt, Shigella flexneri 2a str. 301
cccgauggucagcuuca

SEQ ID NO: 3923513 - RNA, 18 nt, Shigella flexneri 2a str. 301
cccgauucggucauggua

SEQ ID NO: 3923514 - RNA, 18 nt, Shigella flexneri 2a str. 301
cccgcaagccaacauguu

SEQ ID NO: 3923515 - RNA, 13 nt, Shigella flexneri 2a str. 301
cccgcaagcugcg

SEQ ID NO: 3923516 - RNA, 20 nt, Shigella flexneri 2a str. 301
cccgcaaguccccaguaauc

SEQ ID NO: 3923517 - RNA, 16 nt, Shigella flexneri 2a str. 301
cccgcacaaagcacgc

SEQ ID NO: 3923518 - RNA, 23 nt, Shigella flexneri 2a str. 301
cccgcacagucacuacgcgaccg

SEQ ID NO: 3923519 - RNA, 13 nt, Shigella flexneri 2a str. 301
cccgcagcaaccg

SEQ ID NO: 3923520 - RNA, 12 nt, Shigella flexneri 2a str. 301
cccgcagccacg

SEQ ID NO: 3923521 - RNA, 17 nt, Shigella flexneri 2a str. 301
cccgcauccgcugaugc

SEQ ID NO: 3923522 - RNA, 16 nt, Shigella flexneri 2a str. 301
cccgcaugccuaccaa

SEQ ID NO: 3923523 - RNA, 15 nt, Shigella flexneri 2a str. 301
cccgccagcaccagc

SEQ ID NO: 3923524 - RNA, 13 nt, Shigella flexneri 2a str. 301
cccgccagcacga

SEQ ID NO: 3923525 - RNA, 19 nt, Shigella flexneri 2a str. 301
cccgccagcacgaccgcca

SEQ ID NO: 3923526 - RNA, 16 nt, Shigella flexneri 2a str. 301
cccgccagcgcggcga

SEQ ID NO: 3923527 - RNA, 22 nt, Shigella flexneri 2a str. 301
cccgccaguuugucuggcaauc

SEQ ID NO: 3923528 - RNA, 15 nt, Shigella flexneri 2a str. 301
cccgccccugacagg

SEQ ID NO: 3923529 - RNA, 21 nt, Shigella flexneri 2a str. 301
cccgccgcgacuauucacugc

SEQ ID NO: 3923530 - RNA, 22 nt, Shigella flexneri 2a str. 301
cccgccgcugguuaccaccugc

SEQ ID NO: 3923531 - RNA, 12 nt, Shigella flexneri 2a str. 301
cccgccggcgua

SEQ ID NO: 3923532 - RNA, 15 nt, Shigella flexneri 2a str. 301
cccgccgugcugcca

SEQ ID NO: 3923533 - RNA, 16 nt, Shigella flexneri 2a str. 301
cccgccguugccgcag

SEQ ID NO: 3923534 - RNA, 17 nt, Shigella flexneri 2a str. 301
cccgccguugccgcagc

SEQ ID NO: 3923535 - RNA, 16 nt, Shigella flexneri 2a str. 301
cccgccugagucacuu

SEQ ID NO: 3923536 - RNA, 21 nt, Shigella flexneri 2a str. 301
cccgccuguugcgucgccgcc

SEQ ID NO: 3923537 - RNA, 13 nt, Shigella flexneri 2a str. 301
cccgcgaccacca

SEQ ID NO: 3923538 - RNA, 18 nt, Shigella flexneri 2a str. 301
cccgcgauaaaaauccug

SEQ ID NO: 3923539 - RNA, 14 nt, Shigella flexneri 2a str. 301
cccgcgaucgccug

SEQ ID NO: 3923540 - RNA, 19 nt, Shigella flexneri 2a str. 301
cccgcgcggcgcaggcgcu

SEQ ID NO: 3923541 - RNA, 18 nt, Shigella flexneri 2a str. 301
cccgcgucguucaucgca

SEQ ID NO: 3923542 - RNA, 18 nt, Shigella flexneri 2a str. 301
cccgcguuaagacacacu

SEQ ID NO: 3923543 - RNA, 13 nt, Shigella flexneri 2a str. 301
cccgcucacgcag

SEQ ID NO: 3923544 - RNA, 20 nt, Shigella flexneri 2a str. 301
cccgcucgaaguuuuccuca

SEQ ID NO: 3923545 - RNA, 20 nt, Shigella flexneri 2a str. 301
cccgcugaaaagcgggcuga

SEQ ID NO: 3923546 - RNA, 20 nt, Shigella flexneri 2a str. 301
cccgcugccgcagauauucc

SEQ ID NO: 3923547 - RNA, 15 nt, Shigella flexneri 2a str. 301
cccgcuuccugcagc

SEQ ID NO: 3923548 - RNA, 16 nt, Shigella flexneri 2a str. 301
cccgcuucgcccgcca

SEQ ID NO: 3923549 - RNA, 21 nt, Shigella flexneri 2a str. 301
cccgcuucguuuucagcuucg

SEQ ID NO: 3923550 - RNA, 23 nt, Shigella flexneri 2a str. 301
cccggaacgggagaaacccggcc

SEQ ID NO: 3923551 - RNA, 17 nt, Shigella flexneri 2a str. 301
cccggaagcaucaaacg

SEQ ID NO: 3923552 - RNA, 12 nt, Shigella flexneri 2a str. 301
cccggaagccac

SEQ ID NO: 3923553 - RNA, 20 nt, Shigella flexneri 2a str. 301
cccggacaguccccucgccc

SEQ ID NO: 3923554 - RNA, 12 nt, Shigella flexneri 2a str. 301
cccggagcagca

SEQ ID NO: 3923555 - RNA, 23 nt, Shigella flexneri 2a str. 301
cccggagggguuuuugccagcaa

SEQ ID NO: 3923556 - RNA, 15 nt, Shigella flexneri 2a str. 301
cccggauaucaccac

SEQ ID NO: 3923557 - RNA, 16 nt, Shigella flexneri 2a str. 301
cccggaucguucacau

SEQ ID NO: 3923558 - RNA, 19 nt, Shigella flexneri 2a str. 301
cccggauuuggcaaaugca

SEQ ID NO: 3923559 - RNA, 20 nt, Shigella flexneri 2a str. 301
cccggcaacaaauucacgcc

SEQ ID NO: 3923560 - RNA, 21 nt, Shigella flexneri 2a str. 301
cccggcaagaaauaccgaaga

SEQ ID NO: 3923561 - RNA, 16 nt, Shigella flexneri 2a str. 301
cccggcaccaaucacc

SEQ ID NO: 3923562 - RNA, 21 nt, Shigella flexneri 2a str. 301
cccggcaccaaucaccgccag

SEQ ID NO: 3923563 - RNA, 23 nt, Shigella flexneri 2a str. 301
cccggcauucaccucugcggcaa

SEQ ID NO: 3923564 - RNA, 17 nt, Shigella flexneri 2a str. 301
cccggccacagcgccag

SEQ ID NO: 3923565 - RNA, 16 nt, Shigella flexneri 2a str. 301
cccggccugcucccga

SEQ ID NO: 3923566 - RNA, 17 nt, Shigella flexneri 2a str. 301
cccggccugugucacuu

SEQ ID NO: 3923567 - RNA, 23 nt, Shigella flexneri 2a str. 301
cccggcgaugguuuucaucccga

SEQ ID NO: 3923568 - RNA, 15 nt, Shigella flexneri 2a str. 301
cccggcgcagcgcgc

SEQ ID NO: 3923569 - RNA, 17 nt, Shigella flexneri 2a str. 301
cccggcgcagcgcgcga

SEQ ID NO: 3923570 - RNA, 20 nt, Shigella flexneri 2a str. 301
cccggcgcauggccgggguu

SEQ ID NO: 3923571 - RNA, 18 nt, Shigella flexneri 2a str. 301
cccggcggccggaugaca

SEQ ID NO: 3923572 - RNA, 15 nt, Shigella flexneri 2a str. 301
cccggcucauccccu

SEQ ID NO: 3923573 - RNA, 15 nt, Shigella flexneri 2a str. 301
cccggcuucaaagca

SEQ ID NO: 3923574 - RNA, 19 nt, Shigella flexneri 2a str. 301
cccggcuuuuuuacgccug

SEQ ID NO: 3923575 - RNA, 20 nt, Shigella flexneri 2a str. 301
cccgggccuccccggauuca

SEQ ID NO: 3923576 - RNA, 15 nt, Shigella flexneri 2a str. 301
cccgggucagcgcca

SEQ ID NO: 3923577 - RNA, 21 nt, Shigella flexneri 2a str. 301
cccgguaauugcacguccggu

SEQ ID NO: 3923578 - RNA, 21 nt, Shigella flexneri 2a str. 301
cccgguaccuuugaacugcug

SEQ ID NO: 3923579 - RNA, 22 nt, Shigella flexneri 2a str. 301
cccgguauccaucagacuuugc

SEQ ID NO: 3923580 - RNA, 23 nt, Shigella flexneri 2a str. 301
cccggucagcagcaccaccgccc

SEQ ID NO: 3923581 - RNA, 17 nt, Shigella flexneri 2a str. 301
cccggucauaaugagca

SEQ ID NO: 3923582 - RNA, 14 nt, Shigella flexneri 2a str. 301
cccgguccgcgcag

SEQ ID NO: 3923583 - RNA, 16 nt, Shigella flexneri 2a str. 301
cccgguccgcgcagcg

SEQ ID NO: 3923584 - RNA, 12 nt, Shigella flexneri 2a str. 301
cccgguccuggc

SEQ ID NO: 3923585 - RNA, 12 nt, Shigella flexneri 2a str. 301
cccggugggcga

SEQ ID NO: 3923586 - RNA, 23 nt, Shigella flexneri 2a str. 301
cccgguuaauugcgccagcacau

SEQ ID NO: 3923587 - RNA, 19 nt, Shigella flexneri 2a str. 301
cccgguuaucggcgcgcca

SEQ ID NO: 3923588 - RNA, 16 nt, Shigella flexneri 2a str. 301
cccgguuuuacuuugc

SEQ ID NO: 3923589 - RNA, 16 nt, Shigella flexneri 2a str. 301
cccguacuucugacca

SEQ ID NO: 3923590 - RNA, 12 nt, Shigella flexneri 2a str. 301
cccguagugugg

SEQ ID NO: 3923591 - RNA, 21 nt, Shigella flexneri 2a str. 301
cccguaguguggggaaugaua

SEQ ID NO: 3923592 - RNA, 22 nt, Shigella flexneri 2a str. 301
cccgucaauuaccacuggccca

SEQ ID NO: 3923593 - RNA, 12 nt, Shigella flexneri 2a str. 301
cccgucagagca

SEQ ID NO: 3923594 - RNA, 14 nt, Shigella flexneri 2a str. 301
cccgucagcaaaau

SEQ ID NO: 3923595 - RNA, 23 nt, Shigella flexneri 2a str. 301
cccgucagcaaaauacugaacag

SEQ ID NO: 3923596 - RNA, 16 nt, Shigella flexneri 2a str. 301
cccguccguuccgcca

SEQ ID NO: 3923597 - RNA, 15 nt, Shigella flexneri 2a str. 301
cccgucguugcaauc

SEQ ID NO: 3923598 - RNA, 14 nt, Shigella flexneri 2a str. 301
cccgucuacaaaaa

SEQ ID NO: 3923599 - RNA, 20 nt, Shigella flexneri 2a str. 301
ccgaagccguuagucaucau

SEQ ID NO: 3923600 - RNA, 16 nt, Shigella flexneri 2a str. 301
ccgaaggaggcgugcu

SEQ ID NO: 3923601 - RNA, 14 nt, Shigella flexneri 2a str. 301
ccgaauaacgcgca

SEQ ID NO: 3923602 - RNA, 15 nt, Shigella flexneri 2a str. 301
ccgaaugcagcucca

SEQ ID NO: 3923603 - RNA, 13 nt, Shigella flexneri 2a str. 301
ccgaauucaaauc

SEQ ID NO: 3923604 - RNA, 23 nt, Shigella flexneri 2a str. 301
ccgacaaacaaugagaauaccga

SEQ ID NO: 3923605 - RNA, 17 nt, Shigella flexneri 2a str. 301
ccgacaaugccacaaac

SEQ ID NO: 3923606 - RNA, 13 nt, Shigella flexneri 2a str. 301
ccgacacuggcag

SEQ ID NO: 3923607 - RNA, 12 nt, Shigella flexneri 2a str. 301
ccgacagaauau

SEQ ID NO: 3923608 - RNA, 13 nt, Shigella flexneri 2a str. 301
ccgacagcaggcu

SEQ ID NO: 3923609 - RNA, 12 nt, Shigella flexneri 2a str. 301
ccgacaucacgg

SEQ ID NO: 3923610 - RNA, 13 nt, Shigella flexneri 2a str. 301
ccgacaucgccac

SEQ ID NO: 3923611 - RNA, 17 nt, Shigella flexneri 2a str. 301
ccgacauuugcacaaga

SEQ ID NO: 3923612 - RNA, 12 nt, Shigella flexneri 2a str. 301
ccgaccaccauu

SEQ ID NO: 3923613 - RNA, 10 nt, Shigella flexneri 2a str. 301
ccgaccacuu

SEQ ID NO: 3923614 - RNA, 17 nt, Shigella flexneri 2a str. 301
ccgaccaucccaccacc

SEQ ID NO: 3923615 - RNA, 15 nt, Shigella flexneri 2a str. 301
ccgaccaucgccagc

SEQ ID NO: 3923616 - RNA, 16 nt, Shigella flexneri 2a str. 301
ccgaccaucgccagcu

SEQ ID NO: 3923617 - RNA, 14 nt, Shigella flexneri 2a str. 301
ccgaccauugccag

SEQ ID NO: 3923618 - RNA, 20 nt, Shigella flexneri 2a str. 301
ccgaccauugccaguaacag

SEQ ID NO: 3923619 - RNA, 12 nt, Shigella flexneri 2a str. 301
ccgaccucaaca

SEQ ID NO: 3923620 - RNA, 19 nt, Shigella flexneri 2a str. 301
ccgacucacuugcagucgg

SEQ ID NO: 3923621 - RNA, 12 nt, Shigella flexneri 2a str. 301
ccgacugccugc

SEQ ID NO: 3923622 - RNA, 19 nt, Shigella flexneri 2a str. 301
ccgacuuaucacugccagu

SEQ ID NO: 3923623 - RNA, 14 nt, Shigella flexneri 2a str. 301
ccgagaagcagcaa

SEQ ID NO: 3923624 - RNA, 16 nt, Shigella flexneri 2a str. 301
ccgagaagcagcaaca

SEQ ID NO: 3923625 - RNA, 15 nt, Shigella flexneri 2a str. 301
ccgagaauaauuuca

SEQ ID NO: 3923626 - RNA, 18 nt, Shigella flexneri 2a str. 301
ccgagaauggacaccagc

SEQ ID NO: 3923627 - RNA, 23 nt, Shigella flexneri 2a str. 301
ccgagauaaugguuuccagcauc

SEQ ID NO: 3923628 - RNA, 23 nt, Shigella flexneri 2a str. 301
ccgagcggucggagguucgaauc

SEQ ID NO: 3923629 - RNA, 15 nt, Shigella flexneri 2a str. 301
ccgagcgucacuucg

SEQ ID NO: 3923630 - RNA, 20 nt, Shigella flexneri 2a str. 301
ccgagcguucaaaacggcug

SEQ ID NO: 3923631 - RNA, 18 nt, Shigella flexneri 2a str. 301
ccgaggauacagccgaag

SEQ ID NO: 3923632 - RNA, 17 nt, Shigella flexneri 2a str. 301
ccgaggcauucagccag

SEQ ID NO: 3923633 - RNA, 15 nt, Shigella flexneri 2a str. 301
ccgaggccaaaacca

SEQ ID NO: 3923634 - RNA, 23 nt, Shigella flexneri 2a str. 301
ccgaggcgcuggcagaaggccgc

SEQ ID NO: 3923635 - RNA, 23 nt, Shigella flexneri 2a str. 301
ccgaggggcugacgcaacugguc

SEQ ID NO: 3923636 - RNA, 19 nt, Shigella flexneri 2a str. 301
ccgaguaaaaaaacaucau

SEQ ID NO: 3923637 - RNA, 21 nt, Shigella flexneri 2a str. 301
ccgaguaguuauauuccggcg

SEQ ID NO: 3923638 - RNA, 13 nt, Shigella flexneri 2a str. 301
ccgaguggcauuu

SEQ ID NO: 3923639 - RNA, 20 nt, Shigella flexneri 2a str. 301
ccgaguggcauuucgccaaa

SEQ ID NO: 3923640 - RNA, 21 nt, Shigella flexneri 2a str. 301
ccgauaaaggucgacagcagc

SEQ ID NO: 3923641 - RNA, 13 nt, Shigella flexneri 2a str. 301
ccgauaaccacgc

SEQ ID NO: 3923642 - RNA, 17 nt, Shigella flexneri 2a str. 301
ccgauaaccgcaaaacc

SEQ ID NO: 3923643 - RNA, 18 nt, Shigella flexneri 2a str. 301
ccgauaauaaagccuauc

SEQ ID NO: 3923644 - RNA, 17 nt, Shigella flexneri 2a str. 301
ccgauaauuccucccgu

SEQ ID NO: 3923645 - RNA, 16 nt, Shigella flexneri 2a str. 301
ccgauaccgacacagg

SEQ ID NO: 3923646 - RNA, 15 nt, Shigella flexneri 2a str. 301
ccgauacgcuggaug

SEQ ID NO: 3923647 - RNA, 21 nt, Shigella flexneri 2a str. 301
ccgauauguucagaaagcgcc

SEQ ID NO: 3923648 - RNA, 14 nt, Shigella flexneri 2a str. 301
ccgauccggcacca

SEQ ID NO: 3923649 - RNA, 16 nt, Shigella flexneri 2a str. 301
ccgauccggcaccaau

SEQ ID NO: 3923650 - RNA, 18 nt, Shigella flexneri 2a str. 301
ccgauccuagaucgggca

SEQ ID NO: 3923651 - RNA, 14 nt, Shigella flexneri 2a str. 301
ccgaucgugcuaaa

SEQ ID NO: 3923652 - RNA, 17 nt, Shigella flexneri 2a str. 301
ccgaugaguuaagaaga

SEQ ID NO: 3923653 - RNA, 20 nt, Shigella flexneri 2a str. 301
ccgaugaguuaagaagaucg

SEQ ID NO: 3923654 - RNA, 19 nt, Shigella flexneri 2a str. 301
ccgaugaucaacagcauca

SEQ ID NO: 3923655 - RNA, 21 nt, Shigella flexneri 2a str. 301
ccgaugaucaacagcaucauc

SEQ ID NO: 3923656 - RNA, 22 nt, Shigella flexneri 2a str. 301
ccgaugaucaacagcaucaucg

SEQ ID NO: 3923657 - RNA, 23 nt, Shigella flexneri 2a str. 301
ccgaugcgggauucccccaggcc

SEQ ID NO: 3923658 - RNA, 16 nt, Shigella flexneri 2a str. 301
ccgauggucagcuuca

SEQ ID NO: 3923659 - RNA, 17 nt, Shigella flexneri 2a str. 301
ccgauggucagcuucac

SEQ ID NO: 3923660 - RNA, 21 nt, Shigella flexneri 2a str. 301
ccgauuaaucuuccagaucac

SEQ ID NO: 3923661 - RNA, 21 nt, Shigella flexneri 2a str. 301
ccgauuguaaucacauucgau

SEQ ID NO: 3923662 - RNA, 12 nt, Shigella flexneri 2a str. 301
ccgauuuaaccc

SEQ ID NO: 3923663 - RNA, 13 nt, Shigella flexneri 2a str. 301
ccgauuuguucuc

SEQ ID NO: 3923664 - RNA, 20 nt, Shigella flexneri 2a str. 301
ccgauuuucagccaucaucc

SEQ ID NO: 3923665 - RNA, 18 nt, Shigella flexneri 2a str. 301
ccgauuuugccuucauac

SEQ ID NO: 3923666 - RNA, 18 nt, Shigella flexneri 2a str. 301
ccgauuuuguaaaagaag

SEQ ID NO: 3923667 - RNA, 15 nt, Shigella flexneri 2a str. 301
ccgcaaaaccaacgc

SEQ ID NO: 3923668 - RNA, 20 nt, Shigella flexneri 2a str. 301
ccgcaaaaggcgaaacgccu

SEQ ID NO: 3923669 - RNA, 14 nt, Shigella flexneri 2a str. 301
ccgcaaaccuggca

SEQ ID NO: 3923670 - RNA, 14 nt, Shigella flexneri 2a str. 301
ccgcaaacgacacu

SEQ ID NO: 3923671 - RNA, 11 nt, Shigella flexneri 2a str. 301
ccgcaaagccc

SEQ ID NO: 3923672 - RNA, 13 nt, Shigella flexneri 2a str. 301
ccgcaaauaacgu

SEQ ID NO: 3923673 - RNA, 22 nt, Shigella flexneri 2a str. 301
ccgcaacaaugccgauaaauac

SEQ ID NO: 3923674 - RNA, 20 nt, Shigella flexneri 2a str. 301
ccgcaacagugaaauacagu

SEQ ID NO: 3923675 - RNA, 14 nt, Shigella flexneri 2a str. 301
ccgcaacuaccagc

SEQ ID NO: 3923676 - RNA, 19 nt, Shigella flexneri 2a str. 301
ccgcaacuuauuggcaauc

SEQ ID NO: 3923677 - RNA, 16 nt, Shigella flexneri 2a str. 301
ccgcaagccaacaugu

SEQ ID NO: 3923678 - RNA, 23 nt, Shigella flexneri 2a str. 301
ccgcaaucaucgaccccaggccg

SEQ ID NO: 3923679 - RNA, 20 nt, Shigella flexneri 2a str. 301
ccgcaauggccguuccggca

SEQ ID NO: 3923680 - RNA, 13 nt, Shigella flexneri 2a str. 301
ccgcaaugugcuc

SEQ ID NO: 3923681 - RNA, 15 nt, Shigella flexneri 2a str. 301
ccgcacaauacauag

SEQ ID NO: 3923682 - RNA, 18 nt, Shigella flexneri 2a str. 301
ccgcacaauacauagaaa

SEQ ID NO: 3923683 - RNA, 13 nt, Shigella flexneri 2a str. 301
ccgcaccaggcag

SEQ ID NO: 3923684 - RNA, 12 nt, Shigella flexneri 2a str. 301
ccgcaccgccgu

SEQ ID NO: 3923685 - RNA, 18 nt, Shigella flexneri 2a str. 301
ccgcaccugaguaauuaa

SEQ ID NO: 3923686 - RNA, 15 nt, Shigella flexneri 2a str. 301
ccgcaccugccagcg

SEQ ID NO: 3923687 - RNA, 23 nt, Shigella flexneri 2a str. 301
ccgcacgcuggagaacaaggcuu

SEQ ID NO: 3923688 - RNA, 21 nt, Shigella flexneri 2a str. 301
ccgcacguuagaaacaaaaaa

SEQ ID NO: 3923689 - RNA, 17 nt, Shigella flexneri 2a str. 301
ccgcacucuacuucuuc

SEQ ID NO: 3923690 - RNA, 16 nt, Shigella flexneri 2a str. 301
ccgcacuucuuccuug

SEQ ID NO: 3923691 - RNA, 20 nt, Shigella flexneri 2a str. 301
ccgcagaagccgaucgugcu

SEQ ID NO: 3923692 - RNA, 21 nt, Shigella flexneri 2a str. 301
ccgcagagauagaacugcauu

SEQ ID NO: 3923693 - RNA, 19 nt, Shigella flexneri 2a str. 301
ccgcagcauugcucaccgc

SEQ ID NO: 3923694 - RNA, 13 nt, Shigella flexneri 2a str. 301
ccgcagccaucac

SEQ ID NO: 3923695 - RNA, 15 nt, Shigella flexneri 2a str. 301
ccgcagccaucacca

SEQ ID NO: 3923696 - RNA, 13 nt, Shigella flexneri 2a str. 301
ccgcagccgccac

SEQ ID NO: 3923697 - RNA, 15 nt, Shigella flexneri 2a str. 301
ccgcagccgccagaa

SEQ ID NO: 3923698 - RNA, 20 nt, Shigella flexneri 2a str. 301
ccgcagccgccagaaauggc

SEQ ID NO: 3923699 - RNA, 20 nt, Shigella flexneri 2a str. 301
ccgcagcgauugucagcugg

SEQ ID NO: 3923700 - RNA, 14 nt, Shigella flexneri 2a str. 301
ccgcagcuccagcc

SEQ ID NO: 3923701 - RNA, 15 nt, Shigella flexneri 2a str. 301
ccgcagcuccagccc

SEQ ID NO: 3923702 - RNA, 15 nt, Shigella flexneri 2a str. 301
ccgcaguaaagcgca

SEQ ID NO: 3923703 - RNA, 19 nt, Shigella flexneri 2a str. 301
ccgcagucauggcucuucc

SEQ ID NO: 3923704 - RNA, 17 nt, Shigella flexneri 2a str. 301
ccgcaguggcuucggcg

SEQ ID NO: 3923705 - RNA, 16 nt, Shigella flexneri 2a str. 301
ccgcaguguaguucug

SEQ ID NO: 3923706 - RNA, 21 nt, Shigella flexneri 2a str. 301
ccgcaguuucugauacugcuc

SEQ ID NO: 3923707 - RNA, 16 nt, Shigella flexneri 2a str. 301
ccgcauaccccuucac

SEQ ID NO: 3923708 - RNA, 20 nt, Shigella flexneri 2a str. 301
ccgcaucaacagugccaauc

SEQ ID NO: 3923709 - RNA, 16 nt, Shigella flexneri 2a str. 301
ccgcaucaaugaccuu

SEQ ID NO: 3923710 - RNA, 19 nt, Shigella flexneri 2a str. 301
ccgcaucacuccacaccau

SEQ ID NO: 3923711 - RNA, 21 nt, Shigella flexneri 2a str. 301
ccgcaucacuccacaccauau

SEQ ID NO: 3923712 - RNA, 23 nt, Shigella flexneri 2a str. 301
ccgcaucaggcaucugagcauga

SEQ ID NO: 3923713 - RNA, 11 nt, Shigella flexneri 2a str. 301
ccgcauccaga

SEQ ID NO: 3923714 - RNA, 20 nt, Shigella flexneri 2a str. 301
ccgcauccggcaauugugau

SEQ ID NO: 3923715 - RNA, 19 nt, Shigella flexneri 2a str. 301
ccgcauccggcaucaacaa

SEQ ID NO: 3923716 - RNA, 22 nt, Shigella flexneri 2a str. 301
ccgcaugccuaccaaaccugca

SEQ ID NO: 3923717 - RNA, 22 nt, Shigella flexneri 2a str. 301
ccgcauuuuuucuucaguuccg

SEQ ID NO: 3923718 - RNA, 14 nt, Shigella flexneri 2a str. 301
ccgccaaccaccgc

SEQ ID NO: 3923719 - RNA, 18 nt, Shigella flexneri 2a str. 301
ccgccaacguucaccacg

SEQ ID NO: 3923720 - RNA, 21 nt, Shigella flexneri 2a str. 301
ccgccaauaaccggcacuuca

SEQ ID NO: 3923721 - RNA, 17 nt, Shigella flexneri 2a str. 301
ccgccaauaaucagcgc

SEQ ID NO: 3923722 - RNA, 14 nt, Shigella flexneri 2a str. 301
ccgccaaucacgcc

SEQ ID NO: 3923723 - RNA, 16 nt, Shigella flexneri 2a str. 301
ccgccaccaccagacg

SEQ ID NO: 3923724 - RNA, 13 nt, Shigella flexneri 2a str. 301
ccgccaccagcgu

SEQ ID NO: 3923725 - RNA, 11 nt, Shigella flexneri 2a str. 301
ccgccaccagg

SEQ ID NO: 3923726 - RNA, 22 nt, Shigella flexneri 2a str. 301
ccgccaccaggaacgcgccaag

SEQ ID NO: 3923727 - RNA, 22 nt, Shigella flexneri 2a str. 301
ccgccacgguaucaagcccgcc

SEQ ID NO: 3923728 - RNA, 13 nt, Shigella flexneri 2a str. 301
ccgccacugccac

SEQ ID NO: 3923729 - RNA, 19 nt, Shigella flexneri 2a str. 301
ccgccacuugagccuccag

SEQ ID NO: 3923730 - RNA, 19 nt, Shigella flexneri 2a str. 301
ccgccagaacgacgacugc

SEQ ID NO: 3923731 - RNA, 16 nt, Shigella flexneri 2a str. 301
ccgccagcaggaacga

SEQ ID NO: 3923732 - RNA, 12 nt, Shigella flexneri 2a str. 301
ccgccagcgcca

SEQ ID NO: 3923733 - RNA, 11 nt, Shigella flexneri 2a str. 301
ccgccagcgcg

SEQ ID NO: 3923734 - RNA, 14 nt, Shigella flexneri 2a str. 301
ccgccagcggcggc

SEQ ID NO: 3923735 - RNA, 19 nt, Shigella flexneri 2a str. 301
ccgccaggcugcgaacggu

SEQ ID NO: 3923736 - RNA, 17 nt, Shigella flexneri 2a str. 301
ccgccaguaaucuggcc

SEQ ID NO: 3923737 - RNA, 17 nt, Shigella flexneri 2a str. 301
ccgccagugcagcgaag

SEQ ID NO: 3923738 - RNA, 18 nt, Shigella flexneri 2a str. 301
ccgccagugccaaagcca

SEQ ID NO: 3923739 - RNA, 18 nt, Shigella flexneri 2a str. 301
ccgccaguuacugccacc

SEQ ID NO: 3923740 - RNA, 20 nt, Shigella flexneri 2a str. 301
ccgccaguuacugccaccau

SEQ ID NO: 3923741 - RNA, 15 nt, Shigella flexneri 2a str. 301
ccgccaguucuucca

SEQ ID NO: 3923742 - RNA, 17 nt, Shigella flexneri 2a str. 301
ccgccaguucuuccagu

SEQ ID NO: 3923743 - RNA, 18 nt, Shigella flexneri 2a str. 301
ccgccaguuuguagccaa

SEQ ID NO: 3923744 - RNA, 19 nt, Shigella flexneri 2a str. 301
ccgccauaaacagcaggca

SEQ ID NO: 3923745 - RNA, 13 nt, Shigella flexneri 2a str. 301
ccgccaucagcag

SEQ ID NO: 3923746 - RNA, 15 nt, Shigella flexneri 2a str. 301
ccgccaucgcccauc

SEQ ID NO: 3923747 - RNA, 16 nt, Shigella flexneri 2a str. 301
ccgccaucucuuccag

SEQ ID NO: 3923748 - RNA, 19 nt, Shigella flexneri 2a str. 301
ccgccaucucuuccagcga

SEQ ID NO: 3923749 - RNA, 13 nt, Shigella flexneri 2a str. 301
ccgccaucuucuu

SEQ ID NO: 3923750 - RNA, 13 nt, Shigella flexneri 2a str. 301
ccgccaugcauga

SEQ ID NO: 3923751 - RNA, 18 nt, Shigella flexneri 2a str. 301
ccgccauuaaacgcagua

SEQ ID NO: 3923752 - RNA, 14 nt, Shigella flexneri 2a str. 301
ccgcccacaccagu

SEQ ID NO: 3923753 - RNA, 19 nt, Shigella flexneri 2a str. 301
ccgcccagaagcacugcca

SEQ ID NO: 3923754 - RNA, 15 nt, Shigella flexneri 2a str. 301
ccgcccauaaauucc

SEQ ID NO: 3923755 - RNA, 18 nt, Shigella flexneri 2a str. 301
ccgccccggguuuccugg

SEQ ID NO: 3923756 - RNA, 11 nt, Shigella flexneri 2a str. 301
ccgccccugca

SEQ ID NO: 3923757 - RNA, 21 nt, Shigella flexneri 2a str. 301
ccgcccgauaaaacgguuuau

SEQ ID NO: 3923758 - RNA, 17 nt, Shigella flexneri 2a str. 301
ccgcccgaugaauagca

SEQ ID NO: 3923759 - RNA, 18 nt, Shigella flexneri 2a str. 301
ccgcccguuuucuccagc

SEQ ID NO: 3923760 - RNA, 23 nt, Shigella flexneri 2a str. 301
ccgcccguuuucuccagcgccgc

SEQ ID NO: 3923761 - RNA, 12 nt, Shigella flexneri 2a str. 301
ccgcccuacgcg

SEQ ID NO: 3923762 - RNA, 21 nt, Shigella flexneri 2a str. 301
ccgcccugcggcugaccacca

SEQ ID NO: 3923763 - RNA, 21 nt, Shigella flexneri 2a str. 301
ccgcccuguuugguugccagc

SEQ ID NO: 3923764 - RNA, 20 nt, Shigella flexneri 2a str. 301
ccgccgaggauacagccgaa

SEQ ID NO: 3923765 - RNA, 17 nt, Shigella flexneri 2a str. 301
ccgccgaucucaccgau

SEQ ID NO: 3923766 - RNA, 18 nt, Shigella flexneri 2a str. 301
ccgccgauguugcaugau

SEQ ID NO: 3923767 - RNA, 22 nt, Shigella flexneri 2a str. 301
ccgccgauuuccugcgucgcua

SEQ ID NO: 3923768 - RNA, 14 nt, Shigella flexneri 2a str. 301
ccgccgcaauccgc

SEQ ID NO: 3923769 - RNA, 19 nt, Shigella flexneri 2a str. 301
ccgccgcgaaccugugaaa

SEQ ID NO: 3923770 - RNA, 21 nt, Shigella flexneri 2a str. 301
ccgccgcuauuauaucgcucu

SEQ ID NO: 3923771 - RNA, 14 nt, Shigella flexneri 2a str. 301
ccgccgcuccucau

SEQ ID NO: 3923772 - RNA, 16 nt, Shigella flexneri 2a str. 301
ccgccgcuucaucggu

SEQ ID NO: 3923773 - RNA, 23 nt, Shigella flexneri 2a str. 301
ccgccgguggcguuuccagcagu

SEQ ID NO: 3923774 - RNA, 14 nt, Shigella flexneri 2a str. 301
ccgccguaacuggc

SEQ ID NO: 3923775 - RNA, 18 nt, Shigella flexneri 2a str. 301
ccgccguauguucucugg

SEQ ID NO: 3923776 - RNA, 16 nt, Shigella flexneri 2a str. 301
ccgccgugcugccagc

SEQ ID NO: 3923777 - RNA, 17 nt, Shigella flexneri 2a str. 301
ccgccguguucuucggu

SEQ ID NO: 3923778 - RNA, 19 nt, Shigella flexneri 2a str. 301
ccgccguuagcuucagccg

SEQ ID NO: 3923779 - RNA, 16 nt, Shigella flexneri 2a str. 301
ccgccuaauuacauaa

SEQ ID NO: 3923780 - RNA, 16 nt, Shigella flexneri 2a str. 301
ccgccuaccauaauca

SEQ ID NO: 3923781 - RNA, 19 nt, Shigella flexneri 2a str. 301
ccgccucacuauccgcccc

SEQ ID NO: 3923782 - RNA, 15 nt, Shigella flexneri 2a str. 301
ccgccucagccagaa

SEQ ID NO: 3923783 - RNA, 19 nt, Shigella flexneri 2a str. 301
ccgccugauagaccggacc

SEQ ID NO: 3923784 - RNA, 20 nt, Shigella flexneri 2a str. 301
ccgccugaucauuuccgguu

SEQ ID NO: 3923785 - RNA, 15 nt, Shigella flexneri 2a str. 301
ccgccuguuccagca

SEQ ID NO: 3923786 - RNA, 12 nt, Shigella flexneri 2a str. 301
ccgccuugcugu

SEQ ID NO: 3923787 - RNA, 16 nt, Shigella flexneri 2a str. 301
ccgccuuucacgccgg

SEQ ID NO: 3923788 - RNA, 19 nt, Shigella flexneri 2a str. 301
ccgccuuugaucucaaacg

SEQ ID NO: 3923789 - RNA, 14 nt, Shigella flexneri 2a str. 301
ccgcgaaauaauca

SEQ ID NO: 3923790 - RNA, 23 nt, Shigella flexneri 2a str. 301
ccgcgaaauaaucaaaugaaugc

SEQ ID NO: 3923791 - RNA, 17 nt, Shigella flexneri 2a str. 301
ccgcgaaccggaccagc

SEQ ID NO: 3923792 - RNA, 21 nt, Shigella flexneri 2a str. 301
ccgcgaacggggcugccagcu

SEQ ID NO: 3923793 - RNA, 16 nt, Shigella flexneri 2a str. 301
ccgcgacgacgacagg

SEQ ID NO: 3923794 - RNA, 19 nt, Shigella flexneri 2a str. 301
ccgcgacgacgacaggcaa

SEQ ID NO: 3923795 - RNA, 12 nt, Shigella flexneri 2a str. 301
ccgcgacuggga

SEQ ID NO: 3923796 - RNA, 15 nt, Shigella flexneri 2a str. 301
ccgcgaguaaucaca

SEQ ID NO: 3923797 - RNA, 18 nt, Shigella flexneri 2a str. 301
ccgcgauaaaaauccugu

SEQ ID NO: 3923798 - RNA, 14 nt, Shigella flexneri 2a str. 301
ccgcgauccagcgc

SEQ ID NO: 3923799 - RNA, 15 nt, Shigella flexneri 2a str. 301
ccggauaaacaaugu

SEQ ID NO: 3923800 - RNA, 22 nt, Shigella flexneri 2a str. 301
ccggauaaauuuaaaacugccu

SEQ ID NO: 3923801 - RNA, 22 nt, Shigella flexneri 2a str. 301
ccggauaaggcauuuacgccgc

SEQ ID NO: 3923802 - RNA, 22 nt, Shigella flexneri 2a str. 301
ccggauaaggcguucgcgccgc

SEQ ID NO: 3923803 - RNA, 22 nt, Shigella flexneri 2a str. 301
ccggauaaggcguuuacgccgc

SEQ ID NO: 3923804 - RNA, 21 nt, Shigella flexneri 2a str. 301
ccggauaagguguuuacaccg

SEQ ID NO: 3923805 - RNA, 16 nt, Shigella flexneri 2a str. 301
ccggauauccacccgc

SEQ ID NO: 3923806 - RNA, 16 nt, Shigella flexneri 2a str. 301
ccggauaugcggggau

SEQ ID NO: 3923807 - RNA, 14 nt, Shigella flexneri 2a str. 301
ccggaucgcuuucu

SEQ ID NO: 3923808 - RNA, 20 nt, Shigella flexneri 2a str. 301
ccggaugacacaucaccucc

SEQ ID NO: 3923809 - RNA, 16 nt, Shigella flexneri 2a str. 301
ccggaugacagacucc

SEQ ID NO: 3923810 - RNA, 20 nt, Shigella flexneri 2a str. 301
ccggaugacguuucgcgcca

SEQ ID NO: 3923811 - RNA, 16 nt, Shigella flexneri 2a str. 301
ccggaugcaccaucuc

SEQ ID NO: 3923812 - RNA, 15 nt, Shigella flexneri 2a str. 301
ccggaugccucuccu

SEQ ID NO: 3923813 - RNA, 19 nt, Shigella flexneri 2a str. 301
ccggaugcgacauagaucu

SEQ ID NO: 3923814 - RNA, 17 nt, Shigella flexneri 2a str. 301
ccggaugcgccagcauc

SEQ ID NO: 3923815 - RNA, 16 nt, Shigella flexneri 2a str. 301
ccggaugcggcguaaa

SEQ ID NO: 3923816 - RNA, 21 nt, Shigella flexneri 2a str. 301
ccggaugcgggugaacgcguu

SEQ ID NO: 3923817 - RNA, 13 nt, Shigella flexneri 2a str. 301
ccggauggcagag

SEQ ID NO: 3923818 - RNA, 15 nt, Shigella flexneri 2a str. 301
ccggauguuuccauc

SEQ ID NO: 3923819 - RNA, 14 nt, Shigella flexneri 2a str. 301
ccggauucagauug

SEQ ID NO: 3923820 - RNA, 15 nt, Shigella flexneri 2a str. 301
ccggauuuuuuuucc

SEQ ID NO: 3923821 - RNA, 16 nt, Shigella flexneri 2a str. 301
ccggauuuuuuuuccg

SEQ ID NO: 3923822 - RNA, 18 nt, Shigella flexneri 2a str. 301
ccggcaaaaacaacgagc

SEQ ID NO: 3923823 - RNA, 18 nt, Shigella flexneri 2a str. 301
ccggcaaagaaccaacgc

SEQ ID NO: 3923824 - RNA, 19 nt, Shigella flexneri 2a str. 301
ccggcaacaaugccacgcc

SEQ ID NO: 3923825 - RNA, 16 nt, Shigella flexneri 2a str. 301
ccggcaaccacaccca

SEQ ID NO: 3923826 - RNA, 14 nt, Shigella flexneri 2a str. 301
ccggcaaccagcac

SEQ ID NO: 3923827 - RNA, 18 nt, Shigella flexneri 2a str. 301
ccggcaacgacugcgagc

SEQ ID NO: 3923828 - RNA, 18 nt, Shigella flexneri 2a str. 301
ccggcaacgucaguccca

SEQ ID NO: 3923829 - RNA, 13 nt, Shigella flexneri 2a str. 301
ccggcaagauucc

SEQ ID NO: 3923830 - RNA, 14 nt, Shigella flexneri 2a str. 301
ccggcaagauucca

SEQ ID NO: 3923831 - RNA, 13 nt, Shigella flexneri 2a str. 301
ccggcaauaaaac

SEQ ID NO: 3923832 - RNA, 15 nt, Shigella flexneri 2a str. 301
ccggcaauaaaacag

SEQ ID NO: 3923833 - RNA, 16 nt, Shigella flexneri 2a str. 301
ccggcaauaaaacagg

SEQ ID NO: 3923834 - RNA, 19 nt, Shigella flexneri 2a str. 301
ccggcaaucggugcaaaug

SEQ ID NO: 3923835 - RNA, 20 nt, Shigella flexneri 2a str. 301
ccggcaccaauguaggccug

SEQ ID NO: 3923836 - RNA, 14 nt, Shigella flexneri 2a str. 301
ccggcacuucaacu

SEQ ID NO: 3923837 - RNA, 16 nt, Shigella flexneri 2a str. 301
ccggcagaagcaauca

SEQ ID NO: 3923838 - RNA, 18 nt, Shigella flexneri 2a str. 301
ccggcagaagcaaucauc

SEQ ID NO: 3923839 - RNA, 13 nt, Shigella flexneri 2a str. 301
ccggcagagaaaa

SEQ ID NO: 3923840 - RNA, 22 nt, Shigella flexneri 2a str. 301
ccggcagagaaaaugccgcaca

SEQ ID NO: 3923841 - RNA, 15 nt, Shigella flexneri 2a str. 301
ccggcagcaugugua

SEQ ID NO: 3923842 - RNA, 15 nt, Shigella flexneri 2a str. 301
ccggcaggugggcgc

SEQ ID NO: 3923843 - RNA, 24 nt, Shigella flexneri 2a str. 301
ccggcagucaguguuaucaaauca

SEQ ID NO: 3923844 - RNA, 14 nt, Shigella flexneri 2a str. 301
ccggcauauaccuc

SEQ ID NO: 3923845 - RNA, 13 nt, Shigella flexneri 2a str. 301
ccggcaucaacca

SEQ ID NO: 3923846 - RNA, 16 nt, Shigella flexneri 2a str. 301
ccggcauccuuaucac

SEQ ID NO: 3923847 - RNA, 21 nt, Shigella flexneri 2a str. 301
ccggcaucgcaaaccagacgc

SEQ ID NO: 3923848 - RNA, 23 nt, Shigella flexneri 2a str. 301
ccggcaucguuugcugccuucac

SEQ ID NO: 3923849 - RNA, 14 nt, Shigella flexneri 2a str. 301
ccggcaugaacaaa

SEQ ID NO: 3923850 - RNA, 13 nt, Shigella flexneri 2a str. 301
ccggcauuaucac

SEQ ID NO: 3923851 - RNA, 19 nt, Shigella flexneri 2a str. 301
ccggcauuaucacaucagc

SEQ ID NO: 3923852 - RNA, 12 nt, Shigella flexneri 2a str. 301
ccggccagcauc

SEQ ID NO: 3923853 - RNA, 16 nt, Shigella flexneri 2a str. 301
ccggccagcgccacca

SEQ ID NO: 3923854 - RNA, 17 nt, Shigella flexneri 2a str. 301
ccggccagcgccgcgcg

SEQ ID NO: 3923855 - RNA, 22 nt, Shigella flexneri 2a str. 301
ccggccccugaucggccaugau

SEQ ID NO: 3923856 - RNA, 17 nt, Shigella flexneri 2a str. 301
ccggccuacaagaacca

SEQ ID NO: 3923857 - RNA, 14 nt, Shigella flexneri 2a str. 301
ccggccuacacaug

SEQ ID NO: 3923858 - RNA, 19 nt, Shigella flexneri 2a str. 301
ccggccuaccguucaggca

SEQ ID NO: 3923859 - RNA, 17 nt, Shigella flexneri 2a str. 301
ccggccuaucaacgucg

SEQ ID NO: 3923860 - RNA, 22 nt, Shigella flexneri 2a str. 301
ccggccugcacugcaggccgga

SEQ ID NO: 3923861 - RNA, 15 nt, Shigella flexneri 2a str. 301
ccggccuggauggcu

SEQ ID NO: 3923862 - RNA, 23 nt, Shigella flexneri 2a str. 301
ccggccuguuuauccaucacgcu

SEQ ID NO: 3923863 - RNA, 16 nt, Shigella flexneri 2a str. 301
ccggcgaaagagcugg

SEQ ID NO: 3923864 - RNA, 19 nt, Shigella flexneri 2a str. 301
ccggcgacacaucuaaugc

SEQ ID NO: 3923865 - RNA, 20 nt, Shigella flexneri 2a str. 301
ccggcgacguauugcgcaga

SEQ ID NO: 3923866 - RNA, 19 nt, Shigella flexneri 2a str. 301
ccggcgcaguaugacuaca

SEQ ID NO: 3923867 - RNA, 14 nt, Shigella flexneri 2a str. 301
ccggcgcauccaug

SEQ ID NO: 3923868 - RNA, 19 nt, Shigella flexneri 2a str. 301
ccggcggaauggucggcgc

SEQ ID NO: 3923869 - RNA, 22 nt, Shigella flexneri 2a str. 301
ccggcgggaaaaaucuucgauc

SEQ ID NO: 3923870 - RNA, 23 nt, Shigella flexneri 2a str. 301
ccggcguaccuuugccuuccagc

SEQ ID NO: 3923871 - RNA, 22 nt, Shigella flexneri 2a str. 301
ccggcguccaccugcgucgcgc

SEQ ID NO: 3923872 - RNA, 17 nt, Shigella flexneri 2a str. 301
ccggcgucgcauccgac

SEQ ID NO: 3923873 - RNA, 18 nt, Shigella flexneri 2a str. 301
ccggcgucgcauccgaca

SEQ ID NO: 3923874 - RNA, 17 nt, Shigella flexneri 2a str. 301
ccggcgucgcauccggc

SEQ ID NO: 3923875 - RNA, 18 nt, Shigella flexneri 2a str. 301
ccggcgugacgaucacca

SEQ ID NO: 3923876 - RNA, 23 nt, Shigella flexneri 2a str. 301
ccggcguuaugccguaaugccag

SEQ ID NO: 3923877 - RNA, 14 nt, Shigella flexneri 2a str. 301
ccggcguuucacau

SEQ ID NO: 3923878 - RNA, 13 nt, Shigella flexneri 2a str. 301
ccggcucccgcag

SEQ ID NO: 3923879 - RNA, 16 nt, Shigella flexneri 2a str. 301
ccggcucccgcagcca

SEQ ID NO: 3923880 - RNA, 22 nt, Shigella flexneri 2a str. 301
ccggcuccgguuaacgccgcgc

SEQ ID NO: 3923881 - RNA, 22 nt, Shigella flexneri 2a str. 301
ccggcugaggcguuucaacucc

SEQ ID NO: 3923882 - RNA, 14 nt, Shigella flexneri 2a str. 301
ccggcuguuccagc

SEQ ID NO: 3923883 - RNA, 18 nt, Shigella flexneri 2a str. 301
ccggcuuaaugcauggca

SEQ ID NO: 3923884 - RNA, 16 nt, Shigella flexneri 2a str. 301
ccggcuuaccgcuccg

SEQ ID NO: 3923885 - RNA, 18 nt, Shigella flexneri 2a str. 301
ccggcuuguucaucacca

SEQ ID NO: 3923886 - RNA, 14 nt, Shigella flexneri 2a str. 301
ccgggagaaggccu

SEQ ID NO: 3923887 - RNA, 14 nt, Shigella flexneri 2a str. 301
ccgggaucacauca

SEQ ID NO: 3923888 - RNA, 22 nt, Shigella flexneri 2a str. 301
ccgggaucaccgaaccagggcg

SEQ ID NO: 3923889 - RNA, 18 nt, Shigella flexneri 2a str. 301
ccgggaucagacgaccca

SEQ ID NO: 3923890 - RNA, 17 nt, Shigella flexneri 2a str. 301
ccgggauggucagcgga

SEQ ID NO: 3923891 - RNA, 13 nt, Shigella flexneri 2a str. 301
ccgggauugagau

SEQ ID NO: 3923892 - RNA, 14 nt, Shigella flexneri 2a str. 301
ccgggcauaaacac

SEQ ID NO: 3923893 - RNA, 16 nt, Shigella flexneri 2a str. 301
ccgggcaucagcagca

SEQ ID NO: 3923894 - RNA, 12 nt, Shigella flexneri 2a str. 301
ccgggcuggauu

SEQ ID NO: 3923895 - RNA, 19 nt, Shigella flexneri 2a str. 301
ccgggcuuccggcaauggc

SEQ ID NO: 3923896 - RNA, 17 nt, Shigella flexneri 2a str. 301
ccgggcuucucgcucga

SEQ ID NO: 3923897 - RNA, 13 nt, Shigella flexneri 2a str. 301
ccgggcuuuccgc

SEQ ID NO: 3923898 - RNA, 21 nt, Shigella flexneri 2a str. 301
ccggggccucuuacgccgcca

SEQ ID NO: 3923899 - RNA, 13 nt, Shigella flexneri 2a str. 301
ccguccccucgcc

SEQ ID NO: 3923900 - RNA, 15 nt, Shigella flexneri 2a str. 301
ccguccggcaucgca

SEQ ID NO: 3923901 - RNA, 16 nt, Shigella flexneri 2a str. 301
ccgucgagcagagaaa

SEQ ID NO: 3923902 - RNA, 12 nt, Shigella flexneri 2a str. 301
ccgucgcauggg

SEQ ID NO: 3923903 - RNA, 21 nt, Shigella flexneri 2a str. 301
ccgucgcauggggaucgugau

SEQ ID NO: 3923904 - RNA, 17 nt, Shigella flexneri 2a str. 301
ccgucgccuucaacgua

SEQ ID NO: 3923905 - RNA, 14 nt, Shigella flexneri 2a str. 301
ccgucgucccuucc

SEQ ID NO: 3923906 - RNA, 22 nt, Shigella flexneri 2a str. 301
ccgucguuaccggucacuggca

SEQ ID NO: 3923907 - RNA, 21 nt, Shigella flexneri 2a str. 301
ccgucguugagcaucugcaaa

SEQ ID NO: 3923908 - RNA, 17 nt, Shigella flexneri 2a str. 301
ccgucuucccgcagcca

SEQ ID NO: 3923909 - RNA, 14 nt, Shigella flexneri 2a str. 301
ccgucuuuuuucac

SEQ ID NO: 3923910 - RNA, 20 nt, Shigella flexneri 2a str. 301
ccgugaaaacagcaaccucc

SEQ ID NO: 3923911 - RNA, 14 nt, Shigella flexneri 2a str. 301
ccgugaauuacugc

SEQ ID NO: 3923912 - RNA, 21 nt, Shigella flexneri 2a str. 301
ccgugacacacugaaccgcgc

SEQ ID NO: 3923913 - RNA, 17 nt, Shigella flexneri 2a str. 301
ccgugacugggugccgc

SEQ ID NO: 3923914 - RNA, 24 nt, Shigella flexneri 2a str. 301
ccgugagcggaacggcaggaauac

SEQ ID NO: 3923915 - RNA, 18 nt, Shigella flexneri 2a str. 301
ccgugaucguggccauga

SEQ ID NO: 3923916 - RNA, 18 nt, Shigella flexneri 2a str. 301
ccgugaugcggucgcuga

SEQ ID NO: 3923917 - RNA, 12 nt, Shigella flexneri 2a str. 301
ccgugauucacg

SEQ ID NO: 3923918 - RNA, 17 nt, Shigella flexneri 2a str. 301
ccgugcaacugcggcgc

SEQ ID NO: 3923919 - RNA, 13 nt, Shigella flexneri 2a str. 301
ccgugcacaccga

SEQ ID NO: 3923920 - RNA, 23 nt, Shigella flexneri 2a str. 301
ccgugcagcgcaaucgccuccag

SEQ ID NO: 3923921 - RNA, 19 nt, Shigella flexneri 2a str. 301
ccgugcaucuccugaaaca

SEQ ID NO: 3923922 - RNA, 16 nt, Shigella flexneri 2a str. 301
ccgugccccauauggc

SEQ ID NO: 3923923 - RNA, 18 nt, Shigella flexneri 2a str. 301
ccgugccgcuaauggugc

SEQ ID NO: 3923924 - RNA, 23 nt, Shigella flexneri 2a str. 301
ccgugcgggcaucaucuuccggu

SEQ ID NO: 3923925 - RNA, 17 nt, Shigella flexneri 2a str. 301
ccgugcugacucagcgg

SEQ ID NO: 3923926 - RNA, 15 nt, Shigella flexneri 2a str. 301
ccgugcuguacagca

SEQ ID NO: 3923927 - RNA, 14 nt, Shigella flexneri 2a str. 301
ccguggauuuaaug

SEQ ID NO: 3923928 - RNA, 23 nt, Shigella flexneri 2a str. 301
ccguggcuguugacguccagccc

SEQ ID NO: 3923929 - RNA, 22 nt, Shigella flexneri 2a str. 301
ccguggucggcaaaauacauga

SEQ ID NO: 3923930 - RNA, 19 nt, Shigella flexneri 2a str. 301
ccgugguggcagccagcca

SEQ ID NO: 3923931 - RNA, 20 nt, Shigella flexneri 2a str. 301
ccguuaacccgucugguuug

SEQ ID NO: 3923932 - RNA, 15 nt, Shigella flexneri 2a str. 301
ccguuaagaugguua

SEQ ID NO: 3923933 - RNA, 13 nt, Shigella flexneri 2a str. 301
ccguuaagcugga

SEQ ID NO: 3923934 - RNA, 15 nt, Shigella flexneri 2a str. 301
ccguuaauuuccgcg

SEQ ID NO: 3923935 - RNA, 22 nt, Shigella flexneri 2a str. 301
ccguuaccguaccaaccgcaau

SEQ ID NO: 3923936 - RNA, 15 nt, Shigella flexneri 2a str. 301
ccguuaucacagcag

SEQ ID NO: 3923937 - RNA, 19 nt, Shigella flexneri 2a str. 301
ccguuauccugaucaagca

SEQ ID NO: 3923938 - RNA, 18 nt, Shigella flexneri 2a str. 301
ccguuauuacgcccgcca

SEQ ID NO: 3923939 - RNA, 13 nt, Shigella flexneri 2a str. 301
ccguucaguuccg

SEQ ID NO: 3923940 - RNA, 23 nt, Shigella flexneri 2a str. 301
ccguucauauggagcaaaagugg

SEQ ID NO: 3923941 - RNA, 13 nt, Shigella flexneri 2a str. 301
ccguucauccgcu

SEQ ID NO: 3923942 - RNA, 12 nt, Shigella flexneri 2a str. 301
ccguuccgcgac

SEQ ID NO: 3923943 - RNA, 22 nt, Shigella flexneri 2a str. 301
ccguucgcuaccuuucagugcg

SEQ ID NO: 3923944 - RNA, 12 nt, Shigella flexneri 2a str. 301
ccguucuucccg

SEQ ID NO: 3923945 - RNA, 18 nt, Shigella flexneri 2a str. 301
ccguugaaaaugcugguu

SEQ ID NO: 3923946 - RNA, 18 nt, Shigella flexneri 2a str. 301
ccguugaaauugcugguu

SEQ ID NO: 3923947 - RNA, 18 nt, Shigella flexneri 2a str. 301
ccguugauuuuauuggca

SEQ ID NO: 3923948 - RNA, 16 nt, Shigella flexneri 2a str. 301
ccguugcgcgucaacu

SEQ ID NO: 3923949 - RNA, 18 nt, Shigella flexneri 2a str. 301
ccguuggcagaccgccaa

SEQ ID NO: 3923950 - RNA, 13 nt, Shigella flexneri 2a str. 301
ccguuggcgcugg

SEQ ID NO: 3923951 - RNA, 17 nt, Shigella flexneri 2a str. 301
ccguugucgacacccuc

SEQ ID NO: 3923952 - RNA, 19 nt, Shigella flexneri 2a str. 301
ccguugugcgauccacgcc

SEQ ID NO: 3923953 - RNA, 20 nt, Shigella flexneri 2a str. 301
ccguugugcgauccacgcca

SEQ ID NO: 3923954 - RNA, 16 nt, Shigella flexneri 2a str. 301
ccguuuaccccaguca

SEQ ID NO: 3923955 - RNA, 15 nt, Shigella flexneri 2a str. 301
ccguuuacggcuaaa

SEQ ID NO: 3923956 - RNA, 18 nt, Shigella flexneri 2a str. 301
ccguuucccugucucuca

SEQ ID NO: 3923957 - RNA, 16 nt, Shigella flexneri 2a str. 301
ccguuucgcagguucc

SEQ ID NO: 3923958 - RNA, 20 nt, Shigella flexneri 2a str. 301
ccguuucuacaagcagagag

SEQ ID NO: 3923959 - RNA, 19 nt, Shigella flexneri 2a str. 301
ccguuugcgucaguuuuug

SEQ ID NO: 3923960 - RNA, 14 nt, Shigella flexneri 2a str. 301
ccguuuucaccuua

SEQ ID NO: 3923961 - RNA, 20 nt, Shigella flexneri 2a str. 301
ccguuuuccagccuuuuucu

SEQ ID NO: 3923962 - RNA, 12 nt, Shigella flexneri 2a str. 301
ccguuuucucca

SEQ ID NO: 3923963 - RNA, 13 nt, Shigella flexneri 2a str. 301
ccuaaaggcaaaa

SEQ ID NO: 3923964 - RNA, 14 nt, Shigella flexneri 2a str. 301
ccuaaagggcggca

SEQ ID NO: 3923965 - RNA, 12 nt, Shigella flexneri 2a str. 301
ccuaaaucgcua

SEQ ID NO: 3923966 - RNA, 17 nt, Shigella flexneri 2a str. 301
ccuaaauggaaaauugg

SEQ ID NO: 3923967 - RNA, 16 nt, Shigella flexneri 2a str. 301
ccuaacaauucgccag

SEQ ID NO: 3923968 - RNA, 15 nt, Shigella flexneri 2a str. 301
ccuaacacaugcaag

SEQ ID NO: 3923969 - RNA, 21 nt, Shigella flexneri 2a str. 301
ccuaacacaugcaagucgaac

SEQ ID NO: 3923970 - RNA, 16 nt, Shigella flexneri 2a str. 301
ccuaacaucauccccg

SEQ ID NO: 3923971 - RNA, 14 nt, Shigella flexneri 2a str. 301
ccuaacauuuuacu

SEQ ID NO: 3923972 - RNA, 15 nt, Shigella flexneri 2a str. 301
ccuaauccagccuac

SEQ ID NO: 3923973 - RNA, 17 nt, Shigella flexneri 2a str. 301
ccuaaucgacgcggacg

SEQ ID NO: 3923974 - RNA, 18 nt, Shigella flexneri 2a str. 301
ccuaauuacauaacacua

SEQ ID NO: 3923975 - RNA, 22 nt, Shigella flexneri 2a str. 301
ccuaauuccgcgcgaacgguaa

SEQ ID NO: 3923976 - RNA, 19 nt, Shigella flexneri 2a str. 301
ccuacaaaaucuugcaaaa

SEQ ID NO: 3923977 - RNA, 22 nt, Shigella flexneri 2a str. 301
ccuacacauuaucucaacacac

SEQ ID NO: 3923978 - RNA, 23 nt, Shigella flexneri 2a str. 301
ccuacauagucccugcaauagau

SEQ ID NO: 3923979 - RNA, 18 nt, Shigella flexneri 2a str. 301
ccuacauuggugccggau

SEQ ID NO: 3923980 - RNA, 13 nt, Shigella flexneri 2a str. 301
ccuaccaaaccug

SEQ ID NO: 3923981 - RNA, 16 nt, Shigella flexneri 2a str. 301
ccuaccaaaccugcac

SEQ ID NO: 3923982 - RNA, 23 nt, Shigella flexneri 2a str. 301
ccuaccauaaucagcguaugcag

SEQ ID NO: 3923983 - RNA, 17 nt, Shigella flexneri 2a str. 301
ccuaccgcccgcgcggu

SEQ ID NO: 3923984 - RNA, 18 nt, Shigella flexneri 2a str. 301
ccuaccggcuggcgcaua

SEQ ID NO: 3923985 - RNA, 17 nt, Shigella flexneri 2a str. 301
ccuaccugcaguucauc

SEQ ID NO: 3923986 - RNA, 17 nt, Shigella flexneri 2a str. 301
ccuacgcgcccgcgcag

SEQ ID NO: 3923987 - RNA, 22 nt, Shigella flexneri 2a str. 301
ccuacgugcgcaauaacccaga

SEQ ID NO: 3923988 - RNA, 18 nt, Shigella flexneri 2a str. 301
ccuacucucgcaugggga

SEQ ID NO: 3923989 - RNA, 15 nt, Shigella flexneri 2a str. 301
ccuagaaaucauuca

SEQ ID NO: 3923990 - RNA, 18 nt, Shigella flexneri 2a str. 301
ccuagagcaucaugaaua

SEQ ID NO: 3923991 - RNA, 19 nt, Shigella flexneri 2a str. 301
ccuaguaccguuuuguaga

SEQ ID NO: 3923992 - RNA, 22 nt, Shigella flexneri 2a str. 301
ccuagugcgguaaauuuuuuga

SEQ ID NO: 3923993 - RNA, 13 nt, Shigella flexneri 2a str. 301
ccuauaguucaau

SEQ ID NO: 3923994 - RNA, 14 nt, Shigella flexneri 2a str. 301
ccuauccagaagcc

SEQ ID NO: 3923995 - RNA, 22 nt, Shigella flexneri 2a str. 301
ccuaucgaugaacgguuuaaac

SEQ ID NO: 3923996 - RNA, 15 nt, Shigella flexneri 2a str. 301
ccuaucuucauggag

SEQ ID NO: 3923997 - RNA, 18 nt, Shigella flexneri 2a str. 301
ccuaugcaacaacugaaa

SEQ ID NO: 3923998 - RNA, 12 nt, Shigella flexneri 2a str. 301
ccuauugcugcu

SEQ ID NO: 3923999 - RNA, 18 nt, Shigella flexneri 2a str. 301
ccugaaucaccugauuga

SEQ ID NO: 3924000 - RNA, 12 nt, Shigella flexneri 2a str. 301
ccugacaacaaa

SEQ ID NO: 3924001 - RNA, 21 nt, Shigella flexneri 2a str. 301
ccugacaagguacgaaaaaaa

SEQ ID NO: 3924002 - RNA, 13 nt, Shigella flexneri 2a str. 301
ccugaccaaagcc

SEQ ID NO: 3924003 - RNA, 19 nt, Shigella flexneri 2a str. 301
ccugaccaaagccccgcuu

SEQ ID NO: 3924004 - RNA, 15 nt, Shigella flexneri 2a str. 301
ccugacccagcaagg

SEQ ID NO: 3924005 - RNA, 17 nt, Shigella flexneri 2a str. 301
ccugacccagcaaggcg

SEQ ID NO: 3924006 - RNA, 16 nt, Shigella flexneri 2a str. 301
ccugacccagcaccag

SEQ ID NO: 3924007 - RNA, 17 nt, Shigella flexneri 2a str. 301
ccugaccugcgaccagu

SEQ ID NO: 3924008 - RNA, 16 nt, Shigella flexneri 2a str. 301
ccugaccuuuuuucag

SEQ ID NO: 3924009 - RNA, 20 nt, Shigella flexneri 2a str. 301
ccugacgaccacccagcauc

SEQ ID NO: 3924010 - RNA, 21 nt, Shigella flexneri 2a str. 301
ccugacgagcuuucuuauuug

SEQ ID NO: 3924011 - RNA, 24 nt, Shigella flexneri 2a str. 301
ccugacgcccguuaccaauaccaa

SEQ ID NO: 3924012 - RNA, 15 nt, Shigella flexneri 2a str. 301
ccugacgguuuaccu

SEQ ID NO: 3924013 - RNA, 16 nt, Shigella flexneri 2a str. 301
ccugacgguuuaccug

SEQ ID NO: 3924014 - RNA, 14 nt, Shigella flexneri 2a str. 301
ccugagaagcgcaa

SEQ ID NO: 3924015 - RNA, 22 nt, Shigella flexneri 2a str. 301
ccugagaauuccggcagagaaa

SEQ ID NO: 3924016 - RNA, 16 nt, Shigella flexneri 2a str. 301
ccugagcagccaccac

SEQ ID NO: 3924017 - RNA, 15 nt, Shigella flexneri 2a str. 301
ccugagccggaguug

SEQ ID NO: 3924018 - RNA, 18 nt, Shigella flexneri 2a str. 301
ccugagcgccauaaacag

SEQ ID NO: 3924019 - RNA, 22 nt, Shigella flexneri 2a str. 301
ccugagcgguuaacacggcagc

SEQ ID NO: 3924020 - RNA, 19 nt, Shigella flexneri 2a str. 301
ccugaguuaccgcuauuug

SEQ ID NO: 3924021 - RNA, 21 nt, Shigella flexneri 2a str. 301
ccugauaagacgcgacaagcg

SEQ ID NO: 3924022 - RNA, 21 nt, Shigella flexneri 2a str. 301
ccugauaagacgcgccagcgu

SEQ ID NO: 3924023 - RNA, 16 nt, Shigella flexneri 2a str. 301
ccugauaaucugcuga

SEQ ID NO: 3924024 - RNA, 17 nt, Shigella flexneri 2a str. 301
ccugauacucucgcucc

SEQ ID NO: 3924025 - RNA, 17 nt, Shigella flexneri 2a str. 301
ccugauagcacgucacg

SEQ ID NO: 3924026 - RNA, 19 nt, Shigella flexneri 2a str. 301
ccugauagcccgcacaaag

SEQ ID NO: 3924027 - RNA, 22 nt, Shigella flexneri 2a str. 301
ccugauagcccgcacaaagcac

SEQ ID NO: 3924028 - RNA, 15 nt, Shigella flexneri 2a str. 301
ccugaucaagcacau

SEQ ID NO: 3924029 - RNA, 16 nt, Shigella flexneri 2a str. 301
ccugaucaugugcagg

SEQ ID NO: 3924030 - RNA, 15 nt, Shigella flexneri 2a str. 301
ccugauccugcaaca

SEQ ID NO: 3924031 - RNA, 15 nt, Shigella flexneri 2a str. 301
ccugaucgacgcgcu

SEQ ID NO: 3924032 - RNA, 19 nt, Shigella flexneri 2a str. 301
ccugaucgccauauuucuc

SEQ ID NO: 3924033 - RNA, 21 nt, Shigella flexneri 2a str. 301
ccugaucuuccgcgucauuca

SEQ ID NO: 3924034 - RNA, 21 nt, Shigella flexneri 2a str. 301
ccugaugacaugcaaugauuc

SEQ ID NO: 3924035 - RNA, 21 nt, Shigella flexneri 2a str. 301
ccugaugcagcguaaaccccu

SEQ ID NO: 3924036 - RNA, 19 nt, Shigella flexneri 2a str. 301
ccugaugcaucagucacga

SEQ ID NO: 3924037 - RNA, 16 nt, Shigella flexneri 2a str. 301
ccugaugcgacgcuua

SEQ ID NO: 3924038 - RNA, 16 nt, Shigella flexneri 2a str. 301
ccugaugcgacgcuug

SEQ ID NO: 3924039 - RNA, 19 nt, Shigella flexneri 2a str. 301
ccugaugcgacgcuugacg

SEQ ID NO: 3924040 - RNA, 19 nt, Shigella flexneri 2a str. 301
ccugaugcgaugcuugacg

SEQ ID NO: 3924041 - RNA, 16 nt, Shigella flexneri 2a str. 301
ccugaugugacgcuug

SEQ ID NO: 3924042 - RNA, 16 nt, Shigella flexneri 2a str. 301
ccugcaacagcaccag

SEQ ID NO: 3924043 - RNA, 13 nt, Shigella flexneri 2a str. 301
ccugcaacgcuuu

SEQ ID NO: 3924044 - RNA, 22 nt, Shigella flexneri 2a str. 301
ccugcaacgguugauggcaguc

SEQ ID NO: 3924045 - RNA, 18 nt, Shigella flexneri 2a str. 301
ccugcaauaccgccguua

SEQ ID NO: 3924046 - RNA, 17 nt, Shigella flexneri 2a str. 301
ccugcaaugucaucagc

SEQ ID NO: 3924047 - RNA, 13 nt, Shigella flexneri 2a str. 301
ccugcaauuccug

SEQ ID NO: 3924048 - RNA, 19 nt, Shigella flexneri 2a str. 301
ccugcacaaauagccagca

SEQ ID NO: 3924049 - RNA, 12 nt, Shigella flexneri 2a str. 301
ccugcaccauug

SEQ ID NO: 3924050 - RNA, 19 nt, Shigella flexneri 2a str. 301
ccugcaccggugcauccac

SEQ ID NO: 3924051 - RNA, 16 nt, Shigella flexneri 2a str. 301
ccugcacugcaggccg

SEQ ID NO: 3924052 - RNA, 12 nt, Shigella flexneri 2a str. 301
ccugcagcugcu

SEQ ID NO: 3924053 - RNA, 16 nt, Shigella flexneri 2a str. 301
ccugcagcuggucgcc

SEQ ID NO: 3924054 - RNA, 15 nt, Shigella flexneri 2a str. 301
ccugcagggcuuuca

SEQ ID NO: 3924055 - RNA, 14 nt, Shigella flexneri 2a str. 301
ccugcagucaccug

SEQ ID NO: 3924056 - RNA, 13 nt, Shigella flexneri 2a str. 301
ccugcagugaaau

SEQ ID NO: 3924057 - RNA, 16 nt, Shigella flexneri 2a str. 301
ccugcauaaacgccgu

SEQ ID NO: 3924058 - RNA, 18 nt, Shigella flexneri 2a str. 301
ccugcauacgacgugccg

SEQ ID NO: 3924059 - RNA, 21 nt, Shigella flexneri 2a str. 301
ccugcauacgacgugccgcag

SEQ ID NO: 3924060 - RNA, 23 nt, Shigella flexneri 2a str. 301
ccugcauaucgguaaaugcuuua

SEQ ID NO: 3924061 - RNA, 13 nt, Shigella flexneri 2a str. 301
ccugcauccgcca

SEQ ID NO: 3924062 - RNA, 12 nt, Shigella flexneri 2a str. 301
ccugccacauau

SEQ ID NO: 3924063 - RNA, 19 nt, Shigella flexneri 2a str. 301
ccugccagaggagccauca

SEQ ID NO: 3924064 - RNA, 17 nt, Shigella flexneri 2a str. 301
ccugccagcgccgacag

SEQ ID NO: 3924065 - RNA, 19 nt, Shigella flexneri 2a str. 301
ccugccagcgccgacagca

SEQ ID NO: 3924066 - RNA, 14 nt, Shigella flexneri 2a str. 301
ccugccaucuggca

SEQ ID NO: 3924067 - RNA, 19 nt, Shigella flexneri 2a str. 301
ccugccaucuggcaggcuu

SEQ ID NO: 3924068 - RNA, 16 nt, Shigella flexneri 2a str. 301
ccugccaugcgcaauc

SEQ ID NO: 3924069 - RNA, 18 nt, Shigella flexneri 2a str. 301
ccugcccgcgauccagcg

SEQ ID NO: 3924070 - RNA, 22 nt, Shigella flexneri 2a str. 301
ccugccgcaggacgggcaauuc

SEQ ID NO: 3924071 - RNA, 22 nt, Shigella flexneri 2a str. 301
ccugccggagcgccaccacccu

SEQ ID NO: 3924072 - RNA, 23 nt, Shigella flexneri 2a str. 301
ccugccgucugggcaaaaucauc

SEQ ID NO: 3924073 - RNA, 13 nt, Shigella flexneri 2a str. 301
ccugccugacgga

SEQ ID NO: 3924074 - RNA, 23 nt, Shigella flexneri 2a str. 301
ccugccugacggaaaucaugcaa

SEQ ID NO: 3924075 - RNA, 17 nt, Shigella flexneri 2a str. 301
ccugccugcagcugcuc

SEQ ID NO: 3924076 - RNA, 19 nt, Shigella flexneri 2a str. 301
ccugccuucacuuccggca

SEQ ID NO: 3924077 - RNA, 13 nt, Shigella flexneri 2a str. 301
ccugcgacaggga

SEQ ID NO: 3924078 - RNA, 22 nt, Shigella flexneri 2a str. 301
ccugcgacagggaucucuucca

SEQ ID NO: 3924079 - RNA, 13 nt, Shigella flexneri 2a str. 301
ccugcgcaggcau

SEQ ID NO: 3924080 - RNA, 14 nt, Shigella flexneri 2a str. 301
ccugcgccagcggc

SEQ ID NO: 3924081 - RNA, 12 nt, Shigella flexneri 2a str. 301
ccugcgcgauga

SEQ ID NO: 3924082 - RNA, 14 nt, Shigella flexneri 2a str. 301
ccugcgcuuccagc

SEQ ID NO: 3924083 - RNA, 15 nt, Shigella flexneri 2a str. 301
ccugcggacagucac

SEQ ID NO: 3924084 - RNA, 17 nt, Shigella flexneri 2a str. 301
ccugcggcaccagcggu

SEQ ID NO: 3924085 - RNA, 19 nt, Shigella flexneri 2a str. 301
ccugcggcaccuaauaacu

SEQ ID NO: 3924086 - RNA, 22 nt, Shigella flexneri 2a str. 301
ccugcggcaccuaauaacucuc

SEQ ID NO: 3924087 - RNA, 14 nt, Shigella flexneri 2a str. 301
ccugcggccagcag

SEQ ID NO: 3924088 - RNA, 15 nt, Shigella flexneri 2a str. 301
ccugcggccagcagc

SEQ ID NO: 3924089 - RNA, 19 nt, Shigella flexneri 2a str. 301
ccugcggcggcaucgccuu

SEQ ID NO: 3924090 - RNA, 19 nt, Shigella flexneri 2a str. 301
ccugcggcugaccaccacc

SEQ ID NO: 3924091 - RNA, 20 nt, Shigella flexneri 2a str. 301
ccugcggcugcugaggcuga

SEQ ID NO: 3924092 - RNA, 23 nt, Shigella flexneri 2a str. 301
ccugcgggagcgcuuuuuuccug

SEQ ID NO: 3924093 - RNA, 18 nt, Shigella flexneri 2a str. 301
ccugcgggcauuucgcuu

SEQ ID NO: 3924094 - RNA, 16 nt, Shigella flexneri 2a str. 301
ccugcggguucuuacc

SEQ ID NO: 3924095 - RNA, 14 nt, Shigella flexneri 2a str. 301
ccugcggugcagcc

SEQ ID NO: 3924096 - RNA, 19 nt, Shigella flexneri 2a str. 301
ccugcgucuuucgcggcaa

SEQ ID NO: 3924097 - RNA, 20 nt, Shigella flexneri 2a str. 301
ccugcgugacuaaaacccuu

SEQ ID NO: 3924098 - RNA, 18 nt, Shigella flexneri 2a str. 301
ccugcguugucgcaguga

SEQ ID NO: 3924099 - RNA, 12 nt, Shigella flexneri 2a str. 301
ccuuauccggcc

SEQ ID NO: 3924100 - RNA, 20 nt, Shigella flexneri 2a str. 301
ccuuauccggccuaccguua

SEQ ID NO: 3924101 - RNA, 21 nt, Shigella flexneri 2a str. 301
ccuuauccggccuaccguuca

SEQ ID NO: 3924102 - RNA, 21 nt, Shigella flexneri 2a str. 301
ccuuaugacuacgacauugaa

SEQ ID NO: 3924103 - RNA, 17 nt, Shigella flexneri 2a str. 301
ccuuauugucuuuaaau

SEQ ID NO: 3924104 - RNA, 20 nt, Shigella flexneri 2a str. 301
ccuucaacacuggcaaaauc

SEQ ID NO: 3924105 - RNA, 15 nt, Shigella flexneri 2a str. 301
ccuucaacccaucaa

SEQ ID NO: 3924106 - RNA, 13 nt, Shigella flexneri 2a str. 301
ccuucaacgcggc

SEQ ID NO: 3924107 - RNA, 15 nt, Shigella flexneri 2a str. 301
ccuucaagaauuaaa

SEQ ID NO: 3924108 - RNA, 20 nt, Shigella flexneri 2a str. 301
ccuucaaucccagacguuuc

SEQ ID NO: 3924109 - RNA, 13 nt, Shigella flexneri 2a str. 301
ccuucacccauug

SEQ ID NO: 3924110 - RNA, 18 nt, Shigella flexneri 2a str. 301
ccuucacgacauaaacau

SEQ ID NO: 3924111 - RNA, 14 nt, Shigella flexneri 2a str. 301
ccuucacgauagcc

SEQ ID NO: 3924112 - RNA, 17 nt, Shigella flexneri 2a str. 301
ccuucacgaucgaagcc

SEQ ID NO: 3924113 - RNA, 16 nt, Shigella flexneri 2a str. 301
ccuucacgcgcuccag

SEQ ID NO: 3924114 - RNA, 17 nt, Shigella flexneri 2a str. 301
ccuucacgcgcuccagg

SEQ ID NO: 3924115 - RNA, 13 nt, Shigella flexneri 2a str. 301
ccuucacuuuugc

SEQ ID NO: 3924116 - RNA, 21 nt, Shigella flexneri 2a str. 301
ccuucacuuuugccagacgaa

SEQ ID NO: 3924117 - RNA, 17 nt, Shigella flexneri 2a str. 301
ccuucagcaacuuguuc

SEQ ID NO: 3924118 - RNA, 17 nt, Shigella flexneri 2a str. 301
ccuucaggcgugauuca

SEQ ID NO: 3924119 - RNA, 22 nt, Shigella flexneri 2a str. 301
ccuucagucauauuucuguuug

SEQ ID NO: 3924120 - RNA, 22 nt, Shigella flexneri 2a str. 301
ccuucauauuccugacccagca

SEQ ID NO: 3924121 - RNA, 22 nt, Shigella flexneri 2a str. 301
ccuucaucacgcagcgucagca

SEQ ID NO: 3924122 - RNA, 13 nt, Shigella flexneri 2a str. 301
ccuucauccagca

SEQ ID NO: 3924123 - RNA, 18 nt, Shigella flexneri 2a str. 301
ccuucauccagcaucaua

SEQ ID NO: 3924124 - RNA, 20 nt, Shigella flexneri 2a str. 301
ccuucaucccuuucgcuuca

SEQ ID NO: 3924125 - RNA, 16 nt, Shigella flexneri 2a str. 301
ccuucaucgcuccugc

SEQ ID NO: 3924126 - RNA, 19 nt, Shigella flexneri 2a str. 301
ccuucaucguuucugcugg

SEQ ID NO: 3924127 - RNA, 14 nt, Shigella flexneri 2a str. 301
ccuucaucuucaac

SEQ ID NO: 3924128 - RNA, 20 nt, Shigella flexneri 2a str. 301
ccuucaucuucaacugccau

SEQ ID NO: 3924129 - RNA, 14 nt, Shigella flexneri 2a str. 301
ccuuccacaccacu

SEQ ID NO: 3924130 - RNA, 14 nt, Shigella flexneri 2a str. 301
ccuuccagcuccag

SEQ ID NO: 3924131 - RNA, 14 nt, Shigella flexneri 2a str. 301
ccuucccagccggg

SEQ ID NO: 3924132 - RNA, 16 nt, Shigella flexneri 2a str. 301
ccuucccagccgggaa

SEQ ID NO: 3924133 - RNA, 17 nt, Shigella flexneri 2a str. 301
ccuuccccguucugcca

SEQ ID NO: 3924134 - RNA, 21 nt, Shigella flexneri 2a str. 301
ccuucccgucuacaaaaacug

SEQ ID NO: 3924135 - RNA, 12 nt, Shigella flexneri 2a str. 301
ccuucccuuuca

SEQ ID NO: 3924136 - RNA, 17 nt, Shigella flexneri 2a str. 301
ccuucgacuuucagugg

SEQ ID NO: 3924137 - RNA, 19 nt, Shigella flexneri 2a str. 301
ccuucgagcgauacaucau

SEQ ID NO: 3924138 - RNA, 21 nt, Shigella flexneri 2a str. 301
ccuucgcggaauuucagaaaa

SEQ ID NO: 3924139 - RNA, 12 nt, Shigella flexneri 2a str. 301
ccuucgcggcac

SEQ ID NO: 3924140 - RNA, 17 nt, Shigella flexneri 2a str. 301
ccuucggcgucuccacc

SEQ ID NO: 3924141 - RNA, 20 nt, Shigella flexneri 2a str. 301
ccuucgggcuggcauuuuuu

SEQ ID NO: 3924142 - RNA, 20 nt, Shigella flexneri 2a str. 301
ccuucggggcuaaugccagu

SEQ ID NO: 3924143 - RNA, 14 nt, Shigella flexneri 2a str. 301
ccuucgugcggcug

SEQ ID NO: 3924144 - RNA, 13 nt, Shigella flexneri 2a str. 301
ccuucguucucug

SEQ ID NO: 3924145 - RNA, 14 nt, Shigella flexneri 2a str. 301
ccuucguucucugc

SEQ ID NO: 3924146 - RNA, 13 nt, Shigella flexneri 2a str. 301
ccuucuaaagcaa

SEQ ID NO: 3924147 - RNA, 20 nt, Shigella flexneri 2a str. 301
ccuucuaccuuaacgguauc

SEQ ID NO: 3924148 - RNA, 19 nt, Shigella flexneri 2a str. 301
ccuucuauaaggccccuuc

SEQ ID NO: 3924149 - RNA, 20 nt, Shigella flexneri 2a str. 301
ccuucuauaaggccccuucc

SEQ ID NO: 3924150 - RNA, 13 nt, Shigella flexneri 2a str. 301
ccuucucagcggu

SEQ ID NO: 3924151 - RNA, 12 nt, Shigella flexneri 2a str. 301
ccuucuccacac

SEQ ID NO: 3924152 - RNA, 15 nt, Shigella flexneri 2a str. 301
ccuucuccacaccgu

SEQ ID NO: 3924153 - RNA, 14 nt, Shigella flexneri 2a str. 301
ccuucugagaucaa

SEQ ID NO: 3924154 - RNA, 20 nt, Shigella flexneri 2a str. 301
ccuucugcacgccaggauuc

SEQ ID NO: 3924155 - RNA, 19 nt, Shigella flexneri 2a str. 301
ccuucuguggacugauuua

SEQ ID NO: 3924156 - RNA, 11 nt, Shigella flexneri 2a str. 301
ccuucuucauc

SEQ ID NO: 3924157 - RNA, 16 nt, Shigella flexneri 2a str. 301
ccuucuugaacccuuu

SEQ ID NO: 3924158 - RNA, 20 nt, Shigella flexneri 2a str. 301
ccuucuuuacugcccgcuug

SEQ ID NO: 3924159 - RNA, 17 nt, Shigella flexneri 2a str. 301
ccuugaguuuuucaucc

SEQ ID NO: 3924160 - RNA, 22 nt, Shigella flexneri 2a str. 301
ccuugcaauaauuuacagccug

SEQ ID NO: 3924161 - RNA, 16 nt, Shigella flexneri 2a str. 301
ccuugcaguugaucua

SEQ ID NO: 3924162 - RNA, 16 nt, Shigella flexneri 2a str. 301
ccuugccaaauguugu

SEQ ID NO: 3924163 - RNA, 23 nt, Shigella flexneri 2a str. 301
ccuugccggaugcggcguaaaug

SEQ ID NO: 3924164 - RNA, 21 nt, Shigella flexneri 2a str. 301
ccuugcgauuacgcucggcaa

SEQ ID NO: 3924165 - RNA, 22 nt, Shigella flexneri 2a str. 301
ccuugcgauuacgcucggcaaa

SEQ ID NO: 3924166 - RNA, 16 nt, Shigella flexneri 2a str. 301
ccuugcggaaauucca

SEQ ID NO: 3924167 - RNA, 23 nt, Shigella flexneri 2a str. 301
ccuugcggaaauuccagcggcag

SEQ ID NO: 3924168 - RNA, 21 nt, Shigella flexneri 2a str. 301
ccuugcguacaccaacaucac

SEQ ID NO: 3924169 - RNA, 14 nt, Shigella flexneri 2a str. 301
ccuugcguuucuga

SEQ ID NO: 3924170 - RNA, 15 nt, Shigella flexneri 2a str. 301
ccuugcucaaugagu

SEQ ID NO: 3924171 - RNA, 18 nt, Shigella flexneri 2a str. 301
ccuugcuucgccaguucg

SEQ ID NO: 3924172 - RNA, 22 nt, Shigella flexneri 2a str. 301
ccuugucaugcagcuccaccga

SEQ ID NO: 3924173 - RNA, 20 nt, Shigella flexneri 2a str. 301
ccuugugcacuggcgcgaau

SEQ ID NO: 3924174 - RNA, 19 nt, Shigella flexneri 2a str. 301
ccuugugggccugaaagcu

SEQ ID NO: 3924175 - RNA, 15 nt, Shigella flexneri 2a str. 301
ccuuguuuaaggaaa

SEQ ID NO: 3924176 - RNA, 19 nt, Shigella flexneri 2a str. 301
ccuuguuucuucaacgaag

SEQ ID NO: 3924177 - RNA, 16 nt, Shigella flexneri 2a str. 301
ccuuuaaaucccgcuu

SEQ ID NO: 3924178 - RNA, 20 nt, Shigella flexneri 2a str. 301
ccuuuaccgccacagcagcc

SEQ ID NO: 3924179 - RNA, 18 nt, Shigella flexneri 2a str. 301
ccuuuacgaagaaagcaa

SEQ ID NO: 3924180 - RNA, 16 nt, Shigella flexneri 2a str. 301
ccuuuacggcgcguca

SEQ ID NO: 3924181 - RNA, 14 nt, Shigella flexneri 2a str. 301
ccuuuagcgagcga

SEQ ID NO: 3924182 - RNA, 15 nt, Shigella flexneri 2a str. 301
ccuuuaugacgaucg

SEQ ID NO: 3924183 - RNA, 14 nt, Shigella flexneri 2a str. 301
ccuuuauuuucugg

SEQ ID NO: 3924184 - RNA, 21 nt, Shigella flexneri 2a str. 301
ccuuucaauaccgccugcaaa

SEQ ID NO: 3924185 - RNA, 22 nt, Shigella flexneri 2a str. 301
ccuuucacuucggucaccguca

SEQ ID NO: 3924186 - RNA, 13 nt, Shigella flexneri 2a str. 301
ccuuucagcgcau

SEQ ID NO: 3924187 - RNA, 23 nt, Shigella flexneri 2a str. 301
ccuuucaugguugucaccgccag

SEQ ID NO: 3924188 - RNA, 17 nt, Shigella flexneri 2a str. 301
ccuuucccuauuuuuuc

SEQ ID NO: 3924189 - RNA, 17 nt, Shigella flexneri 2a str. 301
ccuuuccugacucagca

SEQ ID NO: 3924190 - RNA, 22 nt, Shigella flexneri 2a str. 301
ccuuuccuuaagccagcgcccg

SEQ ID NO: 3924191 - RNA, 15 nt, Shigella flexneri 2a str. 301
ccuuucgaacccaac

SEQ ID NO: 3924192 - RNA, 21 nt, Shigella flexneri 2a str. 301
ccuuucggcgcagucacacca

SEQ ID NO: 3924193 - RNA, 16 nt, Shigella flexneri 2a str. 301
ccuuucggcugcagca

SEQ ID NO: 3924194 - RNA, 21 nt, Shigella flexneri 2a str. 301
ccuuucguuaaauucuucuga

SEQ ID NO: 3924195 - RNA, 15 nt, Shigella flexneri 2a str. 301
ccuuucugagaggaa

SEQ ID NO: 3924196 - RNA, 21 nt, Shigella flexneri 2a str. 301
ccuuucugaugcauaaaaaaa

SEQ ID NO: 3924197 - RNA, 21 nt, Shigella flexneri 2a str. 301
ccuuucugcauccguucuucg

SEQ ID NO: 3924198 - RNA, 18 nt, Shigella flexneri 2a str. 301
ccuuucuggacacagcgu

SEQ ID NO: 3924199 - RNA, 20 nt, Shigella flexneri 2a str. 301
cgaagauguuguacagcgaa

SEQ ID NO: 3924200 - RNA, 21 nt, Shigella flexneri 2a str. 301
cgaagauguuguacagcgaaa

SEQ ID NO: 3924201 - RNA, 15 nt, Shigella flexneri 2a str. 301
cgaagccaauuugcg

SEQ ID NO: 3924202 - RNA, 20 nt, Shigella flexneri 2a str. 301
cgaagcccagaaugcucagu

SEQ ID NO: 3924203 - RNA, 23 nt, Shigella flexneri 2a str. 301
cgaagcccaucaguacaccaccu

SEQ ID NO: 3924204 - RNA, 17 nt, Shigella flexneri 2a str. 301
cgaagcccucaaacaac

SEQ ID NO: 3924205 - RNA, 13 nt, Shigella flexneri 2a str. 301
cgaagccgugcca

SEQ ID NO: 3924206 - RNA, 16 nt, Shigella flexneri 2a str. 301
cgaagccucuuacacu

SEQ ID NO: 3924207 - RNA, 19 nt, Shigella flexneri 2a str. 301
cgaagccugcgaugucuga

SEQ ID NO: 3924208 - RNA, 15 nt, Shigella flexneri 2a str. 301
cgaagcgcaguuuaa

SEQ ID NO: 3924209 - RNA, 13 nt, Shigella flexneri 2a str. 301
cgaagcggcugcg

SEQ ID NO: 3924210 - RNA, 23 nt, Shigella flexneri 2a str. 301
cgaagcucucugcuauuccguua

SEQ ID NO: 3924211 - RNA, 18 nt, Shigella flexneri 2a str. 301
cgaagcucuguauauaaa

SEQ ID NO: 3924212 - RNA, 22 nt, Shigella flexneri 2a str. 301
cgaagcuucucauccuuccccg

SEQ ID NO: 3924213 - RNA, 13 nt, Shigella flexneri 2a str. 301
cgaaggacggccg

SEQ ID NO: 3924214 - RNA, 13 nt, Shigella flexneri 2a str. 301
cgaaggcggcgaa

SEQ ID NO: 3924215 - RNA, 20 nt, Shigella flexneri 2a str. 301
cgaaggugccugcccagccg

SEQ ID NO: 3924216 - RNA, 14 nt, Shigella flexneri 2a str. 301
cgaaguacgcggca

SEQ ID NO: 3924217 - RNA, 15 nt, Shigella flexneri 2a str. 301
cgaaguacgcggcaa

SEQ ID NO: 3924218 - RNA, 20 nt, Shigella flexneri 2a str. 301
cgaaguauggaaaucaccca

SEQ ID NO: 3924219 - RNA, 22 nt, Shigella flexneri 2a str. 301
cgaagucccacggugcagcugc

SEQ ID NO: 3924220 - RNA, 21 nt, Shigella flexneri 2a str. 301
cgaaguggacgaacaguucaa

SEQ ID NO: 3924221 - RNA, 12 nt, Shigella flexneri 2a str. 301
cgaaguuuuccu

SEQ ID NO: 3924222 - RNA, 12 nt, Shigella flexneri 2a str. 301
cgaauacacccu

SEQ ID NO: 3924223 - RNA, 14 nt, Shigella flexneri 2a str. 301
cgaauacacccuga

SEQ ID NO: 3924224 - RNA, 16 nt, Shigella flexneri 2a str. 301
cgaauaccuucuuccu

SEQ ID NO: 3924225 - RNA, 19 nt, Shigella flexneri 2a str. 301
cgaauaccuucuuccugcg

SEQ ID NO: 3924226 - RNA, 22 nt, Shigella flexneri 2a str. 301
cgaauacggauauguuuacuuc

SEQ ID NO: 3924227 - RNA, 23 nt, Shigella flexneri 2a str. 301
cgaauacguugcuucaugccgga

SEQ ID NO: 3924228 - RNA, 12 nt, Shigella flexneri 2a str. 301
cgaauagaaagc

SEQ ID NO: 3924229 - RNA, 12 nt, Shigella flexneri 2a str. 301
cgaauauuuccc

SEQ ID NO: 3924230 - RNA, 14 nt, Shigella flexneri 2a str. 301
cgaaucaacuccag

SEQ ID NO: 3924231 - RNA, 23 nt, Shigella flexneri 2a str. 301
cgaaucaugguuuauuucccaga

SEQ ID NO: 3924232 - RNA, 16 nt, Shigella flexneri 2a str. 301
cgaauccagcaugcuc

SEQ ID NO: 3924233 - RNA, 17 nt, Shigella flexneri 2a str. 301
cgaaugacaugcccggu

SEQ ID NO: 3924234 - RNA, 20 nt, Shigella flexneri 2a str. 301
cgaaugacguuuacuucgcu

SEQ ID NO: 3924235 - RNA, 15 nt, Shigella flexneri 2a str. 301
cgaaugcagcuccac

SEQ ID NO: 3924236 - RNA, 16 nt, Shigella flexneri 2a str. 301
cgaaugcgaaaauccu

SEQ ID NO: 3924237 - RNA, 15 nt, Shigella flexneri 2a str. 301
cgaauguggcagcaa

SEQ ID NO: 3924238 - RNA, 17 nt, Shigella flexneri 2a str. 301
cgaauguuccaucacca

SEQ ID NO: 3924239 - RNA, 19 nt, Shigella flexneri 2a str. 301
cgaauguuccaucaccaga

SEQ ID NO: 3924240 - RNA, 16 nt, Shigella flexneri 2a str. 301
cgaauucauaagaagc

SEQ ID NO: 3924241 - RNA, 10 nt, Shigella flexneri 2a str. 301
cgaauuccaa

SEQ ID NO: 3924242 - RNA, 14 nt, Shigella flexneri 2a str. 301
cgaauugccaccau

SEQ ID NO: 3924243 - RNA, 15 nt, Shigella flexneri 2a str. 301
cgaauugccaccauc

SEQ ID NO: 3924244 - RNA, 16 nt, Shigella flexneri 2a str. 301
cgaauuguucugcgcc

SEQ ID NO: 3924245 - RNA, 21 nt, Shigella flexneri 2a str. 301
cgaauuucucauccgcagucc

SEQ ID NO: 3924246 - RNA, 18 nt, Shigella flexneri 2a str. 301
cgaauuugaauauauaca

SEQ ID NO: 3924247 - RNA, 18 nt, Shigella flexneri 2a str. 301
cgacaaaaauuacugccu

SEQ ID NO: 3924248 - RNA, 23 nt, Shigella flexneri 2a str. 301
cgacaaaacgauguccgcucuca

SEQ ID NO: 3924249 - RNA, 21 nt, Shigella flexneri 2a str. 301
cgacaaaaucggaaacaaaua

SEQ ID NO: 3924250 - RNA, 15 nt, Shigella flexneri 2a str. 301
cgacaaacaccgaac

SEQ ID NO: 3924251 - RNA, 13 nt, Shigella flexneri 2a str. 301
cgacaacagaaau

SEQ ID NO: 3924252 - RNA, 23 nt, Shigella flexneri 2a str. 301
cgacaaccugaccuuuuuucagc

SEQ ID NO: 3924253 - RNA, 16 nt, Shigella flexneri 2a str. 301
cgacaagauccugaua

SEQ ID NO: 3924254 - RNA, 16 nt, Shigella flexneri 2a str. 301
cgacaaucaucgccuu

SEQ ID NO: 3924255 - RNA, 16 nt, Shigella flexneri 2a str. 301
cgacaaugccacaaac

SEQ ID NO: 3924256 - RNA, 16 nt, Shigella flexneri 2a str. 301
cgacacaaauggcagu

SEQ ID NO: 3924257 - RNA, 15 nt, Shigella flexneri 2a str. 301
cgacacaauccaugc

SEQ ID NO: 3924258 - RNA, 17 nt, Shigella flexneri 2a str. 301
cgacacagguaucgaca

SEQ ID NO: 3924259 - RNA, 12 nt, Shigella flexneri 2a str. 301
cgacaccgccuc

SEQ ID NO: 3924260 - RNA, 16 nt, Shigella flexneri 2a str. 301
cgacaccguuaaauaa

SEQ ID NO: 3924261 - RNA, 17 nt, Shigella flexneri 2a str. 301
cgacacgccuccuggcu

SEQ ID NO: 3924262 - RNA, 19 nt, Shigella flexneri 2a str. 301
cgacacuggcagugugucu

SEQ ID NO: 3924263 - RNA, 22 nt, Shigella flexneri 2a str. 301
cgacagaacucguucagcgcau

SEQ ID NO: 3924264 - RNA, 16 nt, Shigella flexneri 2a str. 301
cgacagacgccagcgc

SEQ ID NO: 3924265 - RNA, 19 nt, Shigella flexneri 2a str. 301
cgacagcgaaaucccuucg

SEQ ID NO: 3924266 - RNA, 13 nt, Shigella flexneri 2a str. 301
cgacaggaacgcc

SEQ ID NO: 3924267 - RNA, 20 nt, Shigella flexneri 2a str. 301
cgacaggcuuucuucgucgu

SEQ ID NO: 3924268 - RNA, 16 nt, Shigella flexneri 2a str. 301
cgacagggaucucuuc

SEQ ID NO: 3924269 - RNA, 19 nt, Shigella flexneri 2a str. 301
cgacagggaucucuuccag

SEQ ID NO: 3924270 - RNA, 15 nt, Shigella flexneri 2a str. 301
cgacaguaccagcag

SEQ ID NO: 3924271 - RNA, 20 nt, Shigella flexneri 2a str. 301
cgacaguaccagcaguacag

SEQ ID NO: 3924272 - RNA, 19 nt, Shigella flexneri 2a str. 301
cgacauccaugcacugcaa

SEQ ID NO: 3924273 - RNA, 20 nt, Shigella flexneri 2a str. 301
cgacaucgacguagugaaau

SEQ ID NO: 3924274 - RNA, 12 nt, Shigella flexneri 2a str. 301
cgacaucgccac

SEQ ID NO: 3924275 - RNA, 23 nt, Shigella flexneri 2a str. 301
cgacaucgccacggcaugaaagc

SEQ ID NO: 3924276 - RNA, 20 nt, Shigella flexneri 2a str. 301
cgacaucuuuaccgcgacca

SEQ ID NO: 3924277 - RNA, 15 nt, Shigella flexneri 2a str. 301
cgacaugcaucacgc

SEQ ID NO: 3924278 - RNA, 14 nt, Shigella flexneri 2a str. 301
cgacaugcuuacca

SEQ ID NO: 3924279 - RNA, 19 nt, Shigella flexneri 2a str. 301
cgacauggcgaaaauuggu

SEQ ID NO: 3924280 - RNA, 15 nt, Shigella flexneri 2a str. 301
cgacauugaccagcc

SEQ ID NO: 3924281 - RNA, 15 nt, Shigella flexneri 2a str. 301
cgacauuucugcugc

SEQ ID NO: 3924282 - RNA, 16 nt, Shigella flexneri 2a str. 301
cgacauuucugcugcc

SEQ ID NO: 3924283 - RNA, 12 nt, Shigella flexneri 2a str. 301
cgaccaccacca

SEQ ID NO: 3924284 - RNA, 12 nt, Shigella flexneri 2a str. 301
cgaccaccaccg

SEQ ID NO: 3924285 - RNA, 18 nt, Shigella flexneri 2a str. 301
cgaccacuucaugcccca

SEQ ID NO: 3924286 - RNA, 14 nt, Shigella flexneri 2a str. 301
cgaccagaaaugca

SEQ ID NO: 3924287 - RNA, 18 nt, Shigella flexneri 2a str. 301
cgaccagaauaagucugg

SEQ ID NO: 3924288 - RNA, 12 nt, Shigella flexneri 2a str. 301
cgaccaggcaaa

SEQ ID NO: 3924289 - RNA, 13 nt, Shigella flexneri 2a str. 301
cgaccaggcaaac

SEQ ID NO: 3924290 - RNA, 17 nt, Shigella flexneri 2a str. 301
cgaccaggccaucagca

SEQ ID NO: 3924291 - RNA, 19 nt, Shigella flexneri 2a str. 301
cgaccaggccaucagcagc

SEQ ID NO: 3924292 - RNA, 18 nt, Shigella flexneri 2a str. 301
cgaccauacagcagcaac

SEQ ID NO: 3924293 - RNA, 14 nt, Shigella flexneri 2a str. 301
cgaccaucagcugc

SEQ ID NO: 3924294 - RNA, 18 nt, Shigella flexneri 2a str. 301
cgaccaucagcugccagg

SEQ ID NO: 3924295 - RNA, 19 nt, Shigella flexneri 2a str. 301
cgaccaucggaucggccau

SEQ ID NO: 3924296 - RNA, 21 nt, Shigella flexneri 2a str. 301
cgaccaucuccuuacugcccc

SEQ ID NO: 3924297 - RNA, 16 nt, Shigella flexneri 2a str. 301
cgacccagaaacaggc

SEQ ID NO: 3924298 - RNA, 21 nt, Shigella flexneri 2a str. 301
cgacccgacagaugcucgcca

SEQ ID NO: 3924299 - RNA, 19 nt, Shigella flexneri 2a str. 301
cgagcgccaccaucgauac

SEQ ID NO: 3924300 - RNA, 23 nt, Shigella flexneri 2a str. 301
cgagcgguaaaccguuaucaccu

SEQ ID NO: 3924301 - RNA, 21 nt, Shigella flexneri 2a str. 301
cgagcgucauauagccgccuu

SEQ ID NO: 3924302 - RNA, 14 nt, Shigella flexneri 2a str. 301
cgagcguggaacuu

SEQ ID NO: 3924303 - RNA, 12 nt, Shigella flexneri 2a str. 301
cgagcuggugcc

SEQ ID NO: 3924304 - RNA, 23 nt, Shigella flexneri 2a str. 301
cgagcuuaauguuaaccaucuca

SEQ ID NO: 3924305 - RNA, 22 nt, Shigella flexneri 2a str. 301
cgagcuuauuuguugagcugga

SEQ ID NO: 3924306 - RNA, 18 nt, Shigella flexneri 2a str. 301
cgagcuuucgaccagcca

SEQ ID NO: 3924307 - RNA, 19 nt, Shigella flexneri 2a str. 301
cgaggaagcuuucgcagua

SEQ ID NO: 3924308 - RNA, 12 nt, Shigella flexneri 2a str. 301
cgaggacagcau

SEQ ID NO: 3924309 - RNA, 13 nt, Shigella flexneri 2a str. 301
cgaggacagcauc

SEQ ID NO: 3924310 - RNA, 20 nt, Shigella flexneri 2a str. 301
cgaggaucacaaugccacca

SEQ ID NO: 3924311 - RNA, 20 nt, Shigella flexneri 2a str. 301
cgaggauucgaaccucggaa

SEQ ID NO: 3924312 - RNA, 12 nt, Shigella flexneri 2a str. 301
cgaggcaaagag

SEQ ID NO: 3924313 - RNA, 22 nt, Shigella flexneri 2a str. 301
cgaggccaaucagcaauaaacg

SEQ ID NO: 3924314 - RNA, 14 nt, Shigella flexneri 2a str. 301
cgaggccaauuugg

SEQ ID NO: 3924315 - RNA, 20 nt, Shigella flexneri 2a str. 301
cgaggccaauuuggcugcca

SEQ ID NO: 3924316 - RNA, 15 nt, Shigella flexneri 2a str. 301
cgaggcgaacaugcg

SEQ ID NO: 3924317 - RNA, 18 nt, Shigella flexneri 2a str. 301
cgaggcucugauugccuu

SEQ ID NO: 3924318 - RNA, 18 nt, Shigella flexneri 2a str. 301
cgagggaaaauaaaaugu

SEQ ID NO: 3924319 - RNA, 19 nt, Shigella flexneri 2a str. 301
cgagggagaaaacccggcc

SEQ ID NO: 3924320 - RNA, 13 nt, Shigella flexneri 2a str. 301
cgaggucacacgc

SEQ ID NO: 3924321 - RNA, 15 nt, Shigella flexneri 2a str. 301
cgagguccagcuccg

SEQ ID NO: 3924322 - RNA, 22 nt, Shigella flexneri 2a str. 301
cgagguuaaugaucgcgccgcc

SEQ ID NO: 3924323 - RNA, 18 nt, Shigella flexneri 2a str. 301
cgagguuauccgccagcg

SEQ ID NO: 3924324 - RNA, 16 nt, Shigella flexneri 2a str. 301
cgagguuggcucauca

SEQ ID NO: 3924325 - RNA, 13 nt, Shigella flexneri 2a str. 301
cgagguuuuccuu

SEQ ID NO: 3924326 - RNA, 12 nt, Shigella flexneri 2a str. 301
cgaguaaaaaaa

SEQ ID NO: 3924327 - RNA, 15 nt, Shigella flexneri 2a str. 301
cgaguaaaaaaacau

SEQ ID NO: 3924328 - RNA, 19 nt, Shigella flexneri 2a str. 301
cgaguaaacaggggcugua

SEQ ID NO: 3924329 - RNA, 14 nt, Shigella flexneri 2a str. 301
cgaguaaucaggcu

SEQ ID NO: 3924330 - RNA, 13 nt, Shigella flexneri 2a str. 301
cgaguagaucaac

SEQ ID NO: 3924331 - RNA, 14 nt, Shigella flexneri 2a str. 301
cgaguagaucaaca

SEQ ID NO: 3924332 - RNA, 22 nt, Shigella flexneri 2a str. 301
cgaguauugucuccgcugagac

SEQ ID NO: 3924333 - RNA, 20 nt, Shigella flexneri 2a str. 301
cgaguccuguugucuuucca

SEQ ID NO: 3924334 - RNA, 19 nt, Shigella flexneri 2a str. 301
cgagucgcguuaaggcguc

SEQ ID NO: 3924335 - RNA, 17 nt, Shigella flexneri 2a str. 301
cgagucgcugagcgugc

SEQ ID NO: 3924336 - RNA, 20 nt, Shigella flexneri 2a str. 301
cgagucgcugagcgugcccc

SEQ ID NO: 3924337 - RNA, 16 nt, Shigella flexneri 2a str. 301
cgagucgucaguucca

SEQ ID NO: 3924338 - RNA, 16 nt, Shigella flexneri 2a str. 301
cgagugcggcgagcau

SEQ ID NO: 3924339 - RNA, 19 nt, Shigella flexneri 2a str. 301
cgaguucaucacaccaguc

SEQ ID NO: 3924340 - RNA, 20 nt, Shigella flexneri 2a str. 301
cgaguucggcuucauuggcg

SEQ ID NO: 3924341 - RNA, 13 nt, Shigella flexneri 2a str. 301
cgaguugaucacg

SEQ ID NO: 3924342 - RNA, 14 nt, Shigella flexneri 2a str. 301
cgaguugcccgcau

SEQ ID NO: 3924343 - RNA, 15 nt, Shigella flexneri 2a str. 301
cgaguuggugcgccg

SEQ ID NO: 3924344 - RNA, 15 nt, Shigella flexneri 2a str. 301
cgauaaaaauaccga

SEQ ID NO: 3924345 - RNA, 14 nt, Shigella flexneri 2a str. 301
cgauaaaaucccau

SEQ ID NO: 3924346 - RNA, 16 nt, Shigella flexneri 2a str. 301
cgauaaaccagcaacc

SEQ ID NO: 3924347 - RNA, 13 nt, Shigella flexneri 2a str. 301
cgauaaacucaau

SEQ ID NO: 3924348 - RNA, 13 nt, Shigella flexneri 2a str. 301
cgauaaagcuggg

SEQ ID NO: 3924349 - RNA, 14 nt, Shigella flexneri 2a str. 301
cgauaaagcugggu

SEQ ID NO: 3924350 - RNA, 21 nt, Shigella flexneri 2a str. 301
cgauaaaggucgacagcagcc

SEQ ID NO: 3924351 - RNA, 19 nt, Shigella flexneri 2a str. 301
cgauaaauaacuuuuaucu

SEQ ID NO: 3924352 - RNA, 21 nt, Shigella flexneri 2a str. 301
cgauaaauaacuuuuaucugu

SEQ ID NO: 3924353 - RNA, 21 nt, Shigella flexneri 2a str. 301
cgauaaauacagcguuaaaaa

SEQ ID NO: 3924354 - RNA, 19 nt, Shigella flexneri 2a str. 301
cgauaacgccccaauccac

SEQ ID NO: 3924355 - RNA, 14 nt, Shigella flexneri 2a str. 301
cgauaacggucgua

SEQ ID NO: 3924356 - RNA, 15 nt, Shigella flexneri 2a str. 301
cgauaacucgcuuug

SEQ ID NO: 3924357 - RNA, 22 nt, Shigella flexneri 2a str. 301
cgauaagguaucgcgaaaaaaa

SEQ ID NO: 3924358 - RNA, 19 nt, Shigella flexneri 2a str. 301
cgauaauauugaugcacac

SEQ ID NO: 3924359 - RNA, 18 nt, Shigella flexneri 2a str. 301
cgauaaucucaauauccg

SEQ ID NO: 3924360 - RNA, 22 nt, Shigella flexneri 2a str. 301
cgauaaucucugcuuucgcauu

SEQ ID NO: 3924361 - RNA, 20 nt, Shigella flexneri 2a str. 301
cgauaauuuaugccugauac

SEQ ID NO: 3924362 - RNA, 16 nt, Shigella flexneri 2a str. 301
cgauacagaagcaccg

SEQ ID NO: 3924363 - RNA, 22 nt, Shigella flexneri 2a str. 301
cgauaccaauguagccgcggau

SEQ ID NO: 3924364 - RNA, 12 nt, Shigella flexneri 2a str. 301
cgauaccacccg

SEQ ID NO: 3924365 - RNA, 12 nt, Shigella flexneri 2a str. 301
cgauacccauuu

SEQ ID NO: 3924366 - RNA, 18 nt, Shigella flexneri 2a str. 301
cgauacgcuugcgcaucg

SEQ ID NO: 3924367 - RNA, 17 nt, Shigella flexneri 2a str. 301
cgauacggcccagaccc

SEQ ID NO: 3924368 - RNA, 16 nt, Shigella flexneri 2a str. 301
cgauacgggcucgggc

SEQ ID NO: 3924369 - RNA, 15 nt, Shigella flexneri 2a str. 301
cgauacggucgagga

SEQ ID NO: 3924370 - RNA, 16 nt, Shigella flexneri 2a str. 301
cgauagaauauuucua

SEQ ID NO: 3924371 - RNA, 18 nt, Shigella flexneri 2a str. 301
cgauagccuucagugccg

SEQ ID NO: 3924372 - RNA, 23 nt, Shigella flexneri 2a str. 301
cgauagcgcacgcgcuucacaug

SEQ ID NO: 3924373 - RNA, 18 nt, Shigella flexneri 2a str. 301
cgauaguggaacaaagaa

SEQ ID NO: 3924374 - RNA, 17 nt, Shigella flexneri 2a str. 301
cgauauaaauuccacgc

SEQ ID NO: 3924375 - RNA, 19 nt, Shigella flexneri 2a str. 301
cgauauccugaaacgcggc

SEQ ID NO: 3924376 - RNA, 22 nt, Shigella flexneri 2a str. 301
cgauaucgauaaucaguaacgu

SEQ ID NO: 3924377 - RNA, 17 nt, Shigella flexneri 2a str. 301
cgauaucggaggccugu

SEQ ID NO: 3924378 - RNA, 17 nt, Shigella flexneri 2a str. 301
cgauaugaccauuggua

SEQ ID NO: 3924379 - RNA, 15 nt, Shigella flexneri 2a str. 301
cgauaugccggcauc

SEQ ID NO: 3924380 - RNA, 19 nt, Shigella flexneri 2a str. 301
cgauauggacuuuaugaac

SEQ ID NO: 3924381 - RNA, 16 nt, Shigella flexneri 2a str. 301
cgauauucauuuugcu

SEQ ID NO: 3924382 - RNA, 12 nt, Shigella flexneri 2a str. 301
cgauauugccac

SEQ ID NO: 3924383 - RNA, 17 nt, Shigella flexneri 2a str. 301
cgaucacuuucugcgcc

SEQ ID NO: 3924384 - RNA, 21 nt, Shigella flexneri 2a str. 301
cgaucacuuucugcgccagcg

SEQ ID NO: 3924385 - RNA, 19 nt, Shigella flexneri 2a str. 301
cgaucagcaauuucuccgc

SEQ ID NO: 3924386 - RNA, 13 nt, Shigella flexneri 2a str. 301
cgaucagcggacg

SEQ ID NO: 3924387 - RNA, 15 nt, Shigella flexneri 2a str. 301
cgaucauauuguucc

SEQ ID NO: 3924388 - RNA, 23 nt, Shigella flexneri 2a str. 301
cgaucaucacguuggucuggucg

SEQ ID NO: 3924389 - RNA, 15 nt, Shigella flexneri 2a str. 301
cgaucaucauccagc

SEQ ID NO: 3924390 - RNA, 22 nt, Shigella flexneri 2a str. 301
cgaucauuggccggaauaccac

SEQ ID NO: 3924391 - RNA, 13 nt, Shigella flexneri 2a str. 301
cgauccaccaccg

SEQ ID NO: 3924392 - RNA, 11 nt, Shigella flexneri 2a str. 301
cgauccacgcc

SEQ ID NO: 3924393 - RNA, 16 nt, Shigella flexneri 2a str. 301
cgaucccauuacgucc

SEQ ID NO: 3924394 - RNA, 19 nt, Shigella flexneri 2a str. 301
cgauccccaaagagagcac

SEQ ID NO: 3924395 - RNA, 18 nt, Shigella flexneri 2a str. 301
cgaucgcaaauccauuca

SEQ ID NO: 3924396 - RNA, 16 nt, Shigella flexneri 2a str. 301
cgaucgccagcagggc

SEQ ID NO: 3924397 - RNA, 17 nt, Shigella flexneri 2a str. 301
cgaucgcccgccaagca

SEQ ID NO: 3924398 - RNA, 20 nt, Shigella flexneri 2a str. 301
cgaucgcgccaaucagcgca

SEQ ID NO: 3924399 - RNA, 13 nt, Shigella flexneri 2a str. 301
cgcaaacuugcgu

SEQ ID NO: 3924400 - RNA, 12 nt, Shigella flexneri 2a str. 301
cgcaaagcgacg

SEQ ID NO: 3924401 - RNA, 19 nt, Shigella flexneri 2a str. 301
cgcaaaguagcgggcugac

SEQ ID NO: 3924402 - RNA, 18 nt, Shigella flexneri 2a str. 301
cgcaaaugaugcaccacc

SEQ ID NO: 3924403 - RNA, 13 nt, Shigella flexneri 2a str. 301
cgcaaauucggcg

SEQ ID NO: 3924404 - RNA, 14 nt, Shigella flexneri 2a str. 301
cgcaacagaccaga

SEQ ID NO: 3924405 - RNA, 18 nt, Shigella flexneri 2a str. 301
cgcaacaugucagcaauc

SEQ ID NO: 3924406 - RNA, 17 nt, Shigella flexneri 2a str. 301
cgcaacauugcgccuca

SEQ ID NO: 3924407 - RNA, 23 nt, Shigella flexneri 2a str. 301
cgcaaccacaaaacacucuucaa

SEQ ID NO: 3924408 - RNA, 15 nt, Shigella flexneri 2a str. 301
cgcaaccagcgucag

SEQ ID NO: 3924409 - RNA, 15 nt, Shigella flexneri 2a str. 301
cgcaacgacaccguu

SEQ ID NO: 3924410 - RNA, 20 nt, Shigella flexneri 2a str. 301
cgcaacgacaccguuaaaua

SEQ ID NO: 3924411 - RNA, 20 nt, Shigella flexneri 2a str. 301
cgcaacgccuaaauccgcca

SEQ ID NO: 3924412 - RNA, 16 nt, Shigella flexneri 2a str. 301
cgcaacggcugcugcu

SEQ ID NO: 3924413 - RNA, 15 nt, Shigella flexneri 2a str. 301
cgcaacggugcggcu

SEQ ID NO: 3924414 - RNA, 20 nt, Shigella flexneri 2a str. 301
cgcaacgguugcggaaccca

SEQ ID NO: 3924415 - RNA, 20 nt, Shigella flexneri 2a str. 301
cgcaacugaggcaauaauga

SEQ ID NO: 3924416 - RNA, 21 nt, Shigella flexneri 2a str. 301
cgcaacugguccagccccuga

SEQ ID NO: 3924417 - RNA, 21 nt, Shigella flexneri 2a str. 301
cgcaacuuguugucuucucaa

SEQ ID NO: 3924418 - RNA, 19 nt, Shigella flexneri 2a str. 301
cgcaagcagacgcucguua

SEQ ID NO: 3924419 - RNA, 20 nt, Shigella flexneri 2a str. 301
cgcaagcgaaugaggcagca

SEQ ID NO: 3924420 - RNA, 15 nt, Shigella flexneri 2a str. 301
cgcaagcggcaucca

SEQ ID NO: 3924421 - RNA, 15 nt, Shigella flexneri 2a str. 301
cgcaauaaacaugau

SEQ ID NO: 3924422 - RNA, 16 nt, Shigella flexneri 2a str. 301
cgcaauaaacaugaug

SEQ ID NO: 3924423 - RNA, 16 nt, Shigella flexneri 2a str. 301
cgcaauaaccaucagc

SEQ ID NO: 3924424 - RNA, 18 nt, Shigella flexneri 2a str. 301
cgcaauaccggcaaagaa

SEQ ID NO: 3924425 - RNA, 18 nt, Shigella flexneri 2a str. 301
cgcaauacgcuuguacuu

SEQ ID NO: 3924426 - RNA, 17 nt, Shigella flexneri 2a str. 301
cgcaauagcacugcuuu

SEQ ID NO: 3924427 - RNA, 23 nt, Shigella flexneri 2a str. 301
cgcaauagcacugcuuuccgcug

SEQ ID NO: 3924428 - RNA, 20 nt, Shigella flexneri 2a str. 301
cgcaauauccugcgcuuccu

SEQ ID NO: 3924429 - RNA, 15 nt, Shigella flexneri 2a str. 301
cgcaaucagcaccgc

SEQ ID NO: 3924430 - RNA, 23 nt, Shigella flexneri 2a str. 301
cgcaauccgccgucgggucagcu

SEQ ID NO: 3924431 - RNA, 16 nt, Shigella flexneri 2a str. 301
cgcaauccuuucccug

SEQ ID NO: 3924432 - RNA, 23 nt, Shigella flexneri 2a str. 301
cgcaaucgcccagcgcguaaaua

SEQ ID NO: 3924433 - RNA, 14 nt, Shigella flexneri 2a str. 301
cgcaaucgccucca

SEQ ID NO: 3924434 - RNA, 18 nt, Shigella flexneri 2a str. 301
cgcaauggccguuccggc

SEQ ID NO: 3924435 - RNA, 18 nt, Shigella flexneri 2a str. 301
cgcaauggucccuugcug

SEQ ID NO: 3924436 - RNA, 12 nt, Shigella flexneri 2a str. 301
cgcaaugugcuc

SEQ ID NO: 3924437 - RNA, 22 nt, Shigella flexneri 2a str. 301
cgcaauugccggaugcgaguuu

SEQ ID NO: 3924438 - RNA, 22 nt, Shigella flexneri 2a str. 301
cgcaauuuauacugcgauggga

SEQ ID NO: 3924439 - RNA, 14 nt, Shigella flexneri 2a str. 301
cgcaauuuccauug

SEQ ID NO: 3924440 - RNA, 18 nt, Shigella flexneri 2a str. 301
cgcaauuuugacaauaau

SEQ ID NO: 3924441 - RNA, 16 nt, Shigella flexneri 2a str. 301
cgcacaaugccugaug

SEQ ID NO: 3924442 - RNA, 19 nt, Shigella flexneri 2a str. 301
cgcacaaugccugaugcga

SEQ ID NO: 3924443 - RNA, 14 nt, Shigella flexneri 2a str. 301
cgcacacaacagac

SEQ ID NO: 3924444 - RNA, 23 nt, Shigella flexneri 2a str. 301
cgcacaccgagauaaugguuucc

SEQ ID NO: 3924445 - RNA, 15 nt, Shigella flexneri 2a str. 301
cgcacacgccgugca

SEQ ID NO: 3924446 - RNA, 19 nt, Shigella flexneri 2a str. 301
cgcacagcccgccgccauc

SEQ ID NO: 3924447 - RNA, 21 nt, Shigella flexneri 2a str. 301
cgcacauccgcgucggcaagu

SEQ ID NO: 3924448 - RNA, 11 nt, Shigella flexneri 2a str. 301
cgcaccaccag

SEQ ID NO: 3924449 - RNA, 23 nt, Shigella flexneri 2a str. 301
cgcaccaggcgaaaacgcugacc

SEQ ID NO: 3924450 - RNA, 14 nt, Shigella flexneri 2a str. 301
cgcacccguaacau

SEQ ID NO: 3924451 - RNA, 17 nt, Shigella flexneri 2a str. 301
cgcaccggaacaaccca

SEQ ID NO: 3924452 - RNA, 18 nt, Shigella flexneri 2a str. 301
cgcaccgggcuuccggca

SEQ ID NO: 3924453 - RNA, 14 nt, Shigella flexneri 2a str. 301
cgcacgacgaaucu

SEQ ID NO: 3924454 - RNA, 20 nt, Shigella flexneri 2a str. 301
cgcacgaggaagauuacgcu

SEQ ID NO: 3924455 - RNA, 17 nt, Shigella flexneri 2a str. 301
cgcacgcagaaucucug

SEQ ID NO: 3924456 - RNA, 22 nt, Shigella flexneri 2a str. 301
cgcacgcagggaguuaccgugu

SEQ ID NO: 3924457 - RNA, 22 nt, Shigella flexneri 2a str. 301
cgcacgccuggcagucacggcg

SEQ ID NO: 3924458 - RNA, 16 nt, Shigella flexneri 2a str. 301
cgcacgcgcuucacau

SEQ ID NO: 3924459 - RNA, 11 nt, Shigella flexneri 2a str. 301
cgcacgcucaa

SEQ ID NO: 3924460 - RNA, 19 nt, Shigella flexneri 2a str. 301
cgcacgcucuauggcaccu

SEQ ID NO: 3924461 - RNA, 14 nt, Shigella flexneri 2a str. 301
cgcacgcugguaac

SEQ ID NO: 3924462 - RNA, 17 nt, Shigella flexneri 2a str. 301
cgcacggccgcaagcag

SEQ ID NO: 3924463 - RNA, 21 nt, Shigella flexneri 2a str. 301
cgcacguucugucgcucugcu

SEQ ID NO: 3924464 - RNA, 17 nt, Shigella flexneri 2a str. 301
cgcacguugucagcaac

SEQ ID NO: 3924465 - RNA, 18 nt, Shigella flexneri 2a str. 301
cgcacguugucagcaacu

SEQ ID NO: 3924466 - RNA, 19 nt, Shigella flexneri 2a str. 301
cgcacguugucagcaacug

SEQ ID NO: 3924467 - RNA, 16 nt, Shigella flexneri 2a str. 301
cgcacuauacaaccag

SEQ ID NO: 3924468 - RNA, 20 nt, Shigella flexneri 2a str. 301
cgcacuaugugccagcuucc

SEQ ID NO: 3924469 - RNA, 13 nt, Shigella flexneri 2a str. 301
cgcacucgcagac

SEQ ID NO: 3924470 - RNA, 20 nt, Shigella flexneri 2a str. 301
cgcacuggcgagcgccagca

SEQ ID NO: 3924471 - RNA, 12 nt, Shigella flexneri 2a str. 301
cgcacuggugcc

SEQ ID NO: 3924472 - RNA, 12 nt, Shigella flexneri 2a str. 301
cgcacuuaauau

SEQ ID NO: 3924473 - RNA, 20 nt, Shigella flexneri 2a str. 301
cgcacuucuuccuugaaaug

SEQ ID NO: 3924474 - RNA, 19 nt, Shigella flexneri 2a str. 301
cgcacuuugucaucagucu

SEQ ID NO: 3924475 - RNA, 20 nt, Shigella flexneri 2a str. 301
cgcagaaaaagagcaucagc

SEQ ID NO: 3924476 - RNA, 22 nt, Shigella flexneri 2a str. 301
cgcagaaaaagagcaucagcag

SEQ ID NO: 3924477 - RNA, 19 nt, Shigella flexneri 2a str. 301
cgcagaacuucacucucuu

SEQ ID NO: 3924478 - RNA, 22 nt, Shigella flexneri 2a str. 301
cgcagacaaucacaucacugcc

SEQ ID NO: 3924479 - RNA, 13 nt, Shigella flexneri 2a str. 301
cgcagacaccaga

SEQ ID NO: 3924480 - RNA, 22 nt, Shigella flexneri 2a str. 301
cgcagacacuuucccuggcgcu

SEQ ID NO: 3924481 - RNA, 17 nt, Shigella flexneri 2a str. 301
cgcagagacaucaccaa

SEQ ID NO: 3924482 - RNA, 19 nt, Shigella flexneri 2a str. 301
cgcagaguuuccaggcugg

SEQ ID NO: 3924483 - RNA, 15 nt, Shigella flexneri 2a str. 301
cgcagauacagccuc

SEQ ID NO: 3924484 - RNA, 21 nt, Shigella flexneri 2a str. 301
cgcagauagagcgccugcaga

SEQ ID NO: 3924485 - RNA, 19 nt, Shigella flexneri 2a str. 301
cgcagauauucgcucgcca

SEQ ID NO: 3924486 - RNA, 23 nt, Shigella flexneri 2a str. 301
cgcagaucagaccaauccagccg

SEQ ID NO: 3924487 - RNA, 12 nt, Shigella flexneri 2a str. 301
cgcagcacggcg

SEQ ID NO: 3924488 - RNA, 14 nt, Shigella flexneri 2a str. 301
cgcagcagcgcgcc

SEQ ID NO: 3924489 - RNA, 12 nt, Shigella flexneri 2a str. 301
cgcagcauugcu

SEQ ID NO: 3924490 - RNA, 22 nt, Shigella flexneri 2a str. 301
cgcagcauugcucaccgccagc

SEQ ID NO: 3924491 - RNA, 21 nt, Shigella flexneri 2a str. 301
cgcagccagcacugccgcauc

SEQ ID NO: 3924492 - RNA, 14 nt, Shigella flexneri 2a str. 301
cgcagccagcgcgc

SEQ ID NO: 3924493 - RNA, 23 nt, Shigella flexneri 2a str. 301
cgcagccagcgucgcacccggca

SEQ ID NO: 3924494 - RNA, 21 nt, Shigella flexneri 2a str. 301
cgcagccagcguuacaaccuc

SEQ ID NO: 3924495 - RNA, 13 nt, Shigella flexneri 2a str. 301
cgcagccaguuaa

SEQ ID NO: 3924496 - RNA, 11 nt, Shigella flexneri 2a str. 301
cgcagccauca

SEQ ID NO: 3924497 - RNA, 18 nt, Shigella flexneri 2a str. 301
cgcagccaucaaccugug

SEQ ID NO: 3924498 - RNA, 14 nt, Shigella flexneri 2a str. 301
cgcagccaucagcg

SEQ ID NO: 3924499 - RNA, 22 nt, Shigella flexneri 2a str. 301
cgcaugcucacagaguauuucc

SEQ ID NO: 3924500 - RNA, 15 nt, Shigella flexneri 2a str. 301
cgcauggcggcagcg

SEQ ID NO: 3924501 - RNA, 20 nt, Shigella flexneri 2a str. 301
cgcauuaaaaacccgccaug

SEQ ID NO: 3924502 - RNA, 13 nt, Shigella flexneri 2a str. 301
cgcauugcauuuc

SEQ ID NO: 3924503 - RNA, 15 nt, Shigella flexneri 2a str. 301
cgcauugccagagug

SEQ ID NO: 3924504 - RNA, 13 nt, Shigella flexneri 2a str. 301
cgcauugcuggcu

SEQ ID NO: 3924505 - RNA, 15 nt, Shigella flexneri 2a str. 301
cgcauuuacucucau

SEQ ID NO: 3924506 - RNA, 18 nt, Shigella flexneri 2a str. 301
cgccaaaaggcaauucaa

SEQ ID NO: 3924507 - RNA, 21 nt, Shigella flexneri 2a str. 301
cgccaaaaggcaauucaauua

SEQ ID NO: 3924508 - RNA, 16 nt, Shigella flexneri 2a str. 301
cgccaaacccaccagc

SEQ ID NO: 3924509 - RNA, 17 nt, Shigella flexneri 2a str. 301
cgccaaacggauacgaa

SEQ ID NO: 3924510 - RNA, 14 nt, Shigella flexneri 2a str. 301
cgccaaagcggcag

SEQ ID NO: 3924511 - RNA, 15 nt, Shigella flexneri 2a str. 301
cgccaaagcggcagu

SEQ ID NO: 3924512 - RNA, 16 nt, Shigella flexneri 2a str. 301
cgccaaagcggcaguu

SEQ ID NO: 3924513 - RNA, 18 nt, Shigella flexneri 2a str. 301
cgccaaaucgcugcugcu

SEQ ID NO: 3924514 - RNA, 18 nt, Shigella flexneri 2a str. 301
cgccaaaugucaccagcc

SEQ ID NO: 3924515 - RNA, 15 nt, Shigella flexneri 2a str. 301
cgccaacaaaagcaa

SEQ ID NO: 3924516 - RNA, 21 nt, Shigella flexneri 2a str. 301
cgccaacccuucugcacgcca

SEQ ID NO: 3924517 - RNA, 23 nt, Shigella flexneri 2a str. 301
cgccaaccguggcguaaaucauc

SEQ ID NO: 3924518 - RNA, 15 nt, Shigella flexneri 2a str. 301
cgccaacgcaccuga

SEQ ID NO: 3924519 - RNA, 16 nt, Shigella flexneri 2a str. 301
cgccaacuucaugacc

SEQ ID NO: 3924520 - RNA, 21 nt, Shigella flexneri 2a str. 301
cgccaauaaccggcacuucaa

SEQ ID NO: 3924521 - RNA, 22 nt, Shigella flexneri 2a str. 301
cgccaauuaaugcaccaacaaa

SEQ ID NO: 3924522 - RNA, 20 nt, Shigella flexneri 2a str. 301
cgccaauugccuacguuuuu

SEQ ID NO: 3924523 - RNA, 19 nt, Shigella flexneri 2a str. 301
cgccacaauauuccggcau

SEQ ID NO: 3924524 - RNA, 13 nt, Shigella flexneri 2a str. 301
cgccacagcagcc

SEQ ID NO: 3924525 - RNA, 22 nt, Shigella flexneri 2a str. 301
cgccacagcauucucggcccgg

SEQ ID NO: 3924526 - RNA, 18 nt, Shigella flexneri 2a str. 301
cgccacauaagaucaucg

SEQ ID NO: 3924527 - RNA, 22 nt, Shigella flexneri 2a str. 301
cgccacauaagaucaucggcca

SEQ ID NO: 3924528 - RNA, 13 nt, Shigella flexneri 2a str. 301
cgccaccacaaaa

SEQ ID NO: 3924529 - RNA, 13 nt, Shigella flexneri 2a str. 301
cgccaccacaaca

SEQ ID NO: 3924530 - RNA, 22 nt, Shigella flexneri 2a str. 301
cgccaccaccagacgcaacaga

SEQ ID NO: 3924531 - RNA, 13 nt, Shigella flexneri 2a str. 301
cgccaccacccug

SEQ ID NO: 3924532 - RNA, 20 nt, Shigella flexneri 2a str. 301
cgccaccagcaacagcgccg

SEQ ID NO: 3924533 - RNA, 12 nt, Shigella flexneri 2a str. 301
cgccaccagcgu

SEQ ID NO: 3924534 - RNA, 18 nt, Shigella flexneri 2a str. 301
cgccaccauguugcgcag

SEQ ID NO: 3924535 - RNA, 18 nt, Shigella flexneri 2a str. 301
cgccaccauuuuacgucc

SEQ ID NO: 3924536 - RNA, 13 nt, Shigella flexneri 2a str. 301
cgccacccagucc

SEQ ID NO: 3924537 - RNA, 16 nt, Shigella flexneri 2a str. 301
cgccaccgaccaggca

SEQ ID NO: 3924538 - RNA, 15 nt, Shigella flexneri 2a str. 301
cgccaccgcaagcca

SEQ ID NO: 3924539 - RNA, 13 nt, Shigella flexneri 2a str. 301
cgccaccgcacgc

SEQ ID NO: 3924540 - RNA, 13 nt, Shigella flexneri 2a str. 301
cgccaccgcgcgu

SEQ ID NO: 3924541 - RNA, 14 nt, Shigella flexneri 2a str. 301
cgccaccucuuuca

SEQ ID NO: 3924542 - RNA, 20 nt, Shigella flexneri 2a str. 301
cgccaccucuuucaccaacg

SEQ ID NO: 3924543 - RNA, 13 nt, Shigella flexneri 2a str. 301
cgccacgaaacug

SEQ ID NO: 3924544 - RNA, 17 nt, Shigella flexneri 2a str. 301
cgccacgcggagcgccu

SEQ ID NO: 3924545 - RNA, 13 nt, Shigella flexneri 2a str. 301
cgccacgcucacu

SEQ ID NO: 3924546 - RNA, 20 nt, Shigella flexneri 2a str. 301
cgccacgcuuaaccccgggc

SEQ ID NO: 3924547 - RNA, 13 nt, Shigella flexneri 2a str. 301
cgccacggcauga

SEQ ID NO: 3924548 - RNA, 23 nt, Shigella flexneri 2a str. 301
cgccacgguaucaagcccgccgg

SEQ ID NO: 3924549 - RNA, 14 nt, Shigella flexneri 2a str. 301
cgccacgguguugu

SEQ ID NO: 3924550 - RNA, 12 nt, Shigella flexneri 2a str. 301
cgccacuucugc

SEQ ID NO: 3924551 - RNA, 19 nt, Shigella flexneri 2a str. 301
cgccacuuucacgccgcca

SEQ ID NO: 3924552 - RNA, 16 nt, Shigella flexneri 2a str. 301
cgccacuuuucggcaa

SEQ ID NO: 3924553 - RNA, 15 nt, Shigella flexneri 2a str. 301
cgccagaaaaccugg

SEQ ID NO: 3924554 - RNA, 20 nt, Shigella flexneri 2a str. 301
cgccagaaaaccuggcgcag

SEQ ID NO: 3924555 - RNA, 20 nt, Shigella flexneri 2a str. 301
cgccagaaacagugaccuga

SEQ ID NO: 3924556 - RNA, 19 nt, Shigella flexneri 2a str. 301
cgccagaacacgcucccag

SEQ ID NO: 3924557 - RNA, 22 nt, Shigella flexneri 2a str. 301
cgccagaacgacgacugccgcu

SEQ ID NO: 3924558 - RNA, 17 nt, Shigella flexneri 2a str. 301
cgccagaagcguucggc

SEQ ID NO: 3924559 - RNA, 14 nt, Shigella flexneri 2a str. 301
cgccagaaguugcu

SEQ ID NO: 3924560 - RNA, 19 nt, Shigella flexneri 2a str. 301
cgccagacaauugccgcca

SEQ ID NO: 3924561 - RNA, 21 nt, Shigella flexneri 2a str. 301
cgccagaccagcuaccacgcc

SEQ ID NO: 3924562 - RNA, 20 nt, Shigella flexneri 2a str. 301
cgccagaccuaccaucuccu

SEQ ID NO: 3924563 - RNA, 18 nt, Shigella flexneri 2a str. 301
cgccagagagcgaauauc

SEQ ID NO: 3924564 - RNA, 16 nt, Shigella flexneri 2a str. 301
cgccagagcuucaacc

SEQ ID NO: 3924565 - RNA, 17 nt, Shigella flexneri 2a str. 301
cgccagauagccgaccg

SEQ ID NO: 3924566 - RNA, 14 nt, Shigella flexneri 2a str. 301
cgccagaucaggga

SEQ ID NO: 3924567 - RNA, 15 nt, Shigella flexneri 2a str. 301
cgccagaugcggcgu

SEQ ID NO: 3924568 - RNA, 14 nt, Shigella flexneri 2a str. 301
cgccagauuacgcu

SEQ ID NO: 3924569 - RNA, 13 nt, Shigella flexneri 2a str. 301
cgccagcaacaca

SEQ ID NO: 3924570 - RNA, 23 nt, Shigella flexneri 2a str. 301
cgccagcaccggacuauccgccu

SEQ ID NO: 3924571 - RNA, 19 nt, Shigella flexneri 2a str. 301
cgccagcacgaccgccauu

SEQ ID NO: 3924572 - RNA, 22 nt, Shigella flexneri 2a str. 301
cgccagcagaguuuuuuaugcg

SEQ ID NO: 3924573 - RNA, 15 nt, Shigella flexneri 2a str. 301
cgccagcagcagcgc

SEQ ID NO: 3924574 - RNA, 19 nt, Shigella flexneri 2a str. 301
cgccagcagcagcgccaac

SEQ ID NO: 3924575 - RNA, 20 nt, Shigella flexneri 2a str. 301
cgccagcagcagcgccaacg

SEQ ID NO: 3924576 - RNA, 15 nt, Shigella flexneri 2a str. 301
cgccagcagcagcgu

SEQ ID NO: 3924577 - RNA, 20 nt, Shigella flexneri 2a str. 301
cgccagcagcagcguaccuc

SEQ ID NO: 3924578 - RNA, 15 nt, Shigella flexneri 2a str. 301
cgccagcagggcaaa

SEQ ID NO: 3924579 - RNA, 17 nt, Shigella flexneri 2a str. 301
cgccagcauucccgcca

SEQ ID NO: 3924580 - RNA, 22 nt, Shigella flexneri 2a str. 301
cgccagcauucccgccagcggc

SEQ ID NO: 3924581 - RNA, 21 nt, Shigella flexneri 2a str. 301
cgccagccaauugccauauac

SEQ ID NO: 3924582 - RNA, 12 nt, Shigella flexneri 2a str. 301
cgccagccacca

SEQ ID NO: 3924583 - RNA, 13 nt, Shigella flexneri 2a str. 301
cgccagccaccau

SEQ ID NO: 3924584 - RNA, 15 nt, Shigella flexneri 2a str. 301
cgccagccaccaugc

SEQ ID NO: 3924585 - RNA, 16 nt, Shigella flexneri 2a str. 301
cgccagccagccaagc

SEQ ID NO: 3924586 - RNA, 21 nt, Shigella flexneri 2a str. 301
cgccagccaggucgguccguc

SEQ ID NO: 3924587 - RNA, 23 nt, Shigella flexneri 2a str. 301
cgccagccaguuuacccagcgaa

SEQ ID NO: 3924588 - RNA, 14 nt, Shigella flexneri 2a str. 301
cgccagccauucaa

SEQ ID NO: 3924589 - RNA, 15 nt, Shigella flexneri 2a str. 301
cgccagcgccagcgc

SEQ ID NO: 3924590 - RNA, 13 nt, Shigella flexneri 2a str. 301
cgccagcgccugg

SEQ ID NO: 3924591 - RNA, 23 nt, Shigella flexneri 2a str. 301
cgccagcggcguuugcuccugcu

SEQ ID NO: 3924592 - RNA, 20 nt, Shigella flexneri 2a str. 301
cgccagcggguucccggcgu

SEQ ID NO: 3924593 - RNA, 13 nt, Shigella flexneri 2a str. 301
cgccagcgucuga

SEQ ID NO: 3924594 - RNA, 15 nt, Shigella flexneri 2a str. 301
cgccagcgucugagc

SEQ ID NO: 3924595 - RNA, 22 nt, Shigella flexneri 2a str. 301
cgccagcguuacuucaccuucu

SEQ ID NO: 3924596 - RNA, 13 nt, Shigella flexneri 2a str. 301
cgccagcucacgg

SEQ ID NO: 3924597 - RNA, 18 nt, Shigella flexneri 2a str. 301
cgccagcugcauuucaua

SEQ ID NO: 3924598 - RNA, 19 nt, Shigella flexneri 2a str. 301
cgccagcuucgcuucccaa

SEQ ID NO: 3924599 - RNA, 11 nt, Shigella flexneri 2a str. 301
cgcccuacucc

SEQ ID NO: 3924600 - RNA, 14 nt, Shigella flexneri 2a str. 301
cgcccucacccgua

SEQ ID NO: 3924601 - RNA, 18 nt, Shigella flexneri 2a str. 301
cgcccucagcccacaucc

SEQ ID NO: 3924602 - RNA, 12 nt, Shigella flexneri 2a str. 301
cgcccuccugca

SEQ ID NO: 3924603 - RNA, 18 nt, Shigella flexneri 2a str. 301
cgcccugcgcuggugaaa

SEQ ID NO: 3924604 - RNA, 18 nt, Shigella flexneri 2a str. 301
cgcccugcggcugaccac

SEQ ID NO: 3924605 - RNA, 23 nt, Shigella flexneri 2a str. 301
cgcccugcggcugaccaccaccg

SEQ ID NO: 3924606 - RNA, 12 nt, Shigella flexneri 2a str. 301
cgcccugcucgu

SEQ ID NO: 3924607 - RNA, 13 nt, Shigella flexneri 2a str. 301
cgcccuggaugca

SEQ ID NO: 3924608 - RNA, 16 nt, Shigella flexneri 2a str. 301
cgcccuuucagcgccu

SEQ ID NO: 3924609 - RNA, 14 nt, Shigella flexneri 2a str. 301
cgccgaaaccgcgc

SEQ ID NO: 3924610 - RNA, 18 nt, Shigella flexneri 2a str. 301
cgccgaauaacgcgcagc

SEQ ID NO: 3924611 - RNA, 14 nt, Shigella flexneri 2a str. 301
cgccgacgcccugc

SEQ ID NO: 3924612 - RNA, 13 nt, Shigella flexneri 2a str. 301
cgccgacugucaa

SEQ ID NO: 3924613 - RNA, 18 nt, Shigella flexneri 2a str. 301
cgccgagcgggaucgccg

SEQ ID NO: 3924614 - RNA, 23 nt, Shigella flexneri 2a str. 301
cgccgauaaucaacgcgccgcca

SEQ ID NO: 3924615 - RNA, 19 nt, Shigella flexneri 2a str. 301
cgccgauaucgcuggcaga

SEQ ID NO: 3924616 - RNA, 21 nt, Shigella flexneri 2a str. 301
cgccgauuuugccuucauacu

SEQ ID NO: 3924617 - RNA, 22 nt, Shigella flexneri 2a str. 301
cgccgcaaaucguauccggcau

SEQ ID NO: 3924618 - RNA, 14 nt, Shigella flexneri 2a str. 301
cgccgcacacgccg

SEQ ID NO: 3924619 - RNA, 14 nt, Shigella flexneri 2a str. 301
cgccgcagccggaa

SEQ ID NO: 3924620 - RNA, 18 nt, Shigella flexneri 2a str. 301
cgccgcauaguaagccgg

SEQ ID NO: 3924621 - RNA, 15 nt, Shigella flexneri 2a str. 301
cgccgcauccaacau

SEQ ID NO: 3924622 - RNA, 13 nt, Shigella flexneri 2a str. 301
cgccgcauccgac

SEQ ID NO: 3924623 - RNA, 15 nt, Shigella flexneri 2a str. 301
cgccgcauccggcau

SEQ ID NO: 3924624 - RNA, 13 nt, Shigella flexneri 2a str. 301
cgccgcauccggu

SEQ ID NO: 3924625 - RNA, 15 nt, Shigella flexneri 2a str. 301
cgccgcaucgccagu

SEQ ID NO: 3924626 - RNA, 16 nt, Shigella flexneri 2a str. 301
cgccgcaucguccugc

SEQ ID NO: 3924627 - RNA, 16 nt, Shigella flexneri 2a str. 301
cgccgccaacccuucu

SEQ ID NO: 3924628 - RNA, 14 nt, Shigella flexneri 2a str. 301
cgccgccacugcca

SEQ ID NO: 3924629 - RNA, 13 nt, Shigella flexneri 2a str. 301
cgccgccagcaac

SEQ ID NO: 3924630 - RNA, 14 nt, Shigella flexneri 2a str. 301
cgccgccaguacgc

SEQ ID NO: 3924631 - RNA, 17 nt, Shigella flexneri 2a str. 301
cgccgccgagcaccacg

SEQ ID NO: 3924632 - RNA, 16 nt, Shigella flexneri 2a str. 301
cgccgccgcugaacug

SEQ ID NO: 3924633 - RNA, 16 nt, Shigella flexneri 2a str. 301
cgccgccgcuggcgug

SEQ ID NO: 3924634 - RNA, 15 nt, Shigella flexneri 2a str. 301
cgccgcggacaauaa

SEQ ID NO: 3924635 - RNA, 17 nt, Shigella flexneri 2a str. 301
cgccgcgguacagcucg

SEQ ID NO: 3924636 - RNA, 21 nt, Shigella flexneri 2a str. 301
cgccgcguuuaucgacagacg

SEQ ID NO: 3924637 - RNA, 22 nt, Shigella flexneri 2a str. 301
cgccgcguuuaucgacagacgc

SEQ ID NO: 3924638 - RNA, 19 nt, Shigella flexneri 2a str. 301
cgccgcguuugcgcagcca

SEQ ID NO: 3924639 - RNA, 20 nt, Shigella flexneri 2a str. 301
cgccgcguuugcgcagccag

SEQ ID NO: 3924640 - RNA, 18 nt, Shigella flexneri 2a str. 301
cgccgcuaacaucgucgg

SEQ ID NO: 3924641 - RNA, 13 nt, Shigella flexneri 2a str. 301
cgccgcuaccggc

SEQ ID NO: 3924642 - RNA, 23 nt, Shigella flexneri 2a str. 301
cgccgcuauuauaucgcucucuu

SEQ ID NO: 3924643 - RNA, 22 nt, Shigella flexneri 2a str. 301
cgccgcugaacugauugccacc

SEQ ID NO: 3924644 - RNA, 23 nt, Shigella flexneri 2a str. 301
cgccgcuggccauuucugccagu

SEQ ID NO: 3924645 - RNA, 20 nt, Shigella flexneri 2a str. 301
cgccgcugucuaccagcacc

SEQ ID NO: 3924646 - RNA, 15 nt, Shigella flexneri 2a str. 301
cgccgcuuaccauaa

SEQ ID NO: 3924647 - RNA, 19 nt, Shigella flexneri 2a str. 301
cgccggaaauuugcagugc

SEQ ID NO: 3924648 - RNA, 20 nt, Shigella flexneri 2a str. 301
cgccggaaucaacggcaaca

SEQ ID NO: 3924649 - RNA, 20 nt, Shigella flexneri 2a str. 301
cgccggacgucaggccgcca

SEQ ID NO: 3924650 - RNA, 23 nt, Shigella flexneri 2a str. 301
cgccggagagggaaauccccugg

SEQ ID NO: 3924651 - RNA, 22 nt, Shigella flexneri 2a str. 301
cgccggauagacaugcccggaa

SEQ ID NO: 3924652 - RNA, 22 nt, Shigella flexneri 2a str. 301
cgccgggaugauggcuuuggcg

SEQ ID NO: 3924653 - RNA, 18 nt, Shigella flexneri 2a str. 301
cgccgggaugcuggggcc

SEQ ID NO: 3924654 - RNA, 16 nt, Shigella flexneri 2a str. 301
cgccgggcuaaccgcu

SEQ ID NO: 3924655 - RNA, 16 nt, Shigella flexneri 2a str. 301
cgccgggguuauguga

SEQ ID NO: 3924656 - RNA, 14 nt, Shigella flexneri 2a str. 301
cgccgguagucacc

SEQ ID NO: 3924657 - RNA, 14 nt, Shigella flexneri 2a str. 301
cgccggucaacgcg

SEQ ID NO: 3924658 - RNA, 15 nt, Shigella flexneri 2a str. 301
cgccggucacgcccg

SEQ ID NO: 3924659 - RNA, 17 nt, Shigella flexneri 2a str. 301
cgccggugaccaucagc

SEQ ID NO: 3924660 - RNA, 17 nt, Shigella flexneri 2a str. 301
cgccguaaaucccgcca

SEQ ID NO: 3924661 - RNA, 14 nt, Shigella flexneri 2a str. 301
cgccguaacgcccu

SEQ ID NO: 3924662 - RNA, 21 nt, Shigella flexneri 2a str. 301
cgccguacggcguaccgccgc

SEQ ID NO: 3924663 - RNA, 18 nt, Shigella flexneri 2a str. 301
cgccguauaauaucuuuu

SEQ ID NO: 3924664 - RNA, 16 nt, Shigella flexneri 2a str. 301
cgccgucaucacaccg

SEQ ID NO: 3924665 - RNA, 15 nt, Shigella flexneri 2a str. 301
cgccgucaucacgca

SEQ ID NO: 3924666 - RNA, 18 nt, Shigella flexneri 2a str. 301
cgccgucaucacgcaggc

SEQ ID NO: 3924667 - RNA, 18 nt, Shigella flexneri 2a str. 301
cgccguccacaaaccguu

SEQ ID NO: 3924668 - RNA, 14 nt, Shigella flexneri 2a str. 301
cgccgugcacaccg

SEQ ID NO: 3924669 - RNA, 21 nt, Shigella flexneri 2a str. 301
cgccguuuuuacccagcagca

SEQ ID NO: 3924670 - RNA, 23 nt, Shigella flexneri 2a str. 301
cgccguuuuuacccagcagcagc

SEQ ID NO: 3924671 - RNA, 19 nt, Shigella flexneri 2a str. 301
cgccguuuuuuuucuguca

SEQ ID NO: 3924672 - RNA, 15 nt, Shigella flexneri 2a str. 301
cgccuaauuacauaa

SEQ ID NO: 3924673 - RNA, 14 nt, Shigella flexneri 2a str. 301
cgccucaacccauu

SEQ ID NO: 3924674 - RNA, 19 nt, Shigella flexneri 2a str. 301
cgccucaagaaucacuuca

SEQ ID NO: 3924675 - RNA, 19 nt, Shigella flexneri 2a str. 301
cgccucacuauccgcccca

SEQ ID NO: 3924676 - RNA, 14 nt, Shigella flexneri 2a str. 301
cgccucagccagaa

SEQ ID NO: 3924677 - RNA, 17 nt, Shigella flexneri 2a str. 301
cgccucccuucgcugcu

SEQ ID NO: 3924678 - RNA, 18 nt, Shigella flexneri 2a str. 301
cgccucgagaaauuuuua

SEQ ID NO: 3924679 - RNA, 14 nt, Shigella flexneri 2a str. 301
cgccucgcgccagc

SEQ ID NO: 3924680 - RNA, 13 nt, Shigella flexneri 2a str. 301
cgccucggggcca

SEQ ID NO: 3924681 - RNA, 19 nt, Shigella flexneri 2a str. 301
cgccucguaaugcuccggc

SEQ ID NO: 3924682 - RNA, 12 nt, Shigella flexneri 2a str. 301
cgccucuucaua

SEQ ID NO: 3924683 - RNA, 17 nt, Shigella flexneri 2a str. 301
cgccucuucauacaucu

SEQ ID NO: 3924684 - RNA, 11 nt, Shigella flexneri 2a str. 301
cgccucuucca

SEQ ID NO: 3924685 - RNA, 18 nt, Shigella flexneri 2a str. 301
cgccugaaauacccgcuc

SEQ ID NO: 3924686 - RNA, 15 nt, Shigella flexneri 2a str. 301
cgccugaucgcgcag

SEQ ID NO: 3924687 - RNA, 18 nt, Shigella flexneri 2a str. 301
cgccugaucuuccgcguc

SEQ ID NO: 3924688 - RNA, 13 nt, Shigella flexneri 2a str. 301
cgccugcaaauaa

SEQ ID NO: 3924689 - RNA, 18 nt, Shigella flexneri 2a str. 301
cgccugcaccauugcugc

SEQ ID NO: 3924690 - RNA, 14 nt, Shigella flexneri 2a str. 301
cgccugcagggcuu

SEQ ID NO: 3924691 - RNA, 12 nt, Shigella flexneri 2a str. 301
cgccugcagguu

SEQ ID NO: 3924692 - RNA, 19 nt, Shigella flexneri 2a str. 301
cgccugcauccgccaucca

SEQ ID NO: 3924693 - RNA, 14 nt, Shigella flexneri 2a str. 301
cgccugcaucucuu

SEQ ID NO: 3924694 - RNA, 18 nt, Shigella flexneri 2a str. 301
cgccugcggccagcagcu

SEQ ID NO: 3924695 - RNA, 18 nt, Shigella flexneri 2a str. 301
cgccugcggcgcaugcau

SEQ ID NO: 3924696 - RNA, 15 nt, Shigella flexneri 2a str. 301
cgccugcggcuucca

SEQ ID NO: 3924697 - RNA, 19 nt, Shigella flexneri 2a str. 301
cgccuggacaucaugcugc

SEQ ID NO: 3924698 - RNA, 16 nt, Shigella flexneri 2a str. 301
cgccuggaccagcggg

SEQ ID NO: 3924699 - RNA, 12 nt, Shigella flexneri 2a str. 301
cgccugggaagu

SEQ ID NO: 3924700 - RNA, 16 nt, Shigella flexneri 2a str. 301
cgcgcuaauuccaguc

SEQ ID NO: 3924701 - RNA, 13 nt, Shigella flexneri 2a str. 301
cgcgcuaucagca

SEQ ID NO: 3924702 - RNA, 14 nt, Shigella flexneri 2a str. 301
cgcgcuauugccgu

SEQ ID NO: 3924703 - RNA, 14 nt, Shigella flexneri 2a str. 301
cgcgcuauuuuccu

SEQ ID NO: 3924704 - RNA, 15 nt, Shigella flexneri 2a str. 301
cgcgcucaucagcgg

SEQ ID NO: 3924705 - RNA, 14 nt, Shigella flexneri 2a str. 301
cgcgcucugccagc

SEQ ID NO: 3924706 - RNA, 16 nt, Shigella flexneri 2a str. 301
cgcgcucuuuaaaggc

SEQ ID NO: 3924707 - RNA, 15 nt, Shigella flexneri 2a str. 301
cgcgcugauugccgu

SEQ ID NO: 3924708 - RNA, 15 nt, Shigella flexneri 2a str. 301
cgcgcuuaucgccag

SEQ ID NO: 3924709 - RNA, 16 nt, Shigella flexneri 2a str. 301
cgcgcuuaucgccagc

SEQ ID NO: 3924710 - RNA, 20 nt, Shigella flexneri 2a str. 301
cgcgcuuaucgccagcgcca

SEQ ID NO: 3924711 - RNA, 17 nt, Shigella flexneri 2a str. 301
cgcgcuucagucgccag

SEQ ID NO: 3924712 - RNA, 18 nt, Shigella flexneri 2a str. 301
cgcgcuucagucgccagc

SEQ ID NO: 3924713 - RNA, 22 nt, Shigella flexneri 2a str. 301
cgcgcuucgguguuaaaacgca

SEQ ID NO: 3924714 - RNA, 20 nt, Shigella flexneri 2a str. 301
cgcgcuugcggaagcaaccg

SEQ ID NO: 3924715 - RNA, 17 nt, Shigella flexneri 2a str. 301
cgcgcuuuuuuuaugcc

SEQ ID NO: 3924716 - RNA, 15 nt, Shigella flexneri 2a str. 301
cgcggaccaacaaaa

SEQ ID NO: 3924717 - RNA, 12 nt, Shigella flexneri 2a str. 301
cgcggacgcaca

SEQ ID NO: 3924718 - RNA, 13 nt, Shigella flexneri 2a str. 301
cgcggagcgccug

SEQ ID NO: 3924719 - RNA, 14 nt, Shigella flexneri 2a str. 301
cgcggauccccugc

SEQ ID NO: 3924720 - RNA, 15 nt, Shigella flexneri 2a str. 301
cgcggauggccucug

SEQ ID NO: 3924721 - RNA, 22 nt, Shigella flexneri 2a str. 301
cgcggcaauuagcggccagcgg

SEQ ID NO: 3924722 - RNA, 20 nt, Shigella flexneri 2a str. 301
cgcggcaauuuuuaccgguc

SEQ ID NO: 3924723 - RNA, 12 nt, Shigella flexneri 2a str. 301
cgcggcaggcau

SEQ ID NO: 3924724 - RNA, 16 nt, Shigella flexneri 2a str. 301
cgcggcagucacauuc

SEQ ID NO: 3924725 - RNA, 19 nt, Shigella flexneri 2a str. 301
cgcggcagugacugcccca

SEQ ID NO: 3924726 - RNA, 20 nt, Shigella flexneri 2a str. 301
cgcggcauuaccggcaaugu

SEQ ID NO: 3924727 - RNA, 20 nt, Shigella flexneri 2a str. 301
cgcggcauuuuuacugcgcg

SEQ ID NO: 3924728 - RNA, 16 nt, Shigella flexneri 2a str. 301
cgcggcccaccuggcu

SEQ ID NO: 3924729 - RNA, 14 nt, Shigella flexneri 2a str. 301
cgcggcccaggcgg

SEQ ID NO: 3924730 - RNA, 16 nt, Shigella flexneri 2a str. 301
cgcggcccaggcggcg

SEQ ID NO: 3924731 - RNA, 19 nt, Shigella flexneri 2a str. 301
cgcggcgauauccagcgcg

SEQ ID NO: 3924732 - RNA, 13 nt, Shigella flexneri 2a str. 301
cgcggcuccagaa

SEQ ID NO: 3924733 - RNA, 19 nt, Shigella flexneri 2a str. 301
cgcggcuuugucauaacca

SEQ ID NO: 3924734 - RNA, 18 nt, Shigella flexneri 2a str. 301
cgcgggccauccaccagu

SEQ ID NO: 3924735 - RNA, 21 nt, Shigella flexneri 2a str. 301
cgcgggcgaauuaucggcagc

SEQ ID NO: 3924736 - RNA, 19 nt, Shigella flexneri 2a str. 301
cgcggggaucacuggcaga

SEQ ID NO: 3924737 - RNA, 15 nt, Shigella flexneri 2a str. 301
cgcgggucaguauuc

SEQ ID NO: 3924738 - RNA, 15 nt, Shigella flexneri 2a str. 301
cgcgggucguugauc

SEQ ID NO: 3924739 - RNA, 23 nt, Shigella flexneri 2a str. 301
cgcgguaagaguaaagcccgcca

SEQ ID NO: 3924740 - RNA, 13 nt, Shigella flexneri 2a str. 301
cgcgguagcgggc

SEQ ID NO: 3924741 - RNA, 18 nt, Shigella flexneri 2a str. 301
cgcgguagcgggcaguaa

SEQ ID NO: 3924742 - RNA, 14 nt, Shigella flexneri 2a str. 301
cgcgguaucaccac

SEQ ID NO: 3924743 - RNA, 19 nt, Shigella flexneri 2a str. 301
cgcgguaucaccacccagc

SEQ ID NO: 3924744 - RNA, 15 nt, Shigella flexneri 2a str. 301
cgcgguauugccugu

SEQ ID NO: 3924745 - RNA, 17 nt, Shigella flexneri 2a str. 301
cgcggucagcugcuguu

SEQ ID NO: 3924746 - RNA, 21 nt, Shigella flexneri 2a str. 301
cgcggucgccgucaggcaagc

SEQ ID NO: 3924747 - RNA, 14 nt, Shigella flexneri 2a str. 301
cgcggugauugacg

SEQ ID NO: 3924748 - RNA, 23 nt, Shigella flexneri 2a str. 301
cgcgguguugauacaggcgcugu

SEQ ID NO: 3924749 - RNA, 22 nt, Shigella flexneri 2a str. 301
cgcgguugcggguuuucgcugc

SEQ ID NO: 3924750 - RNA, 15 nt, Shigella flexneri 2a str. 301
cgcgguuugugcucu

SEQ ID NO: 3924751 - RNA, 16 nt, Shigella flexneri 2a str. 301
cgcguaaaacagccag

SEQ ID NO: 3924752 - RNA, 17 nt, Shigella flexneri 2a str. 301
cgcguaaaacagccagc

SEQ ID NO: 3924753 - RNA, 20 nt, Shigella flexneri 2a str. 301
cgcguaaccgguaccugccg

SEQ ID NO: 3924754 - RNA, 16 nt, Shigella flexneri 2a str. 301
cgcguaauggcagcau

SEQ ID NO: 3924755 - RNA, 19 nt, Shigella flexneri 2a str. 301
cgcguaauggcagcauuca

SEQ ID NO: 3924756 - RNA, 17 nt, Shigella flexneri 2a str. 301
cgcguaccgccgagucg

SEQ ID NO: 3924757 - RNA, 20 nt, Shigella flexneri 2a str. 301
cgcguagagaauccagugcu

SEQ ID NO: 3924758 - RNA, 24 nt, Shigella flexneri 2a str. 301
cgcguaugguuuuuccagccgagc

SEQ ID NO: 3924759 - RNA, 22 nt, Shigella flexneri 2a str. 301
cgcgucaacagggcagacauuc

SEQ ID NO: 3924760 - RNA, 21 nt, Shigella flexneri 2a str. 301
cgcguccccugcaauauuuug

SEQ ID NO: 3924761 - RNA, 15 nt, Shigella flexneri 2a str. 301
cgcgucggcuugagu

SEQ ID NO: 3924762 - RNA, 14 nt, Shigella flexneri 2a str. 301
cgcgucuggcauca

SEQ ID NO: 3924763 - RNA, 20 nt, Shigella flexneri 2a str. 301
cgcgucuuauccggccucca

SEQ ID NO: 3924764 - RNA, 18 nt, Shigella flexneri 2a str. 301
cgcgucuuaucuggccua

SEQ ID NO: 3924765 - RNA, 16 nt, Shigella flexneri 2a str. 301
cgcgugaaugccugau

SEQ ID NO: 3924766 - RNA, 15 nt, Shigella flexneri 2a str. 301
cgcgugacagccuug

SEQ ID NO: 3924767 - RNA, 17 nt, Shigella flexneri 2a str. 301
cgcgugacgcuggcaga

SEQ ID NO: 3924768 - RNA, 16 nt, Shigella flexneri 2a str. 301
cgcguggaucaagcaa

SEQ ID NO: 3924769 - RNA, 23 nt, Shigella flexneri 2a str. 301
cgcguggcaauggcgacuucugc

SEQ ID NO: 3924770 - RNA, 17 nt, Shigella flexneri 2a str. 301
cgcguggugagugugcu

SEQ ID NO: 3924771 - RNA, 17 nt, Shigella flexneri 2a str. 301
cgcguuacccauucaag

SEQ ID NO: 3924772 - RNA, 13 nt, Shigella flexneri 2a str. 301
cgcguucacugcc

SEQ ID NO: 3924773 - RNA, 14 nt, Shigella flexneri 2a str. 301
cgcguucacugccg

SEQ ID NO: 3924774 - RNA, 19 nt, Shigella flexneri 2a str. 301
cgcguucgauggcgcgcca

SEQ ID NO: 3924775 - RNA, 13 nt, Shigella flexneri 2a str. 301
cgcguucuguugc

SEQ ID NO: 3924776 - RNA, 23 nt, Shigella flexneri 2a str. 301
cgcguugacguucaugccggucg

SEQ ID NO: 3924777 - RNA, 21 nt, Shigella flexneri 2a str. 301
cgcguuggcaagauaggcauc

SEQ ID NO: 3924778 - RNA, 18 nt, Shigella flexneri 2a str. 301
cgcguuguugcaggaaca

SEQ ID NO: 3924779 - RNA, 21 nt, Shigella flexneri 2a str. 301
cgcguuuaauggcggugccca

SEQ ID NO: 3924780 - RNA, 21 nt, Shigella flexneri 2a str. 301
cgcguuuccacgcugauugca

SEQ ID NO: 3924781 - RNA, 15 nt, Shigella flexneri 2a str. 301
cgcguuucugcgcuu

SEQ ID NO: 3924782 - RNA, 19 nt, Shigella flexneri 2a str. 301
cgcuaaaaaagguaacauu

SEQ ID NO: 3924783 - RNA, 21 nt, Shigella flexneri 2a str. 301
cgcuaaaugccgcguggccug

SEQ ID NO: 3924784 - RNA, 12 nt, Shigella flexneri 2a str. 301
cgcuaaauguuu

SEQ ID NO: 3924785 - RNA, 14 nt, Shigella flexneri 2a str. 301
cgcuaacagcagca

SEQ ID NO: 3924786 - RNA, 22 nt, Shigella flexneri 2a str. 301
cgcuaacccgcagcuuaaugaa

SEQ ID NO: 3924787 - RNA, 13 nt, Shigella flexneri 2a str. 301
cgcuaacccgcgu

SEQ ID NO: 3924788 - RNA, 16 nt, Shigella flexneri 2a str. 301
cgcuaacggugcacgc

SEQ ID NO: 3924789 - RNA, 17 nt, Shigella flexneri 2a str. 301
cgcuaagauaccccagc

SEQ ID NO: 3924790 - RNA, 20 nt, Shigella flexneri 2a str. 301
cgcuaaggucaccaguucac

SEQ ID NO: 3924791 - RNA, 18 nt, Shigella flexneri 2a str. 301
cgcuacauaacgcagcgg

SEQ ID NO: 3924792 - RNA, 13 nt, Shigella flexneri 2a str. 301
cgcuacauccgac

SEQ ID NO: 3924793 - RNA, 14 nt, Shigella flexneri 2a str. 301
cgcuaccgcccuga

SEQ ID NO: 3924794 - RNA, 16 nt, Shigella flexneri 2a str. 301
cgcuaccugccgccac

SEQ ID NO: 3924795 - RNA, 20 nt, Shigella flexneri 2a str. 301
cgcuacuuuuuucacccaca

SEQ ID NO: 3924796 - RNA, 21 nt, Shigella flexneri 2a str. 301
cgcuagccaacuuaccgccgg

SEQ ID NO: 3924797 - RNA, 15 nt, Shigella flexneri 2a str. 301
cgcuauacagcagcc

SEQ ID NO: 3924798 - RNA, 22 nt, Shigella flexneri 2a str. 301
cgcuauagacaccuugcaacuc

SEQ ID NO: 3924799 - RNA, 21 nt, Shigella flexneri 2a str. 301
cgcuauaucgcugauaucaaa

SEQ ID NO: 3924800 - RNA, 22 nt, Shigella flexneri 2a str. 301
cgcuggcuuugcccuggcgcga

SEQ ID NO: 3924801 - RNA, 20 nt, Shigella flexneri 2a str. 301
cgcuggugacaucgccagag

SEQ ID NO: 3924802 - RNA, 19 nt, Shigella flexneri 2a str. 301
cgcuggugauugcaccgac

SEQ ID NO: 3924803 - RNA, 11 nt, Shigella flexneri 2a str. 301
cgcuguaaaug

SEQ ID NO: 3924804 - RNA, 15 nt, Shigella flexneri 2a str. 301
cgcuguaauauccaa

SEQ ID NO: 3924805 - RNA, 18 nt, Shigella flexneri 2a str. 301
cgcuguagccgccgucgu

SEQ ID NO: 3924806 - RNA, 23 nt, Shigella flexneri 2a str. 301
cgcugucgggcagcguuugaaca

SEQ ID NO: 3924807 - RNA, 22 nt, Shigella flexneri 2a str. 301
cgcuguggaacaucaccccgcc

SEQ ID NO: 3924808 - RNA, 18 nt, Shigella flexneri 2a str. 301
cgcuguguaaacccagcc

SEQ ID NO: 3924809 - RNA, 17 nt, Shigella flexneri 2a str. 301
cgcuguugcguaacuga

SEQ ID NO: 3924810 - RNA, 18 nt, Shigella flexneri 2a str. 301
cgcuuaaauuuccaccgc

SEQ ID NO: 3924811 - RNA, 22 nt, Shigella flexneri 2a str. 301
cgcuuaagguuacccgcacggc

SEQ ID NO: 3924812 - RNA, 14 nt, Shigella flexneri 2a str. 301
cgcuuaauccgcgc

SEQ ID NO: 3924813 - RNA, 16 nt, Shigella flexneri 2a str. 301
cgcuuacacacccggc

SEQ ID NO: 3924814 - RNA, 17 nt, Shigella flexneri 2a str. 301
cgcuuacacacccggcc

SEQ ID NO: 3924815 - RNA, 23 nt, Shigella flexneri 2a str. 301
cgcuuacgcgucuuaucaugccu

SEQ ID NO: 3924816 - RNA, 19 nt, Shigella flexneri 2a str. 301
cgcuuacucauccacugcc

SEQ ID NO: 3924817 - RNA, 18 nt, Shigella flexneri 2a str. 301
cgcuuaucaggccuacaa

SEQ ID NO: 3924818 - RNA, 22 nt, Shigella flexneri 2a str. 301
cgcuuaucaggccugcaaacga

SEQ ID NO: 3924819 - RNA, 13 nt, Shigella flexneri 2a str. 301
cgcuuauccggcc

SEQ ID NO: 3924820 - RNA, 23 nt, Shigella flexneri 2a str. 301
cgcuuauuguugucaauauucug

SEQ ID NO: 3924821 - RNA, 15 nt, Shigella flexneri 2a str. 301
cgcuucaaccaacgc

SEQ ID NO: 3924822 - RNA, 14 nt, Shigella flexneri 2a str. 301
cgcuucaaccaccu

SEQ ID NO: 3924823 - RNA, 17 nt, Shigella flexneri 2a str. 301
cgcuucaccaaucagaa

SEQ ID NO: 3924824 - RNA, 19 nt, Shigella flexneri 2a str. 301
cgcuucacucccugcccca

SEQ ID NO: 3924825 - RNA, 14 nt, Shigella flexneri 2a str. 301
cgcuucagugacuu

SEQ ID NO: 3924826 - RNA, 15 nt, Shigella flexneri 2a str. 301
cgcuuccagcgcauc

SEQ ID NO: 3924827 - RNA, 13 nt, Shigella flexneri 2a str. 301
cgcuucccaacgc

SEQ ID NO: 3924828 - RNA, 19 nt, Shigella flexneri 2a str. 301
cgcuucccaacgcagcaac

SEQ ID NO: 3924829 - RNA, 18 nt, Shigella flexneri 2a str. 301
cgcuucccucuacaggaa

SEQ ID NO: 3924830 - RNA, 11 nt, Shigella flexneri 2a str. 301
cgcuuccugca

SEQ ID NO: 3924831 - RNA, 16 nt, Shigella flexneri 2a str. 301
cgcuucgcccaaaucc

SEQ ID NO: 3924832 - RNA, 16 nt, Shigella flexneri 2a str. 301
cgcuucgcccgccagc

SEQ ID NO: 3924833 - RNA, 14 nt, Shigella flexneri 2a str. 301
cgcuucggcgcaua

SEQ ID NO: 3924834 - RNA, 17 nt, Shigella flexneri 2a str. 301
cgcuucggcggguuuuu

SEQ ID NO: 3924835 - RNA, 20 nt, Shigella flexneri 2a str. 301
cgcuucggcuccagcgcguc

SEQ ID NO: 3924836 - RNA, 21 nt, Shigella flexneri 2a str. 301
cgcuucgucgucaccugcguc

SEQ ID NO: 3924837 - RNA, 14 nt, Shigella flexneri 2a str. 301
cgcuucguuuucag

SEQ ID NO: 3924838 - RNA, 11 nt, Shigella flexneri 2a str. 301
cgcuucugcca

SEQ ID NO: 3924839 - RNA, 20 nt, Shigella flexneri 2a str. 301
cgcuucugucgcuucacgca

SEQ ID NO: 3924840 - RNA, 12 nt, Shigella flexneri 2a str. 301
cgcuucuucagc

SEQ ID NO: 3924841 - RNA, 14 nt, Shigella flexneri 2a str. 301
cgcuucuucagccu

SEQ ID NO: 3924842 - RNA, 14 nt, Shigella flexneri 2a str. 301
cgcuucuuccagca

SEQ ID NO: 3924843 - RNA, 22 nt, Shigella flexneri 2a str. 301
cgcuucuuccagcaucgccccc

SEQ ID NO: 3924844 - RNA, 20 nt, Shigella flexneri 2a str. 301
cgcuucuucugccgcuucca

SEQ ID NO: 3924845 - RNA, 13 nt, Shigella flexneri 2a str. 301
cgcuugagcagga

SEQ ID NO: 3924846 - RNA, 19 nt, Shigella flexneri 2a str. 301
cgcuugagcaggagcagca

SEQ ID NO: 3924847 - RNA, 14 nt, Shigella flexneri 2a str. 301
cgcuugauuucucg

SEQ ID NO: 3924848 - RNA, 21 nt, Shigella flexneri 2a str. 301
cgcuuggcaagcccagcaccc

SEQ ID NO: 3924849 - RNA, 23 nt, Shigella flexneri 2a str. 301
cgcuugucaucgaugagaugacg

SEQ ID NO: 3924850 - RNA, 14 nt, Shigella flexneri 2a str. 301
cgcuuguucgcaua

SEQ ID NO: 3924851 - RNA, 19 nt, Shigella flexneri 2a str. 301
cgcuuuacucaacuccccg

SEQ ID NO: 3924852 - RNA, 20 nt, Shigella flexneri 2a str. 301
cgcuuuauagggugccauuu

SEQ ID NO: 3924853 - RNA, 13 nt, Shigella flexneri 2a str. 301
cgcuuuaucgccg

SEQ ID NO: 3924854 - RNA, 17 nt, Shigella flexneri 2a str. 301
cgcuuuaucgccuacca

SEQ ID NO: 3924855 - RNA, 18 nt, Shigella flexneri 2a str. 301
cgcuuuaucgccuaccaa

SEQ ID NO: 3924856 - RNA, 14 nt, Shigella flexneri 2a str. 301
cgcuuuaugugcuu

SEQ ID NO: 3924857 - RNA, 19 nt, Shigella flexneri 2a str. 301
cgcuuucacuauuucuuug

SEQ ID NO: 3924858 - RNA, 12 nt, Shigella flexneri 2a str. 301
cgcuuucccagc

SEQ ID NO: 3924859 - RNA, 17 nt, Shigella flexneri 2a str. 301
cgcuuucccagcgauga

SEQ ID NO: 3924860 - RNA, 20 nt, Shigella flexneri 2a str. 301
cgcuuuccgggguaaauuuc

SEQ ID NO: 3924861 - RNA, 21 nt, Shigella flexneri 2a str. 301
cgcuuucgcuacuucaaacaa

SEQ ID NO: 3924862 - RNA, 18 nt, Shigella flexneri 2a str. 301
cgcuuucucaccaugacc

SEQ ID NO: 3924863 - RNA, 16 nt, Shigella flexneri 2a str. 301
cgcuuucucuucggcu

SEQ ID NO: 3924864 - RNA, 15 nt, Shigella flexneri 2a str. 301
cgcuuugcaggcugg

SEQ ID NO: 3924865 - RNA, 15 nt, Shigella flexneri 2a str. 301
cgcuuuuauaaaggg

SEQ ID NO: 3924866 - RNA, 13 nt, Shigella flexneri 2a str. 301
cgcuuuucagugc

SEQ ID NO: 3924867 - RNA, 17 nt, Shigella flexneri 2a str. 301
cgcuuuucgccagcuca

SEQ ID NO: 3924868 - RNA, 22 nt, Shigella flexneri 2a str. 301
cgcuuuuucaauuuccaguuug

SEQ ID NO: 3924869 - RNA, 13 nt, Shigella flexneri 2a str. 301
cggaaacccugcg

SEQ ID NO: 3924870 - RNA, 17 nt, Shigella flexneri 2a str. 301
cggaaacugucaauaaa

SEQ ID NO: 3924871 - RNA, 14 nt, Shigella flexneri 2a str. 301
cggaaagcacaaaa

SEQ ID NO: 3924872 - RNA, 17 nt, Shigella flexneri 2a str. 301
cggaaagcacaaaauca

SEQ ID NO: 3924873 - RNA, 20 nt, Shigella flexneri 2a str. 301
cggaaaguuuaauugccauu

SEQ ID NO: 3924874 - RNA, 21 nt, Shigella flexneri 2a str. 301
cggaaaguuuaauugccauuu

SEQ ID NO: 3924875 - RNA, 12 nt, Shigella flexneri 2a str. 301
cggaaauauauu

SEQ ID NO: 3924876 - RNA, 23 nt, Shigella flexneri 2a str. 301
cggaaaucacgauugcugccgau

SEQ ID NO: 3924877 - RNA, 13 nt, Shigella flexneri 2a str. 301
cggaaaucacgca

SEQ ID NO: 3924878 - RNA, 15 nt, Shigella flexneri 2a str. 301
cggaaauugccacug

SEQ ID NO: 3924879 - RNA, 14 nt, Shigella flexneri 2a str. 301
cggaacaacccagc

SEQ ID NO: 3924880 - RNA, 15 nt, Shigella flexneri 2a str. 301
cggaacaacggcaaa

SEQ ID NO: 3924881 - RNA, 19 nt, Shigella flexneri 2a str. 301
cggaacacucuuccagucg

SEQ ID NO: 3924882 - RNA, 12 nt, Shigella flexneri 2a str. 301
cggaacaggcag

SEQ ID NO: 3924883 - RNA, 21 nt, Shigella flexneri 2a str. 301
cggaacaucgccugccgcagg

SEQ ID NO: 3924884 - RNA, 14 nt, Shigella flexneri 2a str. 301
cggaaccagccagg

SEQ ID NO: 3924885 - RNA, 20 nt, Shigella flexneri 2a str. 301
cggaacccaccgcaauaacc

SEQ ID NO: 3924886 - RNA, 20 nt, Shigella flexneri 2a str. 301
cggaaccggauuuucaccau

SEQ ID NO: 3924887 - RNA, 20 nt, Shigella flexneri 2a str. 301
cggaacgcagauauaaaaaa

SEQ ID NO: 3924888 - RNA, 16 nt, Shigella flexneri 2a str. 301
cggaacgcuuucuuug

SEQ ID NO: 3924889 - RNA, 14 nt, Shigella flexneri 2a str. 301
cggaagagacuauu

SEQ ID NO: 3924890 - RNA, 17 nt, Shigella flexneri 2a str. 301
cggaagagacuauuucu

SEQ ID NO: 3924891 - RNA, 13 nt, Shigella flexneri 2a str. 301
cggaagagauggu

SEQ ID NO: 3924892 - RNA, 19 nt, Shigella flexneri 2a str. 301
cggaagcgagguauuuucu

SEQ ID NO: 3924893 - RNA, 12 nt, Shigella flexneri 2a str. 301
cggaagcuccac

SEQ ID NO: 3924894 - RNA, 19 nt, Shigella flexneri 2a str. 301
cggaaggggcggaaaucac

SEQ ID NO: 3924895 - RNA, 16 nt, Shigella flexneri 2a str. 301
cggaaguaccaauggc

SEQ ID NO: 3924896 - RNA, 21 nt, Shigella flexneri 2a str. 301
cggaagucgcagcugccugca

SEQ ID NO: 3924897 - RNA, 17 nt, Shigella flexneri 2a str. 301
cggaaguguguaucuuc

SEQ ID NO: 3924898 - RNA, 19 nt, Shigella flexneri 2a str. 301
cggaauaacgcgaucgcga

SEQ ID NO: 3924899 - RNA, 15 nt, Shigella flexneri 2a str. 301
cggaauaaucagaug

SEQ ID NO: 3924900 - RNA, 22 nt, Shigella flexneri 2a str. 301
cggaugugaugcauccggcaca

SEQ ID NO: 3924901 - RNA, 17 nt, Shigella flexneri 2a str. 301
cggauguugcugcacca

SEQ ID NO: 3924902 - RNA, 22 nt, Shigella flexneri 2a str. 301
cggauuaacaguccgccguucu

SEQ ID NO: 3924903 - RNA, 14 nt, Shigella flexneri 2a str. 301
cggauuacccgcgc

SEQ ID NO: 3924904 - RNA, 18 nt, Shigella flexneri 2a str. 301
cggauuacgacucaaccc

SEQ ID NO: 3924905 - RNA, 18 nt, Shigella flexneri 2a str. 301
cggauucagauugcagac

SEQ ID NO: 3924906 - RNA, 17 nt, Shigella flexneri 2a str. 301
cggauucaguaaaucca

SEQ ID NO: 3924907 - RNA, 16 nt, Shigella flexneri 2a str. 301
cggauugcuccugcuc

SEQ ID NO: 3924908 - RNA, 22 nt, Shigella flexneri 2a str. 301
cggauuggucgcucgcgccgca

SEQ ID NO: 3924909 - RNA, 19 nt, Shigella flexneri 2a str. 301
cggauuuacgccauccggc

SEQ ID NO: 3924910 - RNA, 22 nt, Shigella flexneri 2a str. 301
cggauuuggcaaaugcaucagu

SEQ ID NO: 3924911 - RNA, 16 nt, Shigella flexneri 2a str. 301
cggauuuggcugaaua

SEQ ID NO: 3924912 - RNA, 20 nt, Shigella flexneri 2a str. 301
cggauuuucaccaucgccau

SEQ ID NO: 3924913 - RNA, 15 nt, Shigella flexneri 2a str. 301
cggcaaaaaucggca

SEQ ID NO: 3924914 - RNA, 14 nt, Shigella flexneri 2a str. 301
cggcaaaaccguuc

SEQ ID NO: 3924915 - RNA, 15 nt, Shigella flexneri 2a str. 301
cggcaaaaucuucca

SEQ ID NO: 3924916 - RNA, 18 nt, Shigella flexneri 2a str. 301
cggcaaacagcugcuggu

SEQ ID NO: 3924917 - RNA, 14 nt, Shigella flexneri 2a str. 301
cggcaaacgcaacc

SEQ ID NO: 3924918 - RNA, 13 nt, Shigella flexneri 2a str. 301
cggcaaacgucgc

SEQ ID NO: 3924919 - RNA, 15 nt, Shigella flexneri 2a str. 301
cggcaaacugcugau

SEQ ID NO: 3924920 - RNA, 16 nt, Shigella flexneri 2a str. 301
cggcaaacuucgucaa

SEQ ID NO: 3924921 - RNA, 21 nt, Shigella flexneri 2a str. 301
cggcaaagaaccaacgcugcc

SEQ ID NO: 3924922 - RNA, 14 nt, Shigella flexneri 2a str. 301
cggcaaagcgcuga

SEQ ID NO: 3924923 - RNA, 18 nt, Shigella flexneri 2a str. 301
cggcaaaggcuucguuca

SEQ ID NO: 3924924 - RNA, 17 nt, Shigella flexneri 2a str. 301
cggcaaauaacagaccu

SEQ ID NO: 3924925 - RNA, 17 nt, Shigella flexneri 2a str. 301
cggcaaaugacgaugca

SEQ ID NO: 3924926 - RNA, 21 nt, Shigella flexneri 2a str. 301
cggcaaauucauuaccaaccu

SEQ ID NO: 3924927 - RNA, 17 nt, Shigella flexneri 2a str. 301
cggcaacacgccuggcu

SEQ ID NO: 3924928 - RNA, 19 nt, Shigella flexneri 2a str. 301
cggcaaccacacccacauc

SEQ ID NO: 3924929 - RNA, 15 nt, Shigella flexneri 2a str. 301
cggcaaccagcaccg

SEQ ID NO: 3924930 - RNA, 17 nt, Shigella flexneri 2a str. 301
cggcaaccgcauccaga

SEQ ID NO: 3924931 - RNA, 22 nt, Shigella flexneri 2a str. 301
cggcaacuuuggguugccgcca

SEQ ID NO: 3924932 - RNA, 18 nt, Shigella flexneri 2a str. 301
cggcaagauacugcauaa

SEQ ID NO: 3924933 - RNA, 17 nt, Shigella flexneri 2a str. 301
cggcaagaucaccguuu

SEQ ID NO: 3924934 - RNA, 15 nt, Shigella flexneri 2a str. 301
cggcaagaucagcau

SEQ ID NO: 3924935 - RNA, 23 nt, Shigella flexneri 2a str. 301
cggcaagaucgcgaugggucgcc

SEQ ID NO: 3924936 - RNA, 13 nt, Shigella flexneri 2a str. 301
cggcaagcaaaug

SEQ ID NO: 3924937 - RNA, 15 nt, Shigella flexneri 2a str. 301
cggcaagcaaaugaa

SEQ ID NO: 3924938 - RNA, 17 nt, Shigella flexneri 2a str. 301
cggcaagguugaaggug

SEQ ID NO: 3924939 - RNA, 23 nt, Shigella flexneri 2a str. 301
cggcaaguaauaauaucuccagc

SEQ ID NO: 3924940 - RNA, 20 nt, Shigella flexneri 2a str. 301
cggcaaguguuggcgacauc

SEQ ID NO: 3924941 - RNA, 14 nt, Shigella flexneri 2a str. 301
cggcaauaccugac

SEQ ID NO: 3924942 - RNA, 21 nt, Shigella flexneri 2a str. 301
cggcaauacuuugcagaucgc

SEQ ID NO: 3924943 - RNA, 22 nt, Shigella flexneri 2a str. 301
cggcaauauagauaucaugcuc

SEQ ID NO: 3924944 - RNA, 14 nt, Shigella flexneri 2a str. 301
cggcaauauucuuu

SEQ ID NO: 3924945 - RNA, 14 nt, Shigella flexneri 2a str. 301
cggcaaucacgccc

SEQ ID NO: 3924946 - RNA, 15 nt, Shigella flexneri 2a str. 301
cggcaaugaaagcga

SEQ ID NO: 3924947 - RNA, 14 nt, Shigella flexneri 2a str. 301
cggcaauggcugcg

SEQ ID NO: 3924948 - RNA, 20 nt, Shigella flexneri 2a str. 301
cggcaauggguaacggcaga

SEQ ID NO: 3924949 - RNA, 21 nt, Shigella flexneri 2a str. 301
cggcaauguuaccgaucgcca

SEQ ID NO: 3924950 - RNA, 17 nt, Shigella flexneri 2a str. 301
cggcaauuagcggcugg

SEQ ID NO: 3924951 - RNA, 17 nt, Shigella flexneri 2a str. 301
cggcaauucucucugau

SEQ ID NO: 3924952 - RNA, 14 nt, Shigella flexneri 2a str. 301
cggcaauuggugca

SEQ ID NO: 3924953 - RNA, 21 nt, Shigella flexneri 2a str. 301
cggcaauuuuaccuagcacug

SEQ ID NO: 3924954 - RNA, 14 nt, Shigella flexneri 2a str. 301
cggcaccaaucacc

SEQ ID NO: 3924955 - RNA, 13 nt, Shigella flexneri 2a str. 301
cggcaccacauuc

SEQ ID NO: 3924956 - RNA, 18 nt, Shigella flexneri 2a str. 301
cggcaccacauucugcau

SEQ ID NO: 3924957 - RNA, 12 nt, Shigella flexneri 2a str. 301
cggcaccaccaa

SEQ ID NO: 3924958 - RNA, 15 nt, Shigella flexneri 2a str. 301
cggcaccaccaaaaa

SEQ ID NO: 3924959 - RNA, 21 nt, Shigella flexneri 2a str. 301
cggcaccauuccaccucccgu

SEQ ID NO: 3924960 - RNA, 23 nt, Shigella flexneri 2a str. 301
cggcacccaauccaguacaugaa

SEQ ID NO: 3924961 - RNA, 21 nt, Shigella flexneri 2a str. 301
cggcacccauuuauccagcgg

SEQ ID NO: 3924962 - RNA, 17 nt, Shigella flexneri 2a str. 301
cggcaccuuuucaucag

SEQ ID NO: 3924963 - RNA, 15 nt, Shigella flexneri 2a str. 301
cggcacgccagucgg

SEQ ID NO: 3924964 - RNA, 15 nt, Shigella flexneri 2a str. 301
cggcacguuccugca

SEQ ID NO: 3924965 - RNA, 14 nt, Shigella flexneri 2a str. 301
cggcacuccucuuc

SEQ ID NO: 3924966 - RNA, 14 nt, Shigella flexneri 2a str. 301
cggcacugaccacu

SEQ ID NO: 3924967 - RNA, 19 nt, Shigella flexneri 2a str. 301
cggcagaacagaacauccc

SEQ ID NO: 3924968 - RNA, 14 nt, Shigella flexneri 2a str. 301
cggcagaagcaauc

SEQ ID NO: 3924969 - RNA, 15 nt, Shigella flexneri 2a str. 301
cggcagaaugguaac

SEQ ID NO: 3924970 - RNA, 22 nt, Shigella flexneri 2a str. 301
cggcagacgcucgccauuuuuc

SEQ ID NO: 3924971 - RNA, 21 nt, Shigella flexneri 2a str. 301
cggcagaucaaauucaaugac

SEQ ID NO: 3924972 - RNA, 20 nt, Shigella flexneri 2a str. 301
cggcagaugaaaacgcugau

SEQ ID NO: 3924973 - RNA, 20 nt, Shigella flexneri 2a str. 301
cggcagaugacuugccgcaa

SEQ ID NO: 3924974 - RNA, 15 nt, Shigella flexneri 2a str. 301
cggcagcaaccgcuu

SEQ ID NO: 3924975 - RNA, 16 nt, Shigella flexneri 2a str. 301
cggcagcaggaucucc

SEQ ID NO: 3924976 - RNA, 19 nt, Shigella flexneri 2a str. 301
cggcagcaggugcgccagc

SEQ ID NO: 3924977 - RNA, 21 nt, Shigella flexneri 2a str. 301
cggcagcauguguaaccgcuu

SEQ ID NO: 3924978 - RNA, 17 nt, Shigella flexneri 2a str. 301
cggcagccaccgccagc

SEQ ID NO: 3924979 - RNA, 16 nt, Shigella flexneri 2a str. 301
cggcagccaggcaauc

SEQ ID NO: 3924980 - RNA, 13 nt, Shigella flexneri 2a str. 301
cggcagccuccug

SEQ ID NO: 3924981 - RNA, 18 nt, Shigella flexneri 2a str. 301
cggcagccuccugcacgg

SEQ ID NO: 3924982 - RNA, 15 nt, Shigella flexneri 2a str. 301
cggcagccugacgcc

SEQ ID NO: 3924983 - RNA, 20 nt, Shigella flexneri 2a str. 301
cggcagccugggucgccauc

SEQ ID NO: 3924984 - RNA, 13 nt, Shigella flexneri 2a str. 301
cggcagcgcgcuc

SEQ ID NO: 3924985 - RNA, 14 nt, Shigella flexneri 2a str. 301
cggcagcgguucca

SEQ ID NO: 3924986 - RNA, 12 nt, Shigella flexneri 2a str. 301
cggcagcgucgg

SEQ ID NO: 3924987 - RNA, 18 nt, Shigella flexneri 2a str. 301
cggcagcgucggaagcga

SEQ ID NO: 3924988 - RNA, 21 nt, Shigella flexneri 2a str. 301
cggcagcgugccaggcgcgcu

SEQ ID NO: 3924989 - RNA, 14 nt, Shigella flexneri 2a str. 301
cggcagcuccagca

SEQ ID NO: 3924990 - RNA, 14 nt, Shigella flexneri 2a str. 301
cggcagcugcucgc

SEQ ID NO: 3924991 - RNA, 13 nt, Shigella flexneri 2a str. 301
cggcagcugucau

SEQ ID NO: 3924992 - RNA, 18 nt, Shigella flexneri 2a str. 301
cggcaggaaaaaagcgcu

SEQ ID NO: 3924993 - RNA, 15 nt, Shigella flexneri 2a str. 301
cggcaggagccgaac

SEQ ID NO: 3924994 - RNA, 15 nt, Shigella flexneri 2a str. 301
cggcaggaucugcgc

SEQ ID NO: 3924995 - RNA, 17 nt, Shigella flexneri 2a str. 301
cggcaggguuugcgccc

SEQ ID NO: 3924996 - RNA, 14 nt, Shigella flexneri 2a str. 301
cggcaggugacugg

SEQ ID NO: 3924997 - RNA, 19 nt, Shigella flexneri 2a str. 301
cggcaguaauaccagaccu

SEQ ID NO: 3924998 - RNA, 18 nt, Shigella flexneri 2a str. 301
cggcaguauagcggcaug

SEQ ID NO: 3924999 - RNA, 16 nt, Shigella flexneri 2a str. 301
cggcagucacauucug

SEQ ID NO: 3925000 - RNA, 22 nt, Shigella flexneri 2a str. 301
cggcguaaacgccuuauccggc

SEQ ID NO: 3925001 - RNA, 15 nt, Shigella flexneri 2a str. 301
cggcguaacgccacg

SEQ ID NO: 3925002 - RNA, 19 nt, Shigella flexneri 2a str. 301
cggcguaccuucaggcaca

SEQ ID NO: 3925003 - RNA, 17 nt, Shigella flexneri 2a str. 301
cggcguacgacguucag

SEQ ID NO: 3925004 - RNA, 18 nt, Shigella flexneri 2a str. 301
cggcguacuaucugcugc

SEQ ID NO: 3925005 - RNA, 15 nt, Shigella flexneri 2a str. 301
cggcguacuggcaau

SEQ ID NO: 3925006 - RNA, 22 nt, Shigella flexneri 2a str. 301
cggcguacuggcaaucgccagc

SEQ ID NO: 3925007 - RNA, 18 nt, Shigella flexneri 2a str. 301
cggcguauauugcaccgg

SEQ ID NO: 3925008 - RNA, 15 nt, Shigella flexneri 2a str. 301
cggcguauccggcuc

SEQ ID NO: 3925009 - RNA, 17 nt, Shigella flexneri 2a str. 301
cggcguaucgacaauca

SEQ ID NO: 3925010 - RNA, 22 nt, Shigella flexneri 2a str. 301
cggcgucaacaccgggugcaga

SEQ ID NO: 3925011 - RNA, 21 nt, Shigella flexneri 2a str. 301
cggcgucauaauccggcaaca

SEQ ID NO: 3925012 - RNA, 15 nt, Shigella flexneri 2a str. 301
cggcgucaucgacau

SEQ ID NO: 3925013 - RNA, 16 nt, Shigella flexneri 2a str. 301
cggcguccaccugcgu

SEQ ID NO: 3925014 - RNA, 15 nt, Shigella flexneri 2a str. 301
cggcgucccaucggc

SEQ ID NO: 3925015 - RNA, 15 nt, Shigella flexneri 2a str. 301
cggcguccuggaacu

SEQ ID NO: 3925016 - RNA, 19 nt, Shigella flexneri 2a str. 301
cggcgucuuguugaacagg

SEQ ID NO: 3925017 - RNA, 22 nt, Shigella flexneri 2a str. 301
cggcgugaaugccuuauccgau

SEQ ID NO: 3925018 - RNA, 16 nt, Shigella flexneri 2a str. 301
cggcgugaccucuucg

SEQ ID NO: 3925019 - RNA, 13 nt, Shigella flexneri 2a str. 301
cggcgugggcgcu

SEQ ID NO: 3925020 - RNA, 14 nt, Shigella flexneri 2a str. 301
cggcguuccccagu

SEQ ID NO: 3925021 - RNA, 16 nt, Shigella flexneri 2a str. 301
cggcguugagaaacgc

SEQ ID NO: 3925022 - RNA, 22 nt, Shigella flexneri 2a str. 301
cggcguuguaagguuaagccuc

SEQ ID NO: 3925023 - RNA, 16 nt, Shigella flexneri 2a str. 301
cggcguuucacuucug

SEQ ID NO: 3925024 - RNA, 22 nt, Shigella flexneri 2a str. 301
cggcguuuucaaccagccgacg

SEQ ID NO: 3925025 - RNA, 14 nt, Shigella flexneri 2a str. 301
cggcguuuucaggu

SEQ ID NO: 3925026 - RNA, 20 nt, Shigella flexneri 2a str. 301
cggcguuuucucaucgcugc

SEQ ID NO: 3925027 - RNA, 22 nt, Shigella flexneri 2a str. 301
cggcguuuuucguuuuggcaga

SEQ ID NO: 3925028 - RNA, 17 nt, Shigella flexneri 2a str. 301
cggcuacacuauuuccu

SEQ ID NO: 3925029 - RNA, 21 nt, Shigella flexneri 2a str. 301
cggcuacuacggcgugcaggg

SEQ ID NO: 3925030 - RNA, 21 nt, Shigella flexneri 2a str. 301
cggcuaucuacgcguaaaugc

SEQ ID NO: 3925031 - RNA, 17 nt, Shigella flexneri 2a str. 301
cggcucaccccgcgcac

SEQ ID NO: 3925032 - RNA, 16 nt, Shigella flexneri 2a str. 301
cggcucaggcgcacgc

SEQ ID NO: 3925033 - RNA, 21 nt, Shigella flexneri 2a str. 301
cggcucaguaaaaucgacauc

SEQ ID NO: 3925034 - RNA, 14 nt, Shigella flexneri 2a str. 301
cggcucauugccau

SEQ ID NO: 3925035 - RNA, 11 nt, Shigella flexneri 2a str. 301
cggcuccagau

SEQ ID NO: 3925036 - RNA, 11 nt, Shigella flexneri 2a str. 301
cggcuccagca

SEQ ID NO: 3925037 - RNA, 14 nt, Shigella flexneri 2a str. 301
cggcuccagcaaug

SEQ ID NO: 3925038 - RNA, 22 nt, Shigella flexneri 2a str. 301
cggcuccagcaaugucauaaac

SEQ ID NO: 3925039 - RNA, 23 nt, Shigella flexneri 2a str. 301
cggcucccgcagccacuccuuau

SEQ ID NO: 3925040 - RNA, 18 nt, Shigella flexneri 2a str. 301
cggcuccgccccaaugcg

SEQ ID NO: 3925041 - RNA, 19 nt, Shigella flexneri 2a str. 301
cggcuccgcugacgccugc

SEQ ID NO: 3925042 - RNA, 23 nt, Shigella flexneri 2a str. 301
cggcuccgguuaacgccgcgccc

SEQ ID NO: 3925043 - RNA, 19 nt, Shigella flexneri 2a str. 301
cggcucgccuuucggcugc

SEQ ID NO: 3925044 - RNA, 20 nt, Shigella flexneri 2a str. 301
cggcucgccuuucggcugca

SEQ ID NO: 3925045 - RNA, 18 nt, Shigella flexneri 2a str. 301
cggcucgcgaccucaagc

SEQ ID NO: 3925046 - RNA, 19 nt, Shigella flexneri 2a str. 301
cggcucggucagacccggg

SEQ ID NO: 3925047 - RNA, 20 nt, Shigella flexneri 2a str. 301
cggcucguuacuuuccuuca

SEQ ID NO: 3925048 - RNA, 23 nt, Shigella flexneri 2a str. 301
cggcugauaacaauaucaaaugc

SEQ ID NO: 3925049 - RNA, 18 nt, Shigella flexneri 2a str. 301
cggcugcagugcaaugac

SEQ ID NO: 3925050 - RNA, 20 nt, Shigella flexneri 2a str. 301
cggcugcugauguucgccag

SEQ ID NO: 3925051 - RNA, 21 nt, Shigella flexneri 2a str. 301
cggcugcuucggucagcacgc

SEQ ID NO: 3925052 - RNA, 14 nt, Shigella flexneri 2a str. 301
cggcuggcugaccg

SEQ ID NO: 3925053 - RNA, 14 nt, Shigella flexneri 2a str. 301
cggcuggcugaccu

SEQ ID NO: 3925054 - RNA, 15 nt, Shigella flexneri 2a str. 301
cggcuggcuggauga

SEQ ID NO: 3925055 - RNA, 21 nt, Shigella flexneri 2a str. 301
cggcugggaaaucaccaccag

SEQ ID NO: 3925056 - RNA, 23 nt, Shigella flexneri 2a str. 301
cggcugggaaaucaccaccagca

SEQ ID NO: 3925057 - RNA, 20 nt, Shigella flexneri 2a str. 301
cggcuggugauuucguccag

SEQ ID NO: 3925058 - RNA, 20 nt, Shigella flexneri 2a str. 301
cggcugucauccagcagcgg

SEQ ID NO: 3925059 - RNA, 18 nt, Shigella flexneri 2a str. 301
cggcuguccggcaccauc

SEQ ID NO: 3925060 - RNA, 16 nt, Shigella flexneri 2a str. 301
cggcugucuuccugug

SEQ ID NO: 3925061 - RNA, 15 nt, Shigella flexneri 2a str. 301
cggcuguugccggau

SEQ ID NO: 3925062 - RNA, 19 nt, Shigella flexneri 2a str. 301
cggcuguuggaaucacuca

SEQ ID NO: 3925063 - RNA, 17 nt, Shigella flexneri 2a str. 301
cggcuguuucuggauga

SEQ ID NO: 3925064 - RNA, 23 nt, Shigella flexneri 2a str. 301
cggcuguuucuggaugauccugg

SEQ ID NO: 3925065 - RNA, 20 nt, Shigella flexneri 2a str. 301
cggcuuagcaaggcuggcgu

SEQ ID NO: 3925066 - RNA, 23 nt, Shigella flexneri 2a str. 301
cggcuuauugcuucaagaugcca

SEQ ID NO: 3925067 - RNA, 19 nt, Shigella flexneri 2a str. 301
cggcuucauuggcgcgcgu

SEQ ID NO: 3925068 - RNA, 18 nt, Shigella flexneri 2a str. 301
cggcuucgccuccuguuc

SEQ ID NO: 3925069 - RNA, 20 nt, Shigella flexneri 2a str. 301
cggcuucgccuccuguucug

SEQ ID NO: 3925070 - RNA, 22 nt, Shigella flexneri 2a str. 301
cggcuucucggcaaacagcugc

SEQ ID NO: 3925071 - RNA, 22 nt, Shigella flexneri 2a str. 301
cggcuugcgcgcaaucagcacc

SEQ ID NO: 3925072 - RNA, 18 nt, Shigella flexneri 2a str. 301
cggcuuguacgccgccgc

SEQ ID NO: 3925073 - RNA, 18 nt, Shigella flexneri 2a str. 301
cggcuuguucaucaccau

SEQ ID NO: 3925074 - RNA, 20 nt, Shigella flexneri 2a str. 301
cggcuuugaauaucuccucu

SEQ ID NO: 3925075 - RNA, 17 nt, Shigella flexneri 2a str. 301
cggcuuugcagguucug

SEQ ID NO: 3925076 - RNA, 23 nt, Shigella flexneri 2a str. 301
cggcuuuggcaaauggcgcuaac

SEQ ID NO: 3925077 - RNA, 24 nt, Shigella flexneri 2a str. 301
cggcuuuuuacuucucagcgucag

SEQ ID NO: 3925078 - RNA, 15 nt, Shigella flexneri 2a str. 301
cggcuuuuuccugcc

SEQ ID NO: 3925079 - RNA, 18 nt, Shigella flexneri 2a str. 301
cggcuuuuuuacgccugu

SEQ ID NO: 3925080 - RNA, 19 nt, Shigella flexneri 2a str. 301
cgggaaaccaacuccagcg

SEQ ID NO: 3925081 - RNA, 23 nt, Shigella flexneri 2a str. 301
cgggaaacgaaccauaaaaucac

SEQ ID NO: 3925082 - RNA, 14 nt, Shigella flexneri 2a str. 301
cgggaaaucaaguu

SEQ ID NO: 3925083 - RNA, 18 nt, Shigella flexneri 2a str. 301
cgggaacagaauaacguc

SEQ ID NO: 3925084 - RNA, 20 nt, Shigella flexneri 2a str. 301
cgggaacagucgguauaaau

SEQ ID NO: 3925085 - RNA, 20 nt, Shigella flexneri 2a str. 301
cgggaacuggcaacaauggc

SEQ ID NO: 3925086 - RNA, 15 nt, Shigella flexneri 2a str. 301
cgggaagauccaggu

SEQ ID NO: 3925087 - RNA, 15 nt, Shigella flexneri 2a str. 301
cgggaauaaaagcca

SEQ ID NO: 3925088 - RNA, 22 nt, Shigella flexneri 2a str. 301
cgggaauucguucagacgcucu

SEQ ID NO: 3925089 - RNA, 16 nt, Shigella flexneri 2a str. 301
cgggacagcauggggc

SEQ ID NO: 3925090 - RNA, 14 nt, Shigella flexneri 2a str. 301
cgggaccagcauuc

SEQ ID NO: 3925091 - RNA, 23 nt, Shigella flexneri 2a str. 301
cgggacgccaguuacugcugacg

SEQ ID NO: 3925092 - RNA, 16 nt, Shigella flexneri 2a str. 301
cgggagagauaagaua

SEQ ID NO: 3925093 - RNA, 18 nt, Shigella flexneri 2a str. 301
cgggagauuuucuccugc

SEQ ID NO: 3925094 - RNA, 14 nt, Shigella flexneri 2a str. 301
cgggagcaauuugu

SEQ ID NO: 3925095 - RNA, 19 nt, Shigella flexneri 2a str. 301
cgggaggcgaaggugccuc

SEQ ID NO: 3925096 - RNA, 18 nt, Shigella flexneri 2a str. 301
cgggagguaaugacucca

SEQ ID NO: 3925097 - RNA, 17 nt, Shigella flexneri 2a str. 301
cgggaguugaucgccaa

SEQ ID NO: 3925098 - RNA, 11 nt, Shigella flexneri 2a str. 301
cgggauaaacg

SEQ ID NO: 3925099 - RNA, 17 nt, Shigella flexneri 2a str. 301
cgguagcaugaaccauu

SEQ ID NO: 3925100 - RNA, 17 nt, Shigella flexneri 2a str. 301
cgguaguggcaaccagc

SEQ ID NO: 3925101 - RNA, 23 nt, Shigella flexneri 2a str. 301
cgguaguggcaaccagcagaugu

SEQ ID NO: 3925102 - RNA, 18 nt, Shigella flexneri 2a str. 301
cgguaguuaaacuuucau

SEQ ID NO: 3925103 - RNA, 15 nt, Shigella flexneri 2a str. 301
cgguaguuucagcgg

SEQ ID NO: 3925104 - RNA, 16 nt, Shigella flexneri 2a str. 301
cgguaucaccacccag

SEQ ID NO: 3925105 - RNA, 17 nt, Shigella flexneri 2a str. 301
cgguaucaccacccagc

SEQ ID NO: 3925106 - RNA, 15 nt, Shigella flexneri 2a str. 301
cggucaaaagcugca

SEQ ID NO: 3925107 - RNA, 16 nt, Shigella flexneri 2a str. 301
cggucaaccaucgcau

SEQ ID NO: 3925108 - RNA, 19 nt, Shigella flexneri 2a str. 301
cggucacauguuccagggc

SEQ ID NO: 3925109 - RNA, 19 nt, Shigella flexneri 2a str. 301
cggucacgcccggaauuuc

SEQ ID NO: 3925110 - RNA, 20 nt, Shigella flexneri 2a str. 301
cggucacggcuguagccagc

SEQ ID NO: 3925111 - RNA, 23 nt, Shigella flexneri 2a str. 301
cggucagcagcaccaccgcccgu

SEQ ID NO: 3925112 - RNA, 21 nt, Shigella flexneri 2a str. 301
cggucagccauugcuaccgcu

SEQ ID NO: 3925113 - RNA, 23 nt, Shigella flexneri 2a str. 301
cggucagccauugcuaccgcuuc

SEQ ID NO: 3925114 - RNA, 15 nt, Shigella flexneri 2a str. 301
cggucaucaguucag

SEQ ID NO: 3925115 - RNA, 22 nt, Shigella flexneri 2a str. 301
cggucauuuucuucagcaguuc

SEQ ID NO: 3925116 - RNA, 18 nt, Shigella flexneri 2a str. 301
cgguccgguugcagagua

SEQ ID NO: 3925117 - RNA, 11 nt, Shigella flexneri 2a str. 301
cgguccuggcg

SEQ ID NO: 3925118 - RNA, 19 nt, Shigella flexneri 2a str. 301
cggucgaggcaaccagcac

SEQ ID NO: 3925119 - RNA, 20 nt, Shigella flexneri 2a str. 301
cggucgaggcaaccagcacg

SEQ ID NO: 3925120 - RNA, 23 nt, Shigella flexneri 2a str. 301
cggucgaugccaauccccagacc

SEQ ID NO: 3925121 - RNA, 13 nt, Shigella flexneri 2a str. 301
cggucgcggaaca

SEQ ID NO: 3925122 - RNA, 17 nt, Shigella flexneri 2a str. 301
cggucgcugacgccaug

SEQ ID NO: 3925123 - RNA, 22 nt, Shigella flexneri 2a str. 301
cggucggaaaauuauuuuaaau

SEQ ID NO: 3925124 - RNA, 18 nt, Shigella flexneri 2a str. 301
cggucguaaucgcccgcu

SEQ ID NO: 3925125 - RNA, 19 nt, Shigella flexneri 2a str. 301
cggucuggauuuggcugcc

SEQ ID NO: 3925126 - RNA, 24 nt, Shigella flexneri 2a str. 301
cggugaaaaaccaaucucccagcc

SEQ ID NO: 3925127 - RNA, 21 nt, Shigella flexneri 2a str. 301
cggugaagaagcggaaaucac

SEQ ID NO: 3925128 - RNA, 24 nt, Shigella flexneri 2a str. 301
cggugacacuuugcgccaucgcca

SEQ ID NO: 3925129 - RNA, 15 nt, Shigella flexneri 2a str. 301
cggugacagcgagcg

SEQ ID NO: 3925130 - RNA, 14 nt, Shigella flexneri 2a str. 301
cggugaccagcagc

SEQ ID NO: 3925131 - RNA, 20 nt, Shigella flexneri 2a str. 301
cggugaccgaucgcccgcca

SEQ ID NO: 3925132 - RNA, 18 nt, Shigella flexneri 2a str. 301
cggugacgcaaccgcaaa

SEQ ID NO: 3925133 - RNA, 22 nt, Shigella flexneri 2a str. 301
cggugacgcacaguacgcgccc

SEQ ID NO: 3925134 - RNA, 14 nt, Shigella flexneri 2a str. 301
cggugagcugcauc

SEQ ID NO: 3925135 - RNA, 12 nt, Shigella flexneri 2a str. 301
cggugauaaacc

SEQ ID NO: 3925136 - RNA, 18 nt, Shigella flexneri 2a str. 301
cggugauaaucaucccac

SEQ ID NO: 3925137 - RNA, 21 nt, Shigella flexneri 2a str. 301
cggugauauacgucacuucau

SEQ ID NO: 3925138 - RNA, 13 nt, Shigella flexneri 2a str. 301
cggugaugaugcu

SEQ ID NO: 3925139 - RNA, 19 nt, Shigella flexneri 2a str. 301
cggugauguuuaucgucug

SEQ ID NO: 3925140 - RNA, 13 nt, Shigella flexneri 2a str. 301
cggugauuuccgc

SEQ ID NO: 3925141 - RNA, 16 nt, Shigella flexneri 2a str. 301
cggugcaaaugccaga

SEQ ID NO: 3925142 - RNA, 17 nt, Shigella flexneri 2a str. 301
cggugcaaaugccagau

SEQ ID NO: 3925143 - RNA, 14 nt, Shigella flexneri 2a str. 301
cggugcaccgcauc

SEQ ID NO: 3925144 - RNA, 14 nt, Shigella flexneri 2a str. 301
cggugcacuccgcc

SEQ ID NO: 3925145 - RNA, 19 nt, Shigella flexneri 2a str. 301
cggugccauugaccagcug

SEQ ID NO: 3925146 - RNA, 15 nt, Shigella flexneri 2a str. 301
cggugcgaacaauca

SEQ ID NO: 3925147 - RNA, 20 nt, Shigella flexneri 2a str. 301
cggugcgaauugccaccauc

SEQ ID NO: 3925148 - RNA, 22 nt, Shigella flexneri 2a str. 301
cggugcgggaguugaucgccaa

SEQ ID NO: 3925149 - RNA, 18 nt, Shigella flexneri 2a str. 301
cggugcgguaaucgcccg

SEQ ID NO: 3925150 - RNA, 15 nt, Shigella flexneri 2a str. 301
cggugcguugucauc

SEQ ID NO: 3925151 - RNA, 21 nt, Shigella flexneri 2a str. 301
cggugcucaucagcccggcaa

SEQ ID NO: 3925152 - RNA, 21 nt, Shigella flexneri 2a str. 301
cggugcuggucuguuccccuc

SEQ ID NO: 3925153 - RNA, 22 nt, Shigella flexneri 2a str. 301
cgguggaccacggcgugccguc

SEQ ID NO: 3925154 - RNA, 23 nt, Shigella flexneri 2a str. 301
cgguggcaguagcgccucuucca

SEQ ID NO: 3925155 - RNA, 18 nt, Shigella flexneri 2a str. 301
cgguggcguuuccagcag

SEQ ID NO: 3925156 - RNA, 19 nt, Shigella flexneri 2a str. 301
cgguggcguuuccagcagu

SEQ ID NO: 3925157 - RNA, 13 nt, Shigella flexneri 2a str. 301
cggugggcugaca

SEQ ID NO: 3925158 - RNA, 15 nt, Shigella flexneri 2a str. 301
cggugguguuaucac

SEQ ID NO: 3925159 - RNA, 16 nt, Shigella flexneri 2a str. 301
cggugguuguuccugc

SEQ ID NO: 3925160 - RNA, 14 nt, Shigella flexneri 2a str. 301
cgguguacccugcu

SEQ ID NO: 3925161 - RNA, 16 nt, Shigella flexneri 2a str. 301
cgguguaggccugaua

SEQ ID NO: 3925162 - RNA, 17 nt, Shigella flexneri 2a str. 301
cgguguauuaccuccgc

SEQ ID NO: 3925163 - RNA, 15 nt, Shigella flexneri 2a str. 301
cggugucaauucccg

SEQ ID NO: 3925164 - RNA, 15 nt, Shigella flexneri 2a str. 301
cgguguccacuuccg

SEQ ID NO: 3925165 - RNA, 19 nt, Shigella flexneri 2a str. 301
cgguguccacuuccgcguc

SEQ ID NO: 3925166 - RNA, 20 nt, Shigella flexneri 2a str. 301
cgguguccacuuccgcguca

SEQ ID NO: 3925167 - RNA, 23 nt, Shigella flexneri 2a str. 301
cggugucgauacgacaacggcag

SEQ ID NO: 3925168 - RNA, 12 nt, Shigella flexneri 2a str. 301
cggugucgccag

SEQ ID NO: 3925169 - RNA, 23 nt, Shigella flexneri 2a str. 301
cggugugcagcguacuucaugag

SEQ ID NO: 3925170 - RNA, 20 nt, Shigella flexneri 2a str. 301
cggugugcgggaacauauca

SEQ ID NO: 3925171 - RNA, 13 nt, Shigella flexneri 2a str. 301
cgguguggcaugg

SEQ ID NO: 3925172 - RNA, 15 nt, Shigella flexneri 2a str. 301
cgguguucacucauc

SEQ ID NO: 3925173 - RNA, 18 nt, Shigella flexneri 2a str. 301
cgguguugccgaagcagc

SEQ ID NO: 3925174 - RNA, 23 nt, Shigella flexneri 2a str. 301
cgguuaaaucgacguucugccaa

SEQ ID NO: 3925175 - RNA, 18 nt, Shigella flexneri 2a str. 301
cgguuaaccuuuaaucag

SEQ ID NO: 3925176 - RNA, 20 nt, Shigella flexneri 2a str. 301
cgguuaacgccgcgcccgcu

SEQ ID NO: 3925177 - RNA, 17 nt, Shigella flexneri 2a str. 301
cgguuaccuuggcacug

SEQ ID NO: 3925178 - RNA, 15 nt, Shigella flexneri 2a str. 301
cgguuacgccgcauc

SEQ ID NO: 3925179 - RNA, 20 nt, Shigella flexneri 2a str. 301
cgguuagaauaccugccugu

SEQ ID NO: 3925180 - RNA, 17 nt, Shigella flexneri 2a str. 301
cgguuagcucaacgcau

SEQ ID NO: 3925181 - RNA, 20 nt, Shigella flexneri 2a str. 301
cgguuaucccaaaucgcaau

SEQ ID NO: 3925182 - RNA, 19 nt, Shigella flexneri 2a str. 301
cgguuaucggcgcgccagc

SEQ ID NO: 3925183 - RNA, 17 nt, Shigella flexneri 2a str. 301
cgguucaauaucuuccu

SEQ ID NO: 3925184 - RNA, 16 nt, Shigella flexneri 2a str. 301
cgguucaauuuccagu

SEQ ID NO: 3925185 - RNA, 18 nt, Shigella flexneri 2a str. 301
cgguucauggucgccaag

SEQ ID NO: 3925186 - RNA, 22 nt, Shigella flexneri 2a str. 301
cgguuccacaucuaccgccagc

SEQ ID NO: 3925187 - RNA, 14 nt, Shigella flexneri 2a str. 301
cgguuccagcuuca

SEQ ID NO: 3925188 - RNA, 14 nt, Shigella flexneri 2a str. 301
cgguucccucaucu

SEQ ID NO: 3925189 - RNA, 14 nt, Shigella flexneri 2a str. 301
cgguucccucgccc

SEQ ID NO: 3925190 - RNA, 18 nt, Shigella flexneri 2a str. 301
cgguucgacggcuggaca

SEQ ID NO: 3925191 - RNA, 13 nt, Shigella flexneri 2a str. 301
cgguucgccauca

SEQ ID NO: 3925192 - RNA, 16 nt, Shigella flexneri 2a str. 301
cgguucgccugcacca

SEQ ID NO: 3925193 - RNA, 18 nt, Shigella flexneri 2a str. 301
cgguucguugauaauaaa

SEQ ID NO: 3925194 - RNA, 14 nt, Shigella flexneri 2a str. 301
cgguugauggcagu

SEQ ID NO: 3925195 - RNA, 15 nt, Shigella flexneri 2a str. 301
cgguugccagcgcca

SEQ ID NO: 3925196 - RNA, 19 nt, Shigella flexneri 2a str. 301
cgguugcggaacccagcgc

SEQ ID NO: 3925197 - RNA, 20 nt, Shigella flexneri 2a str. 301
cgguugcggaacccagcgcg

SEQ ID NO: 3925198 - RNA, 17 nt, Shigella flexneri 2a str. 301
cguagcaguucaccgcc

SEQ ID NO: 3925199 - RNA, 14 nt, Shigella flexneri 2a str. 301
cguagccaccaucu

SEQ ID NO: 3925200 - RNA, 21 nt, Shigella flexneri 2a str. 301
cguagccaugaugaacaaccc

SEQ ID NO: 3925201 - RNA, 19 nt, Shigella flexneri 2a str. 301
cguagccccagucuuccug

SEQ ID NO: 3925202 - RNA, 20 nt, Shigella flexneri 2a str. 301
cguagcgacgcaaugccagu

SEQ ID NO: 3925203 - RNA, 13 nt, Shigella flexneri 2a str. 301
cguagcgcaucag

SEQ ID NO: 3925204 - RNA, 23 nt, Shigella flexneri 2a str. 301
cguagcgccucagguaccagcau

SEQ ID NO: 3925205 - RNA, 17 nt, Shigella flexneri 2a str. 301
cguagcucaucuucaua

SEQ ID NO: 3925206 - RNA, 21 nt, Shigella flexneri 2a str. 301
cguagcuggcggcaaugaaag

SEQ ID NO: 3925207 - RNA, 23 nt, Shigella flexneri 2a str. 301
cguagcugguucucgcuucugag

SEQ ID NO: 3925208 - RNA, 12 nt, Shigella flexneri 2a str. 301
cguaggccagau

SEQ ID NO: 3925209 - RNA, 20 nt, Shigella flexneri 2a str. 301
cguaggccagauaaggcguu

SEQ ID NO: 3925210 - RNA, 15 nt, Shigella flexneri 2a str. 301
cguaggcccagccgu

SEQ ID NO: 3925211 - RNA, 20 nt, Shigella flexneri 2a str. 301
cguaggccggauaaggcgua

SEQ ID NO: 3925212 - RNA, 13 nt, Shigella flexneri 2a str. 301
cguaggccugaua

SEQ ID NO: 3925213 - RNA, 14 nt, Shigella flexneri 2a str. 301
cguaggccugauaa

SEQ ID NO: 3925214 - RNA, 19 nt, Shigella flexneri 2a str. 301
cguaggccugauaagcgua

SEQ ID NO: 3925215 - RNA, 20 nt, Shigella flexneri 2a str. 301
cguaggccugauaagcguag

SEQ ID NO: 3925216 - RNA, 20 nt, Shigella flexneri 2a str. 301
cguaggcuggauaaggcguu

SEQ ID NO: 3925217 - RNA, 17 nt, Shigella flexneri 2a str. 301
cguaggucggauaagac

SEQ ID NO: 3925218 - RNA, 19 nt, Shigella flexneri 2a str. 301
cguaggucggauaagacgc

SEQ ID NO: 3925219 - RNA, 18 nt, Shigella flexneri 2a str. 301
cguagucugaccucuucu

SEQ ID NO: 3925220 - RNA, 16 nt, Shigella flexneri 2a str. 301
cguaguucuuucucug

SEQ ID NO: 3925221 - RNA, 18 nt, Shigella flexneri 2a str. 301
cguauaauaucuuuucuu

SEQ ID NO: 3925222 - RNA, 17 nt, Shigella flexneri 2a str. 301
cguaucaccccgcccga

SEQ ID NO: 3925223 - RNA, 20 nt, Shigella flexneri 2a str. 301
cguauccagcauaccuucca

SEQ ID NO: 3925224 - RNA, 13 nt, Shigella flexneri 2a str. 301
cguauccggcauu

SEQ ID NO: 3925225 - RNA, 19 nt, Shigella flexneri 2a str. 301
cguaucgaccagaauaagu

SEQ ID NO: 3925226 - RNA, 17 nt, Shigella flexneri 2a str. 301
cguaugcagccaggcca

SEQ ID NO: 3925227 - RNA, 14 nt, Shigella flexneri 2a str. 301
cguaugcauaauuu

SEQ ID NO: 3925228 - RNA, 17 nt, Shigella flexneri 2a str. 301
cguauguggugggcgaa

SEQ ID NO: 3925229 - RNA, 12 nt, Shigella flexneri 2a str. 301
cguauuaauucc

SEQ ID NO: 3925230 - RNA, 14 nt, Shigella flexneri 2a str. 301
cguauuaugcacac

SEQ ID NO: 3925231 - RNA, 23 nt, Shigella flexneri 2a str. 301
cguauuccgcguuacccauucaa

SEQ ID NO: 3925232 - RNA, 21 nt, Shigella flexneri 2a str. 301
cguauucgcgcagaacauaaa

SEQ ID NO: 3925233 - RNA, 18 nt, Shigella flexneri 2a str. 301
cguauugguacauaacac

SEQ ID NO: 3925234 - RNA, 15 nt, Shigella flexneri 2a str. 301
cguauuucagcccca

SEQ ID NO: 3925235 - RNA, 16 nt, Shigella flexneri 2a str. 301
cguauuuccugccaga

SEQ ID NO: 3925236 - RNA, 22 nt, Shigella flexneri 2a str. 301
cgucaaaacgcgacugcaaaaa

SEQ ID NO: 3925237 - RNA, 13 nt, Shigella flexneri 2a str. 301
cgucaaaaucauc

SEQ ID NO: 3925238 - RNA, 18 nt, Shigella flexneri 2a str. 301
cgucaaauaauuccugcg

SEQ ID NO: 3925239 - RNA, 20 nt, Shigella flexneri 2a str. 301
cgucaacagcguuucuucga

SEQ ID NO: 3925240 - RNA, 17 nt, Shigella flexneri 2a str. 301
cgucaaccugaccaaau

SEQ ID NO: 3925241 - RNA, 18 nt, Shigella flexneri 2a str. 301
cgucaacugacgcagugu

SEQ ID NO: 3925242 - RNA, 22 nt, Shigella flexneri 2a str. 301
cgucaagcgguaaccauccaua

SEQ ID NO: 3925243 - RNA, 20 nt, Shigella flexneri 2a str. 301
cgucaaggguugccggaugu

SEQ ID NO: 3925244 - RNA, 20 nt, Shigella flexneri 2a str. 301
cgucaaucugcccgaccaga

SEQ ID NO: 3925245 - RNA, 22 nt, Shigella flexneri 2a str. 301
cgucaauuuuaagcagaucggc

SEQ ID NO: 3925246 - RNA, 13 nt, Shigella flexneri 2a str. 301
cgucacaccuuca

SEQ ID NO: 3925247 - RNA, 23 nt, Shigella flexneri 2a str. 301
cgucacagcggcuuccaccgccg

SEQ ID NO: 3925248 - RNA, 19 nt, Shigella flexneri 2a str. 301
cgucacaggcacaccgccg

SEQ ID NO: 3925249 - RNA, 13 nt, Shigella flexneri 2a str. 301
cgucaccacuuca

SEQ ID NO: 3925250 - RNA, 13 nt, Shigella flexneri 2a str. 301
cgucaccggaacc

SEQ ID NO: 3925251 - RNA, 14 nt, Shigella flexneri 2a str. 301
cgucaccugcccgg

SEQ ID NO: 3925252 - RNA, 22 nt, Shigella flexneri 2a str. 301
cgucacgaagcauugcgccugc

SEQ ID NO: 3925253 - RNA, 17 nt, Shigella flexneri 2a str. 301
cgucacgauaucgauau

SEQ ID NO: 3925254 - RNA, 14 nt, Shigella flexneri 2a str. 301
cgucacgaucgcgc

SEQ ID NO: 3925255 - RNA, 20 nt, Shigella flexneri 2a str. 301
cgucacgaucgcgccagccu

SEQ ID NO: 3925256 - RNA, 16 nt, Shigella flexneri 2a str. 301
cgucacggacucggcg

SEQ ID NO: 3925257 - RNA, 23 nt, Shigella flexneri 2a str. 301
cgucacgguaauaacacucggcg

SEQ ID NO: 3925258 - RNA, 15 nt, Shigella flexneri 2a str. 301
cgucacugaaucgcu

SEQ ID NO: 3925259 - RNA, 21 nt, Shigella flexneri 2a str. 301
cgucacuggugugucaucugc

SEQ ID NO: 3925260 - RNA, 23 nt, Shigella flexneri 2a str. 301
cgucagaaaaaucaauauuuuca

SEQ ID NO: 3925261 - RNA, 13 nt, Shigella flexneri 2a str. 301
cgucagaaacagu

SEQ ID NO: 3925262 - RNA, 21 nt, Shigella flexneri 2a str. 301
cgucagaccggcaaccagcac

SEQ ID NO: 3925263 - RNA, 23 nt, Shigella flexneri 2a str. 301
cgucagaccggcaaccagcaccg

SEQ ID NO: 3925264 - RNA, 16 nt, Shigella flexneri 2a str. 301
cgucagauccgccagu

SEQ ID NO: 3925265 - RNA, 13 nt, Shigella flexneri 2a str. 301
cgucagcaacaug

SEQ ID NO: 3925266 - RNA, 21 nt, Shigella flexneri 2a str. 301
cgucagcaguucacgcagcuu

SEQ ID NO: 3925267 - RNA, 23 nt, Shigella flexneri 2a str. 301
cgucagcaguucacgcagcuucu

SEQ ID NO: 3925268 - RNA, 20 nt, Shigella flexneri 2a str. 301
cgucagccacuucuuccagc

SEQ ID NO: 3925269 - RNA, 23 nt, Shigella flexneri 2a str. 301
cgucagccacuucuuccagcggc

SEQ ID NO: 3925270 - RNA, 15 nt, Shigella flexneri 2a str. 301
cgucagccagaaaga

SEQ ID NO: 3925271 - RNA, 15 nt, Shigella flexneri 2a str. 301
cgucagccugcucag

SEQ ID NO: 3925272 - RNA, 21 nt, Shigella flexneri 2a str. 301
cgucagcggcaauucuuucuc

SEQ ID NO: 3925273 - RNA, 20 nt, Shigella flexneri 2a str. 301
cgucagcgucgcaucuggca

SEQ ID NO: 3925274 - RNA, 16 nt, Shigella flexneri 2a str. 301
cgucagcucgcugcca

SEQ ID NO: 3925275 - RNA, 22 nt, Shigella flexneri 2a str. 301
cgucagcucgcugccaucaacu

SEQ ID NO: 3925276 - RNA, 14 nt, Shigella flexneri 2a str. 301
cgucagcuucagau

SEQ ID NO: 3925277 - RNA, 13 nt, Shigella flexneri 2a str. 301
cgucagcuuucag

SEQ ID NO: 3925278 - RNA, 15 nt, Shigella flexneri 2a str. 301
cgucaggcaaccgcu

SEQ ID NO: 3925279 - RNA, 19 nt, Shigella flexneri 2a str. 301
cgucaggucacccaacaug

SEQ ID NO: 3925280 - RNA, 18 nt, Shigella flexneri 2a str. 301
cgucaguagcgcaaucac

SEQ ID NO: 3925281 - RNA, 20 nt, Shigella flexneri 2a str. 301
cgucagugucuuaucuggca

SEQ ID NO: 3925282 - RNA, 14 nt, Shigella flexneri 2a str. 301
cgucaguucacgcg

SEQ ID NO: 3925283 - RNA, 14 nt, Shigella flexneri 2a str. 301
cgucauacugcuca

SEQ ID NO: 3925284 - RNA, 14 nt, Shigella flexneri 2a str. 301
cgucaucaaacggc

SEQ ID NO: 3925285 - RNA, 16 nt, Shigella flexneri 2a str. 301
cgucauccagcacuug

SEQ ID NO: 3925286 - RNA, 18 nt, Shigella flexneri 2a str. 301
cgucauccauaccacgac

SEQ ID NO: 3925287 - RNA, 19 nt, Shigella flexneri 2a str. 301
cgucauccauaccgcgacc

SEQ ID NO: 3925288 - RNA, 14 nt, Shigella flexneri 2a str. 301
cgucaucccagucu

SEQ ID NO: 3925289 - RNA, 18 nt, Shigella flexneri 2a str. 301
cgucauccggaaagcaca

SEQ ID NO: 3925290 - RNA, 17 nt, Shigella flexneri 2a str. 301
cgucauccguggcgaca

SEQ ID NO: 3925291 - RNA, 19 nt, Shigella flexneri 2a str. 301
cgucaucgguaugcaacau

SEQ ID NO: 3925292 - RNA, 22 nt, Shigella flexneri 2a str. 301
cgucaucucgcucaaaaaucca

SEQ ID NO: 3925293 - RNA, 13 nt, Shigella flexneri 2a str. 301
cgucauggcuguc

SEQ ID NO: 3925294 - RNA, 21 nt, Shigella flexneri 2a str. 301
cgucaugguauagagauagca

SEQ ID NO: 3925295 - RNA, 19 nt, Shigella flexneri 2a str. 301
cgucauucagcucgcuaaa

SEQ ID NO: 3925296 - RNA, 13 nt, Shigella flexneri 2a str. 301
cguccacacggca

SEQ ID NO: 3925297 - RNA, 16 nt, Shigella flexneri 2a str. 301
cgugcacugaaauuuu

SEQ ID NO: 3925298 - RNA, 21 nt, Shigella flexneri 2a str. 301
cgugcagaacauccagcucgc

SEQ ID NO: 3925299 - RNA, 17 nt, Shigella flexneri 2a str. 301
cgugcagcgcaaucgcc

SEQ ID NO: 3925300 - RNA, 17 nt, Shigella flexneri 2a str. 301
cgugcagcuuucccuuc

SEQ ID NO: 3925301 - RNA, 15 nt, Shigella flexneri 2a str. 301
cgugcaggcauucag

SEQ ID NO: 3925302 - RNA, 20 nt, Shigella flexneri 2a str. 301
cgugcauagcagcacaccac

SEQ ID NO: 3925303 - RNA, 16 nt, Shigella flexneri 2a str. 301
cgugcaucauggaagc

SEQ ID NO: 3925304 - RNA, 16 nt, Shigella flexneri 2a str. 301
cgugcauuucucacuu

SEQ ID NO: 3925305 - RNA, 16 nt, Shigella flexneri 2a str. 301
cgugccaccagugcag

SEQ ID NO: 3925306 - RNA, 12 nt, Shigella flexneri 2a str. 301
cgugccagaacu

SEQ ID NO: 3925307 - RNA, 18 nt, Shigella flexneri 2a str. 301
cgugccaggaccauucac

SEQ ID NO: 3925308 - RNA, 19 nt, Shigella flexneri 2a str. 301
cgugcccaacugccugaug

SEQ ID NO: 3925309 - RNA, 22 nt, Shigella flexneri 2a str. 301
cgugcccacguucaugccgacg

SEQ ID NO: 3925310 - RNA, 11 nt, Shigella flexneri 2a str. 301
cgugcccugcg

SEQ ID NO: 3925311 - RNA, 23 nt, Shigella flexneri 2a str. 301
cgugccggaagucucuugccggu

SEQ ID NO: 3925312 - RNA, 14 nt, Shigella flexneri 2a str. 301
cgugccgguaaugc

SEQ ID NO: 3925313 - RNA, 18 nt, Shigella flexneri 2a str. 301
cgugcgggagaguaucca

SEQ ID NO: 3925314 - RNA, 16 nt, Shigella flexneri 2a str. 301
cgugcgggcacaggcg

SEQ ID NO: 3925315 - RNA, 20 nt, Shigella flexneri 2a str. 301
cgugcguuccacccacggcg

SEQ ID NO: 3925316 - RNA, 14 nt, Shigella flexneri 2a str. 301
cgugcguuuguagg

SEQ ID NO: 3925317 - RNA, 13 nt, Shigella flexneri 2a str. 301
cgugcguuuuuug

SEQ ID NO: 3925318 - RNA, 16 nt, Shigella flexneri 2a str. 301
cgugcuaacguuuagu

SEQ ID NO: 3925319 - RNA, 16 nt, Shigella flexneri 2a str. 301
cgugcucgcuuuccau

SEQ ID NO: 3925320 - RNA, 22 nt, Shigella flexneri 2a str. 301
cgugcuguuaauaucuuucugc

SEQ ID NO: 3925321 - RNA, 14 nt, Shigella flexneri 2a str. 301
cgugcuucgccuua

SEQ ID NO: 3925322 - RNA, 16 nt, Shigella flexneri 2a str. 301
cguggagagcagcauc

SEQ ID NO: 3925323 - RNA, 20 nt, Shigella flexneri 2a str. 301
cguggagcaacacgccagcg

SEQ ID NO: 3925324 - RNA, 18 nt, Shigella flexneri 2a str. 301
cguggaugcgauguuccc

SEQ ID NO: 3925325 - RNA, 18 nt, Shigella flexneri 2a str. 301
cguggauuuaaugccaau

SEQ ID NO: 3925326 - RNA, 20 nt, Shigella flexneri 2a str. 301
cguggauuuaaugccaaucu

SEQ ID NO: 3925327 - RNA, 20 nt, Shigella flexneri 2a str. 301
cguggcagggaaucagauuc

SEQ ID NO: 3925328 - RNA, 15 nt, Shigella flexneri 2a str. 301
cguggcaucgggcac

SEQ ID NO: 3925329 - RNA, 17 nt, Shigella flexneri 2a str. 301
cguggcaucgggcacag

SEQ ID NO: 3925330 - RNA, 19 nt, Shigella flexneri 2a str. 301
cguggcaucgggcacagcg

SEQ ID NO: 3925331 - RNA, 23 nt, Shigella flexneri 2a str. 301
cguggccaugagccaguucuucu

SEQ ID NO: 3925332 - RNA, 20 nt, Shigella flexneri 2a str. 301
cguggcccuaggcauagaaa

SEQ ID NO: 3925333 - RNA, 20 nt, Shigella flexneri 2a str. 301
cguggcgauaaucagcgcca

SEQ ID NO: 3925334 - RNA, 17 nt, Shigella flexneri 2a str. 301
cguggcgcagccgucau

SEQ ID NO: 3925335 - RNA, 19 nt, Shigella flexneri 2a str. 301
cgugggauugccgcuucau

SEQ ID NO: 3925336 - RNA, 14 nt, Shigella flexneri 2a str. 301
cgugggcaggaaaa

SEQ ID NO: 3925337 - RNA, 17 nt, Shigella flexneri 2a str. 301
cguggguaggaucagaa

SEQ ID NO: 3925338 - RNA, 20 nt, Shigella flexneri 2a str. 301
cgugguaagaaggcccauga

SEQ ID NO: 3925339 - RNA, 14 nt, Shigella flexneri 2a str. 301
cguggucauggcau

SEQ ID NO: 3925340 - RNA, 18 nt, Shigella flexneri 2a str. 301
cguggugauaccagacca

SEQ ID NO: 3925341 - RNA, 19 nt, Shigella flexneri 2a str. 301
cgugguucauaugauucau

SEQ ID NO: 3925342 - RNA, 21 nt, Shigella flexneri 2a str. 301
cgugguuuucgccggaaccug

SEQ ID NO: 3925343 - RNA, 16 nt, Shigella flexneri 2a str. 301
cgugguuuuugcugac

SEQ ID NO: 3925344 - RNA, 13 nt, Shigella flexneri 2a str. 301
cguguaggccuga

SEQ ID NO: 3925345 - RNA, 21 nt, Shigella flexneri 2a str. 301
cgugucauaacuggucaucaa

SEQ ID NO: 3925346 - RNA, 21 nt, Shigella flexneri 2a str. 301
cgugucggacggaauuugaaa

SEQ ID NO: 3925347 - RNA, 22 nt, Shigella flexneri 2a str. 301
cgugucggugcucaucagcccg

SEQ ID NO: 3925348 - RNA, 18 nt, Shigella flexneri 2a str. 301
cgugucuuaucaggccua

SEQ ID NO: 3925349 - RNA, 15 nt, Shigella flexneri 2a str. 301
cguguggauaaucca

SEQ ID NO: 3925350 - RNA, 14 nt, Shigella flexneri 2a str. 301
cguguuaauuaccu

SEQ ID NO: 3925351 - RNA, 12 nt, Shigella flexneri 2a str. 301
cguguuccaguu

SEQ ID NO: 3925352 - RNA, 16 nt, Shigella flexneri 2a str. 301
cguguucucaucgcca

SEQ ID NO: 3925353 - RNA, 22 nt, Shigella flexneri 2a str. 301
cguguugcaccgaguucuucac

SEQ ID NO: 3925354 - RNA, 18 nt, Shigella flexneri 2a str. 301
cguuaaaacuaaaaacag

SEQ ID NO: 3925355 - RNA, 13 nt, Shigella flexneri 2a str. 301
cguuaaagaaagu

SEQ ID NO: 3925356 - RNA, 19 nt, Shigella flexneri 2a str. 301
cguuaaagcacgauuugua

SEQ ID NO: 3925357 - RNA, 12 nt, Shigella flexneri 2a str. 301
cguuaaauaacu

SEQ ID NO: 3925358 - RNA, 16 nt, Shigella flexneri 2a str. 301
cguuaacagcgcauuc

SEQ ID NO: 3925359 - RNA, 23 nt, Shigella flexneri 2a str. 301
cguuaacguuuuucgcugucggu

SEQ ID NO: 3925360 - RNA, 22 nt, Shigella flexneri 2a str. 301
cguuaacuuucguguguuuucu

SEQ ID NO: 3925361 - RNA, 20 nt, Shigella flexneri 2a str. 301
cguuaagaaaacggaagcuc

SEQ ID NO: 3925362 - RNA, 18 nt, Shigella flexneri 2a str. 301
cguuaagcuggaaaucaa

SEQ ID NO: 3925363 - RNA, 16 nt, Shigella flexneri 2a str. 301
cguuaauuucuuuuca

SEQ ID NO: 3925364 - RNA, 14 nt, Shigella flexneri 2a str. 301
cguuacagcuggag

SEQ ID NO: 3925365 - RNA, 16 nt, Shigella flexneri 2a str. 301
cguuaccggguguucu

SEQ ID NO: 3925366 - RNA, 21 nt, Shigella flexneri 2a str. 301
cguuacgacgcaaucaaaaaa

SEQ ID NO: 3925367 - RNA, 16 nt, Shigella flexneri 2a str. 301
cguuacgccccaacac

SEQ ID NO: 3925368 - RNA, 17 nt, Shigella flexneri 2a str. 301
cguuacguacuuccuua

SEQ ID NO: 3925369 - RNA, 22 nt, Shigella flexneri 2a str. 301
cguuacuacagaggguuuuuua

SEQ ID NO: 3925370 - RNA, 22 nt, Shigella flexneri 2a str. 301
cguuagaaaacgccugcuccuc

SEQ ID NO: 3925371 - RNA, 12 nt, Shigella flexneri 2a str. 301
cguuagugucuu

SEQ ID NO: 3925372 - RNA, 18 nt, Shigella flexneri 2a str. 301
cguuagugucuuaucugg

SEQ ID NO: 3925373 - RNA, 20 nt, Shigella flexneri 2a str. 301
cguuagugucuuaucuggca

SEQ ID NO: 3925374 - RNA, 23 nt, Shigella flexneri 2a str. 301
cguuagugucuuaucuggcauuu

SEQ ID NO: 3925375 - RNA, 20 nt, Shigella flexneri 2a str. 301
cguuaguucgcguaacugcu

SEQ ID NO: 3925376 - RNA, 19 nt, Shigella flexneri 2a str. 301
cguuauacaucgcuuucca

SEQ ID NO: 3925377 - RNA, 22 nt, Shigella flexneri 2a str. 301
cguuauacaucgcuuuccaggu

SEQ ID NO: 3925378 - RNA, 13 nt, Shigella flexneri 2a str. 301
cguuaucacagca

SEQ ID NO: 3925379 - RNA, 23 nt, Shigella flexneri 2a str. 301
cguuaucagggagucuugcugga

SEQ ID NO: 3925380 - RNA, 16 nt, Shigella flexneri 2a str. 301
cguuaugcacggcaug

SEQ ID NO: 3925381 - RNA, 22 nt, Shigella flexneri 2a str. 301
cguuauggcgugagcugccucg

SEQ ID NO: 3925382 - RNA, 12 nt, Shigella flexneri 2a str. 301
cguuaugucucc

SEQ ID NO: 3925383 - RNA, 15 nt, Shigella flexneri 2a str. 301
cguuaugucucccgc

SEQ ID NO: 3925384 - RNA, 16 nt, Shigella flexneri 2a str. 301
cguuauuacuggugcg

SEQ ID NO: 3925385 - RNA, 20 nt, Shigella flexneri 2a str. 301
cguuauucaggcccgccagc

SEQ ID NO: 3925386 - RNA, 15 nt, Shigella flexneri 2a str. 301
cguucaaaacggcug

SEQ ID NO: 3925387 - RNA, 21 nt, Shigella flexneri 2a str. 301
cguucaaaacggcuggugauu

SEQ ID NO: 3925388 - RNA, 20 nt, Shigella flexneri 2a str. 301
cguucaauaccgucugcgcc

SEQ ID NO: 3925389 - RNA, 19 nt, Shigella flexneri 2a str. 301
cguucacgcagcucacgca

SEQ ID NO: 3925390 - RNA, 16 nt, Shigella flexneri 2a str. 301
cguucacgccgcaucc

SEQ ID NO: 3925391 - RNA, 15 nt, Shigella flexneri 2a str. 301
cguucagucgccggg

SEQ ID NO: 3925392 - RNA, 19 nt, Shigella flexneri 2a str. 301
cguucauauggagcaaaag

SEQ ID NO: 3925393 - RNA, 24 nt, Shigella flexneri 2a str. 301
cguucaucgggcauugcaaccaca

SEQ ID NO: 3925394 - RNA, 22 nt, Shigella flexneri 2a str. 301
cguucauggcgcgacauggcga

SEQ ID NO: 3925395 - RNA, 23 nt, Shigella flexneri 2a str. 301
cguucauggcgcgacauggcgaa

SEQ ID NO: 3925396 - RNA, 16 nt, Shigella flexneri 2a str. 301
cuaaaagcacgccaga

SEQ ID NO: 3925397 - RNA, 24 nt, Shigella flexneri 2a str. 301
cuaaaagcauagccccagcgcaga

SEQ ID NO: 3925398 - RNA, 18 nt, Shigella flexneri 2a str. 301
cuaaaaguuuuagcaugc

SEQ ID NO: 3925399 - RNA, 23 nt, Shigella flexneri 2a str. 301
cuaaaccagguauccaguuucug

SEQ ID NO: 3925400 - RNA, 23 nt, Shigella flexneri 2a str. 301
cuaaaccaucaggaugacaaacu

SEQ ID NO: 3925401 - RNA, 19 nt, Shigella flexneri 2a str. 301
cuaaacccgaccacuucca

SEQ ID NO: 3925402 - RNA, 16 nt, Shigella flexneri 2a str. 301
cuaaacguuuaaaaac

SEQ ID NO: 3925403 - RNA, 17 nt, Shigella flexneri 2a str. 301
cuaaacguuuaaaaacu

SEQ ID NO: 3925404 - RNA, 15 nt, Shigella flexneri 2a str. 301
cuaaagcaacuccau

SEQ ID NO: 3925405 - RNA, 18 nt, Shigella flexneri 2a str. 301
cuaaagcacccagcaauc

SEQ ID NO: 3925406 - RNA, 14 nt, Shigella flexneri 2a str. 301
cuaaagccugcuuu

SEQ ID NO: 3925407 - RNA, 19 nt, Shigella flexneri 2a str. 301
cuaaagccugcuuugacaa

SEQ ID NO: 3925408 - RNA, 18 nt, Shigella flexneri 2a str. 301
cuaaagccuuuugccagu

SEQ ID NO: 3925409 - RNA, 18 nt, Shigella flexneri 2a str. 301
cuaaagcgguuacacaug

SEQ ID NO: 3925410 - RNA, 16 nt, Shigella flexneri 2a str. 301
cuaaaggcaaaaugcc

SEQ ID NO: 3925411 - RNA, 13 nt, Shigella flexneri 2a str. 301
cuaaaguaaagga

SEQ ID NO: 3925412 - RNA, 16 nt, Shigella flexneri 2a str. 301
cuaaaguaaaggaaca

SEQ ID NO: 3925413 - RNA, 20 nt, Shigella flexneri 2a str. 301
cuaaaguaaaggaacaaggg

SEQ ID NO: 3925414 - RNA, 17 nt, Shigella flexneri 2a str. 301
cuaaaguaaaggcacaa

SEQ ID NO: 3925415 - RNA, 20 nt, Shigella flexneri 2a str. 301
cuaaaguaaaggcacaaggg

SEQ ID NO: 3925416 - RNA, 18 nt, Shigella flexneri 2a str. 301
cuaaaguacguaaaacaa

SEQ ID NO: 3925417 - RNA, 15 nt, Shigella flexneri 2a str. 301
cuaaauaaccagcau

SEQ ID NO: 3925418 - RNA, 16 nt, Shigella flexneri 2a str. 301
cuaaaucacaccauug

SEQ ID NO: 3925419 - RNA, 19 nt, Shigella flexneri 2a str. 301
cuaaaucuggugcuuuuuc

SEQ ID NO: 3925420 - RNA, 21 nt, Shigella flexneri 2a str. 301
cuaaaucuggugcuuuuucaa

SEQ ID NO: 3925421 - RNA, 22 nt, Shigella flexneri 2a str. 301
cuaaaucuggugcuuuuucaac

SEQ ID NO: 3925422 - RNA, 14 nt, Shigella flexneri 2a str. 301
cuaaauguucaaua

SEQ ID NO: 3925423 - RNA, 16 nt, Shigella flexneri 2a str. 301
cuaacaaggcuucgcu

SEQ ID NO: 3925424 - RNA, 19 nt, Shigella flexneri 2a str. 301
cuaacaaucucaaccgcuu

SEQ ID NO: 3925425 - RNA, 19 nt, Shigella flexneri 2a str. 301
cuaacacaugcaagucgaa

SEQ ID NO: 3925426 - RNA, 17 nt, Shigella flexneri 2a str. 301
cuaacacugcguacagc

SEQ ID NO: 3925427 - RNA, 20 nt, Shigella flexneri 2a str. 301
cuaacacugcguacagcgcg

SEQ ID NO: 3925428 - RNA, 15 nt, Shigella flexneri 2a str. 301
cuaacagaacaauaa

SEQ ID NO: 3925429 - RNA, 15 nt, Shigella flexneri 2a str. 301
cuaacagagcacugu

SEQ ID NO: 3925430 - RNA, 16 nt, Shigella flexneri 2a str. 301
cuaacagagccgcgau

SEQ ID NO: 3925431 - RNA, 14 nt, Shigella flexneri 2a str. 301
cuaacagaucaucc

SEQ ID NO: 3925432 - RNA, 12 nt, Shigella flexneri 2a str. 301
cuaacagcagca

SEQ ID NO: 3925433 - RNA, 15 nt, Shigella flexneri 2a str. 301
cuaacauuuuacuua

SEQ ID NO: 3925434 - RNA, 23 nt, Shigella flexneri 2a str. 301
cuaaccauuauuaaauuuaauaa

SEQ ID NO: 3925435 - RNA, 22 nt, Shigella flexneri 2a str. 301
cuaaccgaauucaaauccuuca

SEQ ID NO: 3925436 - RNA, 13 nt, Shigella flexneri 2a str. 301
cuaacgaaagaac

SEQ ID NO: 3925437 - RNA, 15 nt, Shigella flexneri 2a str. 301
cuaacgaaagaacag

SEQ ID NO: 3925438 - RNA, 20 nt, Shigella flexneri 2a str. 301
cuaacgauaccguguuauuc

SEQ ID NO: 3925439 - RNA, 16 nt, Shigella flexneri 2a str. 301
cuaacgcgucuuaucu

SEQ ID NO: 3925440 - RNA, 21 nt, Shigella flexneri 2a str. 301
cuaacgcgucuuaucuggccu

SEQ ID NO: 3925441 - RNA, 19 nt, Shigella flexneri 2a str. 301
cuaacggugcacgcuuuau

SEQ ID NO: 3925442 - RNA, 18 nt, Shigella flexneri 2a str. 301
cuaacgucuaguaaagca

SEQ ID NO: 3925443 - RNA, 19 nt, Shigella flexneri 2a str. 301
cuaacguuuuacgcgucac

SEQ ID NO: 3925444 - RNA, 20 nt, Shigella flexneri 2a str. 301
cuaacucauuuuuuaauaug

SEQ ID NO: 3925445 - RNA, 14 nt, Shigella flexneri 2a str. 301
cuaacugacuuccg

SEQ ID NO: 3925446 - RNA, 19 nt, Shigella flexneri 2a str. 301
cuaagaagccuuuaucugg

SEQ ID NO: 3925447 - RNA, 15 nt, Shigella flexneri 2a str. 301
cuaagaagucauugg

SEQ ID NO: 3925448 - RNA, 14 nt, Shigella flexneri 2a str. 301
cuaagcgaacuguu

SEQ ID NO: 3925449 - RNA, 19 nt, Shigella flexneri 2a str. 301
cuaagcgccaccgucagug

SEQ ID NO: 3925450 - RNA, 14 nt, Shigella flexneri 2a str. 301
cuaagcugcguagc

SEQ ID NO: 3925451 - RNA, 17 nt, Shigella flexneri 2a str. 301
cuaagcugcguagcuca

SEQ ID NO: 3925452 - RNA, 14 nt, Shigella flexneri 2a str. 301
cuaaggcagccaga

SEQ ID NO: 3925453 - RNA, 13 nt, Shigella flexneri 2a str. 301
cuaaggcaugaau

SEQ ID NO: 3925454 - RNA, 21 nt, Shigella flexneri 2a str. 301
cuaaggguaaaacgacuggcc

SEQ ID NO: 3925455 - RNA, 18 nt, Shigella flexneri 2a str. 301
cuaaguugaaucggcugc

SEQ ID NO: 3925456 - RNA, 15 nt, Shigella flexneri 2a str. 301
cuaauaaaucuaaaa

SEQ ID NO: 3925457 - RNA, 16 nt, Shigella flexneri 2a str. 301
cuaauaaugagcagaa

SEQ ID NO: 3925458 - RNA, 16 nt, Shigella flexneri 2a str. 301
cuaauacaccaucaug

SEQ ID NO: 3925459 - RNA, 15 nt, Shigella flexneri 2a str. 301
cuaaucagcuuuucc

SEQ ID NO: 3925460 - RNA, 14 nt, Shigella flexneri 2a str. 301
cuaaucaucaucag

SEQ ID NO: 3925461 - RNA, 14 nt, Shigella flexneri 2a str. 301
cuaaucgagccgau

SEQ ID NO: 3925462 - RNA, 15 nt, Shigella flexneri 2a str. 301
cuaaucgcacaaaau

SEQ ID NO: 3925463 - RNA, 17 nt, Shigella flexneri 2a str. 301
cuaaucgcuuuauagca

SEQ ID NO: 3925464 - RNA, 17 nt, Shigella flexneri 2a str. 301
cuaaucgucaucgacag

SEQ ID NO: 3925465 - RNA, 23 nt, Shigella flexneri 2a str. 301
cuaaucguccgauuaaaaacccu

SEQ ID NO: 3925466 - RNA, 11 nt, Shigella flexneri 2a str. 301
cuaaucugaau

SEQ ID NO: 3925467 - RNA, 18 nt, Shigella flexneri 2a str. 301
cuaaugagucaggacagu

SEQ ID NO: 3925468 - RNA, 15 nt, Shigella flexneri 2a str. 301
cuaauggugaacuga

SEQ ID NO: 3925469 - RNA, 14 nt, Shigella flexneri 2a str. 301
cuaauuacauaaca

SEQ ID NO: 3925470 - RNA, 18 nt, Shigella flexneri 2a str. 301
cuaauuuccuuugguuau

SEQ ID NO: 3925471 - RNA, 22 nt, Shigella flexneri 2a str. 301
cuaauuucgccgaggcgcuggc

SEQ ID NO: 3925472 - RNA, 15 nt, Shigella flexneri 2a str. 301
cuaauuuuucccgac

SEQ ID NO: 3925473 - RNA, 20 nt, Shigella flexneri 2a str. 301
cuaauuuuucccucuucaau

SEQ ID NO: 3925474 - RNA, 15 nt, Shigella flexneri 2a str. 301
cuaauuuuuguuguu

SEQ ID NO: 3925475 - RNA, 18 nt, Shigella flexneri 2a str. 301
cuaauuuuuugcgccacu

SEQ ID NO: 3925476 - RNA, 23 nt, Shigella flexneri 2a str. 301
cuacaaaaccaauuaaauucaau

SEQ ID NO: 3925477 - RNA, 22 nt, Shigella flexneri 2a str. 301
cuacaaaaccacacuucuucag

SEQ ID NO: 3925478 - RNA, 13 nt, Shigella flexneri 2a str. 301
cuacaaaaccugc

SEQ ID NO: 3925479 - RNA, 21 nt, Shigella flexneri 2a str. 301
cuacaaaaucuauugcaacau

SEQ ID NO: 3925480 - RNA, 23 nt, Shigella flexneri 2a str. 301
cuacaaaauuguguaaauucaau

SEQ ID NO: 3925481 - RNA, 15 nt, Shigella flexneri 2a str. 301
cuacaaauuugugca

SEQ ID NO: 3925482 - RNA, 14 nt, Shigella flexneri 2a str. 301
cuacaagcagagag

SEQ ID NO: 3925483 - RNA, 19 nt, Shigella flexneri 2a str. 301
cuacaaugucgggauuuuc

SEQ ID NO: 3925484 - RNA, 16 nt, Shigella flexneri 2a str. 301
cuacaauguuucugca

SEQ ID NO: 3925485 - RNA, 23 nt, Shigella flexneri 2a str. 301
cuacacagacgguuuuucaaguc

SEQ ID NO: 3925486 - RNA, 14 nt, Shigella flexneri 2a str. 301
cuacaccccagcgu

SEQ ID NO: 3925487 - RNA, 14 nt, Shigella flexneri 2a str. 301
cuacacuauuuccu

SEQ ID NO: 3925488 - RNA, 18 nt, Shigella flexneri 2a str. 301
cuacacuauuuccuuggu

SEQ ID NO: 3925489 - RNA, 21 nt, Shigella flexneri 2a str. 301
cuacagaggaaucgcuguuga

SEQ ID NO: 3925490 - RNA, 22 nt, Shigella flexneri 2a str. 301
cuacagaggaaucgcuguugag

SEQ ID NO: 3925491 - RNA, 14 nt, Shigella flexneri 2a str. 301
cuacagcauauaau

SEQ ID NO: 3925492 - RNA, 14 nt, Shigella flexneri 2a str. 301
cuacagccugguga

SEQ ID NO: 3925493 - RNA, 23 nt, Shigella flexneri 2a str. 301
cuacaggcaacgaccagaaaugc

SEQ ID NO: 3925494 - RNA, 14 nt, Shigella flexneri 2a str. 301
cuacagguaaggua

SEQ ID NO: 3925495 - RNA, 14 nt, Shigella flexneri 2a str. 301
cuacaugauuucug

SEQ ID NO: 3925496 - RNA, 16 nt, Shigella flexneri 2a str. 301
cuauugauuuaacagc

SEQ ID NO: 3925497 - RNA, 12 nt, Shigella flexneri 2a str. 301
cuauugcaacau

SEQ ID NO: 3925498 - RNA, 21 nt, Shigella flexneri 2a str. 301
cuauugcggaugaaagugguu

SEQ ID NO: 3925499 - RNA, 12 nt, Shigella flexneri 2a str. 301
cuauuggcggau

SEQ ID NO: 3925500 - RNA, 13 nt, Shigella flexneri 2a str. 301
cuauuguuuuaau

SEQ ID NO: 3925501 - RNA, 22 nt, Shigella flexneri 2a str. 301
cuauuuccccggaaccugaacu

SEQ ID NO: 3925502 - RNA, 14 nt, Shigella flexneri 2a str. 301
cuauuugcgccugg

SEQ ID NO: 3925503 - RNA, 20 nt, Shigella flexneri 2a str. 301
cuauuuuccuauugcugcug

SEQ ID NO: 3925504 - RNA, 15 nt, Shigella flexneri 2a str. 301
cucaaaacaacacaa

SEQ ID NO: 3925505 - RNA, 14 nt, Shigella flexneri 2a str. 301
cucaaaaucacugg

SEQ ID NO: 3925506 - RNA, 18 nt, Shigella flexneri 2a str. 301
cucaaacuucgucacagc

SEQ ID NO: 3925507 - RNA, 16 nt, Shigella flexneri 2a str. 301
cucaaaggccgacagc

SEQ ID NO: 3925508 - RNA, 16 nt, Shigella flexneri 2a str. 301
cucaaaguaaucaagc

SEQ ID NO: 3925509 - RNA, 19 nt, Shigella flexneri 2a str. 301
cucaaaguaaucaagcccu

SEQ ID NO: 3925510 - RNA, 21 nt, Shigella flexneri 2a str. 301
cucaaauaucuauauacaauc

SEQ ID NO: 3925511 - RNA, 22 nt, Shigella flexneri 2a str. 301
cucaaauaucuauauacaauca

SEQ ID NO: 3925512 - RNA, 14 nt, Shigella flexneri 2a str. 301
cucaacaaccagaa

SEQ ID NO: 3925513 - RNA, 16 nt, Shigella flexneri 2a str. 301
cucaacacauuacugc

SEQ ID NO: 3925514 - RNA, 20 nt, Shigella flexneri 2a str. 301
cucaacacauuacugcuugc

SEQ ID NO: 3925515 - RNA, 12 nt, Shigella flexneri 2a str. 301
cucaacaggccc

SEQ ID NO: 3925516 - RNA, 13 nt, Shigella flexneri 2a str. 301
cucaaccagauuc

SEQ ID NO: 3925517 - RNA, 23 nt, Shigella flexneri 2a str. 301
cucaaccagauucggcgcaauga

SEQ ID NO: 3925518 - RNA, 19 nt, Shigella flexneri 2a str. 301
cucaacccuuuuuuaaaca

SEQ ID NO: 3925519 - RNA, 17 nt, Shigella flexneri 2a str. 301
cucaaccgcuucuuucu

SEQ ID NO: 3925520 - RNA, 21 nt, Shigella flexneri 2a str. 301
cucaacgccuaaugccagcga

SEQ ID NO: 3925521 - RNA, 19 nt, Shigella flexneri 2a str. 301
cucaacggcaauuuuaccu

SEQ ID NO: 3925522 - RNA, 14 nt, Shigella flexneri 2a str. 301
cucaacucacgccc

SEQ ID NO: 3925523 - RNA, 14 nt, Shigella flexneri 2a str. 301
cucaacuccccgca

SEQ ID NO: 3925524 - RNA, 21 nt, Shigella flexneri 2a str. 301
cucaacugacugacgugauga

SEQ ID NO: 3925525 - RNA, 23 nt, Shigella flexneri 2a str. 301
cucaacugccaguucccccugcc

SEQ ID NO: 3925526 - RNA, 14 nt, Shigella flexneri 2a str. 301
cucaacuuuaccuu

SEQ ID NO: 3925527 - RNA, 16 nt, Shigella flexneri 2a str. 301
cucaacuuuaccuuca

SEQ ID NO: 3925528 - RNA, 16 nt, Shigella flexneri 2a str. 301
cucaagaaucacuuca

SEQ ID NO: 3925529 - RNA, 14 nt, Shigella flexneri 2a str. 301
cucaagacaauuag

SEQ ID NO: 3925530 - RNA, 21 nt, Shigella flexneri 2a str. 301
cucaagcucguugguuccacg

SEQ ID NO: 3925531 - RNA, 24 nt, Shigella flexneri 2a str. 301
cucaagcucguugguuccacggca

SEQ ID NO: 3925532 - RNA, 14 nt, Shigella flexneri 2a str. 301
cucaaguugcgaaa

SEQ ID NO: 3925533 - RNA, 14 nt, Shigella flexneri 2a str. 301
cucaauaaaagaaa

SEQ ID NO: 3925534 - RNA, 15 nt, Shigella flexneri 2a str. 301
cucaauaucaucauu

SEQ ID NO: 3925535 - RNA, 16 nt, Shigella flexneri 2a str. 301
cucaauaucaucauuu

SEQ ID NO: 3925536 - RNA, 19 nt, Shigella flexneri 2a str. 301
cucaauaucaucauuugca

SEQ ID NO: 3925537 - RNA, 17 nt, Shigella flexneri 2a str. 301
cucaauauuagcauuaa

SEQ ID NO: 3925538 - RNA, 16 nt, Shigella flexneri 2a str. 301
cucaaucaacuccauu

SEQ ID NO: 3925539 - RNA, 15 nt, Shigella flexneri 2a str. 301
cucaaucaucucaca

SEQ ID NO: 3925540 - RNA, 14 nt, Shigella flexneri 2a str. 301
cucaaucccuuucu

SEQ ID NO: 3925541 - RNA, 19 nt, Shigella flexneri 2a str. 301
cucaaucccuuucucuuca

SEQ ID NO: 3925542 - RNA, 20 nt, Shigella flexneri 2a str. 301
cucaauccgccaaaacaucu

SEQ ID NO: 3925543 - RNA, 22 nt, Shigella flexneri 2a str. 301
cucaauccgggcgauccggcaa

SEQ ID NO: 3925544 - RNA, 22 nt, Shigella flexneri 2a str. 301
cucaaucgagauacgacugaua

SEQ ID NO: 3925545 - RNA, 14 nt, Shigella flexneri 2a str. 301
cucaaucgccacca

SEQ ID NO: 3925546 - RNA, 22 nt, Shigella flexneri 2a str. 301
cucaaucucuuuuuccaccgca

SEQ ID NO: 3925547 - RNA, 21 nt, Shigella flexneri 2a str. 301
cucaaucuucacgucuuucgg

SEQ ID NO: 3925548 - RNA, 16 nt, Shigella flexneri 2a str. 301
cucaaugaaauccauu

SEQ ID NO: 3925549 - RNA, 19 nt, Shigella flexneri 2a str. 301
cucaaugagccggaccucu

SEQ ID NO: 3925550 - RNA, 15 nt, Shigella flexneri 2a str. 301
cucaauggauuuacc

SEQ ID NO: 3925551 - RNA, 14 nt, Shigella flexneri 2a str. 301
cucaauggcauccg

SEQ ID NO: 3925552 - RNA, 20 nt, Shigella flexneri 2a str. 301
cucaaugguguuuuccaccg

SEQ ID NO: 3925553 - RNA, 14 nt, Shigella flexneri 2a str. 301
cucaaugucuguca

SEQ ID NO: 3925554 - RNA, 19 nt, Shigella flexneri 2a str. 301
cucaaugucugucauauua

SEQ ID NO: 3925555 - RNA, 11 nt, Shigella flexneri 2a str. 301
cucaauuacca

SEQ ID NO: 3925556 - RNA, 20 nt, Shigella flexneri 2a str. 301
cucaauuaccacaaguaaaa

SEQ ID NO: 3925557 - RNA, 17 nt, Shigella flexneri 2a str. 301
cucacaaccccggcaaa

SEQ ID NO: 3925558 - RNA, 22 nt, Shigella flexneri 2a str. 301
cucacagaggucuuuucucguu

SEQ ID NO: 3925559 - RNA, 15 nt, Shigella flexneri 2a str. 301
cucacagcuaaucau

SEQ ID NO: 3925560 - RNA, 15 nt, Shigella flexneri 2a str. 301
cucacaugaguugcu

SEQ ID NO: 3925561 - RNA, 19 nt, Shigella flexneri 2a str. 301
cucacaugaguugcuggac

SEQ ID NO: 3925562 - RNA, 20 nt, Shigella flexneri 2a str. 301
cucacaugaguugcuggacg

SEQ ID NO: 3925563 - RNA, 22 nt, Shigella flexneri 2a str. 301
cucaccaaaugcggucaauugc

SEQ ID NO: 3925564 - RNA, 21 nt, Shigella flexneri 2a str. 301
cucaccacgcagcagccaagc

SEQ ID NO: 3925565 - RNA, 21 nt, Shigella flexneri 2a str. 301
cucaccagacaucccagugca

SEQ ID NO: 3925566 - RNA, 21 nt, Shigella flexneri 2a str. 301
cucaccagauuauaagccagu

SEQ ID NO: 3925567 - RNA, 17 nt, Shigella flexneri 2a str. 301
cucaccagccgcgacau

SEQ ID NO: 3925568 - RNA, 14 nt, Shigella flexneri 2a str. 301
cucacccggaggaa

SEQ ID NO: 3925569 - RNA, 18 nt, Shigella flexneri 2a str. 301
cucacccggaggaaagca

SEQ ID NO: 3925570 - RNA, 21 nt, Shigella flexneri 2a str. 301
cucacccggaggaaagcaccu

SEQ ID NO: 3925571 - RNA, 13 nt, Shigella flexneri 2a str. 301
cucacccguacag

SEQ ID NO: 3925572 - RNA, 13 nt, Shigella flexneri 2a str. 301
cucaccgccgccu

SEQ ID NO: 3925573 - RNA, 13 nt, Shigella flexneri 2a str. 301
cucaccggauaau

SEQ ID NO: 3925574 - RNA, 16 nt, Shigella flexneri 2a str. 301
cucaccggauaauucc

SEQ ID NO: 3925575 - RNA, 20 nt, Shigella flexneri 2a str. 301
cucaccugauacgcgccaau

SEQ ID NO: 3925576 - RNA, 15 nt, Shigella flexneri 2a str. 301
cucaccuuccacgcg

SEQ ID NO: 3925577 - RNA, 15 nt, Shigella flexneri 2a str. 301
cucacgcccaucagc

SEQ ID NO: 3925578 - RNA, 19 nt, Shigella flexneri 2a str. 301
cucacgcgcugccucucuu

SEQ ID NO: 3925579 - RNA, 13 nt, Shigella flexneri 2a str. 301
cucacguuccaga

SEQ ID NO: 3925580 - RNA, 22 nt, Shigella flexneri 2a str. 301
cucacuaauugcaaacagagcg

SEQ ID NO: 3925581 - RNA, 13 nt, Shigella flexneri 2a str. 301
cucacuaucgcug

SEQ ID NO: 3925582 - RNA, 14 nt, Shigella flexneri 2a str. 301
cucacucaccgcag

SEQ ID NO: 3925583 - RNA, 15 nt, Shigella flexneri 2a str. 301
cucacucauacucac

SEQ ID NO: 3925584 - RNA, 18 nt, Shigella flexneri 2a str. 301
cucacuccagccagagcc

SEQ ID NO: 3925585 - RNA, 17 nt, Shigella flexneri 2a str. 301
cucacuccggccagagc

SEQ ID NO: 3925586 - RNA, 18 nt, Shigella flexneri 2a str. 301
cucacuccggccagagca

SEQ ID NO: 3925587 - RNA, 14 nt, Shigella flexneri 2a str. 301
cucacuguucacuu

SEQ ID NO: 3925588 - RNA, 16 nt, Shigella flexneri 2a str. 301
cucacuguucacuuuu

SEQ ID NO: 3925589 - RNA, 18 nt, Shigella flexneri 2a str. 301
cucacuguucacuuuugc

SEQ ID NO: 3925590 - RNA, 13 nt, Shigella flexneri 2a str. 301
cucacuuccuuuu

SEQ ID NO: 3925591 - RNA, 22 nt, Shigella flexneri 2a str. 301
cucacuucgcuuacgccugcca

SEQ ID NO: 3925592 - RNA, 14 nt, Shigella flexneri 2a str. 301
cucacuuuucaccg

SEQ ID NO: 3925593 - RNA, 12 nt, Shigella flexneri 2a str. 301
cucacuuuuccg

SEQ ID NO: 3925594 - RNA, 14 nt, Shigella flexneri 2a str. 301
cucagaaaggggga

SEQ ID NO: 3925595 - RNA, 16 nt, Shigella flexneri 2a str. 301
cucagaagacgcucca

SEQ ID NO: 3925596 - RNA, 19 nt, Shigella flexneri 2a str. 301
cucccggcgguaaaucgcc

SEQ ID NO: 3925597 - RNA, 15 nt, Shigella flexneri 2a str. 301
cucccgugccagagc

SEQ ID NO: 3925598 - RNA, 15 nt, Shigella flexneri 2a str. 301
cucccugccccaucu

SEQ ID NO: 3925599 - RNA, 12 nt, Shigella flexneri 2a str. 301
cucccuucgcug

SEQ ID NO: 3925600 - RNA, 16 nt, Shigella flexneri 2a str. 301
cucccuuuggccgcuc

SEQ ID NO: 3925601 - RNA, 18 nt, Shigella flexneri 2a str. 301
cucccuuuuucaagcuca

SEQ ID NO: 3925602 - RNA, 14 nt, Shigella flexneri 2a str. 301
cuccgaucccugcg

SEQ ID NO: 3925603 - RNA, 21 nt, Shigella flexneri 2a str. 301
cuccgccagcguagucggcag

SEQ ID NO: 3925604 - RNA, 14 nt, Shigella flexneri 2a str. 301
cuccgccccggcaa

SEQ ID NO: 3925605 - RNA, 21 nt, Shigella flexneri 2a str. 301
cuccgccucgguaagcaaagc

SEQ ID NO: 3925606 - RNA, 17 nt, Shigella flexneri 2a str. 301
cuccgccuuugaaaaua

SEQ ID NO: 3925607 - RNA, 18 nt, Shigella flexneri 2a str. 301
cuccgcugagacgcgcuu

SEQ ID NO: 3925608 - RNA, 23 nt, Shigella flexneri 2a str. 301
cuccggaaauuuggggccguccc

SEQ ID NO: 3925609 - RNA, 14 nt, Shigella flexneri 2a str. 301
cuccggacuccgca

SEQ ID NO: 3925610 - RNA, 16 nt, Shigella flexneri 2a str. 301
cuccggcaggaaaugg

SEQ ID NO: 3925611 - RNA, 17 nt, Shigella flexneri 2a str. 301
cuccggccugcacugca

SEQ ID NO: 3925612 - RNA, 23 nt, Shigella flexneri 2a str. 301
cuccggccuuuuuuaucucuuac

SEQ ID NO: 3925613 - RNA, 17 nt, Shigella flexneri 2a str. 301
cuccggcgcauccauga

SEQ ID NO: 3925614 - RNA, 17 nt, Shigella flexneri 2a str. 301
cuccggcggcacagcca

SEQ ID NO: 3925615 - RNA, 14 nt, Shigella flexneri 2a str. 301
cuccggcugggcgu

SEQ ID NO: 3925616 - RNA, 21 nt, Shigella flexneri 2a str. 301
cuccggcuuuuuacuucucag

SEQ ID NO: 3925617 - RNA, 21 nt, Shigella flexneri 2a str. 301
cuccgggaaaacgcuggcagc

SEQ ID NO: 3925618 - RNA, 21 nt, Shigella flexneri 2a str. 301
cuccgguuugcggaucaacuu

SEQ ID NO: 3925619 - RNA, 22 nt, Shigella flexneri 2a str. 301
cuccguaaaacucaggcuggca

SEQ ID NO: 3925620 - RNA, 14 nt, Shigella flexneri 2a str. 301
cuccguaaaccccg

SEQ ID NO: 3925621 - RNA, 17 nt, Shigella flexneri 2a str. 301
cuccgugguagcaauuc

SEQ ID NO: 3925622 - RNA, 20 nt, Shigella flexneri 2a str. 301
cuccuauuaucggcaccauu

SEQ ID NO: 3925623 - RNA, 17 nt, Shigella flexneri 2a str. 301
cuccucaacaaucguca

SEQ ID NO: 3925624 - RNA, 17 nt, Shigella flexneri 2a str. 301
cuccucgaguccuucca

SEQ ID NO: 3925625 - RNA, 18 nt, Shigella flexneri 2a str. 301
cuccucgaguccuuccag

SEQ ID NO: 3925626 - RNA, 20 nt, Shigella flexneri 2a str. 301
cuccucgaguccuuccaggu

SEQ ID NO: 3925627 - RNA, 19 nt, Shigella flexneri 2a str. 301
cuccucuucacguuuuucg

SEQ ID NO: 3925628 - RNA, 18 nt, Shigella flexneri 2a str. 301
cuccucuuucaucucccg

SEQ ID NO: 3925629 - RNA, 17 nt, Shigella flexneri 2a str. 301
cuccugaacuuucuccc

SEQ ID NO: 3925630 - RNA, 15 nt, Shigella flexneri 2a str. 301
cuccugauaacacag

SEQ ID NO: 3925631 - RNA, 16 nt, Shigella flexneri 2a str. 301
cuccugauaacacaga

SEQ ID NO: 3925632 - RNA, 17 nt, Shigella flexneri 2a str. 301
cuccugcggaaugcugu

SEQ ID NO: 3925633 - RNA, 13 nt, Shigella flexneri 2a str. 301
cuccugcucauca

SEQ ID NO: 3925634 - RNA, 22 nt, Shigella flexneri 2a str. 301
cuccuggcgguuaauaaugauu

SEQ ID NO: 3925635 - RNA, 20 nt, Shigella flexneri 2a str. 301
cuccuguaccuucacgcgcu

SEQ ID NO: 3925636 - RNA, 19 nt, Shigella flexneri 2a str. 301
cuccugucaguauaacuac

SEQ ID NO: 3925637 - RNA, 17 nt, Shigella flexneri 2a str. 301
cuccuguuaugccucaa

SEQ ID NO: 3925638 - RNA, 20 nt, Shigella flexneri 2a str. 301
cuccuguuuaauaugcaauu

SEQ ID NO: 3925639 - RNA, 14 nt, Shigella flexneri 2a str. 301
cuccuucacucuau

SEQ ID NO: 3925640 - RNA, 17 nt, Shigella flexneri 2a str. 301
cuccuuuaccgugguug

SEQ ID NO: 3925641 - RNA, 13 nt, Shigella flexneri 2a str. 301
cuccuuucggcca

SEQ ID NO: 3925642 - RNA, 17 nt, Shigella flexneri 2a str. 301
cucgaaaaccacuccug

SEQ ID NO: 3925643 - RNA, 11 nt, Shigella flexneri 2a str. 301
cucgaacccgu

SEQ ID NO: 3925644 - RNA, 15 nt, Shigella flexneri 2a str. 301
cucgaaguuuuccuc

SEQ ID NO: 3925645 - RNA, 13 nt, Shigella flexneri 2a str. 301
cucgacaaaauga

SEQ ID NO: 3925646 - RNA, 15 nt, Shigella flexneri 2a str. 301
cucgacaccaaacag

SEQ ID NO: 3925647 - RNA, 17 nt, Shigella flexneri 2a str. 301
cucgacaccaaacagac

SEQ ID NO: 3925648 - RNA, 18 nt, Shigella flexneri 2a str. 301
cucgaccaaaugaaacag

SEQ ID NO: 3925649 - RNA, 17 nt, Shigella flexneri 2a str. 301
cucgacgcccagcuuca

SEQ ID NO: 3925650 - RNA, 12 nt, Shigella flexneri 2a str. 301
cucgacgucaca

SEQ ID NO: 3925651 - RNA, 16 nt, Shigella flexneri 2a str. 301
cucgacuguggcgcga

SEQ ID NO: 3925652 - RNA, 23 nt, Shigella flexneri 2a str. 301
cucgacuuuagucgcuugcagga

SEQ ID NO: 3925653 - RNA, 17 nt, Shigella flexneri 2a str. 301
cucgagagagaaaauaa

SEQ ID NO: 3925654 - RNA, 13 nt, Shigella flexneri 2a str. 301
cucgagcagcuga

SEQ ID NO: 3925655 - RNA, 13 nt, Shigella flexneri 2a str. 301
cucgauaaaaccu

SEQ ID NO: 3925656 - RNA, 17 nt, Shigella flexneri 2a str. 301
cucgauaaaaccuuccu

SEQ ID NO: 3925657 - RNA, 19 nt, Shigella flexneri 2a str. 301
cucgauaaggcgcugaagg

SEQ ID NO: 3925658 - RNA, 22 nt, Shigella flexneri 2a str. 301
cucgauacgacacgccuccugg

SEQ ID NO: 3925659 - RNA, 21 nt, Shigella flexneri 2a str. 301
cucgaucggcucuuccgcgaa

SEQ ID NO: 3925660 - RNA, 14 nt, Shigella flexneri 2a str. 301
cucgcaaaacgucg

SEQ ID NO: 3925661 - RNA, 24 nt, Shigella flexneri 2a str. 301
cucgcaagccgaauaacggcucaa

SEQ ID NO: 3925662 - RNA, 20 nt, Shigella flexneri 2a str. 301
cucgcagaaauaccccgcca

SEQ ID NO: 3925663 - RNA, 18 nt, Shigella flexneri 2a str. 301
cucgcaucagggcgcugg

SEQ ID NO: 3925664 - RNA, 14 nt, Shigella flexneri 2a str. 301
cucgcauccucuuu

SEQ ID NO: 3925665 - RNA, 18 nt, Shigella flexneri 2a str. 301
cucgccagagagcggagc

SEQ ID NO: 3925666 - RNA, 13 nt, Shigella flexneri 2a str. 301
cucgccagccacc

SEQ ID NO: 3925667 - RNA, 19 nt, Shigella flexneri 2a str. 301
cucgccaucaaauagcccc

SEQ ID NO: 3925668 - RNA, 18 nt, Shigella flexneri 2a str. 301
cucgcccccgaagagggg

SEQ ID NO: 3925669 - RNA, 20 nt, Shigella flexneri 2a str. 301
cucgcccccuuggggagagg

SEQ ID NO: 3925670 - RNA, 19 nt, Shigella flexneri 2a str. 301
cucgccccgagaaaaauag

SEQ ID NO: 3925671 - RNA, 16 nt, Shigella flexneri 2a str. 301
cucgccccgugaugaa

SEQ ID NO: 3925672 - RNA, 18 nt, Shigella flexneri 2a str. 301
cucgccccugcccuuuca

SEQ ID NO: 3925673 - RNA, 14 nt, Shigella flexneri 2a str. 301
cucgccgcagagau

SEQ ID NO: 3925674 - RNA, 19 nt, Shigella flexneri 2a str. 301
cucgccggaugaaaaguca

SEQ ID NO: 3925675 - RNA, 17 nt, Shigella flexneri 2a str. 301
cucgccuaccauccaua

SEQ ID NO: 3925676 - RNA, 15 nt, Shigella flexneri 2a str. 301
cucgccuuucacacg

SEQ ID NO: 3925677 - RNA, 16 nt, Shigella flexneri 2a str. 301
cucgcgaaccgccugg

SEQ ID NO: 3925678 - RNA, 17 nt, Shigella flexneri 2a str. 301
cucgcgaaccgccuggc

SEQ ID NO: 3925679 - RNA, 20 nt, Shigella flexneri 2a str. 301
cucgcgaaccgccuggcgcu

SEQ ID NO: 3925680 - RNA, 21 nt, Shigella flexneri 2a str. 301
cucgcgacccaugaacaaaau

SEQ ID NO: 3925681 - RNA, 23 nt, Shigella flexneri 2a str. 301
cucgcgaccucaagcucgccacc

SEQ ID NO: 3925682 - RNA, 23 nt, Shigella flexneri 2a str. 301
cucgcgcuucauauagaucuuua

SEQ ID NO: 3925683 - RNA, 18 nt, Shigella flexneri 2a str. 301
cucgcgcuugcggaagca

SEQ ID NO: 3925684 - RNA, 15 nt, Shigella flexneri 2a str. 301
cucgcggacugccug

SEQ ID NO: 3925685 - RNA, 23 nt, Shigella flexneri 2a str. 301
cucgcguuacuaccggcgugcgu

SEQ ID NO: 3925686 - RNA, 16 nt, Shigella flexneri 2a str. 301
cucgcucgagagagaa

SEQ ID NO: 3925687 - RNA, 20 nt, Shigella flexneri 2a str. 301
cucgcucuuguucuuccggc

SEQ ID NO: 3925688 - RNA, 19 nt, Shigella flexneri 2a str. 301
cucgcuuaagccaucauca

SEQ ID NO: 3925689 - RNA, 13 nt, Shigella flexneri 2a str. 301
cucgcuuuccauu

SEQ ID NO: 3925690 - RNA, 20 nt, Shigella flexneri 2a str. 301
cucggaaugccggaaucaga

SEQ ID NO: 3925691 - RNA, 18 nt, Shigella flexneri 2a str. 301
cucggauaaggcuucccg

SEQ ID NO: 3925692 - RNA, 15 nt, Shigella flexneri 2a str. 301
cucggcaaagcgcug

SEQ ID NO: 3925693 - RNA, 13 nt, Shigella flexneri 2a str. 301
cucggcaaauuca

SEQ ID NO: 3925694 - RNA, 20 nt, Shigella flexneri 2a str. 301
cucgggcgguuaugggauau

SEQ ID NO: 3925695 - RNA, 21 nt, Shigella flexneri 2a str. 301
cucgggcuuugcuacagccug

SEQ ID NO: 3925696 - RNA, 13 nt, Shigella flexneri 2a str. 301
cucuucuuccgcu

SEQ ID NO: 3925697 - RNA, 22 nt, Shigella flexneri 2a str. 301
cucuucuucgcgauaaaucaga

SEQ ID NO: 3925698 - RNA, 17 nt, Shigella flexneri 2a str. 301
cucuuguaaauuuccca

SEQ ID NO: 3925699 - RNA, 18 nt, Shigella flexneri 2a str. 301
cucuuuaacccauuuugu

SEQ ID NO: 3925700 - RNA, 15 nt, Shigella flexneri 2a str. 301
cucuuuauugcaaac

SEQ ID NO: 3925701 - RNA, 12 nt, Shigella flexneri 2a str. 301
cucuuucaacuu

SEQ ID NO: 3925702 - RNA, 12 nt, Shigella flexneri 2a str. 301
cucuuuccacaa

SEQ ID NO: 3925703 - RNA, 15 nt, Shigella flexneri 2a str. 301
cucuuucuggcauca

SEQ ID NO: 3925704 - RNA, 16 nt, Shigella flexneri 2a str. 301
cucuuugcuuccugag

SEQ ID NO: 3925705 - RNA, 19 nt, Shigella flexneri 2a str. 301
cucuuuuauuucugcuucg

SEQ ID NO: 3925706 - RNA, 15 nt, Shigella flexneri 2a str. 301
cucuuuuccagccau

SEQ ID NO: 3925707 - RNA, 23 nt, Shigella flexneri 2a str. 301
cucuuuuuauuuacucuccugcg

SEQ ID NO: 3925708 - RNA, 18 nt, Shigella flexneri 2a str. 301
cucuuuuuuguucaguuc

SEQ ID NO: 3925709 - RNA, 15 nt, Shigella flexneri 2a str. 301
cugaaaagaguagua

SEQ ID NO: 3925710 - RNA, 21 nt, Shigella flexneri 2a str. 301
cugaaaagaguaguaauugcu

SEQ ID NO: 3925711 - RNA, 14 nt, Shigella flexneri 2a str. 301
cugaaaaggucacu

SEQ ID NO: 3925712 - RNA, 16 nt, Shigella flexneri 2a str. 301
cugaaaaggucacucc

SEQ ID NO: 3925713 - RNA, 17 nt, Shigella flexneri 2a str. 301
cugaaaaguuaauguug

SEQ ID NO: 3925714 - RNA, 24 nt, Shigella flexneri 2a str. 301
cugaaacggcgauggcuucuucag

SEQ ID NO: 3925715 - RNA, 18 nt, Shigella flexneri 2a str. 301
cugaaacucgaccagcag

SEQ ID NO: 3925716 - RNA, 16 nt, Shigella flexneri 2a str. 301
cugaaagcgugucaug

SEQ ID NO: 3925717 - RNA, 20 nt, Shigella flexneri 2a str. 301
cugaaaguggaaaaauaaca

SEQ ID NO: 3925718 - RNA, 17 nt, Shigella flexneri 2a str. 301
cugaaauagaauggcau

SEQ ID NO: 3925719 - RNA, 14 nt, Shigella flexneri 2a str. 301
cugaaaucacagcg

SEQ ID NO: 3925720 - RNA, 18 nt, Shigella flexneri 2a str. 301
cugaaauguuugcaauaa

SEQ ID NO: 3925721 - RNA, 20 nt, Shigella flexneri 2a str. 301
cugaacaauaaauuucaccg

SEQ ID NO: 3925722 - RNA, 22 nt, Shigella flexneri 2a str. 301
cugaacaauuggauagugagua

SEQ ID NO: 3925723 - RNA, 14 nt, Shigella flexneri 2a str. 301
cugaacagcuuuuu

SEQ ID NO: 3925724 - RNA, 20 nt, Shigella flexneri 2a str. 301
cugaacaguacuggccucca

SEQ ID NO: 3925725 - RNA, 21 nt, Shigella flexneri 2a str. 301
cugaacaguacuggccuccac

SEQ ID NO: 3925726 - RNA, 16 nt, Shigella flexneri 2a str. 301
cugaacauuguuauuc

SEQ ID NO: 3925727 - RNA, 22 nt, Shigella flexneri 2a str. 301
cugaacauuuucuucugccagg

SEQ ID NO: 3925728 - RNA, 24 nt, Shigella flexneri 2a str. 301
cugaaccaucgacguccaaucagc

SEQ ID NO: 3925729 - RNA, 17 nt, Shigella flexneri 2a str. 301
cugaacgagaaaagcca

SEQ ID NO: 3925730 - RNA, 15 nt, Shigella flexneri 2a str. 301
cugaacgcaccuucc

SEQ ID NO: 3925731 - RNA, 22 nt, Shigella flexneri 2a str. 301
cugaacgucgucgugaagcaga

SEQ ID NO: 3925732 - RNA, 20 nt, Shigella flexneri 2a str. 301
cugaacuaaagccuuuugcc

SEQ ID NO: 3925733 - RNA, 23 nt, Shigella flexneri 2a str. 301
cugaacuaaagccuuuugccagu

SEQ ID NO: 3925734 - RNA, 21 nt, Shigella flexneri 2a str. 301
cugaacucgccagccaccaug

SEQ ID NO: 3925735 - RNA, 14 nt, Shigella flexneri 2a str. 301
cugaacugaacaaa

SEQ ID NO: 3925736 - RNA, 21 nt, Shigella flexneri 2a str. 301
cugaagaaaauggccagccag

SEQ ID NO: 3925737 - RNA, 14 nt, Shigella flexneri 2a str. 301
cugaagaguaaaaa

SEQ ID NO: 3925738 - RNA, 14 nt, Shigella flexneri 2a str. 301
cugaagaugcugca

SEQ ID NO: 3925739 - RNA, 19 nt, Shigella flexneri 2a str. 301
cugaagauugaacagcaga

SEQ ID NO: 3925740 - RNA, 13 nt, Shigella flexneri 2a str. 301
cugaagcaaacuu

SEQ ID NO: 3925741 - RNA, 19 nt, Shigella flexneri 2a str. 301
cugaagcaguuucaccagc

SEQ ID NO: 3925742 - RNA, 16 nt, Shigella flexneri 2a str. 301
cugaagccgcaccugu

SEQ ID NO: 3925743 - RNA, 22 nt, Shigella flexneri 2a str. 301
cugaagcuuacguaacccacca

SEQ ID NO: 3925744 - RNA, 13 nt, Shigella flexneri 2a str. 301
cugaaggcacaga

SEQ ID NO: 3925745 - RNA, 15 nt, Shigella flexneri 2a str. 301
cugaaggcacagaaa

SEQ ID NO: 3925746 - RNA, 21 nt, Shigella flexneri 2a str. 301
cugaagguugugaacccugaa

SEQ ID NO: 3925747 - RNA, 18 nt, Shigella flexneri 2a str. 301
cugaaguaagaaauaacg

SEQ ID NO: 3925748 - RNA, 13 nt, Shigella flexneri 2a str. 301
cugaagugcguca

SEQ ID NO: 3925749 - RNA, 18 nt, Shigella flexneri 2a str. 301
cugaaguuauaaggcguu

SEQ ID NO: 3925750 - RNA, 17 nt, Shigella flexneri 2a str. 301
cugaauaaacucgcaaa

SEQ ID NO: 3925751 - RNA, 18 nt, Shigella flexneri 2a str. 301
cugaauaacaccagccag

SEQ ID NO: 3925752 - RNA, 17 nt, Shigella flexneri 2a str. 301
cugaauaauacacacag

SEQ ID NO: 3925753 - RNA, 11 nt, Shigella flexneri 2a str. 301
cugaauaaucc

SEQ ID NO: 3925754 - RNA, 21 nt, Shigella flexneri 2a str. 301
cugaauaauccccauaucagg

SEQ ID NO: 3925755 - RNA, 11 nt, Shigella flexneri 2a str. 301
cugaauaaucg

SEQ ID NO: 3925756 - RNA, 23 nt, Shigella flexneri 2a str. 301
cugaauacgcaccgcuccaucgc

SEQ ID NO: 3925757 - RNA, 14 nt, Shigella flexneri 2a str. 301
cugaauacgcuggc

SEQ ID NO: 3925758 - RNA, 23 nt, Shigella flexneri 2a str. 301
cugaauaucaucccccugcgauu

SEQ ID NO: 3925759 - RNA, 14 nt, Shigella flexneri 2a str. 301
cugaauauccagau

SEQ ID NO: 3925760 - RNA, 17 nt, Shigella flexneri 2a str. 301
cugaauauccugacuuu

SEQ ID NO: 3925761 - RNA, 20 nt, Shigella flexneri 2a str. 301
cugaauaugagucguaaaca

SEQ ID NO: 3925762 - RNA, 16 nt, Shigella flexneri 2a str. 301
cugaauauguaagauc

SEQ ID NO: 3925763 - RNA, 14 nt, Shigella flexneri 2a str. 301
cugaaucaaaauca

SEQ ID NO: 3925764 - RNA, 15 nt, Shigella flexneri 2a str. 301
cugaaugauaacuuc

SEQ ID NO: 3925765 - RNA, 17 nt, Shigella flexneri 2a str. 301
cugaaugauaacuucua

SEQ ID NO: 3925766 - RNA, 21 nt, Shigella flexneri 2a str. 301
cugaaugccccuuuaaauacc

SEQ ID NO: 3925767 - RNA, 16 nt, Shigella flexneri 2a str. 301
cugaauuucagcgccu

SEQ ID NO: 3925768 - RNA, 19 nt, Shigella flexneri 2a str. 301
cugaauuucagcgccugau

SEQ ID NO: 3925769 - RNA, 14 nt, Shigella flexneri 2a str. 301
cugaauuugaccuu

SEQ ID NO: 3925770 - RNA, 16 nt, Shigella flexneri 2a str. 301
cugacaaagugcgcgu

SEQ ID NO: 3925771 - RNA, 12 nt, Shigella flexneri 2a str. 301
cugacaaaucag

SEQ ID NO: 3925772 - RNA, 19 nt, Shigella flexneri 2a str. 301
cugacaacaccaauuucug

SEQ ID NO: 3925773 - RNA, 14 nt, Shigella flexneri 2a str. 301
cugacaauuugccc

SEQ ID NO: 3925774 - RNA, 16 nt, Shigella flexneri 2a str. 301
cugacacaggcagcaa

SEQ ID NO: 3925775 - RNA, 15 nt, Shigella flexneri 2a str. 301
cugacaccaucaccc

SEQ ID NO: 3925776 - RNA, 23 nt, Shigella flexneri 2a str. 301
cugacagccaaagggcuggcaau

SEQ ID NO: 3925777 - RNA, 21 nt, Shigella flexneri 2a str. 301
cugacagcgcgucuuguacuu

SEQ ID NO: 3925778 - RNA, 23 nt, Shigella flexneri 2a str. 301
cugacaguugucagcccuuuuuc

SEQ ID NO: 3925779 - RNA, 21 nt, Shigella flexneri 2a str. 301
cugacauaaacaccagcaaua

SEQ ID NO: 3925780 - RNA, 17 nt, Shigella flexneri 2a str. 301
cugacauaaccacucac

SEQ ID NO: 3925781 - RNA, 17 nt, Shigella flexneri 2a str. 301
cugaccaaauacacgca

SEQ ID NO: 3925782 - RNA, 15 nt, Shigella flexneri 2a str. 301
cugaccacggccaca

SEQ ID NO: 3925783 - RNA, 17 nt, Shigella flexneri 2a str. 301
cugaccacggccacagc

SEQ ID NO: 3925784 - RNA, 20 nt, Shigella flexneri 2a str. 301
cugaccacggccacagccag

SEQ ID NO: 3925785 - RNA, 11 nt, Shigella flexneri 2a str. 301
cugaccagaau

SEQ ID NO: 3925786 - RNA, 22 nt, Shigella flexneri 2a str. 301
cugaccauaacccgcuuccaga

SEQ ID NO: 3925787 - RNA, 14 nt, Shigella flexneri 2a str. 301
cugacccagaccga

SEQ ID NO: 3925788 - RNA, 18 nt, Shigella flexneri 2a str. 301
cugacccaguagacgagc

SEQ ID NO: 3925789 - RNA, 13 nt, Shigella flexneri 2a str. 301
cugaccgaccaga

SEQ ID NO: 3925790 - RNA, 18 nt, Shigella flexneri 2a str. 301
cugaccggauugaucggu

SEQ ID NO: 3925791 - RNA, 14 nt, Shigella flexneri 2a str. 301
cugaccguacccgc

SEQ ID NO: 3925792 - RNA, 22 nt, Shigella flexneri 2a str. 301
cugaccgugcgggcgaaagcag

SEQ ID NO: 3925793 - RNA, 15 nt, Shigella flexneri 2a str. 301
cugaccguuaauuuc

SEQ ID NO: 3925794 - RNA, 19 nt, Shigella flexneri 2a str. 301
cugaccucuucuaccacau

SEQ ID NO: 3925795 - RNA, 22 nt, Shigella flexneri 2a str. 301
cugaccugaauuaaugccucuc

SEQ ID NO: 3925796 - RNA, 12 nt, Shigella flexneri 2a str. 301
cugaugagcaaa

SEQ ID NO: 3925797 - RNA, 18 nt, Shigella flexneri 2a str. 301
cugaugagcaaaucgcgg

SEQ ID NO: 3925798 - RNA, 20 nt, Shigella flexneri 2a str. 301
cugaugauaaguuaacccca

SEQ ID NO: 3925799 - RNA, 16 nt, Shigella flexneri 2a str. 301
cugaugcaggcgaucg

SEQ ID NO: 3925800 - RNA, 17 nt, Shigella flexneri 2a str. 301
cugaugcaucagucacg

SEQ ID NO: 3925801 - RNA, 13 nt, Shigella flexneri 2a str. 301
cugaugcgacacu

SEQ ID NO: 3925802 - RNA, 22 nt, Shigella flexneri 2a str. 301
cugaugcgacgcuugcgcgucu

SEQ ID NO: 3925803 - RNA, 16 nt, Shigella flexneri 2a str. 301
cugaugcgcugcgcuu

SEQ ID NO: 3925804 - RNA, 21 nt, Shigella flexneri 2a str. 301
cugaugcgcuucgcuuaucag

SEQ ID NO: 3925805 - RNA, 19 nt, Shigella flexneri 2a str. 301
cugauggaagacauagcac

SEQ ID NO: 3925806 - RNA, 18 nt, Shigella flexneri 2a str. 301
cugauggcgggaugugua

SEQ ID NO: 3925807 - RNA, 22 nt, Shigella flexneri 2a str. 301
cugaugggaugggcauuucugc

SEQ ID NO: 3925808 - RNA, 22 nt, Shigella flexneri 2a str. 301
cugaugguguugcaccaucagg

SEQ ID NO: 3925809 - RNA, 13 nt, Shigella flexneri 2a str. 301
cugauguagucac

SEQ ID NO: 3925810 - RNA, 21 nt, Shigella flexneri 2a str. 301
cugauguagucacgcuuuauc

SEQ ID NO: 3925811 - RNA, 15 nt, Shigella flexneri 2a str. 301
cugaugucagcacuu

SEQ ID NO: 3925812 - RNA, 18 nt, Shigella flexneri 2a str. 301
cugaugucagcacuucca

SEQ ID NO: 3925813 - RNA, 22 nt, Shigella flexneri 2a str. 301
cugaugucagcacuuccagcuc

SEQ ID NO: 3925814 - RNA, 19 nt, Shigella flexneri 2a str. 301
cugaugugacgcugucuua

SEQ ID NO: 3925815 - RNA, 22 nt, Shigella flexneri 2a str. 301
cugaugugauccaucaggucau

SEQ ID NO: 3925816 - RNA, 17 nt, Shigella flexneri 2a str. 301
cugauguuguuucucuu

SEQ ID NO: 3925817 - RNA, 23 nt, Shigella flexneri 2a str. 301
cugauguuguuucucuuucuuca

SEQ ID NO: 3925818 - RNA, 20 nt, Shigella flexneri 2a str. 301
cugauuaauuuucgcccguu

SEQ ID NO: 3925819 - RNA, 14 nt, Shigella flexneri 2a str. 301
cugauuacccuucg

SEQ ID NO: 3925820 - RNA, 17 nt, Shigella flexneri 2a str. 301
cugauuaccgugaauca

SEQ ID NO: 3925821 - RNA, 14 nt, Shigella flexneri 2a str. 301
cugauuacuuccuu

SEQ ID NO: 3925822 - RNA, 20 nt, Shigella flexneri 2a str. 301
cugauuauccgcaucacucc

SEQ ID NO: 3925823 - RNA, 22 nt, Shigella flexneri 2a str. 301
cugauuauccgcaucacuccac

SEQ ID NO: 3925824 - RNA, 17 nt, Shigella flexneri 2a str. 301
cugauuaugucaucauc

SEQ ID NO: 3925825 - RNA, 22 nt, Shigella flexneri 2a str. 301
cugauuauugauauccaccucc

SEQ ID NO: 3925826 - RNA, 13 nt, Shigella flexneri 2a str. 301
cugauucagauaa

SEQ ID NO: 3925827 - RNA, 18 nt, Shigella flexneri 2a str. 301
cugauucgcgccacguuc

SEQ ID NO: 3925828 - RNA, 18 nt, Shigella flexneri 2a str. 301
cugauucugauccugcac

SEQ ID NO: 3925829 - RNA, 16 nt, Shigella flexneri 2a str. 301
cugauugaaauagcca

SEQ ID NO: 3925830 - RNA, 15 nt, Shigella flexneri 2a str. 301
cugauugcugucggc

SEQ ID NO: 3925831 - RNA, 23 nt, Shigella flexneri 2a str. 301
cugauuggcaucgggaugcuggu

SEQ ID NO: 3925832 - RNA, 13 nt, Shigella flexneri 2a str. 301
cugauuucaccau

SEQ ID NO: 3925833 - RNA, 15 nt, Shigella flexneri 2a str. 301
cugauuugcuucaau

SEQ ID NO: 3925834 - RNA, 13 nt, Shigella flexneri 2a str. 301
cugauuuuauugc

SEQ ID NO: 3925835 - RNA, 18 nt, Shigella flexneri 2a str. 301
cugauuuucaucuucuuc

SEQ ID NO: 3925836 - RNA, 17 nt, Shigella flexneri 2a str. 301
cugauuuuccuccagca

SEQ ID NO: 3925837 - RNA, 22 nt, Shigella flexneri 2a str. 301
cugauuuuccuccagcagcaca

SEQ ID NO: 3925838 - RNA, 15 nt, Shigella flexneri 2a str. 301
cugauuuuuuuucaa

SEQ ID NO: 3925839 - RNA, 16 nt, Shigella flexneri 2a str. 301
cugcaaaauaccaaua

SEQ ID NO: 3925840 - RNA, 17 nt, Shigella flexneri 2a str. 301
cugcaaaauaccaauaa

SEQ ID NO: 3925841 - RNA, 17 nt, Shigella flexneri 2a str. 301
cugcaaaauuuucauug

SEQ ID NO: 3925842 - RNA, 11 nt, Shigella flexneri 2a str. 301
cugcaaaccau

SEQ ID NO: 3925843 - RNA, 20 nt, Shigella flexneri 2a str. 301
cugcaaagcugaugguugaa

SEQ ID NO: 3925844 - RNA, 21 nt, Shigella flexneri 2a str. 301
cugcaaagucugggcuuuugu

SEQ ID NO: 3925845 - RNA, 13 nt, Shigella flexneri 2a str. 301
cugcaaauaaaua

SEQ ID NO: 3925846 - RNA, 14 nt, Shigella flexneri 2a str. 301
cugcaaauacccaa

SEQ ID NO: 3925847 - RNA, 14 nt, Shigella flexneri 2a str. 301
cugcaaauauuaau

SEQ ID NO: 3925848 - RNA, 14 nt, Shigella flexneri 2a str. 301
cugcaaaucaccac

SEQ ID NO: 3925849 - RNA, 16 nt, Shigella flexneri 2a str. 301
cugcaaaucgaucuca

SEQ ID NO: 3925850 - RNA, 14 nt, Shigella flexneri 2a str. 301
cugcaaauucaaua

SEQ ID NO: 3925851 - RNA, 15 nt, Shigella flexneri 2a str. 301
cugcaaauucaauaa

SEQ ID NO: 3925852 - RNA, 23 nt, Shigella flexneri 2a str. 301
cugcaacauacaggugcagccgu

SEQ ID NO: 3925853 - RNA, 13 nt, Shigella flexneri 2a str. 301
cugcaacgagugc

SEQ ID NO: 3925854 - RNA, 15 nt, Shigella flexneri 2a str. 301
cugcaacgucuccgg

SEQ ID NO: 3925855 - RNA, 14 nt, Shigella flexneri 2a str. 301
cugcaacuucucuu

SEQ ID NO: 3925856 - RNA, 19 nt, Shigella flexneri 2a str. 301
cugcaagauuaaaccaguu

SEQ ID NO: 3925857 - RNA, 18 nt, Shigella flexneri 2a str. 301
cugcaaggccauccgcug

SEQ ID NO: 3925858 - RNA, 14 nt, Shigella flexneri 2a str. 301
cugcaaggcucuau

SEQ ID NO: 3925859 - RNA, 18 nt, Shigella flexneri 2a str. 301
cugcaaggugaaagcaau

SEQ ID NO: 3925860 - RNA, 20 nt, Shigella flexneri 2a str. 301
cugcaauaaaauaucuucca

SEQ ID NO: 3925861 - RNA, 21 nt, Shigella flexneri 2a str. 301
cugcaauaaaauaucuuccac

SEQ ID NO: 3925862 - RNA, 15 nt, Shigella flexneri 2a str. 301
cugcaauaccgccgu

SEQ ID NO: 3925863 - RNA, 12 nt, Shigella flexneri 2a str. 301
cugcaaugacca

SEQ ID NO: 3925864 - RNA, 20 nt, Shigella flexneri 2a str. 301
cugcaaugccguuugcugca

SEQ ID NO: 3925865 - RNA, 16 nt, Shigella flexneri 2a str. 301
cugcaauugcggcagg

SEQ ID NO: 3925866 - RNA, 23 nt, Shigella flexneri 2a str. 301
cugcaauugcggcaggucaucgu

SEQ ID NO: 3925867 - RNA, 20 nt, Shigella flexneri 2a str. 301
cugcacaaguuguuuacagu

SEQ ID NO: 3925868 - RNA, 13 nt, Shigella flexneri 2a str. 301
cugcacgaaacca

SEQ ID NO: 3925869 - RNA, 13 nt, Shigella flexneri 2a str. 301
cugcacgccagga

SEQ ID NO: 3925870 - RNA, 19 nt, Shigella flexneri 2a str. 301
cugcacgccaucuggcuga

SEQ ID NO: 3925871 - RNA, 13 nt, Shigella flexneri 2a str. 301
cugcacgcccuga

SEQ ID NO: 3925872 - RNA, 18 nt, Shigella flexneri 2a str. 301
cugcacgcuaguuuccug

SEQ ID NO: 3925873 - RNA, 22 nt, Shigella flexneri 2a str. 301
cugcacggagauauccagcgcc

SEQ ID NO: 3925874 - RNA, 23 nt, Shigella flexneri 2a str. 301
cugcacggagauauccagcgccg

SEQ ID NO: 3925875 - RNA, 20 nt, Shigella flexneri 2a str. 301
cugcacggucacaucgcuga

SEQ ID NO: 3925876 - RNA, 19 nt, Shigella flexneri 2a str. 301
cugcacggugugcggcagg

SEQ ID NO: 3925877 - RNA, 19 nt, Shigella flexneri 2a str. 301
cugcacgguuuuuccagcu

SEQ ID NO: 3925878 - RNA, 21 nt, Shigella flexneri 2a str. 301
cugcacgguuuuuccagcucu

SEQ ID NO: 3925879 - RNA, 20 nt, Shigella flexneri 2a str. 301
cugcacgucauacugcucag

SEQ ID NO: 3925880 - RNA, 19 nt, Shigella flexneri 2a str. 301
cugcacguuggcgcauaac

SEQ ID NO: 3925881 - RNA, 20 nt, Shigella flexneri 2a str. 301
cugcacguuuucaaccguuu

SEQ ID NO: 3925882 - RNA, 15 nt, Shigella flexneri 2a str. 301
cugcacguuuugcug

SEQ ID NO: 3925883 - RNA, 13 nt, Shigella flexneri 2a str. 301
cugcacucaggua

SEQ ID NO: 3925884 - RNA, 15 nt, Shigella flexneri 2a str. 301
cugcacuggcuucca

SEQ ID NO: 3925885 - RNA, 16 nt, Shigella flexneri 2a str. 301
cugcacuggcuuccag

SEQ ID NO: 3925886 - RNA, 21 nt, Shigella flexneri 2a str. 301
cugcacuuaacaggaucuggu

SEQ ID NO: 3925887 - RNA, 15 nt, Shigella flexneri 2a str. 301
cugcagauauucaug

SEQ ID NO: 3925888 - RNA, 14 nt, Shigella flexneri 2a str. 301
cugcagcaucaccg

SEQ ID NO: 3925889 - RNA, 13 nt, Shigella flexneri 2a str. 301
cugcagccagcgu

SEQ ID NO: 3925890 - RNA, 21 nt, Shigella flexneri 2a str. 301
cugcagcggucacauguucca

SEQ ID NO: 3925891 - RNA, 23 nt, Shigella flexneri 2a str. 301
cugcagcucaucuaaugcagggg

SEQ ID NO: 3925892 - RNA, 18 nt, Shigella flexneri 2a str. 301
cugcaggaacggcaauac

SEQ ID NO: 3925893 - RNA, 15 nt, Shigella flexneri 2a str. 301
cugcagggcaucgca

SEQ ID NO: 3925894 - RNA, 14 nt, Shigella flexneri 2a str. 301
cugcagggcuuuca

SEQ ID NO: 3925895 - RNA, 16 nt, Shigella flexneri 2a str. 301
cugcagucaccugccc

SEQ ID NO: 3925896 - RNA, 19 nt, Shigella flexneri 2a str. 301
cugcgucgcuuuccagucg

SEQ ID NO: 3925897 - RNA, 15 nt, Shigella flexneri 2a str. 301
cugcguggaauuugu

SEQ ID NO: 3925898 - RNA, 16 nt, Shigella flexneri 2a str. 301
cugcguggaauuuguc

SEQ ID NO: 3925899 - RNA, 17 nt, Shigella flexneri 2a str. 301
cugcguggcgcgcguca

SEQ ID NO: 3925900 - RNA, 20 nt, Shigella flexneri 2a str. 301
cugcguggucauuaugaccg

SEQ ID NO: 3925901 - RNA, 20 nt, Shigella flexneri 2a str. 301
cugcgugucguaagccaccg

SEQ ID NO: 3925902 - RNA, 20 nt, Shigella flexneri 2a str. 301
cugcguuagaaaacgccugc

SEQ ID NO: 3925903 - RNA, 22 nt, Shigella flexneri 2a str. 301
cugcguuagaaaacgccugcuc

SEQ ID NO: 3925904 - RNA, 14 nt, Shigella flexneri 2a str. 301
cugcguucagcagu

SEQ ID NO: 3925905 - RNA, 18 nt, Shigella flexneri 2a str. 301
cugcguucagcaguucug

SEQ ID NO: 3925906 - RNA, 16 nt, Shigella flexneri 2a str. 301
cugcguuccggcauga

SEQ ID NO: 3925907 - RNA, 13 nt, Shigella flexneri 2a str. 301
cugcguucugucg

SEQ ID NO: 3925908 - RNA, 21 nt, Shigella flexneri 2a str. 301
cugcguuuucgagaaggcgcu

SEQ ID NO: 3925909 - RNA, 12 nt, Shigella flexneri 2a str. 301
cugcuaauuuau

SEQ ID NO: 3925910 - RNA, 14 nt, Shigella flexneri 2a str. 301
cugcuagcuggcuc

SEQ ID NO: 3925911 - RNA, 19 nt, Shigella flexneri 2a str. 301
cugcuagcuggcucgacaa

SEQ ID NO: 3925912 - RNA, 22 nt, Shigella flexneri 2a str. 301
cugcuagcuggcucgacaaaau

SEQ ID NO: 3925913 - RNA, 19 nt, Shigella flexneri 2a str. 301
cugcuaugcaagauguuaa

SEQ ID NO: 3925914 - RNA, 21 nt, Shigella flexneri 2a str. 301
cugcucaacugccaguucccc

SEQ ID NO: 3925915 - RNA, 12 nt, Shigella flexneri 2a str. 301
cugcucaauguc

SEQ ID NO: 3925916 - RNA, 20 nt, Shigella flexneri 2a str. 301
cugcucagacggugaccaga

SEQ ID NO: 3925917 - RNA, 12 nt, Shigella flexneri 2a str. 301
cugcucagcucc

SEQ ID NO: 3925918 - RNA, 14 nt, Shigella flexneri 2a str. 301
cugcucagcuccuc

SEQ ID NO: 3925919 - RNA, 15 nt, Shigella flexneri 2a str. 301
cugcucagcuccucu

SEQ ID NO: 3925920 - RNA, 16 nt, Shigella flexneri 2a str. 301
cugcucagcuccucuu

SEQ ID NO: 3925921 - RNA, 17 nt, Shigella flexneri 2a str. 301
cugcucagcuccucuuu

SEQ ID NO: 3925922 - RNA, 15 nt, Shigella flexneri 2a str. 301
cugcucaucagcggu

SEQ ID NO: 3925923 - RNA, 21 nt, Shigella flexneri 2a str. 301
cugcucauugguccaucuuuu

SEQ ID NO: 3925924 - RNA, 18 nt, Shigella flexneri 2a str. 301
cugcucccuuuggccgcu

SEQ ID NO: 3925925 - RNA, 18 nt, Shigella flexneri 2a str. 301
cugcuccguaaaacucag

SEQ ID NO: 3925926 - RNA, 17 nt, Shigella flexneri 2a str. 301
cugcuccuccuucucac

SEQ ID NO: 3925927 - RNA, 16 nt, Shigella flexneri 2a str. 301
cugcuccugcggcugc

SEQ ID NO: 3925928 - RNA, 17 nt, Shigella flexneri 2a str. 301
cugcuccuguugaugug

SEQ ID NO: 3925929 - RNA, 16 nt, Shigella flexneri 2a str. 301
cugcucgcaucaggga

SEQ ID NO: 3925930 - RNA, 21 nt, Shigella flexneri 2a str. 301
cugcucgccaucagggccgau

SEQ ID NO: 3925931 - RNA, 14 nt, Shigella flexneri 2a str. 301
cugcucgcuggaag

SEQ ID NO: 3925932 - RNA, 16 nt, Shigella flexneri 2a str. 301
cugcucggaaauauuc

SEQ ID NO: 3925933 - RNA, 15 nt, Shigella flexneri 2a str. 301
cugcucgguucgcug

SEQ ID NO: 3925934 - RNA, 22 nt, Shigella flexneri 2a str. 301
cugcucguauaaugacugcccu

SEQ ID NO: 3925935 - RNA, 14 nt, Shigella flexneri 2a str. 301
cugcucguugccug

SEQ ID NO: 3925936 - RNA, 15 nt, Shigella flexneri 2a str. 301
cugcucuucaguagu

SEQ ID NO: 3925937 - RNA, 15 nt, Shigella flexneri 2a str. 301
cugcucuuccggcgu

SEQ ID NO: 3925938 - RNA, 18 nt, Shigella flexneri 2a str. 301
cugcucuucuuucaucau

SEQ ID NO: 3925939 - RNA, 19 nt, Shigella flexneri 2a str. 301
cugcucuuucagcaccgcg

SEQ ID NO: 3925940 - RNA, 19 nt, Shigella flexneri 2a str. 301
cugcucuuuuugcauaauu

SEQ ID NO: 3925941 - RNA, 15 nt, Shigella flexneri 2a str. 301
cugcugaccaccagc

SEQ ID NO: 3925942 - RNA, 17 nt, Shigella flexneri 2a str. 301
cugcugaccaccagcac

SEQ ID NO: 3925943 - RNA, 19 nt, Shigella flexneri 2a str. 301
cugcugacgcagauccuga

SEQ ID NO: 3925944 - RNA, 20 nt, Shigella flexneri 2a str. 301
cugcugacgcuacuggacau

SEQ ID NO: 3925945 - RNA, 20 nt, Shigella flexneri 2a str. 301
cugcugacuuugauccagcc

SEQ ID NO: 3925946 - RNA, 16 nt, Shigella flexneri 2a str. 301
cugcugaggcugaccc

SEQ ID NO: 3925947 - RNA, 18 nt, Shigella flexneri 2a str. 301
cugcugauccagcuucca

SEQ ID NO: 3925948 - RNA, 18 nt, Shigella flexneri 2a str. 301
cugcugauuaacccgacc

SEQ ID NO: 3925949 - RNA, 16 nt, Shigella flexneri 2a str. 301
cugcugcacgcccuga

SEQ ID NO: 3925950 - RNA, 23 nt, Shigella flexneri 2a str. 301
cugcugccggcacaggcaucacu

SEQ ID NO: 3925951 - RNA, 18 nt, Shigella flexneri 2a str. 301
cugcugcguuccggcaug

SEQ ID NO: 3925952 - RNA, 20 nt, Shigella flexneri 2a str. 301
cugcugcuguagccgaugcc

SEQ ID NO: 3925953 - RNA, 18 nt, Shigella flexneri 2a str. 301
cugcuggguaaagacauc

SEQ ID NO: 3925954 - RNA, 14 nt, Shigella flexneri 2a str. 301
cugcuggugaugga

SEQ ID NO: 3925955 - RNA, 13 nt, Shigella flexneri 2a str. 301
cugcuggugccga

SEQ ID NO: 3925956 - RNA, 22 nt, Shigella flexneri 2a str. 301
cugcugguucggcaucgccgcu

SEQ ID NO: 3925957 - RNA, 16 nt, Shigella flexneri 2a str. 301
cugcugguucugcggg

SEQ ID NO: 3925958 - RNA, 18 nt, Shigella flexneri 2a str. 301
cugcuguacuuuuuccuu

SEQ ID NO: 3925959 - RNA, 20 nt, Shigella flexneri 2a str. 301
cugcuguagcaguuccagca

SEQ ID NO: 3925960 - RNA, 20 nt, Shigella flexneri 2a str. 301
cugcugugccguaaauccca

SEQ ID NO: 3925961 - RNA, 14 nt, Shigella flexneri 2a str. 301
cugcuguugcgucu

SEQ ID NO: 3925962 - RNA, 13 nt, Shigella flexneri 2a str. 301
cugcuuacaggcu

SEQ ID NO: 3925963 - RNA, 15 nt, Shigella flexneri 2a str. 301
cugcuuacaggcugg

SEQ ID NO: 3925964 - RNA, 16 nt, Shigella flexneri 2a str. 301
cugcuuacaggcuggu

SEQ ID NO: 3925965 - RNA, 22 nt, Shigella flexneri 2a str. 301
cugcuuaguaaaaauagugcgu

SEQ ID NO: 3925966 - RNA, 20 nt, Shigella flexneri 2a str. 301
cugcuucaaaaaaauucuga

SEQ ID NO: 3925967 - RNA, 23 nt, Shigella flexneri 2a str. 301
cugcuucagccgcacuuuuuaaa

SEQ ID NO: 3925968 - RNA, 22 nt, Shigella flexneri 2a str. 301
cugcuucugccaguuguugcug

SEQ ID NO: 3925969 - RNA, 12 nt, Shigella flexneri 2a str. 301
cugcuucugccg

SEQ ID NO: 3925970 - RNA, 18 nt, Shigella flexneri 2a str. 301
cugcuugaacgcaccgcc

SEQ ID NO: 3925971 - RNA, 16 nt, Shigella flexneri 2a str. 301
cugcuugccagauacg

SEQ ID NO: 3925972 - RNA, 20 nt, Shigella flexneri 2a str. 301
cugcuugcucuggucugcca

SEQ ID NO: 3925973 - RNA, 20 nt, Shigella flexneri 2a str. 301
cugcuugucguaacgauaac

SEQ ID NO: 3925974 - RNA, 16 nt, Shigella flexneri 2a str. 301
cugcuuguuccacuuc

SEQ ID NO: 3925975 - RNA, 18 nt, Shigella flexneri 2a str. 301
cugcuuuacgccagguug

SEQ ID NO: 3925976 - RNA, 21 nt, Shigella flexneri 2a str. 301
cugcuuuaucagaucacgcau

SEQ ID NO: 3925977 - RNA, 16 nt, Shigella flexneri 2a str. 301
cugcuuuuaaccgcuu

SEQ ID NO: 3925978 - RNA, 23 nt, Shigella flexneri 2a str. 301
cugcuuuuaaccgcuuucccagu

SEQ ID NO: 3925979 - RNA, 19 nt, Shigella flexneri 2a str. 301
cugcuuuuccggucagcaa

SEQ ID NO: 3925980 - RNA, 20 nt, Shigella flexneri 2a str. 301
cuggaaaaagugccccagcu

SEQ ID NO: 3925981 - RNA, 21 nt, Shigella flexneri 2a str. 301
cuggaaaaucuacguuaaaaa

SEQ ID NO: 3925982 - RNA, 21 nt, Shigella flexneri 2a str. 301
cuggaaacucacgccagcagc

SEQ ID NO: 3925983 - RNA, 20 nt, Shigella flexneri 2a str. 301
cuggaaagcucuucaugcag

SEQ ID NO: 3925984 - RNA, 14 nt, Shigella flexneri 2a str. 301
cuggaaaucaaaaa

SEQ ID NO: 3925985 - RNA, 24 nt, Shigella flexneri 2a str. 301
cuggaaauguccgcgaacagcagc

SEQ ID NO: 3925986 - RNA, 15 nt, Shigella flexneri 2a str. 301
cuggaacaacguggc

SEQ ID NO: 3925987 - RNA, 17 nt, Shigella flexneri 2a str. 301
cuggaaccacagcgccg

SEQ ID NO: 3925988 - RNA, 13 nt, Shigella flexneri 2a str. 301
cuggaacgaugcc

SEQ ID NO: 3925989 - RNA, 15 nt, Shigella flexneri 2a str. 301
cuggaacugguggau

SEQ ID NO: 3925990 - RNA, 20 nt, Shigella flexneri 2a str. 301
cuggaagaaguaaacgccga

SEQ ID NO: 3925991 - RNA, 23 nt, Shigella flexneri 2a str. 301
cuggaagaguuuguugagauggu

SEQ ID NO: 3925992 - RNA, 14 nt, Shigella flexneri 2a str. 301
cuggaagauucccc

SEQ ID NO: 3925993 - RNA, 14 nt, Shigella flexneri 2a str. 301
cuggaaggugaaau

SEQ ID NO: 3925994 - RNA, 23 nt, Shigella flexneri 2a str. 301
cuggaauggaaacagcaccaucc

SEQ ID NO: 3925995 - RNA, 18 nt, Shigella flexneri 2a str. 301
cuggaauuccuuucccua

SEQ ID NO: 3925996 - RNA, 24 nt, Shigella flexneri 2a str. 301
cuggcucaagcaccauccuguucc

SEQ ID NO: 3925997 - RNA, 18 nt, Shigella flexneri 2a str. 301
cuggcucaucgccuucca

SEQ ID NO: 3925998 - RNA, 16 nt, Shigella flexneri 2a str. 301
cuggcugaacgacaaa

SEQ ID NO: 3925999 - RNA, 22 nt, Shigella flexneri 2a str. 301
cuggcugaccguacccgcugcu

SEQ ID NO: 3926000 - RNA, 21 nt, Shigella flexneri 2a str. 301
cuggcugauaaaacucucauc

SEQ ID NO: 3926001 - RNA, 19 nt, Shigella flexneri 2a str. 301
cuggcugcagaauacggau

SEQ ID NO: 3926002 - RNA, 16 nt, Shigella flexneri 2a str. 301
cuggcugcauggcaau

SEQ ID NO: 3926003 - RNA, 23 nt, Shigella flexneri 2a str. 301
cuggcugcguaagcgccaucuga

SEQ ID NO: 3926004 - RNA, 23 nt, Shigella flexneri 2a str. 301
cuggcugcgugguuuguuccgca

SEQ ID NO: 3926005 - RNA, 16 nt, Shigella flexneri 2a str. 301
cuggcugcuuucuuug

SEQ ID NO: 3926006 - RNA, 12 nt, Shigella flexneri 2a str. 301
cuggcuggauga

SEQ ID NO: 3926007 - RNA, 16 nt, Shigella flexneri 2a str. 301
cuggcuggcaucuuga

SEQ ID NO: 3926008 - RNA, 20 nt, Shigella flexneri 2a str. 301
cuggcuguuucgcuucuuca

SEQ ID NO: 3926009 - RNA, 16 nt, Shigella flexneri 2a str. 301
cuggcuucccggcaau

SEQ ID NO: 3926010 - RNA, 14 nt, Shigella flexneri 2a str. 301
cuggcuucgcuguu

SEQ ID NO: 3926011 - RNA, 13 nt, Shigella flexneri 2a str. 301
cuggcuuucauuu

SEQ ID NO: 3926012 - RNA, 17 nt, Shigella flexneri 2a str. 301
cugggaaaccuggauau

SEQ ID NO: 3926013 - RNA, 18 nt, Shigella flexneri 2a str. 301
cugggaaaucaccaccag

SEQ ID NO: 3926014 - RNA, 16 nt, Shigella flexneri 2a str. 301
cugggacgcagacugg

SEQ ID NO: 3926015 - RNA, 15 nt, Shigella flexneri 2a str. 301
cugggagaacgcugc

SEQ ID NO: 3926016 - RNA, 22 nt, Shigella flexneri 2a str. 301
cugggagaugauaaccccgcaa

SEQ ID NO: 3926017 - RNA, 20 nt, Shigella flexneri 2a str. 301
cugggagauuaccucgaccc

SEQ ID NO: 3926018 - RNA, 19 nt, Shigella flexneri 2a str. 301
cugggaugaucaccugcau

SEQ ID NO: 3926019 - RNA, 15 nt, Shigella flexneri 2a str. 301
cugggauggcaaaac

SEQ ID NO: 3926020 - RNA, 15 nt, Shigella flexneri 2a str. 301
cugggaugugaaaau

SEQ ID NO: 3926021 - RNA, 14 nt, Shigella flexneri 2a str. 301
cugggcaaugcugu

SEQ ID NO: 3926022 - RNA, 20 nt, Shigella flexneri 2a str. 301
cugggcgauuuccuucagca

SEQ ID NO: 3926023 - RNA, 23 nt, Shigella flexneri 2a str. 301
cugggcgauuuccuucagcagca

SEQ ID NO: 3926024 - RNA, 18 nt, Shigella flexneri 2a str. 301
cugggcgauuuucuacuu

SEQ ID NO: 3926025 - RNA, 19 nt, Shigella flexneri 2a str. 301
cugggcgcgcucagcgcca

SEQ ID NO: 3926026 - RNA, 13 nt, Shigella flexneri 2a str. 301
cuggggccgucau

SEQ ID NO: 3926027 - RNA, 19 nt, Shigella flexneri 2a str. 301
cuggggcuugccagagcag

SEQ ID NO: 3926028 - RNA, 23 nt, Shigella flexneri 2a str. 301
cuggggcuuugaugucgcuucca

SEQ ID NO: 3926029 - RNA, 19 nt, Shigella flexneri 2a str. 301
cuggguaacaccaaucagc

SEQ ID NO: 3926030 - RNA, 19 nt, Shigella flexneri 2a str. 301
cuggguagaguuugaacuc

SEQ ID NO: 3926031 - RNA, 21 nt, Shigella flexneri 2a str. 301
cuggguagaguuugaacucac

SEQ ID NO: 3926032 - RNA, 15 nt, Shigella flexneri 2a str. 301
cuggguaguccauga

SEQ ID NO: 3926033 - RNA, 24 nt, Shigella flexneri 2a str. 301
cugggucugcagauauucaugcag

SEQ ID NO: 3926034 - RNA, 19 nt, Shigella flexneri 2a str. 301
cuggguuucgccugccaga

SEQ ID NO: 3926035 - RNA, 14 nt, Shigella flexneri 2a str. 301
cuggguuuucacag

SEQ ID NO: 3926036 - RNA, 20 nt, Shigella flexneri 2a str. 301
cugguaaaaaaugauuuccu

SEQ ID NO: 3926037 - RNA, 15 nt, Shigella flexneri 2a str. 301
cugguaacagugcac

SEQ ID NO: 3926038 - RNA, 18 nt, Shigella flexneri 2a str. 301
cugguaacuggugccagg

SEQ ID NO: 3926039 - RNA, 16 nt, Shigella flexneri 2a str. 301
cugguaaucaccaccc

SEQ ID NO: 3926040 - RNA, 12 nt, Shigella flexneri 2a str. 301
cugguaauccgu

SEQ ID NO: 3926041 - RNA, 16 nt, Shigella flexneri 2a str. 301
cugguaccagcaccgu

SEQ ID NO: 3926042 - RNA, 18 nt, Shigella flexneri 2a str. 301
cugguacucaaccgccac

SEQ ID NO: 3926043 - RNA, 18 nt, Shigella flexneri 2a str. 301
cugguacucgacuguggc

SEQ ID NO: 3926044 - RNA, 20 nt, Shigella flexneri 2a str. 301
cugguagacguucaguuccg

SEQ ID NO: 3926045 - RNA, 14 nt, Shigella flexneri 2a str. 301
cugguagauaagca

SEQ ID NO: 3926046 - RNA, 14 nt, Shigella flexneri 2a str. 301
cugguauuuccagu

SEQ ID NO: 3926047 - RNA, 18 nt, Shigella flexneri 2a str. 301
cugguauuuccaguccag

SEQ ID NO: 3926048 - RNA, 13 nt, Shigella flexneri 2a str. 301
cuggucaccaucu

SEQ ID NO: 3926049 - RNA, 17 nt, Shigella flexneri 2a str. 301
cuggucaccaucuuugu

SEQ ID NO: 3926050 - RNA, 16 nt, Shigella flexneri 2a str. 301
cuggucacucucgacc

SEQ ID NO: 3926051 - RNA, 20 nt, Shigella flexneri 2a str. 301
cuggucauaggccgcugaug

SEQ ID NO: 3926052 - RNA, 15 nt, Shigella flexneri 2a str. 301
cuggucauugccagg

SEQ ID NO: 3926053 - RNA, 14 nt, Shigella flexneri 2a str. 301
cuggucuccuuuac

SEQ ID NO: 3926054 - RNA, 16 nt, Shigella flexneri 2a str. 301
cuggucugaaucaaca

SEQ ID NO: 3926055 - RNA, 12 nt, Shigella flexneri 2a str. 301
cuggucugcugg

SEQ ID NO: 3926056 - RNA, 12 nt, Shigella flexneri 2a str. 301
cuggugaccugg

SEQ ID NO: 3926057 - RNA, 14 nt, Shigella flexneri 2a str. 301
cuggugaccuggga

SEQ ID NO: 3926058 - RNA, 20 nt, Shigella flexneri 2a str. 301
cuggugauacaacgaccggc

SEQ ID NO: 3926059 - RNA, 13 nt, Shigella flexneri 2a str. 301
cuggugauugccg

SEQ ID NO: 3926060 - RNA, 20 nt, Shigella flexneri 2a str. 301
cuggugauugccggaauggu

SEQ ID NO: 3926061 - RNA, 15 nt, Shigella flexneri 2a str. 301
cuggugcaaaaccug

SEQ ID NO: 3926062 - RNA, 18 nt, Shigella flexneri 2a str. 301
cuggugccaagcuccagc

SEQ ID NO: 3926063 - RNA, 14 nt, Shigella flexneri 2a str. 301
cuggugcgagaucg

SEQ ID NO: 3926064 - RNA, 22 nt, Shigella flexneri 2a str. 301
cuggugcggcaaaaacccuucu

SEQ ID NO: 3926065 - RNA, 23 nt, Shigella flexneri 2a str. 301
cuggugcuaacagcaaucccaaa

SEQ ID NO: 3926066 - RNA, 14 nt, Shigella flexneri 2a str. 301
cuggugcuuuuuca

SEQ ID NO: 3926067 - RNA, 22 nt, Shigella flexneri 2a str. 301
cugguggcgagguaggcaguca

SEQ ID NO: 3926068 - RNA, 19 nt, Shigella flexneri 2a str. 301
cuggugggcggcgugauug

SEQ ID NO: 3926069 - RNA, 22 nt, Shigella flexneri 2a str. 301
cugguguaagucggucacaguc

SEQ ID NO: 3926070 - RNA, 22 nt, Shigella flexneri 2a str. 301
cugguguucgauaaccaucccu

SEQ ID NO: 3926071 - RNA, 18 nt, Shigella flexneri 2a str. 301
cugguguucggcauucug

SEQ ID NO: 3926072 - RNA, 22 nt, Shigella flexneri 2a str. 301
cugguguucggcauucugcugg

SEQ ID NO: 3926073 - RNA, 19 nt, Shigella flexneri 2a str. 301
cugguguugcuccccagaa

SEQ ID NO: 3926074 - RNA, 16 nt, Shigella flexneri 2a str. 301
cugguuaccaccugcu

SEQ ID NO: 3926075 - RNA, 22 nt, Shigella flexneri 2a str. 301
cugguuaguuuuagcgcgggga

SEQ ID NO: 3926076 - RNA, 15 nt, Shigella flexneri 2a str. 301
cugguuauauuuccc

SEQ ID NO: 3926077 - RNA, 21 nt, Shigella flexneri 2a str. 301
cugguuaucuuccaccaccac

SEQ ID NO: 3926078 - RNA, 16 nt, Shigella flexneri 2a str. 301
cugguucaagagagaa

SEQ ID NO: 3926079 - RNA, 20 nt, Shigella flexneri 2a str. 301
cugguucugcggguuagucu

SEQ ID NO: 3926080 - RNA, 23 nt, Shigella flexneri 2a str. 301
cugguucugcggguuagucugca

SEQ ID NO: 3926081 - RNA, 19 nt, Shigella flexneri 2a str. 301
cugguuucgaucuggcagc

SEQ ID NO: 3926082 - RNA, 13 nt, Shigella flexneri 2a str. 301
cugguuucucuuc

SEQ ID NO: 3926083 - RNA, 15 nt, Shigella flexneri 2a str. 301
cugguuuuucgauuu

SEQ ID NO: 3926084 - RNA, 21 nt, Shigella flexneri 2a str. 301
cuguaaaacgcgcccucagcc

SEQ ID NO: 3926085 - RNA, 17 nt, Shigella flexneri 2a str. 301
cuguaaaaggcgccauu

SEQ ID NO: 3926086 - RNA, 22 nt, Shigella flexneri 2a str. 301
cuguaaagagugugaauauuca

SEQ ID NO: 3926087 - RNA, 20 nt, Shigella flexneri 2a str. 301
cuguaaauucucaauaucau

SEQ ID NO: 3926088 - RNA, 22 nt, Shigella flexneri 2a str. 301
cuguaaauucucaauaucauca

SEQ ID NO: 3926089 - RNA, 17 nt, Shigella flexneri 2a str. 301
cuguaaccagcgcagac

SEQ ID NO: 3926090 - RNA, 16 nt, Shigella flexneri 2a str. 301
cuguaacgccuuuucc

SEQ ID NO: 3926091 - RNA, 19 nt, Shigella flexneri 2a str. 301
cuguaacgccuuuuccagc

SEQ ID NO: 3926092 - RNA, 14 nt, Shigella flexneri 2a str. 301
cuguaacuggaagu

SEQ ID NO: 3926093 - RNA, 23 nt, Shigella flexneri 2a str. 301
cuguaauaccagccuucuucauc

SEQ ID NO: 3926094 - RNA, 19 nt, Shigella flexneri 2a str. 301
cuguaauuaccagcgccgg

SEQ ID NO: 3926095 - RNA, 14 nt, Shigella flexneri 2a str. 301
cugugguagcggcu

SEQ ID NO: 3926096 - RNA, 20 nt, Shigella flexneri 2a str. 301
cuguguaaacccagccgcgu

SEQ ID NO: 3926097 - RNA, 16 nt, Shigella flexneri 2a str. 301
cuguguaaugcggcug

SEQ ID NO: 3926098 - RNA, 11 nt, Shigella flexneri 2a str. 301
cuguguuuaug

SEQ ID NO: 3926099 - RNA, 13 nt, Shigella flexneri 2a str. 301
cuguuaaccggag

SEQ ID NO: 3926100 - RNA, 22 nt, Shigella flexneri 2a str. 301
cuguuaauaucuuucugccacc

SEQ ID NO: 3926101 - RNA, 17 nt, Shigella flexneri 2a str. 301
cuguuacgccagaacag

SEQ ID NO: 3926102 - RNA, 20 nt, Shigella flexneri 2a str. 301
cuguuaucacuuaacccauu

SEQ ID NO: 3926103 - RNA, 13 nt, Shigella flexneri 2a str. 301
cuguucaaacauu

SEQ ID NO: 3926104 - RNA, 19 nt, Shigella flexneri 2a str. 301
cuguucaguacgaaauaac

SEQ ID NO: 3926105 - RNA, 15 nt, Shigella flexneri 2a str. 301
cuguucauuaaagcc

SEQ ID NO: 3926106 - RNA, 16 nt, Shigella flexneri 2a str. 301
cuguuccagcaaaucc

SEQ ID NO: 3926107 - RNA, 12 nt, Shigella flexneri 2a str. 301
cuguuccccuca

SEQ ID NO: 3926108 - RNA, 15 nt, Shigella flexneri 2a str. 301
cuguuccccucaccc

SEQ ID NO: 3926109 - RNA, 12 nt, Shigella flexneri 2a str. 301
cuguucccuucu

SEQ ID NO: 3926110 - RNA, 15 nt, Shigella flexneri 2a str. 301
cuguuccgccagagc

SEQ ID NO: 3926111 - RNA, 16 nt, Shigella flexneri 2a str. 301
cuguuccggcggcagg

SEQ ID NO: 3926112 - RNA, 15 nt, Shigella flexneri 2a str. 301
cuguuccggcuuugu

SEQ ID NO: 3926113 - RNA, 21 nt, Shigella flexneri 2a str. 301
cuguucgcaaccuaaaccaaa

SEQ ID NO: 3926114 - RNA, 14 nt, Shigella flexneri 2a str. 301
cuguucgccgccgc

SEQ ID NO: 3926115 - RNA, 18 nt, Shigella flexneri 2a str. 301
cuguucgccgccgcuuuc

SEQ ID NO: 3926116 - RNA, 19 nt, Shigella flexneri 2a str. 301
cuguucgguuuugcccaca

SEQ ID NO: 3926117 - RNA, 20 nt, Shigella flexneri 2a str. 301
cuguucgucccgauucagca

SEQ ID NO: 3926118 - RNA, 16 nt, Shigella flexneri 2a str. 301
cuguugaaaagccgga

SEQ ID NO: 3926119 - RNA, 23 nt, Shigella flexneri 2a str. 301
cuguugaagccgccgguagucac

SEQ ID NO: 3926120 - RNA, 22 nt, Shigella flexneri 2a str. 301
cuguuggaaucacucaucaugc

SEQ ID NO: 3926121 - RNA, 18 nt, Shigella flexneri 2a str. 301
cuguugguaacuuacuga

SEQ ID NO: 3926122 - RNA, 14 nt, Shigella flexneri 2a str. 301
cuguuguaaugauu

SEQ ID NO: 3926123 - RNA, 18 nt, Shigella flexneri 2a str. 301
cuguugugaugcaacugu

SEQ ID NO: 3926124 - RNA, 19 nt, Shigella flexneri 2a str. 301
cuguugugccagaccaaac

SEQ ID NO: 3926125 - RNA, 16 nt, Shigella flexneri 2a str. 301
cuguuguucaacacuc

SEQ ID NO: 3926126 - RNA, 18 nt, Shigella flexneri 2a str. 301
cuguuuaauaugcaauuc

SEQ ID NO: 3926127 - RNA, 18 nt, Shigella flexneri 2a str. 301
cuguuuacgcagcucacu

SEQ ID NO: 3926128 - RNA, 19 nt, Shigella flexneri 2a str. 301
cuguuuagccgcuucugca

SEQ ID NO: 3926129 - RNA, 23 nt, Shigella flexneri 2a str. 301
cuguuuagccgcuucugcagcuu

SEQ ID NO: 3926130 - RNA, 20 nt, Shigella flexneri 2a str. 301
cuguuuagcgacucgauggc

SEQ ID NO: 3926131 - RNA, 16 nt, Shigella flexneri 2a str. 301
cuguuuaucuucccag

SEQ ID NO: 3926132 - RNA, 20 nt, Shigella flexneri 2a str. 301
cuguuucaucucuucacgcu

SEQ ID NO: 3926133 - RNA, 18 nt, Shigella flexneri 2a str. 301
cuguuucgcuucuucagc

SEQ ID NO: 3926134 - RNA, 22 nt, Shigella flexneri 2a str. 301
cuguuugaaaugaugucgcugu

SEQ ID NO: 3926135 - RNA, 19 nt, Shigella flexneri 2a str. 301
cuguuugcaggugaccagc

SEQ ID NO: 3926136 - RNA, 12 nt, Shigella flexneri 2a str. 301
cuguuugccagu

SEQ ID NO: 3926137 - RNA, 22 nt, Shigella flexneri 2a str. 301
cuguuugccucguucuucccuc

SEQ ID NO: 3926138 - RNA, 18 nt, Shigella flexneri 2a str. 301
cuguuugcgucagcuuca

SEQ ID NO: 3926139 - RNA, 22 nt, Shigella flexneri 2a str. 301
cuguuugucgaucaucaggccc

SEQ ID NO: 3926140 - RNA, 16 nt, Shigella flexneri 2a str. 301
cuguuuucagcaccag

SEQ ID NO: 3926141 - RNA, 19 nt, Shigella flexneri 2a str. 301
cuguuuuccagcaccacuu

SEQ ID NO: 3926142 - RNA, 16 nt, Shigella flexneri 2a str. 301
cuguuuugucaucuuc

SEQ ID NO: 3926143 - RNA, 19 nt, Shigella flexneri 2a str. 301
cuguuuuucguuuggggca

SEQ ID NO: 3926144 - RNA, 14 nt, Shigella flexneri 2a str. 301
cuguuuuuuauacu

SEQ ID NO: 3926145 - RNA, 15 nt, Shigella flexneri 2a str. 301
cuguuuuuuauacuu

SEQ ID NO: 3926146 - RNA, 15 nt, Shigella flexneri 2a str. 301
cuuaaaaaauuuauu

SEQ ID NO: 3926147 - RNA, 13 nt, Shigella flexneri 2a str. 301
cuuaaaacaauau

SEQ ID NO: 3926148 - RNA, 17 nt, Shigella flexneri 2a str. 301
cuuaaaaucccgccagc

SEQ ID NO: 3926149 - RNA, 15 nt, Shigella flexneri 2a str. 301
cuuaaagucuuugua

SEQ ID NO: 3926150 - RNA, 17 nt, Shigella flexneri 2a str. 301
cuuaaagucuuuguauu

SEQ ID NO: 3926151 - RNA, 20 nt, Shigella flexneri 2a str. 301
cuuaaagucuuuguauuuau

SEQ ID NO: 3926152 - RNA, 23 nt, Shigella flexneri 2a str. 301
cuuaaauaagguuaauuaccuua

SEQ ID NO: 3926153 - RNA, 20 nt, Shigella flexneri 2a str. 301
cuuaacaacgggcaccgccg

SEQ ID NO: 3926154 - RNA, 15 nt, Shigella flexneri 2a str. 301
cuuaacgcaccaugc

SEQ ID NO: 3926155 - RNA, 19 nt, Shigella flexneri 2a str. 301
cuuaacgcgggcuucuucu

SEQ ID NO: 3926156 - RNA, 22 nt, Shigella flexneri 2a str. 301
cuuaacgcgggcuucuucuuuc

SEQ ID NO: 3926157 - RNA, 23 nt, Shigella flexneri 2a str. 301
cuuaacgguguuuaguuucguuc

SEQ ID NO: 3926158 - RNA, 14 nt, Shigella flexneri 2a str. 301
cuuaagccagcgcc

SEQ ID NO: 3926159 - RNA, 14 nt, Shigella flexneri 2a str. 301
cuuaagccaucauc

SEQ ID NO: 3926160 - RNA, 16 nt, Shigella flexneri 2a str. 301
cuuaaggcuguuccca

SEQ ID NO: 3926161 - RNA, 20 nt, Shigella flexneri 2a str. 301
cuuaaggcuguucccacgca

SEQ ID NO: 3926162 - RNA, 17 nt, Shigella flexneri 2a str. 301
cuuaagguucacuuaau

SEQ ID NO: 3926163 - RNA, 22 nt, Shigella flexneri 2a str. 301
cuuaaguuagucgcuuucauuc

SEQ ID NO: 3926164 - RNA, 20 nt, Shigella flexneri 2a str. 301
cuuaaguuugcgccaucggc

SEQ ID NO: 3926165 - RNA, 17 nt, Shigella flexneri 2a str. 301
cuuaauauuaacuuaau

SEQ ID NO: 3926166 - RNA, 14 nt, Shigella flexneri 2a str. 301
cuuaaucaacucac

SEQ ID NO: 3926167 - RNA, 13 nt, Shigella flexneri 2a str. 301
cuuaaucaccagc

SEQ ID NO: 3926168 - RNA, 20 nt, Shigella flexneri 2a str. 301
cuuaaucagaauuuuucgcu

SEQ ID NO: 3926169 - RNA, 17 nt, Shigella flexneri 2a str. 301
cuuaaucaucaaugcca

SEQ ID NO: 3926170 - RNA, 18 nt, Shigella flexneri 2a str. 301
cuuaaucaucaaugccag

SEQ ID NO: 3926171 - RNA, 22 nt, Shigella flexneri 2a str. 301
cuuaaucaucaaugccagcaua

SEQ ID NO: 3926172 - RNA, 23 nt, Shigella flexneri 2a str. 301
cuuaaucaucgcguacucaccgc

SEQ ID NO: 3926173 - RNA, 17 nt, Shigella flexneri 2a str. 301
cuuaaucccauccgcgc

SEQ ID NO: 3926174 - RNA, 22 nt, Shigella flexneri 2a str. 301
cuuaaugcauggcagauaaaca

SEQ ID NO: 3926175 - RNA, 16 nt, Shigella flexneri 2a str. 301
cuuaauggaaaacugu

SEQ ID NO: 3926176 - RNA, 18 nt, Shigella flexneri 2a str. 301
cuuaauggaaaacuguuu

SEQ ID NO: 3926177 - RNA, 17 nt, Shigella flexneri 2a str. 301
cuuaauguaaugcuuug

SEQ ID NO: 3926178 - RNA, 19 nt, Shigella flexneri 2a str. 301
cuuaauugcccgaagccaa

SEQ ID NO: 3926179 - RNA, 14 nt, Shigella flexneri 2a str. 301
cuuacacacccggc

SEQ ID NO: 3926180 - RNA, 17 nt, Shigella flexneri 2a str. 301
cuuacacucaaauaucu

SEQ ID NO: 3926181 - RNA, 16 nt, Shigella flexneri 2a str. 301
cuuacauuccgucuca

SEQ ID NO: 3926182 - RNA, 17 nt, Shigella flexneri 2a str. 301
cuuaccaaauaaacgaa

SEQ ID NO: 3926183 - RNA, 13 nt, Shigella flexneri 2a str. 301
cuuaccacugccg

SEQ ID NO: 3926184 - RNA, 22 nt, Shigella flexneri 2a str. 301
cuuacccggaccgucuuuuuuc

SEQ ID NO: 3926185 - RNA, 16 nt, Shigella flexneri 2a str. 301
cuuacccuaaauccgc

SEQ ID NO: 3926186 - RNA, 18 nt, Shigella flexneri 2a str. 301
cuuaccguccucuuccca

SEQ ID NO: 3926187 - RNA, 15 nt, Shigella flexneri 2a str. 301
cuuaccuacuugcuc

SEQ ID NO: 3926188 - RNA, 17 nt, Shigella flexneri 2a str. 301
cuuaccuuuacguccac

SEQ ID NO: 3926189 - RNA, 20 nt, Shigella flexneri 2a str. 301
cuuacgagugcgcucuucaa

SEQ ID NO: 3926190 - RNA, 15 nt, Shigella flexneri 2a str. 301
cuuacgcaacugcca

SEQ ID NO: 3926191 - RNA, 17 nt, Shigella flexneri 2a str. 301
cuuacgccgacuaauuu

SEQ ID NO: 3926192 - RNA, 16 nt, Shigella flexneri 2a str. 301
cuuacgccugccagcu

SEQ ID NO: 3926193 - RNA, 18 nt, Shigella flexneri 2a str. 301
cuuacgcguucauacuuu

SEQ ID NO: 3926194 - RNA, 18 nt, Shigella flexneri 2a str. 301
cuuacggauaauuauuua

SEQ ID NO: 3926195 - RNA, 21 nt, Shigella flexneri 2a str. 301
cuucacuuccccgagcucaau

SEQ ID NO: 3926196 - RNA, 15 nt, Shigella flexneri 2a str. 301
cuucacuucuuaccg

SEQ ID NO: 3926197 - RNA, 16 nt, Shigella flexneri 2a str. 301
cuucacuucuucuuca

SEQ ID NO: 3926198 - RNA, 23 nt, Shigella flexneri 2a str. 301
cuucagacggucagcgagauaac

SEQ ID NO: 3926199 - RNA, 19 nt, Shigella flexneri 2a str. 301
cuucagcaacaaaauggca

SEQ ID NO: 3926200 - RNA, 21 nt, Shigella flexneri 2a str. 301
cuucagcaacaaaauggcaaa

SEQ ID NO: 3926201 - RNA, 21 nt, Shigella flexneri 2a str. 301
cuucagcaacuuguucacgcc

SEQ ID NO: 3926202 - RNA, 23 nt, Shigella flexneri 2a str. 301
cuucagcaacuuguucacgccau

SEQ ID NO: 3926203 - RNA, 14 nt, Shigella flexneri 2a str. 301
cuucagcaagcgau

SEQ ID NO: 3926204 - RNA, 24 nt, Shigella flexneri 2a str. 301
cuucagccaccagguucaacagcg

SEQ ID NO: 3926205 - RNA, 16 nt, Shigella flexneri 2a str. 301
cuucagccccuccaca

SEQ ID NO: 3926206 - RNA, 22 nt, Shigella flexneri 2a str. 301
cuucagccgcaaaccuggcaac

SEQ ID NO: 3926207 - RNA, 12 nt, Shigella flexneri 2a str. 301
cuucagcggcag

SEQ ID NO: 3926208 - RNA, 22 nt, Shigella flexneri 2a str. 301
cuucaggacccuuaaaggguca

SEQ ID NO: 3926209 - RNA, 23 nt, Shigella flexneri 2a str. 301
cuucaggaucaaccgcuacauac

SEQ ID NO: 3926210 - RNA, 11 nt, Shigella flexneri 2a str. 301
cuucaggcaca

SEQ ID NO: 3926211 - RNA, 15 nt, Shigella flexneri 2a str. 301
cuucaguuccgcugc

SEQ ID NO: 3926212 - RNA, 17 nt, Shigella flexneri 2a str. 301
cuucaguuccgcugcaa

SEQ ID NO: 3926213 - RNA, 20 nt, Shigella flexneri 2a str. 301
cuucaguuuuucccgcuucg

SEQ ID NO: 3926214 - RNA, 19 nt, Shigella flexneri 2a str. 301
cuucauaaagauaauguaa

SEQ ID NO: 3926215 - RNA, 22 nt, Shigella flexneri 2a str. 301
cuucauaacuuugaucgcguuu

SEQ ID NO: 3926216 - RNA, 15 nt, Shigella flexneri 2a str. 301
cuucauacaccacua

SEQ ID NO: 3926217 - RNA, 14 nt, Shigella flexneri 2a str. 301
cuucauacuaccug

SEQ ID NO: 3926218 - RNA, 22 nt, Shigella flexneri 2a str. 301
cuucauagauagccagcaacau

SEQ ID NO: 3926219 - RNA, 12 nt, Shigella flexneri 2a str. 301
cuucauaggcuu

SEQ ID NO: 3926220 - RNA, 15 nt, Shigella flexneri 2a str. 301
cuucauagguaaaca

SEQ ID NO: 3926221 - RNA, 22 nt, Shigella flexneri 2a str. 301
cuucaucauaacccuuuccuuc

SEQ ID NO: 3926222 - RNA, 14 nt, Shigella flexneri 2a str. 301
cuucaucaucgcag

SEQ ID NO: 3926223 - RNA, 15 nt, Shigella flexneri 2a str. 301
cuucauccaccgauu

SEQ ID NO: 3926224 - RNA, 16 nt, Shigella flexneri 2a str. 301
cuucauccagcaucau

SEQ ID NO: 3926225 - RNA, 14 nt, Shigella flexneri 2a str. 301
cuucaucccugaaa

SEQ ID NO: 3926226 - RNA, 23 nt, Shigella flexneri 2a str. 301
cuucaucccuuucgcuucaagua

SEQ ID NO: 3926227 - RNA, 22 nt, Shigella flexneri 2a str. 301
cuucauccgccccggcuucaaa

SEQ ID NO: 3926228 - RNA, 18 nt, Shigella flexneri 2a str. 301
cuucauccggauacagcc

SEQ ID NO: 3926229 - RNA, 21 nt, Shigella flexneri 2a str. 301
cuucauccuucacacugccuc

SEQ ID NO: 3926230 - RNA, 13 nt, Shigella flexneri 2a str. 301
cuucaucgucaua

SEQ ID NO: 3926231 - RNA, 17 nt, Shigella flexneri 2a str. 301
cuucaucgugcucgcuu

SEQ ID NO: 3926232 - RNA, 18 nt, Shigella flexneri 2a str. 301
cuucaucgugcucgcuuu

SEQ ID NO: 3926233 - RNA, 21 nt, Shigella flexneri 2a str. 301
cuucaucgugcucgcuuucca

SEQ ID NO: 3926234 - RNA, 15 nt, Shigella flexneri 2a str. 301
cuucaucucagugag

SEQ ID NO: 3926235 - RNA, 17 nt, Shigella flexneri 2a str. 301
cuucaucucagugagau

SEQ ID NO: 3926236 - RNA, 13 nt, Shigella flexneri 2a str. 301
cuucaugaccuuc

SEQ ID NO: 3926237 - RNA, 19 nt, Shigella flexneri 2a str. 301
cuucaugcagcauggucag

SEQ ID NO: 3926238 - RNA, 22 nt, Shigella flexneri 2a str. 301
cuucauggggaugcugaaaaga

SEQ ID NO: 3926239 - RNA, 22 nt, Shigella flexneri 2a str. 301
cuucauuaaauuuccgcgaaac

SEQ ID NO: 3926240 - RNA, 13 nt, Shigella flexneri 2a str. 301
cuucauuaccuuc

SEQ ID NO: 3926241 - RNA, 14 nt, Shigella flexneri 2a str. 301
cuucauuaccuuca

SEQ ID NO: 3926242 - RNA, 15 nt, Shigella flexneri 2a str. 301
cuucauuaccuuuuu

SEQ ID NO: 3926243 - RNA, 17 nt, Shigella flexneri 2a str. 301
cuucauuaccuuuuuuc

SEQ ID NO: 3926244 - RNA, 19 nt, Shigella flexneri 2a str. 301
cuucauuaccuuuuuuccc

SEQ ID NO: 3926245 - RNA, 13 nt, Shigella flexneri 2a str. 301
cuucauuauccuu

SEQ ID NO: 3926246 - RNA, 19 nt, Shigella flexneri 2a str. 301
cuucauucagacaggcgaa

SEQ ID NO: 3926247 - RNA, 15 nt, Shigella flexneri 2a str. 301
cuucauugacgccaa

SEQ ID NO: 3926248 - RNA, 12 nt, Shigella flexneri 2a str. 301
cuucauugcucu

SEQ ID NO: 3926249 - RNA, 13 nt, Shigella flexneri 2a str. 301
cuucauugcucuc

SEQ ID NO: 3926250 - RNA, 21 nt, Shigella flexneri 2a str. 301
cuucauugcucucuucuccuu

SEQ ID NO: 3926251 - RNA, 17 nt, Shigella flexneri 2a str. 301
cuucauuugccagcuuc

SEQ ID NO: 3926252 - RNA, 15 nt, Shigella flexneri 2a str. 301
cuuccaccacgucca

SEQ ID NO: 3926253 - RNA, 16 nt, Shigella flexneri 2a str. 301
cuuccaccacuuccug

SEQ ID NO: 3926254 - RNA, 19 nt, Shigella flexneri 2a str. 301
cuuccaccguuucuuuuuc

SEQ ID NO: 3926255 - RNA, 15 nt, Shigella flexneri 2a str. 301
cuuccacgccugcau

SEQ ID NO: 3926256 - RNA, 12 nt, Shigella flexneri 2a str. 301
cuuccacuuccu

SEQ ID NO: 3926257 - RNA, 16 nt, Shigella flexneri 2a str. 301
cuuccacuuccugcgg

SEQ ID NO: 3926258 - RNA, 23 nt, Shigella flexneri 2a str. 301
cuuccagaucaccgcagaagcga

SEQ ID NO: 3926259 - RNA, 15 nt, Shigella flexneri 2a str. 301
cuuccagauucaguu

SEQ ID NO: 3926260 - RNA, 15 nt, Shigella flexneri 2a str. 301
cuuccagcaaaucca

SEQ ID NO: 3926261 - RNA, 17 nt, Shigella flexneri 2a str. 301
cuuccagcaaauccauc

SEQ ID NO: 3926262 - RNA, 22 nt, Shigella flexneri 2a str. 301
cuuccagcagaccagcaauaac

SEQ ID NO: 3926263 - RNA, 18 nt, Shigella flexneri 2a str. 301
cuuccagcaguucgcccg

SEQ ID NO: 3926264 - RNA, 11 nt, Shigella flexneri 2a str. 301
cuuccagcauc

SEQ ID NO: 3926265 - RNA, 14 nt, Shigella flexneri 2a str. 301
cuuccagcgauaau

SEQ ID NO: 3926266 - RNA, 18 nt, Shigella flexneri 2a str. 301
cuuccagcgcaucugccg

SEQ ID NO: 3926267 - RNA, 12 nt, Shigella flexneri 2a str. 301
cuuccagcgcca

SEQ ID NO: 3926268 - RNA, 17 nt, Shigella flexneri 2a str. 301
cuuccagcggcaggccg

SEQ ID NO: 3926269 - RNA, 19 nt, Shigella flexneri 2a str. 301
cuuccagcguucgccaaac

SEQ ID NO: 3926270 - RNA, 20 nt, Shigella flexneri 2a str. 301
cuuccagcguucgccaaacc

SEQ ID NO: 3926271 - RNA, 22 nt, Shigella flexneri 2a str. 301
cuuccagcguucgccaaaccca

SEQ ID NO: 3926272 - RNA, 12 nt, Shigella flexneri 2a str. 301
cuuccagcucca

SEQ ID NO: 3926273 - RNA, 15 nt, Shigella flexneri 2a str. 301
cuuccagcuccagcc

SEQ ID NO: 3926274 - RNA, 15 nt, Shigella flexneri 2a str. 301
cuuccaggguaaaca

SEQ ID NO: 3926275 - RNA, 22 nt, Shigella flexneri 2a str. 301
cuuccaggucaaccuagccuuc

SEQ ID NO: 3926276 - RNA, 20 nt, Shigella flexneri 2a str. 301
cuuccaguacgcgcaacccc

SEQ ID NO: 3926277 - RNA, 17 nt, Shigella flexneri 2a str. 301
cuuccaguugcacgcca

SEQ ID NO: 3926278 - RNA, 19 nt, Shigella flexneri 2a str. 301
cuuccaguuugcucaaauc

SEQ ID NO: 3926279 - RNA, 13 nt, Shigella flexneri 2a str. 301
cuuccaucacaaa

SEQ ID NO: 3926280 - RNA, 19 nt, Shigella flexneri 2a str. 301
cuuccaucgcaucuucgcc

SEQ ID NO: 3926281 - RNA, 20 nt, Shigella flexneri 2a str. 301
cuuccaucguccgugaagaa

SEQ ID NO: 3926282 - RNA, 22 nt, Shigella flexneri 2a str. 301
cuuccauugccgcuuuccaggc

SEQ ID NO: 3926283 - RNA, 18 nt, Shigella flexneri 2a str. 301
cuuccauuucaucgccag

SEQ ID NO: 3926284 - RNA, 13 nt, Shigella flexneri 2a str. 301
cuucccagcccag

SEQ ID NO: 3926285 - RNA, 12 nt, Shigella flexneri 2a str. 301
cuucccagcgca

SEQ ID NO: 3926286 - RNA, 15 nt, Shigella flexneri 2a str. 301
cuucccaguguucug

SEQ ID NO: 3926287 - RNA, 16 nt, Shigella flexneri 2a str. 301
cuuccccgcuucagcc

SEQ ID NO: 3926288 - RNA, 14 nt, Shigella flexneri 2a str. 301
cuuccccuucucgu

SEQ ID NO: 3926289 - RNA, 15 nt, Shigella flexneri 2a str. 301
cuucccgcagccacg

SEQ ID NO: 3926290 - RNA, 14 nt, Shigella flexneri 2a str. 301
cuucccgcauccag

SEQ ID NO: 3926291 - RNA, 13 nt, Shigella flexneri 2a str. 301
cuucccgccuguc

SEQ ID NO: 3926292 - RNA, 17 nt, Shigella flexneri 2a str. 301
cuucccgucuacaaaaa

SEQ ID NO: 3926293 - RNA, 16 nt, Shigella flexneri 2a str. 301
cuucccucuacaggaa

SEQ ID NO: 3926294 - RNA, 21 nt, Shigella flexneri 2a str. 301
cuucccugcugaauccccuuc

SEQ ID NO: 3926295 - RNA, 15 nt, Shigella flexneri 2a str. 301
cuucucuucuuccgc

SEQ ID NO: 3926296 - RNA, 21 nt, Shigella flexneri 2a str. 301
cuucugacauaaccacucacc

SEQ ID NO: 3926297 - RNA, 23 nt, Shigella flexneri 2a str. 301
cuucugacuauauaaauuacccu

SEQ ID NO: 3926298 - RNA, 17 nt, Shigella flexneri 2a str. 301
cuucugaucuacagccu

SEQ ID NO: 3926299 - RNA, 19 nt, Shigella flexneri 2a str. 301
cuucugcaacgucuccggu

SEQ ID NO: 3926300 - RNA, 14 nt, Shigella flexneri 2a str. 301
cuucugcacgccag

SEQ ID NO: 3926301 - RNA, 17 nt, Shigella flexneri 2a str. 301
cuucugccacuucuucg

SEQ ID NO: 3926302 - RNA, 20 nt, Shigella flexneri 2a str. 301
cuucugcuuucauucgguuu

SEQ ID NO: 3926303 - RNA, 22 nt, Shigella flexneri 2a str. 301
cuucuggcgacauuuucucuac

SEQ ID NO: 3926304 - RNA, 22 nt, Shigella flexneri 2a str. 301
cuucuggcgacccguuuuucuu

SEQ ID NO: 3926305 - RNA, 15 nt, Shigella flexneri 2a str. 301
cuucuggcggcggca

SEQ ID NO: 3926306 - RNA, 20 nt, Shigella flexneri 2a str. 301
cuucuggcguacgcauucuc

SEQ ID NO: 3926307 - RNA, 14 nt, Shigella flexneri 2a str. 301
cuucuggcuacuga

SEQ ID NO: 3926308 - RNA, 17 nt, Shigella flexneri 2a str. 301
cuucuggcuacugaugg

SEQ ID NO: 3926309 - RNA, 20 nt, Shigella flexneri 2a str. 301
cuucugguaacagcggacgg

SEQ ID NO: 3926310 - RNA, 19 nt, Shigella flexneri 2a str. 301
cuucuggugauaggcguug

SEQ ID NO: 3926311 - RNA, 17 nt, Shigella flexneri 2a str. 301
cuucugguuauauuucc

SEQ ID NO: 3926312 - RNA, 18 nt, Shigella flexneri 2a str. 301
cuucugguuauauuuccc

SEQ ID NO: 3926313 - RNA, 15 nt, Shigella flexneri 2a str. 301
cuucugguuuuucug

SEQ ID NO: 3926314 - RNA, 16 nt, Shigella flexneri 2a str. 301
cuucuguuuuaccugc

SEQ ID NO: 3926315 - RNA, 18 nt, Shigella flexneri 2a str. 301
cuucuucaaccgucgcgc

SEQ ID NO: 3926316 - RNA, 15 nt, Shigella flexneri 2a str. 301
cuucuucacuucuuc

SEQ ID NO: 3926317 - RNA, 15 nt, Shigella flexneri 2a str. 301
cuucuucaguuuuuc

SEQ ID NO: 3926318 - RNA, 17 nt, Shigella flexneri 2a str. 301
cuucuucauucauccgc

SEQ ID NO: 3926319 - RNA, 20 nt, Shigella flexneri 2a str. 301
cuucuuccauaccgaccaug

SEQ ID NO: 3926320 - RNA, 14 nt, Shigella flexneri 2a str. 301
cuucuucgcuuucg

SEQ ID NO: 3926321 - RNA, 23 nt, Shigella flexneri 2a str. 301
cuucuucguagggucacguucca

SEQ ID NO: 3926322 - RNA, 23 nt, Shigella flexneri 2a str. 301
cuucuucgugggccgcugaacug

SEQ ID NO: 3926323 - RNA, 15 nt, Shigella flexneri 2a str. 301
cuucuucuacugcgc

SEQ ID NO: 3926324 - RNA, 14 nt, Shigella flexneri 2a str. 301
cuucuucucagcca

SEQ ID NO: 3926325 - RNA, 16 nt, Shigella flexneri 2a str. 301
cuucuucuggcugcca

SEQ ID NO: 3926326 - RNA, 22 nt, Shigella flexneri 2a str. 301
cuucuuuugucgugcccugcgc

SEQ ID NO: 3926327 - RNA, 20 nt, Shigella flexneri 2a str. 301
cuucuuuuuuauggcuggca

SEQ ID NO: 3926328 - RNA, 16 nt, Shigella flexneri 2a str. 301
cuugaacuuaucauca

SEQ ID NO: 3926329 - RNA, 15 nt, Shigella flexneri 2a str. 301
cuugaagccuucgcc

SEQ ID NO: 3926330 - RNA, 16 nt, Shigella flexneri 2a str. 301
cuugacaucaccgccg

SEQ ID NO: 3926331 - RNA, 18 nt, Shigella flexneri 2a str. 301
cuugacucuguagcggga

SEQ ID NO: 3926332 - RNA, 20 nt, Shigella flexneri 2a str. 301
cuugagcccuggccacaaac

SEQ ID NO: 3926333 - RNA, 14 nt, Shigella flexneri 2a str. 301
cuugaggugguagu

SEQ ID NO: 3926334 - RNA, 19 nt, Shigella flexneri 2a str. 301
cuugauaacgagcaauaga

SEQ ID NO: 3926335 - RNA, 18 nt, Shigella flexneri 2a str. 301
cuugauagaacaaaagac

SEQ ID NO: 3926336 - RNA, 18 nt, Shigella flexneri 2a str. 301
cuugauauaaaucccagg

SEQ ID NO: 3926337 - RNA, 21 nt, Shigella flexneri 2a str. 301
cuugauuauuucccucguuuu

SEQ ID NO: 3926338 - RNA, 23 nt, Shigella flexneri 2a str. 301
cuugauugggguugcagaaacaa

SEQ ID NO: 3926339 - RNA, 15 nt, Shigella flexneri 2a str. 301
cuugcaaaaucaaua

SEQ ID NO: 3926340 - RNA, 21 nt, Shigella flexneri 2a str. 301
cuugcaagaucgcucaucagc

SEQ ID NO: 3926341 - RNA, 18 nt, Shigella flexneri 2a str. 301
cuugcaagccuguaguac

SEQ ID NO: 3926342 - RNA, 22 nt, Shigella flexneri 2a str. 301
cuugcaauaauuuacagccugc

SEQ ID NO: 3926343 - RNA, 21 nt, Shigella flexneri 2a str. 301
cuugcaccggcgacaucccag

SEQ ID NO: 3926344 - RNA, 17 nt, Shigella flexneri 2a str. 301
cuugcacucgcagaagc

SEQ ID NO: 3926345 - RNA, 18 nt, Shigella flexneri 2a str. 301
cuugcacucgcagaagca

SEQ ID NO: 3926346 - RNA, 20 nt, Shigella flexneri 2a str. 301
cuugcacucgcagaagcagu

SEQ ID NO: 3926347 - RNA, 18 nt, Shigella flexneri 2a str. 301
cuugcagucggcuuucuc

SEQ ID NO: 3926348 - RNA, 14 nt, Shigella flexneri 2a str. 301
cuugccaacgcaaa

SEQ ID NO: 3926349 - RNA, 22 nt, Shigella flexneri 2a str. 301
cuugccaagugccggucugaau

SEQ ID NO: 3926350 - RNA, 15 nt, Shigella flexneri 2a str. 301
cuugccagagcagca

SEQ ID NO: 3926351 - RNA, 18 nt, Shigella flexneri 2a str. 301
cuugccagauacgauguu

SEQ ID NO: 3926352 - RNA, 17 nt, Shigella flexneri 2a str. 301
cuugccagaugccagga

SEQ ID NO: 3926353 - RNA, 16 nt, Shigella flexneri 2a str. 301
cuugccagcaggguuu

SEQ ID NO: 3926354 - RNA, 15 nt, Shigella flexneri 2a str. 301
cuugccauuccacaa

SEQ ID NO: 3926355 - RNA, 15 nt, Shigella flexneri 2a str. 301
cuugcccaggugugu

SEQ ID NO: 3926356 - RNA, 22 nt, Shigella flexneri 2a str. 301
cuugccgcaaaacccaggcuua

SEQ ID NO: 3926357 - RNA, 23 nt, Shigella flexneri 2a str. 301
cuugccgcgucuuaucaggccua

SEQ ID NO: 3926358 - RNA, 13 nt, Shigella flexneri 2a str. 301
cuugccuuuccuc

SEQ ID NO: 3926359 - RNA, 17 nt, Shigella flexneri 2a str. 301
cuugccuuuccuccugu

SEQ ID NO: 3926360 - RNA, 20 nt, Shigella flexneri 2a str. 301
cuugcgagacggcggaaagg

SEQ ID NO: 3926361 - RNA, 20 nt, Shigella flexneri 2a str. 301
cuugcgauauucuucaguau

SEQ ID NO: 3926362 - RNA, 16 nt, Shigella flexneri 2a str. 301
cuugcgauccugcaga

SEQ ID NO: 3926363 - RNA, 19 nt, Shigella flexneri 2a str. 301
cuugcgccgcuuucucugc

SEQ ID NO: 3926364 - RNA, 19 nt, Shigella flexneri 2a str. 301
cuugcggaagcgucaaggu

SEQ ID NO: 3926365 - RNA, 20 nt, Shigella flexneri 2a str. 301
cuugcggcuuaacugucgcu

SEQ ID NO: 3926366 - RNA, 23 nt, Shigella flexneri 2a str. 301
cuugcguacaccaacaucacgca

SEQ ID NO: 3926367 - RNA, 18 nt, Shigella flexneri 2a str. 301
cuugcguaucgacggcgu

SEQ ID NO: 3926368 - RNA, 12 nt, Shigella flexneri 2a str. 301
cuugcgucacau

SEQ ID NO: 3926369 - RNA, 21 nt, Shigella flexneri 2a str. 301
cuugcguuuuucaucuuccgu

SEQ ID NO: 3926370 - RNA, 22 nt, Shigella flexneri 2a str. 301
cuugcuaaccaacaaugcaaaa

SEQ ID NO: 3926371 - RNA, 14 nt, Shigella flexneri 2a str. 301
cuugcucaaugagu

SEQ ID NO: 3926372 - RNA, 19 nt, Shigella flexneri 2a str. 301
cuugcuccacaagcuccgg

SEQ ID NO: 3926373 - RNA, 19 nt, Shigella flexneri 2a str. 301
cuugcuccacguucagaga

SEQ ID NO: 3926374 - RNA, 22 nt, Shigella flexneri 2a str. 301
cuugcucgcgcaccuacagcca

SEQ ID NO: 3926375 - RNA, 23 nt, Shigella flexneri 2a str. 301
cuugcugcauugagguaaacaga

SEQ ID NO: 3926376 - RNA, 15 nt, Shigella flexneri 2a str. 301
cuugcuggucacuga

SEQ ID NO: 3926377 - RNA, 18 nt, Shigella flexneri 2a str. 301
cuugcuggucacugacca

SEQ ID NO: 3926378 - RNA, 16 nt, Shigella flexneri 2a str. 301
cuugcuguuugcgauu

SEQ ID NO: 3926379 - RNA, 20 nt, Shigella flexneri 2a str. 301
cuugcuuuccagcuucaaau

SEQ ID NO: 3926380 - RNA, 14 nt, Shigella flexneri 2a str. 301
cuuggcaagcccag

SEQ ID NO: 3926381 - RNA, 15 nt, Shigella flexneri 2a str. 301
cuuggcaucuugaac

SEQ ID NO: 3926382 - RNA, 15 nt, Shigella flexneri 2a str. 301
cuuggcuauaaccug

SEQ ID NO: 3926383 - RNA, 12 nt, Shigella flexneri 2a str. 301
cuuggcuuccau

SEQ ID NO: 3926384 - RNA, 16 nt, Shigella flexneri 2a str. 301
cuugguaaugacucca

SEQ ID NO: 3926385 - RNA, 14 nt, Shigella flexneri 2a str. 301
cuugguuuugccau

SEQ ID NO: 3926386 - RNA, 18 nt, Shigella flexneri 2a str. 301
cuuguaacagaguaucca

SEQ ID NO: 3926387 - RNA, 16 nt, Shigella flexneri 2a str. 301
cuuguacccuuaacuc

SEQ ID NO: 3926388 - RNA, 18 nt, Shigella flexneri 2a str. 301
cuuguacucuacaaccag

SEQ ID NO: 3926389 - RNA, 13 nt, Shigella flexneri 2a str. 301
cuuguaggaauca

SEQ ID NO: 3926390 - RNA, 17 nt, Shigella flexneri 2a str. 301
cuuguauaucaaaccac

SEQ ID NO: 3926391 - RNA, 22 nt, Shigella flexneri 2a str. 301
cuugucaaacgggcuucuaauc

SEQ ID NO: 3926392 - RNA, 20 nt, Shigella flexneri 2a str. 301
cuugucaccguaaccaccag

SEQ ID NO: 3926393 - RNA, 16 nt, Shigella flexneri 2a str. 301
cuugucacgucucauc

SEQ ID NO: 3926394 - RNA, 22 nt, Shigella flexneri 2a str. 301
cuuucccuucacucugcugcca

SEQ ID NO: 3926395 - RNA, 13 nt, Shigella flexneri 2a str. 301
cuuucccuucucg

SEQ ID NO: 3926396 - RNA, 19 nt, Shigella flexneri 2a str. 301
cuuuccgcuggcgucuggg

SEQ ID NO: 3926397 - RNA, 17 nt, Shigella flexneri 2a str. 301
cuuuccggcaucacauc

SEQ ID NO: 3926398 - RNA, 15 nt, Shigella flexneri 2a str. 301
cuuuccucacuccuu

SEQ ID NO: 3926399 - RNA, 19 nt, Shigella flexneri 2a str. 301
cuuuccuccugucuucccu

SEQ ID NO: 3926400 - RNA, 13 nt, Shigella flexneri 2a str. 301
cuuuccugcugcg

SEQ ID NO: 3926401 - RNA, 18 nt, Shigella flexneri 2a str. 301
cuuuccuggucggcaaac

SEQ ID NO: 3926402 - RNA, 20 nt, Shigella flexneri 2a str. 301
cuuucgaaaucauucgcagu

SEQ ID NO: 3926403 - RNA, 21 nt, Shigella flexneri 2a str. 301
cuuucgaaaucauucgcaguu

SEQ ID NO: 3926404 - RNA, 22 nt, Shigella flexneri 2a str. 301
cuuucgaauguggcagcaacug

SEQ ID NO: 3926405 - RNA, 20 nt, Shigella flexneri 2a str. 301
cuuucgacagcgauuccagu

SEQ ID NO: 3926406 - RNA, 21 nt, Shigella flexneri 2a str. 301
cuuucgagaagcaagcauuau

SEQ ID NO: 3926407 - RNA, 18 nt, Shigella flexneri 2a str. 301
cuuucgagcaauuuuccu

SEQ ID NO: 3926408 - RNA, 21 nt, Shigella flexneri 2a str. 301
cuuucgagcaauuuuccuuga

SEQ ID NO: 3926409 - RNA, 22 nt, Shigella flexneri 2a str. 301
cuuucgauuucggcgugcgcgc

SEQ ID NO: 3926410 - RNA, 13 nt, Shigella flexneri 2a str. 301
cuuucgcaaauau

SEQ ID NO: 3926411 - RNA, 19 nt, Shigella flexneri 2a str. 301
cuuucgcggcaaccugauc

SEQ ID NO: 3926412 - RNA, 15 nt, Shigella flexneri 2a str. 301
cuuucgcuguaaacg

SEQ ID NO: 3926413 - RNA, 15 nt, Shigella flexneri 2a str. 301
cuuucgcuucaagua

SEQ ID NO: 3926414 - RNA, 16 nt, Shigella flexneri 2a str. 301
cuuucgcuuucucuuc

SEQ ID NO: 3926415 - RNA, 20 nt, Shigella flexneri 2a str. 301
cuuucgucugguucgccaaa

SEQ ID NO: 3926416 - RNA, 14 nt, Shigella flexneri 2a str. 301
cuuucgugaagcug

SEQ ID NO: 3926417 - RNA, 19 nt, Shigella flexneri 2a str. 301
cuuucguggugagggcaaa

SEQ ID NO: 3926418 - RNA, 21 nt, Shigella flexneri 2a str. 301
cuuucguggugagggcaaaca

SEQ ID NO: 3926419 - RNA, 14 nt, Shigella flexneri 2a str. 301
cuuucguuaaauuc

SEQ ID NO: 3926420 - RNA, 18 nt, Shigella flexneri 2a str. 301
cuuucguuaaauucuucu

SEQ ID NO: 3926421 - RNA, 22 nt, Shigella flexneri 2a str. 301
cuuucguuaaauucuucugaau

SEQ ID NO: 3926422 - RNA, 23 nt, Shigella flexneri 2a str. 301
cuuucguuaaauucuucugaaug

SEQ ID NO: 3926423 - RNA, 19 nt, Shigella flexneri 2a str. 301
cuuucguuugaaaacuggc

SEQ ID NO: 3926424 - RNA, 21 nt, Shigella flexneri 2a str. 301
cuuucuauaagauacuggaua

SEQ ID NO: 3926425 - RNA, 23 nt, Shigella flexneri 2a str. 301
cuuucucaauuaacgguaauaau

SEQ ID NO: 3926426 - RNA, 14 nt, Shigella flexneri 2a str. 301
cuuucucuucaucu

SEQ ID NO: 3926427 - RNA, 16 nt, Shigella flexneri 2a str. 301
cuuucucuucaucuau

SEQ ID NO: 3926428 - RNA, 14 nt, Shigella flexneri 2a str. 301
cuuucugaaggauu

SEQ ID NO: 3926429 - RNA, 19 nt, Shigella flexneri 2a str. 301
cuuucugaaggauuagccg

SEQ ID NO: 3926430 - RNA, 16 nt, Shigella flexneri 2a str. 301
cuuucugagcaucaca

SEQ ID NO: 3926431 - RNA, 20 nt, Shigella flexneri 2a str. 301
cuuucugagcggccuuuucc

SEQ ID NO: 3926432 - RNA, 23 nt, Shigella flexneri 2a str. 301
cuuucugcccgcguuuccacgcu

SEQ ID NO: 3926433 - RNA, 18 nt, Shigella flexneri 2a str. 301
cuuucuggcaucacuucu

SEQ ID NO: 3926434 - RNA, 15 nt, Shigella flexneri 2a str. 301
cuuucugugcaucug

SEQ ID NO: 3926435 - RNA, 14 nt, Shigella flexneri 2a str. 301
cuuucuuaaauuaa

SEQ ID NO: 3926436 - RNA, 22 nt, Shigella flexneri 2a str. 301
cuuucuuaccccugauuuuguu

SEQ ID NO: 3926437 - RNA, 19 nt, Shigella flexneri 2a str. 301
cuuucuuggcacccagcgc

SEQ ID NO: 3926438 - RNA, 17 nt, Shigella flexneri 2a str. 301
cuuugaaaauaacaucg

SEQ ID NO: 3926439 - RNA, 14 nt, Shigella flexneri 2a str. 301
cuuugaauaucucc

SEQ ID NO: 3926440 - RNA, 21 nt, Shigella flexneri 2a str. 301
cuuugaauaucuccucugcuu

SEQ ID NO: 3926441 - RNA, 18 nt, Shigella flexneri 2a str. 301
cuuugacaacaucaucug

SEQ ID NO: 3926442 - RNA, 20 nt, Shigella flexneri 2a str. 301
cuuugacgucgaaacugaca

SEQ ID NO: 3926443 - RNA, 21 nt, Shigella flexneri 2a str. 301
cuuugacugcuuuuacaaaau

SEQ ID NO: 3926444 - RNA, 14 nt, Shigella flexneri 2a str. 301
cuuugauccagcca

SEQ ID NO: 3926445 - RNA, 12 nt, Shigella flexneri 2a str. 301
cuuugaucgcgu

SEQ ID NO: 3926446 - RNA, 18 nt, Shigella flexneri 2a str. 301
cuuugaucgcguuuuuug

SEQ ID NO: 3926447 - RNA, 22 nt, Shigella flexneri 2a str. 301
cuuugaucgguugcugaacagc

SEQ ID NO: 3926448 - RNA, 21 nt, Shigella flexneri 2a str. 301
cuuugaucucaaacgguucuu

SEQ ID NO: 3926449 - RNA, 21 nt, Shigella flexneri 2a str. 301
cuuugaucugcgucgcuuucc

SEQ ID NO: 3926450 - RNA, 23 nt, Shigella flexneri 2a str. 301
cuuugauguacgcugccgcuucu

SEQ ID NO: 3926451 - RNA, 15 nt, Shigella flexneri 2a str. 301
cuuugauuaaccguu

SEQ ID NO: 3926452 - RNA, 13 nt, Shigella flexneri 2a str. 301
cuuugcaagcguu

SEQ ID NO: 3926453 - RNA, 14 nt, Shigella flexneri 2a str. 301
cuuugcaugacgau

SEQ ID NO: 3926454 - RNA, 21 nt, Shigella flexneri 2a str. 301
cuuugccacgguauuugccaa

SEQ ID NO: 3926455 - RNA, 15 nt, Shigella flexneri 2a str. 301
cuuugccccagcggg

SEQ ID NO: 3926456 - RNA, 15 nt, Shigella flexneri 2a str. 301
cuuugccgucagcca

SEQ ID NO: 3926457 - RNA, 17 nt, Shigella flexneri 2a str. 301
cuuugccgucagccacu

SEQ ID NO: 3926458 - RNA, 16 nt, Shigella flexneri 2a str. 301
cuuugccuggcggcag

SEQ ID NO: 3926459 - RNA, 19 nt, Shigella flexneri 2a str. 301
cuuugcgcgcuuccaucgu

SEQ ID NO: 3926460 - RNA, 17 nt, Shigella flexneri 2a str. 301
cuuugcguuccaucaga

SEQ ID NO: 3926461 - RNA, 19 nt, Shigella flexneri 2a str. 301
cuuugcuacagccugguga

SEQ ID NO: 3926462 - RNA, 17 nt, Shigella flexneri 2a str. 301
cuuugcuaccuuccucc

SEQ ID NO: 3926463 - RNA, 17 nt, Shigella flexneri 2a str. 301
cuuugcugauucucccu

SEQ ID NO: 3926464 - RNA, 17 nt, Shigella flexneri 2a str. 301
cuuugcugcaaugaagg

SEQ ID NO: 3926465 - RNA, 13 nt, Shigella flexneri 2a str. 301
cuuugcuggcaug

SEQ ID NO: 3926466 - RNA, 14 nt, Shigella flexneri 2a str. 301
cuuugcuggcuggc

SEQ ID NO: 3926467 - RNA, 12 nt, Shigella flexneri 2a str. 301
cuuugcuguaca

SEQ ID NO: 3926468 - RNA, 14 nt, Shigella flexneri 2a str. 301
cuuugcuuccugag

SEQ ID NO: 3926469 - RNA, 16 nt, Shigella flexneri 2a str. 301
cuuugcuuccugagua

SEQ ID NO: 3926470 - RNA, 14 nt, Shigella flexneri 2a str. 301
cuuuggcaaacuac

SEQ ID NO: 3926471 - RNA, 18 nt, Shigella flexneri 2a str. 301
cuuuggcaaacuacaaau

SEQ ID NO: 3926472 - RNA, 13 nt, Shigella flexneri 2a str. 301
cuuuggcaucaau

SEQ ID NO: 3926473 - RNA, 16 nt, Shigella flexneri 2a str. 301
cuuuggguugccgcca

SEQ ID NO: 3926474 - RNA, 13 nt, Shigella flexneri 2a str. 301
cuuuguagaugau

SEQ ID NO: 3926475 - RNA, 23 nt, Shigella flexneri 2a str. 301
cuuugucaaaaaucuaaccuacu

SEQ ID NO: 3926476 - RNA, 21 nt, Shigella flexneri 2a str. 301
cuuugucauuaaagccgccaa

SEQ ID NO: 3926477 - RNA, 21 nt, Shigella flexneri 2a str. 301
cuuugugaagguagucccugc

SEQ ID NO: 3926478 - RNA, 18 nt, Shigella flexneri 2a str. 301
cuuuguuaaacagugccc

SEQ ID NO: 3926479 - RNA, 19 nt, Shigella flexneri 2a str. 301
cuuuguuaaacagugccca

SEQ ID NO: 3926480 - RNA, 15 nt, Shigella flexneri 2a str. 301
cuuuguucugaauca

SEQ ID NO: 3926481 - RNA, 15 nt, Shigella flexneri 2a str. 301
cuuuuaaauccugca

SEQ ID NO: 3926482 - RNA, 15 nt, Shigella flexneri 2a str. 301
cuuuuacaagcaacu

SEQ ID NO: 3926483 - RNA, 17 nt, Shigella flexneri 2a str. 301
cuuuuacaucuacaaaa

SEQ ID NO: 3926484 - RNA, 18 nt, Shigella flexneri 2a str. 301
cuuuuacaucuacaaaaa

SEQ ID NO: 3926485 - RNA, 14 nt, Shigella flexneri 2a str. 301
cuuuuacauuaucc

SEQ ID NO: 3926486 - RNA, 19 nt, Shigella flexneri 2a str. 301
cuuuuaccugcuuaaucau

SEQ ID NO: 3926487 - RNA, 16 nt, Shigella flexneri 2a str. 301
cuuuuagcaucuuauc

SEQ ID NO: 3926488 - RNA, 12 nt, Shigella flexneri 2a str. 301
cuuuuauuguua

SEQ ID NO: 3926489 - RNA, 22 nt, Shigella flexneri 2a str. 301
cuuuucaccaugggcaauccac

SEQ ID NO: 3926490 - RNA, 20 nt, Shigella flexneri 2a str. 301
cuuuucaguuggcugacaaa

SEQ ID NO: 3926491 - RNA, 20 nt, Shigella flexneri 2a str. 301
cuuuucauaaucacgcuuua

SEQ ID NO: 3926492 - RNA, 16 nt, Shigella flexneri 2a str. 301
cuuuucauauuauuug

SEQ ID NO: 3926493 - RNA, 18 nt, Shigella flexneri 2a str. 301
cuuuucaucagaucgcga

SEQ ID NO: 3926494 - RNA, 22 nt, Shigella flexneri 2a str. 301
gaaaauuaacgggcaggucacu

SEQ ID NO: 3926495 - RNA, 18 nt, Shigella flexneri 2a str. 301
gaaaauucuccggcguuu

SEQ ID NO: 3926496 - RNA, 20 nt, Shigella flexneri 2a str. 301
gaaaauugguagaccagagc

SEQ ID NO: 3926497 - RNA, 23 nt, Shigella flexneri 2a str. 301
gaaacaaaaaaaccgccucaggc

SEQ ID NO: 3926498 - RNA, 14 nt, Shigella flexneri 2a str. 301
gaaacaaacgcaaa

SEQ ID NO: 3926499 - RNA, 16 nt, Shigella flexneri 2a str. 301
gaaacaaauacaugau

SEQ ID NO: 3926500 - RNA, 23 nt, Shigella flexneri 2a str. 301
gaaacaaaucacuauuaaagaaa

SEQ ID NO: 3926501 - RNA, 16 nt, Shigella flexneri 2a str. 301
gaaacagaaaauuacg

SEQ ID NO: 3926502 - RNA, 15 nt, Shigella flexneri 2a str. 301
gaaacaggggcugga

SEQ ID NO: 3926503 - RNA, 23 nt, Shigella flexneri 2a str. 301
gaaacagguggcguuugccaccu

SEQ ID NO: 3926504 - RNA, 19 nt, Shigella flexneri 2a str. 301
gaaacagugauuucuucau

SEQ ID NO: 3926505 - RNA, 18 nt, Shigella flexneri 2a str. 301
gaaacauacaggcuaacc

SEQ ID NO: 3926506 - RNA, 19 nt, Shigella flexneri 2a str. 301
gaaaccacggugauucccg

SEQ ID NO: 3926507 - RNA, 13 nt, Shigella flexneri 2a str. 301
gaaacccaacgca

SEQ ID NO: 3926508 - RNA, 19 nt, Shigella flexneri 2a str. 301
gaaacccggccacagcgcc

SEQ ID NO: 3926509 - RNA, 14 nt, Shigella flexneri 2a str. 301
gaaaccgaaguugu

SEQ ID NO: 3926510 - RNA, 19 nt, Shigella flexneri 2a str. 301
gaaaccgcgcagcgggcau

SEQ ID NO: 3926511 - RNA, 19 nt, Shigella flexneri 2a str. 301
gaaaccgcuauuuacggua

SEQ ID NO: 3926512 - RNA, 20 nt, Shigella flexneri 2a str. 301
gaaaccgucuucccgcagcc

SEQ ID NO: 3926513 - RNA, 16 nt, Shigella flexneri 2a str. 301
gaaaccgugaaaaugg

SEQ ID NO: 3926514 - RNA, 14 nt, Shigella flexneri 2a str. 301
gaaaccuugcauag

SEQ ID NO: 3926515 - RNA, 19 nt, Shigella flexneri 2a str. 301
gaaaccuuuaacgaagccg

SEQ ID NO: 3926516 - RNA, 16 nt, Shigella flexneri 2a str. 301
gaaaccuuuaugcagc

SEQ ID NO: 3926517 - RNA, 16 nt, Shigella flexneri 2a str. 301
gaaacgauuaauuaca

SEQ ID NO: 3926518 - RNA, 13 nt, Shigella flexneri 2a str. 301
gaaacgcauaccu

SEQ ID NO: 3926519 - RNA, 18 nt, Shigella flexneri 2a str. 301
gaaacgcauaccuaccug

SEQ ID NO: 3926520 - RNA, 19 nt, Shigella flexneri 2a str. 301
gaaacgccaucucuuuaug

SEQ ID NO: 3926521 - RNA, 15 nt, Shigella flexneri 2a str. 301
gaaacgccaucugaa

SEQ ID NO: 3926522 - RNA, 19 nt, Shigella flexneri 2a str. 301
gaaacgcgaucgccaaaua

SEQ ID NO: 3926523 - RNA, 18 nt, Shigella flexneri 2a str. 301
gaaacgcucauaaauugc

SEQ ID NO: 3926524 - RNA, 21 nt, Shigella flexneri 2a str. 301
gaaacgcucauaaauugcagc

SEQ ID NO: 3926525 - RNA, 19 nt, Shigella flexneri 2a str. 301
gaaacgggcugauuucacc

SEQ ID NO: 3926526 - RNA, 22 nt, Shigella flexneri 2a str. 301
gaaacgguaauuauugaugaag

SEQ ID NO: 3926527 - RNA, 15 nt, Shigella flexneri 2a str. 301
gaaacgucaaauaau

SEQ ID NO: 3926528 - RNA, 13 nt, Shigella flexneri 2a str. 301
gaaacucacgcag

SEQ ID NO: 3926529 - RNA, 15 nt, Shigella flexneri 2a str. 301
gaaacucacgccagc

SEQ ID NO: 3926530 - RNA, 17 nt, Shigella flexneri 2a str. 301
gaaacucacgccagcag

SEQ ID NO: 3926531 - RNA, 15 nt, Shigella flexneri 2a str. 301
gaaacucauaugcag

SEQ ID NO: 3926532 - RNA, 19 nt, Shigella flexneri 2a str. 301
gaaacucauaugcagcauc

SEQ ID NO: 3926533 - RNA, 13 nt, Shigella flexneri 2a str. 301
gaaacucgcguaa

SEQ ID NO: 3926534 - RNA, 18 nt, Shigella flexneri 2a str. 301
gaaacucgcguaaaucca

SEQ ID NO: 3926535 - RNA, 21 nt, Shigella flexneri 2a str. 301
gaaacucgcguaaauccagcg

SEQ ID NO: 3926536 - RNA, 19 nt, Shigella flexneri 2a str. 301
gaaacucucaaaacaacac

SEQ ID NO: 3926537 - RNA, 14 nt, Shigella flexneri 2a str. 301
gaaacugccggaag

SEQ ID NO: 3926538 - RNA, 24 nt, Shigella flexneri 2a str. 301
gaaacugucaauaaacgccugcuu

SEQ ID NO: 3926539 - RNA, 19 nt, Shigella flexneri 2a str. 301
gaaacuuauucaaucucuu

SEQ ID NO: 3926540 - RNA, 12 nt, Shigella flexneri 2a str. 301
gaaacuuguaac

SEQ ID NO: 3926541 - RNA, 24 nt, Shigella flexneri 2a str. 301
gaaagaaaaucaauccaguguaaa

SEQ ID NO: 3926542 - RNA, 22 nt, Shigella flexneri 2a str. 301
gaaagaagcccacgagcaaaac

SEQ ID NO: 3926543 - RNA, 17 nt, Shigella flexneri 2a str. 301
gaaagagcgucuggaag

SEQ ID NO: 3926544 - RNA, 16 nt, Shigella flexneri 2a str. 301
gaaagaggcgcagaug

SEQ ID NO: 3926545 - RNA, 21 nt, Shigella flexneri 2a str. 301
gaaagagggcauucuuaccgg

SEQ ID NO: 3926546 - RNA, 18 nt, Shigella flexneri 2a str. 301
gaaagaucgccacugcug

SEQ ID NO: 3926547 - RNA, 21 nt, Shigella flexneri 2a str. 301
gaaagauggcgcgcagaaaga

SEQ ID NO: 3926548 - RNA, 13 nt, Shigella flexneri 2a str. 301
gaaagcaccugcg

SEQ ID NO: 3926549 - RNA, 17 nt, Shigella flexneri 2a str. 301
gaaagcaccugcgcagg

SEQ ID NO: 3926550 - RNA, 16 nt, Shigella flexneri 2a str. 301
gaaagcagauaaccca

SEQ ID NO: 3926551 - RNA, 22 nt, Shigella flexneri 2a str. 301
gaaagcagauaacccagcagcc

SEQ ID NO: 3926552 - RNA, 22 nt, Shigella flexneri 2a str. 301
gaaagcagcauacccaccgguc

SEQ ID NO: 3926553 - RNA, 18 nt, Shigella flexneri 2a str. 301
gaaagcagcauguagaug

SEQ ID NO: 3926554 - RNA, 17 nt, Shigella flexneri 2a str. 301
gaaagcagcgaugcuuu

SEQ ID NO: 3926555 - RNA, 17 nt, Shigella flexneri 2a str. 301
gaaagcagggcggcagg

SEQ ID NO: 3926556 - RNA, 15 nt, Shigella flexneri 2a str. 301
gaaagcccaucaucc

SEQ ID NO: 3926557 - RNA, 15 nt, Shigella flexneri 2a str. 301
gaaagccccaccagc

SEQ ID NO: 3926558 - RNA, 20 nt, Shigella flexneri 2a str. 301
gaaagccccaccagcaaaua

SEQ ID NO: 3926559 - RNA, 16 nt, Shigella flexneri 2a str. 301
gaaagcccuugccgau

SEQ ID NO: 3926560 - RNA, 14 nt, Shigella flexneri 2a str. 301
gaaagccgacugca

SEQ ID NO: 3926561 - RNA, 16 nt, Shigella flexneri 2a str. 301
gaaagcgaucuuucug

SEQ ID NO: 3926562 - RNA, 15 nt, Shigella flexneri 2a str. 301
gaaagcgaugcugau

SEQ ID NO: 3926563 - RNA, 14 nt, Shigella flexneri 2a str. 301
gaaagcgccagcaa

SEQ ID NO: 3926564 - RNA, 19 nt, Shigella flexneri 2a str. 301
gaaagcgccagcaagagca

SEQ ID NO: 3926565 - RNA, 17 nt, Shigella flexneri 2a str. 301
gaaagcgccucaagcuc

SEQ ID NO: 3926566 - RNA, 15 nt, Shigella flexneri 2a str. 301
gaaagcggcguuuug

SEQ ID NO: 3926567 - RNA, 19 nt, Shigella flexneri 2a str. 301
gaaagcgucagcuuucaga

SEQ ID NO: 3926568 - RNA, 20 nt, Shigella flexneri 2a str. 301
gaaagcgucagcuuucagag

SEQ ID NO: 3926569 - RNA, 22 nt, Shigella flexneri 2a str. 301
gaaagcugcugaccaccagcac

SEQ ID NO: 3926570 - RNA, 16 nt, Shigella flexneri 2a str. 301
gaaagcuucaggcacc

SEQ ID NO: 3926571 - RNA, 22 nt, Shigella flexneri 2a str. 301
gaaaggaaaaaauacagucacu

SEQ ID NO: 3926572 - RNA, 17 nt, Shigella flexneri 2a str. 301
gaaaggaucacaauaau

SEQ ID NO: 3926573 - RNA, 16 nt, Shigella flexneri 2a str. 301
gaaaggcaagcacggc

SEQ ID NO: 3926574 - RNA, 20 nt, Shigella flexneri 2a str. 301
gaaaggcguuguccuuacca

SEQ ID NO: 3926575 - RNA, 12 nt, Shigella flexneri 2a str. 301
gaaagggaagaa

SEQ ID NO: 3926576 - RNA, 14 nt, Shigella flexneri 2a str. 301
gaaaguaaaaaaga

SEQ ID NO: 3926577 - RNA, 19 nt, Shigella flexneri 2a str. 301
gaaaguaaaaaagaaggaa

SEQ ID NO: 3926578 - RNA, 20 nt, Shigella flexneri 2a str. 301
gaaaguaaaaaagaaggaaa

SEQ ID NO: 3926579 - RNA, 15 nt, Shigella flexneri 2a str. 301
gaaaguaaaccacca

SEQ ID NO: 3926580 - RNA, 13 nt, Shigella flexneri 2a str. 301
gaaaguaaauuua

SEQ ID NO: 3926581 - RNA, 15 nt, Shigella flexneri 2a str. 301
gaaaguaacaccauc

SEQ ID NO: 3926582 - RNA, 20 nt, Shigella flexneri 2a str. 301
gaaaguaaucuauauuucug

SEQ ID NO: 3926583 - RNA, 17 nt, Shigella flexneri 2a str. 301
gaaaguaauuacacccu

SEQ ID NO: 3926584 - RNA, 22 nt, Shigella flexneri 2a str. 301
gaaaguacuucacaaucagcgc

SEQ ID NO: 3926585 - RNA, 18 nt, Shigella flexneri 2a str. 301
gaaagugacagcccggca

SEQ ID NO: 3926586 - RNA, 21 nt, Shigella flexneri 2a str. 301
gaaagugacagcccggcaugu

SEQ ID NO: 3926587 - RNA, 21 nt, Shigella flexneri 2a str. 301
gaaagugauggugguggggga

SEQ ID NO: 3926588 - RNA, 18 nt, Shigella flexneri 2a str. 301
gaaaguggaaacacgcuc

SEQ ID NO: 3926589 - RNA, 20 nt, Shigella flexneri 2a str. 301
gaaaguguaaagcaggugcc

SEQ ID NO: 3926590 - RNA, 15 nt, Shigella flexneri 2a str. 301
gaaaguuguuuuuug

SEQ ID NO: 3926591 - RNA, 16 nt, Shigella flexneri 2a str. 301
gaaaguuuuucaacac

SEQ ID NO: 3926592 - RNA, 13 nt, Shigella flexneri 2a str. 301
gaaauaaaaauaa

SEQ ID NO: 3926593 - RNA, 14 nt, Shigella flexneri 2a str. 301
gaaauaaaaauaag

SEQ ID NO: 3926594 - RNA, 17 nt, Shigella flexneri 2a str. 301
gaaauaaacuuuugggc

SEQ ID NO: 3926595 - RNA, 22 nt, Shigella flexneri 2a str. 301
gaaauaacugcuauucaccagc

SEQ ID NO: 3926596 - RNA, 18 nt, Shigella flexneri 2a str. 301
gaaauacagguccccgcu

SEQ ID NO: 3926597 - RNA, 14 nt, Shigella flexneri 2a str. 301
gaaauaccagguug

SEQ ID NO: 3926598 - RNA, 15 nt, Shigella flexneri 2a str. 301
gaaauaccagguugc

SEQ ID NO: 3926599 - RNA, 18 nt, Shigella flexneri 2a str. 301
gaaauaccccgccagcag

SEQ ID NO: 3926600 - RNA, 16 nt, Shigella flexneri 2a str. 301
gaaauagaaacuggcc

SEQ ID NO: 3926601 - RNA, 17 nt, Shigella flexneri 2a str. 301
gaaauagaaacuggccc

SEQ ID NO: 3926602 - RNA, 18 nt, Shigella flexneri 2a str. 301
gaaauauagaccgccauc

SEQ ID NO: 3926603 - RNA, 12 nt, Shigella flexneri 2a str. 301
gaaaucaccacc

SEQ ID NO: 3926604 - RNA, 19 nt, Shigella flexneri 2a str. 301
gaaaucaccaccagcaccg

SEQ ID NO: 3926605 - RNA, 20 nt, Shigella flexneri 2a str. 301
gaaaucaccaccagcaccgc

SEQ ID NO: 3926606 - RNA, 20 nt, Shigella flexneri 2a str. 301
gaaaucaccgccaccagcgu

SEQ ID NO: 3926607 - RNA, 21 nt, Shigella flexneri 2a str. 301
gaaaucagaaggguuggugaa

SEQ ID NO: 3926608 - RNA, 22 nt, Shigella flexneri 2a str. 301
gaaaucagagauuugcuccagc

SEQ ID NO: 3926609 - RNA, 20 nt, Shigella flexneri 2a str. 301
gaaaucaucaauaccagccc

SEQ ID NO: 3926610 - RNA, 19 nt, Shigella flexneri 2a str. 301
gaaauccauugauuuaucg

SEQ ID NO: 3926611 - RNA, 17 nt, Shigella flexneri 2a str. 301
gaaauccucaaccggug

SEQ ID NO: 3926612 - RNA, 14 nt, Shigella flexneri 2a str. 301
gaaauccugccgca

SEQ ID NO: 3926613 - RNA, 24 nt, Shigella flexneri 2a str. 301
gaaaucgacgcugcugcguacuga

SEQ ID NO: 3926614 - RNA, 18 nt, Shigella flexneri 2a str. 301
gaaaucgcaucgcgccau

SEQ ID NO: 3926615 - RNA, 11 nt, Shigella flexneri 2a str. 301
gaaaucggcgu

SEQ ID NO: 3926616 - RNA, 21 nt, Shigella flexneri 2a str. 301
gaaaucguuugcauccagcuc

SEQ ID NO: 3926617 - RNA, 21 nt, Shigella flexneri 2a str. 301
gaaaucuacgguggaacauuu

SEQ ID NO: 3926618 - RNA, 18 nt, Shigella flexneri 2a str. 301
gaaaucugacucuuguaa

SEQ ID NO: 3926619 - RNA, 19 nt, Shigella flexneri 2a str. 301
gaaaucugacucuuguaac

SEQ ID NO: 3926620 - RNA, 14 nt, Shigella flexneri 2a str. 301
gaaaugaaaaaaua

SEQ ID NO: 3926621 - RNA, 15 nt, Shigella flexneri 2a str. 301
gaaaugaaaaaauag

SEQ ID NO: 3926622 - RNA, 17 nt, Shigella flexneri 2a str. 301
gaaaugaaaaucaccau

SEQ ID NO: 3926623 - RNA, 16 nt, Shigella flexneri 2a str. 301
gaaaugauggucuggu

SEQ ID NO: 3926624 - RNA, 19 nt, Shigella flexneri 2a str. 301
gaaaugcagcguuuccagc

SEQ ID NO: 3926625 - RNA, 18 nt, Shigella flexneri 2a str. 301
gaaaugccaguaacucau

SEQ ID NO: 3926626 - RNA, 13 nt, Shigella flexneri 2a str. 301
gaaauggcccggu

SEQ ID NO: 3926627 - RNA, 23 nt, Shigella flexneri 2a str. 301
gaaauguugaauugccgggugca

SEQ ID NO: 3926628 - RNA, 19 nt, Shigella flexneri 2a str. 301
gaaauguuugcaauaaaga

SEQ ID NO: 3926629 - RNA, 22 nt, Shigella flexneri 2a str. 301
gaaauuaaacugucgucgcuuu

SEQ ID NO: 3926630 - RNA, 16 nt, Shigella flexneri 2a str. 301
gaaauuaacgucacca

SEQ ID NO: 3926631 - RNA, 19 nt, Shigella flexneri 2a str. 301
gaaauuaacgucaccaucc

SEQ ID NO: 3926632 - RNA, 15 nt, Shigella flexneri 2a str. 301
gaaauuacaggcagu

SEQ ID NO: 3926633 - RNA, 16 nt, Shigella flexneri 2a str. 301
gaaauuacaggcagua

SEQ ID NO: 3926634 - RNA, 22 nt, Shigella flexneri 2a str. 301
gaaauuaccgcaccaccagcag

SEQ ID NO: 3926635 - RNA, 20 nt, Shigella flexneri 2a str. 301
gaaauuacgauguguggcau

SEQ ID NO: 3926636 - RNA, 13 nt, Shigella flexneri 2a str. 301
gaaauucacuguc

SEQ ID NO: 3926637 - RNA, 19 nt, Shigella flexneri 2a str. 301
gaaauucagcaguuuuugc

SEQ ID NO: 3926638 - RNA, 21 nt, Shigella flexneri 2a str. 301
gaaauucagcaguuuuugcaa

SEQ ID NO: 3926639 - RNA, 18 nt, Shigella flexneri 2a str. 301
gaaauuccagcggcagga

SEQ ID NO: 3926640 - RNA, 20 nt, Shigella flexneri 2a str. 301
gaaauugaaaaaccagacga

SEQ ID NO: 3926641 - RNA, 12 nt, Shigella flexneri 2a str. 301
gaaauugcacug

SEQ ID NO: 3926642 - RNA, 23 nt, Shigella flexneri 2a str. 301
gaaauugccacgccaauguguuu

SEQ ID NO: 3926643 - RNA, 15 nt, Shigella flexneri 2a str. 301
gaaauugugauggag

SEQ ID NO: 3926644 - RNA, 22 nt, Shigella flexneri 2a str. 301
gaaauuuugcaacguccugcaa

SEQ ID NO: 3926645 - RNA, 20 nt, Shigella flexneri 2a str. 301
gaaauuuugcugauauuuau

SEQ ID NO: 3926646 - RNA, 12 nt, Shigella flexneri 2a str. 301
gaacaaaacagc

SEQ ID NO: 3926647 - RNA, 19 nt, Shigella flexneri 2a str. 301
gaacaaaauguuuaugccu

SEQ ID NO: 3926648 - RNA, 16 nt, Shigella flexneri 2a str. 301
gaacaacaagaagcgu

SEQ ID NO: 3926649 - RNA, 17 nt, Shigella flexneri 2a str. 301
gaacaacagaucaacau

SEQ ID NO: 3926650 - RNA, 20 nt, Shigella flexneri 2a str. 301
gaacaacagucccaggcaga

SEQ ID NO: 3926651 - RNA, 19 nt, Shigella flexneri 2a str. 301
gaacaaccacgacauuggc

SEQ ID NO: 3926652 - RNA, 12 nt, Shigella flexneri 2a str. 301
gaacaaccagaa

SEQ ID NO: 3926653 - RNA, 18 nt, Shigella flexneri 2a str. 301
gaacaacguaucuugcgu

SEQ ID NO: 3926654 - RNA, 18 nt, Shigella flexneri 2a str. 301
gaacaaggguaagggagg

SEQ ID NO: 3926655 - RNA, 21 nt, Shigella flexneri 2a str. 301
gaacaauaaauuucaccguuc

SEQ ID NO: 3926656 - RNA, 22 nt, Shigella flexneri 2a str. 301
gaacaauaaauuucaccguucg

SEQ ID NO: 3926657 - RNA, 16 nt, Shigella flexneri 2a str. 301
gaacaaucacccccac

SEQ ID NO: 3926658 - RNA, 15 nt, Shigella flexneri 2a str. 301
gaacaauuggauagu

SEQ ID NO: 3926659 - RNA, 22 nt, Shigella flexneri 2a str. 301
gaacaauuggauagugaguaca

SEQ ID NO: 3926660 - RNA, 14 nt, Shigella flexneri 2a str. 301
gaacaccaccugcc

SEQ ID NO: 3926661 - RNA, 22 nt, Shigella flexneri 2a str. 301
gaacaccaccugccagagcuga

SEQ ID NO: 3926662 - RNA, 19 nt, Shigella flexneri 2a str. 301
gaacaccgacauugccagc

SEQ ID NO: 3926663 - RNA, 22 nt, Shigella flexneri 2a str. 301
gaacacgacauacaccgcagcc

SEQ ID NO: 3926664 - RNA, 13 nt, Shigella flexneri 2a str. 301
gaacacgaucuca

SEQ ID NO: 3926665 - RNA, 20 nt, Shigella flexneri 2a str. 301
gaacacgcucccagcagaga

SEQ ID NO: 3926666 - RNA, 17 nt, Shigella flexneri 2a str. 301
gaacacuucuucugucg

SEQ ID NO: 3926667 - RNA, 14 nt, Shigella flexneri 2a str. 301
gaacagaacuggcg

SEQ ID NO: 3926668 - RNA, 15 nt, Shigella flexneri 2a str. 301
gaacagaagaaagca

SEQ ID NO: 3926669 - RNA, 14 nt, Shigella flexneri 2a str. 301
gaacagaccacauu

SEQ ID NO: 3926670 - RNA, 15 nt, Shigella flexneri 2a str. 301
gaacagaccagcacc

SEQ ID NO: 3926671 - RNA, 19 nt, Shigella flexneri 2a str. 301
gaacagaggcagcuugauu

SEQ ID NO: 3926672 - RNA, 13 nt, Shigella flexneri 2a str. 301
gaacagcagcagg

SEQ ID NO: 3926673 - RNA, 15 nt, Shigella flexneri 2a str. 301
gaacagcagcagguc

SEQ ID NO: 3926674 - RNA, 17 nt, Shigella flexneri 2a str. 301
gaacagcagcaggucac

SEQ ID NO: 3926675 - RNA, 13 nt, Shigella flexneri 2a str. 301
gaacagcagcggu

SEQ ID NO: 3926676 - RNA, 15 nt, Shigella flexneri 2a str. 301
gaacagcaguuguuu

SEQ ID NO: 3926677 - RNA, 17 nt, Shigella flexneri 2a str. 301
gaacagccagaagcccg

SEQ ID NO: 3926678 - RNA, 16 nt, Shigella flexneri 2a str. 301
gaacagcgccagacaa

SEQ ID NO: 3926679 - RNA, 17 nt, Shigella flexneri 2a str. 301
gaacagcgccagacaaa

SEQ ID NO: 3926680 - RNA, 23 nt, Shigella flexneri 2a str. 301
gaacagcucaguuaacggcauaa

SEQ ID NO: 3926681 - RNA, 18 nt, Shigella flexneri 2a str. 301
gaacagcuuuuuccugcg

SEQ ID NO: 3926682 - RNA, 13 nt, Shigella flexneri 2a str. 301
gaacaggcgcagg

SEQ ID NO: 3926683 - RNA, 14 nt, Shigella flexneri 2a str. 301
gaacaguaaagcgc

SEQ ID NO: 3926684 - RNA, 15 nt, Shigella flexneri 2a str. 301
gaacaguaaagcgca

SEQ ID NO: 3926685 - RNA, 14 nt, Shigella flexneri 2a str. 301
gaacaguucaacgc

SEQ ID NO: 3926686 - RNA, 14 nt, Shigella flexneri 2a str. 301
gaacaucauucccg

SEQ ID NO: 3926687 - RNA, 15 nt, Shigella flexneri 2a str. 301
gaacauccagcagca

SEQ ID NO: 3926688 - RNA, 20 nt, Shigella flexneri 2a str. 301
gaacaucccgguaauaaugc

SEQ ID NO: 3926689 - RNA, 16 nt, Shigella flexneri 2a str. 301
gaacauccuuuccuua

SEQ ID NO: 3926690 - RNA, 18 nt, Shigella flexneri 2a str. 301
gaacaucgccugccgcag

SEQ ID NO: 3926691 - RNA, 19 nt, Shigella flexneri 2a str. 301
gaacaucgcuucgucguca

SEQ ID NO: 3926692 - RNA, 13 nt, Shigella flexneri 2a str. 301
gaacauuggauua

SEQ ID NO: 3926693 - RNA, 23 nt, Shigella flexneri 2a str. 301
gaacauuguuauucuccuucacg

SEQ ID NO: 3926694 - RNA, 19 nt, Shigella flexneri 2a str. 301
gaacuucauaugcgccaga

SEQ ID NO: 3926695 - RNA, 12 nt, Shigella flexneri 2a str. 301
gaacuucgccac

SEQ ID NO: 3926696 - RNA, 23 nt, Shigella flexneri 2a str. 301
gaacuugacgaucugcuacaggc

SEQ ID NO: 3926697 - RNA, 17 nt, Shigella flexneri 2a str. 301
gaacuuucucccgaaaa

SEQ ID NO: 3926698 - RNA, 13 nt, Shigella flexneri 2a str. 301
gaagaaaccgcua

SEQ ID NO: 3926699 - RNA, 12 nt, Shigella flexneri 2a str. 301
gaagaaagcaau

SEQ ID NO: 3926700 - RNA, 20 nt, Shigella flexneri 2a str. 301
gaagaaaucccccagcauca

SEQ ID NO: 3926701 - RNA, 24 nt, Shigella flexneri 2a str. 301
gaagaaggcuucguaaguggcguu

SEQ ID NO: 3926702 - RNA, 13 nt, Shigella flexneri 2a str. 301
gaagaaguaaaac

SEQ ID NO: 3926703 - RNA, 19 nt, Shigella flexneri 2a str. 301
gaagaagucgaaugcgcaa

SEQ ID NO: 3926704 - RNA, 13 nt, Shigella flexneri 2a str. 301
gaagacaaccaaa

SEQ ID NO: 3926705 - RNA, 18 nt, Shigella flexneri 2a str. 301
gaagacgcagcaugcauc

SEQ ID NO: 3926706 - RNA, 14 nt, Shigella flexneri 2a str. 301
gaagagacaaaaaa

SEQ ID NO: 3926707 - RNA, 16 nt, Shigella flexneri 2a str. 301
gaagagacaaaaaagg

SEQ ID NO: 3926708 - RNA, 13 nt, Shigella flexneri 2a str. 301
gaagaggaacaaa

SEQ ID NO: 3926709 - RNA, 19 nt, Shigella flexneri 2a str. 301
gaagaggaucugcucuucu

SEQ ID NO: 3926710 - RNA, 17 nt, Shigella flexneri 2a str. 301
gaagaguaaaaaaaccg

SEQ ID NO: 3926711 - RNA, 13 nt, Shigella flexneri 2a str. 301
gaagauaccgaac

SEQ ID NO: 3926712 - RNA, 20 nt, Shigella flexneri 2a str. 301
gaagauauugcgcaugacac

SEQ ID NO: 3926713 - RNA, 14 nt, Shigella flexneri 2a str. 301
gaagaucaacgucu

SEQ ID NO: 3926714 - RNA, 18 nt, Shigella flexneri 2a str. 301
gaagaucguggagaacaa

SEQ ID NO: 3926715 - RNA, 18 nt, Shigella flexneri 2a str. 301
gaagaugaauugagacgu

SEQ ID NO: 3926716 - RNA, 19 nt, Shigella flexneri 2a str. 301
gaagaugccaacuggcaua

SEQ ID NO: 3926717 - RNA, 23 nt, Shigella flexneri 2a str. 301
gaagauguuucuggucugcugga

SEQ ID NO: 3926718 - RNA, 23 nt, Shigella flexneri 2a str. 301
gaagcaaaauaaccggcaagcaa

SEQ ID NO: 3926719 - RNA, 23 nt, Shigella flexneri 2a str. 301
gaagcacguucaucccacucuga

SEQ ID NO: 3926720 - RNA, 16 nt, Shigella flexneri 2a str. 301
gaagcagcuugcuguu

SEQ ID NO: 3926721 - RNA, 14 nt, Shigella flexneri 2a str. 301
gaagcagucaacac

SEQ ID NO: 3926722 - RNA, 13 nt, Shigella flexneri 2a str. 301
gaagcaguuuugc

SEQ ID NO: 3926723 - RNA, 23 nt, Shigella flexneri 2a str. 301
gaagcaguuuugccuuccccgag

SEQ ID NO: 3926724 - RNA, 21 nt, Shigella flexneri 2a str. 301
gaagccaaaucauccagaccg

SEQ ID NO: 3926725 - RNA, 18 nt, Shigella flexneri 2a str. 301
gaagccaccacgccaaga

SEQ ID NO: 3926726 - RNA, 13 nt, Shigella flexneri 2a str. 301
gaagccauccagc

SEQ ID NO: 3926727 - RNA, 18 nt, Shigella flexneri 2a str. 301
gaagccauuaaacaccag

SEQ ID NO: 3926728 - RNA, 20 nt, Shigella flexneri 2a str. 301
gaagcccaucaguacaccac

SEQ ID NO: 3926729 - RNA, 21 nt, Shigella flexneri 2a str. 301
gaagccuaccgggaugcugau

SEQ ID NO: 3926730 - RNA, 11 nt, Shigella flexneri 2a str. 301
gaagccuccau

SEQ ID NO: 3926731 - RNA, 15 nt, Shigella flexneri 2a str. 301
gaagccucuacccgu

SEQ ID NO: 3926732 - RNA, 14 nt, Shigella flexneri 2a str. 301
gaagcgaaacugcc

SEQ ID NO: 3926733 - RNA, 15 nt, Shigella flexneri 2a str. 301
gaagcgaacaucgag

SEQ ID NO: 3926734 - RNA, 16 nt, Shigella flexneri 2a str. 301
gaagcgcaacgcauca

SEQ ID NO: 3926735 - RNA, 20 nt, Shigella flexneri 2a str. 301
gaagcgcaacgcaucaggca

SEQ ID NO: 3926736 - RNA, 21 nt, Shigella flexneri 2a str. 301
gaagcgcauggcguccgucau

SEQ ID NO: 3926737 - RNA, 23 nt, Shigella flexneri 2a str. 301
gaagcgcauggcguccgucaucg

SEQ ID NO: 3926738 - RNA, 19 nt, Shigella flexneri 2a str. 301
gaagcgccgguuccacauc

SEQ ID NO: 3926739 - RNA, 14 nt, Shigella flexneri 2a str. 301
gaagcggaaaucac

SEQ ID NO: 3926740 - RNA, 17 nt, Shigella flexneri 2a str. 301
gaagcguaaaucccagc

SEQ ID NO: 3926741 - RNA, 19 nt, Shigella flexneri 2a str. 301
gaagcguucuucugcuucu

SEQ ID NO: 3926742 - RNA, 12 nt, Shigella flexneri 2a str. 301
gaagcucuuucg

SEQ ID NO: 3926743 - RNA, 16 nt, Shigella flexneri 2a str. 301
gaagcugcaaguauuc

SEQ ID NO: 3926744 - RNA, 18 nt, Shigella flexneri 2a str. 301
gaagcuggauuaacgcug

SEQ ID NO: 3926745 - RNA, 18 nt, Shigella flexneri 2a str. 301
gaagcuggucagcaucgu

SEQ ID NO: 3926746 - RNA, 19 nt, Shigella flexneri 2a str. 301
gaaggaagacgcagcaugc

SEQ ID NO: 3926747 - RNA, 13 nt, Shigella flexneri 2a str. 301
gaaggauuacuca

SEQ ID NO: 3926748 - RNA, 17 nt, Shigella flexneri 2a str. 301
gaaggcaagaaagcgua

SEQ ID NO: 3926749 - RNA, 21 nt, Shigella flexneri 2a str. 301
gaaggcgauguucuggucacu

SEQ ID NO: 3926750 - RNA, 20 nt, Shigella flexneri 2a str. 301
gaaggcgauuaaacgccauc

SEQ ID NO: 3926751 - RNA, 11 nt, Shigella flexneri 2a str. 301
gaaggcggcga

SEQ ID NO: 3926752 - RNA, 18 nt, Shigella flexneri 2a str. 301
gaaggcuucguaaguggc

SEQ ID NO: 3926753 - RNA, 16 nt, Shigella flexneri 2a str. 301
gaagggauugugcagg

SEQ ID NO: 3926754 - RNA, 21 nt, Shigella flexneri 2a str. 301
gaaggguauugccgaugaacg

SEQ ID NO: 3926755 - RNA, 22 nt, Shigella flexneri 2a str. 301
gaaggucggcugaaucagaugu

SEQ ID NO: 3926756 - RNA, 22 nt, Shigella flexneri 2a str. 301
gaaggugaaauugucggcguaa

SEQ ID NO: 3926757 - RNA, 20 nt, Shigella flexneri 2a str. 301
gaagguucaagacgaauacc

SEQ ID NO: 3926758 - RNA, 19 nt, Shigella flexneri 2a str. 301
gaagguugccauaucuucc

SEQ ID NO: 3926759 - RNA, 23 nt, Shigella flexneri 2a str. 301
gaagguugcgccuugucuuuauu

SEQ ID NO: 3926760 - RNA, 21 nt, Shigella flexneri 2a str. 301
gaaguaauaaucaacgcaccg

SEQ ID NO: 3926761 - RNA, 16 nt, Shigella flexneri 2a str. 301
gaaguacguagcguaa

SEQ ID NO: 3926762 - RNA, 20 nt, Shigella flexneri 2a str. 301
gaaguacuccugcucgccga

SEQ ID NO: 3926763 - RNA, 19 nt, Shigella flexneri 2a str. 301
gaaguagccaguaccaccc

SEQ ID NO: 3926764 - RNA, 17 nt, Shigella flexneri 2a str. 301
gaaguaguugcugucga

SEQ ID NO: 3926765 - RNA, 17 nt, Shigella flexneri 2a str. 301
gaaguauuggugagucc

SEQ ID NO: 3926766 - RNA, 18 nt, Shigella flexneri 2a str. 301
gaaguauuggugaguccu

SEQ ID NO: 3926767 - RNA, 22 nt, Shigella flexneri 2a str. 301
gaaguccacgcgguagcgggca

SEQ ID NO: 3926768 - RNA, 23 nt, Shigella flexneri 2a str. 301
gaaguccacgcgguagcgggcag

SEQ ID NO: 3926769 - RNA, 20 nt, Shigella flexneri 2a str. 301
gaagucccacggugcagcug

SEQ ID NO: 3926770 - RNA, 17 nt, Shigella flexneri 2a str. 301
gaagucgaacuucucuu

SEQ ID NO: 3926771 - RNA, 14 nt, Shigella flexneri 2a str. 301
gaagucgaucauau

SEQ ID NO: 3926772 - RNA, 21 nt, Shigella flexneri 2a str. 301
gaagucgcagaccaaacucuu

SEQ ID NO: 3926773 - RNA, 20 nt, Shigella flexneri 2a str. 301
gaagugauccgccgcgcggu

SEQ ID NO: 3926774 - RNA, 23 nt, Shigella flexneri 2a str. 301
gaagugauccgccgcgcgguggg

SEQ ID NO: 3926775 - RNA, 20 nt, Shigella flexneri 2a str. 301
gaaguggugagccacauugc

SEQ ID NO: 3926776 - RNA, 23 nt, Shigella flexneri 2a str. 301
gaagugguucauguugcgguggu

SEQ ID NO: 3926777 - RNA, 17 nt, Shigella flexneri 2a str. 301
gaaguuaauuucgacgg

SEQ ID NO: 3926778 - RNA, 22 nt, Shigella flexneri 2a str. 301
gaaguuuaaccgccuaauuaca

SEQ ID NO: 3926779 - RNA, 18 nt, Shigella flexneri 2a str. 301
gaaguuuugucgcugauu

SEQ ID NO: 3926780 - RNA, 12 nt, Shigella flexneri 2a str. 301
gaauaaaacaga

SEQ ID NO: 3926781 - RNA, 15 nt, Shigella flexneri 2a str. 301
gaauaaaacagaaac

SEQ ID NO: 3926782 - RNA, 13 nt, Shigella flexneri 2a str. 301
gaauaaaacaggc

SEQ ID NO: 3926783 - RNA, 12 nt, Shigella flexneri 2a str. 301
gaauaaaagcca

SEQ ID NO: 3926784 - RNA, 22 nt, Shigella flexneri 2a str. 301
gaauaaacguuccccaggguuu

SEQ ID NO: 3926785 - RNA, 23 nt, Shigella flexneri 2a str. 301
gaauaaaguuuuaguugccguuc

SEQ ID NO: 3926786 - RNA, 16 nt, Shigella flexneri 2a str. 301
gaauaaauuggcuggg

SEQ ID NO: 3926787 - RNA, 17 nt, Shigella flexneri 2a str. 301
gaauaacaccagccaga

SEQ ID NO: 3926788 - RNA, 23 nt, Shigella flexneri 2a str. 301
gaauaacacccauaaaaaaaccc

SEQ ID NO: 3926789 - RNA, 13 nt, Shigella flexneri 2a str. 301
gaauaaccagcga

SEQ ID NO: 3926790 - RNA, 19 nt, Shigella flexneri 2a str. 301
gaauaacgucgcggauggu

SEQ ID NO: 3926791 - RNA, 19 nt, Shigella flexneri 2a str. 301
gaauaaucaccuuuaaccu

SEQ ID NO: 3926792 - RNA, 17 nt, Shigella flexneri 2a str. 301
gaauaauccccauauca

SEQ ID NO: 3926793 - RNA, 14 nt, Shigella flexneri 2a str. 301
gaauguuccauacc

SEQ ID NO: 3926794 - RNA, 20 nt, Shigella flexneri 2a str. 301
gaauguuccaucaccagauu

SEQ ID NO: 3926795 - RNA, 21 nt, Shigella flexneri 2a str. 301
gaauuaaaacagguacuggcg

SEQ ID NO: 3926796 - RNA, 12 nt, Shigella flexneri 2a str. 301
gaauuaaaauau

SEQ ID NO: 3926797 - RNA, 19 nt, Shigella flexneri 2a str. 301
gaauuaagaauguuaaaua

SEQ ID NO: 3926798 - RNA, 16 nt, Shigella flexneri 2a str. 301
gaauuacacagccaca

SEQ ID NO: 3926799 - RNA, 14 nt, Shigella flexneri 2a str. 301
gaauuauaauuccu

SEQ ID NO: 3926800 - RNA, 18 nt, Shigella flexneri 2a str. 301
gaauuauaauuccuucac

SEQ ID NO: 3926801 - RNA, 13 nt, Shigella flexneri 2a str. 301
gaauuaugcagcc

SEQ ID NO: 3926802 - RNA, 16 nt, Shigella flexneri 2a str. 301
gaauuaugcagccuuc

SEQ ID NO: 3926803 - RNA, 18 nt, Shigella flexneri 2a str. 301
gaauucaaauccuucaga

SEQ ID NO: 3926804 - RNA, 13 nt, Shigella flexneri 2a str. 301
gaauucagaaaaa

SEQ ID NO: 3926805 - RNA, 18 nt, Shigella flexneri 2a str. 301
gaauuccggcagagaaag

SEQ ID NO: 3926806 - RNA, 16 nt, Shigella flexneri 2a str. 301
gaauucuaucaugcaa

SEQ ID NO: 3926807 - RNA, 17 nt, Shigella flexneri 2a str. 301
gaauucuaucaugcaaa

SEQ ID NO: 3926808 - RNA, 19 nt, Shigella flexneri 2a str. 301
gaauugauuuucgaaaaaa

SEQ ID NO: 3926809 - RNA, 14 nt, Shigella flexneri 2a str. 301
gaauugccaccauc

SEQ ID NO: 3926810 - RNA, 15 nt, Shigella flexneri 2a str. 301
gaauugcgagccugu

SEQ ID NO: 3926811 - RNA, 20 nt, Shigella flexneri 2a str. 301
gaauugcugcgcccgcagcg

SEQ ID NO: 3926812 - RNA, 13 nt, Shigella flexneri 2a str. 301
gaauugguagacg

SEQ ID NO: 3926813 - RNA, 14 nt, Shigella flexneri 2a str. 301
gaauugguagacgc

SEQ ID NO: 3926814 - RNA, 22 nt, Shigella flexneri 2a str. 301
gaauuguucugcgccaaacaga

SEQ ID NO: 3926815 - RNA, 19 nt, Shigella flexneri 2a str. 301
gaauuguuuuauaaagaac

SEQ ID NO: 3926816 - RNA, 15 nt, Shigella flexneri 2a str. 301
gaauuucagaaaacg

SEQ ID NO: 3926817 - RNA, 20 nt, Shigella flexneri 2a str. 301
gaauuucaucaucacgaaau

SEQ ID NO: 3926818 - RNA, 20 nt, Shigella flexneri 2a str. 301
gaauuuccuucgcuuccugu

SEQ ID NO: 3926819 - RNA, 21 nt, Shigella flexneri 2a str. 301
gaauuucucauccgcaguccc

SEQ ID NO: 3926820 - RNA, 14 nt, Shigella flexneri 2a str. 301
gaauuugaggaagc

SEQ ID NO: 3926821 - RNA, 13 nt, Shigella flexneri 2a str. 301
gaauuugcaugac

SEQ ID NO: 3926822 - RNA, 23 nt, Shigella flexneri 2a str. 301
gaauuuuaguucacauagacccu

SEQ ID NO: 3926823 - RNA, 12 nt, Shigella flexneri 2a str. 301
gaauuuuccuuc

SEQ ID NO: 3926824 - RNA, 21 nt, Shigella flexneri 2a str. 301
gaauuuuccuucggauuuccg

SEQ ID NO: 3926825 - RNA, 19 nt, Shigella flexneri 2a str. 301
gaauuuucucuuucaacau

SEQ ID NO: 3926826 - RNA, 14 nt, Shigella flexneri 2a str. 301
gacaaaaauaccac

SEQ ID NO: 3926827 - RNA, 12 nt, Shigella flexneri 2a str. 301
gacaaaauccug

SEQ ID NO: 3926828 - RNA, 17 nt, Shigella flexneri 2a str. 301
gacaaaaucggaaacaa

SEQ ID NO: 3926829 - RNA, 13 nt, Shigella flexneri 2a str. 301
gacaaaauguucg

SEQ ID NO: 3926830 - RNA, 14 nt, Shigella flexneri 2a str. 301
gacaaacaaugaga

SEQ ID NO: 3926831 - RNA, 14 nt, Shigella flexneri 2a str. 301
gacaaacacaaaac

SEQ ID NO: 3926832 - RNA, 21 nt, Shigella flexneri 2a str. 301
gacaaacacaauauucauagu

SEQ ID NO: 3926833 - RNA, 23 nt, Shigella flexneri 2a str. 301
gacaaacacgguuaguucaaugc

SEQ ID NO: 3926834 - RNA, 21 nt, Shigella flexneri 2a str. 301
gacaaacagcucgacaccaaa

SEQ ID NO: 3926835 - RNA, 19 nt, Shigella flexneri 2a str. 301
gacaaacagggugcagcga

SEQ ID NO: 3926836 - RNA, 20 nt, Shigella flexneri 2a str. 301
gacaaacuugauagaacaaa

SEQ ID NO: 3926837 - RNA, 15 nt, Shigella flexneri 2a str. 301
gacaaagacaucaaa

SEQ ID NO: 3926838 - RNA, 12 nt, Shigella flexneri 2a str. 301
gacaaagcauga

SEQ ID NO: 3926839 - RNA, 18 nt, Shigella flexneri 2a str. 301
gacaaaucagaacggaau

SEQ ID NO: 3926840 - RNA, 10 nt, Shigella flexneri 2a str. 301
gacaaaucau

SEQ ID NO: 3926841 - RNA, 18 nt, Shigella flexneri 2a str. 301
gacaaauguguucagcga

SEQ ID NO: 3926842 - RNA, 18 nt, Shigella flexneri 2a str. 301
gacaacaaaacgggggcu

SEQ ID NO: 3926843 - RNA, 23 nt, Shigella flexneri 2a str. 301
gacaacaaacgcaaacaccagcg

SEQ ID NO: 3926844 - RNA, 13 nt, Shigella flexneri 2a str. 301
gacaacaacauca

SEQ ID NO: 3926845 - RNA, 21 nt, Shigella flexneri 2a str. 301
gacaacaacaucacaccugcu

SEQ ID NO: 3926846 - RNA, 11 nt, Shigella flexneri 2a str. 301
gacaacaucau

SEQ ID NO: 3926847 - RNA, 11 nt, Shigella flexneri 2a str. 301
gacaaccgcaa

SEQ ID NO: 3926848 - RNA, 19 nt, Shigella flexneri 2a str. 301
gacaacgcuuuuugguuca

SEQ ID NO: 3926849 - RNA, 17 nt, Shigella flexneri 2a str. 301
gacaacugcauuuucaa

SEQ ID NO: 3926850 - RNA, 12 nt, Shigella flexneri 2a str. 301
gacaacuucccu

SEQ ID NO: 3926851 - RNA, 18 nt, Shigella flexneri 2a str. 301
gacaacuucugauguugu

SEQ ID NO: 3926852 - RNA, 19 nt, Shigella flexneri 2a str. 301
gacaacuuucaucagcaca

SEQ ID NO: 3926853 - RNA, 19 nt, Shigella flexneri 2a str. 301
gacaagcguaugauugccu

SEQ ID NO: 3926854 - RNA, 13 nt, Shigella flexneri 2a str. 301
gacaagcuuacgu

SEQ ID NO: 3926855 - RNA, 14 nt, Shigella flexneri 2a str. 301
gacaaggcaucaga

SEQ ID NO: 3926856 - RNA, 21 nt, Shigella flexneri 2a str. 301
gacaauaauacccagcaccgc

SEQ ID NO: 3926857 - RNA, 22 nt, Shigella flexneri 2a str. 301
gacaauaauaucuuuuuugcgu

SEQ ID NO: 3926858 - RNA, 20 nt, Shigella flexneri 2a str. 301
gacaauagcuaacgaaaaug

SEQ ID NO: 3926859 - RNA, 23 nt, Shigella flexneri 2a str. 301
gacaauaucggcaccagcgcaga

SEQ ID NO: 3926860 - RNA, 19 nt, Shigella flexneri 2a str. 301
gacaauaugcucuccacca

SEQ ID NO: 3926861 - RNA, 20 nt, Shigella flexneri 2a str. 301
gacaaucgccagugauugcu

SEQ ID NO: 3926862 - RNA, 20 nt, Shigella flexneri 2a str. 301
gacaaucgcuucgucaagac

SEQ ID NO: 3926863 - RNA, 22 nt, Shigella flexneri 2a str. 301
gacacaaauggcaguaucggca

SEQ ID NO: 3926864 - RNA, 15 nt, Shigella flexneri 2a str. 301
gacacaaucaaaucc

SEQ ID NO: 3926865 - RNA, 16 nt, Shigella flexneri 2a str. 301
gacacaggcagcaauc

SEQ ID NO: 3926866 - RNA, 12 nt, Shigella flexneri 2a str. 301
gacaccaaacag

SEQ ID NO: 3926867 - RNA, 17 nt, Shigella flexneri 2a str. 301
gacaccaaggaacugug

SEQ ID NO: 3926868 - RNA, 18 nt, Shigella flexneri 2a str. 301
gacaccagcucagugacc

SEQ ID NO: 3926869 - RNA, 17 nt, Shigella flexneri 2a str. 301
gacaccagucgugcggu

SEQ ID NO: 3926870 - RNA, 18 nt, Shigella flexneri 2a str. 301
gacaccccacagcucuug

SEQ ID NO: 3926871 - RNA, 16 nt, Shigella flexneri 2a str. 301
gacaccccuucauuca

SEQ ID NO: 3926872 - RNA, 17 nt, Shigella flexneri 2a str. 301
gacaccccuucauucag

SEQ ID NO: 3926873 - RNA, 18 nt, Shigella flexneri 2a str. 301
gacaccgauauucgccgc

SEQ ID NO: 3926874 - RNA, 16 nt, Shigella flexneri 2a str. 301
gacaccgcccaacaga

SEQ ID NO: 3926875 - RNA, 18 nt, Shigella flexneri 2a str. 301
gacaccgcccaacagacg

SEQ ID NO: 3926876 - RNA, 17 nt, Shigella flexneri 2a str. 301
gacaccgccuccauucg

SEQ ID NO: 3926877 - RNA, 16 nt, Shigella flexneri 2a str. 301
gacacgcgcgcauggu

SEQ ID NO: 3926878 - RNA, 21 nt, Shigella flexneri 2a str. 301
gacacgcuaccuugagguggu

SEQ ID NO: 3926879 - RNA, 18 nt, Shigella flexneri 2a str. 301
gacacuaacgcgucuuau

SEQ ID NO: 3926880 - RNA, 13 nt, Shigella flexneri 2a str. 301
gacacuauuuccc

SEQ ID NO: 3926881 - RNA, 17 nt, Shigella flexneri 2a str. 301
gacacuccugacgcggu

SEQ ID NO: 3926882 - RNA, 18 nt, Shigella flexneri 2a str. 301
gacacucggcgcggaugc

SEQ ID NO: 3926883 - RNA, 18 nt, Shigella flexneri 2a str. 301
gacacugaaugacgacgu

SEQ ID NO: 3926884 - RNA, 14 nt, Shigella flexneri 2a str. 301
gacacuguucgcgu

SEQ ID NO: 3926885 - RNA, 14 nt, Shigella flexneri 2a str. 301
gacacuucaagaau

SEQ ID NO: 3926886 - RNA, 20 nt, Shigella flexneri 2a str. 301
gacacuuucagcgcagcgcg

SEQ ID NO: 3926887 - RNA, 12 nt, Shigella flexneri 2a str. 301
gacagaauauaa

SEQ ID NO: 3926888 - RNA, 16 nt, Shigella flexneri 2a str. 301
gacagaaucaggccau

SEQ ID NO: 3926889 - RNA, 19 nt, Shigella flexneri 2a str. 301
gacagaccaaaacgugcag

SEQ ID NO: 3926890 - RNA, 12 nt, Shigella flexneri 2a str. 301
gacagacuggcu

SEQ ID NO: 3926891 - RNA, 20 nt, Shigella flexneri 2a str. 301
gacagagauucgguaaccau

SEQ ID NO: 3926892 - RNA, 22 nt, Shigella flexneri 2a str. 301
gacagagauucgguaaccaucc

SEQ ID NO: 3926893 - RNA, 13 nt, Shigella flexneri 2a str. 301
gaccagcagcauu

SEQ ID NO: 3926894 - RNA, 18 nt, Shigella flexneri 2a str. 301
gaccagcauuccagauac

SEQ ID NO: 3926895 - RNA, 16 nt, Shigella flexneri 2a str. 301
gaccagccaggccgcc

SEQ ID NO: 3926896 - RNA, 17 nt, Shigella flexneri 2a str. 301
gaccagccgcuaccagc

SEQ ID NO: 3926897 - RNA, 22 nt, Shigella flexneri 2a str. 301
gaccagcgccgcaacuaccagc

SEQ ID NO: 3926898 - RNA, 19 nt, Shigella flexneri 2a str. 301
gaccagcggguugcugaga

SEQ ID NO: 3926899 - RNA, 20 nt, Shigella flexneri 2a str. 301
gaccagcgucgcaucaggca

SEQ ID NO: 3926900 - RNA, 21 nt, Shigella flexneri 2a str. 301
gaccagcgucgcaucaggcau

SEQ ID NO: 3926901 - RNA, 16 nt, Shigella flexneri 2a str. 301
gaccagcuccagcaga

SEQ ID NO: 3926902 - RNA, 18 nt, Shigella flexneri 2a str. 301
gaccagcuccagcagacc

SEQ ID NO: 3926903 - RNA, 23 nt, Shigella flexneri 2a str. 301
gaccagcugccgacgccaguucu

SEQ ID NO: 3926904 - RNA, 16 nt, Shigella flexneri 2a str. 301
gaccaggaaacccaac

SEQ ID NO: 3926905 - RNA, 16 nt, Shigella flexneri 2a str. 301
gaccaggcaaaccagu

SEQ ID NO: 3926906 - RNA, 15 nt, Shigella flexneri 2a str. 301
gaccaggccaucagc

SEQ ID NO: 3926907 - RNA, 13 nt, Shigella flexneri 2a str. 301
gaccaguaccacc

SEQ ID NO: 3926908 - RNA, 18 nt, Shigella flexneri 2a str. 301
gaccaguucacaccagcc

SEQ ID NO: 3926909 - RNA, 17 nt, Shigella flexneri 2a str. 301
gaccauaaauaugguga

SEQ ID NO: 3926910 - RNA, 15 nt, Shigella flexneri 2a str. 301
gaccauacagcagca

SEQ ID NO: 3926911 - RNA, 19 nt, Shigella flexneri 2a str. 301
gaccauacagcagcaacga

SEQ ID NO: 3926912 - RNA, 16 nt, Shigella flexneri 2a str. 301
gaccauauuagccgcc

SEQ ID NO: 3926913 - RNA, 17 nt, Shigella flexneri 2a str. 301
gaccaucagcaugacaa

SEQ ID NO: 3926914 - RNA, 13 nt, Shigella flexneri 2a str. 301
gaccaucccacca

SEQ ID NO: 3926915 - RNA, 15 nt, Shigella flexneri 2a str. 301
gaccaucccaccacc

SEQ ID NO: 3926916 - RNA, 20 nt, Shigella flexneri 2a str. 301
gaccaucccaccaccagcaa

SEQ ID NO: 3926917 - RNA, 21 nt, Shigella flexneri 2a str. 301
gaccaucccaccaccagcaau

SEQ ID NO: 3926918 - RNA, 19 nt, Shigella flexneri 2a str. 301
gaccaucuccuuacugccc

SEQ ID NO: 3926919 - RNA, 18 nt, Shigella flexneri 2a str. 301
gaccaucuuccaguugca

SEQ ID NO: 3926920 - RNA, 21 nt, Shigella flexneri 2a str. 301
gaccaucuuccaguugcacgc

SEQ ID NO: 3926921 - RNA, 23 nt, Shigella flexneri 2a str. 301
gaccauugaugcucuccgccauc

SEQ ID NO: 3926922 - RNA, 16 nt, Shigella flexneri 2a str. 301
gacccaccccagcagc

SEQ ID NO: 3926923 - RNA, 11 nt, Shigella flexneri 2a str. 301
gacccagcaag

SEQ ID NO: 3926924 - RNA, 20 nt, Shigella flexneri 2a str. 301
gacccagcaccaguaccauu

SEQ ID NO: 3926925 - RNA, 19 nt, Shigella flexneri 2a str. 301
gacccagccagacgccagc

SEQ ID NO: 3926926 - RNA, 19 nt, Shigella flexneri 2a str. 301
gaccccaaccgcccugcgg

SEQ ID NO: 3926927 - RNA, 20 nt, Shigella flexneri 2a str. 301
gaccccgaacucaucucucg

SEQ ID NO: 3926928 - RNA, 16 nt, Shigella flexneri 2a str. 301
gacccgagccacguca

SEQ ID NO: 3926929 - RNA, 15 nt, Shigella flexneri 2a str. 301
gacccggcggcgcgc

SEQ ID NO: 3926930 - RNA, 19 nt, Shigella flexneri 2a str. 301
gacccguuuacggcuaaaa

SEQ ID NO: 3926931 - RNA, 22 nt, Shigella flexneri 2a str. 301
gacccugcguugucgcagugaa

SEQ ID NO: 3926932 - RNA, 23 nt, Shigella flexneri 2a str. 301
gacccugcguugucgcagugaag

SEQ ID NO: 3926933 - RNA, 16 nt, Shigella flexneri 2a str. 301
gacccugcucuuucag

SEQ ID NO: 3926934 - RNA, 20 nt, Shigella flexneri 2a str. 301
gacccugcucuuucagcacc

SEQ ID NO: 3926935 - RNA, 21 nt, Shigella flexneri 2a str. 301
gacccugcucuuucagcaccg

SEQ ID NO: 3926936 - RNA, 19 nt, Shigella flexneri 2a str. 301
gacccugcuucggcggggu

SEQ ID NO: 3926937 - RNA, 14 nt, Shigella flexneri 2a str. 301
gaccgaaugcaguc

SEQ ID NO: 3926938 - RNA, 18 nt, Shigella flexneri 2a str. 301
gaccgauccaguggcugu

SEQ ID NO: 3926939 - RNA, 17 nt, Shigella flexneri 2a str. 301
gaccgaugucgucccuu

SEQ ID NO: 3926940 - RNA, 15 nt, Shigella flexneri 2a str. 301
gaccgcaaccggccg

SEQ ID NO: 3926941 - RNA, 19 nt, Shigella flexneri 2a str. 301
gaccgcacaccccggcggc

SEQ ID NO: 3926942 - RNA, 13 nt, Shigella flexneri 2a str. 301
gaccgccagcgcc

SEQ ID NO: 3926943 - RNA, 14 nt, Shigella flexneri 2a str. 301
gaccgccagcgcca

SEQ ID NO: 3926944 - RNA, 17 nt, Shigella flexneri 2a str. 301
gaccgccgccaaucacc

SEQ ID NO: 3926945 - RNA, 17 nt, Shigella flexneri 2a str. 301
gaccgccuucagucaua

SEQ ID NO: 3926946 - RNA, 15 nt, Shigella flexneri 2a str. 301
gaccgcuccgccauc

SEQ ID NO: 3926947 - RNA, 23 nt, Shigella flexneri 2a str. 301
gaccgcuucaaaguucugugucu

SEQ ID NO: 3926948 - RNA, 20 nt, Shigella flexneri 2a str. 301
gaccggcgucgcauccggca

SEQ ID NO: 3926949 - RNA, 14 nt, Shigella flexneri 2a str. 301
gaccgggcgcggcu

SEQ ID NO: 3926950 - RNA, 20 nt, Shigella flexneri 2a str. 301
gaccguacccgcugcugacu

SEQ ID NO: 3926951 - RNA, 24 nt, Shigella flexneri 2a str. 301
gaccguugauuuuauuggcauggu

SEQ ID NO: 3926952 - RNA, 14 nt, Shigella flexneri 2a str. 301
gaccuaccaucucc

SEQ ID NO: 3926953 - RNA, 18 nt, Shigella flexneri 2a str. 301
gaccuacugcuaucacaa

SEQ ID NO: 3926954 - RNA, 15 nt, Shigella flexneri 2a str. 301
gaccucaaaggccga

SEQ ID NO: 3926955 - RNA, 14 nt, Shigella flexneri 2a str. 301
gaccucaacaaaau

SEQ ID NO: 3926956 - RNA, 17 nt, Shigella flexneri 2a str. 301
gaccucaagcucgccac

SEQ ID NO: 3926957 - RNA, 18 nt, Shigella flexneri 2a str. 301
gaccucaagcucgccacc

SEQ ID NO: 3926958 - RNA, 19 nt, Shigella flexneri 2a str. 301
gaccucaagcucgccacca

SEQ ID NO: 3926959 - RNA, 22 nt, Shigella flexneri 2a str. 301
gaccucuucugccuguccacca

SEQ ID NO: 3926960 - RNA, 16 nt, Shigella flexneri 2a str. 301
gaccugacaaccggau

SEQ ID NO: 3926961 - RNA, 15 nt, Shigella flexneri 2a str. 301
gaccugauacauagc

SEQ ID NO: 3926962 - RNA, 20 nt, Shigella flexneri 2a str. 301
gaccugcagaaaauccucaa

SEQ ID NO: 3926963 - RNA, 15 nt, Shigella flexneri 2a str. 301
gaccugcgccugcac

SEQ ID NO: 3926964 - RNA, 14 nt, Shigella flexneri 2a str. 301
gaccugcgucacca

SEQ ID NO: 3926965 - RNA, 15 nt, Shigella flexneri 2a str. 301
gaccugggaaaucca

SEQ ID NO: 3926966 - RNA, 14 nt, Shigella flexneri 2a str. 301
gaccugguugcugg

SEQ ID NO: 3926967 - RNA, 23 nt, Shigella flexneri 2a str. 301
gaccugucggggccagcgcaucc

SEQ ID NO: 3926968 - RNA, 17 nt, Shigella flexneri 2a str. 301
gaccuucuucagcaaua

SEQ ID NO: 3926969 - RNA, 19 nt, Shigella flexneri 2a str. 301
gaccuuucaguuugccgcu

SEQ ID NO: 3926970 - RNA, 18 nt, Shigella flexneri 2a str. 301
gaccuuucgaacccaacc

SEQ ID NO: 3926971 - RNA, 12 nt, Shigella flexneri 2a str. 301
gaccuuucugau

SEQ ID NO: 3926972 - RNA, 13 nt, Shigella flexneri 2a str. 301
gaccuuuuuucag

SEQ ID NO: 3926973 - RNA, 15 nt, Shigella flexneri 2a str. 301
gacgaaagucugggc

SEQ ID NO: 3926974 - RNA, 16 nt, Shigella flexneri 2a str. 301
gacgaaauccccccgg

SEQ ID NO: 3926975 - RNA, 13 nt, Shigella flexneri 2a str. 301
gacgaaccggcac

SEQ ID NO: 3926976 - RNA, 18 nt, Shigella flexneri 2a str. 301
gacgaacguuuaauaaaa

SEQ ID NO: 3926977 - RNA, 23 nt, Shigella flexneri 2a str. 301
gacgaagauguuguacagcgaaa

SEQ ID NO: 3926978 - RNA, 16 nt, Shigella flexneri 2a str. 301
gacgaagcaaccgcca

SEQ ID NO: 3926979 - RNA, 20 nt, Shigella flexneri 2a str. 301
gacgaagcgccuucgauaau

SEQ ID NO: 3926980 - RNA, 12 nt, Shigella flexneri 2a str. 301
gacgacaggcaa

SEQ ID NO: 3926981 - RNA, 15 nt, Shigella flexneri 2a str. 301
gacgacaggcaagca

SEQ ID NO: 3926982 - RNA, 14 nt, Shigella flexneri 2a str. 301
gacgaccaaugaca

SEQ ID NO: 3926983 - RNA, 15 nt, Shigella flexneri 2a str. 301
gacgaccugauuuug

SEQ ID NO: 3926984 - RNA, 22 nt, Shigella flexneri 2a str. 301
gacgacgccccggccuugccug

SEQ ID NO: 3926985 - RNA, 11 nt, Shigella flexneri 2a str. 301
gacgacgcuga

SEQ ID NO: 3926986 - RNA, 18 nt, Shigella flexneri 2a str. 301
gacgacguaccagcgucg

SEQ ID NO: 3926987 - RNA, 14 nt, Shigella flexneri 2a str. 301
gacgauacaacgcu

SEQ ID NO: 3926988 - RNA, 17 nt, Shigella flexneri 2a str. 301
gacgauagaaccuucca

SEQ ID NO: 3926989 - RNA, 15 nt, Shigella flexneri 2a str. 301
gacgaucaacccagu

SEQ ID NO: 3926990 - RNA, 16 nt, Shigella flexneri 2a str. 301
gacgaucgcagaugaa

SEQ ID NO: 3926991 - RNA, 17 nt, Shigella flexneri 2a str. 301
gacgaucuucggcguca

SEQ ID NO: 3926992 - RNA, 21 nt, Shigella flexneri 2a str. 301
gacgaugggucacugugacgu

SEQ ID NO: 3926993 - RNA, 22 nt, Shigella flexneri 2a str. 301
gacguucuucgcugacaguacc

SEQ ID NO: 3926994 - RNA, 19 nt, Shigella flexneri 2a str. 301
gacguugauaaccacggcg

SEQ ID NO: 3926995 - RNA, 14 nt, Shigella flexneri 2a str. 301
gacguuguucaggu

SEQ ID NO: 3926996 - RNA, 17 nt, Shigella flexneri 2a str. 301
gacguuugcgcccagcc

SEQ ID NO: 3926997 - RNA, 20 nt, Shigella flexneri 2a str. 301
gacguuuuacagcaacgggc

SEQ ID NO: 3926998 - RNA, 21 nt, Shigella flexneri 2a str. 301
gacuaaauuucacugcuuaau

SEQ ID NO: 3926999 - RNA, 14 nt, Shigella flexneri 2a str. 301
gacuaacuucugau

SEQ ID NO: 3927000 - RNA, 15 nt, Shigella flexneri 2a str. 301
gacuaauuucucgcc

SEQ ID NO: 3927001 - RNA, 15 nt, Shigella flexneri 2a str. 301
gacuaccauccgagu

SEQ ID NO: 3927002 - RNA, 21 nt, Shigella flexneri 2a str. 301
gacuaccggggacaggcggcc

SEQ ID NO: 3927003 - RNA, 20 nt, Shigella flexneri 2a str. 301
gacuacgacgccaagaaaga

SEQ ID NO: 3927004 - RNA, 15 nt, Shigella flexneri 2a str. 301
gacuacgccaacaga

SEQ ID NO: 3927005 - RNA, 18 nt, Shigella flexneri 2a str. 301
gacuacgccaacagaagu

SEQ ID NO: 3927006 - RNA, 17 nt, Shigella flexneri 2a str. 301
gacuagcgccauaauaa

SEQ ID NO: 3927007 - RNA, 16 nt, Shigella flexneri 2a str. 301
gacuagcucaauaaaa

SEQ ID NO: 3927008 - RNA, 18 nt, Shigella flexneri 2a str. 301
gacuagcucaauaaaaga

SEQ ID NO: 3927009 - RNA, 21 nt, Shigella flexneri 2a str. 301
gacuagcucaauaaaagaaau

SEQ ID NO: 3927010 - RNA, 16 nt, Shigella flexneri 2a str. 301
gacuagugauaaccac

SEQ ID NO: 3927011 - RNA, 13 nt, Shigella flexneri 2a str. 301
gacuaucaucgcc

SEQ ID NO: 3927012 - RNA, 13 nt, Shigella flexneri 2a str. 301
gacuaucauugcg

SEQ ID NO: 3927013 - RNA, 20 nt, Shigella flexneri 2a str. 301
gacuaucgcgacgaauaggu

SEQ ID NO: 3927014 - RNA, 19 nt, Shigella flexneri 2a str. 301
gacuauuuuuuugauaauc

SEQ ID NO: 3927015 - RNA, 18 nt, Shigella flexneri 2a str. 301
gacucccgcgccgcagcc

SEQ ID NO: 3927016 - RNA, 20 nt, Shigella flexneri 2a str. 301
gacuccugacuugccagaua

SEQ ID NO: 3927017 - RNA, 16 nt, Shigella flexneri 2a str. 301
gacucgccgcugugga

SEQ ID NO: 3927018 - RNA, 21 nt, Shigella flexneri 2a str. 301
gacucggagucgacuucagau

SEQ ID NO: 3927019 - RNA, 16 nt, Shigella flexneri 2a str. 301
gacucgguugcacaga

SEQ ID NO: 3927020 - RNA, 14 nt, Shigella flexneri 2a str. 301
gacucugaaacucg

SEQ ID NO: 3927021 - RNA, 18 nt, Shigella flexneri 2a str. 301
gacucuguagcgggaaag

SEQ ID NO: 3927022 - RNA, 20 nt, Shigella flexneri 2a str. 301
gacucuuacucuuucaauuu

SEQ ID NO: 3927023 - RNA, 20 nt, Shigella flexneri 2a str. 301
gacugaaauuacaggcagua

SEQ ID NO: 3927024 - RNA, 18 nt, Shigella flexneri 2a str. 301
gacugaccgaaaccguaa

SEQ ID NO: 3927025 - RNA, 15 nt, Shigella flexneri 2a str. 301
gacugacgugaugau

SEQ ID NO: 3927026 - RNA, 15 nt, Shigella flexneri 2a str. 301
gacugaggccgccac

SEQ ID NO: 3927027 - RNA, 14 nt, Shigella flexneri 2a str. 301
gacugauaucccgc

SEQ ID NO: 3927028 - RNA, 19 nt, Shigella flexneri 2a str. 301
gacugauaucugcccgcac

SEQ ID NO: 3927029 - RNA, 17 nt, Shigella flexneri 2a str. 301
gacugaugacaaacgca

SEQ ID NO: 3927030 - RNA, 12 nt, Shigella flexneri 2a str. 301
gacugcagcggu

SEQ ID NO: 3927031 - RNA, 14 nt, Shigella flexneri 2a str. 301
gacugcccgcgagc

SEQ ID NO: 3927032 - RNA, 14 nt, Shigella flexneri 2a str. 301
gacugccgcucacc

SEQ ID NO: 3927033 - RNA, 18 nt, Shigella flexneri 2a str. 301
gacugccgcucaccugac

SEQ ID NO: 3927034 - RNA, 22 nt, Shigella flexneri 2a str. 301
gacugcgccacuucccagccuu

SEQ ID NO: 3927035 - RNA, 15 nt, Shigella flexneri 2a str. 301
gacugcgccgugucg

SEQ ID NO: 3927036 - RNA, 15 nt, Shigella flexneri 2a str. 301
gacugcgcgccgccg

SEQ ID NO: 3927037 - RNA, 18 nt, Shigella flexneri 2a str. 301
gacugcgcgccgccgcug

SEQ ID NO: 3927038 - RNA, 20 nt, Shigella flexneri 2a str. 301
gacugcggcgugggcgcugu

SEQ ID NO: 3927039 - RNA, 17 nt, Shigella flexneri 2a str. 301
gacugcucagcuccucu

SEQ ID NO: 3927040 - RNA, 12 nt, Shigella flexneri 2a str. 301
gacugcuccugu

SEQ ID NO: 3927041 - RNA, 17 nt, Shigella flexneri 2a str. 301
gacuggaauaagccaaa

SEQ ID NO: 3927042 - RNA, 22 nt, Shigella flexneri 2a str. 301
gacuggaauaagccaaauccag

SEQ ID NO: 3927043 - RNA, 23 nt, Shigella flexneri 2a str. 301
gacuggaauaagccaaauccagc

SEQ ID NO: 3927044 - RNA, 16 nt, Shigella flexneri 2a str. 301
gacuggcaaagcaggc

SEQ ID NO: 3927045 - RNA, 19 nt, Shigella flexneri 2a str. 301
gacuggcaugcuguccagc

SEQ ID NO: 3927046 - RNA, 13 nt, Shigella flexneri 2a str. 301
gacuggcggcaaa

SEQ ID NO: 3927047 - RNA, 21 nt, Shigella flexneri 2a str. 301
gacuggcggcaaaacagggcu

SEQ ID NO: 3927048 - RNA, 20 nt, Shigella flexneri 2a str. 301
gacuguaaauaaaccaccug

SEQ ID NO: 3927049 - RNA, 16 nt, Shigella flexneri 2a str. 301
gacuguacagauccgc

SEQ ID NO: 3927050 - RNA, 16 nt, Shigella flexneri 2a str. 301
gacugucgcagccagc

SEQ ID NO: 3927051 - RNA, 18 nt, Shigella flexneri 2a str. 301
gacugucgcagccagcgc

SEQ ID NO: 3927052 - RNA, 21 nt, Shigella flexneri 2a str. 301
gacuguuauugcgcaggcgcg

SEQ ID NO: 3927053 - RNA, 20 nt, Shigella flexneri 2a str. 301
gacuuaaaaggaaaaucaca

SEQ ID NO: 3927054 - RNA, 15 nt, Shigella flexneri 2a str. 301
gacuuauaagucuca

SEQ ID NO: 3927055 - RNA, 19 nt, Shigella flexneri 2a str. 301
gacuuauaagucucagaaa

SEQ ID NO: 3927056 - RNA, 13 nt, Shigella flexneri 2a str. 301
gacuuauucuuca

SEQ ID NO: 3927057 - RNA, 14 nt, Shigella flexneri 2a str. 301
gacuuauucuucaa

SEQ ID NO: 3927058 - RNA, 14 nt, Shigella flexneri 2a str. 301
gacuucagauaaau

SEQ ID NO: 3927059 - RNA, 13 nt, Shigella flexneri 2a str. 301
gacuuccagcgua

SEQ ID NO: 3927060 - RNA, 14 nt, Shigella flexneri 2a str. 301
gacuucuucauuca

SEQ ID NO: 3927061 - RNA, 17 nt, Shigella flexneri 2a str. 301
gacuucuucauucaucc

SEQ ID NO: 3927062 - RNA, 15 nt, Shigella flexneri 2a str. 301
gacuugaaccagcga

SEQ ID NO: 3927063 - RNA, 17 nt, Shigella flexneri 2a str. 301
gacuuuaaucaccugcc

SEQ ID NO: 3927064 - RNA, 23 nt, Shigella flexneri 2a str. 301
gacuuuaaucaccugccagggag

SEQ ID NO: 3927065 - RNA, 21 nt, Shigella flexneri 2a str. 301
gacuuuauaccuugcggaagc

SEQ ID NO: 3927066 - RNA, 24 nt, Shigella flexneri 2a str. 301
gacuuucuggcacgaccuggcagc

SEQ ID NO: 3927067 - RNA, 22 nt, Shigella flexneri 2a str. 301
gacuuugauccagccauugcca

SEQ ID NO: 3927068 - RNA, 12 nt, Shigella flexneri 2a str. 301
gacuuugccugg

SEQ ID NO: 3927069 - RNA, 18 nt, Shigella flexneri 2a str. 301
gacuuugccuggcggcag

SEQ ID NO: 3927070 - RNA, 20 nt, Shigella flexneri 2a str. 301
gacuuuguuuuuaguuaaau

SEQ ID NO: 3927071 - RNA, 23 nt, Shigella flexneri 2a str. 301
gacuuuucaggcuagccgccagc

SEQ ID NO: 3927072 - RNA, 22 nt, Shigella flexneri 2a str. 301
gacuuuucauaagcgucagaaa

SEQ ID NO: 3927073 - RNA, 23 nt, Shigella flexneri 2a str. 301
gacuuuuuucaugggugccagau

SEQ ID NO: 3927074 - RNA, 14 nt, Shigella flexneri 2a str. 301
gagaaaaagcgaag

SEQ ID NO: 3927075 - RNA, 11 nt, Shigella flexneri 2a str. 301
gagaaaaauag

SEQ ID NO: 3927076 - RNA, 14 nt, Shigella flexneri 2a str. 301
gagaaaaauagcau

SEQ ID NO: 3927077 - RNA, 21 nt, Shigella flexneri 2a str. 301
gagaaaaauaucguaggccug

SEQ ID NO: 3927078 - RNA, 21 nt, Shigella flexneri 2a str. 301
gagaaaaccgaugcagugcgg

SEQ ID NO: 3927079 - RNA, 14 nt, Shigella flexneri 2a str. 301
gagaaaaccggugu

SEQ ID NO: 3927080 - RNA, 23 nt, Shigella flexneri 2a str. 301
gagaaaauuucauuaauaucagg

SEQ ID NO: 3927081 - RNA, 16 nt, Shigella flexneri 2a str. 301
gagaaagcaaaaauaa

SEQ ID NO: 3927082 - RNA, 22 nt, Shigella flexneri 2a str. 301
gagaaaguaaaccaccaguccu

SEQ ID NO: 3927083 - RNA, 18 nt, Shigella flexneri 2a str. 301
gagaaagucguaggccug

SEQ ID NO: 3927084 - RNA, 17 nt, Shigella flexneri 2a str. 301
gagaacaaggcuuuaau

SEQ ID NO: 3927085 - RNA, 16 nt, Shigella flexneri 2a str. 301
gagaacaccaccugcc

SEQ ID NO: 3927086 - RNA, 22 nt, Shigella flexneri 2a str. 301
gagaacaccaccugccagagcu

SEQ ID NO: 3927087 - RNA, 18 nt, Shigella flexneri 2a str. 301
gagaacaucaauccaaac

SEQ ID NO: 3927088 - RNA, 17 nt, Shigella flexneri 2a str. 301
gagaaccuuuacgcaga

SEQ ID NO: 3927089 - RNA, 12 nt, Shigella flexneri 2a str. 301
gagaacgaugcu

SEQ ID NO: 3927090 - RNA, 15 nt, Shigella flexneri 2a str. 301
gagaagaccgccgcu

SEQ ID NO: 3927091 - RNA, 21 nt, Shigella flexneri 2a str. 301
gagaagcacguucaucccacu

SEQ ID NO: 3927092 - RNA, 14 nt, Shigella flexneri 2a str. 301
gagaagcuggaagg

SEQ ID NO: 3927093 - RNA, 17 nt, Shigella flexneri 2a str. 301
gagcuaaagggccuuaa

SEQ ID NO: 3927094 - RNA, 23 nt, Shigella flexneri 2a str. 301
gagcuaaugcaaaucacgcugcu

SEQ ID NO: 3927095 - RNA, 15 nt, Shigella flexneri 2a str. 301
gagcuaccggcagga

SEQ ID NO: 3927096 - RNA, 16 nt, Shigella flexneri 2a str. 301
gagcucaauacaaccc

SEQ ID NO: 3927097 - RNA, 20 nt, Shigella flexneri 2a str. 301
gagcucccaggcuccgccag

SEQ ID NO: 3927098 - RNA, 22 nt, Shigella flexneri 2a str. 301
gagcugauacgggaggucauca

SEQ ID NO: 3927099 - RNA, 12 nt, Shigella flexneri 2a str. 301
gagcugcaacca

SEQ ID NO: 3927100 - RNA, 20 nt, Shigella flexneri 2a str. 301
gagcuggcgaacgugcagga

SEQ ID NO: 3927101 - RNA, 12 nt, Shigella flexneri 2a str. 301
gagcuggucuga

SEQ ID NO: 3927102 - RNA, 18 nt, Shigella flexneri 2a str. 301
gagcuucacccgcagcac

SEQ ID NO: 3927103 - RNA, 22 nt, Shigella flexneri 2a str. 301
gagcuuugacgaccuucuucca

SEQ ID NO: 3927104 - RNA, 14 nt, Shigella flexneri 2a str. 301
gaggaagacaacca

SEQ ID NO: 3927105 - RNA, 13 nt, Shigella flexneri 2a str. 301
gaggaauggcaga

SEQ ID NO: 3927106 - RNA, 21 nt, Shigella flexneri 2a str. 301
gaggacgcguuuaauggcggu

SEQ ID NO: 3927107 - RNA, 21 nt, Shigella flexneri 2a str. 301
gaggagagugcaaugaaaaac

SEQ ID NO: 3927108 - RNA, 16 nt, Shigella flexneri 2a str. 301
gaggagccaucaccau

SEQ ID NO: 3927109 - RNA, 14 nt, Shigella flexneri 2a str. 301
gaggaguuuaauaa

SEQ ID NO: 3927110 - RNA, 17 nt, Shigella flexneri 2a str. 301
gaggauaauauuuuugc

SEQ ID NO: 3927111 - RNA, 12 nt, Shigella flexneri 2a str. 301
gaggaucaccag

SEQ ID NO: 3927112 - RNA, 14 nt, Shigella flexneri 2a str. 301
gaggauucgaaccu

SEQ ID NO: 3927113 - RNA, 18 nt, Shigella flexneri 2a str. 301
gaggcaaaccuuaaagca

SEQ ID NO: 3927114 - RNA, 16 nt, Shigella flexneri 2a str. 301
gaggcaauaguucugu

SEQ ID NO: 3927115 - RNA, 15 nt, Shigella flexneri 2a str. 301
gaggcagcaaggaaa

SEQ ID NO: 3927116 - RNA, 17 nt, Shigella flexneri 2a str. 301
gaggcagcaaggaaaac

SEQ ID NO: 3927117 - RNA, 17 nt, Shigella flexneri 2a str. 301
gaggcauuggcaaauuu

SEQ ID NO: 3927118 - RNA, 15 nt, Shigella flexneri 2a str. 301
gaggccaaucagcaa

SEQ ID NO: 3927119 - RNA, 13 nt, Shigella flexneri 2a str. 301
gaggccgccacac

SEQ ID NO: 3927120 - RNA, 20 nt, Shigella flexneri 2a str. 301
gaggccuucgccugaugaua

SEQ ID NO: 3927121 - RNA, 22 nt, Shigella flexneri 2a str. 301
gaggcgcuggcgcauguuggcg

SEQ ID NO: 3927122 - RNA, 19 nt, Shigella flexneri 2a str. 301
gaggcguaauuuccacgcc

SEQ ID NO: 3927123 - RNA, 20 nt, Shigella flexneri 2a str. 301
gaggcgucagcguuccacgu

SEQ ID NO: 3927124 - RNA, 17 nt, Shigella flexneri 2a str. 301
gaggcuuauccggcaug

SEQ ID NO: 3927125 - RNA, 22 nt, Shigella flexneri 2a str. 301
gaggcuucuuuuuuauggcugg

SEQ ID NO: 3927126 - RNA, 18 nt, Shigella flexneri 2a str. 301
gaggcuuuaauaccugcc

SEQ ID NO: 3927127 - RNA, 23 nt, Shigella flexneri 2a str. 301
gaggcuuuaauaccugccuggua

SEQ ID NO: 3927128 - RNA, 17 nt, Shigella flexneri 2a str. 301
gagggaaauagagaaau

SEQ ID NO: 3927129 - RNA, 19 nt, Shigella flexneri 2a str. 301
gagggaaccuguucaacaa

SEQ ID NO: 3927130 - RNA, 14 nt, Shigella flexneri 2a str. 301
gagggaauccagca

SEQ ID NO: 3927131 - RNA, 22 nt, Shigella flexneri 2a str. 301
gagggauaucuucccgccguug

SEQ ID NO: 3927132 - RNA, 17 nt, Shigella flexneri 2a str. 301
gagggcaaacaggcgcu

SEQ ID NO: 3927133 - RNA, 22 nt, Shigella flexneri 2a str. 301
gagggcaaaggcgcggcggcga

SEQ ID NO: 3927134 - RNA, 16 nt, Shigella flexneri 2a str. 301
gaggggcggcucuccu

SEQ ID NO: 3927135 - RNA, 23 nt, Shigella flexneri 2a str. 301
gaggggcuuucccguuucagccc

SEQ ID NO: 3927136 - RNA, 19 nt, Shigella flexneri 2a str. 301
gagguacaaccgcaaaggu

SEQ ID NO: 3927137 - RNA, 16 nt, Shigella flexneri 2a str. 301
gagguacgcuccagca

SEQ ID NO: 3927138 - RNA, 14 nt, Shigella flexneri 2a str. 301
gaggucaaaaucca

SEQ ID NO: 3927139 - RNA, 14 nt, Shigella flexneri 2a str. 301
gaggucgcuggcgu

SEQ ID NO: 3927140 - RNA, 12 nt, Shigella flexneri 2a str. 301
gagguguucaua

SEQ ID NO: 3927141 - RNA, 16 nt, Shigella flexneri 2a str. 301
gagguuaaaaagugcu

SEQ ID NO: 3927142 - RNA, 16 nt, Shigella flexneri 2a str. 301
gagguuauccgccagc

SEQ ID NO: 3927143 - RNA, 15 nt, Shigella flexneri 2a str. 301
gaguaaacggcagag

SEQ ID NO: 3927144 - RNA, 14 nt, Shigella flexneri 2a str. 301
gaguaacagauugu

SEQ ID NO: 3927145 - RNA, 20 nt, Shigella flexneri 2a str. 301
gaguaacgggcacguaaauc

SEQ ID NO: 3927146 - RNA, 17 nt, Shigella flexneri 2a str. 301
gaguaauagaugauagu

SEQ ID NO: 3927147 - RNA, 14 nt, Shigella flexneri 2a str. 301
gaguaaucgccagc

SEQ ID NO: 3927148 - RNA, 12 nt, Shigella flexneri 2a str. 301
gaguaccagcgc

SEQ ID NO: 3927149 - RNA, 21 nt, Shigella flexneri 2a str. 301
gaguauccaaaucgcaguagc

SEQ ID NO: 3927150 - RNA, 19 nt, Shigella flexneri 2a str. 301
gaguauguuaccugugaau

SEQ ID NO: 3927151 - RNA, 17 nt, Shigella flexneri 2a str. 301
gaguauucuugcugaua

SEQ ID NO: 3927152 - RNA, 18 nt, Shigella flexneri 2a str. 301
gagucacucgacagcacc

SEQ ID NO: 3927153 - RNA, 16 nt, Shigella flexneri 2a str. 301
gagucagcccaacaaa

SEQ ID NO: 3927154 - RNA, 17 nt, Shigella flexneri 2a str. 301
gagucagcccaacaaag

SEQ ID NO: 3927155 - RNA, 22 nt, Shigella flexneri 2a str. 301
gagucauucuccagaucuuccg

SEQ ID NO: 3927156 - RNA, 19 nt, Shigella flexneri 2a str. 301
gagucgccugcucuaacca

SEQ ID NO: 3927157 - RNA, 14 nt, Shigella flexneri 2a str. 301
gagucgggucgccg

SEQ ID NO: 3927158 - RNA, 23 nt, Shigella flexneri 2a str. 301
gagucugaccgucgaugaaagcg

SEQ ID NO: 3927159 - RNA, 13 nt, Shigella flexneri 2a str. 301
gagugaaaaugcc

SEQ ID NO: 3927160 - RNA, 19 nt, Shigella flexneri 2a str. 301
gagugacaguucaaucucc

SEQ ID NO: 3927161 - RNA, 22 nt, Shigella flexneri 2a str. 301
gagugacgucauagcaguaccu

SEQ ID NO: 3927162 - RNA, 18 nt, Shigella flexneri 2a str. 301
gagugauacguaaaccac

SEQ ID NO: 3927163 - RNA, 16 nt, Shigella flexneri 2a str. 301
gagugcggaugacgau

SEQ ID NO: 3927164 - RNA, 21 nt, Shigella flexneri 2a str. 301
gagugcguucaccgaagacgu

SEQ ID NO: 3927165 - RNA, 21 nt, Shigella flexneri 2a str. 301
gagugcguuccccgaagacgu

SEQ ID NO: 3927166 - RNA, 20 nt, Shigella flexneri 2a str. 301
gaguggaacaauacaggacg

SEQ ID NO: 3927167 - RNA, 15 nt, Shigella flexneri 2a str. 301
gaguggcccagguua

SEQ ID NO: 3927168 - RNA, 20 nt, Shigella flexneri 2a str. 301
gaguggugaaaaaaaggcga

SEQ ID NO: 3927169 - RNA, 14 nt, Shigella flexneri 2a str. 301
gaguguggcguggc

SEQ ID NO: 3927170 - RNA, 20 nt, Shigella flexneri 2a str. 301
gaguguuauaaaacgcgccc

SEQ ID NO: 3927171 - RNA, 19 nt, Shigella flexneri 2a str. 301
gaguuaccagcggccggau

SEQ ID NO: 3927172 - RNA, 18 nt, Shigella flexneri 2a str. 301
gaguucaauuggccugau

SEQ ID NO: 3927173 - RNA, 20 nt, Shigella flexneri 2a str. 301
gaguucaucacaccagucca

SEQ ID NO: 3927174 - RNA, 23 nt, Shigella flexneri 2a str. 301
gaguuccaacgcagcacguaauu

SEQ ID NO: 3927175 - RNA, 18 nt, Shigella flexneri 2a str. 301
gaguucgucgaguuuaua

SEQ ID NO: 3927176 - RNA, 14 nt, Shigella flexneri 2a str. 301
gaguugaaaaccuc

SEQ ID NO: 3927177 - RNA, 21 nt, Shigella flexneri 2a str. 301
gaguugagcaguccccacauc

SEQ ID NO: 3927178 - RNA, 15 nt, Shigella flexneri 2a str. 301
gaguugcaccagcaa

SEQ ID NO: 3927179 - RNA, 22 nt, Shigella flexneri 2a str. 301
gaguugcaccagcaacaagcca

SEQ ID NO: 3927180 - RNA, 15 nt, Shigella flexneri 2a str. 301
gaguuuuaaacgcag

SEQ ID NO: 3927181 - RNA, 12 nt, Shigella flexneri 2a str. 301
gauaaaaaugaa

SEQ ID NO: 3927182 - RNA, 21 nt, Shigella flexneri 2a str. 301
gauaaaacgcagucuucccag

SEQ ID NO: 3927183 - RNA, 14 nt, Shigella flexneri 2a str. 301
gauaaaacuucccg

SEQ ID NO: 3927184 - RNA, 13 nt, Shigella flexneri 2a str. 301
gauaaaauacuua

SEQ ID NO: 3927185 - RNA, 19 nt, Shigella flexneri 2a str. 301
gauaaacaguuucgccagg

SEQ ID NO: 3927186 - RNA, 15 nt, Shigella flexneri 2a str. 301
gauaaaccuccagca

SEQ ID NO: 3927187 - RNA, 17 nt, Shigella flexneri 2a str. 301
gauaaaccuccagcauc

SEQ ID NO: 3927188 - RNA, 16 nt, Shigella flexneri 2a str. 301
gauaaacggcaggaga

SEQ ID NO: 3927189 - RNA, 17 nt, Shigella flexneri 2a str. 301
gauaaacggcaggagau

SEQ ID NO: 3927190 - RNA, 17 nt, Shigella flexneri 2a str. 301
gauaaacguacauccau

SEQ ID NO: 3927191 - RNA, 14 nt, Shigella flexneri 2a str. 301
gauaaacuccugca

SEQ ID NO: 3927192 - RNA, 12 nt, Shigella flexneri 2a str. 301
gauaaaggucga

SEQ ID NO: 3927193 - RNA, 17 nt, Shigella flexneri 2a str. 301
gauauaaaccaucggcg

SEQ ID NO: 3927194 - RNA, 22 nt, Shigella flexneri 2a str. 301
gauauaauaaaccugccuuaca

SEQ ID NO: 3927195 - RNA, 13 nt, Shigella flexneri 2a str. 301
gauauacagcccg

SEQ ID NO: 3927196 - RNA, 17 nt, Shigella flexneri 2a str. 301
gauauaccgugcugacu

SEQ ID NO: 3927197 - RNA, 14 nt, Shigella flexneri 2a str. 301
gauauagaaaaugg

SEQ ID NO: 3927198 - RNA, 14 nt, Shigella flexneri 2a str. 301
gauaucaccaccaa

SEQ ID NO: 3927199 - RNA, 21 nt, Shigella flexneri 2a str. 301
gauauccagauccagcaccuu

SEQ ID NO: 3927200 - RNA, 16 nt, Shigella flexneri 2a str. 301
gauaucccgccagcac

SEQ ID NO: 3927201 - RNA, 18 nt, Shigella flexneri 2a str. 301
gauaucccgccagcacca

SEQ ID NO: 3927202 - RNA, 23 nt, Shigella flexneri 2a str. 301
gauaucccgccagcaccagcaac

SEQ ID NO: 3927203 - RNA, 14 nt, Shigella flexneri 2a str. 301
gauauccgccaaua

SEQ ID NO: 3927204 - RNA, 15 nt, Shigella flexneri 2a str. 301
gauauccgccaggcu

SEQ ID NO: 3927205 - RNA, 19 nt, Shigella flexneri 2a str. 301
gauauccgccaggcugcga

SEQ ID NO: 3927206 - RNA, 16 nt, Shigella flexneri 2a str. 301
gauaucucaccagauu

SEQ ID NO: 3927207 - RNA, 15 nt, Shigella flexneri 2a str. 301
gauaucugcccgcac

SEQ ID NO: 3927208 - RNA, 23 nt, Shigella flexneri 2a str. 301
gauaucuucccgccguugccgca

SEQ ID NO: 3927209 - RNA, 13 nt, Shigella flexneri 2a str. 301
gauaucuuuccgg

SEQ ID NO: 3927210 - RNA, 18 nt, Shigella flexneri 2a str. 301
gauaugcaguaaggaaau

SEQ ID NO: 3927211 - RNA, 17 nt, Shigella flexneri 2a str. 301
gauaugcaucaugaaaa

SEQ ID NO: 3927212 - RNA, 15 nt, Shigella flexneri 2a str. 301
gauaugccggcauca

SEQ ID NO: 3927213 - RNA, 14 nt, Shigella flexneri 2a str. 301
gauaugcgucagau

SEQ ID NO: 3927214 - RNA, 19 nt, Shigella flexneri 2a str. 301
gauauggcgagaagagagg

SEQ ID NO: 3927215 - RNA, 20 nt, Shigella flexneri 2a str. 301
gauauguucagaaagcgcca

SEQ ID NO: 3927216 - RNA, 23 nt, Shigella flexneri 2a str. 301
gauauguucaggauauuuauauu

SEQ ID NO: 3927217 - RNA, 21 nt, Shigella flexneri 2a str. 301
gauauuauccccugcgauggu

SEQ ID NO: 3927218 - RNA, 14 nt, Shigella flexneri 2a str. 301
gauauuaucuucau

SEQ ID NO: 3927219 - RNA, 23 nt, Shigella flexneri 2a str. 301
gauauuaucuucaucgauacugc

SEQ ID NO: 3927220 - RNA, 22 nt, Shigella flexneri 2a str. 301
gauauucaggcguugaaaaauc

SEQ ID NO: 3927221 - RNA, 11 nt, Shigella flexneri 2a str. 301
gauauucagua

SEQ ID NO: 3927222 - RNA, 18 nt, Shigella flexneri 2a str. 301
gauauucaucuccagcac

SEQ ID NO: 3927223 - RNA, 13 nt, Shigella flexneri 2a str. 301
gauauuccccaga

SEQ ID NO: 3927224 - RNA, 14 nt, Shigella flexneri 2a str. 301
gauauuccugaaug

SEQ ID NO: 3927225 - RNA, 16 nt, Shigella flexneri 2a str. 301
gauauucgacaccauc

SEQ ID NO: 3927226 - RNA, 18 nt, Shigella flexneri 2a str. 301
gauauucgcucgccacuu

SEQ ID NO: 3927227 - RNA, 15 nt, Shigella flexneri 2a str. 301
gauauucuccagcuu

SEQ ID NO: 3927228 - RNA, 21 nt, Shigella flexneri 2a str. 301
gauauugauucaucucuucuu

SEQ ID NO: 3927229 - RNA, 13 nt, Shigella flexneri 2a str. 301
gauauugccaccu

SEQ ID NO: 3927230 - RNA, 21 nt, Shigella flexneri 2a str. 301
gauauugccgcgauagcaagc

SEQ ID NO: 3927231 - RNA, 18 nt, Shigella flexneri 2a str. 301
gauauugcggaacaucgc

SEQ ID NO: 3927232 - RNA, 20 nt, Shigella flexneri 2a str. 301
gauauuuagccagcaacuga

SEQ ID NO: 3927233 - RNA, 16 nt, Shigella flexneri 2a str. 301
gauauuuauuuccuuc

SEQ ID NO: 3927234 - RNA, 16 nt, Shigella flexneri 2a str. 301
gauauuucaccagcgc

SEQ ID NO: 3927235 - RNA, 21 nt, Shigella flexneri 2a str. 301
gauauuuuucccugaaggcug

SEQ ID NO: 3927236 - RNA, 13 nt, Shigella flexneri 2a str. 301
gaucaaacgaagc

SEQ ID NO: 3927237 - RNA, 16 nt, Shigella flexneri 2a str. 301
gaucaaauacuucaau

SEQ ID NO: 3927238 - RNA, 14 nt, Shigella flexneri 2a str. 301
gaucaaaucucgcc

SEQ ID NO: 3927239 - RNA, 17 nt, Shigella flexneri 2a str. 301
gaucaaaucucgccgug

SEQ ID NO: 3927240 - RNA, 14 nt, Shigella flexneri 2a str. 301
gaucaaauuauuac

SEQ ID NO: 3927241 - RNA, 16 nt, Shigella flexneri 2a str. 301
gaucaaauuauuacca

SEQ ID NO: 3927242 - RNA, 15 nt, Shigella flexneri 2a str. 301
gaucaacagcaucau

SEQ ID NO: 3927243 - RNA, 18 nt, Shigella flexneri 2a str. 301
gaucaacagcaucaucgc

SEQ ID NO: 3927244 - RNA, 21 nt, Shigella flexneri 2a str. 301
gaucaaccaccgucgucccuu

SEQ ID NO: 3927245 - RNA, 14 nt, Shigella flexneri 2a str. 301
gaucaacgcuggca

SEQ ID NO: 3927246 - RNA, 17 nt, Shigella flexneri 2a str. 301
gaucaacuuuguucuga

SEQ ID NO: 3927247 - RNA, 18 nt, Shigella flexneri 2a str. 301
gaucaacuuuguucugaa

SEQ ID NO: 3927248 - RNA, 18 nt, Shigella flexneri 2a str. 301
gaucaagcacaugcugac

SEQ ID NO: 3927249 - RNA, 19 nt, Shigella flexneri 2a str. 301
gaucaagcacaugcugaca

SEQ ID NO: 3927250 - RNA, 14 nt, Shigella flexneri 2a str. 301
gaucaaucugcucu

SEQ ID NO: 3927251 - RNA, 23 nt, Shigella flexneri 2a str. 301
gaucaccaguccaucggcauuaa

SEQ ID NO: 3927252 - RNA, 20 nt, Shigella flexneri 2a str. 301
gaucacccacaucagcggca

SEQ ID NO: 3927253 - RNA, 19 nt, Shigella flexneri 2a str. 301
gaucaccgaaccagggcga

SEQ ID NO: 3927254 - RNA, 15 nt, Shigella flexneri 2a str. 301
gaucaccugcacaug

SEQ ID NO: 3927255 - RNA, 19 nt, Shigella flexneri 2a str. 301
gaucacgcggucaaugguc

SEQ ID NO: 3927256 - RNA, 13 nt, Shigella flexneri 2a str. 301
gaucacugcaacu

SEQ ID NO: 3927257 - RNA, 14 nt, Shigella flexneri 2a str. 301
gaucacuuccagca

SEQ ID NO: 3927258 - RNA, 16 nt, Shigella flexneri 2a str. 301
gaucacuuccagcagu

SEQ ID NO: 3927259 - RNA, 20 nt, Shigella flexneri 2a str. 301
gaucacuucgcgcaaccagu

SEQ ID NO: 3927260 - RNA, 20 nt, Shigella flexneri 2a str. 301
gaucagaagcguaaccgagc

SEQ ID NO: 3927261 - RNA, 16 nt, Shigella flexneri 2a str. 301
gaucagagugguggau

SEQ ID NO: 3927262 - RNA, 19 nt, Shigella flexneri 2a str. 301
gaucagcaaauccaucgcc

SEQ ID NO: 3927263 - RNA, 20 nt, Shigella flexneri 2a str. 301
gaucagcauccauaucgcca

SEQ ID NO: 3927264 - RNA, 14 nt, Shigella flexneri 2a str. 301
gaucagccaggcga

SEQ ID NO: 3927265 - RNA, 21 nt, Shigella flexneri 2a str. 301
gaucagcgaagcgugauuguu

SEQ ID NO: 3927266 - RNA, 16 nt, Shigella flexneri 2a str. 301
gaucagcggacgcugc

SEQ ID NO: 3927267 - RNA, 15 nt, Shigella flexneri 2a str. 301
gaucagcggugguga

SEQ ID NO: 3927268 - RNA, 13 nt, Shigella flexneri 2a str. 301
gaucaggcaaacg

SEQ ID NO: 3927269 - RNA, 15 nt, Shigella flexneri 2a str. 301
gaucaggcaaacgaa

SEQ ID NO: 3927270 - RNA, 11 nt, Shigella flexneri 2a str. 301
gaucaguaaac

SEQ ID NO: 3927271 - RNA, 11 nt, Shigella flexneri 2a str. 301
gaucaguucca

SEQ ID NO: 3927272 - RNA, 20 nt, Shigella flexneri 2a str. 301
gaucaguugaccgauccagu

SEQ ID NO: 3927273 - RNA, 17 nt, Shigella flexneri 2a str. 301
gaucauacugaacuuau

SEQ ID NO: 3927274 - RNA, 20 nt, Shigella flexneri 2a str. 301
gaucaucaaggcuuccuucg

SEQ ID NO: 3927275 - RNA, 15 nt, Shigella flexneri 2a str. 301
gaucaucagcaaacg

SEQ ID NO: 3927276 - RNA, 13 nt, Shigella flexneri 2a str. 301
gaucauccgcaca

SEQ ID NO: 3927277 - RNA, 12 nt, Shigella flexneri 2a str. 301
gaucauccgccu

SEQ ID NO: 3927278 - RNA, 20 nt, Shigella flexneri 2a str. 301
gaucaucgacaguaccagca

SEQ ID NO: 3927279 - RNA, 14 nt, Shigella flexneri 2a str. 301
gaucaugugcagga

SEQ ID NO: 3927280 - RNA, 15 nt, Shigella flexneri 2a str. 301
gaucauuagcccaau

SEQ ID NO: 3927281 - RNA, 18 nt, Shigella flexneri 2a str. 301
gaucauuauuaaacagac

SEQ ID NO: 3927282 - RNA, 15 nt, Shigella flexneri 2a str. 301
gaucauucaccagcc

SEQ ID NO: 3927283 - RNA, 20 nt, Shigella flexneri 2a str. 301
gauccacaacgugggccugg

SEQ ID NO: 3927284 - RNA, 14 nt, Shigella flexneri 2a str. 301
gauccacaguugcu

SEQ ID NO: 3927285 - RNA, 15 nt, Shigella flexneri 2a str. 301
gauccaccaccgcaa

SEQ ID NO: 3927286 - RNA, 15 nt, Shigella flexneri 2a str. 301
gauccaccacgcugu

SEQ ID NO: 3927287 - RNA, 16 nt, Shigella flexneri 2a str. 301
gauccagccauugcca

SEQ ID NO: 3927288 - RNA, 15 nt, Shigella flexneri 2a str. 301
gauccagcgcaauac

SEQ ID NO: 3927289 - RNA, 14 nt, Shigella flexneri 2a str. 301
gauccagucccccc

SEQ ID NO: 3927290 - RNA, 14 nt, Shigella flexneri 2a str. 301
gauccagugcguau

SEQ ID NO: 3927291 - RNA, 20 nt, Shigella flexneri 2a str. 301
gauccauaagguccuccagc

SEQ ID NO: 3927292 - RNA, 16 nt, Shigella flexneri 2a str. 301
gauccauacucuuucc

SEQ ID NO: 3927293 - RNA, 15 nt, Shigella flexneri 2a str. 301
gaucccaccagacgu

SEQ ID NO: 3927294 - RNA, 22 nt, Shigella flexneri 2a str. 301
gaugaucaagcgcacaauggcg

SEQ ID NO: 3927295 - RNA, 18 nt, Shigella flexneri 2a str. 301
gaugauccuggccuggau

SEQ ID NO: 3927296 - RNA, 22 nt, Shigella flexneri 2a str. 301
gaugaucgucacgaucgcgcca

SEQ ID NO: 3927297 - RNA, 17 nt, Shigella flexneri 2a str. 301
gaugaugcaaacaugga

SEQ ID NO: 3927298 - RNA, 19 nt, Shigella flexneri 2a str. 301
gaugaugcaaacauggaaa

SEQ ID NO: 3927299 - RNA, 12 nt, Shigella flexneri 2a str. 301
gaugaugccaag

SEQ ID NO: 3927300 - RNA, 14 nt, Shigella flexneri 2a str. 301
gaugaugcucccca

SEQ ID NO: 3927301 - RNA, 22 nt, Shigella flexneri 2a str. 301
gaugaugugaauggccagacac

SEQ ID NO: 3927302 - RNA, 13 nt, Shigella flexneri 2a str. 301
gaugcacagcacg

SEQ ID NO: 3927303 - RNA, 21 nt, Shigella flexneri 2a str. 301
gaugcacugggagaacgcugc

SEQ ID NO: 3927304 - RNA, 14 nt, Shigella flexneri 2a str. 301
gaugcagugcggcu

SEQ ID NO: 3927305 - RNA, 21 nt, Shigella flexneri 2a str. 301
gaugcaucgcauccgacauca

SEQ ID NO: 3927306 - RNA, 14 nt, Shigella flexneri 2a str. 301
gaugccaacuggca

SEQ ID NO: 3927307 - RNA, 18 nt, Shigella flexneri 2a str. 301
gaugccaauccccagacc

SEQ ID NO: 3927308 - RNA, 22 nt, Shigella flexneri 2a str. 301
gaugccaguaaucacgaucucg

SEQ ID NO: 3927309 - RNA, 18 nt, Shigella flexneri 2a str. 301
gaugccaguaauccggcu

SEQ ID NO: 3927310 - RNA, 17 nt, Shigella flexneri 2a str. 301
gaugccauuugccagac

SEQ ID NO: 3927311 - RNA, 13 nt, Shigella flexneri 2a str. 301
gaugcccagcuca

SEQ ID NO: 3927312 - RNA, 15 nt, Shigella flexneri 2a str. 301
gaugcccaugccaau

SEQ ID NO: 3927313 - RNA, 18 nt, Shigella flexneri 2a str. 301
gaugccggaugcggcgug

SEQ ID NO: 3927314 - RNA, 18 nt, Shigella flexneri 2a str. 301
gaugccgguuaauacgcc

SEQ ID NO: 3927315 - RNA, 15 nt, Shigella flexneri 2a str. 301
gaugccgugcagcac

SEQ ID NO: 3927316 - RNA, 16 nt, Shigella flexneri 2a str. 301
gaugccgugcagcacg

SEQ ID NO: 3927317 - RNA, 18 nt, Shigella flexneri 2a str. 301
gaugccgugcagcacgga

SEQ ID NO: 3927318 - RNA, 21 nt, Shigella flexneri 2a str. 301
gaugccguuccacccagcuca

SEQ ID NO: 3927319 - RNA, 19 nt, Shigella flexneri 2a str. 301
gaugccugauguacaacca

SEQ ID NO: 3927320 - RNA, 13 nt, Shigella flexneri 2a str. 301
gaugcgacgcuua

SEQ ID NO: 3927321 - RNA, 19 nt, Shigella flexneri 2a str. 301
gaugcgacggcaccacauu

SEQ ID NO: 3927322 - RNA, 14 nt, Shigella flexneri 2a str. 301
gaugcgauguaauc

SEQ ID NO: 3927323 - RNA, 19 nt, Shigella flexneri 2a str. 301
gaugcgcgaacuggaugaa

SEQ ID NO: 3927324 - RNA, 15 nt, Shigella flexneri 2a str. 301
gaugcgcuacgcuua

SEQ ID NO: 3927325 - RNA, 17 nt, Shigella flexneri 2a str. 301
gaugcgcuacgcuuauc

SEQ ID NO: 3927326 - RNA, 20 nt, Shigella flexneri 2a str. 301
gaugcgcuacgcuuaucagg

SEQ ID NO: 3927327 - RNA, 21 nt, Shigella flexneri 2a str. 301
gaugcggcguaaacgccuuau

SEQ ID NO: 3927328 - RNA, 13 nt, Shigella flexneri 2a str. 301
gaugcggcgugaa

SEQ ID NO: 3927329 - RNA, 16 nt, Shigella flexneri 2a str. 301
gaugcggcgugaacgc

SEQ ID NO: 3927330 - RNA, 19 nt, Shigella flexneri 2a str. 301
gaugcggcgugaacgccua

SEQ ID NO: 3927331 - RNA, 17 nt, Shigella flexneri 2a str. 301
gaugcggcgugaaugcc

SEQ ID NO: 3927332 - RNA, 14 nt, Shigella flexneri 2a str. 301
gaugcgggcgguaa

SEQ ID NO: 3927333 - RNA, 19 nt, Shigella flexneri 2a str. 301
gaugcgggugaacgcguua

SEQ ID NO: 3927334 - RNA, 20 nt, Shigella flexneri 2a str. 301
gaugcguaccucacguucca

SEQ ID NO: 3927335 - RNA, 14 nt, Shigella flexneri 2a str. 301
gaugcuaaaaacau

SEQ ID NO: 3927336 - RNA, 15 nt, Shigella flexneri 2a str. 301
gaugcucgccaggcg

SEQ ID NO: 3927337 - RNA, 22 nt, Shigella flexneri 2a str. 301
gaugcucgccaggcguuugaaa

SEQ ID NO: 3927338 - RNA, 12 nt, Shigella flexneri 2a str. 301
gaugcucuccgc

SEQ ID NO: 3927339 - RNA, 12 nt, Shigella flexneri 2a str. 301
gaugcugauuuu

SEQ ID NO: 3927340 - RNA, 14 nt, Shigella flexneri 2a str. 301
gaugcuugauuucg

SEQ ID NO: 3927341 - RNA, 13 nt, Shigella flexneri 2a str. 301
gaugcuuucccac

SEQ ID NO: 3927342 - RNA, 19 nt, Shigella flexneri 2a str. 301
gauggaaaaagagcagcug

SEQ ID NO: 3927343 - RNA, 22 nt, Shigella flexneri 2a str. 301
gauggaacaaaauuuucagcgu

SEQ ID NO: 3927344 - RNA, 15 nt, Shigella flexneri 2a str. 301
gauggaaugagcauc

SEQ ID NO: 3927345 - RNA, 18 nt, Shigella flexneri 2a str. 301
gauggaauuucaucauca

SEQ ID NO: 3927346 - RNA, 14 nt, Shigella flexneri 2a str. 301
gauggacauucucc

SEQ ID NO: 3927347 - RNA, 18 nt, Shigella flexneri 2a str. 301
gauggaccgugccggacg

SEQ ID NO: 3927348 - RNA, 18 nt, Shigella flexneri 2a str. 301
gauggaguaguugaucgc

SEQ ID NO: 3927349 - RNA, 13 nt, Shigella flexneri 2a str. 301
gauggauugcuga

SEQ ID NO: 3927350 - RNA, 18 nt, Shigella flexneri 2a str. 301
gauggcaaacugauuauc

SEQ ID NO: 3927351 - RNA, 23 nt, Shigella flexneri 2a str. 301
gauggcaaagugcaucucaccgu

SEQ ID NO: 3927352 - RNA, 17 nt, Shigella flexneri 2a str. 301
gauggcaauuuucacug

SEQ ID NO: 3927353 - RNA, 11 nt, Shigella flexneri 2a str. 301
gauggcagagu

SEQ ID NO: 3927354 - RNA, 16 nt, Shigella flexneri 2a str. 301
gauggcagucuggaca

SEQ ID NO: 3927355 - RNA, 16 nt, Shigella flexneri 2a str. 301
gauggcauacaacgcc

SEQ ID NO: 3927356 - RNA, 20 nt, Shigella flexneri 2a str. 301
gauggcauaccauccggcau

SEQ ID NO: 3927357 - RNA, 13 nt, Shigella flexneri 2a str. 301
gauggcauuaccg

SEQ ID NO: 3927358 - RNA, 18 nt, Shigella flexneri 2a str. 301
gauggccaaccaugucga

SEQ ID NO: 3927359 - RNA, 21 nt, Shigella flexneri 2a str. 301
gauggcccacgacgucuccau

SEQ ID NO: 3927360 - RNA, 12 nt, Shigella flexneri 2a str. 301
gauggcccggcg

SEQ ID NO: 3927361 - RNA, 16 nt, Shigella flexneri 2a str. 301
gauggcgauaaucuuu

SEQ ID NO: 3927362 - RNA, 21 nt, Shigella flexneri 2a str. 301
gauggcgcaaugccauccagc

SEQ ID NO: 3927363 - RNA, 16 nt, Shigella flexneri 2a str. 301
gauggcgcgcggcagg

SEQ ID NO: 3927364 - RNA, 20 nt, Shigella flexneri 2a str. 301
gauggcggcagccuccugca

SEQ ID NO: 3927365 - RNA, 23 nt, Shigella flexneri 2a str. 301
gauggcuauuacuuuaagccuuc

SEQ ID NO: 3927366 - RNA, 22 nt, Shigella flexneri 2a str. 301
gauggcucugauugauucaggg

SEQ ID NO: 3927367 - RNA, 11 nt, Shigella flexneri 2a str. 301
gauggcugggg

SEQ ID NO: 3927368 - RNA, 22 nt, Shigella flexneri 2a str. 301
gauggcuguuuucagcaccaga

SEQ ID NO: 3927369 - RNA, 19 nt, Shigella flexneri 2a str. 301
gauggcuugcgucauccag

SEQ ID NO: 3927370 - RNA, 23 nt, Shigella flexneri 2a str. 301
gaugggcgaagagaaagaacgag

SEQ ID NO: 3927371 - RNA, 21 nt, Shigella flexneri 2a str. 301
gaugggcgccauuuuucacug

SEQ ID NO: 3927372 - RNA, 19 nt, Shigella flexneri 2a str. 301
gaugguacgcguggacugg

SEQ ID NO: 3927373 - RNA, 20 nt, Shigella flexneri 2a str. 301
gaugguacuucaaucgccac

SEQ ID NO: 3927374 - RNA, 19 nt, Shigella flexneri 2a str. 301
gaugguaugcgaagguggc

SEQ ID NO: 3927375 - RNA, 21 nt, Shigella flexneri 2a str. 301
gaugguaugcgaagguggcgg

SEQ ID NO: 3927376 - RNA, 15 nt, Shigella flexneri 2a str. 301
gaugguauucaucgc

SEQ ID NO: 3927377 - RNA, 19 nt, Shigella flexneri 2a str. 301
gauggucacggacagguga

SEQ ID NO: 3927378 - RNA, 23 nt, Shigella flexneri 2a str. 301
gauggucacggacaggugaugca

SEQ ID NO: 3927379 - RNA, 18 nt, Shigella flexneri 2a str. 301
gauggucagcuucaccuu

SEQ ID NO: 3927380 - RNA, 19 nt, Shigella flexneri 2a str. 301
gauggucgcuuuguggcgg

SEQ ID NO: 3927381 - RNA, 19 nt, Shigella flexneri 2a str. 301
gaugguugcccugcuggug

SEQ ID NO: 3927382 - RNA, 15 nt, Shigella flexneri 2a str. 301
gaugguuuuauagcg

SEQ ID NO: 3927383 - RNA, 16 nt, Shigella flexneri 2a str. 301
gaugguuuugcuuuau

SEQ ID NO: 3927384 - RNA, 22 nt, Shigella flexneri 2a str. 301
gaugguuuuuggguucagcauu

SEQ ID NO: 3927385 - RNA, 15 nt, Shigella flexneri 2a str. 301
gauguaauucagcca

SEQ ID NO: 3927386 - RNA, 22 nt, Shigella flexneri 2a str. 301
gauguacgcugccgcuucuucu

SEQ ID NO: 3927387 - RNA, 21 nt, Shigella flexneri 2a str. 301
gauguacuucaacauaacgca

SEQ ID NO: 3927388 - RNA, 13 nt, Shigella flexneri 2a str. 301
gaugucagcacuu

SEQ ID NO: 3927389 - RNA, 22 nt, Shigella flexneri 2a str. 301
gaugucagcgggaugccaguca

SEQ ID NO: 3927390 - RNA, 18 nt, Shigella flexneri 2a str. 301
gaugugagcgauacccau

SEQ ID NO: 3927391 - RNA, 21 nt, Shigella flexneri 2a str. 301
gaugugaugcccggucgcucc

SEQ ID NO: 3927392 - RNA, 20 nt, Shigella flexneri 2a str. 301
gauguggcgugaacgccuua

SEQ ID NO: 3927393 - RNA, 18 nt, Shigella flexneri 2a str. 301
gaugugggcaaucucacu

SEQ ID NO: 3927394 - RNA, 17 nt, Shigella flexneri 2a str. 301
gauuucuucaccagccu

SEQ ID NO: 3927395 - RNA, 22 nt, Shigella flexneri 2a str. 301
gauuucuucauuaaauuuccgc

SEQ ID NO: 3927396 - RNA, 14 nt, Shigella flexneri 2a str. 301
gauuucuuuauccg

SEQ ID NO: 3927397 - RNA, 17 nt, Shigella flexneri 2a str. 301
gauuugauggucucgcc

SEQ ID NO: 3927398 - RNA, 21 nt, Shigella flexneri 2a str. 301
gauuugcuucaauacgcucca

SEQ ID NO: 3927399 - RNA, 13 nt, Shigella flexneri 2a str. 301
gauuuggcugccg

SEQ ID NO: 3927400 - RNA, 20 nt, Shigella flexneri 2a str. 301
gauuugguucggucacggcg

SEQ ID NO: 3927401 - RNA, 16 nt, Shigella flexneri 2a str. 301
gauuuguaggccggau

SEQ ID NO: 3927402 - RNA, 16 nt, Shigella flexneri 2a str. 301
gauuuucaucuucuuc

SEQ ID NO: 3927403 - RNA, 16 nt, Shigella flexneri 2a str. 301
gauuuucgaaaaaaaa

SEQ ID NO: 3927404 - RNA, 16 nt, Shigella flexneri 2a str. 301
gauuuugcaauaaugg

SEQ ID NO: 3927405 - RNA, 23 nt, Shigella flexneri 2a str. 301
gauuuugccagcaugacuaccgg

SEQ ID NO: 3927406 - RNA, 15 nt, Shigella flexneri 2a str. 301
gauuuugcugugcuu

SEQ ID NO: 3927407 - RNA, 16 nt, Shigella flexneri 2a str. 301
gauuuuggucaugcua

SEQ ID NO: 3927408 - RNA, 15 nt, Shigella flexneri 2a str. 301
gauuuuguaaaagaa

SEQ ID NO: 3927409 - RNA, 17 nt, Shigella flexneri 2a str. 301
gauuuuguaggccggau

SEQ ID NO: 3927410 - RNA, 16 nt, Shigella flexneri 2a str. 301
gauuuuuuccagcgca

SEQ ID NO: 3927411 - RNA, 18 nt, Shigella flexneri 2a str. 301
gauuuuuugccagcacca

SEQ ID NO: 3927412 - RNA, 22 nt, Shigella flexneri 2a str. 301
gcaaaaaaaacgggcauggugu

SEQ ID NO: 3927413 - RNA, 21 nt, Shigella flexneri 2a str. 301
gcaaaaaauugcgucaguauu

SEQ ID NO: 3927414 - RNA, 22 nt, Shigella flexneri 2a str. 301
gcaaaaacccuucuuccauacc

SEQ ID NO: 3927415 - RNA, 13 nt, Shigella flexneri 2a str. 301
gcaaaaauaagcg

SEQ ID NO: 3927416 - RNA, 19 nt, Shigella flexneri 2a str. 301
gcaaaaaucgacagcagga

SEQ ID NO: 3927417 - RNA, 20 nt, Shigella flexneri 2a str. 301
gcaaaaaucgacagcaggau

SEQ ID NO: 3927418 - RNA, 16 nt, Shigella flexneri 2a str. 301
gcaaaaaucggcaaca

SEQ ID NO: 3927419 - RNA, 13 nt, Shigella flexneri 2a str. 301
gcaaaaaugccuu

SEQ ID NO: 3927420 - RNA, 14 nt, Shigella flexneri 2a str. 301
gcaaaaccugguug

SEQ ID NO: 3927421 - RNA, 12 nt, Shigella flexneri 2a str. 301
gcaaaacgcugc

SEQ ID NO: 3927422 - RNA, 19 nt, Shigella flexneri 2a str. 301
gcaaaauaaccggcaagca

SEQ ID NO: 3927423 - RNA, 18 nt, Shigella flexneri 2a str. 301
gcaaaauacugaacaggc

SEQ ID NO: 3927424 - RNA, 22 nt, Shigella flexneri 2a str. 301
gcaaaauagguaucguaauuuu

SEQ ID NO: 3927425 - RNA, 13 nt, Shigella flexneri 2a str. 301
gcaaaaucaaaua

SEQ ID NO: 3927426 - RNA, 19 nt, Shigella flexneri 2a str. 301
gcaaaaucaucacucccuu

SEQ ID NO: 3927427 - RNA, 12 nt, Shigella flexneri 2a str. 301
gcaaaaucccac

SEQ ID NO: 3927428 - RNA, 19 nt, Shigella flexneri 2a str. 301
gcaaaaucguaagcaggag

SEQ ID NO: 3927429 - RNA, 24 nt, Shigella flexneri 2a str. 301
gcaaaaucucacacucaugauccu

SEQ ID NO: 3927430 - RNA, 14 nt, Shigella flexneri 2a str. 301
gcaaacaccagcga

SEQ ID NO: 3927431 - RNA, 13 nt, Shigella flexneri 2a str. 301
gcaaacaguuucu

SEQ ID NO: 3927432 - RNA, 22 nt, Shigella flexneri 2a str. 301
gcaaacaguuucugcagcucca

SEQ ID NO: 3927433 - RNA, 15 nt, Shigella flexneri 2a str. 301
gcaaaccaggccggu

SEQ ID NO: 3927434 - RNA, 21 nt, Shigella flexneri 2a str. 301
gcaaaccuggcauguggcggc

SEQ ID NO: 3927435 - RNA, 17 nt, Shigella flexneri 2a str. 301
gcaaaccuuaaagcauu

SEQ ID NO: 3927436 - RNA, 17 nt, Shigella flexneri 2a str. 301
gcaaacgaaagcagggc

SEQ ID NO: 3927437 - RNA, 16 nt, Shigella flexneri 2a str. 301
gcaaacgaaaucugac

SEQ ID NO: 3927438 - RNA, 17 nt, Shigella flexneri 2a str. 301
gcaaacggcgcgacuuu

SEQ ID NO: 3927439 - RNA, 23 nt, Shigella flexneri 2a str. 301
gcaaacgguuguagcucggcgca

SEQ ID NO: 3927440 - RNA, 19 nt, Shigella flexneri 2a str. 301
gcaaacuacaaauccaaca

SEQ ID NO: 3927441 - RNA, 15 nt, Shigella flexneri 2a str. 301
gcaaacuaucccagc

SEQ ID NO: 3927442 - RNA, 21 nt, Shigella flexneri 2a str. 301
gcaaacucaucgccgccaaac

SEQ ID NO: 3927443 - RNA, 19 nt, Shigella flexneri 2a str. 301
gcaaacucgcgcaggcuga

SEQ ID NO: 3927444 - RNA, 16 nt, Shigella flexneri 2a str. 301
gcaaacugaguggagu

SEQ ID NO: 3927445 - RNA, 19 nt, Shigella flexneri 2a str. 301
gcaaacugccguugcugcc

SEQ ID NO: 3927446 - RNA, 11 nt, Shigella flexneri 2a str. 301
gcaaacugcug

SEQ ID NO: 3927447 - RNA, 23 nt, Shigella flexneri 2a str. 301
gcaaacugcugauguuguuucuc

SEQ ID NO: 3927448 - RNA, 20 nt, Shigella flexneri 2a str. 301
gcaaacugucuaauggugaa

SEQ ID NO: 3927449 - RNA, 21 nt, Shigella flexneri 2a str. 301
gcaaagagaacugagcgauca

SEQ ID NO: 3927450 - RNA, 14 nt, Shigella flexneri 2a str. 301
gcaaagagagaagc

SEQ ID NO: 3927451 - RNA, 15 nt, Shigella flexneri 2a str. 301
gcaaagcaaauuuug

SEQ ID NO: 3927452 - RNA, 21 nt, Shigella flexneri 2a str. 301
gcaaagcaaauuuugugggca

SEQ ID NO: 3927453 - RNA, 19 nt, Shigella flexneri 2a str. 301
gcaaagcauuuuuucacau

SEQ ID NO: 3927454 - RNA, 18 nt, Shigella flexneri 2a str. 301
gcaaagccgauaccuucc

SEQ ID NO: 3927455 - RNA, 19 nt, Shigella flexneri 2a str. 301
gcaaagcugucaccaauca

SEQ ID NO: 3927456 - RNA, 16 nt, Shigella flexneri 2a str. 301
gcaaaggccagcaauc

SEQ ID NO: 3927457 - RNA, 14 nt, Shigella flexneri 2a str. 301
gcaaaggccagcca

SEQ ID NO: 3927458 - RNA, 14 nt, Shigella flexneri 2a str. 301
gcaaaggcguuaua

SEQ ID NO: 3927459 - RNA, 15 nt, Shigella flexneri 2a str. 301
gcaaaguagcgggcu

SEQ ID NO: 3927460 - RNA, 20 nt, Shigella flexneri 2a str. 301
gcaaagugaauacagaacag

SEQ ID NO: 3927461 - RNA, 21 nt, Shigella flexneri 2a str. 301
gcaaagugaauacagaacagu

SEQ ID NO: 3927462 - RNA, 13 nt, Shigella flexneri 2a str. 301
gcaaagugccccc

SEQ ID NO: 3927463 - RNA, 15 nt, Shigella flexneri 2a str. 301
gcaaagugcccccaa

SEQ ID NO: 3927464 - RNA, 14 nt, Shigella flexneri 2a str. 301
gcaaagugccgaac

SEQ ID NO: 3927465 - RNA, 13 nt, Shigella flexneri 2a str. 301
gcaaauaaaacau

SEQ ID NO: 3927466 - RNA, 18 nt, Shigella flexneri 2a str. 301
gcaaauaacgccccggca

SEQ ID NO: 3927467 - RNA, 21 nt, Shigella flexneri 2a str. 301
gcaaauaauccaccuggccug

SEQ ID NO: 3927468 - RNA, 20 nt, Shigella flexneri 2a str. 301
gcaaauaaucccgcgcaaca

SEQ ID NO: 3927469 - RNA, 21 nt, Shigella flexneri 2a str. 301
gcaaauaccggacacacuuca

SEQ ID NO: 3927470 - RNA, 22 nt, Shigella flexneri 2a str. 301
gcaaauaccggacacacuucau

SEQ ID NO: 3927471 - RNA, 19 nt, Shigella flexneri 2a str. 301
gcaaauacugacuggcaag

SEQ ID NO: 3927472 - RNA, 16 nt, Shigella flexneri 2a str. 301
gcaaauauuaauaaua

SEQ ID NO: 3927473 - RNA, 21 nt, Shigella flexneri 2a str. 301
gcaaaucaauagugaacugac

SEQ ID NO: 3927474 - RNA, 16 nt, Shigella flexneri 2a str. 301
gcaaauccaucgccug

SEQ ID NO: 3927475 - RNA, 22 nt, Shigella flexneri 2a str. 301
gcaaaucgacgccacaaucuga

SEQ ID NO: 3927476 - RNA, 19 nt, Shigella flexneri 2a str. 301
gcaaaucgaucucaaugag

SEQ ID NO: 3927477 - RNA, 20 nt, Shigella flexneri 2a str. 301
gcaaaucgaucucaaugagc

SEQ ID NO: 3927478 - RNA, 12 nt, Shigella flexneri 2a str. 301
gcaaaucgcggc

SEQ ID NO: 3927479 - RNA, 20 nt, Shigella flexneri 2a str. 301
gcaaaucugcgccuacggca

SEQ ID NO: 3927480 - RNA, 22 nt, Shigella flexneri 2a str. 301
gcaaaucuucgucgugaaagga

SEQ ID NO: 3927481 - RNA, 22 nt, Shigella flexneri 2a str. 301
gcaaaugaugcaccaccugauu

SEQ ID NO: 3927482 - RNA, 18 nt, Shigella flexneri 2a str. 301
gcaaaugauuagugccag

SEQ ID NO: 3927483 - RNA, 15 nt, Shigella flexneri 2a str. 301
gcaaaugcagcauug

SEQ ID NO: 3927484 - RNA, 18 nt, Shigella flexneri 2a str. 301
gcaaaugcagcauugccu

SEQ ID NO: 3927485 - RNA, 23 nt, Shigella flexneri 2a str. 301
gcaaaugcggagacucaaacccc

SEQ ID NO: 3927486 - RNA, 19 nt, Shigella flexneri 2a str. 301
gcaaauucaauaaauugca

SEQ ID NO: 3927487 - RNA, 20 nt, Shigella flexneri 2a str. 301
gcaaauucggcggcgugccu

SEQ ID NO: 3927488 - RNA, 20 nt, Shigella flexneri 2a str. 301
gcaaauucuugugcgggggc

SEQ ID NO: 3927489 - RNA, 19 nt, Shigella flexneri 2a str. 301
gcaaauugccccagaugcc

SEQ ID NO: 3927490 - RNA, 21 nt, Shigella flexneri 2a str. 301
gcaacaaaauccgccguaaau

SEQ ID NO: 3927491 - RNA, 12 nt, Shigella flexneri 2a str. 301
gcaacaaauaaa

SEQ ID NO: 3927492 - RNA, 13 nt, Shigella flexneri 2a str. 301
gcaacaacagcgc

SEQ ID NO: 3927493 - RNA, 23 nt, Shigella flexneri 2a str. 301
gcaauaaucucuuuacccagcgg

SEQ ID NO: 3927494 - RNA, 21 nt, Shigella flexneri 2a str. 301
gcaauaaugccagucccgcga

SEQ ID NO: 3927495 - RNA, 20 nt, Shigella flexneri 2a str. 301
gcaauacagguuucaaugca

SEQ ID NO: 3927496 - RNA, 18 nt, Shigella flexneri 2a str. 301
gcaauaccauuuacaagc

SEQ ID NO: 3927497 - RNA, 12 nt, Shigella flexneri 2a str. 301
gcaauaccgcga

SEQ ID NO: 3927498 - RNA, 21 nt, Shigella flexneri 2a str. 301
gcaauaccuggcgcagcugcg

SEQ ID NO: 3927499 - RNA, 23 nt, Shigella flexneri 2a str. 301
gcaauacgcuugaagccuucgcc

SEQ ID NO: 3927500 - RNA, 22 nt, Shigella flexneri 2a str. 301
gcaauagcggacacuaccauuu

SEQ ID NO: 3927501 - RNA, 22 nt, Shigella flexneri 2a str. 301
gcaauagcuucuuccacauugu

SEQ ID NO: 3927502 - RNA, 13 nt, Shigella flexneri 2a str. 301
gcaauauauugaa

SEQ ID NO: 3927503 - RNA, 19 nt, Shigella flexneri 2a str. 301
gcaauauauugaauuugca

SEQ ID NO: 3927504 - RNA, 14 nt, Shigella flexneri 2a str. 301
gcaauaucgcggca

SEQ ID NO: 3927505 - RNA, 17 nt, Shigella flexneri 2a str. 301
gcaauaugcggugccau

SEQ ID NO: 3927506 - RNA, 19 nt, Shigella flexneri 2a str. 301
gcaauauuguagcaacucc

SEQ ID NO: 3927507 - RNA, 17 nt, Shigella flexneri 2a str. 301
gcaaucaaaaaaggcug

SEQ ID NO: 3927508 - RNA, 20 nt, Shigella flexneri 2a str. 301
gcaaucaaauaccaccagcg

SEQ ID NO: 3927509 - RNA, 21 nt, Shigella flexneri 2a str. 301
gcaaucaaauaccaccagcga

SEQ ID NO: 3927510 - RNA, 14 nt, Shigella flexneri 2a str. 301
gcaaucaccgccag

SEQ ID NO: 3927511 - RNA, 15 nt, Shigella flexneri 2a str. 301
gcaaucacuuccuca

SEQ ID NO: 3927512 - RNA, 18 nt, Shigella flexneri 2a str. 301
gcaaucagauaaaauaca

SEQ ID NO: 3927513 - RNA, 21 nt, Shigella flexneri 2a str. 301
gcaaucagauaaaauacacuu

SEQ ID NO: 3927514 - RNA, 23 nt, Shigella flexneri 2a str. 301
gcaaucagugguguagggcaggc

SEQ ID NO: 3927515 - RNA, 18 nt, Shigella flexneri 2a str. 301
gcaaucauauucaccacg

SEQ ID NO: 3927516 - RNA, 13 nt, Shigella flexneri 2a str. 301
gcaaucaucccag

SEQ ID NO: 3927517 - RNA, 22 nt, Shigella flexneri 2a str. 301
gcaaucaucgaugcgaucauua

SEQ ID NO: 3927518 - RNA, 22 nt, Shigella flexneri 2a str. 301
gcaaucaucuuguaggccugau

SEQ ID NO: 3927519 - RNA, 18 nt, Shigella flexneri 2a str. 301
gcaaucauucccagaccu

SEQ ID NO: 3927520 - RNA, 14 nt, Shigella flexneri 2a str. 301
gcaauccagcucuu

SEQ ID NO: 3927521 - RNA, 14 nt, Shigella flexneri 2a str. 301
gcaauccaguccac

SEQ ID NO: 3927522 - RNA, 14 nt, Shigella flexneri 2a str. 301
gcaauccauaacgc

SEQ ID NO: 3927523 - RNA, 15 nt, Shigella flexneri 2a str. 301
gcaauccccgccagc

SEQ ID NO: 3927524 - RNA, 22 nt, Shigella flexneri 2a str. 301
gcaauccgccgucgggucagcu

SEQ ID NO: 3927525 - RNA, 14 nt, Shigella flexneri 2a str. 301
gcaaucgaccaggc

SEQ ID NO: 3927526 - RNA, 20 nt, Shigella flexneri 2a str. 301
gcaaucgagcccagaugccg

SEQ ID NO: 3927527 - RNA, 22 nt, Shigella flexneri 2a str. 301
gcaaucgaguuugccgcugucc

SEQ ID NO: 3927528 - RNA, 22 nt, Shigella flexneri 2a str. 301
gcaaucgcccagcgcguaaaua

SEQ ID NO: 3927529 - RNA, 15 nt, Shigella flexneri 2a str. 301
gcaaucgccccuucg

SEQ ID NO: 3927530 - RNA, 13 nt, Shigella flexneri 2a str. 301
gcaaucgccucca

SEQ ID NO: 3927531 - RNA, 20 nt, Shigella flexneri 2a str. 301
gcaaucuccguguaggccug

SEQ ID NO: 3927532 - RNA, 21 nt, Shigella flexneri 2a str. 301
gcaaucuccguguaggccuga

SEQ ID NO: 3927533 - RNA, 14 nt, Shigella flexneri 2a str. 301
gcaaucugcuggca

SEQ ID NO: 3927534 - RNA, 22 nt, Shigella flexneri 2a str. 301
gcaaucuguuuauuugacagcc

SEQ ID NO: 3927535 - RNA, 21 nt, Shigella flexneri 2a str. 301
gcaaucuuuagcauaaaaacu

SEQ ID NO: 3927536 - RNA, 11 nt, Shigella flexneri 2a str. 301
gcaaugaaauu

SEQ ID NO: 3927537 - RNA, 14 nt, Shigella flexneri 2a str. 301
gcaaugaagaaccg

SEQ ID NO: 3927538 - RNA, 18 nt, Shigella flexneri 2a str. 301
gcaaugaguggugaaaaa

SEQ ID NO: 3927539 - RNA, 16 nt, Shigella flexneri 2a str. 301
gcaaugccauccagcu

SEQ ID NO: 3927540 - RNA, 17 nt, Shigella flexneri 2a str. 301
gcaaugccauccagcuu

SEQ ID NO: 3927541 - RNA, 21 nt, Shigella flexneri 2a str. 301
gcaaugcccgguguucccgcg

SEQ ID NO: 3927542 - RNA, 18 nt, Shigella flexneri 2a str. 301
gcaaugcggagguuucuu

SEQ ID NO: 3927543 - RNA, 16 nt, Shigella flexneri 2a str. 301
gcaaugcguuccagca

SEQ ID NO: 3927544 - RNA, 18 nt, Shigella flexneri 2a str. 301
gcaauggaaaaaguuuua

SEQ ID NO: 3927545 - RNA, 13 nt, Shigella flexneri 2a str. 301
gcaauggccggaa

SEQ ID NO: 3927546 - RNA, 20 nt, Shigella flexneri 2a str. 301
gcaauggccguuccggcaac

SEQ ID NO: 3927547 - RNA, 17 nt, Shigella flexneri 2a str. 301
gcaauggcuggccccgu

SEQ ID NO: 3927548 - RNA, 14 nt, Shigella flexneri 2a str. 301
gcaauggguaacgg

SEQ ID NO: 3927549 - RNA, 18 nt, Shigella flexneri 2a str. 301
gcaauggguaacggcaga

SEQ ID NO: 3927550 - RNA, 19 nt, Shigella flexneri 2a str. 301
gcaaugugcucuaacccuu

SEQ ID NO: 3927551 - RNA, 16 nt, Shigella flexneri 2a str. 301
gcaauuaacagugaca

SEQ ID NO: 3927552 - RNA, 14 nt, Shigella flexneri 2a str. 301
gcaauuacaugcug

SEQ ID NO: 3927553 - RNA, 16 nt, Shigella flexneri 2a str. 301
gcaauuacaugcuggu

SEQ ID NO: 3927554 - RNA, 16 nt, Shigella flexneri 2a str. 301
gcaauuagcggcuggc

SEQ ID NO: 3927555 - RNA, 14 nt, Shigella flexneri 2a str. 301
gcaauuccaucaua

SEQ ID NO: 3927556 - RNA, 14 nt, Shigella flexneri 2a str. 301
gcaauucccagaau

SEQ ID NO: 3927557 - RNA, 19 nt, Shigella flexneri 2a str. 301
gcaauuggucgcgcaaauu

SEQ ID NO: 3927558 - RNA, 18 nt, Shigella flexneri 2a str. 301
gcaauuggugcacgaugc

SEQ ID NO: 3927559 - RNA, 19 nt, Shigella flexneri 2a str. 301
gcaauuucacguucaccca

SEQ ID NO: 3927560 - RNA, 13 nt, Shigella flexneri 2a str. 301
gcaauuuccauug

SEQ ID NO: 3927561 - RNA, 14 nt, Shigella flexneri 2a str. 301
gcacaaaacagguc

SEQ ID NO: 3927562 - RNA, 14 nt, Shigella flexneri 2a str. 301
gcacaaaaccugcc

SEQ ID NO: 3927563 - RNA, 21 nt, Shigella flexneri 2a str. 301
gcacaaacauccaucugcuuu

SEQ ID NO: 3927564 - RNA, 18 nt, Shigella flexneri 2a str. 301
gcacaaagcgaugaugcu

SEQ ID NO: 3927565 - RNA, 16 nt, Shigella flexneri 2a str. 301
gcacaaaguggcggcu

SEQ ID NO: 3927566 - RNA, 15 nt, Shigella flexneri 2a str. 301
gcacaaauagccagc

SEQ ID NO: 3927567 - RNA, 18 nt, Shigella flexneri 2a str. 301
gcacaaauagccagcaga

SEQ ID NO: 3927568 - RNA, 22 nt, Shigella flexneri 2a str. 301
gcacaaauagccagcagagcaa

SEQ ID NO: 3927569 - RNA, 15 nt, Shigella flexneri 2a str. 301
gcacaacucggcggc

SEQ ID NO: 3927570 - RNA, 21 nt, Shigella flexneri 2a str. 301
gcacaagaugccugaugcgac

SEQ ID NO: 3927571 - RNA, 16 nt, Shigella flexneri 2a str. 301
gcacaagcccaugcac

SEQ ID NO: 3927572 - RNA, 19 nt, Shigella flexneri 2a str. 301
gcacaagggugagggagga

SEQ ID NO: 3927573 - RNA, 23 nt, Shigella flexneri 2a str. 301
gcacaaguuuuuaggcaugauaa

SEQ ID NO: 3927574 - RNA, 15 nt, Shigella flexneri 2a str. 301
gcacaauaaucagcc

SEQ ID NO: 3927575 - RNA, 24 nt, Shigella flexneri 2a str. 301
gcacaaucaaaucgacagccaguu

SEQ ID NO: 3927576 - RNA, 15 nt, Shigella flexneri 2a str. 301
gcacaaucacgucag

SEQ ID NO: 3927577 - RNA, 23 nt, Shigella flexneri 2a str. 301
gcacaaugcuuaaucgcggcggg

SEQ ID NO: 3927578 - RNA, 19 nt, Shigella flexneri 2a str. 301
gcacaauuaccugucgcca

SEQ ID NO: 3927579 - RNA, 15 nt, Shigella flexneri 2a str. 301
gcacaauugccggau

SEQ ID NO: 3927580 - RNA, 24 nt, Shigella flexneri 2a str. 301
gcacacacugcuuaacugcgcuuu

SEQ ID NO: 3927581 - RNA, 23 nt, Shigella flexneri 2a str. 301
gcacacagggcgcuagccaacuu

SEQ ID NO: 3927582 - RNA, 17 nt, Shigella flexneri 2a str. 301
gcacaccaaccgcuucc

SEQ ID NO: 3927583 - RNA, 22 nt, Shigella flexneri 2a str. 301
gcacaccaggcucuuuaaacag

SEQ ID NO: 3927584 - RNA, 23 nt, Shigella flexneri 2a str. 301
gcacaccaggcucuuuaaacagu

SEQ ID NO: 3927585 - RNA, 16 nt, Shigella flexneri 2a str. 301
gcacaccccggcggcc

SEQ ID NO: 3927586 - RNA, 23 nt, Shigella flexneri 2a str. 301
gcacaccgcugacuuucaaacgc

SEQ ID NO: 3927587 - RNA, 16 nt, Shigella flexneri 2a str. 301
gcacacggauauugcu

SEQ ID NO: 3927588 - RNA, 16 nt, Shigella flexneri 2a str. 301
gcacacguaggccaac

SEQ ID NO: 3927589 - RNA, 22 nt, Shigella flexneri 2a str. 301
gcacacugguucccaacaacag

SEQ ID NO: 3927590 - RNA, 21 nt, Shigella flexneri 2a str. 301
gcacacuguucauuaaagccg

SEQ ID NO: 3927591 - RNA, 19 nt, Shigella flexneri 2a str. 301
gcacacuuagccuguguca

SEQ ID NO: 3927592 - RNA, 16 nt, Shigella flexneri 2a str. 301
gcacgccgacaaagau

SEQ ID NO: 3927593 - RNA, 16 nt, Shigella flexneri 2a str. 301
gcacgccgagcgcauc

SEQ ID NO: 3927594 - RNA, 17 nt, Shigella flexneri 2a str. 301
gcacgccggauuugaga

SEQ ID NO: 3927595 - RNA, 14 nt, Shigella flexneri 2a str. 301
gcacgcgcuucaca

SEQ ID NO: 3927596 - RNA, 20 nt, Shigella flexneri 2a str. 301
gcacgcguagagaauccagu

SEQ ID NO: 3927597 - RNA, 22 nt, Shigella flexneri 2a str. 301
gcacgcucuauggcaccuguug

SEQ ID NO: 3927598 - RNA, 18 nt, Shigella flexneri 2a str. 301
gcacgcucuguucugcgc

SEQ ID NO: 3927599 - RNA, 20 nt, Shigella flexneri 2a str. 301
gcacgcucuucaucgcuaaa

SEQ ID NO: 3927600 - RNA, 16 nt, Shigella flexneri 2a str. 301
gcacgcuggagaacaa

SEQ ID NO: 3927601 - RNA, 18 nt, Shigella flexneri 2a str. 301
gcacgcuugccugugcca

SEQ ID NO: 3927602 - RNA, 18 nt, Shigella flexneri 2a str. 301
gcacgcuuuucagugcca

SEQ ID NO: 3927603 - RNA, 16 nt, Shigella flexneri 2a str. 301
gcacggaaagcagcau

SEQ ID NO: 3927604 - RNA, 18 nt, Shigella flexneri 2a str. 301
gcacggauaccgcacgcu

SEQ ID NO: 3927605 - RNA, 16 nt, Shigella flexneri 2a str. 301
gcacgguacuggcagg

SEQ ID NO: 3927606 - RNA, 22 nt, Shigella flexneri 2a str. 301
gcacggugcaucuucacacuga

SEQ ID NO: 3927607 - RNA, 17 nt, Shigella flexneri 2a str. 301
gcacguacaugcagggc

SEQ ID NO: 3927608 - RNA, 19 nt, Shigella flexneri 2a str. 301
gcacguaggcgaucccggc

SEQ ID NO: 3927609 - RNA, 19 nt, Shigella flexneri 2a str. 301
gcacgucaccgcagcaucg

SEQ ID NO: 3927610 - RNA, 15 nt, Shigella flexneri 2a str. 301
gcacgucaucugcac

SEQ ID NO: 3927611 - RNA, 17 nt, Shigella flexneri 2a str. 301
gcacgucuuugccgcgc

SEQ ID NO: 3927612 - RNA, 19 nt, Shigella flexneri 2a str. 301
gcacguuagaaacaaaaaa

SEQ ID NO: 3927613 - RNA, 16 nt, Shigella flexneri 2a str. 301
gcacguucaucccacu

SEQ ID NO: 3927614 - RNA, 13 nt, Shigella flexneri 2a str. 301
gcacguuccugca

SEQ ID NO: 3927615 - RNA, 14 nt, Shigella flexneri 2a str. 301
gcacguugucagca

SEQ ID NO: 3927616 - RNA, 16 nt, Shigella flexneri 2a str. 301
gcacguuuagcuuugg

SEQ ID NO: 3927617 - RNA, 14 nt, Shigella flexneri 2a str. 301
gcacuaccgcccga

SEQ ID NO: 3927618 - RNA, 19 nt, Shigella flexneri 2a str. 301
gcacuaccgcccgaugaau

SEQ ID NO: 3927619 - RNA, 16 nt, Shigella flexneri 2a str. 301
gcacuaugugccagcu

SEQ ID NO: 3927620 - RNA, 23 nt, Shigella flexneri 2a str. 301
gcacuaugugccagcuucccgcu

SEQ ID NO: 3927621 - RNA, 15 nt, Shigella flexneri 2a str. 301
gcacucaaaacuaca

SEQ ID NO: 3927622 - RNA, 17 nt, Shigella flexneri 2a str. 301
gcacucaacaaccagaa

SEQ ID NO: 3927623 - RNA, 19 nt, Shigella flexneri 2a str. 301
gcacuccgccacgucauca

SEQ ID NO: 3927624 - RNA, 12 nt, Shigella flexneri 2a str. 301
gcacuccgcugu

SEQ ID NO: 3927625 - RNA, 16 nt, Shigella flexneri 2a str. 301
gcacuccugccaccac

SEQ ID NO: 3927626 - RNA, 22 nt, Shigella flexneri 2a str. 301
gcacuccuguuaugccucaacc

SEQ ID NO: 3927627 - RNA, 14 nt, Shigella flexneri 2a str. 301
gcacucgcagaagc

SEQ ID NO: 3927628 - RNA, 16 nt, Shigella flexneri 2a str. 301
gcacucgcagacaaua

SEQ ID NO: 3927629 - RNA, 14 nt, Shigella flexneri 2a str. 301
gcacucgcccugac

SEQ ID NO: 3927630 - RNA, 18 nt, Shigella flexneri 2a str. 301
gcacucgcccugaccugc

SEQ ID NO: 3927631 - RNA, 23 nt, Shigella flexneri 2a str. 301
gcacucuccuccguuaaccugga

SEQ ID NO: 3927632 - RNA, 13 nt, Shigella flexneri 2a str. 301
gcacucugacgga

SEQ ID NO: 3927633 - RNA, 16 nt, Shigella flexneri 2a str. 301
gcacugaccaccacca

SEQ ID NO: 3927634 - RNA, 20 nt, Shigella flexneri 2a str. 301
gcacugaucgucagguuuug

SEQ ID NO: 3927635 - RNA, 15 nt, Shigella flexneri 2a str. 301
gcacugcaggcugau

SEQ ID NO: 3927636 - RNA, 17 nt, Shigella flexneri 2a str. 301
gcacugcgcccgccagc

SEQ ID NO: 3927637 - RNA, 15 nt, Shigella flexneri 2a str. 301
gcacugcuugaagcg

SEQ ID NO: 3927638 - RNA, 20 nt, Shigella flexneri 2a str. 301
gcacuggcagccaggcgcga

SEQ ID NO: 3927639 - RNA, 17 nt, Shigella flexneri 2a str. 301
gcacuggcggcagcagg

SEQ ID NO: 3927640 - RNA, 18 nt, Shigella flexneri 2a str. 301
gcacugggcgaagguggc

SEQ ID NO: 3927641 - RNA, 19 nt, Shigella flexneri 2a str. 301
gcacugggcgaagguggcg

SEQ ID NO: 3927642 - RNA, 15 nt, Shigella flexneri 2a str. 301
gcacugguacucaac

SEQ ID NO: 3927643 - RNA, 19 nt, Shigella flexneri 2a str. 301
gcacuguuacugucggcaa

SEQ ID NO: 3927644 - RNA, 19 nt, Shigella flexneri 2a str. 301
gcacuucacccaucgccag

SEQ ID NO: 3927645 - RNA, 20 nt, Shigella flexneri 2a str. 301
gcacuucacccaucgccaga

SEQ ID NO: 3927646 - RNA, 14 nt, Shigella flexneri 2a str. 301
gcacuuccagcggc

SEQ ID NO: 3927647 - RNA, 12 nt, Shigella flexneri 2a str. 301
gcacuucuuccu

SEQ ID NO: 3927648 - RNA, 13 nt, Shigella flexneri 2a str. 301
gcacuucuuccuu

SEQ ID NO: 3927649 - RNA, 12 nt, Shigella flexneri 2a str. 301
gcacuugcagga

SEQ ID NO: 3927650 - RNA, 21 nt, Shigella flexneri 2a str. 301
gcacuugcaggaacagugccu

SEQ ID NO: 3927651 - RNA, 17 nt, Shigella flexneri 2a str. 301
gcacuuucgccugcggc

SEQ ID NO: 3927652 - RNA, 16 nt, Shigella flexneri 2a str. 301
gcacuuugccagaaau

SEQ ID NO: 3927653 - RNA, 22 nt, Shigella flexneri 2a str. 301
gcacuuugccagaaauccaggc

SEQ ID NO: 3927654 - RNA, 13 nt, Shigella flexneri 2a str. 301
gcacuuuguccgc

SEQ ID NO: 3927655 - RNA, 14 nt, Shigella flexneri 2a str. 301
gcacuuuguccgcu

SEQ ID NO: 3927656 - RNA, 22 nt, Shigella flexneri 2a str. 301
gcacuuugugucagcgccagaa

SEQ ID NO: 3927657 - RNA, 18 nt, Shigella flexneri 2a str. 301
gcagaaaaaacaaacggc

SEQ ID NO: 3927658 - RNA, 17 nt, Shigella flexneri 2a str. 301
gcagaaaaagagcauca

SEQ ID NO: 3927659 - RNA, 16 nt, Shigella flexneri 2a str. 301
gcagaaacaaacgcaa

SEQ ID NO: 3927660 - RNA, 18 nt, Shigella flexneri 2a str. 301
gcagaaacaaccugagcg

SEQ ID NO: 3927661 - RNA, 15 nt, Shigella flexneri 2a str. 301
gcagaaagcgacuuu

SEQ ID NO: 3927662 - RNA, 13 nt, Shigella flexneri 2a str. 301
gcagaaauacccc

SEQ ID NO: 3927663 - RNA, 19 nt, Shigella flexneri 2a str. 301
gcagaaauaccccgccagc

SEQ ID NO: 3927664 - RNA, 16 nt, Shigella flexneri 2a str. 301
gcagaacgcuuucgca

SEQ ID NO: 3927665 - RNA, 18 nt, Shigella flexneri 2a str. 301
gcagaagcaaucauccca

SEQ ID NO: 3927666 - RNA, 23 nt, Shigella flexneri 2a str. 301
gcagaagcaaucaucccagugga

SEQ ID NO: 3927667 - RNA, 15 nt, Shigella flexneri 2a str. 301
gcagaagcauuuuac

SEQ ID NO: 3927668 - RNA, 23 nt, Shigella flexneri 2a str. 301
gcagaagcauuuuacauccugau

SEQ ID NO: 3927669 - RNA, 23 nt, Shigella flexneri 2a str. 301
gcagaaguuguccaugugcugga

SEQ ID NO: 3927670 - RNA, 18 nt, Shigella flexneri 2a str. 301
gcagaaucgcaaccagcg

SEQ ID NO: 3927671 - RNA, 15 nt, Shigella flexneri 2a str. 301
gcagacaaagugagc

SEQ ID NO: 3927672 - RNA, 17 nt, Shigella flexneri 2a str. 301
gcagacaaucacaucac

SEQ ID NO: 3927673 - RNA, 22 nt, Shigella flexneri 2a str. 301
gcagacacggcguauacaagaa

SEQ ID NO: 3927674 - RNA, 23 nt, Shigella flexneri 2a str. 301
gcagacacggcguauacaagaac

SEQ ID NO: 3927675 - RNA, 16 nt, Shigella flexneri 2a str. 301
gcagacagccuaccag

SEQ ID NO: 3927676 - RNA, 22 nt, Shigella flexneri 2a str. 301
gcagaccaaggugcuuuaacga

SEQ ID NO: 3927677 - RNA, 14 nt, Shigella flexneri 2a str. 301
gcagaccagcaaaa

SEQ ID NO: 3927678 - RNA, 20 nt, Shigella flexneri 2a str. 301
gcagacccguuaagcguuca

SEQ ID NO: 3927679 - RNA, 16 nt, Shigella flexneri 2a str. 301
gcagaccgccaaccac

SEQ ID NO: 3927680 - RNA, 13 nt, Shigella flexneri 2a str. 301
gcagaccugcuuu

SEQ ID NO: 3927681 - RNA, 11 nt, Shigella flexneri 2a str. 301
gcagacgccac

SEQ ID NO: 3927682 - RNA, 19 nt, Shigella flexneri 2a str. 301
gcagacggcucaucacccc

SEQ ID NO: 3927683 - RNA, 15 nt, Shigella flexneri 2a str. 301
gcagacggcucaucu

SEQ ID NO: 3927684 - RNA, 21 nt, Shigella flexneri 2a str. 301
gcagacguuuuuucugcccca

SEQ ID NO: 3927685 - RNA, 23 nt, Shigella flexneri 2a str. 301
gcagacguuuuuucugccccagu

SEQ ID NO: 3927686 - RNA, 13 nt, Shigella flexneri 2a str. 301
gcagacugaauac

SEQ ID NO: 3927687 - RNA, 17 nt, Shigella flexneri 2a str. 301
gcagacuuuuugcggca

SEQ ID NO: 3927688 - RNA, 21 nt, Shigella flexneri 2a str. 301
gcagacuuuuugcggcagcaa

SEQ ID NO: 3927689 - RNA, 18 nt, Shigella flexneri 2a str. 301
gcagagaaaccacaucaa

SEQ ID NO: 3927690 - RNA, 19 nt, Shigella flexneri 2a str. 301
gcagagaaacgccagcagc

SEQ ID NO: 3927691 - RNA, 21 nt, Shigella flexneri 2a str. 301
gcagagaaacgccagcagcag

SEQ ID NO: 3927692 - RNA, 13 nt, Shigella flexneri 2a str. 301
gcagcucugcgcc

SEQ ID NO: 3927693 - RNA, 12 nt, Shigella flexneri 2a str. 301
gcagcugagaaa

SEQ ID NO: 3927694 - RNA, 18 nt, Shigella flexneri 2a str. 301
gcagcuuaaucauaaugu

SEQ ID NO: 3927695 - RNA, 14 nt, Shigella flexneri 2a str. 301
gcagcuuagaaauu

SEQ ID NO: 3927696 - RNA, 12 nt, Shigella flexneri 2a str. 301
gcagcuucacgg

SEQ ID NO: 3927697 - RNA, 20 nt, Shigella flexneri 2a str. 301
gcagcuucucgugaaacuca

SEQ ID NO: 3927698 - RNA, 14 nt, Shigella flexneri 2a str. 301
gcagcuugauuucc

SEQ ID NO: 3927699 - RNA, 23 nt, Shigella flexneri 2a str. 301
gcagcuugcuguuucgcugacga

SEQ ID NO: 3927700 - RNA, 15 nt, Shigella flexneri 2a str. 301
gcagcuuucagcagc

SEQ ID NO: 3927701 - RNA, 16 nt, Shigella flexneri 2a str. 301
gcagcuuucagcagcg

SEQ ID NO: 3927702 - RNA, 17 nt, Shigella flexneri 2a str. 301
gcagcuuucagcagcgg

SEQ ID NO: 3927703 - RNA, 23 nt, Shigella flexneri 2a str. 301
gcagcuuugcccgaucaucaaaa

SEQ ID NO: 3927704 - RNA, 14 nt, Shigella flexneri 2a str. 301
gcagcuuugugcuu

SEQ ID NO: 3927705 - RNA, 16 nt, Shigella flexneri 2a str. 301
gcagcuuugugcuuca

SEQ ID NO: 3927706 - RNA, 19 nt, Shigella flexneri 2a str. 301
gcaggaaaagguaggccug

SEQ ID NO: 3927707 - RNA, 19 nt, Shigella flexneri 2a str. 301
gcaggaaaaucagcaucaa

SEQ ID NO: 3927708 - RNA, 21 nt, Shigella flexneri 2a str. 301
gcaggaaauacguaggccuga

SEQ ID NO: 3927709 - RNA, 22 nt, Shigella flexneri 2a str. 301
gcaggaacagugccucgcuaau

SEQ ID NO: 3927710 - RNA, 12 nt, Shigella flexneri 2a str. 301
gcaggaacugcu

SEQ ID NO: 3927711 - RNA, 20 nt, Shigella flexneri 2a str. 301
gcaggaaucacguaggccug

SEQ ID NO: 3927712 - RNA, 21 nt, Shigella flexneri 2a str. 301
gcaggaaucacguaggccuga

SEQ ID NO: 3927713 - RNA, 18 nt, Shigella flexneri 2a str. 301
gcaggaauguuguccagg

SEQ ID NO: 3927714 - RNA, 18 nt, Shigella flexneri 2a str. 301
gcaggacgcgcgcgccuu

SEQ ID NO: 3927715 - RNA, 20 nt, Shigella flexneri 2a str. 301
gcaggacugaaauuacaggc

SEQ ID NO: 3927716 - RNA, 14 nt, Shigella flexneri 2a str. 301
gcaggagcagcccc

SEQ ID NO: 3927717 - RNA, 20 nt, Shigella flexneri 2a str. 301
gcaggagcagccccugcgcc

SEQ ID NO: 3927718 - RNA, 21 nt, Shigella flexneri 2a str. 301
gcaggagcgauuaugaaacaa

SEQ ID NO: 3927719 - RNA, 21 nt, Shigella flexneri 2a str. 301
gcaggaucgacugcaaaccau

SEQ ID NO: 3927720 - RNA, 23 nt, Shigella flexneri 2a str. 301
gcaggaucgacugcaaaccauga

SEQ ID NO: 3927721 - RNA, 23 nt, Shigella flexneri 2a str. 301
gcaggaucugacuggcgagaucc

SEQ ID NO: 3927722 - RNA, 19 nt, Shigella flexneri 2a str. 301
gcaggauguuccggcaaag

SEQ ID NO: 3927723 - RNA, 21 nt, Shigella flexneri 2a str. 301
gcaggauuucuucaccagccu

SEQ ID NO: 3927724 - RNA, 19 nt, Shigella flexneri 2a str. 301
gcaggcaacagggaaauga

SEQ ID NO: 3927725 - RNA, 23 nt, Shigella flexneri 2a str. 301
gcaggcaaccguucggaaaaaua

SEQ ID NO: 3927726 - RNA, 18 nt, Shigella flexneri 2a str. 301
gcaggcacaaaaccugcc

SEQ ID NO: 3927727 - RNA, 18 nt, Shigella flexneri 2a str. 301
gcaggcaccagccccugg

SEQ ID NO: 3927728 - RNA, 16 nt, Shigella flexneri 2a str. 301
gcaggcaucaaugaaa

SEQ ID NO: 3927729 - RNA, 19 nt, Shigella flexneri 2a str. 301
gcaggcaucggugaugcuc

SEQ ID NO: 3927730 - RNA, 15 nt, Shigella flexneri 2a str. 301
gcaggcauucagcaa

SEQ ID NO: 3927731 - RNA, 21 nt, Shigella flexneri 2a str. 301
gcaggccaacagucuuaaagg

SEQ ID NO: 3927732 - RNA, 23 nt, Shigella flexneri 2a str. 301
gcaggccaauagcaccguuggcg

SEQ ID NO: 3927733 - RNA, 18 nt, Shigella flexneri 2a str. 301
gcaggccacgaaucagca

SEQ ID NO: 3927734 - RNA, 14 nt, Shigella flexneri 2a str. 301
gcaggccagcaauu

SEQ ID NO: 3927735 - RNA, 13 nt, Shigella flexneri 2a str. 301
gcaggcgcaaugg

SEQ ID NO: 3927736 - RNA, 14 nt, Shigella flexneri 2a str. 301
gcaggcgcugaaaa

SEQ ID NO: 3927737 - RNA, 19 nt, Shigella flexneri 2a str. 301
gcaggcggauugcuucugc

SEQ ID NO: 3927738 - RNA, 16 nt, Shigella flexneri 2a str. 301
gcaggcggcuggcauc

SEQ ID NO: 3927739 - RNA, 19 nt, Shigella flexneri 2a str. 301
gcaggcguaacacucgugc

SEQ ID NO: 3927740 - RNA, 18 nt, Shigella flexneri 2a str. 301
gcaggcguuaaaacaggu

SEQ ID NO: 3927741 - RNA, 23 nt, Shigella flexneri 2a str. 301
gcaggcguuuuuggcaucggcaa

SEQ ID NO: 3927742 - RNA, 15 nt, Shigella flexneri 2a str. 301
gcaggcuauuucugg

SEQ ID NO: 3927743 - RNA, 22 nt, Shigella flexneri 2a str. 301
gcaggcucagaagacgcuccag

SEQ ID NO: 3927744 - RNA, 15 nt, Shigella flexneri 2a str. 301
gcaggcucagacuga

SEQ ID NO: 3927745 - RNA, 15 nt, Shigella flexneri 2a str. 301
gcaggcuggugguga

SEQ ID NO: 3927746 - RNA, 14 nt, Shigella flexneri 2a str. 301
gcaggcuucaacac

SEQ ID NO: 3927747 - RNA, 22 nt, Shigella flexneri 2a str. 301
gcaggcuucaacacaggccggc

SEQ ID NO: 3927748 - RNA, 16 nt, Shigella flexneri 2a str. 301
gcaggcuuuuuuggua

SEQ ID NO: 3927749 - RNA, 18 nt, Shigella flexneri 2a str. 301
gcagggaucugauuuucc

SEQ ID NO: 3927750 - RNA, 21 nt, Shigella flexneri 2a str. 301
gcagggcaaacagacuggcaa

SEQ ID NO: 3927751 - RNA, 13 nt, Shigella flexneri 2a str. 301
gcagggcaucaag

SEQ ID NO: 3927752 - RNA, 16 nt, Shigella flexneri 2a str. 301
gcagggcaucgcaggc

SEQ ID NO: 3927753 - RNA, 22 nt, Shigella flexneri 2a str. 301
gcagggccguuuucguuacucc

SEQ ID NO: 3927754 - RNA, 20 nt, Shigella flexneri 2a str. 301
gcagggcgcggaaauggccc

SEQ ID NO: 3927755 - RNA, 14 nt, Shigella flexneri 2a str. 301
gcagggcggcaggc

SEQ ID NO: 3927756 - RNA, 17 nt, Shigella flexneri 2a str. 301
gcagggcggcaggcagc

SEQ ID NO: 3927757 - RNA, 20 nt, Shigella flexneri 2a str. 301
gcagggcggcaggcagcgcc

SEQ ID NO: 3927758 - RNA, 17 nt, Shigella flexneri 2a str. 301
gcagggcuaucuggaga

SEQ ID NO: 3927759 - RNA, 17 nt, Shigella flexneri 2a str. 301
gcagggcuguuuaucgu

SEQ ID NO: 3927760 - RNA, 15 nt, Shigella flexneri 2a str. 301
gcaggggaauuucaa

SEQ ID NO: 3927761 - RNA, 19 nt, Shigella flexneri 2a str. 301
gcaggguacugcgcgccgc

SEQ ID NO: 3927762 - RNA, 16 nt, Shigella flexneri 2a str. 301
gcagggucagcaucaa

SEQ ID NO: 3927763 - RNA, 14 nt, Shigella flexneri 2a str. 301
gcagguaagaguuu

SEQ ID NO: 3927764 - RNA, 15 nt, Shigella flexneri 2a str. 301
gcagguacgguacug

SEQ ID NO: 3927765 - RNA, 15 nt, Shigella flexneri 2a str. 301
gcaggucagucagug

SEQ ID NO: 3927766 - RNA, 19 nt, Shigella flexneri 2a str. 301
gcaggucauccggcacgcu

SEQ ID NO: 3927767 - RNA, 20 nt, Shigella flexneri 2a str. 301
gcaggucaugguaggccgga

SEQ ID NO: 3927768 - RNA, 23 nt, Shigella flexneri 2a str. 301
gcaggucgcccggauuacagcuc

SEQ ID NO: 3927769 - RNA, 18 nt, Shigella flexneri 2a str. 301
gcaggucgucuuuuacag

SEQ ID NO: 3927770 - RNA, 20 nt, Shigella flexneri 2a str. 301
gcaggugggcgcuggcuccu

SEQ ID NO: 3927771 - RNA, 15 nt, Shigella flexneri 2a str. 301
gcagguuuaaccauc

SEQ ID NO: 3927772 - RNA, 12 nt, Shigella flexneri 2a str. 301
gcaguaaaccac

SEQ ID NO: 3927773 - RNA, 14 nt, Shigella flexneri 2a str. 301
gcaguaaaccaccc

SEQ ID NO: 3927774 - RNA, 15 nt, Shigella flexneri 2a str. 301
gcaguaaaccaccca

SEQ ID NO: 3927775 - RNA, 20 nt, Shigella flexneri 2a str. 301
gcaguaaaccacccaccagc

SEQ ID NO: 3927776 - RNA, 23 nt, Shigella flexneri 2a str. 301
gcaguaaaccacccaccagcgcc

SEQ ID NO: 3927777 - RNA, 13 nt, Shigella flexneri 2a str. 301
gcaguaaaccgcu

SEQ ID NO: 3927778 - RNA, 16 nt, Shigella flexneri 2a str. 301
gcaguaaauauugucu

SEQ ID NO: 3927779 - RNA, 18 nt, Shigella flexneri 2a str. 301
gcaguaaaucaauaucca

SEQ ID NO: 3927780 - RNA, 16 nt, Shigella flexneri 2a str. 301
gcaguaagcgccaggg

SEQ ID NO: 3927781 - RNA, 18 nt, Shigella flexneri 2a str. 301
gcaguaaggaaauguucc

SEQ ID NO: 3927782 - RNA, 20 nt, Shigella flexneri 2a str. 301
gcaguaaggucaucaaucau

SEQ ID NO: 3927783 - RNA, 19 nt, Shigella flexneri 2a str. 301
gcaguaagugcgcaacaaa

SEQ ID NO: 3927784 - RNA, 18 nt, Shigella flexneri 2a str. 301
gcaguaauaccagaccuu

SEQ ID NO: 3927785 - RNA, 21 nt, Shigella flexneri 2a str. 301
gcaguaaucggcgaaaccgcg

SEQ ID NO: 3927786 - RNA, 21 nt, Shigella flexneri 2a str. 301
gcaguaccaccggacgcacac

SEQ ID NO: 3927787 - RNA, 22 nt, Shigella flexneri 2a str. 301
gcaguaccacgguacgccagag

SEQ ID NO: 3927788 - RNA, 12 nt, Shigella flexneri 2a str. 301
gcaguaccagau

SEQ ID NO: 3927789 - RNA, 17 nt, Shigella flexneri 2a str. 301
gcaguaccuccuucaca

SEQ ID NO: 3927790 - RNA, 19 nt, Shigella flexneri 2a str. 301
gcaguaccuccuucacagu

SEQ ID NO: 3927791 - RNA, 21 nt, Shigella flexneri 2a str. 301
gcaucaacgaucagcguggca

SEQ ID NO: 3927792 - RNA, 21 nt, Shigella flexneri 2a str. 301
gcaucaagaaugcucgcuggc

SEQ ID NO: 3927793 - RNA, 13 nt, Shigella flexneri 2a str. 301
gcaucaauaauca

SEQ ID NO: 3927794 - RNA, 15 nt, Shigella flexneri 2a str. 301
gcaucaauaccgcgu

SEQ ID NO: 3927795 - RNA, 17 nt, Shigella flexneri 2a str. 301
gcaucacgacagcacca

SEQ ID NO: 3927796 - RNA, 14 nt, Shigella flexneri 2a str. 301
gcaucacuccacac

SEQ ID NO: 3927797 - RNA, 21 nt, Shigella flexneri 2a str. 301
gcaucacuucuuuguucggca

SEQ ID NO: 3927798 - RNA, 23 nt, Shigella flexneri 2a str. 301
gcaucacuuucggugacagaaac

SEQ ID NO: 3927799 - RNA, 23 nt, Shigella flexneri 2a str. 301
gcaucagacaaaugucacugcuu

SEQ ID NO: 3927800 - RNA, 15 nt, Shigella flexneri 2a str. 301
gcaucagaucggcag

SEQ ID NO: 3927801 - RNA, 12 nt, Shigella flexneri 2a str. 301
gcaucagauggg

SEQ ID NO: 3927802 - RNA, 22 nt, Shigella flexneri 2a str. 301
gcaucagcaacacgcugcucau

SEQ ID NO: 3927803 - RNA, 14 nt, Shigella flexneri 2a str. 301
gcaucagcagcacg

SEQ ID NO: 3927804 - RNA, 19 nt, Shigella flexneri 2a str. 301
gcaucagcgauucauugag

SEQ ID NO: 3927805 - RNA, 19 nt, Shigella flexneri 2a str. 301
gcaucaggaccugcucugc

SEQ ID NO: 3927806 - RNA, 18 nt, Shigella flexneri 2a str. 301
gcaucaggcaacccagaa

SEQ ID NO: 3927807 - RNA, 14 nt, Shigella flexneri 2a str. 301
gcaucaggcaaucu

SEQ ID NO: 3927808 - RNA, 13 nt, Shigella flexneri 2a str. 301
gcaucaggcaauu

SEQ ID NO: 3927809 - RNA, 21 nt, Shigella flexneri 2a str. 301
gcaucaggcauugugcuccau

SEQ ID NO: 3927810 - RNA, 17 nt, Shigella flexneri 2a str. 301
gcaucaggccaaacaga

SEQ ID NO: 3927811 - RNA, 21 nt, Shigella flexneri 2a str. 301
gcaucagucacgacaaagaca

SEQ ID NO: 3927812 - RNA, 20 nt, Shigella flexneri 2a str. 301
gcaucagucucaaaccggcu

SEQ ID NO: 3927813 - RNA, 16 nt, Shigella flexneri 2a str. 301
gcaucaucgcaaugau

SEQ ID NO: 3927814 - RNA, 17 nt, Shigella flexneri 2a str. 301
gcaucaucgcuuugugc

SEQ ID NO: 3927815 - RNA, 18 nt, Shigella flexneri 2a str. 301
gcaucaugaauauauaau

SEQ ID NO: 3927816 - RNA, 16 nt, Shigella flexneri 2a str. 301
gcaucauggaagcaau

SEQ ID NO: 3927817 - RNA, 16 nt, Shigella flexneri 2a str. 301
gcaucauggcauuuca

SEQ ID NO: 3927818 - RNA, 21 nt, Shigella flexneri 2a str. 301
gcaucaugucgcccacgccag

SEQ ID NO: 3927819 - RNA, 23 nt, Shigella flexneri 2a str. 301
gcaucauuuaaaaagaaaaaacu

SEQ ID NO: 3927820 - RNA, 16 nt, Shigella flexneri 2a str. 301
gcauccauaucgccau

SEQ ID NO: 3927821 - RNA, 13 nt, Shigella flexneri 2a str. 301
gcaucccagaaaa

SEQ ID NO: 3927822 - RNA, 14 nt, Shigella flexneri 2a str. 301
gcaucccgcaccag

SEQ ID NO: 3927823 - RNA, 22 nt, Shigella flexneri 2a str. 301
gcaucccgguaucaaagcgcca

SEQ ID NO: 3927824 - RNA, 23 nt, Shigella flexneri 2a str. 301
gcaucccgguaucaaagcgccag

SEQ ID NO: 3927825 - RNA, 13 nt, Shigella flexneri 2a str. 301
gcaucccucuuug

SEQ ID NO: 3927826 - RNA, 18 nt, Shigella flexneri 2a str. 301
gcauccgacaaggcauca

SEQ ID NO: 3927827 - RNA, 16 nt, Shigella flexneri 2a str. 301
gcauccgacacuggca

SEQ ID NO: 3927828 - RNA, 17 nt, Shigella flexneri 2a str. 301
gcauccgacauuugcac

SEQ ID NO: 3927829 - RNA, 14 nt, Shigella flexneri 2a str. 301
gcauccgcugaugc

SEQ ID NO: 3927830 - RNA, 16 nt, Shigella flexneri 2a str. 301
gcauccgcugaugcaa

SEQ ID NO: 3927831 - RNA, 17 nt, Shigella flexneri 2a str. 301
gcauccggcaauaagca

SEQ ID NO: 3927832 - RNA, 18 nt, Shigella flexneri 2a str. 301
gcauccggcaauugugau

SEQ ID NO: 3927833 - RNA, 19 nt, Shigella flexneri 2a str. 301
gcauccggcaucaacaaag

SEQ ID NO: 3927834 - RNA, 21 nt, Shigella flexneri 2a str. 301
gcauccggcauuugagcagga

SEQ ID NO: 3927835 - RNA, 19 nt, Shigella flexneri 2a str. 301
gcauccgggauggucagcg

SEQ ID NO: 3927836 - RNA, 17 nt, Shigella flexneri 2a str. 301
gcauccgggccagcggc

SEQ ID NO: 3927837 - RNA, 18 nt, Shigella flexneri 2a str. 301
gcauccggucagacaacu

SEQ ID NO: 3927838 - RNA, 21 nt, Shigella flexneri 2a str. 301
gcauccggucagacaacuucc

SEQ ID NO: 3927839 - RNA, 16 nt, Shigella flexneri 2a str. 301
gcauccggugauaggc

SEQ ID NO: 3927840 - RNA, 17 nt, Shigella flexneri 2a str. 301
gcauccggugauuuuca

SEQ ID NO: 3927841 - RNA, 14 nt, Shigella flexneri 2a str. 301
gcauccuugcuaac

SEQ ID NO: 3927842 - RNA, 22 nt, Shigella flexneri 2a str. 301
gcaucgacaguuucaccugcug

SEQ ID NO: 3927843 - RNA, 24 nt, Shigella flexneri 2a str. 301
gcaucgacggcggagucauucucc

SEQ ID NO: 3927844 - RNA, 19 nt, Shigella flexneri 2a str. 301
gcaucgauaucaaccaguu

SEQ ID NO: 3927845 - RNA, 20 nt, Shigella flexneri 2a str. 301
gcaucgcaaaccagacgcgc

SEQ ID NO: 3927846 - RNA, 22 nt, Shigella flexneri 2a str. 301
gcaucgcaaaccagacgcgcgu

SEQ ID NO: 3927847 - RNA, 12 nt, Shigella flexneri 2a str. 301
gcaucgcaucaa

SEQ ID NO: 3927848 - RNA, 16 nt, Shigella flexneri 2a str. 301
gcaucgccaaacaggc

SEQ ID NO: 3927849 - RNA, 19 nt, Shigella flexneri 2a str. 301
gcaucgccaguuuugccag

SEQ ID NO: 3927850 - RNA, 15 nt, Shigella flexneri 2a str. 301
gcaucgccauaauaa

SEQ ID NO: 3927851 - RNA, 22 nt, Shigella flexneri 2a str. 301
gcaucgcccaggcgaccaggcc

SEQ ID NO: 3927852 - RNA, 17 nt, Shigella flexneri 2a str. 301
gcaucgcccccaucgcc

SEQ ID NO: 3927853 - RNA, 19 nt, Shigella flexneri 2a str. 301
gcaucgccgggaacagaau

SEQ ID NO: 3927854 - RNA, 15 nt, Shigella flexneri 2a str. 301
gcaucgcgaaaugca

SEQ ID NO: 3927855 - RNA, 16 nt, Shigella flexneri 2a str. 301
gcaucgcgauggcaag

SEQ ID NO: 3927856 - RNA, 21 nt, Shigella flexneri 2a str. 301
gcaucgcgauuaugccgccga

SEQ ID NO: 3927857 - RNA, 22 nt, Shigella flexneri 2a str. 301
gcaucggcaaucacaucaccau

SEQ ID NO: 3927858 - RNA, 14 nt, Shigella flexneri 2a str. 301
gcaucggcauaauc

SEQ ID NO: 3927859 - RNA, 13 nt, Shigella flexneri 2a str. 301
gcaucggcaucaa

SEQ ID NO: 3927860 - RNA, 18 nt, Shigella flexneri 2a str. 301
gcaucggucagacccagu

SEQ ID NO: 3927861 - RNA, 21 nt, Shigella flexneri 2a str. 301
gcaucggucgaugaaagcgcc

SEQ ID NO: 3927862 - RNA, 22 nt, Shigella flexneri 2a str. 301
gcaucggugaggaucaccaguc

SEQ ID NO: 3927863 - RNA, 12 nt, Shigella flexneri 2a str. 301
gcaucguacugg

SEQ ID NO: 3927864 - RNA, 18 nt, Shigella flexneri 2a str. 301
gcaucguauuucagaccu

SEQ ID NO: 3927865 - RNA, 15 nt, Shigella flexneri 2a str. 301
gcaucguccgccagc

SEQ ID NO: 3927866 - RNA, 22 nt, Shigella flexneri 2a str. 301
gcaucguccgccagccuacaga

SEQ ID NO: 3927867 - RNA, 17 nt, Shigella flexneri 2a str. 301
gcaucuacgcucucuuc

SEQ ID NO: 3927868 - RNA, 19 nt, Shigella flexneri 2a str. 301
gcaucuacgcucucuucaa

SEQ ID NO: 3927869 - RNA, 17 nt, Shigella flexneri 2a str. 301
gcaucuccugauuuucu

SEQ ID NO: 3927870 - RNA, 15 nt, Shigella flexneri 2a str. 301
gcaucuccuguuuca

SEQ ID NO: 3927871 - RNA, 15 nt, Shigella flexneri 2a str. 301
gcaucugaccagaug

SEQ ID NO: 3927872 - RNA, 20 nt, Shigella flexneri 2a str. 301
gcaucugagcaugaugccug

SEQ ID NO: 3927873 - RNA, 17 nt, Shigella flexneri 2a str. 301
gcaucugauaagcccag

SEQ ID NO: 3927874 - RNA, 23 nt, Shigella flexneri 2a str. 301
gcaucugcgcauaacugccggau

SEQ ID NO: 3927875 - RNA, 22 nt, Shigella flexneri 2a str. 301
gcaucuggcacuauuggcggau

SEQ ID NO: 3927876 - RNA, 20 nt, Shigella flexneri 2a str. 301
gcaucuggcauaaacaaagc

SEQ ID NO: 3927877 - RNA, 16 nt, Shigella flexneri 2a str. 301
gcaucuguugguaacu

SEQ ID NO: 3927878 - RNA, 20 nt, Shigella flexneri 2a str. 301
gcaucuguuucgaucagcaa

SEQ ID NO: 3927879 - RNA, 22 nt, Shigella flexneri 2a str. 301
gcaucuguuucgaucagcaauu

SEQ ID NO: 3927880 - RNA, 17 nt, Shigella flexneri 2a str. 301
gcaucuucuccacgcca

SEQ ID NO: 3927881 - RNA, 13 nt, Shigella flexneri 2a str. 301
gcaucuucuucau

SEQ ID NO: 3927882 - RNA, 16 nt, Shigella flexneri 2a str. 301
gcaucuucuucauucc

SEQ ID NO: 3927883 - RNA, 21 nt, Shigella flexneri 2a str. 301
gcaucuugauaccaaaauggc

SEQ ID NO: 3927884 - RNA, 22 nt, Shigella flexneri 2a str. 301
gcaucuuguucauagugccuga

SEQ ID NO: 3927885 - RNA, 15 nt, Shigella flexneri 2a str. 301
gcaugaacaaagcgc

SEQ ID NO: 3927886 - RNA, 15 nt, Shigella flexneri 2a str. 301
gcaugaacauugcug

SEQ ID NO: 3927887 - RNA, 14 nt, Shigella flexneri 2a str. 301
gcaugacaggcaac

SEQ ID NO: 3927888 - RNA, 10 nt, Shigella flexneri 2a str. 301
gcaugauaag

SEQ ID NO: 3927889 - RNA, 14 nt, Shigella flexneri 2a str. 301
gcaugauaccgauu

SEQ ID NO: 3927890 - RNA, 19 nt, Shigella flexneri 2a str. 301
gccaaaugucaccagccga

SEQ ID NO: 3927891 - RNA, 19 nt, Shigella flexneri 2a str. 301
gccaaauuuggugcucagu

SEQ ID NO: 3927892 - RNA, 14 nt, Shigella flexneri 2a str. 301
gccaacaaaaucuu

SEQ ID NO: 3927893 - RNA, 17 nt, Shigella flexneri 2a str. 301
gccaacaaucucuucca

SEQ ID NO: 3927894 - RNA, 18 nt, Shigella flexneri 2a str. 301
gccaacaaucucuuccag

SEQ ID NO: 3927895 - RNA, 14 nt, Shigella flexneri 2a str. 301
gccaaccacaugau

SEQ ID NO: 3927896 - RNA, 16 nt, Shigella flexneri 2a str. 301
gccaaccaugccgccc

SEQ ID NO: 3927897 - RNA, 21 nt, Shigella flexneri 2a str. 301
gccaaccccaauguagccgca

SEQ ID NO: 3927898 - RNA, 22 nt, Shigella flexneri 2a str. 301
gccaacccgcucuggauaauca

SEQ ID NO: 3927899 - RNA, 21 nt, Shigella flexneri 2a str. 301
gccaaccgauaucuuuccggc

SEQ ID NO: 3927900 - RNA, 20 nt, Shigella flexneri 2a str. 301
gccaaccgucagauccgcca

SEQ ID NO: 3927901 - RNA, 11 nt, Shigella flexneri 2a str. 301
gccaaccugcg

SEQ ID NO: 3927902 - RNA, 21 nt, Shigella flexneri 2a str. 301
gccaaccuugcggaagcguca

SEQ ID NO: 3927903 - RNA, 21 nt, Shigella flexneri 2a str. 301
gccaacuucaugaccuuccag

SEQ ID NO: 3927904 - RNA, 15 nt, Shigella flexneri 2a str. 301
gccaacuugcccagg

SEQ ID NO: 3927905 - RNA, 15 nt, Shigella flexneri 2a str. 301
gccaagaaagagcgu

SEQ ID NO: 3927906 - RNA, 16 nt, Shigella flexneri 2a str. 301
gccaagauagaaccac

SEQ ID NO: 3927907 - RNA, 15 nt, Shigella flexneri 2a str. 301
gccaagcaccgcauu

SEQ ID NO: 3927908 - RNA, 13 nt, Shigella flexneri 2a str. 301
gccaagcgccgcc

SEQ ID NO: 3927909 - RNA, 19 nt, Shigella flexneri 2a str. 301
gccaauaaaaauaccggcg

SEQ ID NO: 3927910 - RNA, 22 nt, Shigella flexneri 2a str. 301
gccaauacaaaauuuaacacca

SEQ ID NO: 3927911 - RNA, 19 nt, Shigella flexneri 2a str. 301
gccaauagaagcaccguug

SEQ ID NO: 3927912 - RNA, 16 nt, Shigella flexneri 2a str. 301
gccaaucagcaauaaa

SEQ ID NO: 3927913 - RNA, 19 nt, Shigella flexneri 2a str. 301
gccaaucagcgcagcaccc

SEQ ID NO: 3927914 - RNA, 21 nt, Shigella flexneri 2a str. 301
gccaauccagaacaccauaau

SEQ ID NO: 3927915 - RNA, 16 nt, Shigella flexneri 2a str. 301
gccaauccccagaccu

SEQ ID NO: 3927916 - RNA, 21 nt, Shigella flexneri 2a str. 301
gccaauccccagaccugcugu

SEQ ID NO: 3927917 - RNA, 19 nt, Shigella flexneri 2a str. 301
gccaaucccggaagccacc

SEQ ID NO: 3927918 - RNA, 20 nt, Shigella flexneri 2a str. 301
gccaaucccggaagccacca

SEQ ID NO: 3927919 - RNA, 12 nt, Shigella flexneri 2a str. 301
gccaaucggcaa

SEQ ID NO: 3927920 - RNA, 19 nt, Shigella flexneri 2a str. 301
gccaaucuucacaucauca

SEQ ID NO: 3927921 - RNA, 20 nt, Shigella flexneri 2a str. 301
gccaaucuucacaucaucau

SEQ ID NO: 3927922 - RNA, 12 nt, Shigella flexneri 2a str. 301
gccaaugaaauu

SEQ ID NO: 3927923 - RNA, 16 nt, Shigella flexneri 2a str. 301
gccaaugcaggcaucg

SEQ ID NO: 3927924 - RNA, 16 nt, Shigella flexneri 2a str. 301
gccaauguguuuauaa

SEQ ID NO: 3927925 - RNA, 22 nt, Shigella flexneri 2a str. 301
gccaauuaaugcaccaacaaau

SEQ ID NO: 3927926 - RNA, 15 nt, Shigella flexneri 2a str. 301
gccaauuacgcaggc

SEQ ID NO: 3927927 - RNA, 11 nt, Shigella flexneri 2a str. 301
gccaauuccca

SEQ ID NO: 3927928 - RNA, 12 nt, Shigella flexneri 2a str. 301
gccaauugcugu

SEQ ID NO: 3927929 - RNA, 12 nt, Shigella flexneri 2a str. 301
gccaauuucugg

SEQ ID NO: 3927930 - RNA, 15 nt, Shigella flexneri 2a str. 301
gccacaaagcagggc

SEQ ID NO: 3927931 - RNA, 17 nt, Shigella flexneri 2a str. 301
gccacaacuucaacguu

SEQ ID NO: 3927932 - RNA, 14 nt, Shigella flexneri 2a str. 301
gccacaagggcaua

SEQ ID NO: 3927933 - RNA, 20 nt, Shigella flexneri 2a str. 301
gccacaauaaagcgauaaau

SEQ ID NO: 3927934 - RNA, 20 nt, Shigella flexneri 2a str. 301
gccacaauaacugccggaac

SEQ ID NO: 3927935 - RNA, 20 nt, Shigella flexneri 2a str. 301
gccacaauacugaucaucau

SEQ ID NO: 3927936 - RNA, 14 nt, Shigella flexneri 2a str. 301
gccacaauauuccg

SEQ ID NO: 3927937 - RNA, 22 nt, Shigella flexneri 2a str. 301
gccacaaucgcagcgcaagcug

SEQ ID NO: 3927938 - RNA, 17 nt, Shigella flexneri 2a str. 301
gccacacaccgcaaacu

SEQ ID NO: 3927939 - RNA, 22 nt, Shigella flexneri 2a str. 301
gccacacacgauccugcacggu

SEQ ID NO: 3927940 - RNA, 18 nt, Shigella flexneri 2a str. 301
gccacaccaacugugccg

SEQ ID NO: 3927941 - RNA, 20 nt, Shigella flexneri 2a str. 301
gccacaccaacugugccgcc

SEQ ID NO: 3927942 - RNA, 16 nt, Shigella flexneri 2a str. 301
gccacaccacugcgca

SEQ ID NO: 3927943 - RNA, 19 nt, Shigella flexneri 2a str. 301
gccacaccuggugcagcgg

SEQ ID NO: 3927944 - RNA, 21 nt, Shigella flexneri 2a str. 301
gccacagcaauuuugcccagc

SEQ ID NO: 3927945 - RNA, 20 nt, Shigella flexneri 2a str. 301
gccacagcagccuucgccac

SEQ ID NO: 3927946 - RNA, 13 nt, Shigella flexneri 2a str. 301
gccacagccagcc

SEQ ID NO: 3927947 - RNA, 16 nt, Shigella flexneri 2a str. 301
gccacagccagccaac

SEQ ID NO: 3927948 - RNA, 20 nt, Shigella flexneri 2a str. 301
gccacagccgagcgccacca

SEQ ID NO: 3927949 - RNA, 20 nt, Shigella flexneri 2a str. 301
gccacagcgccaucugcagg

SEQ ID NO: 3927950 - RNA, 20 nt, Shigella flexneri 2a str. 301
gccacaggcggucgaacagg

SEQ ID NO: 3927951 - RNA, 17 nt, Shigella flexneri 2a str. 301
gccacaggucagcagga

SEQ ID NO: 3927952 - RNA, 19 nt, Shigella flexneri 2a str. 301
gccacaggucagcaggagc

SEQ ID NO: 3927953 - RNA, 19 nt, Shigella flexneri 2a str. 301
gccacaguugaucagccag

SEQ ID NO: 3927954 - RNA, 21 nt, Shigella flexneri 2a str. 301
gccacaguuuuacugcagcca

SEQ ID NO: 3927955 - RNA, 13 nt, Shigella flexneri 2a str. 301
gccacauccgcgg

SEQ ID NO: 3927956 - RNA, 13 nt, Shigella flexneri 2a str. 301
gccacauccggca

SEQ ID NO: 3927957 - RNA, 15 nt, Shigella flexneri 2a str. 301
gccacauccggcuuu

SEQ ID NO: 3927958 - RNA, 17 nt, Shigella flexneri 2a str. 301
gccacauuccucuguca

SEQ ID NO: 3927959 - RNA, 20 nt, Shigella flexneri 2a str. 301
gccacauugcaucugauaac

SEQ ID NO: 3927960 - RNA, 20 nt, Shigella flexneri 2a str. 301
gccaccaauaaugaacgcca

SEQ ID NO: 3927961 - RNA, 20 nt, Shigella flexneri 2a str. 301
gccaccacaccggaccagac

SEQ ID NO: 3927962 - RNA, 14 nt, Shigella flexneri 2a str. 301
gccaccaccagcac

SEQ ID NO: 3927963 - RNA, 15 nt, Shigella flexneri 2a str. 301
gccaccaccagcaca

SEQ ID NO: 3927964 - RNA, 14 nt, Shigella flexneri 2a str. 301
gccaccaccagcgu

SEQ ID NO: 3927965 - RNA, 17 nt, Shigella flexneri 2a str. 301
gccaccacgccaagaaa

SEQ ID NO: 3927966 - RNA, 17 nt, Shigella flexneri 2a str. 301
gccaccagcaacagcgc

SEQ ID NO: 3927967 - RNA, 18 nt, Shigella flexneri 2a str. 301
gccaccagcgccgcgcca

SEQ ID NO: 3927968 - RNA, 13 nt, Shigella flexneri 2a str. 301
gccaccaggccac

SEQ ID NO: 3927969 - RNA, 23 nt, Shigella flexneri 2a str. 301
gccaccauuuuacguccgcgcac

SEQ ID NO: 3927970 - RNA, 13 nt, Shigella flexneri 2a str. 301
gccaccccacgau

SEQ ID NO: 3927971 - RNA, 17 nt, Shigella flexneri 2a str. 301
gccacccugcggcugcu

SEQ ID NO: 3927972 - RNA, 18 nt, Shigella flexneri 2a str. 301
gccacccugcggcugcug

SEQ ID NO: 3927973 - RNA, 20 nt, Shigella flexneri 2a str. 301
gccacccugcggcugcugag

SEQ ID NO: 3927974 - RNA, 21 nt, Shigella flexneri 2a str. 301
gccaccgaacaaaacagcgag

SEQ ID NO: 3927975 - RNA, 16 nt, Shigella flexneri 2a str. 301
gccaccgcgccgggca

SEQ ID NO: 3927976 - RNA, 18 nt, Shigella flexneri 2a str. 301
gccaccgcgccgggcaga

SEQ ID NO: 3927977 - RNA, 17 nt, Shigella flexneri 2a str. 301
gccaccggcacauccag

SEQ ID NO: 3927978 - RNA, 23 nt, Shigella flexneri 2a str. 301
gccaccggcuuucgcuucaacca

SEQ ID NO: 3927979 - RNA, 23 nt, Shigella flexneri 2a str. 301
gccaccguguucaugaccgugau

SEQ ID NO: 3927980 - RNA, 13 nt, Shigella flexneri 2a str. 301
gccaccucuuuca

SEQ ID NO: 3927981 - RNA, 19 nt, Shigella flexneri 2a str. 301
gccacgaaacugcuggcuu

SEQ ID NO: 3927982 - RNA, 13 nt, Shigella flexneri 2a str. 301
gccacgcaaacuu

SEQ ID NO: 3927983 - RNA, 13 nt, Shigella flexneri 2a str. 301
gccacgcguuugg

SEQ ID NO: 3927984 - RNA, 17 nt, Shigella flexneri 2a str. 301
gccacgcguuugggcca

SEQ ID NO: 3927985 - RNA, 18 nt, Shigella flexneri 2a str. 301
gccacgcuuaaccccggg

SEQ ID NO: 3927986 - RNA, 18 nt, Shigella flexneri 2a str. 301
gccacgcuucaaucugau

SEQ ID NO: 3927987 - RNA, 20 nt, Shigella flexneri 2a str. 301
gccacgcuucaaucugauau

SEQ ID NO: 3927988 - RNA, 23 nt, Shigella flexneri 2a str. 301
gccacggauauauccguggcuuu

SEQ ID NO: 3927989 - RNA, 17 nt, Shigella flexneri 2a str. 301
gccacggcaugaaagcg

SEQ ID NO: 3927990 - RNA, 22 nt, Shigella flexneri 2a str. 301
gccagccccagcgucagcauca

SEQ ID NO: 3927991 - RNA, 22 nt, Shigella flexneri 2a str. 301
gccagcccgaucggcuggcauu

SEQ ID NO: 3927992 - RNA, 19 nt, Shigella flexneri 2a str. 301
gccagccgaugcagguugg

SEQ ID NO: 3927993 - RNA, 14 nt, Shigella flexneri 2a str. 301
gccagccgguaacg

SEQ ID NO: 3927994 - RNA, 10 nt, Shigella flexneri 2a str. 301
gccagccuca

SEQ ID NO: 3927995 - RNA, 14 nt, Shigella flexneri 2a str. 301
gccagccuucacga

SEQ ID NO: 3927996 - RNA, 13 nt, Shigella flexneri 2a str. 301
gccagcgaagaag

SEQ ID NO: 3927997 - RNA, 16 nt, Shigella flexneri 2a str. 301
gccagcgauaucgcga

SEQ ID NO: 3927998 - RNA, 17 nt, Shigella flexneri 2a str. 301
gccagcgccaccaccag

SEQ ID NO: 3927999 - RNA, 19 nt, Shigella flexneri 2a str. 301
gccagcgccgacagcagcc

SEQ ID NO: 3928000 - RNA, 18 nt, Shigella flexneri 2a str. 301
gccagcgcgaccagaaaa

SEQ ID NO: 3928001 - RNA, 15 nt, Shigella flexneri 2a str. 301
gccagcgcgccuuca

SEQ ID NO: 3928002 - RNA, 23 nt, Shigella flexneri 2a str. 301
gccagcgcgccuucauucaggcc

SEQ ID NO: 3928003 - RNA, 13 nt, Shigella flexneri 2a str. 301
gccagcggcagcu

SEQ ID NO: 3928004 - RNA, 17 nt, Shigella flexneri 2a str. 301
gccagcggcagcucgcg

SEQ ID NO: 3928005 - RNA, 12 nt, Shigella flexneri 2a str. 301
gccagcggcggc

SEQ ID NO: 3928006 - RNA, 19 nt, Shigella flexneri 2a str. 301
gccagcggcuccccgcuau

SEQ ID NO: 3928007 - RNA, 17 nt, Shigella flexneri 2a str. 301
gccagcgggccggaggg

SEQ ID NO: 3928008 - RNA, 15 nt, Shigella flexneri 2a str. 301
gccagcguaaauccu

SEQ ID NO: 3928009 - RNA, 16 nt, Shigella flexneri 2a str. 301
gccagcguagucggca

SEQ ID NO: 3928010 - RNA, 21 nt, Shigella flexneri 2a str. 301
gccagcgucgcaucaggcauc

SEQ ID NO: 3928011 - RNA, 14 nt, Shigella flexneri 2a str. 301
gccagcgucugagc

SEQ ID NO: 3928012 - RNA, 20 nt, Shigella flexneri 2a str. 301
gccagcgucugagcaggcgg

SEQ ID NO: 3928013 - RNA, 16 nt, Shigella flexneri 2a str. 301
gccagcgugucgagca

SEQ ID NO: 3928014 - RNA, 16 nt, Shigella flexneri 2a str. 301
gccagcucaaacgaau

SEQ ID NO: 3928015 - RNA, 15 nt, Shigella flexneri 2a str. 301
gccagcucaaccugu

SEQ ID NO: 3928016 - RNA, 18 nt, Shigella flexneri 2a str. 301
gccagcuccgggcugguu

SEQ ID NO: 3928017 - RNA, 15 nt, Shigella flexneri 2a str. 301
gccagcugcugugga

SEQ ID NO: 3928018 - RNA, 22 nt, Shigella flexneri 2a str. 301
gccagcuugccgcgcucugcca

SEQ ID NO: 3928019 - RNA, 17 nt, Shigella flexneri 2a str. 301
gccagcuugcgauccug

SEQ ID NO: 3928020 - RNA, 17 nt, Shigella flexneri 2a str. 301
gccagcuuucaccugcg

SEQ ID NO: 3928021 - RNA, 18 nt, Shigella flexneri 2a str. 301
gccaggaaccugugacag

SEQ ID NO: 3928022 - RNA, 21 nt, Shigella flexneri 2a str. 301
gccaggaaucgcaaaccacgg

SEQ ID NO: 3928023 - RNA, 21 nt, Shigella flexneri 2a str. 301
gccaggagacgcgcaaaucag

SEQ ID NO: 3928024 - RNA, 13 nt, Shigella flexneri 2a str. 301
gccaggagcacgc

SEQ ID NO: 3928025 - RNA, 22 nt, Shigella flexneri 2a str. 301
gccaggagccaacacuuucacu

SEQ ID NO: 3928026 - RNA, 19 nt, Shigella flexneri 2a str. 301
gccaggaugauuccggcaa

SEQ ID NO: 3928027 - RNA, 19 nt, Shigella flexneri 2a str. 301
gccaggcaccgcacuggcu

SEQ ID NO: 3928028 - RNA, 19 nt, Shigella flexneri 2a str. 301
gccaggcagaacgcuuucg

SEQ ID NO: 3928029 - RNA, 16 nt, Shigella flexneri 2a str. 301
gccaggcgcgaaugga

SEQ ID NO: 3928030 - RNA, 23 nt, Shigella flexneri 2a str. 301
gccaggcgcgaauggaaagcccg

SEQ ID NO: 3928031 - RNA, 19 nt, Shigella flexneri 2a str. 301
gccaggcgcugauugggaa

SEQ ID NO: 3928032 - RNA, 13 nt, Shigella flexneri 2a str. 301
gccaggcuggcag

SEQ ID NO: 3928033 - RNA, 22 nt, Shigella flexneri 2a str. 301
gccaggcuuuccgucagcggca

SEQ ID NO: 3928034 - RNA, 14 nt, Shigella flexneri 2a str. 301
gccagggugcuggc

SEQ ID NO: 3928035 - RNA, 17 nt, Shigella flexneri 2a str. 301
gccagggugcuggcgcu

SEQ ID NO: 3928036 - RNA, 13 nt, Shigella flexneri 2a str. 301
gccaggguggcuc

SEQ ID NO: 3928037 - RNA, 23 nt, Shigella flexneri 2a str. 301
gccaggguuucggcuuuuuccug

SEQ ID NO: 3928038 - RNA, 16 nt, Shigella flexneri 2a str. 301
gccaggucagagagcc

SEQ ID NO: 3928039 - RNA, 16 nt, Shigella flexneri 2a str. 301
gccagguuaaccagca

SEQ ID NO: 3928040 - RNA, 20 nt, Shigella flexneri 2a str. 301
gccagguucgauauccgcca

SEQ ID NO: 3928041 - RNA, 18 nt, Shigella flexneri 2a str. 301
gccagguuuaccagcagc

SEQ ID NO: 3928042 - RNA, 16 nt, Shigella flexneri 2a str. 301
gccaguaacagaacgc

SEQ ID NO: 3928043 - RNA, 18 nt, Shigella flexneri 2a str. 301
gccaguaacagaacgcau

SEQ ID NO: 3928044 - RNA, 15 nt, Shigella flexneri 2a str. 301
gccaguaaccuuuca

SEQ ID NO: 3928045 - RNA, 21 nt, Shigella flexneri 2a str. 301
gccaguaagcaguccagcgcc

SEQ ID NO: 3928046 - RNA, 14 nt, Shigella flexneri 2a str. 301
gccaguaaucacga

SEQ ID NO: 3928047 - RNA, 19 nt, Shigella flexneri 2a str. 301
gccaguaauccggcuuccu

SEQ ID NO: 3928048 - RNA, 18 nt, Shigella flexneri 2a str. 301
gccaguaaucuggccaau

SEQ ID NO: 3928049 - RNA, 19 nt, Shigella flexneri 2a str. 301
gccaguaaucuggccaaug

SEQ ID NO: 3928050 - RNA, 15 nt, Shigella flexneri 2a str. 301
gccaguaaucuucaa

SEQ ID NO: 3928051 - RNA, 18 nt, Shigella flexneri 2a str. 301
gccaguaccagcagcgcc

SEQ ID NO: 3928052 - RNA, 22 nt, Shigella flexneri 2a str. 301
gccaguacccaugugauuuaaa

SEQ ID NO: 3928053 - RNA, 14 nt, Shigella flexneri 2a str. 301
gccaguacgcgccc

SEQ ID NO: 3928054 - RNA, 17 nt, Shigella flexneri 2a str. 301
gccaguauuaccggcag

SEQ ID NO: 3928055 - RNA, 13 nt, Shigella flexneri 2a str. 301
gccagucaguuaa

SEQ ID NO: 3928056 - RNA, 13 nt, Shigella flexneri 2a str. 301
gccaguccagguu

SEQ ID NO: 3928057 - RNA, 16 nt, Shigella flexneri 2a str. 301
gccagucccuuucagg

SEQ ID NO: 3928058 - RNA, 21 nt, Shigella flexneri 2a str. 301
gccagucgcgccuuacgcugc

SEQ ID NO: 3928059 - RNA, 15 nt, Shigella flexneri 2a str. 301
gccagucuggcuucg

SEQ ID NO: 3928060 - RNA, 18 nt, Shigella flexneri 2a str. 301
gccagucuuccaucacaa

SEQ ID NO: 3928061 - RNA, 16 nt, Shigella flexneri 2a str. 301
gccagucuuccgccgg

SEQ ID NO: 3928062 - RNA, 15 nt, Shigella flexneri 2a str. 301
gccagugccacacgc

SEQ ID NO: 3928063 - RNA, 15 nt, Shigella flexneri 2a str. 301
gccagugccgguggc

SEQ ID NO: 3928064 - RNA, 15 nt, Shigella flexneri 2a str. 301
gccagugcugaaggu

SEQ ID NO: 3928065 - RNA, 22 nt, Shigella flexneri 2a str. 301
gccaguguuggcgucagaccgg

SEQ ID NO: 3928066 - RNA, 21 nt, Shigella flexneri 2a str. 301
gccaguguuucgacaauaauc

SEQ ID NO: 3928067 - RNA, 14 nt, Shigella flexneri 2a str. 301
gccaguuacugcca

SEQ ID NO: 3928068 - RNA, 20 nt, Shigella flexneri 2a str. 301
gccaguuacugccaccaucc

SEQ ID NO: 3928069 - RNA, 16 nt, Shigella flexneri 2a str. 301
gccaguuacugcugac

SEQ ID NO: 3928070 - RNA, 21 nt, Shigella flexneri 2a str. 301
gccaguucauuugaacuggcu

SEQ ID NO: 3928071 - RNA, 12 nt, Shigella flexneri 2a str. 301
gccaguuccccc

SEQ ID NO: 3928072 - RNA, 19 nt, Shigella flexneri 2a str. 301
gccaguucgaaauccagac

SEQ ID NO: 3928073 - RNA, 23 nt, Shigella flexneri 2a str. 301
gccaguucguuguaguguuccug

SEQ ID NO: 3928074 - RNA, 13 nt, Shigella flexneri 2a str. 301
gccaguucuucca

SEQ ID NO: 3928075 - RNA, 18 nt, Shigella flexneri 2a str. 301
gccaguugcuuauccagc

SEQ ID NO: 3928076 - RNA, 22 nt, Shigella flexneri 2a str. 301
gccaguuguugauaagccccag

SEQ ID NO: 3928077 - RNA, 16 nt, Shigella flexneri 2a str. 301
gccaguuguugcugaa

SEQ ID NO: 3928078 - RNA, 23 nt, Shigella flexneri 2a str. 301
gccaguuuacugucugcuucugc

SEQ ID NO: 3928079 - RNA, 19 nt, Shigella flexneri 2a str. 301
gccaguuucggacgcggca

SEQ ID NO: 3928080 - RNA, 18 nt, Shigella flexneri 2a str. 301
gccaguuugacaucguca

SEQ ID NO: 3928081 - RNA, 22 nt, Shigella flexneri 2a str. 301
gccaguuuggucuggcaaaaau

SEQ ID NO: 3928082 - RNA, 23 nt, Shigella flexneri 2a str. 301
gccaguuuggucuggcaaaaaua

SEQ ID NO: 3928083 - RNA, 22 nt, Shigella flexneri 2a str. 301
gccaguuuugugcccgcgugga

SEQ ID NO: 3928084 - RNA, 14 nt, Shigella flexneri 2a str. 301
gccaguuuuuguuu

SEQ ID NO: 3928085 - RNA, 15 nt, Shigella flexneri 2a str. 301
gccaguuuuuguuuc

SEQ ID NO: 3928086 - RNA, 22 nt, Shigella flexneri 2a str. 301
gccauaaaacacagcaucugga

SEQ ID NO: 3928087 - RNA, 14 nt, Shigella flexneri 2a str. 301
gccauaaacagcag

SEQ ID NO: 3928088 - RNA, 16 nt, Shigella flexneri 2a str. 301
gccauaaacagcaggc

SEQ ID NO: 3928089 - RNA, 22 nt, Shigella flexneri 2a str. 301
gccauaaacgguuucagcagcg

SEQ ID NO: 3928090 - RNA, 14 nt, Shigella flexneri 2a str. 301
gcccagcacccagu

SEQ ID NO: 3928091 - RNA, 13 nt, Shigella flexneri 2a str. 301
gcccagcaucaga

SEQ ID NO: 3928092 - RNA, 15 nt, Shigella flexneri 2a str. 301
gcccagccgugaaug

SEQ ID NO: 3928093 - RNA, 14 nt, Shigella flexneri 2a str. 301
gcccagcgcaucag

SEQ ID NO: 3928094 - RNA, 15 nt, Shigella flexneri 2a str. 301
gcccagcgcaucagg

SEQ ID NO: 3928095 - RNA, 22 nt, Shigella flexneri 2a str. 301
gcccagcgcaucaggcaaucuu

SEQ ID NO: 3928096 - RNA, 15 nt, Shigella flexneri 2a str. 301
gcccagcgcgccgcc

SEQ ID NO: 3928097 - RNA, 21 nt, Shigella flexneri 2a str. 301
gcccagcgucuaaucgcuuua

SEQ ID NO: 3928098 - RNA, 22 nt, Shigella flexneri 2a str. 301
gcccagcguuccggcguccacc

SEQ ID NO: 3928099 - RNA, 22 nt, Shigella flexneri 2a str. 301
gcccagcucauucagccggguu

SEQ ID NO: 3928100 - RNA, 20 nt, Shigella flexneri 2a str. 301
gcccaggcgaccaggccggu

SEQ ID NO: 3928101 - RNA, 21 nt, Shigella flexneri 2a str. 301
gcccaggugugucucaagucg

SEQ ID NO: 3928102 - RNA, 21 nt, Shigella flexneri 2a str. 301
gcccagguuauacaccuguuc

SEQ ID NO: 3928103 - RNA, 16 nt, Shigella flexneri 2a str. 301
gcccaguaccgccagu

SEQ ID NO: 3928104 - RNA, 16 nt, Shigella flexneri 2a str. 301
gcccagugaccaaagg

SEQ ID NO: 3928105 - RNA, 17 nt, Shigella flexneri 2a str. 301
gcccagugaccaaaggc

SEQ ID NO: 3928106 - RNA, 18 nt, Shigella flexneri 2a str. 301
gcccagugaccaaaggcg

SEQ ID NO: 3928107 - RNA, 19 nt, Shigella flexneri 2a str. 301
gcccagugccgagaguaac

SEQ ID NO: 3928108 - RNA, 20 nt, Shigella flexneri 2a str. 301
gcccagugcggugccgcgaa

SEQ ID NO: 3928109 - RNA, 15 nt, Shigella flexneri 2a str. 301
gcccaguucagcggc

SEQ ID NO: 3928110 - RNA, 16 nt, Shigella flexneri 2a str. 301
gcccaguucagcggcu

SEQ ID NO: 3928111 - RNA, 17 nt, Shigella flexneri 2a str. 301
gcccaguugaucaccag

SEQ ID NO: 3928112 - RNA, 17 nt, Shigella flexneri 2a str. 301
gcccauaaauacgucuu

SEQ ID NO: 3928113 - RNA, 15 nt, Shigella flexneri 2a str. 301
gcccauagacagggu

SEQ ID NO: 3928114 - RNA, 23 nt, Shigella flexneri 2a str. 301
gcccauaugaacauuacuuuccg

SEQ ID NO: 3928115 - RNA, 15 nt, Shigella flexneri 2a str. 301
gcccaucaacaugcc

SEQ ID NO: 3928116 - RNA, 15 nt, Shigella flexneri 2a str. 301
gcccaucauccgcgc

SEQ ID NO: 3928117 - RNA, 15 nt, Shigella flexneri 2a str. 301
gcccauccaggguuu

SEQ ID NO: 3928118 - RNA, 14 nt, Shigella flexneri 2a str. 301
gcccauccggcgaa

SEQ ID NO: 3928119 - RNA, 19 nt, Shigella flexneri 2a str. 301
gcccaucgcauaacagagc

SEQ ID NO: 3928120 - RNA, 16 nt, Shigella flexneri 2a str. 301
gcccaucgccagugcc

SEQ ID NO: 3928121 - RNA, 17 nt, Shigella flexneri 2a str. 301
gcccaucgccagugccg

SEQ ID NO: 3928122 - RNA, 17 nt, Shigella flexneri 2a str. 301
gcccaugauagugucca

SEQ ID NO: 3928123 - RNA, 19 nt, Shigella flexneri 2a str. 301
gcccaugaugacaacauag

SEQ ID NO: 3928124 - RNA, 22 nt, Shigella flexneri 2a str. 301
gcccauguccgcggccuuuucc

SEQ ID NO: 3928125 - RNA, 17 nt, Shigella flexneri 2a str. 301
gcccauuauugacagac

SEQ ID NO: 3928126 - RNA, 20 nt, Shigella flexneri 2a str. 301
gcccauugagcuggucugaa

SEQ ID NO: 3928127 - RNA, 14 nt, Shigella flexneri 2a str. 301
gcccauuuugccac

SEQ ID NO: 3928128 - RNA, 21 nt, Shigella flexneri 2a str. 301
gccccaaccgaacccagcagg

SEQ ID NO: 3928129 - RNA, 17 nt, Shigella flexneri 2a str. 301
gccccacaaacccgcca

SEQ ID NO: 3928130 - RNA, 22 nt, Shigella flexneri 2a str. 301
gccccacaaacccgccagacca

SEQ ID NO: 3928131 - RNA, 13 nt, Shigella flexneri 2a str. 301
gccccacaccgcg

SEQ ID NO: 3928132 - RNA, 15 nt, Shigella flexneri 2a str. 301
gccccacagacccag

SEQ ID NO: 3928133 - RNA, 16 nt, Shigella flexneri 2a str. 301
gccccagaauucacgc

SEQ ID NO: 3928134 - RNA, 17 nt, Shigella flexneri 2a str. 301
gccccagaauucacgca

SEQ ID NO: 3928135 - RNA, 22 nt, Shigella flexneri 2a str. 301
gccccagaauucacgcacuucc

SEQ ID NO: 3928136 - RNA, 16 nt, Shigella flexneri 2a str. 301
gccccagaccugaauu

SEQ ID NO: 3928137 - RNA, 17 nt, Shigella flexneri 2a str. 301
gccccagaugccagaau

SEQ ID NO: 3928138 - RNA, 20 nt, Shigella flexneri 2a str. 301
gccccagcgcucgguagugc

SEQ ID NO: 3928139 - RNA, 17 nt, Shigella flexneri 2a str. 301
gccccagcgucagcauc

SEQ ID NO: 3928140 - RNA, 18 nt, Shigella flexneri 2a str. 301
gccccagcgucagcauca

SEQ ID NO: 3928141 - RNA, 16 nt, Shigella flexneri 2a str. 301
gccccagucuuccugc

SEQ ID NO: 3928142 - RNA, 12 nt, Shigella flexneri 2a str. 301
gccccaguuccg

SEQ ID NO: 3928143 - RNA, 22 nt, Shigella flexneri 2a str. 301
gccccauagguucaacgaccag

SEQ ID NO: 3928144 - RNA, 22 nt, Shigella flexneri 2a str. 301
gccccaucaacgccaucgccag

SEQ ID NO: 3928145 - RNA, 21 nt, Shigella flexneri 2a str. 301
gccccauggacauacgcaccu

SEQ ID NO: 3928146 - RNA, 13 nt, Shigella flexneri 2a str. 301
gcccccgauccag

SEQ ID NO: 3928147 - RNA, 22 nt, Shigella flexneri 2a str. 301
gcccccugaagcaguuucacca

SEQ ID NO: 3928148 - RNA, 18 nt, Shigella flexneri 2a str. 301
gccccgaaaaagagccag

SEQ ID NO: 3928149 - RNA, 23 nt, Shigella flexneri 2a str. 301
gccccgacgaacgcagcgucuca

SEQ ID NO: 3928150 - RNA, 16 nt, Shigella flexneri 2a str. 301
gccccgagaaaaauag

SEQ ID NO: 3928151 - RNA, 23 nt, Shigella flexneri 2a str. 301
gccccgcgaacggggcugccagc

SEQ ID NO: 3928152 - RNA, 13 nt, Shigella flexneri 2a str. 301
gccccgcgcggcg

SEQ ID NO: 3928153 - RNA, 20 nt, Shigella flexneri 2a str. 301
gccccgcgcggcgcaggcgc

SEQ ID NO: 3928154 - RNA, 21 nt, Shigella flexneri 2a str. 301
gccccgcgcggcgcaggcgcu

SEQ ID NO: 3928155 - RNA, 20 nt, Shigella flexneri 2a str. 301
gccccggcgaucccagagcg

SEQ ID NO: 3928156 - RNA, 18 nt, Shigella flexneri 2a str. 301
gccccggcucgcgaccuc

SEQ ID NO: 3928157 - RNA, 19 nt, Shigella flexneri 2a str. 301
gccccggcugcgcgacggc

SEQ ID NO: 3928158 - RNA, 17 nt, Shigella flexneri 2a str. 301
gccccggguuuccugga

SEQ ID NO: 3928159 - RNA, 15 nt, Shigella flexneri 2a str. 301
gccccgguggcgcug

SEQ ID NO: 3928160 - RNA, 15 nt, Shigella flexneri 2a str. 301
gccccgguuucucuu

SEQ ID NO: 3928161 - RNA, 18 nt, Shigella flexneri 2a str. 301
gccccguagccaugauga

SEQ ID NO: 3928162 - RNA, 15 nt, Shigella flexneri 2a str. 301
gccccgugaugaacu

SEQ ID NO: 3928163 - RNA, 17 nt, Shigella flexneri 2a str. 301
gccccguugccacccau

SEQ ID NO: 3928164 - RNA, 17 nt, Shigella flexneri 2a str. 301
gccccuaagcgccggac

SEQ ID NO: 3928165 - RNA, 15 nt, Shigella flexneri 2a str. 301
gccccugaauaaucg

SEQ ID NO: 3928166 - RNA, 21 nt, Shigella flexneri 2a str. 301
gccccugagcguuacccgcag

SEQ ID NO: 3928167 - RNA, 22 nt, Shigella flexneri 2a str. 301
gccccugagcguuacccgcagc

SEQ ID NO: 3928168 - RNA, 14 nt, Shigella flexneri 2a str. 301
gccccugcgccagc

SEQ ID NO: 3928169 - RNA, 16 nt, Shigella flexneri 2a str. 301
gccccugcgccagcgc

SEQ ID NO: 3928170 - RNA, 20 nt, Shigella flexneri 2a str. 301
gccccuggucauaggccgcu

SEQ ID NO: 3928171 - RNA, 20 nt, Shigella flexneri 2a str. 301
gccccuggugagagucacca

SEQ ID NO: 3928172 - RNA, 18 nt, Shigella flexneri 2a str. 301
gccccugguuaucuucca

SEQ ID NO: 3928173 - RNA, 14 nt, Shigella flexneri 2a str. 301
gccccuguugaaau

SEQ ID NO: 3928174 - RNA, 16 nt, Shigella flexneri 2a str. 301
gccccuucggggagag

SEQ ID NO: 3928175 - RNA, 21 nt, Shigella flexneri 2a str. 301
gcccgaaugcagcuccaccga

SEQ ID NO: 3928176 - RNA, 13 nt, Shigella flexneri 2a str. 301
gcccgacgauaca

SEQ ID NO: 3928177 - RNA, 21 nt, Shigella flexneri 2a str. 301
gcccgacgauaccgccgcaca

SEQ ID NO: 3928178 - RNA, 21 nt, Shigella flexneri 2a str. 301
gcccgacuugagcgcagucug

SEQ ID NO: 3928179 - RNA, 16 nt, Shigella flexneri 2a str. 301
gcccgauagaaaccau

SEQ ID NO: 3928180 - RNA, 21 nt, Shigella flexneri 2a str. 301
gcccgaugaccuugucaugca

SEQ ID NO: 3928181 - RNA, 17 nt, Shigella flexneri 2a str. 301
gcccgauggcaucacca

SEQ ID NO: 3928182 - RNA, 18 nt, Shigella flexneri 2a str. 301
gcccgauggugaugccau

SEQ ID NO: 3928183 - RNA, 23 nt, Shigella flexneri 2a str. 301
gcccgauggugaugccaucgggc

SEQ ID NO: 3928184 - RNA, 22 nt, Shigella flexneri 2a str. 301
gcccgcaacaaacuuaugcugc

SEQ ID NO: 3928185 - RNA, 18 nt, Shigella flexneri 2a str. 301
gcccgccagcaccggagg

SEQ ID NO: 3928186 - RNA, 13 nt, Shigella flexneri 2a str. 301
gcccgccgccauc

SEQ ID NO: 3928187 - RNA, 23 nt, Shigella flexneri 2a str. 301
gcccgcgauaaaaauccuguucc

SEQ ID NO: 3928188 - RNA, 19 nt, Shigella flexneri 2a str. 301
gcccgcgcgguaucaccac

SEQ ID NO: 3928189 - RNA, 20 nt, Shigella flexneri 2a str. 301
gccgcaaaucguauccggca

SEQ ID NO: 3928190 - RNA, 17 nt, Shigella flexneri 2a str. 301
gccgcaacuaccagcag

SEQ ID NO: 3928191 - RNA, 18 nt, Shigella flexneri 2a str. 301
gccgcaacuaccagcagu

SEQ ID NO: 3928192 - RNA, 15 nt, Shigella flexneri 2a str. 301
gccgcaacuuuagcc

SEQ ID NO: 3928193 - RNA, 21 nt, Shigella flexneri 2a str. 301
gccgcaauggccguuccggca

SEQ ID NO: 3928194 - RNA, 13 nt, Shigella flexneri 2a str. 301
gccgcaaugugcu

SEQ ID NO: 3928195 - RNA, 19 nt, Shigella flexneri 2a str. 301
gccgcaccaggaucuuuug

SEQ ID NO: 3928196 - RNA, 21 nt, Shigella flexneri 2a str. 301
gccgcaccaggaucuuuuguc

SEQ ID NO: 3928197 - RNA, 16 nt, Shigella flexneri 2a str. 301
gccgcacuuaauauac

SEQ ID NO: 3928198 - RNA, 16 nt, Shigella flexneri 2a str. 301
gccgcacuuacagcaa

SEQ ID NO: 3928199 - RNA, 18 nt, Shigella flexneri 2a str. 301
gccgcacuuacagcaacg

SEQ ID NO: 3928200 - RNA, 13 nt, Shigella flexneri 2a str. 301
gccgcagcaaccg

SEQ ID NO: 3928201 - RNA, 15 nt, Shigella flexneri 2a str. 301
gccgcagccaucagc

SEQ ID NO: 3928202 - RNA, 15 nt, Shigella flexneri 2a str. 301
gccgcaggcggacug

SEQ ID NO: 3928203 - RNA, 18 nt, Shigella flexneri 2a str. 301
gccgcaggcuguuacccc

SEQ ID NO: 3928204 - RNA, 12 nt, Shigella flexneri 2a str. 301
gccgcaguuucu

SEQ ID NO: 3928205 - RNA, 19 nt, Shigella flexneri 2a str. 301
gccgcauccgacacuggca

SEQ ID NO: 3928206 - RNA, 12 nt, Shigella flexneri 2a str. 301
gccgcauccggc

SEQ ID NO: 3928207 - RNA, 13 nt, Shigella flexneri 2a str. 301
gccgcauccggca

SEQ ID NO: 3928208 - RNA, 15 nt, Shigella flexneri 2a str. 301
gccgcauccggcauc

SEQ ID NO: 3928209 - RNA, 21 nt, Shigella flexneri 2a str. 301
gccgcaucguccugcgcagga

SEQ ID NO: 3928210 - RNA, 17 nt, Shigella flexneri 2a str. 301
gccgcauggaaccaguu

SEQ ID NO: 3928211 - RNA, 17 nt, Shigella flexneri 2a str. 301
gccgccaacccuucugc

SEQ ID NO: 3928212 - RNA, 23 nt, Shigella flexneri 2a str. 301
gccgccaaucacgcccauugagc

SEQ ID NO: 3928213 - RNA, 14 nt, Shigella flexneri 2a str. 301
gccgccacagcgcc

SEQ ID NO: 3928214 - RNA, 21 nt, Shigella flexneri 2a str. 301
gccgccagacaauugccgcca

SEQ ID NO: 3928215 - RNA, 22 nt, Shigella flexneri 2a str. 301
gccgccagaccacugcgccgcu

SEQ ID NO: 3928216 - RNA, 20 nt, Shigella flexneri 2a str. 301
gccgccagacguccggcgcu

SEQ ID NO: 3928217 - RNA, 15 nt, Shigella flexneri 2a str. 301
gccgccauaaacagc

SEQ ID NO: 3928218 - RNA, 16 nt, Shigella flexneri 2a str. 301
gccgccaucucuucca

SEQ ID NO: 3928219 - RNA, 22 nt, Shigella flexneri 2a str. 301
gccgccauugacguuccuuucu

SEQ ID NO: 3928220 - RNA, 22 nt, Shigella flexneri 2a str. 301
gccgccgagcaaaccacaggcc

SEQ ID NO: 3928221 - RNA, 19 nt, Shigella flexneri 2a str. 301
gccgccgagcaccacguug

SEQ ID NO: 3928222 - RNA, 19 nt, Shigella flexneri 2a str. 301
gccgccgcaaacaucggcu

SEQ ID NO: 3928223 - RNA, 13 nt, Shigella flexneri 2a str. 301
gccgccgcaaccg

SEQ ID NO: 3928224 - RNA, 16 nt, Shigella flexneri 2a str. 301
gccgccgcgcucuuca

SEQ ID NO: 3928225 - RNA, 17 nt, Shigella flexneri 2a str. 301
gccgccgcuggcgugca

SEQ ID NO: 3928226 - RNA, 19 nt, Shigella flexneri 2a str. 301
gccgccgcuucuggcggcg

SEQ ID NO: 3928227 - RNA, 13 nt, Shigella flexneri 2a str. 301
gccgccgcuuucg

SEQ ID NO: 3928228 - RNA, 11 nt, Shigella flexneri 2a str. 301
gccgccggaaa

SEQ ID NO: 3928229 - RNA, 20 nt, Shigella flexneri 2a str. 301
gccgccuaacgacaaaucau

SEQ ID NO: 3928230 - RNA, 20 nt, Shigella flexneri 2a str. 301
gccgcgaaccggaccagcaa

SEQ ID NO: 3928231 - RNA, 20 nt, Shigella flexneri 2a str. 301
gccgcgagaauaugcugaau

SEQ ID NO: 3928232 - RNA, 18 nt, Shigella flexneri 2a str. 301
gccgcgauagcaagcgcu

SEQ ID NO: 3928233 - RNA, 18 nt, Shigella flexneri 2a str. 301
gccgcgcaguuucuuacc

SEQ ID NO: 3928234 - RNA, 20 nt, Shigella flexneri 2a str. 301
gccgcgguaucaaacacagg

SEQ ID NO: 3928235 - RNA, 14 nt, Shigella flexneri 2a str. 301
gccgcguaccgcag

SEQ ID NO: 3928236 - RNA, 18 nt, Shigella flexneri 2a str. 301
gccgcgucuuauccggcc

SEQ ID NO: 3928237 - RNA, 19 nt, Shigella flexneri 2a str. 301
gccgcguguuuccgggccg

SEQ ID NO: 3928238 - RNA, 18 nt, Shigella flexneri 2a str. 301
gccgcguuggcaaugucg

SEQ ID NO: 3928239 - RNA, 24 nt, Shigella flexneri 2a str. 301
gccgcuaacgucuaguaaagcaga

SEQ ID NO: 3928240 - RNA, 15 nt, Shigella flexneri 2a str. 301
gccgcuaccgcccug

SEQ ID NO: 3928241 - RNA, 21 nt, Shigella flexneri 2a str. 301
gccgcuacggaagaugaaaaa

SEQ ID NO: 3928242 - RNA, 19 nt, Shigella flexneri 2a str. 301
gccgcuaucgcugauauac

SEQ ID NO: 3928243 - RNA, 14 nt, Shigella flexneri 2a str. 301
gccgcuaucggcaa

SEQ ID NO: 3928244 - RNA, 17 nt, Shigella flexneri 2a str. 301
gccgcuaucggcaagga

SEQ ID NO: 3928245 - RNA, 17 nt, Shigella flexneri 2a str. 301
gccgcucagucggcgcu

SEQ ID NO: 3928246 - RNA, 16 nt, Shigella flexneri 2a str. 301
gccgcucccuucgggg

SEQ ID NO: 3928247 - RNA, 21 nt, Shigella flexneri 2a str. 301
gccgcucuuuuguucgcggcg

SEQ ID NO: 3928248 - RNA, 20 nt, Shigella flexneri 2a str. 301
gccgcugaacugauugccac

SEQ ID NO: 3928249 - RNA, 18 nt, Shigella flexneri 2a str. 301
gccgcuggccauuucugc

SEQ ID NO: 3928250 - RNA, 15 nt, Shigella flexneri 2a str. 301
gccgcuguaauacca

SEQ ID NO: 3928251 - RNA, 23 nt, Shigella flexneri 2a str. 301
gccgcuguguguaggccagcgau

SEQ ID NO: 3928252 - RNA, 19 nt, Shigella flexneri 2a str. 301
gccgcuucaguugcgccug

SEQ ID NO: 3928253 - RNA, 20 nt, Shigella flexneri 2a str. 301
gccgcuucgcccaaauccuu

SEQ ID NO: 3928254 - RNA, 20 nt, Shigella flexneri 2a str. 301
gccgcuucuucuucagcgcu

SEQ ID NO: 3928255 - RNA, 20 nt, Shigella flexneri 2a str. 301
gccgcuuggcaagcccagca

SEQ ID NO: 3928256 - RNA, 22 nt, Shigella flexneri 2a str. 301
gccgcuuuaugugcuucuacca

SEQ ID NO: 3928257 - RNA, 13 nt, Shigella flexneri 2a str. 301
gccgcuuuccagg

SEQ ID NO: 3928258 - RNA, 16 nt, Shigella flexneri 2a str. 301
gccgcuuuccaggcau

SEQ ID NO: 3928259 - RNA, 13 nt, Shigella flexneri 2a str. 301
gccgcuuuuucug

SEQ ID NO: 3928260 - RNA, 16 nt, Shigella flexneri 2a str. 301
gccggaaaacguuuca

SEQ ID NO: 3928261 - RNA, 22 nt, Shigella flexneri 2a str. 301
gccggaaacauaaauaguggca

SEQ ID NO: 3928262 - RNA, 22 nt, Shigella flexneri 2a str. 301
gccggaaauaucaaccggcuca

SEQ ID NO: 3928263 - RNA, 18 nt, Shigella flexneri 2a str. 301
gccggaaauuugcagugc

SEQ ID NO: 3928264 - RNA, 13 nt, Shigella flexneri 2a str. 301
gccggaaccugau

SEQ ID NO: 3928265 - RNA, 20 nt, Shigella flexneri 2a str. 301
gccggaacguuaagagcugg

SEQ ID NO: 3928266 - RNA, 21 nt, Shigella flexneri 2a str. 301
gccggaaggaagacgcagcau

SEQ ID NO: 3928267 - RNA, 16 nt, Shigella flexneri 2a str. 301
gccggaaguauuucaa

SEQ ID NO: 3928268 - RNA, 22 nt, Shigella flexneri 2a str. 301
gccggaauaccacuuucagcaa

SEQ ID NO: 3928269 - RNA, 16 nt, Shigella flexneri 2a str. 301
gccggaaucaacggca

SEQ ID NO: 3928270 - RNA, 18 nt, Shigella flexneri 2a str. 301
gccggaauuucuuucagc

SEQ ID NO: 3928271 - RNA, 14 nt, Shigella flexneri 2a str. 301
gccggaauuuuccu

SEQ ID NO: 3928272 - RNA, 16 nt, Shigella flexneri 2a str. 301
gccggaauuuuccuuc

SEQ ID NO: 3928273 - RNA, 13 nt, Shigella flexneri 2a str. 301
gccggacaugcug

SEQ ID NO: 3928274 - RNA, 18 nt, Shigella flexneri 2a str. 301
gccggaccaucuuccagu

SEQ ID NO: 3928275 - RNA, 17 nt, Shigella flexneri 2a str. 301
gccggacccacaccccc

SEQ ID NO: 3928276 - RNA, 20 nt, Shigella flexneri 2a str. 301
gccggacgcugagcacguuu

SEQ ID NO: 3928277 - RNA, 13 nt, Shigella flexneri 2a str. 301
gccggacgucagg

SEQ ID NO: 3928278 - RNA, 16 nt, Shigella flexneri 2a str. 301
gccggacguucgccca

SEQ ID NO: 3928279 - RNA, 18 nt, Shigella flexneri 2a str. 301
gccggacugggcgcgcuc

SEQ ID NO: 3928280 - RNA, 13 nt, Shigella flexneri 2a str. 301
gccggacuucaca

SEQ ID NO: 3928281 - RNA, 16 nt, Shigella flexneri 2a str. 301
gccggagacgacgccc

SEQ ID NO: 3928282 - RNA, 14 nt, Shigella flexneri 2a str. 301
gccggagccagccg

SEQ ID NO: 3928283 - RNA, 17 nt, Shigella flexneri 2a str. 301
gccggagccagccguug

SEQ ID NO: 3928284 - RNA, 18 nt, Shigella flexneri 2a str. 301
gccggaggaguaucugcu

SEQ ID NO: 3928285 - RNA, 18 nt, Shigella flexneri 2a str. 301
gccggaggcaaguuuccu

SEQ ID NO: 3928286 - RNA, 21 nt, Shigella flexneri 2a str. 301
gccggagggauguggcccagc

SEQ ID NO: 3928287 - RNA, 18 nt, Shigella flexneri 2a str. 301
gccggagucgcauuaaca

SEQ ID NO: 3928288 - RNA, 23 nt, Shigella flexneri 2a str. 301
gccggauaaacaauguuauccgg

SEQ ID NO: 3928289 - RNA, 19 nt, Shigella flexneri 2a str. 301
gccuauccagaagccugcu

SEQ ID NO: 3928290 - RNA, 15 nt, Shigella flexneri 2a str. 301
gccuauugacgcugu

SEQ ID NO: 3928291 - RNA, 19 nt, Shigella flexneri 2a str. 301
gccucaacccuuuuuuaaa

SEQ ID NO: 3928292 - RNA, 13 nt, Shigella flexneri 2a str. 301
gccucaacgccua

SEQ ID NO: 3928293 - RNA, 22 nt, Shigella flexneri 2a str. 301
gccucacagggcucuuaagcac

SEQ ID NO: 3928294 - RNA, 17 nt, Shigella flexneri 2a str. 301
gccucagguaccagcau

SEQ ID NO: 3928295 - RNA, 20 nt, Shigella flexneri 2a str. 301
gccucaguggcugcguuuca

SEQ ID NO: 3928296 - RNA, 12 nt, Shigella flexneri 2a str. 301
gccucaucaucg

SEQ ID NO: 3928297 - RNA, 14 nt, Shigella flexneri 2a str. 301
gccucaugcaggcg

SEQ ID NO: 3928298 - RNA, 14 nt, Shigella flexneri 2a str. 301
gccucccugccucc

SEQ ID NO: 3928299 - RNA, 20 nt, Shigella flexneri 2a str. 301
gccuccuguucugcgcgcca

SEQ ID NO: 3928300 - RNA, 16 nt, Shigella flexneri 2a str. 301
gccucgccgaaacgcu

SEQ ID NO: 3928301 - RNA, 17 nt, Shigella flexneri 2a str. 301
gccucgccgaaacgcuu

SEQ ID NO: 3928302 - RNA, 18 nt, Shigella flexneri 2a str. 301
gccucgguaagcaaagcg

SEQ ID NO: 3928303 - RNA, 21 nt, Shigella flexneri 2a str. 301
gccucuaacagaucauccauc

SEQ ID NO: 3928304 - RNA, 20 nt, Shigella flexneri 2a str. 301
gccucuacccgucaccguuu

SEQ ID NO: 3928305 - RNA, 13 nt, Shigella flexneri 2a str. 301
gccucuauuaaaa

SEQ ID NO: 3928306 - RNA, 23 nt, Shigella flexneri 2a str. 301
gccucugccagcugcucauagcg

SEQ ID NO: 3928307 - RNA, 16 nt, Shigella flexneri 2a str. 301
gccucuuacgccgcca

SEQ ID NO: 3928308 - RNA, 17 nt, Shigella flexneri 2a str. 301
gccucuuacgccgccac

SEQ ID NO: 3928309 - RNA, 13 nt, Shigella flexneri 2a str. 301
gccucuuuauaaa

SEQ ID NO: 3928310 - RNA, 14 nt, Shigella flexneri 2a str. 301
gccucuuuauaaau

SEQ ID NO: 3928311 - RNA, 16 nt, Shigella flexneri 2a str. 301
gccugaauauccagau

SEQ ID NO: 3928312 - RNA, 23 nt, Shigella flexneri 2a str. 301
gccugaaucgggaucaccuguuc

SEQ ID NO: 3928313 - RNA, 18 nt, Shigella flexneri 2a str. 301
gccugaaugccacaaucg

SEQ ID NO: 3928314 - RNA, 12 nt, Shigella flexneri 2a str. 301
gccugaaugcuu

SEQ ID NO: 3928315 - RNA, 12 nt, Shigella flexneri 2a str. 301
gccugaauuacu

SEQ ID NO: 3928316 - RNA, 14 nt, Shigella flexneri 2a str. 301
gccugaauuacugg

SEQ ID NO: 3928317 - RNA, 20 nt, Shigella flexneri 2a str. 301
gccugacagcacgccccggc

SEQ ID NO: 3928318 - RNA, 21 nt, Shigella flexneri 2a str. 301
gccugacagggaagggagcgc

SEQ ID NO: 3928319 - RNA, 13 nt, Shigella flexneri 2a str. 301
gccugaccgcaca

SEQ ID NO: 3928320 - RNA, 24 nt, Shigella flexneri 2a str. 301
gccugacggaaaucaugcaacacg

SEQ ID NO: 3928321 - RNA, 16 nt, Shigella flexneri 2a str. 301
gccugauaagacgcgc

SEQ ID NO: 3928322 - RNA, 23 nt, Shigella flexneri 2a str. 301
gccugauaagcgcagcgcaucag

SEQ ID NO: 3928323 - RNA, 23 nt, Shigella flexneri 2a str. 301
gccugauaagcguagcgcaucag

SEQ ID NO: 3928324 - RNA, 17 nt, Shigella flexneri 2a str. 301
gccugauaaucugcuga

SEQ ID NO: 3928325 - RNA, 21 nt, Shigella flexneri 2a str. 301
gccugauacaggaaggccgga

SEQ ID NO: 3928326 - RNA, 16 nt, Shigella flexneri 2a str. 301
gccugauagcccgcac

SEQ ID NO: 3928327 - RNA, 21 nt, Shigella flexneri 2a str. 301
gccugauagcccgcacaaagc

SEQ ID NO: 3928328 - RNA, 14 nt, Shigella flexneri 2a str. 301
gccugaucgcgcaa

SEQ ID NO: 3928329 - RNA, 21 nt, Shigella flexneri 2a str. 301
gccugaugaugagucugaccg

SEQ ID NO: 3928330 - RNA, 23 nt, Shigella flexneri 2a str. 301
gccugaugcgacgcuugacgcgu

SEQ ID NO: 3928331 - RNA, 18 nt, Shigella flexneri 2a str. 301
gccugaugcgacgcuugc

SEQ ID NO: 3928332 - RNA, 19 nt, Shigella flexneri 2a str. 301
gccugaugcgacgcuugca

SEQ ID NO: 3928333 - RNA, 12 nt, Shigella flexneri 2a str. 301
gccugaugcgcu

SEQ ID NO: 3928334 - RNA, 16 nt, Shigella flexneri 2a str. 301
gccugaugcgcugcgc

SEQ ID NO: 3928335 - RNA, 18 nt, Shigella flexneri 2a str. 301
gccugaugcgcugcgcuu

SEQ ID NO: 3928336 - RNA, 22 nt, Shigella flexneri 2a str. 301
gccugaugcgcuucgcuuauca

SEQ ID NO: 3928337 - RNA, 14 nt, Shigella flexneri 2a str. 301
gccugaugcggcgu

SEQ ID NO: 3928338 - RNA, 13 nt, Shigella flexneri 2a str. 301
gccugaugcguug

SEQ ID NO: 3928339 - RNA, 21 nt, Shigella flexneri 2a str. 301
gccugaugcguugcgcuucuc

SEQ ID NO: 3928340 - RNA, 22 nt, Shigella flexneri 2a str. 301
gccugauggcgcuacgcuuauc

SEQ ID NO: 3928341 - RNA, 23 nt, Shigella flexneri 2a str. 301
gccugauggcgcuacgcuuauca

SEQ ID NO: 3928342 - RNA, 16 nt, Shigella flexneri 2a str. 301
gccugauguacaacca

SEQ ID NO: 3928343 - RNA, 22 nt, Shigella flexneri 2a str. 301
gccugauucaaugaguuauaca

SEQ ID NO: 3928344 - RNA, 13 nt, Shigella flexneri 2a str. 301
gccugcaaauaaa

SEQ ID NO: 3928345 - RNA, 14 nt, Shigella flexneri 2a str. 301
gccugcaaauaaau

SEQ ID NO: 3928346 - RNA, 19 nt, Shigella flexneri 2a str. 301
gccugcaccauugcugccg

SEQ ID NO: 3928347 - RNA, 12 nt, Shigella flexneri 2a str. 301
gccugcacucag

SEQ ID NO: 3928348 - RNA, 13 nt, Shigella flexneri 2a str. 301
gccugcacugcag

SEQ ID NO: 3928349 - RNA, 17 nt, Shigella flexneri 2a str. 301
gccugcacugcaggccg

SEQ ID NO: 3928350 - RNA, 22 nt, Shigella flexneri 2a str. 301
gccugcagcugcucauuacagu

SEQ ID NO: 3928351 - RNA, 16 nt, Shigella flexneri 2a str. 301
gccugcauacguuuca

SEQ ID NO: 3928352 - RNA, 12 nt, Shigella flexneri 2a str. 301
gccugcaucacc

SEQ ID NO: 3928353 - RNA, 16 nt, Shigella flexneri 2a str. 301
gccugcauccgccauc

SEQ ID NO: 3928354 - RNA, 16 nt, Shigella flexneri 2a str. 301
gccugccagcaugcau

SEQ ID NO: 3928355 - RNA, 14 nt, Shigella flexneri 2a str. 301
gccugccagcucuu

SEQ ID NO: 3928356 - RNA, 16 nt, Shigella flexneri 2a str. 301
gccugccaucuggcag

SEQ ID NO: 3928357 - RNA, 23 nt, Shigella flexneri 2a str. 301
gccugcccagccgguaaggccga

SEQ ID NO: 3928358 - RNA, 16 nt, Shigella flexneri 2a str. 301
gccugccgcauccggu

SEQ ID NO: 3928359 - RNA, 14 nt, Shigella flexneri 2a str. 301
gccugccgccagca

SEQ ID NO: 3928360 - RNA, 15 nt, Shigella flexneri 2a str. 301
gccugccugcagcug

SEQ ID NO: 3928361 - RNA, 15 nt, Shigella flexneri 2a str. 301
gccugcgaagcucuu

SEQ ID NO: 3928362 - RNA, 21 nt, Shigella flexneri 2a str. 301
gccugcgacagggaucucuuc

SEQ ID NO: 3928363 - RNA, 16 nt, Shigella flexneri 2a str. 301
gccugcggcgcaugca

SEQ ID NO: 3928364 - RNA, 18 nt, Shigella flexneri 2a str. 301
gccugcucaagcguuuca

SEQ ID NO: 3928365 - RNA, 21 nt, Shigella flexneri 2a str. 301
gccugcuccagugcauccagc

SEQ ID NO: 3928366 - RNA, 14 nt, Shigella flexneri 2a str. 301
gccugcuuugacaa

SEQ ID NO: 3928367 - RNA, 14 nt, Shigella flexneri 2a str. 301
gccugcuuuugcca

SEQ ID NO: 3928368 - RNA, 15 nt, Shigella flexneri 2a str. 301
gccuggaauuacuga

SEQ ID NO: 3928369 - RNA, 17 nt, Shigella flexneri 2a str. 301
gccuggacaucaugcug

SEQ ID NO: 3928370 - RNA, 16 nt, Shigella flexneri 2a str. 301
gccuggaccagcgggu

SEQ ID NO: 3928371 - RNA, 15 nt, Shigella flexneri 2a str. 301
gccuggauggcuugc

SEQ ID NO: 3928372 - RNA, 23 nt, Shigella flexneri 2a str. 301
gccuggauuuuuauuccgcugga

SEQ ID NO: 3928373 - RNA, 18 nt, Shigella flexneri 2a str. 301
gccuggcccauagacagg

SEQ ID NO: 3928374 - RNA, 18 nt, Shigella flexneri 2a str. 301
gccugggaucaucagcaa

SEQ ID NO: 3928375 - RNA, 18 nt, Shigella flexneri 2a str. 301
gccugggcgauuuccuuc

SEQ ID NO: 3928376 - RNA, 19 nt, Shigella flexneri 2a str. 301
gccugggcgauuuccuuca

SEQ ID NO: 3928377 - RNA, 17 nt, Shigella flexneri 2a str. 301
gccugggucgccaucgu

SEQ ID NO: 3928378 - RNA, 17 nt, Shigella flexneri 2a str. 301
gccuggguuuucacaga

SEQ ID NO: 3928379 - RNA, 20 nt, Shigella flexneri 2a str. 301
gccuggguuuucacagaagu

SEQ ID NO: 3928380 - RNA, 16 nt, Shigella flexneri 2a str. 301
gccugguaccagcacc

SEQ ID NO: 3928381 - RNA, 20 nt, Shigella flexneri 2a str. 301
gccugguuauagcaguaauu

SEQ ID NO: 3928382 - RNA, 20 nt, Shigella flexneri 2a str. 301
gccuguaaagucauccuuaa

SEQ ID NO: 3928383 - RNA, 15 nt, Shigella flexneri 2a str. 301
gccuguaacgccuuu

SEQ ID NO: 3928384 - RNA, 19 nt, Shigella flexneri 2a str. 301
gccuguaccacaaccugca

SEQ ID NO: 3928385 - RNA, 20 nt, Shigella flexneri 2a str. 301
gccuguaccacaaccugcac

SEQ ID NO: 3928386 - RNA, 16 nt, Shigella flexneri 2a str. 301
gccuguaccagcggcu

SEQ ID NO: 3928387 - RNA, 21 nt, Shigella flexneri 2a str. 301
gccuguacggcagugaacgcg

SEQ ID NO: 3928388 - RNA, 15 nt, Shigella flexneri 2a str. 301
gccuguacuuccugu

SEQ ID NO: 3928389 - RNA, 16 nt, Shigella flexneri 2a str. 301
gcgacaucuucuccag

SEQ ID NO: 3928390 - RNA, 12 nt, Shigella flexneri 2a str. 301
gcgacaugaucg

SEQ ID NO: 3928391 - RNA, 13 nt, Shigella flexneri 2a str. 301
gcgacauggcgaa

SEQ ID NO: 3928392 - RNA, 13 nt, Shigella flexneri 2a str. 301
gcgaccaccacca

SEQ ID NO: 3928393 - RNA, 13 nt, Shigella flexneri 2a str. 301
gcgaccaccagcg

SEQ ID NO: 3928394 - RNA, 12 nt, Shigella flexneri 2a str. 301
gcgaccaccggg

SEQ ID NO: 3928395 - RNA, 14 nt, Shigella flexneri 2a str. 301
gcgaccagaaaagc

SEQ ID NO: 3928396 - RNA, 20 nt, Shigella flexneri 2a str. 301
gcgaccagcgucgcaucagg

SEQ ID NO: 3928397 - RNA, 21 nt, Shigella flexneri 2a str. 301
gcgaccagcgucgcaucaggc

SEQ ID NO: 3928398 - RNA, 17 nt, Shigella flexneri 2a str. 301
gcgaccaggccggugau

SEQ ID NO: 3928399 - RNA, 15 nt, Shigella flexneri 2a str. 301
gcgaccauacagcag

SEQ ID NO: 3928400 - RNA, 16 nt, Shigella flexneri 2a str. 301
gcgaccauacagcagc

SEQ ID NO: 3928401 - RNA, 21 nt, Shigella flexneri 2a str. 301
gcgaccauacagcagcaacga

SEQ ID NO: 3928402 - RNA, 18 nt, Shigella flexneri 2a str. 301
gcgaccgaacagaucacg

SEQ ID NO: 3928403 - RNA, 15 nt, Shigella flexneri 2a str. 301
gcgaccguucgccag

SEQ ID NO: 3928404 - RNA, 16 nt, Shigella flexneri 2a str. 301
gcgaccguucgccagg

SEQ ID NO: 3928405 - RNA, 20 nt, Shigella flexneri 2a str. 301
gcgaccuacacgccuucucc

SEQ ID NO: 3928406 - RNA, 13 nt, Shigella flexneri 2a str. 301
gcgaccucaagcu

SEQ ID NO: 3928407 - RNA, 18 nt, Shigella flexneri 2a str. 301
gcgaccucaagcucgcca

SEQ ID NO: 3928408 - RNA, 22 nt, Shigella flexneri 2a str. 301
gcgaccucaagcucgccaccau

SEQ ID NO: 3928409 - RNA, 21 nt, Shigella flexneri 2a str. 301
gcgacgaccacccaccgcagc

SEQ ID NO: 3928410 - RNA, 21 nt, Shigella flexneri 2a str. 301
gcgacgccggucgcgucuuau

SEQ ID NO: 3928411 - RNA, 18 nt, Shigella flexneri 2a str. 301
gcgacgccucuauuaaaa

SEQ ID NO: 3928412 - RNA, 19 nt, Shigella flexneri 2a str. 301
gcgacgcugcgcgucuuau

SEQ ID NO: 3928413 - RNA, 20 nt, Shigella flexneri 2a str. 301
gcgacgcuggcgcgucuuau

SEQ ID NO: 3928414 - RNA, 21 nt, Shigella flexneri 2a str. 301
gcgacgcuggucgcgucuuau

SEQ ID NO: 3928415 - RNA, 21 nt, Shigella flexneri 2a str. 301
gcgacgcuguccgcgucuuau

SEQ ID NO: 3928416 - RNA, 17 nt, Shigella flexneri 2a str. 301
gcgacgcuuaacgcguc

SEQ ID NO: 3928417 - RNA, 21 nt, Shigella flexneri 2a str. 301
gcgacgcuuaccgcgucuuau

SEQ ID NO: 3928418 - RNA, 21 nt, Shigella flexneri 2a str. 301
gcgacgcuugacgcgucuuau

SEQ ID NO: 3928419 - RNA, 21 nt, Shigella flexneri 2a str. 301
gcgacgcuugcagcgucuuau

SEQ ID NO: 3928420 - RNA, 17 nt, Shigella flexneri 2a str. 301
gcgacgcuugccgcguc

SEQ ID NO: 3928421 - RNA, 21 nt, Shigella flexneri 2a str. 301
gcgacgcuugccgcgucuuau

SEQ ID NO: 3928422 - RNA, 11 nt, Shigella flexneri 2a str. 301
gcgacgugacc

SEQ ID NO: 3928423 - RNA, 21 nt, Shigella flexneri 2a str. 301
gcgacguucguuaacaacaac

SEQ ID NO: 3928424 - RNA, 15 nt, Shigella flexneri 2a str. 301
gcgacguugcuucuc

SEQ ID NO: 3928425 - RNA, 18 nt, Shigella flexneri 2a str. 301
gcgacuaauacaccauca

SEQ ID NO: 3928426 - RNA, 19 nt, Shigella flexneri 2a str. 301
gcgacuauucacugcgccu

SEQ ID NO: 3928427 - RNA, 15 nt, Shigella flexneri 2a str. 301
gcgacugccagcauc

SEQ ID NO: 3928428 - RNA, 13 nt, Shigella flexneri 2a str. 301
gcgacuggcggca

SEQ ID NO: 3928429 - RNA, 18 nt, Shigella flexneri 2a str. 301
gcgacuucuucccaccau

SEQ ID NO: 3928430 - RNA, 16 nt, Shigella flexneri 2a str. 301
gcgacuugcucaggag

SEQ ID NO: 3928431 - RNA, 14 nt, Shigella flexneri 2a str. 301
gcgacuugucauca

SEQ ID NO: 3928432 - RNA, 22 nt, Shigella flexneri 2a str. 301
gcgacuuugccuggcggcagau

SEQ ID NO: 3928433 - RNA, 14 nt, Shigella flexneri 2a str. 301
gcgagaagagaggc

SEQ ID NO: 3928434 - RNA, 23 nt, Shigella flexneri 2a str. 301
gcgagaaguucugcagcccgaac

SEQ ID NO: 3928435 - RNA, 14 nt, Shigella flexneri 2a str. 301
gcgagacaacaaag

SEQ ID NO: 3928436 - RNA, 16 nt, Shigella flexneri 2a str. 301
gcgagacugcgcgccg

SEQ ID NO: 3928437 - RNA, 23 nt, Shigella flexneri 2a str. 301
gcgagaucuuuaucaaucaccgc

SEQ ID NO: 3928438 - RNA, 21 nt, Shigella flexneri 2a str. 301
gcgagcgccuuauccugccug

SEQ ID NO: 3928439 - RNA, 16 nt, Shigella flexneri 2a str. 301
gcgagcgcggcuggcu

SEQ ID NO: 3928440 - RNA, 13 nt, Shigella flexneri 2a str. 301
gcgagcuggcgcu

SEQ ID NO: 3928441 - RNA, 23 nt, Shigella flexneri 2a str. 301
gcgagcuuccuguauaacgcaaa

SEQ ID NO: 3928442 - RNA, 23 nt, Shigella flexneri 2a str. 301
gcgagcuuucgaccagccaggcc

SEQ ID NO: 3928443 - RNA, 18 nt, Shigella flexneri 2a str. 301
gcgagguacgcccagcgc

SEQ ID NO: 3928444 - RNA, 19 nt, Shigella flexneri 2a str. 301
gcgagguauuuucugaaac

SEQ ID NO: 3928445 - RNA, 15 nt, Shigella flexneri 2a str. 301
gcgagguccagcucc

SEQ ID NO: 3928446 - RNA, 16 nt, Shigella flexneri 2a str. 301
gcgaguguuaccuuca

SEQ ID NO: 3928447 - RNA, 18 nt, Shigella flexneri 2a str. 301
gcgaguuuuucaguccac

SEQ ID NO: 3928448 - RNA, 21 nt, Shigella flexneri 2a str. 301
gcgauaaaaauccuguuccau

SEQ ID NO: 3928449 - RNA, 23 nt, Shigella flexneri 2a str. 301
gcgauaaaucagauuauagugau

SEQ ID NO: 3928450 - RNA, 17 nt, Shigella flexneri 2a str. 301
gcgauaaccgcaccuuc

SEQ ID NO: 3928451 - RNA, 17 nt, Shigella flexneri 2a str. 301
gcgauaaucagcgccag

SEQ ID NO: 3928452 - RNA, 13 nt, Shigella flexneri 2a str. 301
gcgauaaucgaac

SEQ ID NO: 3928453 - RNA, 12 nt, Shigella flexneri 2a str. 301
gcgauacgcagu

SEQ ID NO: 3928454 - RNA, 16 nt, Shigella flexneri 2a str. 301
gcgauagccgcuuucu

SEQ ID NO: 3928455 - RNA, 18 nt, Shigella flexneri 2a str. 301
gcgauauaauaaaccugc

SEQ ID NO: 3928456 - RNA, 22 nt, Shigella flexneri 2a str. 301
gcgauauguuuaucaggccacg

SEQ ID NO: 3928457 - RNA, 14 nt, Shigella flexneri 2a str. 301
gcgauauugcugca

SEQ ID NO: 3928458 - RNA, 18 nt, Shigella flexneri 2a str. 301
gcgaucaaacgccagauc

SEQ ID NO: 3928459 - RNA, 13 nt, Shigella flexneri 2a str. 301
gcgaucaggcauu

SEQ ID NO: 3928460 - RNA, 13 nt, Shigella flexneri 2a str. 301
gcgaucauuagcc

SEQ ID NO: 3928461 - RNA, 18 nt, Shigella flexneri 2a str. 301
gcgaucccagagcgggca

SEQ ID NO: 3928462 - RNA, 12 nt, Shigella flexneri 2a str. 301
gcgauccggcaa

SEQ ID NO: 3928463 - RNA, 20 nt, Shigella flexneri 2a str. 301
gcgauccgguacuggcgugg

SEQ ID NO: 3928464 - RNA, 18 nt, Shigella flexneri 2a str. 301
gcgaucgaccugcgccug

SEQ ID NO: 3928465 - RNA, 20 nt, Shigella flexneri 2a str. 301
gcgaucgaccugcgccugca

SEQ ID NO: 3928466 - RNA, 16 nt, Shigella flexneri 2a str. 301
gcgaucgacgcgucca

SEQ ID NO: 3928467 - RNA, 15 nt, Shigella flexneri 2a str. 301
gcgaucugcgcguca

SEQ ID NO: 3928468 - RNA, 20 nt, Shigella flexneri 2a str. 301
gcgaucuuccacgccugcau

SEQ ID NO: 3928469 - RNA, 20 nt, Shigella flexneri 2a str. 301
gcgaugaaaaucaccggaug

SEQ ID NO: 3928470 - RNA, 16 nt, Shigella flexneri 2a str. 301
gcgaugaacgccuggg

SEQ ID NO: 3928471 - RNA, 19 nt, Shigella flexneri 2a str. 301
gcgaugacuguacagaucc

SEQ ID NO: 3928472 - RNA, 21 nt, Shigella flexneri 2a str. 301
gcgaugaucgucacgaucgcg

SEQ ID NO: 3928473 - RNA, 13 nt, Shigella flexneri 2a str. 301
gcgaugaugccaa

SEQ ID NO: 3928474 - RNA, 15 nt, Shigella flexneri 2a str. 301
gcgaugccaguaauc

SEQ ID NO: 3928475 - RNA, 17 nt, Shigella flexneri 2a str. 301
gcgaugcccagugacca

SEQ ID NO: 3928476 - RNA, 16 nt, Shigella flexneri 2a str. 301
gcgaugccuggcaaug

SEQ ID NO: 3928477 - RNA, 21 nt, Shigella flexneri 2a str. 301
gcgaugcugacgcaucuucuc

SEQ ID NO: 3928478 - RNA, 17 nt, Shigella flexneri 2a str. 301
gcgauggacgcagacca

SEQ ID NO: 3928479 - RNA, 14 nt, Shigella flexneri 2a str. 301
gcgauggcccgcuu

SEQ ID NO: 3928480 - RNA, 16 nt, Shigella flexneri 2a str. 301
gcgauggcggcagccu

SEQ ID NO: 3928481 - RNA, 12 nt, Shigella flexneri 2a str. 301
gcgaugguggug

SEQ ID NO: 3928482 - RNA, 22 nt, Shigella flexneri 2a str. 301
gcgaugguggugggggaaggau

SEQ ID NO: 3928483 - RNA, 13 nt, Shigella flexneri 2a str. 301
gcgauuaauaaaa

SEQ ID NO: 3928484 - RNA, 17 nt, Shigella flexneri 2a str. 301
gcgauuaugaaacaaga

SEQ ID NO: 3928485 - RNA, 19 nt, Shigella flexneri 2a str. 301
gcgauuaugccgccgacag

SEQ ID NO: 3928486 - RNA, 14 nt, Shigella flexneri 2a str. 301
gcgauucauaugcg

SEQ ID NO: 3928487 - RNA, 22 nt, Shigella flexneri 2a str. 301
gcgauucauaugcgccagcugc

SEQ ID NO: 3928488 - RNA, 21 nt, Shigella flexneri 2a str. 301
gcgauucguugguaaugacuc

SEQ ID NO: 3928489 - RNA, 17 nt, Shigella flexneri 2a str. 301
gcgccagcggccagcgc

SEQ ID NO: 3928490 - RNA, 18 nt, Shigella flexneri 2a str. 301
gcgccagcggccagcgca

SEQ ID NO: 3928491 - RNA, 15 nt, Shigella flexneri 2a str. 301
gcgccagcgucauca

SEQ ID NO: 3928492 - RNA, 18 nt, Shigella flexneri 2a str. 301
gcgccagcgucaucauag

SEQ ID NO: 3928493 - RNA, 22 nt, Shigella flexneri 2a str. 301
gcgccagcgucgcaucaggcau

SEQ ID NO: 3928494 - RNA, 20 nt, Shigella flexneri 2a str. 301
gcgccagcuucgaggccgga

SEQ ID NO: 3928495 - RNA, 21 nt, Shigella flexneri 2a str. 301
gcgccagguguuuaaccaaca

SEQ ID NO: 3928496 - RNA, 23 nt, Shigella flexneri 2a str. 301
gcgccagucggucaaugugcuaa

SEQ ID NO: 3928497 - RNA, 16 nt, Shigella flexneri 2a str. 301
gcgccauaguuacgcg

SEQ ID NO: 3928498 - RNA, 14 nt, Shigella flexneri 2a str. 301
gcgccauccauaau

SEQ ID NO: 3928499 - RNA, 16 nt, Shigella flexneri 2a str. 301
gcgccaucggcagcau

SEQ ID NO: 3928500 - RNA, 22 nt, Shigella flexneri 2a str. 301
gcgccaugcguuuuaccgccuc

SEQ ID NO: 3928501 - RNA, 20 nt, Shigella flexneri 2a str. 301
gcgccauugauguaauuauc

SEQ ID NO: 3928502 - RNA, 23 nt, Shigella flexneri 2a str. 301
gcgccauuggcuuuugcuugcga

SEQ ID NO: 3928503 - RNA, 13 nt, Shigella flexneri 2a str. 301
gcgccauuuucau

SEQ ID NO: 3928504 - RNA, 14 nt, Shigella flexneri 2a str. 301
gcgccauuuuucac

SEQ ID NO: 3928505 - RNA, 17 nt, Shigella flexneri 2a str. 301
gcgcccaacacuucccc

SEQ ID NO: 3928506 - RNA, 19 nt, Shigella flexneri 2a str. 301
gcgcccaguggaugcgcca

SEQ ID NO: 3928507 - RNA, 16 nt, Shigella flexneri 2a str. 301
gcgccccacaccacca

SEQ ID NO: 3928508 - RNA, 13 nt, Shigella flexneri 2a str. 301
gcgcccgccagca

SEQ ID NO: 3928509 - RNA, 16 nt, Shigella flexneri 2a str. 301
gcgcccgccagcaccg

SEQ ID NO: 3928510 - RNA, 15 nt, Shigella flexneri 2a str. 301
gcgcccgccagcauc

SEQ ID NO: 3928511 - RNA, 21 nt, Shigella flexneri 2a str. 301
gcgcccgucugggcgcggcuc

SEQ ID NO: 3928512 - RNA, 15 nt, Shigella flexneri 2a str. 301
gcgccgacagcagcc

SEQ ID NO: 3928513 - RNA, 22 nt, Shigella flexneri 2a str. 301
gcgccgacccugcguugucgca

SEQ ID NO: 3928514 - RNA, 19 nt, Shigella flexneri 2a str. 301
gcgccgacugcgccaauac

SEQ ID NO: 3928515 - RNA, 14 nt, Shigella flexneri 2a str. 301
gcgccgcauccgac

SEQ ID NO: 3928516 - RNA, 21 nt, Shigella flexneri 2a str. 301
gcgccgccucccuucgcugcu

SEQ ID NO: 3928517 - RNA, 22 nt, Shigella flexneri 2a str. 301
gcgccgcuuuuugugcggaagu

SEQ ID NO: 3928518 - RNA, 14 nt, Shigella flexneri 2a str. 301
gcgccgucuucccc

SEQ ID NO: 3928519 - RNA, 23 nt, Shigella flexneri 2a str. 301
gcgccgugaacguggccaugagc

SEQ ID NO: 3928520 - RNA, 19 nt, Shigella flexneri 2a str. 301
gcgccgugcaacugcggcg

SEQ ID NO: 3928521 - RNA, 13 nt, Shigella flexneri 2a str. 301
gcgccucaagaau

SEQ ID NO: 3928522 - RNA, 12 nt, Shigella flexneri 2a str. 301
gcgccucaagcu

SEQ ID NO: 3928523 - RNA, 11 nt, Shigella flexneri 2a str. 301
gcgccucccuu

SEQ ID NO: 3928524 - RNA, 23 nt, Shigella flexneri 2a str. 301
gcgccucccuuuuucaagcucaa

SEQ ID NO: 3928525 - RNA, 22 nt, Shigella flexneri 2a str. 301
gcgccugaccauuaucaaacag

SEQ ID NO: 3928526 - RNA, 14 nt, Shigella flexneri 2a str. 301
gcgccugaucuucc

SEQ ID NO: 3928527 - RNA, 12 nt, Shigella flexneri 2a str. 301
gcgccugcugcu

SEQ ID NO: 3928528 - RNA, 21 nt, Shigella flexneri 2a str. 301
gcgccugucaccgccuccacc

SEQ ID NO: 3928529 - RNA, 23 nt, Shigella flexneri 2a str. 301
gcgccugucaccgccuccaccug

SEQ ID NO: 3928530 - RNA, 21 nt, Shigella flexneri 2a str. 301
gcgccuucauucaggccaaag

SEQ ID NO: 3928531 - RNA, 23 nt, Shigella flexneri 2a str. 301
gcgccuucauucaggccaaagcc

SEQ ID NO: 3928532 - RNA, 15 nt, Shigella flexneri 2a str. 301
gcgccuuguuaccug

SEQ ID NO: 3928533 - RNA, 15 nt, Shigella flexneri 2a str. 301
gcgccuuuaccagac

SEQ ID NO: 3928534 - RNA, 22 nt, Shigella flexneri 2a str. 301
gcgccuuucgagaagcaagcau

SEQ ID NO: 3928535 - RNA, 21 nt, Shigella flexneri 2a str. 301
gcgccuuuuuucgccgcagca

SEQ ID NO: 3928536 - RNA, 13 nt, Shigella flexneri 2a str. 301
gcgcgaacagcac

SEQ ID NO: 3928537 - RNA, 19 nt, Shigella flexneri 2a str. 301
gcgcgaauggaaagcccgc

SEQ ID NO: 3928538 - RNA, 21 nt, Shigella flexneri 2a str. 301
gcgcgaauggaaagcccgccc

SEQ ID NO: 3928539 - RNA, 14 nt, Shigella flexneri 2a str. 301
gcgcgacaauauuc

SEQ ID NO: 3928540 - RNA, 22 nt, Shigella flexneri 2a str. 301
gcgcgaccaucggaucggccau

SEQ ID NO: 3928541 - RNA, 14 nt, Shigella flexneri 2a str. 301
gcgcgacgcucggc

SEQ ID NO: 3928542 - RNA, 14 nt, Shigella flexneri 2a str. 301
gcgcgacuuuuucc

SEQ ID NO: 3928543 - RNA, 13 nt, Shigella flexneri 2a str. 301
gcgcgagcaggcc

SEQ ID NO: 3928544 - RNA, 18 nt, Shigella flexneri 2a str. 301
gcgcgagccauaaacuga

SEQ ID NO: 3928545 - RNA, 21 nt, Shigella flexneri 2a str. 301
gcgcgaucgcuaccuaaggaa

SEQ ID NO: 3928546 - RNA, 22 nt, Shigella flexneri 2a str. 301
gcgcgaucggcuucgcucggcu

SEQ ID NO: 3928547 - RNA, 15 nt, Shigella flexneri 2a str. 301
gcgcgaugccgccgu

SEQ ID NO: 3928548 - RNA, 18 nt, Shigella flexneri 2a str. 301
gcgcgcaaucagcaccgc

SEQ ID NO: 3928549 - RNA, 15 nt, Shigella flexneri 2a str. 301
gcgcgcaggcgcuga

SEQ ID NO: 3928550 - RNA, 15 nt, Shigella flexneri 2a str. 301
gcgcgcagugccggu

SEQ ID NO: 3928551 - RNA, 15 nt, Shigella flexneri 2a str. 301
gcgcgccaagcccgu

SEQ ID NO: 3928552 - RNA, 12 nt, Shigella flexneri 2a str. 301
gcgcgcccgccg

SEQ ID NO: 3928553 - RNA, 21 nt, Shigella flexneri 2a str. 301
gcgcgccgccaauaaucagcg

SEQ ID NO: 3928554 - RNA, 15 nt, Shigella flexneri 2a str. 301
gcgcgcgauaucgcg

SEQ ID NO: 3928555 - RNA, 14 nt, Shigella flexneri 2a str. 301
gcgcgcgcagcacg

SEQ ID NO: 3928556 - RNA, 15 nt, Shigella flexneri 2a str. 301
gcgcgcggcaggaag

SEQ ID NO: 3928557 - RNA, 16 nt, Shigella flexneri 2a str. 301
gcgcgcugccagaacc

SEQ ID NO: 3928558 - RNA, 21 nt, Shigella flexneri 2a str. 301
gcgcggcaauuagcggcuggc

SEQ ID NO: 3928559 - RNA, 22 nt, Shigella flexneri 2a str. 301
gcgcggcaauuagcggcuggcu

SEQ ID NO: 3928560 - RNA, 16 nt, Shigella flexneri 2a str. 301
gcgcggcacccgcagg

SEQ ID NO: 3928561 - RNA, 14 nt, Shigella flexneri 2a str. 301
gcgcggcagccacc

SEQ ID NO: 3928562 - RNA, 14 nt, Shigella flexneri 2a str. 301
gcgcggcaggcauc

SEQ ID NO: 3928563 - RNA, 17 nt, Shigella flexneri 2a str. 301
gcgcggcauuacgcccg

SEQ ID NO: 3928564 - RNA, 14 nt, Shigella flexneri 2a str. 301
gcgcggcccacuuc

SEQ ID NO: 3928565 - RNA, 16 nt, Shigella flexneri 2a str. 301
gcgcggcgcaggcgcu

SEQ ID NO: 3928566 - RNA, 18 nt, Shigella flexneri 2a str. 301
gcgcgggaaagcaaccga

SEQ ID NO: 3928567 - RNA, 18 nt, Shigella flexneri 2a str. 301
gcgcgggcgauaaucuca

SEQ ID NO: 3928568 - RNA, 17 nt, Shigella flexneri 2a str. 301
gcgcggguaaugccgac

SEQ ID NO: 3928569 - RNA, 18 nt, Shigella flexneri 2a str. 301
gcgcgggucaccgcggug

SEQ ID NO: 3928570 - RNA, 23 nt, Shigella flexneri 2a str. 301
gcgcgguaucaccacccagcggu

SEQ ID NO: 3928571 - RNA, 22 nt, Shigella flexneri 2a str. 301
gcgcguaaauaccuuccggcgu

SEQ ID NO: 3928572 - RNA, 14 nt, Shigella flexneri 2a str. 301
gcgcguaagcguca

SEQ ID NO: 3928573 - RNA, 17 nt, Shigella flexneri 2a str. 301
gcgcguccgcagacacu

SEQ ID NO: 3928574 - RNA, 22 nt, Shigella flexneri 2a str. 301
gcgcguccgcagacacuuuccc

SEQ ID NO: 3928575 - RNA, 16 nt, Shigella flexneri 2a str. 301
gcgcgucuuguacuuc

SEQ ID NO: 3928576 - RNA, 15 nt, Shigella flexneri 2a str. 301
gcgcgugagcuggga

SEQ ID NO: 3928577 - RNA, 20 nt, Shigella flexneri 2a str. 301
gcgcguuaaagagcauuaca

SEQ ID NO: 3928578 - RNA, 14 nt, Shigella flexneri 2a str. 301
gcgcguuagccaua

SEQ ID NO: 3928579 - RNA, 23 nt, Shigella flexneri 2a str. 301
gcgcguugcuggauuuucugugc

SEQ ID NO: 3928580 - RNA, 22 nt, Shigella flexneri 2a str. 301
gcgcguuuuucuucagccccuc

SEQ ID NO: 3928581 - RNA, 18 nt, Shigella flexneri 2a str. 301
gcgcuaaaaauagcgacu

SEQ ID NO: 3928582 - RNA, 14 nt, Shigella flexneri 2a str. 301
gcgcuaaccgccug

SEQ ID NO: 3928583 - RNA, 13 nt, Shigella flexneri 2a str. 301
gcgcuaagcgaac

SEQ ID NO: 3928584 - RNA, 19 nt, Shigella flexneri 2a str. 301
gcgcuacgcuaucagaccu

SEQ ID NO: 3928585 - RNA, 15 nt, Shigella flexneri 2a str. 301
gcgcuacggccgcca

SEQ ID NO: 3928586 - RNA, 17 nt, Shigella flexneri 2a str. 301
gcgcuacggcguuucac

SEQ ID NO: 3928587 - RNA, 23 nt, Shigella flexneri 2a str. 301
gcgcuacggcugauggcgccagu

SEQ ID NO: 3928588 - RNA, 23 nt, Shigella flexneri 2a str. 301
gcgcuagccucagguguuagugu

SEQ ID NO: 3928589 - RNA, 14 nt, Shigella flexneri 2a str. 301
gcggcauuucgccg

SEQ ID NO: 3928590 - RNA, 18 nt, Shigella flexneri 2a str. 301
gcggcauuucgccgagca

SEQ ID NO: 3928591 - RNA, 22 nt, Shigella flexneri 2a str. 301
gcggccagccauccgucaucca

SEQ ID NO: 3928592 - RNA, 19 nt, Shigella flexneri 2a str. 301
gcggccaugccauaacgcg

SEQ ID NO: 3928593 - RNA, 18 nt, Shigella flexneri 2a str. 301
gcggccggaugacagacu

SEQ ID NO: 3928594 - RNA, 14 nt, Shigella flexneri 2a str. 301
gcggccguuccauu

SEQ ID NO: 3928595 - RNA, 21 nt, Shigella flexneri 2a str. 301
gcggccguuccauucaaacgu

SEQ ID NO: 3928596 - RNA, 23 nt, Shigella flexneri 2a str. 301
gcggcgaaaacgccacauccggc

SEQ ID NO: 3928597 - RNA, 18 nt, Shigella flexneri 2a str. 301
gcggcgaaccagccguug

SEQ ID NO: 3928598 - RNA, 22 nt, Shigella flexneri 2a str. 301
gcggcgaacugccgaucaccac

SEQ ID NO: 3928599 - RNA, 18 nt, Shigella flexneri 2a str. 301
gcggcgaacuuaaucauc

SEQ ID NO: 3928600 - RNA, 14 nt, Shigella flexneri 2a str. 301
gcggcgaaggugcc

SEQ ID NO: 3928601 - RNA, 17 nt, Shigella flexneri 2a str. 301
gcggcgaauguuccauc

SEQ ID NO: 3928602 - RNA, 18 nt, Shigella flexneri 2a str. 301
gcggcgacuuccagcgau

SEQ ID NO: 3928603 - RNA, 17 nt, Shigella flexneri 2a str. 301
gcggcgauauccagcgc

SEQ ID NO: 3928604 - RNA, 18 nt, Shigella flexneri 2a str. 301
gcggcgauauccagcgcg

SEQ ID NO: 3928605 - RNA, 20 nt, Shigella flexneri 2a str. 301
gcggcgauauccagcgcggc

SEQ ID NO: 3928606 - RNA, 14 nt, Shigella flexneri 2a str. 301
gcggcgauuaagaa

SEQ ID NO: 3928607 - RNA, 16 nt, Shigella flexneri 2a str. 301
gcggcgcaagcggcga

SEQ ID NO: 3928608 - RNA, 14 nt, Shigella flexneri 2a str. 301
gcggcgcaggcgcu

SEQ ID NO: 3928609 - RNA, 20 nt, Shigella flexneri 2a str. 301
gcggcggauauguucucggu

SEQ ID NO: 3928610 - RNA, 11 nt, Shigella flexneri 2a str. 301
gcggcggcaaa

SEQ ID NO: 3928611 - RNA, 15 nt, Shigella flexneri 2a str. 301
gcggcggcaaaauca

SEQ ID NO: 3928612 - RNA, 11 nt, Shigella flexneri 2a str. 301
gcggcggcaga

SEQ ID NO: 3928613 - RNA, 19 nt, Shigella flexneri 2a str. 301
gcggcggguuaaccagcac

SEQ ID NO: 3928614 - RNA, 15 nt, Shigella flexneri 2a str. 301
gcggcggucuucuca

SEQ ID NO: 3928615 - RNA, 20 nt, Shigella flexneri 2a str. 301
gcggcggugagaagaccgcc

SEQ ID NO: 3928616 - RNA, 14 nt, Shigella flexneri 2a str. 301
gcggcguaaacgcc

SEQ ID NO: 3928617 - RNA, 17 nt, Shigella flexneri 2a str. 301
gcggcguaaacgccuua

SEQ ID NO: 3928618 - RNA, 18 nt, Shigella flexneri 2a str. 301
gcggcguaaacgccuuau

SEQ ID NO: 3928619 - RNA, 21 nt, Shigella flexneri 2a str. 301
gcggcguaucgacaaucacca

SEQ ID NO: 3928620 - RNA, 17 nt, Shigella flexneri 2a str. 301
gcggcguaucuuccagg

SEQ ID NO: 3928621 - RNA, 14 nt, Shigella flexneri 2a str. 301
gcggcgugaacgcc

SEQ ID NO: 3928622 - RNA, 17 nt, Shigella flexneri 2a str. 301
gcggcgugaacgccuua

SEQ ID NO: 3928623 - RNA, 18 nt, Shigella flexneri 2a str. 301
gcggcgugaacgccuuau

SEQ ID NO: 3928624 - RNA, 16 nt, Shigella flexneri 2a str. 301
gcggcguuccaccgcu

SEQ ID NO: 3928625 - RNA, 13 nt, Shigella flexneri 2a str. 301
gcggcuaaaauau

SEQ ID NO: 3928626 - RNA, 15 nt, Shigella flexneri 2a str. 301
gcggcuaagcugggc

SEQ ID NO: 3928627 - RNA, 15 nt, Shigella flexneri 2a str. 301
gcggcuagccaggaa

SEQ ID NO: 3928628 - RNA, 22 nt, Shigella flexneri 2a str. 301
gcggcuauauucaaacacccga

SEQ ID NO: 3928629 - RNA, 14 nt, Shigella flexneri 2a str. 301
gcggcuaucccaaa

SEQ ID NO: 3928630 - RNA, 22 nt, Shigella flexneri 2a str. 301
gcggcucauugccauucgccag

SEQ ID NO: 3928631 - RNA, 21 nt, Shigella flexneri 2a str. 301
gcggcucguuagacggcgcug

SEQ ID NO: 3928632 - RNA, 23 nt, Shigella flexneri 2a str. 301
gcggcucuccugaacuuucuccc

SEQ ID NO: 3928633 - RNA, 19 nt, Shigella flexneri 2a str. 301
gcggcucucuuucuccagc

SEQ ID NO: 3928634 - RNA, 12 nt, Shigella flexneri 2a str. 301
gcggcugccagc

SEQ ID NO: 3928635 - RNA, 13 nt, Shigella flexneri 2a str. 301
gcggcugcgcagc

SEQ ID NO: 3928636 - RNA, 20 nt, Shigella flexneri 2a str. 301
gcggcugcugauguucgcca

SEQ ID NO: 3928637 - RNA, 21 nt, Shigella flexneri 2a str. 301
gcggcugcugauguucgccag

SEQ ID NO: 3928638 - RNA, 12 nt, Shigella flexneri 2a str. 301
gcggcuggcgca

SEQ ID NO: 3928639 - RNA, 13 nt, Shigella flexneri 2a str. 301
gcggcugguuaaa

SEQ ID NO: 3928640 - RNA, 22 nt, Shigella flexneri 2a str. 301
gcggcuuaccugaucgacaaaa

SEQ ID NO: 3928641 - RNA, 15 nt, Shigella flexneri 2a str. 301
gcggcuuauucauua

SEQ ID NO: 3928642 - RNA, 15 nt, Shigella flexneri 2a str. 301
gcggcuuccaccgcc

SEQ ID NO: 3928643 - RNA, 23 nt, Shigella flexneri 2a str. 301
gcggcuucgguuuuguugccgcc

SEQ ID NO: 3928644 - RNA, 18 nt, Shigella flexneri 2a str. 301
gcgggaaagcaaccgacg

SEQ ID NO: 3928645 - RNA, 15 nt, Shigella flexneri 2a str. 301
gcgggaacagcgacc

SEQ ID NO: 3928646 - RNA, 20 nt, Shigella flexneri 2a str. 301
gcgggagagccccugccgca

SEQ ID NO: 3928647 - RNA, 18 nt, Shigella flexneri 2a str. 301
gcgggagcagauacggcg

SEQ ID NO: 3928648 - RNA, 21 nt, Shigella flexneri 2a str. 301
gcgggaucgccgcguagagaa

SEQ ID NO: 3928649 - RNA, 19 nt, Shigella flexneri 2a str. 301
gcgggaugccagucaauga

SEQ ID NO: 3928650 - RNA, 14 nt, Shigella flexneri 2a str. 301
gcgggcaguaaacg

SEQ ID NO: 3928651 - RNA, 14 nt, Shigella flexneri 2a str. 301
gcgggccacugacg

SEQ ID NO: 3928652 - RNA, 21 nt, Shigella flexneri 2a str. 301
gcgggccauccaccagugacu

SEQ ID NO: 3928653 - RNA, 22 nt, Shigella flexneri 2a str. 301
gcgggcgaaucaacuccagaau

SEQ ID NO: 3928654 - RNA, 22 nt, Shigella flexneri 2a str. 301
gcgggcgagacugcgcgccgcc

SEQ ID NO: 3928655 - RNA, 18 nt, Shigella flexneri 2a str. 301
gcgggcgcgcaggcgcug

SEQ ID NO: 3928656 - RNA, 17 nt, Shigella flexneri 2a str. 301
gcgggcguagugcccgc

SEQ ID NO: 3928657 - RNA, 19 nt, Shigella flexneri 2a str. 301
gcggggagggaauccagca

SEQ ID NO: 3928658 - RNA, 16 nt, Shigella flexneri 2a str. 301
gcggggcuaccgccag

SEQ ID NO: 3928659 - RNA, 18 nt, Shigella flexneri 2a str. 301
gcgggggagucgcugguu

SEQ ID NO: 3928660 - RNA, 21 nt, Shigella flexneri 2a str. 301
gcgggguuuuuuuaugggcac

SEQ ID NO: 3928661 - RNA, 22 nt, Shigella flexneri 2a str. 301
gcgggguuuuuuuaugggcacg

SEQ ID NO: 3928662 - RNA, 20 nt, Shigella flexneri 2a str. 301
gcggguaauugcuccaucca

SEQ ID NO: 3928663 - RNA, 22 nt, Shigella flexneri 2a str. 301
gcggguaucuuuaaucgagaua

SEQ ID NO: 3928664 - RNA, 15 nt, Shigella flexneri 2a str. 301
gcgggucaggccagg

SEQ ID NO: 3928665 - RNA, 16 nt, Shigella flexneri 2a str. 301
gcgggucaggccagga

SEQ ID NO: 3928666 - RNA, 15 nt, Shigella flexneri 2a str. 301
gcgggucaguauucc

SEQ ID NO: 3928667 - RNA, 20 nt, Shigella flexneri 2a str. 301
gcgggugacuucccgcacgc

SEQ ID NO: 3928668 - RNA, 16 nt, Shigella flexneri 2a str. 301
gcggguuaaccagcac

SEQ ID NO: 3928669 - RNA, 17 nt, Shigella flexneri 2a str. 301
gcggguuaaccagcacc

SEQ ID NO: 3928670 - RNA, 17 nt, Shigella flexneri 2a str. 301
gcggguuaagcgcgcua

SEQ ID NO: 3928671 - RNA, 18 nt, Shigella flexneri 2a str. 301
gcggguuucaacauuucc

SEQ ID NO: 3928672 - RNA, 18 nt, Shigella flexneri 2a str. 301
gcgguaaaauggucagcc

SEQ ID NO: 3928673 - RNA, 17 nt, Shigella flexneri 2a str. 301
gcgguaaaccguuauca

SEQ ID NO: 3928674 - RNA, 18 nt, Shigella flexneri 2a str. 301
gcgguaaaguuuggcugu

SEQ ID NO: 3928675 - RNA, 13 nt, Shigella flexneri 2a str. 301
gcgguaaauuuuu

SEQ ID NO: 3928676 - RNA, 23 nt, Shigella flexneri 2a str. 301
gcgguaacaggauggcguucgca

SEQ ID NO: 3928677 - RNA, 16 nt, Shigella flexneri 2a str. 301
gcgguaacauccagau

SEQ ID NO: 3928678 - RNA, 13 nt, Shigella flexneri 2a str. 301
gcgguaauggucg

SEQ ID NO: 3928679 - RNA, 15 nt, Shigella flexneri 2a str. 301
gcgguacucgcgcag

SEQ ID NO: 3928680 - RNA, 17 nt, Shigella flexneri 2a str. 301
gcgguagcacgucaucu

SEQ ID NO: 3928681 - RNA, 13 nt, Shigella flexneri 2a str. 301
gcgguaucaccac

SEQ ID NO: 3928682 - RNA, 16 nt, Shigella flexneri 2a str. 301
gcggucaaaagcugca

SEQ ID NO: 3928683 - RNA, 14 nt, Shigella flexneri 2a str. 301
gcggucaaugguca

SEQ ID NO: 3928684 - RNA, 13 nt, Shigella flexneri 2a str. 301
gcggucguaaucg

SEQ ID NO: 3928685 - RNA, 19 nt, Shigella flexneri 2a str. 301
gcggucguaaucgcccgcu

SEQ ID NO: 3928686 - RNA, 19 nt, Shigella flexneri 2a str. 301
gcggucugugauuuccggg

SEQ ID NO: 3928687 - RNA, 14 nt, Shigella flexneri 2a str. 301
gcggugaccagcag

SEQ ID NO: 3928688 - RNA, 15 nt, Shigella flexneri 2a str. 301
gcggugaccagcagc

SEQ ID NO: 3928689 - RNA, 21 nt, Shigella flexneri 2a str. 301
gcguggcgauaaucagcgcca

SEQ ID NO: 3928690 - RNA, 16 nt, Shigella flexneri 2a str. 301
gcguggcgcagugccu

SEQ ID NO: 3928691 - RNA, 15 nt, Shigella flexneri 2a str. 301
gcgugucccacuggu

SEQ ID NO: 3928692 - RNA, 13 nt, Shigella flexneri 2a str. 301
gcgugucggacgg

SEQ ID NO: 3928693 - RNA, 13 nt, Shigella flexneri 2a str. 301
gcguguggugagg

SEQ ID NO: 3928694 - RNA, 21 nt, Shigella flexneri 2a str. 301
gcguuaacugcuuaucaucac

SEQ ID NO: 3928695 - RNA, 14 nt, Shigella flexneri 2a str. 301
gcguuaacuuguug

SEQ ID NO: 3928696 - RNA, 20 nt, Shigella flexneri 2a str. 301
gcguuaagccaucccagaca

SEQ ID NO: 3928697 - RNA, 22 nt, Shigella flexneri 2a str. 301
gcguuaaugucgauauggggau

SEQ ID NO: 3928698 - RNA, 17 nt, Shigella flexneri 2a str. 301
gcguuaauucgcuaaca

SEQ ID NO: 3928699 - RNA, 16 nt, Shigella flexneri 2a str. 301
gcguuacagcuggagu

SEQ ID NO: 3928700 - RNA, 20 nt, Shigella flexneri 2a str. 301
gcguuacccauucaagauca

SEQ ID NO: 3928701 - RNA, 16 nt, Shigella flexneri 2a str. 301
gcguuagccauaaaac

SEQ ID NO: 3928702 - RNA, 17 nt, Shigella flexneri 2a str. 301
gcguuauccgcuuuuuc

SEQ ID NO: 3928703 - RNA, 13 nt, Shigella flexneri 2a str. 301
gcguuaugacgcg

SEQ ID NO: 3928704 - RNA, 14 nt, Shigella flexneri 2a str. 301
gcguuaugacgcgc

SEQ ID NO: 3928705 - RNA, 21 nt, Shigella flexneri 2a str. 301
gcguuaugccguaaugccagu

SEQ ID NO: 3928706 - RNA, 22 nt, Shigella flexneri 2a str. 301
gcguucacgacgcauccggcau

SEQ ID NO: 3928707 - RNA, 20 nt, Shigella flexneri 2a str. 301
gcguucacgccgcauccggc

SEQ ID NO: 3928708 - RNA, 22 nt, Shigella flexneri 2a str. 301
gcguucacgccgcauccggcau

SEQ ID NO: 3928709 - RNA, 16 nt, Shigella flexneri 2a str. 301
gcguucaucaguucca

SEQ ID NO: 3928710 - RNA, 21 nt, Shigella flexneri 2a str. 301
gcguucaucaguuccaguuca

SEQ ID NO: 3928711 - RNA, 18 nt, Shigella flexneri 2a str. 301
gcguucauccugcuggug

SEQ ID NO: 3928712 - RNA, 19 nt, Shigella flexneri 2a str. 301
gcguuccauuggcggcguc

SEQ ID NO: 3928713 - RNA, 11 nt, Shigella flexneri 2a str. 301
gcguuccccag

SEQ ID NO: 3928714 - RNA, 15 nt, Shigella flexneri 2a str. 301
gcguuccccagaagc

SEQ ID NO: 3928715 - RNA, 22 nt, Shigella flexneri 2a str. 301
gcguuccccuguugugccagac

SEQ ID NO: 3928716 - RNA, 13 nt, Shigella flexneri 2a str. 301
gcguucugccugg

SEQ ID NO: 3928717 - RNA, 17 nt, Shigella flexneri 2a str. 301
gcguucugccuggcgca

SEQ ID NO: 3928718 - RNA, 19 nt, Shigella flexneri 2a str. 301
gcguucuguggcagggcag

SEQ ID NO: 3928719 - RNA, 19 nt, Shigella flexneri 2a str. 301
gcguugaauuuauguuucc

SEQ ID NO: 3928720 - RNA, 20 nt, Shigella flexneri 2a str. 301
gcguugaugauuugucgaua

SEQ ID NO: 3928721 - RNA, 15 nt, Shigella flexneri 2a str. 301
gcguugauuggcgca

SEQ ID NO: 3928722 - RNA, 20 nt, Shigella flexneri 2a str. 301
gcguugcgccuguucccuuc

SEQ ID NO: 3928723 - RNA, 14 nt, Shigella flexneri 2a str. 301
gcguuggcagguca

SEQ ID NO: 3928724 - RNA, 22 nt, Shigella flexneri 2a str. 301
gcguuuacgccgcauccggcau

SEQ ID NO: 3928725 - RNA, 18 nt, Shigella flexneri 2a str. 301
gcguuucaaaaacaaaga

SEQ ID NO: 3928726 - RNA, 17 nt, Shigella flexneri 2a str. 301
gcguuuccagcaccagu

SEQ ID NO: 3928727 - RNA, 20 nt, Shigella flexneri 2a str. 301
gcguuucugcgcuucugcca

SEQ ID NO: 3928728 - RNA, 21 nt, Shigella flexneri 2a str. 301
gcguuucuggcuuaaacgcag

SEQ ID NO: 3928729 - RNA, 23 nt, Shigella flexneri 2a str. 301
gcguuugaaauaccagguugccu

SEQ ID NO: 3928730 - RNA, 23 nt, Shigella flexneri 2a str. 301
gcguuugaacauuauuuuugcga

SEQ ID NO: 3928731 - RNA, 14 nt, Shigella flexneri 2a str. 301
gcguuugcuccugc

SEQ ID NO: 3928732 - RNA, 17 nt, Shigella flexneri 2a str. 301
gcguuuguaggccggau

SEQ ID NO: 3928733 - RNA, 11 nt, Shigella flexneri 2a str. 301
gcguuuuccag

SEQ ID NO: 3928734 - RNA, 23 nt, Shigella flexneri 2a str. 301
gcguuuugauuuucaccagcauc

SEQ ID NO: 3928735 - RNA, 19 nt, Shigella flexneri 2a str. 301
gcguuuugccaguucguug

SEQ ID NO: 3928736 - RNA, 13 nt, Shigella flexneri 2a str. 301
gcguuuuucagaa

SEQ ID NO: 3928737 - RNA, 16 nt, Shigella flexneri 2a str. 301
gcuaaaaacaucauga

SEQ ID NO: 3928738 - RNA, 18 nt, Shigella flexneri 2a str. 301
gcuaaagacuuugcugcc

SEQ ID NO: 3928739 - RNA, 19 nt, Shigella flexneri 2a str. 301
gcuaaagccguuaccgauu

SEQ ID NO: 3928740 - RNA, 14 nt, Shigella flexneri 2a str. 301
gcuaaaugccgcgu

SEQ ID NO: 3928741 - RNA, 20 nt, Shigella flexneri 2a str. 301
gcuaaaugccgcguggccug

SEQ ID NO: 3928742 - RNA, 13 nt, Shigella flexneri 2a str. 301
gcuaacagcagca

SEQ ID NO: 3928743 - RNA, 16 nt, Shigella flexneri 2a str. 301
gcuaacaggcuuuuac

SEQ ID NO: 3928744 - RNA, 21 nt, Shigella flexneri 2a str. 301
gcuaacuuccugcuggcugua

SEQ ID NO: 3928745 - RNA, 17 nt, Shigella flexneri 2a str. 301
gcuaagcgccaccguca

SEQ ID NO: 3928746 - RNA, 21 nt, Shigella flexneri 2a str. 301
gcuaaggcuguuguagaccgg

SEQ ID NO: 3928747 - RNA, 16 nt, Shigella flexneri 2a str. 301
gcuaaggucaccaguu

SEQ ID NO: 3928748 - RNA, 23 nt, Shigella flexneri 2a str. 301
gcuaauaccgucgaugccaauaa

SEQ ID NO: 3928749 - RNA, 14 nt, Shigella flexneri 2a str. 301
gcuaaucagugccu

SEQ ID NO: 3928750 - RNA, 20 nt, Shigella flexneri 2a str. 301
gcuaaucggcugcagugcaa

SEQ ID NO: 3928751 - RNA, 18 nt, Shigella flexneri 2a str. 301
gcuaaucucuucaccaua

SEQ ID NO: 3928752 - RNA, 14 nt, Shigella flexneri 2a str. 301
gcuaaugcaaauca

SEQ ID NO: 3928753 - RNA, 12 nt, Shigella flexneri 2a str. 301
gcuaauucuguu

SEQ ID NO: 3928754 - RNA, 12 nt, Shigella flexneri 2a str. 301
gcuaauuuaucg

SEQ ID NO: 3928755 - RNA, 17 nt, Shigella flexneri 2a str. 301
gcuacaacaucguaucu

SEQ ID NO: 3928756 - RNA, 15 nt, Shigella flexneri 2a str. 301
gcuacauaacgcagc

SEQ ID NO: 3928757 - RNA, 13 nt, Shigella flexneri 2a str. 301
gcuaccaaaaaau

SEQ ID NO: 3928758 - RNA, 23 nt, Shigella flexneri 2a str. 301
gcuaccaaaaaaucaaugcccau

SEQ ID NO: 3928759 - RNA, 17 nt, Shigella flexneri 2a str. 301
gcuaccaugcuaauaau

SEQ ID NO: 3928760 - RNA, 22 nt, Shigella flexneri 2a str. 301
gcuaccggacaguuugaucagu

SEQ ID NO: 3928761 - RNA, 14 nt, Shigella flexneri 2a str. 301
gcuaccugccgcca

SEQ ID NO: 3928762 - RNA, 21 nt, Shigella flexneri 2a str. 301
gcuacgcuaauuuugccauca

SEQ ID NO: 3928763 - RNA, 21 nt, Shigella flexneri 2a str. 301
gcuacgcuuaucaggccuaca

SEQ ID NO: 3928764 - RNA, 22 nt, Shigella flexneri 2a str. 301
gcuacgcuuaucaggccuacgc

SEQ ID NO: 3928765 - RNA, 16 nt, Shigella flexneri 2a str. 301
gcuacguagccagauu

SEQ ID NO: 3928766 - RNA, 15 nt, Shigella flexneri 2a str. 301
gcuacuucaaacaaa

SEQ ID NO: 3928767 - RNA, 20 nt, Shigella flexneri 2a str. 301
gcuacuuuuuucacccacac

SEQ ID NO: 3928768 - RNA, 12 nt, Shigella flexneri 2a str. 301
gcuagccaacuu

SEQ ID NO: 3928769 - RNA, 18 nt, Shigella flexneri 2a str. 301
gcuagcggcuuuuuacgc

SEQ ID NO: 3928770 - RNA, 20 nt, Shigella flexneri 2a str. 301
gcuagcggguuaagcgcgcu

SEQ ID NO: 3928771 - RNA, 21 nt, Shigella flexneri 2a str. 301
gcuaguuaucuccuugcuggu

SEQ ID NO: 3928772 - RNA, 22 nt, Shigella flexneri 2a str. 301
gcuaguuaucuccuugcuggug

SEQ ID NO: 3928773 - RNA, 17 nt, Shigella flexneri 2a str. 301
gcuauaaccugguggug

SEQ ID NO: 3928774 - RNA, 16 nt, Shigella flexneri 2a str. 301
gcuauacagcagccau

SEQ ID NO: 3928775 - RNA, 21 nt, Shigella flexneri 2a str. 301
gcuauaccccaccccgaaaug

SEQ ID NO: 3928776 - RNA, 21 nt, Shigella flexneri 2a str. 301
gcuauagacaccuugcaacuc

SEQ ID NO: 3928777 - RNA, 14 nt, Shigella flexneri 2a str. 301
gcuauauugcagga

SEQ ID NO: 3928778 - RNA, 16 nt, Shigella flexneri 2a str. 301
gcuaucagcgccacca

SEQ ID NO: 3928779 - RNA, 23 nt, Shigella flexneri 2a str. 301
gcuaucccaugccagugagugaa

SEQ ID NO: 3928780 - RNA, 20 nt, Shigella flexneri 2a str. 301
gcuaucgcugauauacccuu

SEQ ID NO: 3928781 - RNA, 18 nt, Shigella flexneri 2a str. 301
gcuaugaaagaaaaucaa

SEQ ID NO: 3928782 - RNA, 21 nt, Shigella flexneri 2a str. 301
gcuaugcuggagaagauauug

SEQ ID NO: 3928783 - RNA, 18 nt, Shigella flexneri 2a str. 301
gcuauuacuuuaagccuu

SEQ ID NO: 3928784 - RNA, 15 nt, Shigella flexneri 2a str. 301
gcuauuauaucgcuc

SEQ ID NO: 3928785 - RNA, 14 nt, Shigella flexneri 2a str. 301
gcuauucagcaguu

SEQ ID NO: 3928786 - RNA, 20 nt, Shigella flexneri 2a str. 301
gcuauugccgccaaaucgga

SEQ ID NO: 3928787 - RNA, 19 nt, Shigella flexneri 2a str. 301
gcuauugcgccagccuuuc

SEQ ID NO: 3928788 - RNA, 13 nt, Shigella flexneri 2a str. 301
gcuccuguugaug

SEQ ID NO: 3928789 - RNA, 16 nt, Shigella flexneri 2a str. 301
gcuccuuaauaaaaua

SEQ ID NO: 3928790 - RNA, 15 nt, Shigella flexneri 2a str. 301
gcuccuuuuggcaaa

SEQ ID NO: 3928791 - RNA, 18 nt, Shigella flexneri 2a str. 301
gcucgaacagcugguuga

SEQ ID NO: 3928792 - RNA, 15 nt, Shigella flexneri 2a str. 301
gcucgaacgccucug

SEQ ID NO: 3928793 - RNA, 17 nt, Shigella flexneri 2a str. 301
gcucgaacgccucugca

SEQ ID NO: 3928794 - RNA, 17 nt, Shigella flexneri 2a str. 301
gcucgaagcgggcgcgc

SEQ ID NO: 3928795 - RNA, 15 nt, Shigella flexneri 2a str. 301
gcucgacaagauauu

SEQ ID NO: 3928796 - RNA, 18 nt, Shigella flexneri 2a str. 301
gcucgacgagaauuuccu

SEQ ID NO: 3928797 - RNA, 17 nt, Shigella flexneri 2a str. 301
gcucgacgauaucggag

SEQ ID NO: 3928798 - RNA, 17 nt, Shigella flexneri 2a str. 301
gcucgcgcaguuugcca

SEQ ID NO: 3928799 - RNA, 22 nt, Shigella flexneri 2a str. 301
gcucgcgccagguguuuaacca

SEQ ID NO: 3928800 - RNA, 21 nt, Shigella flexneri 2a str. 301
gcucgcggugacgaucguggu

SEQ ID NO: 3928801 - RNA, 18 nt, Shigella flexneri 2a str. 301
gcucgcgguuagcggcuu

SEQ ID NO: 3928802 - RNA, 21 nt, Shigella flexneri 2a str. 301
gcucgcguucgauggcgcgcc

SEQ ID NO: 3928803 - RNA, 16 nt, Shigella flexneri 2a str. 301
gcucgcuggcaggccg

SEQ ID NO: 3928804 - RNA, 16 nt, Shigella flexneri 2a str. 301
gcucggaguaacaggu

SEQ ID NO: 3928805 - RNA, 15 nt, Shigella flexneri 2a str. 301
gcucggcaacaccuc

SEQ ID NO: 3928806 - RNA, 13 nt, Shigella flexneri 2a str. 301
gcucggcggcugg

SEQ ID NO: 3928807 - RNA, 18 nt, Shigella flexneri 2a str. 301
gcucggcggcuggcugga

SEQ ID NO: 3928808 - RNA, 15 nt, Shigella flexneri 2a str. 301
gcucgucacaucacc

SEQ ID NO: 3928809 - RNA, 19 nt, Shigella flexneri 2a str. 301
gcucgucacaucaccaaca

SEQ ID NO: 3928810 - RNA, 16 nt, Shigella flexneri 2a str. 301
gcucgucauccgccag

SEQ ID NO: 3928811 - RNA, 15 nt, Shigella flexneri 2a str. 301
gcucguuaaucagaa

SEQ ID NO: 3928812 - RNA, 22 nt, Shigella flexneri 2a str. 301
gcucuaacccuuccagauucag

SEQ ID NO: 3928813 - RNA, 16 nt, Shigella flexneri 2a str. 301
gcucucaaauaucugc

SEQ ID NO: 3928814 - RNA, 15 nt, Shigella flexneri 2a str. 301
gcucucacuuauuug

SEQ ID NO: 3928815 - RNA, 21 nt, Shigella flexneri 2a str. 301
gcucucauuuuucagcguucc

SEQ ID NO: 3928816 - RNA, 18 nt, Shigella flexneri 2a str. 301
gcucuccacgcuauacag

SEQ ID NO: 3928817 - RNA, 11 nt, Shigella flexneri 2a str. 301
gcucucugcua

SEQ ID NO: 3928818 - RNA, 18 nt, Shigella flexneri 2a str. 301
gcucucuuucucgcugac

SEQ ID NO: 3928819 - RNA, 13 nt, Shigella flexneri 2a str. 301
gcucugaggcuga

SEQ ID NO: 3928820 - RNA, 21 nt, Shigella flexneri 2a str. 301
gcucugauugccuuccaccag

SEQ ID NO: 3928821 - RNA, 20 nt, Shigella flexneri 2a str. 301
gcucugcacuaaugcaucug

SEQ ID NO: 3928822 - RNA, 21 nt, Shigella flexneri 2a str. 301
gcucugccacugguuuuccug

SEQ ID NO: 3928823 - RNA, 20 nt, Shigella flexneri 2a str. 301
gcucugcuuucucagcaaau

SEQ ID NO: 3928824 - RNA, 22 nt, Shigella flexneri 2a str. 301
gcucugcuuucucagcaaauag

SEQ ID NO: 3928825 - RNA, 16 nt, Shigella flexneri 2a str. 301
gcucuggcaagcgacu

SEQ ID NO: 3928826 - RNA, 20 nt, Shigella flexneri 2a str. 301
gcucuggcaggcuucaauuu

SEQ ID NO: 3928827 - RNA, 18 nt, Shigella flexneri 2a str. 301
gcucuggugcggcaaaaa

SEQ ID NO: 3928828 - RNA, 17 nt, Shigella flexneri 2a str. 301
gcucugguguucuuuua

SEQ ID NO: 3928829 - RNA, 15 nt, Shigella flexneri 2a str. 301
gcucugguucaccau

SEQ ID NO: 3928830 - RNA, 20 nt, Shigella flexneri 2a str. 301
gcucugguucaccauucugc

SEQ ID NO: 3928831 - RNA, 14 nt, Shigella flexneri 2a str. 301
gcucuguauauaaa

SEQ ID NO: 3928832 - RNA, 16 nt, Shigella flexneri 2a str. 301
gcucuguucugcgcuu

SEQ ID NO: 3928833 - RNA, 16 nt, Shigella flexneri 2a str. 301
gcucuucaauggucag

SEQ ID NO: 3928834 - RNA, 20 nt, Shigella flexneri 2a str. 301
gcucuucaauggucagccac

SEQ ID NO: 3928835 - RNA, 21 nt, Shigella flexneri 2a str. 301
gcucuucaucgcuaaaauacu

SEQ ID NO: 3928836 - RNA, 13 nt, Shigella flexneri 2a str. 301
gcucuuccuucag

SEQ ID NO: 3928837 - RNA, 15 nt, Shigella flexneri 2a str. 301
gcucuucucaacgug

SEQ ID NO: 3928838 - RNA, 14 nt, Shigella flexneri 2a str. 301
gcucuugaaauggu

SEQ ID NO: 3928839 - RNA, 12 nt, Shigella flexneri 2a str. 301
gcucuuuauaau

SEQ ID NO: 3928840 - RNA, 16 nt, Shigella flexneri 2a str. 301
gcucuuucagcaccgc

SEQ ID NO: 3928841 - RNA, 20 nt, Shigella flexneri 2a str. 301
gcucuuugauguacgcugcc

SEQ ID NO: 3928842 - RNA, 15 nt, Shigella flexneri 2a str. 301
gcucuuuucugaagu

SEQ ID NO: 3928843 - RNA, 21 nt, Shigella flexneri 2a str. 301
gcugaaaccgugcaucuguug

SEQ ID NO: 3928844 - RNA, 23 nt, Shigella flexneri 2a str. 301
gcugaaagaagcggugaaaaaau

SEQ ID NO: 3928845 - RNA, 20 nt, Shigella flexneri 2a str. 301
gcugaaauaacguaggccug

SEQ ID NO: 3928846 - RNA, 13 nt, Shigella flexneri 2a str. 301
gcugaacaaagcc

SEQ ID NO: 3928847 - RNA, 14 nt, Shigella flexneri 2a str. 301
gcugaacaaagccg

SEQ ID NO: 3928848 - RNA, 15 nt, Shigella flexneri 2a str. 301
gcugaacaaagccga

SEQ ID NO: 3928849 - RNA, 15 nt, Shigella flexneri 2a str. 301
gcugaacgcaccuuc

SEQ ID NO: 3928850 - RNA, 15 nt, Shigella flexneri 2a str. 301
gcugaacgccacgcu

SEQ ID NO: 3928851 - RNA, 19 nt, Shigella flexneri 2a str. 301
gcugaacugauugccaccc

SEQ ID NO: 3928852 - RNA, 14 nt, Shigella flexneri 2a str. 301
gcugaacuggcgaa

SEQ ID NO: 3928853 - RNA, 21 nt, Shigella flexneri 2a str. 301
gcugaagaaaauggccagcca

SEQ ID NO: 3928854 - RNA, 22 nt, Shigella flexneri 2a str. 301
gcugaagcagaaagcggaucag

SEQ ID NO: 3928855 - RNA, 16 nt, Shigella flexneri 2a str. 301
gcugaaggcacagaaa

SEQ ID NO: 3928856 - RNA, 22 nt, Shigella flexneri 2a str. 301
gcugaaggcacagaaaaauaac

SEQ ID NO: 3928857 - RNA, 20 nt, Shigella flexneri 2a str. 301
gcugaauaauccccauauca

SEQ ID NO: 3928858 - RNA, 16 nt, Shigella flexneri 2a str. 301
gcugaauaucuuucuc

SEQ ID NO: 3928859 - RNA, 15 nt, Shigella flexneri 2a str. 301
gcugaaucaacaggc

SEQ ID NO: 3928860 - RNA, 13 nt, Shigella flexneri 2a str. 301
gcugaauccccuu

SEQ ID NO: 3928861 - RNA, 19 nt, Shigella flexneri 2a str. 301
gcugaaucgccaaaaacau

SEQ ID NO: 3928862 - RNA, 21 nt, Shigella flexneri 2a str. 301
gcugaaugaggcuuuaauacc

SEQ ID NO: 3928863 - RNA, 19 nt, Shigella flexneri 2a str. 301
gcugaauggcgauuucaca

SEQ ID NO: 3928864 - RNA, 16 nt, Shigella flexneri 2a str. 301
gcugaauuugaccuug

SEQ ID NO: 3928865 - RNA, 21 nt, Shigella flexneri 2a str. 301
gcugaauuugaccuugcggcu

SEQ ID NO: 3928866 - RNA, 23 nt, Shigella flexneri 2a str. 301
gcugaauuuuuuucucgcggcgg

SEQ ID NO: 3928867 - RNA, 15 nt, Shigella flexneri 2a str. 301
gcugacaacgcugaa

SEQ ID NO: 3928868 - RNA, 19 nt, Shigella flexneri 2a str. 301
gcugacagcgcgucuugua

SEQ ID NO: 3928869 - RNA, 17 nt, Shigella flexneri 2a str. 301
gcugacauaaacaccag

SEQ ID NO: 3928870 - RNA, 18 nt, Shigella flexneri 2a str. 301
gcugacauaaacaccagc

SEQ ID NO: 3928871 - RNA, 22 nt, Shigella flexneri 2a str. 301
gcugacauaaacaccagcaaua

SEQ ID NO: 3928872 - RNA, 23 nt, Shigella flexneri 2a str. 301
gcugacauaaacaccagcaauaa

SEQ ID NO: 3928873 - RNA, 20 nt, Shigella flexneri 2a str. 301
gcugacauuaucagacaccg

SEQ ID NO: 3928874 - RNA, 13 nt, Shigella flexneri 2a str. 301
gcugaccaccagc

SEQ ID NO: 3928875 - RNA, 16 nt, Shigella flexneri 2a str. 301
gcugaccaccagcacg

SEQ ID NO: 3928876 - RNA, 16 nt, Shigella flexneri 2a str. 301
gcugaccagacuggag

SEQ ID NO: 3928877 - RNA, 20 nt, Shigella flexneri 2a str. 301
gcugaccgcccgcuaugagc

SEQ ID NO: 3928878 - RNA, 12 nt, Shigella flexneri 2a str. 301
gcugaccgcuug

SEQ ID NO: 3928879 - RNA, 21 nt, Shigella flexneri 2a str. 301
gcugaccuucaaauccucaau

SEQ ID NO: 3928880 - RNA, 19 nt, Shigella flexneri 2a str. 301
gcugacgauuguagaaaau

SEQ ID NO: 3928881 - RNA, 22 nt, Shigella flexneri 2a str. 301
gcugacgcaacugguccagccc

SEQ ID NO: 3928882 - RNA, 17 nt, Shigella flexneri 2a str. 301
gcugacgcaucuucucc

SEQ ID NO: 3928883 - RNA, 15 nt, Shigella flexneri 2a str. 301
gcugacggcgauaaa

SEQ ID NO: 3928884 - RNA, 21 nt, Shigella flexneri 2a str. 301
gcugacggugccagguaaaca

SEQ ID NO: 3928885 - RNA, 16 nt, Shigella flexneri 2a str. 301
gcugacguagcagcuc

SEQ ID NO: 3928886 - RNA, 16 nt, Shigella flexneri 2a str. 301
gcugacguagcaguuc

SEQ ID NO: 3928887 - RNA, 23 nt, Shigella flexneri 2a str. 301
gcugacgucuuuauugaguacca

SEQ ID NO: 3928888 - RNA, 13 nt, Shigella flexneri 2a str. 301
gcugcuuucgccg

SEQ ID NO: 3928889 - RNA, 22 nt, Shigella flexneri 2a str. 301
gcuggaaagcucuucaugcagc

SEQ ID NO: 3928890 - RNA, 16 nt, Shigella flexneri 2a str. 301
gcuggaagauguuucu

SEQ ID NO: 3928891 - RNA, 21 nt, Shigella flexneri 2a str. 301
gcuggaagguaaggauaaaaa

SEQ ID NO: 3928892 - RNA, 15 nt, Shigella flexneri 2a str. 301
gcuggacgcgccaac

SEQ ID NO: 3928893 - RNA, 20 nt, Shigella flexneri 2a str. 301
gcuggacguugcguugcagc

SEQ ID NO: 3928894 - RNA, 20 nt, Shigella flexneri 2a str. 301
gcuggagcggggaacaccuc

SEQ ID NO: 3928895 - RNA, 13 nt, Shigella flexneri 2a str. 301
gcuggaucccaga

SEQ ID NO: 3928896 - RNA, 22 nt, Shigella flexneri 2a str. 301
gcuggaugaacauaaucugcaa

SEQ ID NO: 3928897 - RNA, 22 nt, Shigella flexneri 2a str. 301
gcuggauuaacgcuggggauag

SEQ ID NO: 3928898 - RNA, 17 nt, Shigella flexneri 2a str. 301
gcuggauuuucugugca

SEQ ID NO: 3928899 - RNA, 21 nt, Shigella flexneri 2a str. 301
gcuggcaaaaaugauagccag

SEQ ID NO: 3928900 - RNA, 18 nt, Shigella flexneri 2a str. 301
gcuggcaaaucaguggcu

SEQ ID NO: 3928901 - RNA, 18 nt, Shigella flexneri 2a str. 301
gcuggcaacgcgccgcca

SEQ ID NO: 3928902 - RNA, 23 nt, Shigella flexneri 2a str. 301
gcuggcaacgcgccgccaacccu

SEQ ID NO: 3928903 - RNA, 14 nt, Shigella flexneri 2a str. 301
gcuggcaagauggc

SEQ ID NO: 3928904 - RNA, 22 nt, Shigella flexneri 2a str. 301
gcuggcaagauggcgaacauaa

SEQ ID NO: 3928905 - RNA, 17 nt, Shigella flexneri 2a str. 301
gcuggcaauaaagugau

SEQ ID NO: 3928906 - RNA, 21 nt, Shigella flexneri 2a str. 301
gcuggcaauacuggcagcagu

SEQ ID NO: 3928907 - RNA, 12 nt, Shigella flexneri 2a str. 301
gcuggcaaugac

SEQ ID NO: 3928908 - RNA, 22 nt, Shigella flexneri 2a str. 301
gcuggcaccgcagaucagacca

SEQ ID NO: 3928909 - RNA, 13 nt, Shigella flexneri 2a str. 301
gcuggcacuggga

SEQ ID NO: 3928910 - RNA, 13 nt, Shigella flexneri 2a str. 301
gcuggcagcugcu

SEQ ID NO: 3928911 - RNA, 14 nt, Shigella flexneri 2a str. 301
gcuggcaggccgcg

SEQ ID NO: 3928912 - RNA, 13 nt, Shigella flexneri 2a str. 301
gcuggcagugggc

SEQ ID NO: 3928913 - RNA, 22 nt, Shigella flexneri 2a str. 301
gcuggcagugggccagaaaaaa

SEQ ID NO: 3928914 - RNA, 13 nt, Shigella flexneri 2a str. 301
gcuggcaucgcaa

SEQ ID NO: 3928915 - RNA, 18 nt, Shigella flexneri 2a str. 301
gcuggcaucuugauacca

SEQ ID NO: 3928916 - RNA, 19 nt, Shigella flexneri 2a str. 301
gcuggcccaguugauucgc

SEQ ID NO: 3928917 - RNA, 22 nt, Shigella flexneri 2a str. 301
gcuggccuauuaugacuccagc

SEQ ID NO: 3928918 - RNA, 13 nt, Shigella flexneri 2a str. 301
gcuggccuccagu

SEQ ID NO: 3928919 - RNA, 14 nt, Shigella flexneri 2a str. 301
gcuggccuggcugg

SEQ ID NO: 3928920 - RNA, 23 nt, Shigella flexneri 2a str. 301
gcuggccuggcuggugacgcgcu

SEQ ID NO: 3928921 - RNA, 18 nt, Shigella flexneri 2a str. 301
gcuggcgaacgugcagga

SEQ ID NO: 3928922 - RNA, 13 nt, Shigella flexneri 2a str. 301
gcuggcgacgccu

SEQ ID NO: 3928923 - RNA, 22 nt, Shigella flexneri 2a str. 301
gcuggcgacgccucuauuaaaa

SEQ ID NO: 3928924 - RNA, 22 nt, Shigella flexneri 2a str. 301
gcuggcgcguuuaaucacacca

SEQ ID NO: 3928925 - RNA, 19 nt, Shigella flexneri 2a str. 301
gcuggcgguucuauggucu

SEQ ID NO: 3928926 - RNA, 13 nt, Shigella flexneri 2a str. 301
gcuggcgucuggg

SEQ ID NO: 3928927 - RNA, 14 nt, Shigella flexneri 2a str. 301
gcuggcuccugagc

SEQ ID NO: 3928928 - RNA, 14 nt, Shigella flexneri 2a str. 301
gcuggcugaacauu

SEQ ID NO: 3928929 - RNA, 16 nt, Shigella flexneri 2a str. 301
gcuggcuggcacgcuc

SEQ ID NO: 3928930 - RNA, 16 nt, Shigella flexneri 2a str. 301
gcugggaaaucaccac

SEQ ID NO: 3928931 - RNA, 16 nt, Shigella flexneri 2a str. 301
gcuggguaaagacauc

SEQ ID NO: 3928932 - RNA, 21 nt, Shigella flexneri 2a str. 301
gcuggguuucgccugccagau

SEQ ID NO: 3928933 - RNA, 18 nt, Shigella flexneri 2a str. 301
gcugguaacggcgucaac

SEQ ID NO: 3928934 - RNA, 15 nt, Shigella flexneri 2a str. 301
gcugguaaucaccac

SEQ ID NO: 3928935 - RNA, 14 nt, Shigella flexneri 2a str. 301
gcuggucaccaucu

SEQ ID NO: 3928936 - RNA, 20 nt, Shigella flexneri 2a str. 301
gcuggucacugaccacuucg

SEQ ID NO: 3928937 - RNA, 16 nt, Shigella flexneri 2a str. 301
gcuggucagcgccagu

SEQ ID NO: 3928938 - RNA, 14 nt, Shigella flexneri 2a str. 301
gcuggugauugccg

SEQ ID NO: 3928939 - RNA, 17 nt, Shigella flexneri 2a str. 301
gcuggugauuucgucca

SEQ ID NO: 3928940 - RNA, 12 nt, Shigella flexneri 2a str. 301
gcugguggugca

SEQ ID NO: 3928941 - RNA, 18 nt, Shigella flexneri 2a str. 301
gcugguguaacugcgcca

SEQ ID NO: 3928942 - RNA, 16 nt, Shigella flexneri 2a str. 301
gcugguuaccaccugc

SEQ ID NO: 3928943 - RNA, 21 nt, Shigella flexneri 2a str. 301
gcuguaaaaggcgccauuuuc

SEQ ID NO: 3928944 - RNA, 18 nt, Shigella flexneri 2a str. 301
gcuguaaaggugauauag

SEQ ID NO: 3928945 - RNA, 21 nt, Shigella flexneri 2a str. 301
gcuguaaaugccgacuuuguu

SEQ ID NO: 3928946 - RNA, 16 nt, Shigella flexneri 2a str. 301
gcuguaauaccagccu

SEQ ID NO: 3928947 - RNA, 14 nt, Shigella flexneri 2a str. 301
gcuguaauuucaca

SEQ ID NO: 3928948 - RNA, 20 nt, Shigella flexneri 2a str. 301
gcuguacgguaauggcaaag

SEQ ID NO: 3928949 - RNA, 16 nt, Shigella flexneri 2a str. 301
gcuguagccgaugccg

SEQ ID NO: 3928950 - RNA, 15 nt, Shigella flexneri 2a str. 301
gcuguagcuuuucau

SEQ ID NO: 3928951 - RNA, 17 nt, Shigella flexneri 2a str. 301
gcuguaguccuaacaga

SEQ ID NO: 3928952 - RNA, 15 nt, Shigella flexneri 2a str. 301
gcuguaucgccggug

SEQ ID NO: 3928953 - RNA, 18 nt, Shigella flexneri 2a str. 301
gcuguauucuucagcgac

SEQ ID NO: 3928954 - RNA, 21 nt, Shigella flexneri 2a str. 301
gcuguauuuugcguuucugcu

SEQ ID NO: 3928955 - RNA, 18 nt, Shigella flexneri 2a str. 301
gcugucaacugcgccacu

SEQ ID NO: 3928956 - RNA, 19 nt, Shigella flexneri 2a str. 301
gcugucaccagugagugug

SEQ ID NO: 3928957 - RNA, 23 nt, Shigella flexneri 2a str. 301
gcugucaguucaccauuagacag

SEQ ID NO: 3928958 - RNA, 14 nt, Shigella flexneri 2a str. 301
gcugucauccagca

SEQ ID NO: 3928959 - RNA, 19 nt, Shigella flexneri 2a str. 301
gcuguccgcgucuuaucag

SEQ ID NO: 3928960 - RNA, 18 nt, Shigella flexneri 2a str. 301
gcuguccgcuucaccacc

SEQ ID NO: 3928961 - RNA, 15 nt, Shigella flexneri 2a str. 301
gcuguccuaaaaaau

SEQ ID NO: 3928962 - RNA, 14 nt, Shigella flexneri 2a str. 301
gcugucggcacuga

SEQ ID NO: 3928963 - RNA, 16 nt, Shigella flexneri 2a str. 301
gcugucggugccauca

SEQ ID NO: 3928964 - RNA, 23 nt, Shigella flexneri 2a str. 301
gcugucguccggcagcagaaagc

SEQ ID NO: 3928965 - RNA, 16 nt, Shigella flexneri 2a str. 301
gcugucuaccagcacc

SEQ ID NO: 3928966 - RNA, 19 nt, Shigella flexneri 2a str. 301
gcugugaaccgcacagguu

SEQ ID NO: 3928967 - RNA, 24 nt, Shigella flexneri 2a str. 301
gcugugaagauggcuaacuaggcg

SEQ ID NO: 3928968 - RNA, 23 nt, Shigella flexneri 2a str. 301
gcugugaauauucauuuccggcg

SEQ ID NO: 3928969 - RNA, 23 nt, Shigella flexneri 2a str. 301
gcugugauguccguuuaccacag

SEQ ID NO: 3928970 - RNA, 18 nt, Shigella flexneri 2a str. 301
gcugugccggaaggggcg

SEQ ID NO: 3928971 - RNA, 20 nt, Shigella flexneri 2a str. 301
gcugugccguaaaucccagu

SEQ ID NO: 3928972 - RNA, 15 nt, Shigella flexneri 2a str. 301
gcugugcgauagcaa

SEQ ID NO: 3928973 - RNA, 19 nt, Shigella flexneri 2a str. 301
gcugugcgauagcaacgag

SEQ ID NO: 3928974 - RNA, 13 nt, Shigella flexneri 2a str. 301
gcuguguaagaau

SEQ ID NO: 3928975 - RNA, 20 nt, Shigella flexneri 2a str. 301
gcuguguguaggccagcgau

SEQ ID NO: 3928976 - RNA, 15 nt, Shigella flexneri 2a str. 301
gcuguucacugugcu

SEQ ID NO: 3928977 - RNA, 18 nt, Shigella flexneri 2a str. 301
gcuguucacugugcuggu

SEQ ID NO: 3928978 - RNA, 17 nt, Shigella flexneri 2a str. 301
gcuguucgagcaucaca

SEQ ID NO: 3928979 - RNA, 16 nt, Shigella flexneri 2a str. 301
gcuguucuucugcuga

SEQ ID NO: 3928980 - RNA, 14 nt, Shigella flexneri 2a str. 301
gcuguugaaugccg

SEQ ID NO: 3928981 - RNA, 17 nt, Shigella flexneri 2a str. 301
gcuguugcuccuuaaua

SEQ ID NO: 3928982 - RNA, 18 nt, Shigella flexneri 2a str. 301
gcuguugcuugaggauca

SEQ ID NO: 3928983 - RNA, 21 nt, Shigella flexneri 2a str. 301
gcuguuggaaucacucaucau

SEQ ID NO: 3928984 - RNA, 15 nt, Shigella flexneri 2a str. 301
gcuguuggugccaga

SEQ ID NO: 3928985 - RNA, 16 nt, Shigella flexneri 2a str. 301
gcuguuguucaacacu

SEQ ID NO: 3928986 - RNA, 16 nt, Shigella flexneri 2a str. 301
gcuguuguuuuuucaa

SEQ ID NO: 3928987 - RNA, 22 nt, Shigella flexneri 2a str. 301
gcuguuguuuuuucaaccuaaa

SEQ ID NO: 3928988 - RNA, 22 nt, Shigella flexneri 2a str. 301
gcuucugacuauauaaauuacc

SEQ ID NO: 3928989 - RNA, 16 nt, Shigella flexneri 2a str. 301
gcuucugcuucagccg

SEQ ID NO: 3928990 - RNA, 23 nt, Shigella flexneri 2a str. 301
gcuucuggcgacauuuucucuac

SEQ ID NO: 3928991 - RNA, 13 nt, Shigella flexneri 2a str. 301
gcuucuggcuggc

SEQ ID NO: 3928992 - RNA, 16 nt, Shigella flexneri 2a str. 301
gcuucuggcuggcgcu

SEQ ID NO: 3928993 - RNA, 15 nt, Shigella flexneri 2a str. 301
gcuucuguuauucca

SEQ ID NO: 3928994 - RNA, 19 nt, Shigella flexneri 2a str. 301
gcuucuguuuuaccugcgc

SEQ ID NO: 3928995 - RNA, 13 nt, Shigella flexneri 2a str. 301
gcuucuuccagca

SEQ ID NO: 3928996 - RNA, 13 nt, Shigella flexneri 2a str. 301
gcuucuuccggcg

SEQ ID NO: 3928997 - RNA, 22 nt, Shigella flexneri 2a str. 301
gcuucuucugccgcuuccagca

SEQ ID NO: 3928998 - RNA, 22 nt, Shigella flexneri 2a str. 301
gcuucuuucucaaucugcuugc

SEQ ID NO: 3928999 - RNA, 16 nt, Shigella flexneri 2a str. 301
gcuugaaaaauaaagu

SEQ ID NO: 3929000 - RNA, 16 nt, Shigella flexneri 2a str. 301
gcuugaacgguaagaa

SEQ ID NO: 3929001 - RNA, 14 nt, Shigella flexneri 2a str. 301
gcuugacgugucuu

SEQ ID NO: 3929002 - RNA, 18 nt, Shigella flexneri 2a str. 301
gcuugacgugucuuauca

SEQ ID NO: 3929003 - RNA, 22 nt, Shigella flexneri 2a str. 301
gcuugacgugucuuaucaggcc

SEQ ID NO: 3929004 - RNA, 19 nt, Shigella flexneri 2a str. 301
gcuugagcaggagcagcag

SEQ ID NO: 3929005 - RNA, 22 nt, Shigella flexneri 2a str. 301
gcuugaucaauaacgccaugag

SEQ ID NO: 3929006 - RNA, 23 nt, Shigella flexneri 2a str. 301
gcuugaucaauaacgccaugagc

SEQ ID NO: 3929007 - RNA, 18 nt, Shigella flexneri 2a str. 301
gcuugauccuacacauac

SEQ ID NO: 3929008 - RNA, 13 nt, Shigella flexneri 2a str. 301
gcuugcagcgucu

SEQ ID NO: 3929009 - RNA, 13 nt, Shigella flexneri 2a str. 301
gcuugcaggauca

SEQ ID NO: 3929010 - RNA, 22 nt, Shigella flexneri 2a str. 301
gcuugcaggaucagcuccggca

SEQ ID NO: 3929011 - RNA, 14 nt, Shigella flexneri 2a str. 301
gcuugccgcgcucu

SEQ ID NO: 3929012 - RNA, 21 nt, Shigella flexneri 2a str. 301
gcuugccgcgcucugccagca

SEQ ID NO: 3929013 - RNA, 17 nt, Shigella flexneri 2a str. 301
gcuugccggaaccggau

SEQ ID NO: 3929014 - RNA, 20 nt, Shigella flexneri 2a str. 301
gcuugccgggccguaauauu

SEQ ID NO: 3929015 - RNA, 18 nt, Shigella flexneri 2a str. 301
gcuugccguugagggcgc

SEQ ID NO: 3929016 - RNA, 17 nt, Shigella flexneri 2a str. 301
gcuugcgauauucuuca

SEQ ID NO: 3929017 - RNA, 13 nt, Shigella flexneri 2a str. 301
gcuugcgccgcuu

SEQ ID NO: 3929018 - RNA, 16 nt, Shigella flexneri 2a str. 301
gcuugcgcgcaaucag

SEQ ID NO: 3929019 - RNA, 20 nt, Shigella flexneri 2a str. 301
gcuugcgcgcaaucagcacc

SEQ ID NO: 3929020 - RNA, 19 nt, Shigella flexneri 2a str. 301
gcuugcgucauccagcacu

SEQ ID NO: 3929021 - RNA, 14 nt, Shigella flexneri 2a str. 301
gcuugcucuggucu

SEQ ID NO: 3929022 - RNA, 16 nt, Shigella flexneri 2a str. 301
gcuuggcaagcccagc

SEQ ID NO: 3929023 - RNA, 22 nt, Shigella flexneri 2a str. 301
gcuuguacuugauacgcuucgg

SEQ ID NO: 3929024 - RNA, 16 nt, Shigella flexneri 2a str. 301
gcuugugcaccagcug

SEQ ID NO: 3929025 - RNA, 17 nt, Shigella flexneri 2a str. 301
gcuuguuucauuacucg

SEQ ID NO: 3929026 - RNA, 14 nt, Shigella flexneri 2a str. 301
gcuuuaaagcaggc

SEQ ID NO: 3929027 - RNA, 21 nt, Shigella flexneri 2a str. 301
gcuuuaaauuacugagcaauu

SEQ ID NO: 3929028 - RNA, 16 nt, Shigella flexneri 2a str. 301
gcuuuacaauauccag

SEQ ID NO: 3929029 - RNA, 20 nt, Shigella flexneri 2a str. 301
gcuuuacaauauccagcgcg

SEQ ID NO: 3929030 - RNA, 21 nt, Shigella flexneri 2a str. 301
gcuuuaccaccgucaaaaaaa

SEQ ID NO: 3929031 - RNA, 16 nt, Shigella flexneri 2a str. 301
gcuuuacccagccaug

SEQ ID NO: 3929032 - RNA, 18 nt, Shigella flexneri 2a str. 301
gcuuuacgcuuaucccag

SEQ ID NO: 3929033 - RNA, 14 nt, Shigella flexneri 2a str. 301
gcuuuagggcuggc

SEQ ID NO: 3929034 - RNA, 20 nt, Shigella flexneri 2a str. 301
gcuuuauagcguugcccgau

SEQ ID NO: 3929035 - RNA, 21 nt, Shigella flexneri 2a str. 301
gcuuuauccugcccacuccag

SEQ ID NO: 3929036 - RNA, 23 nt, Shigella flexneri 2a str. 301
gcuuuauccugcccacuccagcu

SEQ ID NO: 3929037 - RNA, 20 nt, Shigella flexneri 2a str. 301
gcuuuaucgacuaacuucug

SEQ ID NO: 3929038 - RNA, 22 nt, Shigella flexneri 2a str. 301
gcuuuaucgccaccaacccgga

SEQ ID NO: 3929039 - RNA, 14 nt, Shigella flexneri 2a str. 301
gcuuuaucgccgcu

SEQ ID NO: 3929040 - RNA, 11 nt, Shigella flexneri 2a str. 301
gcuuucaacaa

SEQ ID NO: 3929041 - RNA, 13 nt, Shigella flexneri 2a str. 301
gcuuucaccgucg

SEQ ID NO: 3929042 - RNA, 14 nt, Shigella flexneri 2a str. 301
gcuuucaccugcgc

SEQ ID NO: 3929043 - RNA, 15 nt, Shigella flexneri 2a str. 301
gcuuucacgccgccg

SEQ ID NO: 3929044 - RNA, 17 nt, Shigella flexneri 2a str. 301
gcuuucacgccgccguu

SEQ ID NO: 3929045 - RNA, 21 nt, Shigella flexneri 2a str. 301
gcuuucacgcucgguccuucg

SEQ ID NO: 3929046 - RNA, 16 nt, Shigella flexneri 2a str. 301
gcuuucacgucaggau

SEQ ID NO: 3929047 - RNA, 16 nt, Shigella flexneri 2a str. 301
gcuuucacuauuucuu

SEQ ID NO: 3929048 - RNA, 18 nt, Shigella flexneri 2a str. 301
gcuuucacuauuucuuug

SEQ ID NO: 3929049 - RNA, 21 nt, Shigella flexneri 2a str. 301
gcuuucacucaguguuggaug

SEQ ID NO: 3929050 - RNA, 15 nt, Shigella flexneri 2a str. 301
gcuuucacucugaaa

SEQ ID NO: 3929051 - RNA, 17 nt, Shigella flexneri 2a str. 301
gcuuucagcacuuaucu

SEQ ID NO: 3929052 - RNA, 20 nt, Shigella flexneri 2a str. 301
gcuuucagcacuuaucucuu

SEQ ID NO: 3929053 - RNA, 13 nt, Shigella flexneri 2a str. 301
gcuuucagcagcg

SEQ ID NO: 3929054 - RNA, 18 nt, Shigella flexneri 2a str. 301
gcuuucaggucagcgaau

SEQ ID NO: 3929055 - RNA, 16 nt, Shigella flexneri 2a str. 301
gcuuucauucgguuuu

SEQ ID NO: 3929056 - RNA, 18 nt, Shigella flexneri 2a str. 301
gcuuuccagcuucaaauu

SEQ ID NO: 3929057 - RNA, 19 nt, Shigella flexneri 2a str. 301
gcuuuccaggcaucagcaa

SEQ ID NO: 3929058 - RNA, 22 nt, Shigella flexneri 2a str. 301
gcuuuccaggcaucagcaacac

SEQ ID NO: 3929059 - RNA, 14 nt, Shigella flexneri 2a str. 301
gcuuuccgcuggcg

SEQ ID NO: 3929060 - RNA, 20 nt, Shigella flexneri 2a str. 301
gcuuuccgucagcggcaauu

SEQ ID NO: 3929061 - RNA, 21 nt, Shigella flexneri 2a str. 301
gcuuucgcuacuucaaacaaa

SEQ ID NO: 3929062 - RNA, 16 nt, Shigella flexneri 2a str. 301
gcuuucgcuuucucuu

SEQ ID NO: 3929063 - RNA, 20 nt, Shigella flexneri 2a str. 301
gcuuucggaaagaucgccac

SEQ ID NO: 3929064 - RNA, 14 nt, Shigella flexneri 2a str. 301
gcuuucgugaagcu

SEQ ID NO: 3929065 - RNA, 15 nt, Shigella flexneri 2a str. 301
gcuuucgugaagcug

SEQ ID NO: 3929066 - RNA, 18 nt, Shigella flexneri 2a str. 301
gcuuucgugaagcuggca

SEQ ID NO: 3929067 - RNA, 14 nt, Shigella flexneri 2a str. 301
gcuuucucaccaug

SEQ ID NO: 3929068 - RNA, 14 nt, Shigella flexneri 2a str. 301
gcuuucucuuccag

SEQ ID NO: 3929069 - RNA, 15 nt, Shigella flexneri 2a str. 301
gcuuucugaacugaa

SEQ ID NO: 3929070 - RNA, 21 nt, Shigella flexneri 2a str. 301
gcuuucugaacugaacaaaaa

SEQ ID NO: 3929071 - RNA, 23 nt, Shigella flexneri 2a str. 301
gcuuugacgaccuucuuccagcu

SEQ ID NO: 3929072 - RNA, 22 nt, Shigella flexneri 2a str. 301
gcuuugacgaugcuccacuccu

SEQ ID NO: 3929073 - RNA, 23 nt, Shigella flexneri 2a str. 301
gcuuugacgaugcuccacuccug

SEQ ID NO: 3929074 - RNA, 14 nt, Shigella flexneri 2a str. 301
gcuuugcaggcugg

SEQ ID NO: 3929075 - RNA, 15 nt, Shigella flexneri 2a str. 301
gcuuugcaggcuggu

SEQ ID NO: 3929076 - RNA, 15 nt, Shigella flexneri 2a str. 301
gcuuugccgucaucu

SEQ ID NO: 3929077 - RNA, 17 nt, Shigella flexneri 2a str. 301
gcuuugcuguuuccagu

SEQ ID NO: 3929078 - RNA, 12 nt, Shigella flexneri 2a str. 301
gcuuuggcaaac

SEQ ID NO: 3929079 - RNA, 17 nt, Shigella flexneri 2a str. 301
gcuuuguguaaguuuaa

SEQ ID NO: 3929080 - RNA, 18 nt, Shigella flexneri 2a str. 301
gcuuuguucaugccggau

SEQ ID NO: 3929081 - RNA, 18 nt, Shigella flexneri 2a str. 301
gcuuuguuuaugccagau

SEQ ID NO: 3929082 - RNA, 18 nt, Shigella flexneri 2a str. 301
gcuuuguuuaugccggau

SEQ ID NO: 3929083 - RNA, 15 nt, Shigella flexneri 2a str. 301
gcuuuuaaccgcuuu

SEQ ID NO: 3929084 - RNA, 22 nt, Shigella flexneri 2a str. 301
gcuuuuacauuauccagcgacu

SEQ ID NO: 3929085 - RNA, 19 nt, Shigella flexneri 2a str. 301
gcuuuuaccagcauacgaa

SEQ ID NO: 3929086 - RNA, 12 nt, Shigella flexneri 2a str. 301
gcuuuuacgcau

SEQ ID NO: 3929087 - RNA, 15 nt, Shigella flexneri 2a str. 301
gcuuuuagcugguga

SEQ ID NO: 3929088 - RNA, 17 nt, Shigella flexneri 2a str. 301
ggacagcguugccagcu

SEQ ID NO: 3929089 - RNA, 20 nt, Shigella flexneri 2a str. 301
ggacaguaucgauauggacu

SEQ ID NO: 3929090 - RNA, 14 nt, Shigella flexneri 2a str. 301
ggacauagcucugc

SEQ ID NO: 3929091 - RNA, 17 nt, Shigella flexneri 2a str. 301
ggacaucccggcagaga

SEQ ID NO: 3929092 - RNA, 16 nt, Shigella flexneri 2a str. 301
ggacaucguccagcuu

SEQ ID NO: 3929093 - RNA, 15 nt, Shigella flexneri 2a str. 301
ggacaugauucauaa

SEQ ID NO: 3929094 - RNA, 14 nt, Shigella flexneri 2a str. 301
ggacauguuuucca

SEQ ID NO: 3929095 - RNA, 20 nt, Shigella flexneri 2a str. 301
ggacauuccguuugcuguau

SEQ ID NO: 3929096 - RNA, 14 nt, Shigella flexneri 2a str. 301
ggaccaauaaacgc

SEQ ID NO: 3929097 - RNA, 10 nt, Shigella flexneri 2a str. 301
ggaccacgga

SEQ ID NO: 3929098 - RNA, 13 nt, Shigella flexneri 2a str. 301
ggaccagcaacaa

SEQ ID NO: 3929099 - RNA, 22 nt, Shigella flexneri 2a str. 301
ggaccauucacacuccaguccc

SEQ ID NO: 3929100 - RNA, 18 nt, Shigella flexneri 2a str. 301
ggacccgcgaucgccugc

SEQ ID NO: 3929101 - RNA, 20 nt, Shigella flexneri 2a str. 301
ggacccuuaaagggucaggg

SEQ ID NO: 3929102 - RNA, 19 nt, Shigella flexneri 2a str. 301
ggaccguaucccccagagc

SEQ ID NO: 3929103 - RNA, 17 nt, Shigella flexneri 2a str. 301
ggaccgucaucuuccac

SEQ ID NO: 3929104 - RNA, 20 nt, Shigella flexneri 2a str. 301
ggacgagucgucgauaucga

SEQ ID NO: 3929105 - RNA, 21 nt, Shigella flexneri 2a str. 301
ggacgaucccaaccauuucau

SEQ ID NO: 3929106 - RNA, 16 nt, Shigella flexneri 2a str. 301
ggacgaucgcagauga

SEQ ID NO: 3929107 - RNA, 20 nt, Shigella flexneri 2a str. 301
ggacgcacaucgcugugcug

SEQ ID NO: 3929108 - RNA, 12 nt, Shigella flexneri 2a str. 301
ggacgggcaauu

SEQ ID NO: 3929109 - RNA, 14 nt, Shigella flexneri 2a str. 301
ggacguuaccauca

SEQ ID NO: 3929110 - RNA, 19 nt, Shigella flexneri 2a str. 301
ggacuauuuuaagaauaga

SEQ ID NO: 3929111 - RNA, 11 nt, Shigella flexneri 2a str. 301
ggacuccaccg

SEQ ID NO: 3929112 - RNA, 22 nt, Shigella flexneri 2a str. 301
ggacuccgcaccgccguguucu

SEQ ID NO: 3929113 - RNA, 18 nt, Shigella flexneri 2a str. 301
ggacugaaaguacuucac

SEQ ID NO: 3929114 - RNA, 17 nt, Shigella flexneri 2a str. 301
ggacugaacgcccacgg

SEQ ID NO: 3929115 - RNA, 14 nt, Shigella flexneri 2a str. 301
ggacugacauuacg

SEQ ID NO: 3929116 - RNA, 15 nt, Shigella flexneri 2a str. 301
ggacugcucacgcca

SEQ ID NO: 3929117 - RNA, 22 nt, Shigella flexneri 2a str. 301
ggacugggcgcgcucagcgcca

SEQ ID NO: 3929118 - RNA, 13 nt, Shigella flexneri 2a str. 301
ggacuuuuuauuu

SEQ ID NO: 3929119 - RNA, 24 nt, Shigella flexneri 2a str. 301
ggagaaacccggccacagcgccag

SEQ ID NO: 3929120 - RNA, 13 nt, Shigella flexneri 2a str. 301
ggagaaacuucug

SEQ ID NO: 3929121 - RNA, 12 nt, Shigella flexneri 2a str. 301
ggagaacgcugc

SEQ ID NO: 3929122 - RNA, 16 nt, Shigella flexneri 2a str. 301
ggagaacggacccgcg

SEQ ID NO: 3929123 - RNA, 18 nt, Shigella flexneri 2a str. 301
ggagaagaugcgucagca

SEQ ID NO: 3929124 - RNA, 22 nt, Shigella flexneri 2a str. 301
ggagacauuacguccaucacaa

SEQ ID NO: 3929125 - RNA, 18 nt, Shigella flexneri 2a str. 301
ggagacguauuaaauucc

SEQ ID NO: 3929126 - RNA, 15 nt, Shigella flexneri 2a str. 301
ggagacuaaggcagc

SEQ ID NO: 3929127 - RNA, 13 nt, Shigella flexneri 2a str. 301
ggagagaaaagca

SEQ ID NO: 3929128 - RNA, 21 nt, Shigella flexneri 2a str. 301
ggagagaaaagcaaaagaugg

SEQ ID NO: 3929129 - RNA, 15 nt, Shigella flexneri 2a str. 301
ggagagagcccugga

SEQ ID NO: 3929130 - RNA, 15 nt, Shigella flexneri 2a str. 301
ggagagggaaauccc

SEQ ID NO: 3929131 - RNA, 15 nt, Shigella flexneri 2a str. 301
ggagagggccggggu

SEQ ID NO: 3929132 - RNA, 20 nt, Shigella flexneri 2a str. 301
ggagaguaugcgcgucagag

SEQ ID NO: 3929133 - RNA, 13 nt, Shigella flexneri 2a str. 301
ggagaguugaaag

SEQ ID NO: 3929134 - RNA, 14 nt, Shigella flexneri 2a str. 301
ggagaguugaaagc

SEQ ID NO: 3929135 - RNA, 21 nt, Shigella flexneri 2a str. 301
ggagaguugcaccagcaacaa

SEQ ID NO: 3929136 - RNA, 19 nt, Shigella flexneri 2a str. 301
ggagauuaacugggcguca

SEQ ID NO: 3929137 - RNA, 23 nt, Shigella flexneri 2a str. 301
ggagcaaaagugguguugaagaa

SEQ ID NO: 3929138 - RNA, 14 nt, Shigella flexneri 2a str. 301
ggagcaacugcgcu

SEQ ID NO: 3929139 - RNA, 22 nt, Shigella flexneri 2a str. 301
ggagcagagcauucccgccauc

SEQ ID NO: 3929140 - RNA, 12 nt, Shigella flexneri 2a str. 301
ggagcagccccu

SEQ ID NO: 3929141 - RNA, 14 nt, Shigella flexneri 2a str. 301
ggagccaguuggcg

SEQ ID NO: 3929142 - RNA, 21 nt, Shigella flexneri 2a str. 301
ggagcgauuaugaaacaagaa

SEQ ID NO: 3929143 - RNA, 23 nt, Shigella flexneri 2a str. 301
ggagcguccugcucgccacguca

SEQ ID NO: 3929144 - RNA, 13 nt, Shigella flexneri 2a str. 301
ggagcuaaacagc

SEQ ID NO: 3929145 - RNA, 19 nt, Shigella flexneri 2a str. 301
ggagcuccagguccuccug

SEQ ID NO: 3929146 - RNA, 17 nt, Shigella flexneri 2a str. 301
ggagcugcaagauuaaa

SEQ ID NO: 3929147 - RNA, 14 nt, Shigella flexneri 2a str. 301
ggagcugccaggcc

SEQ ID NO: 3929148 - RNA, 16 nt, Shigella flexneri 2a str. 301
ggagcugugggguauu

SEQ ID NO: 3929149 - RNA, 18 nt, Shigella flexneri 2a str. 301
ggagcuucacccgcagca

SEQ ID NO: 3929150 - RNA, 21 nt, Shigella flexneri 2a str. 301
ggaggagagugcaaugaaaaa

SEQ ID NO: 3929151 - RNA, 14 nt, Shigella flexneri 2a str. 301
ggaggauuucuccc

SEQ ID NO: 3929152 - RNA, 15 nt, Shigella flexneri 2a str. 301
ggaggcgcugguaau

SEQ ID NO: 3929153 - RNA, 20 nt, Shigella flexneri 2a str. 301
ggagggauguggcccagccu

SEQ ID NO: 3929154 - RNA, 19 nt, Shigella flexneri 2a str. 301
ggagggguuuuugccagca

SEQ ID NO: 3929155 - RNA, 13 nt, Shigella flexneri 2a str. 301
ggaguaaccugcc

SEQ ID NO: 3929156 - RNA, 16 nt, Shigella flexneri 2a str. 301
ggaguaagaauaaaac

SEQ ID NO: 3929157 - RNA, 19 nt, Shigella flexneri 2a str. 301
ggaguaguugaucgccccg

SEQ ID NO: 3929158 - RNA, 23 nt, Shigella flexneri 2a str. 301
ggagucagacccugcucuuucag

SEQ ID NO: 3929159 - RNA, 15 nt, Shigella flexneri 2a str. 301
ggagugaaaauucuc

SEQ ID NO: 3929160 - RNA, 18 nt, Shigella flexneri 2a str. 301
ggauaaacacucgcugug

SEQ ID NO: 3929161 - RNA, 18 nt, Shigella flexneri 2a str. 301
ggauaaacuuggcuauaa

SEQ ID NO: 3929162 - RNA, 19 nt, Shigella flexneri 2a str. 301
ggauaaaucuccauuucau

SEQ ID NO: 3929163 - RNA, 20 nt, Shigella flexneri 2a str. 301
ggauaauaauauccuuuccc

SEQ ID NO: 3929164 - RNA, 20 nt, Shigella flexneri 2a str. 301
ggauaauacacuaacagaac

SEQ ID NO: 3929165 - RNA, 16 nt, Shigella flexneri 2a str. 301
ggauaauauuuuugcg

SEQ ID NO: 3929166 - RNA, 18 nt, Shigella flexneri 2a str. 301
ggauagagcucauuucau

SEQ ID NO: 3929167 - RNA, 19 nt, Shigella flexneri 2a str. 301
ggauagccucucggcauuu

SEQ ID NO: 3929168 - RNA, 21 nt, Shigella flexneri 2a str. 301
ggauagccucucggcauuuau

SEQ ID NO: 3929169 - RNA, 19 nt, Shigella flexneri 2a str. 301
ggauauaaaaaacccucac

SEQ ID NO: 3929170 - RNA, 21 nt, Shigella flexneri 2a str. 301
ggauaucaacguuauucgcuu

SEQ ID NO: 3929171 - RNA, 18 nt, Shigella flexneri 2a str. 301
ggauauccacccgcagcc

SEQ ID NO: 3929172 - RNA, 19 nt, Shigella flexneri 2a str. 301
ggauauccacccgcagcca

SEQ ID NO: 3929173 - RNA, 19 nt, Shigella flexneri 2a str. 301
ggaucaaaaaugucaucgu

SEQ ID NO: 3929174 - RNA, 18 nt, Shigella flexneri 2a str. 301
ggaucaacggccugacca

SEQ ID NO: 3929175 - RNA, 15 nt, Shigella flexneri 2a str. 301
ggaucaagcaacaua

SEQ ID NO: 3929176 - RNA, 21 nt, Shigella flexneri 2a str. 301
ggaucaauuaauccuuucgaa

SEQ ID NO: 3929177 - RNA, 20 nt, Shigella flexneri 2a str. 301
ggaucacaucauaaauaaga

SEQ ID NO: 3929178 - RNA, 14 nt, Shigella flexneri 2a str. 301
ggaucacaucgccg

SEQ ID NO: 3929179 - RNA, 21 nt, Shigella flexneri 2a str. 301
ggaucaccagaccaauggcuu

SEQ ID NO: 3929180 - RNA, 17 nt, Shigella flexneri 2a str. 301
ggaucacuccccgccgu

SEQ ID NO: 3929181 - RNA, 12 nt, Shigella flexneri 2a str. 301
ggaucacuggca

SEQ ID NO: 3929182 - RNA, 15 nt, Shigella flexneri 2a str. 301
ggaucagaaugcgcu

SEQ ID NO: 3929183 - RNA, 20 nt, Shigella flexneri 2a str. 301
ggaucagcaaauccaucgcc

SEQ ID NO: 3929184 - RNA, 15 nt, Shigella flexneri 2a str. 301
ggaucaguuccagca

SEQ ID NO: 3929185 - RNA, 13 nt, Shigella flexneri 2a str. 301
ggaucaguuucag

SEQ ID NO: 3929186 - RNA, 22 nt, Shigella flexneri 2a str. 301
ggaucauccacccgcagcaagc

SEQ ID NO: 3929187 - RNA, 17 nt, Shigella flexneri 2a str. 301
ggauccaguccccccca

SEQ ID NO: 3929188 - RNA, 16 nt, Shigella flexneri 2a str. 301
ggcaaucaugauugaa

SEQ ID NO: 3929189 - RNA, 17 nt, Shigella flexneri 2a str. 301
ggcaaucauucccagac

SEQ ID NO: 3929190 - RNA, 16 nt, Shigella flexneri 2a str. 301
ggcaauccacugcuug

SEQ ID NO: 3929191 - RNA, 17 nt, Shigella flexneri 2a str. 301
ggcaauccccgccagca

SEQ ID NO: 3929192 - RNA, 12 nt, Shigella flexneri 2a str. 301
ggcaaucgccag

SEQ ID NO: 3929193 - RNA, 18 nt, Shigella flexneri 2a str. 301
ggcaaucguagcccagcu

SEQ ID NO: 3929194 - RNA, 23 nt, Shigella flexneri 2a str. 301
ggcaaucucacuccggccagagc

SEQ ID NO: 3929195 - RNA, 14 nt, Shigella flexneri 2a str. 301
ggcaaucugcuggc

SEQ ID NO: 3929196 - RNA, 23 nt, Shigella flexneri 2a str. 301
ggcaaugacuagcgccauaauaa

SEQ ID NO: 3929197 - RNA, 15 nt, Shigella flexneri 2a str. 301
ggcaaugcugucggu

SEQ ID NO: 3929198 - RNA, 18 nt, Shigella flexneri 2a str. 301
ggcaauguagcgcugcaa

SEQ ID NO: 3929199 - RNA, 17 nt, Shigella flexneri 2a str. 301
ggcaaugucgagugaau

SEQ ID NO: 3929200 - RNA, 22 nt, Shigella flexneri 2a str. 301
ggcaauucacugucgaacuggc

SEQ ID NO: 3929201 - RNA, 21 nt, Shigella flexneri 2a str. 301
ggcaauuuuuaccggucagga

SEQ ID NO: 3929202 - RNA, 17 nt, Shigella flexneri 2a str. 301
ggcacaacucggcggcu

SEQ ID NO: 3929203 - RNA, 11 nt, Shigella flexneri 2a str. 301
ggcacaagggu

SEQ ID NO: 3929204 - RNA, 19 nt, Shigella flexneri 2a str. 301
ggcacacguaggccaaccg

SEQ ID NO: 3929205 - RNA, 15 nt, Shigella flexneri 2a str. 301
ggcacagcaggccaa

SEQ ID NO: 3929206 - RNA, 13 nt, Shigella flexneri 2a str. 301
ggcacagccagcg

SEQ ID NO: 3929207 - RNA, 15 nt, Shigella flexneri 2a str. 301
ggcacagccagcgcu

SEQ ID NO: 3929208 - RNA, 20 nt, Shigella flexneri 2a str. 301
ggcacagccagcgcuggcaa

SEQ ID NO: 3929209 - RNA, 16 nt, Shigella flexneri 2a str. 301
ggcacaguagcccacc

SEQ ID NO: 3929210 - RNA, 19 nt, Shigella flexneri 2a str. 301
ggcacagucgcgacgcuga

SEQ ID NO: 3929211 - RNA, 20 nt, Shigella flexneri 2a str. 301
ggcacauccagauuuuucag

SEQ ID NO: 3929212 - RNA, 16 nt, Shigella flexneri 2a str. 301
ggcacaucgacgguga

SEQ ID NO: 3929213 - RNA, 23 nt, Shigella flexneri 2a str. 301
ggcacauucugacugggucagua

SEQ ID NO: 3929214 - RNA, 21 nt, Shigella flexneri 2a str. 301
ggcaccaaucaccgccagcaa

SEQ ID NO: 3929215 - RNA, 21 nt, Shigella flexneri 2a str. 301
ggcaccaccuggcuugccggg

SEQ ID NO: 3929216 - RNA, 13 nt, Shigella flexneri 2a str. 301
ggcaccacuugca

SEQ ID NO: 3929217 - RNA, 13 nt, Shigella flexneri 2a str. 301
ggcacccagcgcu

SEQ ID NO: 3929218 - RNA, 13 nt, Shigella flexneri 2a str. 301
ggcaccgcagauc

SEQ ID NO: 3929219 - RNA, 19 nt, Shigella flexneri 2a str. 301
ggcaccuguaccagcccgc

SEQ ID NO: 3929220 - RNA, 18 nt, Shigella flexneri 2a str. 301
ggcacucaacaaccagaa

SEQ ID NO: 3929221 - RNA, 20 nt, Shigella flexneri 2a str. 301
ggcacuuacucauuaaugca

SEQ ID NO: 3929222 - RNA, 22 nt, Shigella flexneri 2a str. 301
ggcacuuucaucgcggucagcu

SEQ ID NO: 3929223 - RNA, 16 nt, Shigella flexneri 2a str. 301
ggcagaacagaacauc

SEQ ID NO: 3929224 - RNA, 17 nt, Shigella flexneri 2a str. 301
ggcagaauaacggcaga

SEQ ID NO: 3929225 - RNA, 21 nt, Shigella flexneri 2a str. 301
ggcagaauaacggcugauaac

SEQ ID NO: 3929226 - RNA, 22 nt, Shigella flexneri 2a str. 301
ggcagaaugguaacaccagagu

SEQ ID NO: 3929227 - RNA, 20 nt, Shigella flexneri 2a str. 301
ggcagaccugcuuuguucag

SEQ ID NO: 3929228 - RNA, 14 nt, Shigella flexneri 2a str. 301
ggcagacgugacca

SEQ ID NO: 3929229 - RNA, 17 nt, Shigella flexneri 2a str. 301
ggcagagaaaccacauc

SEQ ID NO: 3929230 - RNA, 18 nt, Shigella flexneri 2a str. 301
ggcagagaaagcaaaaau

SEQ ID NO: 3929231 - RNA, 22 nt, Shigella flexneri 2a str. 301
ggcagauaaacaaccccaucgc

SEQ ID NO: 3929232 - RNA, 16 nt, Shigella flexneri 2a str. 301
ggcagauugagcguca

SEQ ID NO: 3929233 - RNA, 22 nt, Shigella flexneri 2a str. 301
ggcagcaacggcaguuugcggu

SEQ ID NO: 3929234 - RNA, 15 nt, Shigella flexneri 2a str. 301
ggcagcaacuggcga

SEQ ID NO: 3929235 - RNA, 22 nt, Shigella flexneri 2a str. 301
ggcagcaaggcuauucagcagu

SEQ ID NO: 3929236 - RNA, 17 nt, Shigella flexneri 2a str. 301
ggcagcaaucacugcca

SEQ ID NO: 3929237 - RNA, 18 nt, Shigella flexneri 2a str. 301
ggcagcaaucgaccaggc

SEQ ID NO: 3929238 - RNA, 20 nt, Shigella flexneri 2a str. 301
ggcagcaauugucgcagaag

SEQ ID NO: 3929239 - RNA, 14 nt, Shigella flexneri 2a str. 301
ggcagcauccggca

SEQ ID NO: 3929240 - RNA, 14 nt, Shigella flexneri 2a str. 301
ggcagcauguguaa

SEQ ID NO: 3929241 - RNA, 17 nt, Shigella flexneri 2a str. 301
ggcagccaccgccagcg

SEQ ID NO: 3929242 - RNA, 20 nt, Shigella flexneri 2a str. 301
ggcagccaccgccagcgggu

SEQ ID NO: 3929243 - RNA, 16 nt, Shigella flexneri 2a str. 301
ggcagccagauggcug

SEQ ID NO: 3929244 - RNA, 13 nt, Shigella flexneri 2a str. 301
ggcagccagcauc

SEQ ID NO: 3929245 - RNA, 23 nt, Shigella flexneri 2a str. 301
ggcagccagccaugcggcaucuu

SEQ ID NO: 3929246 - RNA, 14 nt, Shigella flexneri 2a str. 301
ggcagccaggcgcg

SEQ ID NO: 3929247 - RNA, 21 nt, Shigella flexneri 2a str. 301
ggcagccaguucgagaaaaau

SEQ ID NO: 3929248 - RNA, 12 nt, Shigella flexneri 2a str. 301
ggcagccuuucu

SEQ ID NO: 3929249 - RNA, 13 nt, Shigella flexneri 2a str. 301
ggcagcguuaugu

SEQ ID NO: 3929250 - RNA, 13 nt, Shigella flexneri 2a str. 301
ggcagcuccagca

SEQ ID NO: 3929251 - RNA, 17 nt, Shigella flexneri 2a str. 301
ggcagcucgaccgcugc

SEQ ID NO: 3929252 - RNA, 14 nt, Shigella flexneri 2a str. 301
ggcaggaacugcuc

SEQ ID NO: 3929253 - RNA, 20 nt, Shigella flexneri 2a str. 301
ggcaggaucugcgcggcaaa

SEQ ID NO: 3929254 - RNA, 22 nt, Shigella flexneri 2a str. 301
ggcaggaugcccaugccaauua

SEQ ID NO: 3929255 - RNA, 14 nt, Shigella flexneri 2a str. 301
ggcaggccaaaaaa

SEQ ID NO: 3929256 - RNA, 15 nt, Shigella flexneri 2a str. 301
ggcaggccuaacaca

SEQ ID NO: 3929257 - RNA, 16 nt, Shigella flexneri 2a str. 301
ggcaggccuggguaaa

SEQ ID NO: 3929258 - RNA, 20 nt, Shigella flexneri 2a str. 301
ggcagggaucugauuuuccu

SEQ ID NO: 3929259 - RNA, 15 nt, Shigella flexneri 2a str. 301
ggcagggccaccagc

SEQ ID NO: 3929260 - RNA, 20 nt, Shigella flexneri 2a str. 301
ggcaggggcuucuuccggcg

SEQ ID NO: 3929261 - RNA, 23 nt, Shigella flexneri 2a str. 301
ggcagggucagcaucaagauaaa

SEQ ID NO: 3929262 - RNA, 22 nt, Shigella flexneri 2a str. 301
ggcaggguggugacaccaugcc

SEQ ID NO: 3929263 - RNA, 13 nt, Shigella flexneri 2a str. 301
ggcaggucaucgu

SEQ ID NO: 3929264 - RNA, 20 nt, Shigella flexneri 2a str. 301
ggcaggucaugugucgccgc

SEQ ID NO: 3929265 - RNA, 22 nt, Shigella flexneri 2a str. 301
ggcaggucuuucaccugauuac

SEQ ID NO: 3929266 - RNA, 15 nt, Shigella flexneri 2a str. 301
ggcagguuaaugacc

SEQ ID NO: 3929267 - RNA, 23 nt, Shigella flexneri 2a str. 301
ggcagguuucaccuuuuuccaga

SEQ ID NO: 3929268 - RNA, 19 nt, Shigella flexneri 2a str. 301
ggcaguaaccaaaagcugg

SEQ ID NO: 3929269 - RNA, 15 nt, Shigella flexneri 2a str. 301
ggcaguaauaccaga

SEQ ID NO: 3929270 - RNA, 18 nt, Shigella flexneri 2a str. 301
ggcaguagggugauuuca

SEQ ID NO: 3929271 - RNA, 13 nt, Shigella flexneri 2a str. 301
ggcaguauagcgg

SEQ ID NO: 3929272 - RNA, 14 nt, Shigella flexneri 2a str. 301
ggcaguaucggcaa

SEQ ID NO: 3929273 - RNA, 22 nt, Shigella flexneri 2a str. 301
ggcagucggcgcauaaugccug

SEQ ID NO: 3929274 - RNA, 14 nt, Shigella flexneri 2a str. 301
ggcagucuggacaa

SEQ ID NO: 3929275 - RNA, 16 nt, Shigella flexneri 2a str. 301
ggcaguucgugcagug

SEQ ID NO: 3929276 - RNA, 16 nt, Shigella flexneri 2a str. 301
ggcaguuggcgcacaa

SEQ ID NO: 3929277 - RNA, 22 nt, Shigella flexneri 2a str. 301
ggcaguuggcgcacaaugccug

SEQ ID NO: 3929278 - RNA, 20 nt, Shigella flexneri 2a str. 301
ggcauauccuauauagcccc

SEQ ID NO: 3929279 - RNA, 20 nt, Shigella flexneri 2a str. 301
ggcauauuccgccaccugcg

SEQ ID NO: 3929280 - RNA, 21 nt, Shigella flexneri 2a str. 301
ggcaucaccgcgaaauaauca

SEQ ID NO: 3929281 - RNA, 18 nt, Shigella flexneri 2a str. 301
ggcaucacgaauccgcac

SEQ ID NO: 3929282 - RNA, 13 nt, Shigella flexneri 2a str. 301
ggcaucagcaauu

SEQ ID NO: 3929283 - RNA, 13 nt, Shigella flexneri 2a str. 301
ggcaucagcagaa

SEQ ID NO: 3929284 - RNA, 17 nt, Shigella flexneri 2a str. 301
ggcaucaucuuccggua

SEQ ID NO: 3929285 - RNA, 20 nt, Shigella flexneri 2a str. 301
ggcauccagguuucuuccag

SEQ ID NO: 3929286 - RNA, 18 nt, Shigella flexneri 2a str. 301
ggcauccuugcuaaccaa

SEQ ID NO: 3929287 - RNA, 18 nt, Shigella flexneri 2a str. 301
ggcaucgcaaaccagacg

SEQ ID NO: 3929288 - RNA, 17 nt, Shigella flexneri 2a str. 301
ggccucgcuacgccagc

SEQ ID NO: 3929289 - RNA, 20 nt, Shigella flexneri 2a str. 301
ggccucggguugaugguaaa

SEQ ID NO: 3929290 - RNA, 16 nt, Shigella flexneri 2a str. 301
ggccucuccucgcgag

SEQ ID NO: 3929291 - RNA, 16 nt, Shigella flexneri 2a str. 301
ggccucuccuuuacca

SEQ ID NO: 3929292 - RNA, 15 nt, Shigella flexneri 2a str. 301
ggccugaaagcucau

SEQ ID NO: 3929293 - RNA, 15 nt, Shigella flexneri 2a str. 301
ggccugagaagcgca

SEQ ID NO: 3929294 - RNA, 19 nt, Shigella flexneri 2a str. 301
ggccugagacugaugacaa

SEQ ID NO: 3929295 - RNA, 23 nt, Shigella flexneri 2a str. 301
ggccugauaaacauagcgcauca

SEQ ID NO: 3929296 - RNA, 20 nt, Shigella flexneri 2a str. 301
ggccugauaagacgcggcaa

SEQ ID NO: 3929297 - RNA, 20 nt, Shigella flexneri 2a str. 301
ggccugauaagcgcagcgca

SEQ ID NO: 3929298 - RNA, 21 nt, Shigella flexneri 2a str. 301
ggccugauaagcgcagcgcau

SEQ ID NO: 3929299 - RNA, 23 nt, Shigella flexneri 2a str. 301
ggccugauaagcguagcgcauca

SEQ ID NO: 3929300 - RNA, 20 nt, Shigella flexneri 2a str. 301
ggccugauaaguguagcgca

SEQ ID NO: 3929301 - RNA, 13 nt, Shigella flexneri 2a str. 301
ggccugcacugca

SEQ ID NO: 3929302 - RNA, 15 nt, Shigella flexneri 2a str. 301
ggccugcgcgaccuc

SEQ ID NO: 3929303 - RNA, 14 nt, Shigella flexneri 2a str. 301
ggccugcucaagcg

SEQ ID NO: 3929304 - RNA, 12 nt, Shigella flexneri 2a str. 301
ggccuggcuggu

SEQ ID NO: 3929305 - RNA, 20 nt, Shigella flexneri 2a str. 301
ggccuuaaguaugcaauaac

SEQ ID NO: 3929306 - RNA, 18 nt, Shigella flexneri 2a str. 301
ggccuugauuauuucccu

SEQ ID NO: 3929307 - RNA, 23 nt, Shigella flexneri 2a str. 301
ggccuuuuccgcgaugaucguca

SEQ ID NO: 3929308 - RNA, 17 nt, Shigella flexneri 2a str. 301
ggccuuuuccuuucaga

SEQ ID NO: 3929309 - RNA, 21 nt, Shigella flexneri 2a str. 301
ggcgaaaacgccacauccggc

SEQ ID NO: 3929310 - RNA, 18 nt, Shigella flexneri 2a str. 301
ggcgaaaagcuucuuccu

SEQ ID NO: 3929311 - RNA, 23 nt, Shigella flexneri 2a str. 301
ggcgaaagcagaaaaagaagccg

SEQ ID NO: 3929312 - RNA, 19 nt, Shigella flexneri 2a str. 301
ggcgaaauugcugacgcaa

SEQ ID NO: 3929313 - RNA, 12 nt, Shigella flexneri 2a str. 301
ggcgaaccgcug

SEQ ID NO: 3929314 - RNA, 22 nt, Shigella flexneri 2a str. 301
ggcgaaccggaacaucaccaag

SEQ ID NO: 3929315 - RNA, 15 nt, Shigella flexneri 2a str. 301
ggcgaagagaaagaa

SEQ ID NO: 3929316 - RNA, 22 nt, Shigella flexneri 2a str. 301
ggcgaauuaaucuuucugcgaa

SEQ ID NO: 3929317 - RNA, 19 nt, Shigella flexneri 2a str. 301
ggcgaauuaucggcagcgg

SEQ ID NO: 3929318 - RNA, 19 nt, Shigella flexneri 2a str. 301
ggcgacacaucuaaugcuu

SEQ ID NO: 3929319 - RNA, 13 nt, Shigella flexneri 2a str. 301
ggcgacagcgaaa

SEQ ID NO: 3929320 - RNA, 17 nt, Shigella flexneri 2a str. 301
ggcgacagcgaaauccc

SEQ ID NO: 3929321 - RNA, 17 nt, Shigella flexneri 2a str. 301
ggcgacggcuggcaaaa

SEQ ID NO: 3929322 - RNA, 14 nt, Shigella flexneri 2a str. 301
ggcgacuucugcuu

SEQ ID NO: 3929323 - RNA, 15 nt, Shigella flexneri 2a str. 301
ggcgacuucugcuuu

SEQ ID NO: 3929324 - RNA, 22 nt, Shigella flexneri 2a str. 301
ggcgagaacgacauggcccagc

SEQ ID NO: 3929325 - RNA, 18 nt, Shigella flexneri 2a str. 301
ggcgagaauauuuccagu

SEQ ID NO: 3929326 - RNA, 17 nt, Shigella flexneri 2a str. 301
ggcgagacugcgcgccg

SEQ ID NO: 3929327 - RNA, 21 nt, Shigella flexneri 2a str. 301
ggcgaggaacgaucccagcgu

SEQ ID NO: 3929328 - RNA, 17 nt, Shigella flexneri 2a str. 301
ggcgaggcggggccaau

SEQ ID NO: 3929329 - RNA, 23 nt, Shigella flexneri 2a str. 301
ggcgaggggacgguccgugcgcu

SEQ ID NO: 3929330 - RNA, 17 nt, Shigella flexneri 2a str. 301
ggcgagguacgcccagc

SEQ ID NO: 3929331 - RNA, 16 nt, Shigella flexneri 2a str. 301
ggcgaguaauaaacuc

SEQ ID NO: 3929332 - RNA, 18 nt, Shigella flexneri 2a str. 301
ggcgaguuuccaucaggc

SEQ ID NO: 3929333 - RNA, 16 nt, Shigella flexneri 2a str. 301
ggcgauaaucucaaua

SEQ ID NO: 3929334 - RNA, 13 nt, Shigella flexneri 2a str. 301
ggcgauaccagua

SEQ ID NO: 3929335 - RNA, 15 nt, Shigella flexneri 2a str. 301
ggcgauacucugcca

SEQ ID NO: 3929336 - RNA, 15 nt, Shigella flexneri 2a str. 301
ggcgaucgccugaau

SEQ ID NO: 3929337 - RNA, 22 nt, Shigella flexneri 2a str. 301
ggcgaugaaacaaaucggcgcg

SEQ ID NO: 3929338 - RNA, 19 nt, Shigella flexneri 2a str. 301
ggcgaugauuacgcgcuca

SEQ ID NO: 3929339 - RNA, 21 nt, Shigella flexneri 2a str. 301
ggcgaugcuuugaccucccgc

SEQ ID NO: 3929340 - RNA, 13 nt, Shigella flexneri 2a str. 301
ggcgauuccacuc

SEQ ID NO: 3929341 - RNA, 16 nt, Shigella flexneri 2a str. 301
ggcgcaagggugccgg

SEQ ID NO: 3929342 - RNA, 16 nt, Shigella flexneri 2a str. 301
ggcgcaauggcgcaau

SEQ ID NO: 3929343 - RNA, 20 nt, Shigella flexneri 2a str. 301
ggcgcaauguugcgggggcu

SEQ ID NO: 3929344 - RNA, 17 nt, Shigella flexneri 2a str. 301
ggcgcaccaguucgccg

SEQ ID NO: 3929345 - RNA, 20 nt, Shigella flexneri 2a str. 301
ggcgcaccgauaaaggucga

SEQ ID NO: 3929346 - RNA, 23 nt, Shigella flexneri 2a str. 301
ggcgcacucaaaacuacaauguc

SEQ ID NO: 3929347 - RNA, 11 nt, Shigella flexneri 2a str. 301
ggcgcagcgcg

SEQ ID NO: 3929348 - RNA, 12 nt, Shigella flexneri 2a str. 301
ggcgcagcgcgc

SEQ ID NO: 3929349 - RNA, 15 nt, Shigella flexneri 2a str. 301
ggcgcaggauaucgu

SEQ ID NO: 3929350 - RNA, 15 nt, Shigella flexneri 2a str. 301
ggcgcaguaugacua

SEQ ID NO: 3929351 - RNA, 22 nt, Shigella flexneri 2a str. 301
ggcgcaucggucgaugaaagcg

SEQ ID NO: 3929352 - RNA, 22 nt, Shigella flexneri 2a str. 301
ggcgcaucuguuucgaucagca

SEQ ID NO: 3929353 - RNA, 17 nt, Shigella flexneri 2a str. 301
ggcgcauguuggcgcgg

SEQ ID NO: 3929354 - RNA, 17 nt, Shigella flexneri 2a str. 301
ggcgcgaaccaucaccu

SEQ ID NO: 3929355 - RNA, 19 nt, Shigella flexneri 2a str. 301
ggcgcgcagaaagaggcgg

SEQ ID NO: 3929356 - RNA, 12 nt, Shigella flexneri 2a str. 301
ggcgcgcgcuuu

SEQ ID NO: 3929357 - RNA, 14 nt, Shigella flexneri 2a str. 301
ggcgcggaaauggc

SEQ ID NO: 3929358 - RNA, 14 nt, Shigella flexneri 2a str. 301
ggcgcggcccuggg

SEQ ID NO: 3929359 - RNA, 15 nt, Shigella flexneri 2a str. 301
ggcgcgucagauuga

SEQ ID NO: 3929360 - RNA, 18 nt, Shigella flexneri 2a str. 301
ggcgcgucgaaaacggcu

SEQ ID NO: 3929361 - RNA, 16 nt, Shigella flexneri 2a str. 301
ggcgcuacgcuaucag

SEQ ID NO: 3929362 - RNA, 20 nt, Shigella flexneri 2a str. 301
ggcgcucugcccaugcuggu

SEQ ID NO: 3929363 - RNA, 17 nt, Shigella flexneri 2a str. 301
ggcgcugaugagcaaau

SEQ ID NO: 3929364 - RNA, 21 nt, Shigella flexneri 2a str. 301
ggcgcugcuguacuuuuuccu

SEQ ID NO: 3929365 - RNA, 20 nt, Shigella flexneri 2a str. 301
ggcggaaaucagagauuugc

SEQ ID NO: 3929366 - RNA, 22 nt, Shigella flexneri 2a str. 301
ggcggaauugguagacgcgcua

SEQ ID NO: 3929367 - RNA, 17 nt, Shigella flexneri 2a str. 301
ggcggauggaguggggc

SEQ ID NO: 3929368 - RNA, 14 nt, Shigella flexneri 2a str. 301
ggcggcaacauggc

SEQ ID NO: 3929369 - RNA, 19 nt, Shigella flexneri 2a str. 301
ggcggcaacauggcaaccu

SEQ ID NO: 3929370 - RNA, 14 nt, Shigella flexneri 2a str. 301
ggcggcaaucgcca

SEQ ID NO: 3929371 - RNA, 14 nt, Shigella flexneri 2a str. 301
ggcggcaaugaaag

SEQ ID NO: 3929372 - RNA, 14 nt, Shigella flexneri 2a str. 301
ggcggcacagccag

SEQ ID NO: 3929373 - RNA, 20 nt, Shigella flexneri 2a str. 301
ggcggcaguauagcggcaug

SEQ ID NO: 3929374 - RNA, 24 nt, Shigella flexneri 2a str. 301
ggcggccggaugacagacuccgcu

SEQ ID NO: 3929375 - RNA, 15 nt, Shigella flexneri 2a str. 301
ggcggcgcgaggcga

SEQ ID NO: 3929376 - RNA, 12 nt, Shigella flexneri 2a str. 301
ggcggcgcgcca

SEQ ID NO: 3929377 - RNA, 13 nt, Shigella flexneri 2a str. 301
ggcggcgcggcga

SEQ ID NO: 3929378 - RNA, 18 nt, Shigella flexneri 2a str. 301
ggcggcggcaacgucacc

SEQ ID NO: 3929379 - RNA, 21 nt, Shigella flexneri 2a str. 301
ggcggcucguuagacggcgcu

SEQ ID NO: 3929380 - RNA, 14 nt, Shigella flexneri 2a str. 301
ggcggcucuccuga

SEQ ID NO: 3929381 - RNA, 16 nt, Shigella flexneri 2a str. 301
ggcggcucuccugaac

SEQ ID NO: 3929382 - RNA, 13 nt, Shigella flexneri 2a str. 301
ggcggcuggcugg

SEQ ID NO: 3929383 - RNA, 14 nt, Shigella flexneri 2a str. 301
ggcggcuggcugga

SEQ ID NO: 3929384 - RNA, 19 nt, Shigella flexneri 2a str. 301
ggcggcuuaccugaucgac

SEQ ID NO: 3929385 - RNA, 12 nt, Shigella flexneri 2a str. 301
ggcgggaaaaau

SEQ ID NO: 3929386 - RNA, 18 nt, Shigella flexneri 2a str. 301
ggcgggaagaacggcaac

SEQ ID NO: 3929387 - RNA, 21 nt, Shigella flexneri 2a str. 301
ggcgggaucaccugcacaugc

SEQ ID NO: 3929388 - RNA, 20 nt, Shigella flexneri 2a str. 301
ggcuguugauguccaguucc

SEQ ID NO: 3929389 - RNA, 20 nt, Shigella flexneri 2a str. 301
ggcuguuucaggaacaccgc

SEQ ID NO: 3929390 - RNA, 15 nt, Shigella flexneri 2a str. 301
ggcuguuucuggaug

SEQ ID NO: 3929391 - RNA, 17 nt, Shigella flexneri 2a str. 301
ggcuguuuucagcacca

SEQ ID NO: 3929392 - RNA, 18 nt, Shigella flexneri 2a str. 301
ggcuuaaacgcagagaca

SEQ ID NO: 3929393 - RNA, 13 nt, Shigella flexneri 2a str. 301
ggcuuaauugccc

SEQ ID NO: 3929394 - RNA, 14 nt, Shigella flexneri 2a str. 301
ggcuuauccggcau

SEQ ID NO: 3929395 - RNA, 15 nt, Shigella flexneri 2a str. 301
ggcuuauccggcaug

SEQ ID NO: 3929396 - RNA, 12 nt, Shigella flexneri 2a str. 301
ggcuucaaagca

SEQ ID NO: 3929397 - RNA, 22 nt, Shigella flexneri 2a str. 301
ggcuucauccagcagugacuca

SEQ ID NO: 3929398 - RNA, 22 nt, Shigella flexneri 2a str. 301
ggcuucaucuuuccaaaccuca

SEQ ID NO: 3929399 - RNA, 13 nt, Shigella flexneri 2a str. 301
ggcuucgacgcuc

SEQ ID NO: 3929400 - RNA, 22 nt, Shigella flexneri 2a str. 301
ggcuucgccaaaucgcugcugc

SEQ ID NO: 3929401 - RNA, 15 nt, Shigella flexneri 2a str. 301
ggcuucguccaugcu

SEQ ID NO: 3929402 - RNA, 14 nt, Shigella flexneri 2a str. 301
ggcuucugccuuau

SEQ ID NO: 3929403 - RNA, 15 nt, Shigella flexneri 2a str. 301
ggcuugccagcaggg

SEQ ID NO: 3929404 - RNA, 12 nt, Shigella flexneri 2a str. 301
ggcuugccgggc

SEQ ID NO: 3929405 - RNA, 13 nt, Shigella flexneri 2a str. 301
ggcuugcgcgcaa

SEQ ID NO: 3929406 - RNA, 20 nt, Shigella flexneri 2a str. 301
ggcuugcugaugcacgcaga

SEQ ID NO: 3929407 - RNA, 12 nt, Shigella flexneri 2a str. 301
ggcuuggcuggc

SEQ ID NO: 3929408 - RNA, 13 nt, Shigella flexneri 2a str. 301
ggcuuuaaucacc

SEQ ID NO: 3929409 - RNA, 23 nt, Shigella flexneri 2a str. 301
ggcuuuaccaccgucaaaaaaac

SEQ ID NO: 3929410 - RNA, 15 nt, Shigella flexneri 2a str. 301
ggcuuuaucacugag

SEQ ID NO: 3929411 - RNA, 22 nt, Shigella flexneri 2a str. 301
ggcuuucaucacuugauccaua

SEQ ID NO: 3929412 - RNA, 23 nt, Shigella flexneri 2a str. 301
ggcuuucuucuggguugccugau

SEQ ID NO: 3929413 - RNA, 21 nt, Shigella flexneri 2a str. 301
ggcuuuguuacccccauccac

SEQ ID NO: 3929414 - RNA, 17 nt, Shigella flexneri 2a str. 301
ggcuuuuacgcauugcu

SEQ ID NO: 3929415 - RNA, 18 nt, Shigella flexneri 2a str. 301
ggcuuuuuacgcgacaca

SEQ ID NO: 3929416 - RNA, 20 nt, Shigella flexneri 2a str. 301
ggcuuuuuacuucucagcgu

SEQ ID NO: 3929417 - RNA, 19 nt, Shigella flexneri 2a str. 301
ggcuuuuuuacaucaucag

SEQ ID NO: 3929418 - RNA, 14 nt, Shigella flexneri 2a str. 301
ggcuuuuuuuugcc

SEQ ID NO: 3929419 - RNA, 18 nt, Shigella flexneri 2a str. 301
gggaaaacagcgcaccag

SEQ ID NO: 3929420 - RNA, 22 nt, Shigella flexneri 2a str. 301
gggaaauuaaaugguuaacaug

SEQ ID NO: 3929421 - RNA, 20 nt, Shigella flexneri 2a str. 301
gggaacaauugagauucaaa

SEQ ID NO: 3929422 - RNA, 12 nt, Shigella flexneri 2a str. 301
gggaacagaggc

SEQ ID NO: 3929423 - RNA, 22 nt, Shigella flexneri 2a str. 301
gggaacaguacauuguuuucca

SEQ ID NO: 3929424 - RNA, 13 nt, Shigella flexneri 2a str. 301
gggaacaucaggc

SEQ ID NO: 3929425 - RNA, 14 nt, Shigella flexneri 2a str. 301
gggaacuuaucauc

SEQ ID NO: 3929426 - RNA, 22 nt, Shigella flexneri 2a str. 301
gggaaggcccuuucccuucucg

SEQ ID NO: 3929427 - RNA, 17 nt, Shigella flexneri 2a str. 301
gggaaggucagguuuga

SEQ ID NO: 3929428 - RNA, 17 nt, Shigella flexneri 2a str. 301
gggaauaaaagccagga

SEQ ID NO: 3929429 - RNA, 14 nt, Shigella flexneri 2a str. 301
gggaauccagcaau

SEQ ID NO: 3929430 - RNA, 13 nt, Shigella flexneri 2a str. 301
gggacaugauuca

SEQ ID NO: 3929431 - RNA, 12 nt, Shigella flexneri 2a str. 301
gggacauuuagc

SEQ ID NO: 3929432 - RNA, 12 nt, Shigella flexneri 2a str. 301
gggaccagcauu

SEQ ID NO: 3929433 - RNA, 15 nt, Shigella flexneri 2a str. 301
gggacgcagacugga

SEQ ID NO: 3929434 - RNA, 22 nt, Shigella flexneri 2a str. 301
gggacgguccgugcgcuuuuua

SEQ ID NO: 3929435 - RNA, 15 nt, Shigella flexneri 2a str. 301
gggagagggccgggg

SEQ ID NO: 3929436 - RNA, 23 nt, Shigella flexneri 2a str. 301
gggagcgcuuuuuuccugccgcu

SEQ ID NO: 3929437 - RNA, 14 nt, Shigella flexneri 2a str. 301
gggaggauuucucc

SEQ ID NO: 3929438 - RNA, 15 nt, Shigella flexneri 2a str. 301
gggaggggcuuuccc

SEQ ID NO: 3929439 - RNA, 15 nt, Shigella flexneri 2a str. 301
gggauaaagcccccg

SEQ ID NO: 3929440 - RNA, 19 nt, Shigella flexneri 2a str. 301
gggauaaagcccccgcaac

SEQ ID NO: 3929441 - RNA, 19 nt, Shigella flexneri 2a str. 301
gggauagaaacagucugga

SEQ ID NO: 3929442 - RNA, 19 nt, Shigella flexneri 2a str. 301
gggaucaccuguucguccc

SEQ ID NO: 3929443 - RNA, 15 nt, Shigella flexneri 2a str. 301
gggaucagcuuuuua

SEQ ID NO: 3929444 - RNA, 15 nt, Shigella flexneri 2a str. 301
gggaucaucagcaaa

SEQ ID NO: 3929445 - RNA, 22 nt, Shigella flexneri 2a str. 301
gggaucugauucugauccugca

SEQ ID NO: 3929446 - RNA, 15 nt, Shigella flexneri 2a str. 301
gggaugaaaggcaag

SEQ ID NO: 3929447 - RNA, 17 nt, Shigella flexneri 2a str. 301
gggaugaaaggcaagca

SEQ ID NO: 3929448 - RNA, 19 nt, Shigella flexneri 2a str. 301
gggaugccgaaaaaaguca

SEQ ID NO: 3929449 - RNA, 19 nt, Shigella flexneri 2a str. 301
gggauguaauuaagcgcaa

SEQ ID NO: 3929450 - RNA, 20 nt, Shigella flexneri 2a str. 301
gggauuaaaaaguaagaauu

SEQ ID NO: 3929451 - RNA, 21 nt, Shigella flexneri 2a str. 301
gggcaaauucuucacggaaaa

SEQ ID NO: 3929452 - RNA, 16 nt, Shigella flexneri 2a str. 301
gggcaacuggagcagg

SEQ ID NO: 3929453 - RNA, 19 nt, Shigella flexneri 2a str. 301
gggcaagaauaucugcucc

SEQ ID NO: 3929454 - RNA, 15 nt, Shigella flexneri 2a str. 301
gggcaaucggcugca

SEQ ID NO: 3929455 - RNA, 21 nt, Shigella flexneri 2a str. 301
gggcaaugcgggugcaaucaa

SEQ ID NO: 3929456 - RNA, 21 nt, Shigella flexneri 2a str. 301
gggcacagauuuccaagcgcg

SEQ ID NO: 3929457 - RNA, 14 nt, Shigella flexneri 2a str. 301
gggcaccgccgccg

SEQ ID NO: 3929458 - RNA, 22 nt, Shigella flexneri 2a str. 301
gggcagacgccacaaucucacc

SEQ ID NO: 3929459 - RNA, 23 nt, Shigella flexneri 2a str. 301
gggcaggcuucaacacaggccgg

SEQ ID NO: 3929460 - RNA, 15 nt, Shigella flexneri 2a str. 301
gggcaucucaggcag

SEQ ID NO: 3929461 - RNA, 14 nt, Shigella flexneri 2a str. 301
gggcaugaguaaaa

SEQ ID NO: 3929462 - RNA, 17 nt, Shigella flexneri 2a str. 301
gggcauggcgcagcgau

SEQ ID NO: 3929463 - RNA, 18 nt, Shigella flexneri 2a str. 301
gggcauguguuagcccug

SEQ ID NO: 3929464 - RNA, 11 nt, Shigella flexneri 2a str. 301
gggcauuugca

SEQ ID NO: 3929465 - RNA, 22 nt, Shigella flexneri 2a str. 301
gggcauuuucaagugacauacu

SEQ ID NO: 3929466 - RNA, 13 nt, Shigella flexneri 2a str. 301
gggccaauaccug

SEQ ID NO: 3929467 - RNA, 20 nt, Shigella flexneri 2a str. 301
gggccaauugcugugccgga

SEQ ID NO: 3929468 - RNA, 18 nt, Shigella flexneri 2a str. 301
gggccgaacaucagauaa

SEQ ID NO: 3929469 - RNA, 15 nt, Shigella flexneri 2a str. 301
gggccguaauauuuc

SEQ ID NO: 3929470 - RNA, 15 nt, Shigella flexneri 2a str. 301
gggccugaacaagca

SEQ ID NO: 3929471 - RNA, 21 nt, Shigella flexneri 2a str. 301
gggcgaauuaucggcagcggc

SEQ ID NO: 3929472 - RNA, 17 nt, Shigella flexneri 2a str. 301
gggcgacaaucaucgcc

SEQ ID NO: 3929473 - RNA, 14 nt, Shigella flexneri 2a str. 301
gggcgacauuuagu

SEQ ID NO: 3929474 - RNA, 18 nt, Shigella flexneri 2a str. 301
gggcgagguggauauaaa

SEQ ID NO: 3929475 - RNA, 20 nt, Shigella flexneri 2a str. 301
gggcgauaaaucuccacccg

SEQ ID NO: 3929476 - RNA, 14 nt, Shigella flexneri 2a str. 301
gggcgauuuccuuc

SEQ ID NO: 3929477 - RNA, 16 nt, Shigella flexneri 2a str. 301
gggcgauuugcucccg

SEQ ID NO: 3929478 - RNA, 13 nt, Shigella flexneri 2a str. 301
gggcgcgcucagc

SEQ ID NO: 3929479 - RNA, 18 nt, Shigella flexneri 2a str. 301
gggcgcggaaagcaccug

SEQ ID NO: 3929480 - RNA, 19 nt, Shigella flexneri 2a str. 301
gggcgcguccggcgucgcu

SEQ ID NO: 3929481 - RNA, 20 nt, Shigella flexneri 2a str. 301
gggcggaacuucgcgaguga

SEQ ID NO: 3929482 - RNA, 13 nt, Shigella flexneri 2a str. 301
gggcggcgggcga

SEQ ID NO: 3929483 - RNA, 21 nt, Shigella flexneri 2a str. 301
gggcguagacauauaacccca

SEQ ID NO: 3929484 - RNA, 17 nt, Shigella flexneri 2a str. 301
gggcguuacagcuggag

SEQ ID NO: 3929485 - RNA, 20 nt, Shigella flexneri 2a str. 301
gggcucgggcaaauccacug

SEQ ID NO: 3929486 - RNA, 21 nt, Shigella flexneri 2a str. 301
gggcugacauuaucagacacc

SEQ ID NO: 3929487 - RNA, 16 nt, Shigella flexneri 2a str. 301
gggcuggauuuuuccg

SEQ ID NO: 3929488 - RNA, 21 nt, Shigella flexneri 2a str. 301
ggucagaacgaccaguucaca

SEQ ID NO: 3929489 - RNA, 11 nt, Shigella flexneri 2a str. 301
ggucagacaac

SEQ ID NO: 3929490 - RNA, 13 nt, Shigella flexneri 2a str. 301
ggucagacccagu

SEQ ID NO: 3929491 - RNA, 22 nt, Shigella flexneri 2a str. 301
ggucagagagccagccccacag

SEQ ID NO: 3929492 - RNA, 14 nt, Shigella flexneri 2a str. 301
ggucagaucagcca

SEQ ID NO: 3929493 - RNA, 22 nt, Shigella flexneri 2a str. 301
ggucagcaggagcagccccugc

SEQ ID NO: 3929494 - RNA, 14 nt, Shigella flexneri 2a str. 301
ggucagccagcggc

SEQ ID NO: 3929495 - RNA, 16 nt, Shigella flexneri 2a str. 301
ggucaggcuaaagaaa

SEQ ID NO: 3929496 - RNA, 15 nt, Shigella flexneri 2a str. 301
ggucaguuggcuggg

SEQ ID NO: 3929497 - RNA, 16 nt, Shigella flexneri 2a str. 301
ggucauaggccgcuga

SEQ ID NO: 3929498 - RNA, 20 nt, Shigella flexneri 2a str. 301
ggucaucaaucauuuuuuga

SEQ ID NO: 3929499 - RNA, 20 nt, Shigella flexneri 2a str. 301
ggucaucacaucccagcaga

SEQ ID NO: 3929500 - RNA, 21 nt, Shigella flexneri 2a str. 301
ggucaucacuuuugaaaucaa

SEQ ID NO: 3929501 - RNA, 18 nt, Shigella flexneri 2a str. 301
ggucauuaugaccguuca

SEQ ID NO: 3929502 - RNA, 22 nt, Shigella flexneri 2a str. 301
ggucauuuucuucagcaguuca

SEQ ID NO: 3929503 - RNA, 19 nt, Shigella flexneri 2a str. 301
ggucccucaacaacagucu

SEQ ID NO: 3929504 - RNA, 19 nt, Shigella flexneri 2a str. 301
gguccuaacaaccaucccc

SEQ ID NO: 3929505 - RNA, 12 nt, Shigella flexneri 2a str. 301
gguccuucaggc

SEQ ID NO: 3929506 - RNA, 12 nt, Shigella flexneri 2a str. 301
gguccuucaucu

SEQ ID NO: 3929507 - RNA, 14 nt, Shigella flexneri 2a str. 301
ggucgacagcagcc

SEQ ID NO: 3929508 - RNA, 17 nt, Shigella flexneri 2a str. 301
ggucgauuaaauucacc

SEQ ID NO: 3929509 - RNA, 21 nt, Shigella flexneri 2a str. 301
ggucgauuaaauucaccaguu

SEQ ID NO: 3929510 - RNA, 16 nt, Shigella flexneri 2a str. 301
ggucgccagaagguga

SEQ ID NO: 3929511 - RNA, 23 nt, Shigella flexneri 2a str. 301
ggucggauaaggcgcucgcgccg

SEQ ID NO: 3929512 - RNA, 15 nt, Shigella flexneri 2a str. 301
ggucggcaaacugcu

SEQ ID NO: 3929513 - RNA, 17 nt, Shigella flexneri 2a str. 301
ggucggcaaacugcuga

SEQ ID NO: 3929514 - RNA, 17 nt, Shigella flexneri 2a str. 301
ggucggcuucccugcgg

SEQ ID NO: 3929515 - RNA, 16 nt, Shigella flexneri 2a str. 301
ggucgucuuuuacagc

SEQ ID NO: 3929516 - RNA, 13 nt, Shigella flexneri 2a str. 301
ggucgugcagaac

SEQ ID NO: 3929517 - RNA, 21 nt, Shigella flexneri 2a str. 301
ggucgugcgguuucagcucac

SEQ ID NO: 3929518 - RNA, 22 nt, Shigella flexneri 2a str. 301
ggucguucgcccauuccaguaa

SEQ ID NO: 3929519 - RNA, 14 nt, Shigella flexneri 2a str. 301
ggucugacgcugaa

SEQ ID NO: 3929520 - RNA, 13 nt, Shigella flexneri 2a str. 301
ggucugcaaaaug

SEQ ID NO: 3929521 - RNA, 22 nt, Shigella flexneri 2a str. 301
ggucugcagauauucaugcagg

SEQ ID NO: 3929522 - RNA, 18 nt, Shigella flexneri 2a str. 301
ggucugcaugacggcuga

SEQ ID NO: 3929523 - RNA, 14 nt, Shigella flexneri 2a str. 301
ggucugccaacuuu

SEQ ID NO: 3929524 - RNA, 22 nt, Shigella flexneri 2a str. 301
ggucugccauaauauugauaau

SEQ ID NO: 3929525 - RNA, 18 nt, Shigella flexneri 2a str. 301
ggucugcggaucauggua

SEQ ID NO: 3929526 - RNA, 18 nt, Shigella flexneri 2a str. 301
ggucugcuggaacuggcu

SEQ ID NO: 3929527 - RNA, 15 nt, Shigella flexneri 2a str. 301
ggucuggaacuggcu

SEQ ID NO: 3929528 - RNA, 17 nt, Shigella flexneri 2a str. 301
ggucuggaacuggcugc

SEQ ID NO: 3929529 - RNA, 18 nt, Shigella flexneri 2a str. 301
ggucuggcaaaaauaagg

SEQ ID NO: 3929530 - RNA, 13 nt, Shigella flexneri 2a str. 301
ggucuggcgacgg

SEQ ID NO: 3929531 - RNA, 18 nt, Shigella flexneri 2a str. 301
ggucuuagugcgcuguaa

SEQ ID NO: 3929532 - RNA, 20 nt, Shigella flexneri 2a str. 301
ggucuuuuaaauccugcaca

SEQ ID NO: 3929533 - RNA, 12 nt, Shigella flexneri 2a str. 301
ggugaaaaaaag

SEQ ID NO: 3929534 - RNA, 17 nt, Shigella flexneri 2a str. 301
ggugaaaguaaaaaaga

SEQ ID NO: 3929535 - RNA, 22 nt, Shigella flexneri 2a str. 301
ggugaaaguaacaaagccugca

SEQ ID NO: 3929536 - RNA, 13 nt, Shigella flexneri 2a str. 301
ggugaaccagaga

SEQ ID NO: 3929537 - RNA, 18 nt, Shigella flexneri 2a str. 301
ggugaagcgcccugcaau

SEQ ID NO: 3929538 - RNA, 13 nt, Shigella flexneri 2a str. 301
ggugaaggcaaac

SEQ ID NO: 3929539 - RNA, 16 nt, Shigella flexneri 2a str. 301
ggugaaggcaaacugu

SEQ ID NO: 3929540 - RNA, 18 nt, Shigella flexneri 2a str. 301
ggugaccgaucgcccgcc

SEQ ID NO: 3929541 - RNA, 19 nt, Shigella flexneri 2a str. 301
ggugacgcaaccgcaaaug

SEQ ID NO: 3929542 - RNA, 17 nt, Shigella flexneri 2a str. 301
ggugacgcgggcagcag

SEQ ID NO: 3929543 - RNA, 20 nt, Shigella flexneri 2a str. 301
ggugagggaggauuucuccc

SEQ ID NO: 3929544 - RNA, 23 nt, Shigella flexneri 2a str. 301
ggugauaaucaucccacaugaau

SEQ ID NO: 3929545 - RNA, 22 nt, Shigella flexneri 2a str. 301
ggugauacguccaccccagcag

SEQ ID NO: 3929546 - RNA, 17 nt, Shigella flexneri 2a str. 301
ggugaucaccaguaaca

SEQ ID NO: 3929547 - RNA, 15 nt, Shigella flexneri 2a str. 301
ggugaucagccccgg

SEQ ID NO: 3929548 - RNA, 19 nt, Shigella flexneri 2a str. 301
ggugaugaucgcgcugauu

SEQ ID NO: 3929549 - RNA, 14 nt, Shigella flexneri 2a str. 301
ggugaugguuucau

SEQ ID NO: 3929550 - RNA, 19 nt, Shigella flexneri 2a str. 301
ggugauguuuaucgucugg

SEQ ID NO: 3929551 - RNA, 12 nt, Shigella flexneri 2a str. 301
ggugauuacauc

SEQ ID NO: 3929552 - RNA, 23 nt, Shigella flexneri 2a str. 301
ggugauuuugccugugcaaccuu

SEQ ID NO: 3929553 - RNA, 17 nt, Shigella flexneri 2a str. 301
ggugcaacccgccaggu

SEQ ID NO: 3929554 - RNA, 22 nt, Shigella flexneri 2a str. 301
ggugcaagaaaugacagaguuc

SEQ ID NO: 3929555 - RNA, 20 nt, Shigella flexneri 2a str. 301
ggugcacaacaaucugcaaa

SEQ ID NO: 3929556 - RNA, 15 nt, Shigella flexneri 2a str. 301
ggugcagaaucaauc

SEQ ID NO: 3929557 - RNA, 22 nt, Shigella flexneri 2a str. 301
ggugcagacaugacgcccggca

SEQ ID NO: 3929558 - RNA, 12 nt, Shigella flexneri 2a str. 301
ggugcagccgug

SEQ ID NO: 3929559 - RNA, 20 nt, Shigella flexneri 2a str. 301
ggugcaguggcuccagcgca

SEQ ID NO: 3929560 - RNA, 22 nt, Shigella flexneri 2a str. 301
ggugcaucggggaauugugcuu

SEQ ID NO: 3929561 - RNA, 17 nt, Shigella flexneri 2a str. 301
ggugccagcaacuggcg

SEQ ID NO: 3929562 - RNA, 20 nt, Shigella flexneri 2a str. 301
ggugccauugaccagcugcc

SEQ ID NO: 3929563 - RNA, 16 nt, Shigella flexneri 2a str. 301
ggugccgugaagaaac

SEQ ID NO: 3929564 - RNA, 20 nt, Shigella flexneri 2a str. 301
ggugccgugaagaaacuucu

SEQ ID NO: 3929565 - RNA, 13 nt, Shigella flexneri 2a str. 301
ggugccuuaccgc

SEQ ID NO: 3929566 - RNA, 19 nt, Shigella flexneri 2a str. 301
ggugccuuauccgacauuu

SEQ ID NO: 3929567 - RNA, 23 nt, Shigella flexneri 2a str. 301
ggugccuugugaguuccgcugcu

SEQ ID NO: 3929568 - RNA, 16 nt, Shigella flexneri 2a str. 301
ggugcgaugaacgccu

SEQ ID NO: 3929569 - RNA, 15 nt, Shigella flexneri 2a str. 301
ggugcguugaagaua

SEQ ID NO: 3929570 - RNA, 22 nt, Shigella flexneri 2a str. 301
ggugcuuuaacgaaagcgccuc

SEQ ID NO: 3929571 - RNA, 14 nt, Shigella flexneri 2a str. 301
gguggcaaagaaau

SEQ ID NO: 3929572 - RNA, 15 nt, Shigella flexneri 2a str. 301
gguggccauccgcgu

SEQ ID NO: 3929573 - RNA, 18 nt, Shigella flexneri 2a str. 301
gguggcggaauugguaga

SEQ ID NO: 3929574 - RNA, 11 nt, Shigella flexneri 2a str. 301
gguggcggcgc

SEQ ID NO: 3929575 - RNA, 13 nt, Shigella flexneri 2a str. 301
gguggcgguaaca

SEQ ID NO: 3929576 - RNA, 12 nt, Shigella flexneri 2a str. 301
ggugggcggcgu

SEQ ID NO: 3929577 - RNA, 16 nt, Shigella flexneri 2a str. 301
ggugggcuacggcaug

SEQ ID NO: 3929578 - RNA, 13 nt, Shigella flexneri 2a str. 301
ggugggggaagga

SEQ ID NO: 3929579 - RNA, 21 nt, Shigella flexneri 2a str. 301
gguguaaugccagucaguuaa

SEQ ID NO: 3929580 - RNA, 20 nt, Shigella flexneri 2a str. 301
ggugucguauucucaauaaa

SEQ ID NO: 3929581 - RNA, 18 nt, Shigella flexneri 2a str. 301
gguguucggcauucugcu

SEQ ID NO: 3929582 - RNA, 22 nt, Shigella flexneri 2a str. 301
gguguugcguuuuuaucuucac

SEQ ID NO: 3929583 - RNA, 18 nt, Shigella flexneri 2a str. 301
gguuaacaagcggacuuc

SEQ ID NO: 3929584 - RNA, 20 nt, Shigella flexneri 2a str. 301
gguuaacaaucacaauagaa

SEQ ID NO: 3929585 - RNA, 18 nt, Shigella flexneri 2a str. 301
gguuaacaucaugucggc

SEQ ID NO: 3929586 - RNA, 17 nt, Shigella flexneri 2a str. 301
gguuaaccuuuaaucag

SEQ ID NO: 3929587 - RNA, 17 nt, Shigella flexneri 2a str. 301
gguuaacuguggcguua

SEQ ID NO: 3929588 - RNA, 14 nt, Shigella flexneri 2a str. 301
guaaaucaaaccaa

SEQ ID NO: 3929589 - RNA, 14 nt, Shigella flexneri 2a str. 301
guaaaugagcguuu

SEQ ID NO: 3929590 - RNA, 14 nt, Shigella flexneri 2a str. 301
guaaaugcagauaa

SEQ ID NO: 3929591 - RNA, 19 nt, Shigella flexneri 2a str. 301
guaaauucucaauaucauc

SEQ ID NO: 3929592 - RNA, 20 nt, Shigella flexneri 2a str. 301
guaaauugcaaaccucagga

SEQ ID NO: 3929593 - RNA, 15 nt, Shigella flexneri 2a str. 301
guaaauugccccaga

SEQ ID NO: 3929594 - RNA, 16 nt, Shigella flexneri 2a str. 301
guaacaauauuugcag

SEQ ID NO: 3929595 - RNA, 20 nt, Shigella flexneri 2a str. 301
guaacagaacgcauaacagc

SEQ ID NO: 3929596 - RNA, 16 nt, Shigella flexneri 2a str. 301
guaacagagcaucggu

SEQ ID NO: 3929597 - RNA, 15 nt, Shigella flexneri 2a str. 301
guaacagcggacggc

SEQ ID NO: 3929598 - RNA, 16 nt, Shigella flexneri 2a str. 301
guaacagucaguuauc

SEQ ID NO: 3929599 - RNA, 22 nt, Shigella flexneri 2a str. 301
guaacauaccuaaaagcacgcc

SEQ ID NO: 3929600 - RNA, 22 nt, Shigella flexneri 2a str. 301
guaacauccagaucacgcagca

SEQ ID NO: 3929601 - RNA, 14 nt, Shigella flexneri 2a str. 301
guaacaucccugua

SEQ ID NO: 3929602 - RNA, 14 nt, Shigella flexneri 2a str. 301
guaacauuacgugg

SEQ ID NO: 3929603 - RNA, 23 nt, Shigella flexneri 2a str. 301
guaaccaaacguggucgccagca

SEQ ID NO: 3929604 - RNA, 22 nt, Shigella flexneri 2a str. 301
guaaccagcgcagacaccagaa

SEQ ID NO: 3929605 - RNA, 18 nt, Shigella flexneri 2a str. 301
guaacccccaaauaaccc

SEQ ID NO: 3929606 - RNA, 16 nt, Shigella flexneri 2a str. 301
guaaccggaaauaaac

SEQ ID NO: 3929607 - RNA, 18 nt, Shigella flexneri 2a str. 301
guaaccggaaauaaacuu

SEQ ID NO: 3929608 - RNA, 16 nt, Shigella flexneri 2a str. 301
guaacgaccaccaccg

SEQ ID NO: 3929609 - RNA, 13 nt, Shigella flexneri 2a str. 301
guaacgacugcgg

SEQ ID NO: 3929610 - RNA, 13 nt, Shigella flexneri 2a str. 301
guaacgaucgccu

SEQ ID NO: 3929611 - RNA, 19 nt, Shigella flexneri 2a str. 301
guaacgauggcaauuuuca

SEQ ID NO: 3929612 - RNA, 22 nt, Shigella flexneri 2a str. 301
guaacgcacacauccacaaugc

SEQ ID NO: 3929613 - RNA, 14 nt, Shigella flexneri 2a str. 301
guaacgcaccaggc

SEQ ID NO: 3929614 - RNA, 18 nt, Shigella flexneri 2a str. 301
guaacgcacugguggugc

SEQ ID NO: 3929615 - RNA, 20 nt, Shigella flexneri 2a str. 301
guaacgccuuuuccagcgcg

SEQ ID NO: 3929616 - RNA, 21 nt, Shigella flexneri 2a str. 301
guaacguagcgggaagugaaa

SEQ ID NO: 3929617 - RNA, 16 nt, Shigella flexneri 2a str. 301
guaacucacugaugcc

SEQ ID NO: 3929618 - RNA, 17 nt, Shigella flexneri 2a str. 301
guaacugucuucaccau

SEQ ID NO: 3929619 - RNA, 15 nt, Shigella flexneri 2a str. 301
guaagaacaagcaaa

SEQ ID NO: 3929620 - RNA, 14 nt, Shigella flexneri 2a str. 301
guaagaacguaaau

SEQ ID NO: 3929621 - RNA, 15 nt, Shigella flexneri 2a str. 301
guaagagaacagaua

SEQ ID NO: 3929622 - RNA, 22 nt, Shigella flexneri 2a str. 301
guaagaggaauugauucaucaa

SEQ ID NO: 3929623 - RNA, 16 nt, Shigella flexneri 2a str. 301
guaagaguuucaacau

SEQ ID NO: 3929624 - RNA, 21 nt, Shigella flexneri 2a str. 301
guaagaguuucaacaucaucu

SEQ ID NO: 3929625 - RNA, 15 nt, Shigella flexneri 2a str. 301
guaagcaaaggugcc

SEQ ID NO: 3929626 - RNA, 18 nt, Shigella flexneri 2a str. 301
guaagccuuucaggaaac

SEQ ID NO: 3929627 - RNA, 23 nt, Shigella flexneri 2a str. 301
guaagcgauaaaaauaccgagca

SEQ ID NO: 3929628 - RNA, 15 nt, Shigella flexneri 2a str. 301
guaagcgccagggca

SEQ ID NO: 3929629 - RNA, 16 nt, Shigella flexneri 2a str. 301
guaagcgccagggcau

SEQ ID NO: 3929630 - RNA, 20 nt, Shigella flexneri 2a str. 301
guaagcgcguguuacuggaa

SEQ ID NO: 3929631 - RNA, 15 nt, Shigella flexneri 2a str. 301
guaagcguacagcga

SEQ ID NO: 3929632 - RNA, 22 nt, Shigella flexneri 2a str. 301
guaagcugugcgauagcaacga

SEQ ID NO: 3929633 - RNA, 14 nt, Shigella flexneri 2a str. 301
guaaggcaucuucu

SEQ ID NO: 3929634 - RNA, 14 nt, Shigella flexneri 2a str. 301
guaaguaagauaaa

SEQ ID NO: 3929635 - RNA, 22 nt, Shigella flexneri 2a str. 301
guaaguacauuaaaauuggcuu

SEQ ID NO: 3929636 - RNA, 13 nt, Shigella flexneri 2a str. 301
guaaguacgccau

SEQ ID NO: 3929637 - RNA, 13 nt, Shigella flexneri 2a str. 301
guaaguccauacu

SEQ ID NO: 3929638 - RNA, 13 nt, Shigella flexneri 2a str. 301
guaaguggaugcc

SEQ ID NO: 3929639 - RNA, 17 nt, Shigella flexneri 2a str. 301
guaaguuagaggcacau

SEQ ID NO: 3929640 - RNA, 13 nt, Shigella flexneri 2a str. 301
guaaguuuaaccu

SEQ ID NO: 3929641 - RNA, 16 nt, Shigella flexneri 2a str. 301
guaauaaaaucuauua

SEQ ID NO: 3929642 - RNA, 19 nt, Shigella flexneri 2a str. 301
guaauaaaaucuauuauua

SEQ ID NO: 3929643 - RNA, 19 nt, Shigella flexneri 2a str. 301
guaauaaagcccccuguuu

SEQ ID NO: 3929644 - RNA, 16 nt, Shigella flexneri 2a str. 301
guaauaaccaacggcg

SEQ ID NO: 3929645 - RNA, 13 nt, Shigella flexneri 2a str. 301
guaauaacucacc

SEQ ID NO: 3929646 - RNA, 21 nt, Shigella flexneri 2a str. 301
guaauaacucacccaugaaga

SEQ ID NO: 3929647 - RNA, 15 nt, Shigella flexneri 2a str. 301
guaauaacuuccuga

SEQ ID NO: 3929648 - RNA, 17 nt, Shigella flexneri 2a str. 301
guaauaccagccuucuu

SEQ ID NO: 3929649 - RNA, 20 nt, Shigella flexneri 2a str. 301
guaauagauccuuuuuccca

SEQ ID NO: 3929650 - RNA, 20 nt, Shigella flexneri 2a str. 301
guaauaggcaggcaucauca

SEQ ID NO: 3929651 - RNA, 17 nt, Shigella flexneri 2a str. 301
guaaucaacauauuccc

SEQ ID NO: 3929652 - RNA, 20 nt, Shigella flexneri 2a str. 301
guaaucaacauauuccccug

SEQ ID NO: 3929653 - RNA, 18 nt, Shigella flexneri 2a str. 301
guaaucaacuccgccagc

SEQ ID NO: 3929654 - RNA, 20 nt, Shigella flexneri 2a str. 301
guaaucaacuccgccagcaa

SEQ ID NO: 3929655 - RNA, 18 nt, Shigella flexneri 2a str. 301
guaaucaaugcguucucc

SEQ ID NO: 3929656 - RNA, 12 nt, Shigella flexneri 2a str. 301
guaaucaccaca

SEQ ID NO: 3929657 - RNA, 14 nt, Shigella flexneri 2a str. 301
guaaucaccacaug

SEQ ID NO: 3929658 - RNA, 18 nt, Shigella flexneri 2a str. 301
guaaucaccacccauuuu

SEQ ID NO: 3929659 - RNA, 18 nt, Shigella flexneri 2a str. 301
guaaucacgaauacguaa

SEQ ID NO: 3929660 - RNA, 23 nt, Shigella flexneri 2a str. 301
guaauccgggugaacugccacac

SEQ ID NO: 3929661 - RNA, 15 nt, Shigella flexneri 2a str. 301
guaaucgacaacgca

SEQ ID NO: 3929662 - RNA, 14 nt, Shigella flexneri 2a str. 301
guaaucgccagcaa

SEQ ID NO: 3929663 - RNA, 19 nt, Shigella flexneri 2a str. 301
guaaucgccagcaaaauca

SEQ ID NO: 3929664 - RNA, 22 nt, Shigella flexneri 2a str. 301
guaaucgcccgcuuccagcgca

SEQ ID NO: 3929665 - RNA, 17 nt, Shigella flexneri 2a str. 301
guaaucguauucaacgg

SEQ ID NO: 3929666 - RNA, 21 nt, Shigella flexneri 2a str. 301
guaaugaacuccggagaguau

SEQ ID NO: 3929667 - RNA, 15 nt, Shigella flexneri 2a str. 301
guaaugacuccaacu

SEQ ID NO: 3929668 - RNA, 19 nt, Shigella flexneri 2a str. 301
guaaugacuccaacuuacu

SEQ ID NO: 3929669 - RNA, 14 nt, Shigella flexneri 2a str. 301
guaaugauacuaua

SEQ ID NO: 3929670 - RNA, 14 nt, Shigella flexneri 2a str. 301
guaaugaucgcgau

SEQ ID NO: 3929671 - RNA, 21 nt, Shigella flexneri 2a str. 301
guaaugccugggcgauuuccu

SEQ ID NO: 3929672 - RNA, 19 nt, Shigella flexneri 2a str. 301
guaaugccuuugaaaucga

SEQ ID NO: 3929673 - RNA, 23 nt, Shigella flexneri 2a str. 301
guaaugcggucguaaucgcccgc

SEQ ID NO: 3929674 - RNA, 14 nt, Shigella flexneri 2a str. 301
guaaugcucaauuc

SEQ ID NO: 3929675 - RNA, 12 nt, Shigella flexneri 2a str. 301
guaauggucagu

SEQ ID NO: 3929676 - RNA, 21 nt, Shigella flexneri 2a str. 301
guaaugucggugaaaguaacu

SEQ ID NO: 3929677 - RNA, 19 nt, Shigella flexneri 2a str. 301
guaauguucccugcgccag

SEQ ID NO: 3929678 - RNA, 19 nt, Shigella flexneri 2a str. 301
guaauguuuagagacgcau

SEQ ID NO: 3929679 - RNA, 19 nt, Shigella flexneri 2a str. 301
guaauuaacuuuucauccu

SEQ ID NO: 3929680 - RNA, 14 nt, Shigella flexneri 2a str. 301
guaauuaagcccgg

SEQ ID NO: 3929681 - RNA, 22 nt, Shigella flexneri 2a str. 301
guaauuaagcgcaaaggccagc

SEQ ID NO: 3929682 - RNA, 17 nt, Shigella flexneri 2a str. 301
guaauuaguggcuaacc

SEQ ID NO: 3929683 - RNA, 13 nt, Shigella flexneri 2a str. 301
guaauucagccau

SEQ ID NO: 3929684 - RNA, 14 nt, Shigella flexneri 2a str. 301
guaauucaguaacg

SEQ ID NO: 3929685 - RNA, 21 nt, Shigella flexneri 2a str. 301
guaauugagaaccacaaugaa

SEQ ID NO: 3929686 - RNA, 20 nt, Shigella flexneri 2a str. 301
guaauugcuuuuaccauacu

SEQ ID NO: 3929687 - RNA, 22 nt, Shigella flexneri 2a str. 301
guaauugcuuuuaccauacugg

SEQ ID NO: 3929688 - RNA, 19 nt, Shigella flexneri 2a str. 301
guagagguuauaaauaaaa

SEQ ID NO: 3929689 - RNA, 18 nt, Shigella flexneri 2a str. 301
guagcacgucaucugcac

SEQ ID NO: 3929690 - RNA, 15 nt, Shigella flexneri 2a str. 301
guagcaggccggaga

SEQ ID NO: 3929691 - RNA, 19 nt, Shigella flexneri 2a str. 301
guagcagguaaucugccau

SEQ ID NO: 3929692 - RNA, 22 nt, Shigella flexneri 2a str. 301
guagcagguaaucugccauauu

SEQ ID NO: 3929693 - RNA, 13 nt, Shigella flexneri 2a str. 301
guagcaugaacca

SEQ ID NO: 3929694 - RNA, 23 nt, Shigella flexneri 2a str. 301
guagccaaucccggaagccacca

SEQ ID NO: 3929695 - RNA, 20 nt, Shigella flexneri 2a str. 301
guagccaugaugaacaaccc

SEQ ID NO: 3929696 - RNA, 14 nt, Shigella flexneri 2a str. 301
guagccauucccuc

SEQ ID NO: 3929697 - RNA, 17 nt, Shigella flexneri 2a str. 301
guagccauuugauucac

SEQ ID NO: 3929698 - RNA, 23 nt, Shigella flexneri 2a str. 301
guagccauuugauucacaaggcc

SEQ ID NO: 3929699 - RNA, 21 nt, Shigella flexneri 2a str. 301
guagccccaauguucguccau

SEQ ID NO: 3929700 - RNA, 17 nt, Shigella flexneri 2a str. 301
guagccuuuuucagccg

SEQ ID NO: 3929701 - RNA, 17 nt, Shigella flexneri 2a str. 301
guagcgggaaagcguau

SEQ ID NO: 3929702 - RNA, 15 nt, Shigella flexneri 2a str. 301
guagcgucgccagca

SEQ ID NO: 3929703 - RNA, 17 nt, Shigella flexneri 2a str. 301
guagcguuaccagcaaa

SEQ ID NO: 3929704 - RNA, 20 nt, Shigella flexneri 2a str. 301
guagcuaccuugcucggcgc

SEQ ID NO: 3929705 - RNA, 19 nt, Shigella flexneri 2a str. 301
guagcuacgcaucaacugc

SEQ ID NO: 3929706 - RNA, 20 nt, Shigella flexneri 2a str. 301
guagcucaucuucauaacuu

SEQ ID NO: 3929707 - RNA, 14 nt, Shigella flexneri 2a str. 301
guagcucuggguaa

SEQ ID NO: 3929708 - RNA, 23 nt, Shigella flexneri 2a str. 301
guagcugaaaaucagauccgcac

SEQ ID NO: 3929709 - RNA, 20 nt, Shigella flexneri 2a str. 301
guagcuggcggcaaugaaag

SEQ ID NO: 3929710 - RNA, 15 nt, Shigella flexneri 2a str. 301
guagcuuucaacgcu

SEQ ID NO: 3929711 - RNA, 22 nt, Shigella flexneri 2a str. 301
guagcuuuucauguacucguaa

SEQ ID NO: 3929712 - RNA, 18 nt, Shigella flexneri 2a str. 301
guaggaucacaagaccua

SEQ ID NO: 3929713 - RNA, 17 nt, Shigella flexneri 2a str. 301
guaggaucagaauucca

SEQ ID NO: 3929714 - RNA, 19 nt, Shigella flexneri 2a str. 301
guaggccagauaagacgcg

SEQ ID NO: 3929715 - RNA, 19 nt, Shigella flexneri 2a str. 301
guaggccagauaaggcguu

SEQ ID NO: 3929716 - RNA, 18 nt, Shigella flexneri 2a str. 301
guaggccggauaaggcgc

SEQ ID NO: 3929717 - RNA, 19 nt, Shigella flexneri 2a str. 301
guaggccggauaaggcguu

SEQ ID NO: 3929718 - RNA, 22 nt, Shigella flexneri 2a str. 301
guaggccuaguccguaggcagg

SEQ ID NO: 3929719 - RNA, 17 nt, Shigella flexneri 2a str. 301
guaggccugagaagcgc

SEQ ID NO: 3929720 - RNA, 20 nt, Shigella flexneri 2a str. 301
guaggccugagaagcgcaac

SEQ ID NO: 3929721 - RNA, 14 nt, Shigella flexneri 2a str. 301
guaggccugauaag

SEQ ID NO: 3929722 - RNA, 19 nt, Shigella flexneri 2a str. 301
guaggccugauaagcguag

SEQ ID NO: 3929723 - RNA, 18 nt, Shigella flexneri 2a str. 301
guaggcggauaaggcguu

SEQ ID NO: 3929724 - RNA, 12 nt, Shigella flexneri 2a str. 301
guaggcuggaua

SEQ ID NO: 3929725 - RNA, 19 nt, Shigella flexneri 2a str. 301
guaggcuggauaaggcguu

SEQ ID NO: 3929726 - RNA, 17 nt, Shigella flexneri 2a str. 301
guaggucgccacaccgg

SEQ ID NO: 3929727 - RNA, 20 nt, Shigella flexneri 2a str. 301
guaggucggauaagacgcgg

SEQ ID NO: 3929728 - RNA, 11 nt, Shigella flexneri 2a str. 301
guagguuuugg

SEQ ID NO: 3929729 - RNA, 16 nt, Shigella flexneri 2a str. 301
guaguauuugaguuca

SEQ ID NO: 3929730 - RNA, 22 nt, Shigella flexneri 2a str. 301
guaguauuugaguucacugccg

SEQ ID NO: 3929731 - RNA, 15 nt, Shigella flexneri 2a str. 301
guagugaaggcaaac

SEQ ID NO: 3929732 - RNA, 15 nt, Shigella flexneri 2a str. 301
guagugcccgcagua

SEQ ID NO: 3929733 - RNA, 15 nt, Shigella flexneri 2a str. 301
guagugccgucagca

SEQ ID NO: 3929734 - RNA, 14 nt, Shigella flexneri 2a str. 301
guaguggccacaga

SEQ ID NO: 3929735 - RNA, 23 nt, Shigella flexneri 2a str. 301
guaguucuuucucugcaaauauu

SEQ ID NO: 3929736 - RNA, 16 nt, Shigella flexneri 2a str. 301
guaguugcccuuuuca

SEQ ID NO: 3929737 - RNA, 14 nt, Shigella flexneri 2a str. 301
guaguugcugucga

SEQ ID NO: 3929738 - RNA, 17 nt, Shigella flexneri 2a str. 301
guaguuuggcuucgugu

SEQ ID NO: 3929739 - RNA, 23 nt, Shigella flexneri 2a str. 301
guauaaacgugugugccagguuc

SEQ ID NO: 3929740 - RNA, 16 nt, Shigella flexneri 2a str. 301
guauaaguccauaacu

SEQ ID NO: 3929741 - RNA, 13 nt, Shigella flexneri 2a str. 301
guauacgcuggcg

SEQ ID NO: 3929742 - RNA, 19 nt, Shigella flexneri 2a str. 301
guauagaauuuacggcuag

SEQ ID NO: 3929743 - RNA, 18 nt, Shigella flexneri 2a str. 301
guauauuucgaaugcuca

SEQ ID NO: 3929744 - RNA, 21 nt, Shigella flexneri 2a str. 301
guaucaaacacaggcaaaaca

SEQ ID NO: 3929745 - RNA, 14 nt, Shigella flexneri 2a str. 301
guaucaaacccuuc

SEQ ID NO: 3929746 - RNA, 11 nt, Shigella flexneri 2a str. 301
guaucaaagcg

SEQ ID NO: 3929747 - RNA, 22 nt, Shigella flexneri 2a str. 301
guaucaacaauaaaaccaguaa

SEQ ID NO: 3929748 - RNA, 17 nt, Shigella flexneri 2a str. 301
guaucaacagcgguuuu

SEQ ID NO: 3929749 - RNA, 16 nt, Shigella flexneri 2a str. 301
guaucaccccgcccga

SEQ ID NO: 3929750 - RNA, 14 nt, Shigella flexneri 2a str. 301
guaucaggcugugu

SEQ ID NO: 3929751 - RNA, 22 nt, Shigella flexneri 2a str. 301
guaucaucauuauuaauauuca

SEQ ID NO: 3929752 - RNA, 13 nt, Shigella flexneri 2a str. 301
guauccaugcgca

SEQ ID NO: 3929753 - RNA, 22 nt, Shigella flexneri 2a str. 301
guaucccagaucgcuuucccag

SEQ ID NO: 3929754 - RNA, 20 nt, Shigella flexneri 2a str. 301
guaucccaguucgauuuccc

SEQ ID NO: 3929755 - RNA, 20 nt, Shigella flexneri 2a str. 301
guauccggcaugucacaaau

SEQ ID NO: 3929756 - RNA, 19 nt, Shigella flexneri 2a str. 301
guauccgggcauccaggcc

SEQ ID NO: 3929757 - RNA, 15 nt, Shigella flexneri 2a str. 301
guauccuguuuuuaa

SEQ ID NO: 3929758 - RNA, 17 nt, Shigella flexneri 2a str. 301
guaucgaguggcgcagu

SEQ ID NO: 3929759 - RNA, 22 nt, Shigella flexneri 2a str. 301
guaucgcacagaugcgacggca

SEQ ID NO: 3929760 - RNA, 15 nt, Shigella flexneri 2a str. 301
guaucgcugaaagau

SEQ ID NO: 3929761 - RNA, 16 nt, Shigella flexneri 2a str. 301
guaucgggcaguuuac

SEQ ID NO: 3929762 - RNA, 18 nt, Shigella flexneri 2a str. 301
guaucuaccacugccuga

SEQ ID NO: 3929763 - RNA, 12 nt, Shigella flexneri 2a str. 301
guaucuauucac

SEQ ID NO: 3929764 - RNA, 12 nt, Shigella flexneri 2a str. 301
guaucuauucau

SEQ ID NO: 3929765 - RNA, 15 nt, Shigella flexneri 2a str. 301
guaucugaaucaaaa

SEQ ID NO: 3929766 - RNA, 12 nt, Shigella flexneri 2a str. 301
guaucugcagau

SEQ ID NO: 3929767 - RNA, 19 nt, Shigella flexneri 2a str. 301
guaucuucccagccaaugc

SEQ ID NO: 3929768 - RNA, 16 nt, Shigella flexneri 2a str. 301
guaucuuuauaaccac

SEQ ID NO: 3929769 - RNA, 21 nt, Shigella flexneri 2a str. 301
guaucuuugacuacgacgcca

SEQ ID NO: 3929770 - RNA, 17 nt, Shigella flexneri 2a str. 301
guaugacaacuuucauc

SEQ ID NO: 3929771 - RNA, 22 nt, Shigella flexneri 2a str. 301
guaugacaacuuucaucagcac

SEQ ID NO: 3929772 - RNA, 17 nt, Shigella flexneri 2a str. 301
guaugaggcaaaccuua

SEQ ID NO: 3929773 - RNA, 17 nt, Shigella flexneri 2a str. 301
guaugcagccaggccau

SEQ ID NO: 3929774 - RNA, 18 nt, Shigella flexneri 2a str. 301
guaugccuggcauuucug

SEQ ID NO: 3929775 - RNA, 17 nt, Shigella flexneri 2a str. 301
guaugcgucagcaacau

SEQ ID NO: 3929776 - RNA, 18 nt, Shigella flexneri 2a str. 301
guaugcgucagcaacaug

SEQ ID NO: 3929777 - RNA, 21 nt, Shigella flexneri 2a str. 301
guaugcgucagcaacaugccg

SEQ ID NO: 3929778 - RNA, 22 nt, Shigella flexneri 2a str. 301
guaugcgucagcaacaugccgu

SEQ ID NO: 3929779 - RNA, 15 nt, Shigella flexneri 2a str. 301
guauggaaaucaccc

SEQ ID NO: 3929780 - RNA, 16 nt, Shigella flexneri 2a str. 301
guauggaaaucaccca

SEQ ID NO: 3929781 - RNA, 19 nt, Shigella flexneri 2a str. 301
guauggagcaggaauauac

SEQ ID NO: 3929782 - RNA, 17 nt, Shigella flexneri 2a str. 301
guaugguuacugucguu

SEQ ID NO: 3929783 - RNA, 23 nt, Shigella flexneri 2a str. 301
guauuaaucugccagcguaaauc

SEQ ID NO: 3929784 - RNA, 12 nt, Shigella flexneri 2a str. 301
guauuacagagg

SEQ ID NO: 3929785 - RNA, 15 nt, Shigella flexneri 2a str. 301
guauuagcaucgcga

SEQ ID NO: 3929786 - RNA, 16 nt, Shigella flexneri 2a str. 301
guauuaguggcaacca

SEQ ID NO: 3929787 - RNA, 17 nt, Shigella flexneri 2a str. 301
guauuaucgauaaacgc

SEQ ID NO: 3929788 - RNA, 13 nt, Shigella flexneri 2a str. 301
gucaguuggcugu

SEQ ID NO: 3929789 - RNA, 16 nt, Shigella flexneri 2a str. 301
gucaguuggcuguggu

SEQ ID NO: 3929790 - RNA, 22 nt, Shigella flexneri 2a str. 301
gucaguuuuucacgagagauac

SEQ ID NO: 3929791 - RNA, 20 nt, Shigella flexneri 2a str. 301
gucauaacacagguaacuua

SEQ ID NO: 3929792 - RNA, 17 nt, Shigella flexneri 2a str. 301
gucauaauaugaccuga

SEQ ID NO: 3929793 - RNA, 20 nt, Shigella flexneri 2a str. 301
gucauacgagucgccuguac

SEQ ID NO: 3929794 - RNA, 20 nt, Shigella flexneri 2a str. 301
gucaucaacgccauacggcu

SEQ ID NO: 3929795 - RNA, 21 nt, Shigella flexneri 2a str. 301
gucaucagcauaaucaccagu

SEQ ID NO: 3929796 - RNA, 14 nt, Shigella flexneri 2a str. 301
gucaucaucgccac

SEQ ID NO: 3929797 - RNA, 14 nt, Shigella flexneri 2a str. 301
gucauccagcacuu

SEQ ID NO: 3929798 - RNA, 14 nt, Shigella flexneri 2a str. 301
gucauccaggaacu

SEQ ID NO: 3929799 - RNA, 16 nt, Shigella flexneri 2a str. 301
gucauccaggaacucc

SEQ ID NO: 3929800 - RNA, 13 nt, Shigella flexneri 2a str. 301
gucauccauacca

SEQ ID NO: 3929801 - RNA, 22 nt, Shigella flexneri 2a str. 301
gucauccauaccacgaccucaa

SEQ ID NO: 3929802 - RNA, 16 nt, Shigella flexneri 2a str. 301
gucaucccagucuuca

SEQ ID NO: 3929803 - RNA, 22 nt, Shigella flexneri 2a str. 301
gucauccguggcgacagaggug

SEQ ID NO: 3929804 - RNA, 16 nt, Shigella flexneri 2a str. 301
gucaucgacagcaaau

SEQ ID NO: 3929805 - RNA, 18 nt, Shigella flexneri 2a str. 301
gucaucggcguugcccau

SEQ ID NO: 3929806 - RNA, 23 nt, Shigella flexneri 2a str. 301
gucaucuucucuauaaaaaagag

SEQ ID NO: 3929807 - RNA, 21 nt, Shigella flexneri 2a str. 301
gucaugcagcuccaccgauuu

SEQ ID NO: 3929808 - RNA, 15 nt, Shigella flexneri 2a str. 301
gucauggcugacugu

SEQ ID NO: 3929809 - RNA, 14 nt, Shigella flexneri 2a str. 301
gucaugucaugagu

SEQ ID NO: 3929810 - RNA, 14 nt, Shigella flexneri 2a str. 301
gucauuacaacaag

SEQ ID NO: 3929811 - RNA, 21 nt, Shigella flexneri 2a str. 301
gucauuacccugcaaugaacc

SEQ ID NO: 3929812 - RNA, 22 nt, Shigella flexneri 2a str. 301
gucauuacgggcaaucaucacc

SEQ ID NO: 3929813 - RNA, 21 nt, Shigella flexneri 2a str. 301
gucauuccagucugcuggcga

SEQ ID NO: 3929814 - RNA, 14 nt, Shigella flexneri 2a str. 301
gucauugaccagau

SEQ ID NO: 3929815 - RNA, 19 nt, Shigella flexneri 2a str. 301
gucauuggggauuaucuga

SEQ ID NO: 3929816 - RNA, 13 nt, Shigella flexneri 2a str. 301
gucauuugagugc

SEQ ID NO: 3929817 - RNA, 21 nt, Shigella flexneri 2a str. 301
gucauuuugcguguuucagaa

SEQ ID NO: 3929818 - RNA, 14 nt, Shigella flexneri 2a str. 301
guccaaaagguccu

SEQ ID NO: 3929819 - RNA, 14 nt, Shigella flexneri 2a str. 301
guccaaucagcaca

SEQ ID NO: 3929820 - RNA, 16 nt, Shigella flexneri 2a str. 301
guccaccgugauucac

SEQ ID NO: 3929821 - RNA, 14 nt, Shigella flexneri 2a str. 301
guccacgccgccga

SEQ ID NO: 3929822 - RNA, 19 nt, Shigella flexneri 2a str. 301
guccacgguugguuuuauc

SEQ ID NO: 3929823 - RNA, 16 nt, Shigella flexneri 2a str. 301
guccacugcgagaaaa

SEQ ID NO: 3929824 - RNA, 23 nt, Shigella flexneri 2a str. 301
guccacuugaaaauuauaucuua

SEQ ID NO: 3929825 - RNA, 14 nt, Shigella flexneri 2a str. 301
guccagccgccagg

SEQ ID NO: 3929826 - RNA, 12 nt, Shigella flexneri 2a str. 301
guccagcgccug

SEQ ID NO: 3929827 - RNA, 18 nt, Shigella flexneri 2a str. 301
guccagcuccguccagcc

SEQ ID NO: 3929828 - RNA, 18 nt, Shigella flexneri 2a str. 301
guccaggacaagcgggug

SEQ ID NO: 3929829 - RNA, 21 nt, Shigella flexneri 2a str. 301
guccagucgcaaaccuggcau

SEQ ID NO: 3929830 - RNA, 22 nt, Shigella flexneri 2a str. 301
guccaguuugccuucacaggcc

SEQ ID NO: 3929831 - RNA, 17 nt, Shigella flexneri 2a str. 301
guccauccauacgggca

SEQ ID NO: 3929832 - RNA, 21 nt, Shigella flexneri 2a str. 301
guccaugcugucggcugccag

SEQ ID NO: 3929833 - RNA, 14 nt, Shigella flexneri 2a str. 301
guccauuaccgaua

SEQ ID NO: 3929834 - RNA, 14 nt, Shigella flexneri 2a str. 301
guccauuucagcgc

SEQ ID NO: 3929835 - RNA, 22 nt, Shigella flexneri 2a str. 301
gucccaaccuuguuucugagca

SEQ ID NO: 3929836 - RNA, 19 nt, Shigella flexneri 2a str. 301
gucccacuggucgcccugg

SEQ ID NO: 3929837 - RNA, 16 nt, Shigella flexneri 2a str. 301
gucccagccuugccag

SEQ ID NO: 3929838 - RNA, 20 nt, Shigella flexneri 2a str. 301
gucccagccuugccagaugu

SEQ ID NO: 3929839 - RNA, 17 nt, Shigella flexneri 2a str. 301
gucccaggcagaagcgc

SEQ ID NO: 3929840 - RNA, 17 nt, Shigella flexneri 2a str. 301
gucccaugaugcgcggc

SEQ ID NO: 3929841 - RNA, 21 nt, Shigella flexneri 2a str. 301
guccccacaucacuccaucca

SEQ ID NO: 3929842 - RNA, 15 nt, Shigella flexneri 2a str. 301
guccccacgccauac

SEQ ID NO: 3929843 - RNA, 18 nt, Shigella flexneri 2a str. 301
guccccaguaaucgggca

SEQ ID NO: 3929844 - RNA, 21 nt, Shigella flexneri 2a str. 301
guccccaucaggaaacccgcc

SEQ ID NO: 3929845 - RNA, 17 nt, Shigella flexneri 2a str. 301
guccccgagcacaugca

SEQ ID NO: 3929846 - RNA, 23 nt, Shigella flexneri 2a str. 301
guccccgagcacaugcagugccg

SEQ ID NO: 3929847 - RNA, 19 nt, Shigella flexneri 2a str. 301
guccccuggggagugaccu

SEQ ID NO: 3929848 - RNA, 22 nt, Shigella flexneri 2a str. 301
gucccggcaagauuccagugcc

SEQ ID NO: 3929849 - RNA, 14 nt, Shigella flexneri 2a str. 301
gucccguacccagc

SEQ ID NO: 3929850 - RNA, 15 nt, Shigella flexneri 2a str. 301
gucccguacccagca

SEQ ID NO: 3929851 - RNA, 14 nt, Shigella flexneri 2a str. 301
gucccguccuucau

SEQ ID NO: 3929852 - RNA, 11 nt, Shigella flexneri 2a str. 301
gucccucccug

SEQ ID NO: 3929853 - RNA, 22 nt, Shigella flexneri 2a str. 301
gucccuucgguagcagcuuuca

SEQ ID NO: 3929854 - RNA, 12 nt, Shigella flexneri 2a str. 301
gucccuuucagg

SEQ ID NO: 3929855 - RNA, 22 nt, Shigella flexneri 2a str. 301
guccgauuaaaaacccugcaga

SEQ ID NO: 3929856 - RNA, 16 nt, Shigella flexneri 2a str. 301
guccgauuuguucucu

SEQ ID NO: 3929857 - RNA, 14 nt, Shigella flexneri 2a str. 301
guccgccauggcuu

SEQ ID NO: 3929858 - RNA, 20 nt, Shigella flexneri 2a str. 301
guccgcgaacagcagcgguu

SEQ ID NO: 3929859 - RNA, 15 nt, Shigella flexneri 2a str. 301
guccgcguccgcugg

SEQ ID NO: 3929860 - RNA, 17 nt, Shigella flexneri 2a str. 301
guccggcagcagaaagc

SEQ ID NO: 3929861 - RNA, 16 nt, Shigella flexneri 2a str. 301
guccggcugccagcca

SEQ ID NO: 3929862 - RNA, 15 nt, Shigella flexneri 2a str. 301
guccgggcaucagca

SEQ ID NO: 3929863 - RNA, 22 nt, Shigella flexneri 2a str. 301
guccgguuucgugaaacucagc

SEQ ID NO: 3929864 - RNA, 20 nt, Shigella flexneri 2a str. 301
guccuaacaaccauccccaa

SEQ ID NO: 3929865 - RNA, 12 nt, Shigella flexneri 2a str. 301
guccuccagcuc

SEQ ID NO: 3929866 - RNA, 22 nt, Shigella flexneri 2a str. 301
guccucccuuauugcuaaugau

SEQ ID NO: 3929867 - RNA, 17 nt, Shigella flexneri 2a str. 301
guccucgccguuuucug

SEQ ID NO: 3929868 - RNA, 16 nt, Shigella flexneri 2a str. 301
guccucuucagcauca

SEQ ID NO: 3929869 - RNA, 15 nt, Shigella flexneri 2a str. 301
guccugaccaaagcc

SEQ ID NO: 3929870 - RNA, 15 nt, Shigella flexneri 2a str. 301
guccugcguuucuuc

SEQ ID NO: 3929871 - RNA, 18 nt, Shigella flexneri 2a str. 301
guccuucaauaucauuac

SEQ ID NO: 3929872 - RNA, 14 nt, Shigella flexneri 2a str. 301
guccuucuaccagc

SEQ ID NO: 3929873 - RNA, 22 nt, Shigella flexneri 2a str. 301
gucgaaaccgacagcccuucgc

SEQ ID NO: 3929874 - RNA, 18 nt, Shigella flexneri 2a str. 301
gucgaaagcccaucaucc

SEQ ID NO: 3929875 - RNA, 15 nt, Shigella flexneri 2a str. 301
gucgaacauacacaa

SEQ ID NO: 3929876 - RNA, 14 nt, Shigella flexneri 2a str. 301
gucgaacggguuaa

SEQ ID NO: 3929877 - RNA, 20 nt, Shigella flexneri 2a str. 301
gucgaacucauacaccagcg

SEQ ID NO: 3929878 - RNA, 19 nt, Shigella flexneri 2a str. 301
gucgaaugcgcaaccguaa

SEQ ID NO: 3929879 - RNA, 18 nt, Shigella flexneri 2a str. 301
gucgaauggcaucuacgc

SEQ ID NO: 3929880 - RNA, 12 nt, Shigella flexneri 2a str. 301
gucgacagcagc

SEQ ID NO: 3929881 - RNA, 13 nt, Shigella flexneri 2a str. 301
gucgacagcagcc

SEQ ID NO: 3929882 - RNA, 16 nt, Shigella flexneri 2a str. 301
gucgagaauaucgaua

SEQ ID NO: 3929883 - RNA, 16 nt, Shigella flexneri 2a str. 301
gucgagcagagaaacg

SEQ ID NO: 3929884 - RNA, 15 nt, Shigella flexneri 2a str. 301
gucgaggcaaccagc

SEQ ID NO: 3929885 - RNA, 20 nt, Shigella flexneri 2a str. 301
gucgaggccaauuuggcugc

SEQ ID NO: 3929886 - RNA, 17 nt, Shigella flexneri 2a str. 301
gucgauaucgauaauca

SEQ ID NO: 3929887 - RNA, 17 nt, Shigella flexneri 2a str. 301
gucgaugaaagcgccau

SEQ ID NO: 3929888 - RNA, 14 nt, Shigella flexneri 2a str. 301
gucugaaugccgcu

SEQ ID NO: 3929889 - RNA, 15 nt, Shigella flexneri 2a str. 301
gucugaccauaaccc

SEQ ID NO: 3929890 - RNA, 22 nt, Shigella flexneri 2a str. 301
gucugaccauaacccgcuucca

SEQ ID NO: 3929891 - RNA, 16 nt, Shigella flexneri 2a str. 301
gucugaccgucuuuca

SEQ ID NO: 3929892 - RNA, 15 nt, Shigella flexneri 2a str. 301
gucugagccgaaaaa

SEQ ID NO: 3929893 - RNA, 18 nt, Shigella flexneri 2a str. 301
gucugagccgaaaaagag

SEQ ID NO: 3929894 - RNA, 21 nt, Shigella flexneri 2a str. 301
gucugaucggcaaucacgccc

SEQ ID NO: 3929895 - RNA, 21 nt, Shigella flexneri 2a str. 301
gucugcagauauucaugcagg

SEQ ID NO: 3929896 - RNA, 22 nt, Shigella flexneri 2a str. 301
gucugcauuuucucgcggacug

SEQ ID NO: 3929897 - RNA, 18 nt, Shigella flexneri 2a str. 301
gucugccaucauggcauc

SEQ ID NO: 3929898 - RNA, 20 nt, Shigella flexneri 2a str. 301
gucugccgguacuucaccag

SEQ ID NO: 3929899 - RNA, 14 nt, Shigella flexneri 2a str. 301
gucugcuucugccu

SEQ ID NO: 3929900 - RNA, 14 nt, Shigella flexneri 2a str. 301
gucuggaacggcag

SEQ ID NO: 3929901 - RNA, 16 nt, Shigella flexneri 2a str. 301
gucuggauuuggcugc

SEQ ID NO: 3929902 - RNA, 14 nt, Shigella flexneri 2a str. 301
gucuggcagauccu

SEQ ID NO: 3929903 - RNA, 14 nt, Shigella flexneri 2a str. 301
gucugggcaaaauc

SEQ ID NO: 3929904 - RNA, 14 nt, Shigella flexneri 2a str. 301
gucugggccgauaa

SEQ ID NO: 3929905 - RNA, 17 nt, Shigella flexneri 2a str. 301
gucugggcguugcaaua

SEQ ID NO: 3929906 - RNA, 14 nt, Shigella flexneri 2a str. 301
gucuggugaccugg

SEQ ID NO: 3929907 - RNA, 18 nt, Shigella flexneri 2a str. 301
gucuguaccaccagaauc

SEQ ID NO: 3929908 - RNA, 12 nt, Shigella flexneri 2a str. 301
gucuguacggca

SEQ ID NO: 3929909 - RNA, 14 nt, Shigella flexneri 2a str. 301
gucuguacggcagu

SEQ ID NO: 3929910 - RNA, 18 nt, Shigella flexneri 2a str. 301
gucuguacggcagugaac

SEQ ID NO: 3929911 - RNA, 13 nt, Shigella flexneri 2a str. 301
gucuguuccccuc

SEQ ID NO: 3929912 - RNA, 15 nt, Shigella flexneri 2a str. 301
gucuguuuuaucucc

SEQ ID NO: 3929913 - RNA, 18 nt, Shigella flexneri 2a str. 301
gucuguuuuaucucccug

SEQ ID NO: 3929914 - RNA, 13 nt, Shigella flexneri 2a str. 301
gucuuaauguaau

SEQ ID NO: 3929915 - RNA, 18 nt, Shigella flexneri 2a str. 301
gucuuaucaggccuacaa

SEQ ID NO: 3929916 - RNA, 19 nt, Shigella flexneri 2a str. 301
gucuuaucaggccuacaac

SEQ ID NO: 3929917 - RNA, 21 nt, Shigella flexneri 2a str. 301
gucuuaucaggccuacaaguc

SEQ ID NO: 3929918 - RNA, 13 nt, Shigella flexneri 2a str. 301
gucuuaucuggca

SEQ ID NO: 3929919 - RNA, 19 nt, Shigella flexneri 2a str. 301
gucuuaucuggcauuugca

SEQ ID NO: 3929920 - RNA, 14 nt, Shigella flexneri 2a str. 301
gucuucaaccgcag

SEQ ID NO: 3929921 - RNA, 12 nt, Shigella flexneri 2a str. 301
gucuucaauagg

SEQ ID NO: 3929922 - RNA, 14 nt, Shigella flexneri 2a str. 301
gucuuccagcaaau

SEQ ID NO: 3929923 - RNA, 12 nt, Shigella flexneri 2a str. 301
gucuuccugugg

SEQ ID NO: 3929924 - RNA, 20 nt, Shigella flexneri 2a str. 301
gucuucgauagcaaauugcu

SEQ ID NO: 3929925 - RNA, 13 nt, Shigella flexneri 2a str. 301
gucuucugguugc

SEQ ID NO: 3929926 - RNA, 16 nt, Shigella flexneri 2a str. 301
gucuucugguuuuucu

SEQ ID NO: 3929927 - RNA, 21 nt, Shigella flexneri 2a str. 301
gucuucugugauuccgccagu

SEQ ID NO: 3929928 - RNA, 23 nt, Shigella flexneri 2a str. 301
gucuugaauaaauuggcuggggu

SEQ ID NO: 3929929 - RNA, 19 nt, Shigella flexneri 2a str. 301
gucuuggguauaaaacuca

SEQ ID NO: 3929930 - RNA, 14 nt, Shigella flexneri 2a str. 301
gucuuguacuuccg

SEQ ID NO: 3929931 - RNA, 15 nt, Shigella flexneri 2a str. 301
gucuuguuacuggcu

SEQ ID NO: 3929932 - RNA, 16 nt, Shigella flexneri 2a str. 301
gucuuugcguuccauc

SEQ ID NO: 3929933 - RNA, 18 nt, Shigella flexneri 2a str. 301
gucuuugugccacgcugg

SEQ ID NO: 3929934 - RNA, 13 nt, Shigella flexneri 2a str. 301
gucuuuugaucaa

SEQ ID NO: 3929935 - RNA, 12 nt, Shigella flexneri 2a str. 301
gucuuuuuucac

SEQ ID NO: 3929936 - RNA, 22 nt, Shigella flexneri 2a str. 301
gucuuuuuucacuggcaaugac

SEQ ID NO: 3929937 - RNA, 17 nt, Shigella flexneri 2a str. 301
gucuuuuuuccagcaca

SEQ ID NO: 3929938 - RNA, 14 nt, Shigella flexneri 2a str. 301
gugaaaaaaacugc

SEQ ID NO: 3929939 - RNA, 11 nt, Shigella flexneri 2a str. 301
gugaaaaaaag

SEQ ID NO: 3929940 - RNA, 21 nt, Shigella flexneri 2a str. 301
gugaaaaaccaaucucccagc

SEQ ID NO: 3929941 - RNA, 22 nt, Shigella flexneri 2a str. 301
gugaaaacgacgcgguauuggu

SEQ ID NO: 3929942 - RNA, 14 nt, Shigella flexneri 2a str. 301
gugaaaaucgaguu

SEQ ID NO: 3929943 - RNA, 19 nt, Shigella flexneri 2a str. 301
gugaaacaaaucacuauua

SEQ ID NO: 3929944 - RNA, 23 nt, Shigella flexneri 2a str. 301
gugaaaccuuuaugcagcucggu

SEQ ID NO: 3929945 - RNA, 17 nt, Shigella flexneri 2a str. 301
gugaaagagccgucauu

SEQ ID NO: 3929946 - RNA, 13 nt, Shigella flexneri 2a str. 301
gugaaaguaaaaa

SEQ ID NO: 3929947 - RNA, 16 nt, Shigella flexneri 2a str. 301
gugaaauacaguuauc

SEQ ID NO: 3929948 - RNA, 16 nt, Shigella flexneri 2a str. 301
gugaaauuaaacuguc

SEQ ID NO: 3929949 - RNA, 15 nt, Shigella flexneri 2a str. 301
gugaacgccagcaga

SEQ ID NO: 3929950 - RNA, 20 nt, Shigella flexneri 2a str. 301
gugaacgccuaauccagccu

SEQ ID NO: 3929951 - RNA, 13 nt, Shigella flexneri 2a str. 301
gugaacgccuuau

SEQ ID NO: 3929952 - RNA, 20 nt, Shigella flexneri 2a str. 301
gugaacgccuuauccggccu

SEQ ID NO: 3929953 - RNA, 20 nt, Shigella flexneri 2a str. 301
gugaacgccuuaucuggccu

SEQ ID NO: 3929954 - RNA, 21 nt, Shigella flexneri 2a str. 301
gugaacugccacacaggccau

SEQ ID NO: 3929955 - RNA, 13 nt, Shigella flexneri 2a str. 301
gugaagaugccaa

SEQ ID NO: 3929956 - RNA, 16 nt, Shigella flexneri 2a str. 301
gugaagcagagcagac

SEQ ID NO: 3929957 - RNA, 15 nt, Shigella flexneri 2a str. 301
gugaagguugucauc

SEQ ID NO: 3929958 - RNA, 16 nt, Shigella flexneri 2a str. 301
gugaauaugauuuucu

SEQ ID NO: 3929959 - RNA, 21 nt, Shigella flexneri 2a str. 301
gugaauauuccuuaugguuca

SEQ ID NO: 3929960 - RNA, 23 nt, Shigella flexneri 2a str. 301
gugaauauuuaaccugagcuuga

SEQ ID NO: 3929961 - RNA, 14 nt, Shigella flexneri 2a str. 301
gugaaucacuccau

SEQ ID NO: 3929962 - RNA, 15 nt, Shigella flexneri 2a str. 301
gugaauucagcgacu

SEQ ID NO: 3929963 - RNA, 15 nt, Shigella flexneri 2a str. 301
gugaauuguuuuaua

SEQ ID NO: 3929964 - RNA, 18 nt, Shigella flexneri 2a str. 301
gugacacaaucaaauccu

SEQ ID NO: 3929965 - RNA, 19 nt, Shigella flexneri 2a str. 301
gugacagauuuugccagca

SEQ ID NO: 3929966 - RNA, 18 nt, Shigella flexneri 2a str. 301
gugacagcccggcauguu

SEQ ID NO: 3929967 - RNA, 20 nt, Shigella flexneri 2a str. 301
gugacaguguuauucccaac

SEQ ID NO: 3929968 - RNA, 20 nt, Shigella flexneri 2a str. 301
gugaccagaacugauccaua

SEQ ID NO: 3929969 - RNA, 13 nt, Shigella flexneri 2a str. 301
gugaccagcagca

SEQ ID NO: 3929970 - RNA, 17 nt, Shigella flexneri 2a str. 301
gugaccagcagcauuuc

SEQ ID NO: 3929971 - RNA, 18 nt, Shigella flexneri 2a str. 301
gugaccaguugcuccagc

SEQ ID NO: 3929972 - RNA, 22 nt, Shigella flexneri 2a str. 301
gugaccaucagcaugacaaaaa

SEQ ID NO: 3929973 - RNA, 23 nt, Shigella flexneri 2a str. 301
gugaccgaaggugcacuagacga

SEQ ID NO: 3929974 - RNA, 20 nt, Shigella flexneri 2a str. 301
gugaccgccuuauccggccu

SEQ ID NO: 3929975 - RNA, 17 nt, Shigella flexneri 2a str. 301
gugaccuuucagugggu

SEQ ID NO: 3929976 - RNA, 22 nt, Shigella flexneri 2a str. 301
gugacgaaagucugggccgaua

SEQ ID NO: 3929977 - RNA, 15 nt, Shigella flexneri 2a str. 301
gugacgacaccaucu

SEQ ID NO: 3929978 - RNA, 17 nt, Shigella flexneri 2a str. 301
gugacgacaccaucucu

SEQ ID NO: 3929979 - RNA, 14 nt, Shigella flexneri 2a str. 301
gugacgaucaccac

SEQ ID NO: 3929980 - RNA, 17 nt, Shigella flexneri 2a str. 301
gugacgcugucuuauca

SEQ ID NO: 3929981 - RNA, 13 nt, Shigella flexneri 2a str. 301
gugacgguaacgu

SEQ ID NO: 3929982 - RNA, 21 nt, Shigella flexneri 2a str. 301
gugacguugcgacacuccuga

SEQ ID NO: 3929983 - RNA, 22 nt, Shigella flexneri 2a str. 301
gugacucccacuuuuauuucac

SEQ ID NO: 3929984 - RNA, 15 nt, Shigella flexneri 2a str. 301
gugacuucugccagc

SEQ ID NO: 3929985 - RNA, 18 nt, Shigella flexneri 2a str. 301
gugacuucugccagcugc

SEQ ID NO: 3929986 - RNA, 21 nt, Shigella flexneri 2a str. 301
gugagaucauuauuaaacaga

SEQ ID NO: 3929987 - RNA, 14 nt, Shigella flexneri 2a str. 301
gugagauugcugcg

SEQ ID NO: 3929988 - RNA, 14 nt, Shigella flexneri 2a str. 301
gugcgucagggcga

SEQ ID NO: 3929989 - RNA, 22 nt, Shigella flexneri 2a str. 301
gugcguccgguuuacuuccggg

SEQ ID NO: 3929990 - RNA, 16 nt, Shigella flexneri 2a str. 301
gugcguggcgauacgg

SEQ ID NO: 3929991 - RNA, 15 nt, Shigella flexneri 2a str. 301
gugcguugucaucga

SEQ ID NO: 3929992 - RNA, 22 nt, Shigella flexneri 2a str. 301
gugcuaguuaucuccuugcugg

SEQ ID NO: 3929993 - RNA, 14 nt, Shigella flexneri 2a str. 301
gugcucauagacca

SEQ ID NO: 3929994 - RNA, 15 nt, Shigella flexneri 2a str. 301
gugcucauccuucag

SEQ ID NO: 3929995 - RNA, 22 nt, Shigella flexneri 2a str. 301
gugcuccagucguucaaccacu

SEQ ID NO: 3929996 - RNA, 16 nt, Shigella flexneri 2a str. 301
gugcuccagugcgcuu

SEQ ID NO: 3929997 - RNA, 14 nt, Shigella flexneri 2a str. 301
gugcucgcuuucca

SEQ ID NO: 3929998 - RNA, 20 nt, Shigella flexneri 2a str. 301
gugcucucaaauaucugccg

SEQ ID NO: 3929999 - RNA, 20 nt, Shigella flexneri 2a str. 301
gugcugaaagggcaaauaau

SEQ ID NO: 3930000 - RNA, 16 nt, Shigella flexneri 2a str. 301
gugcugaaaucacagc

SEQ ID NO: 3930001 - RNA, 18 nt, Shigella flexneri 2a str. 301
gugcugaaaucacagcgg

SEQ ID NO: 3930002 - RNA, 20 nt, Shigella flexneri 2a str. 301
gugcugaaaucacagcggcg

SEQ ID NO: 3930003 - RNA, 18 nt, Shigella flexneri 2a str. 301
gugcugacagaaguaauc

SEQ ID NO: 3930004 - RNA, 18 nt, Shigella flexneri 2a str. 301
gugcugaguuucagacca

SEQ ID NO: 3930005 - RNA, 12 nt, Shigella flexneri 2a str. 301
gugcugauuuug

SEQ ID NO: 3930006 - RNA, 22 nt, Shigella flexneri 2a str. 301
gugcuggcaaaucaguggcugg

SEQ ID NO: 3930007 - RNA, 14 nt, Shigella flexneri 2a str. 301
gugcuguacagcag

SEQ ID NO: 3930008 - RNA, 11 nt, Shigella flexneri 2a str. 301
gugcuuauaaa

SEQ ID NO: 3930009 - RNA, 13 nt, Shigella flexneri 2a str. 301
gugcuucaccgau

SEQ ID NO: 3930010 - RNA, 12 nt, Shigella flexneri 2a str. 301
gugcuucaucag

SEQ ID NO: 3930011 - RNA, 12 nt, Shigella flexneri 2a str. 301
guggaaaccuug

SEQ ID NO: 3930012 - RNA, 15 nt, Shigella flexneri 2a str. 301
guggaacggugaaaa

SEQ ID NO: 3930013 - RNA, 19 nt, Shigella flexneri 2a str. 301
guggaagacguugauucac

SEQ ID NO: 3930014 - RNA, 22 nt, Shigella flexneri 2a str. 301
guggaagcccaaaucauaaaaa

SEQ ID NO: 3930015 - RNA, 23 nt, Shigella flexneri 2a str. 301
guggaauaugcgccacaccacug

SEQ ID NO: 3930016 - RNA, 21 nt, Shigella flexneri 2a str. 301
guggacgaacaguucaacgcc

SEQ ID NO: 3930017 - RNA, 21 nt, Shigella flexneri 2a str. 301
guggacucuauggcuggcaau

SEQ ID NO: 3930018 - RNA, 14 nt, Shigella flexneri 2a str. 301
guggacuggcugcg

SEQ ID NO: 3930019 - RNA, 16 nt, Shigella flexneri 2a str. 301
guggaucaagcaacau

SEQ ID NO: 3930020 - RNA, 18 nt, Shigella flexneri 2a str. 301
guggaucaagcaacauaa

SEQ ID NO: 3930021 - RNA, 21 nt, Shigella flexneri 2a str. 301
guggaucaagcaacauaaccu

SEQ ID NO: 3930022 - RNA, 19 nt, Shigella flexneri 2a str. 301
guggaucacaucgccggug

SEQ ID NO: 3930023 - RNA, 22 nt, Shigella flexneri 2a str. 301
guggaucccagaagaauaucaa

SEQ ID NO: 3930024 - RNA, 14 nt, Shigella flexneri 2a str. 301
guggauguuuuacu

SEQ ID NO: 3930025 - RNA, 15 nt, Shigella flexneri 2a str. 301
guggauuaucuucac

SEQ ID NO: 3930026 - RNA, 18 nt, Shigella flexneri 2a str. 301
guggcaaagaaauccaca

SEQ ID NO: 3930027 - RNA, 22 nt, Shigella flexneri 2a str. 301
guggcaaccacaaccgccguug

SEQ ID NO: 3930028 - RNA, 20 nt, Shigella flexneri 2a str. 301
guggcaaucauauucaccac

SEQ ID NO: 3930029 - RNA, 17 nt, Shigella flexneri 2a str. 301
guggcagggaaucagau

SEQ ID NO: 3930030 - RNA, 13 nt, Shigella flexneri 2a str. 301
guggcagggcagc

SEQ ID NO: 3930031 - RNA, 20 nt, Shigella flexneri 2a str. 301
guggcauugguugcuggaaa

SEQ ID NO: 3930032 - RNA, 19 nt, Shigella flexneri 2a str. 301
guggccaguaaucggcuga

SEQ ID NO: 3930033 - RNA, 16 nt, Shigella flexneri 2a str. 301
guggccaguuccacuu

SEQ ID NO: 3930034 - RNA, 21 nt, Shigella flexneri 2a str. 301
guggccaguuccacuucugca

SEQ ID NO: 3930035 - RNA, 22 nt, Shigella flexneri 2a str. 301
guggccauaaccacgcagcgcc

SEQ ID NO: 3930036 - RNA, 20 nt, Shigella flexneri 2a str. 301
guggcccagccuuuccugca

SEQ ID NO: 3930037 - RNA, 16 nt, Shigella flexneri 2a str. 301
guggcgaagugccagu

SEQ ID NO: 3930038 - RNA, 13 nt, Shigella flexneri 2a str. 301
guggcgcagccgu

SEQ ID NO: 3930039 - RNA, 18 nt, Shigella flexneri 2a str. 301
guggcgggaucaccugca

SEQ ID NO: 3930040 - RNA, 16 nt, Shigella flexneri 2a str. 301
guggcguggcgcucca

SEQ ID NO: 3930041 - RNA, 16 nt, Shigella flexneri 2a str. 301
guggcguuuccagcag

SEQ ID NO: 3930042 - RNA, 20 nt, Shigella flexneri 2a str. 301
guggcguuugccaccugugc

SEQ ID NO: 3930043 - RNA, 22 nt, Shigella flexneri 2a str. 301
gugggacaguaucgauauggac

SEQ ID NO: 3930044 - RNA, 23 nt, Shigella flexneri 2a str. 301
gugggaucacaucuucaauccac

SEQ ID NO: 3930045 - RNA, 13 nt, Shigella flexneri 2a str. 301
gugggcaggagaa

SEQ ID NO: 3930046 - RNA, 15 nt, Shigella flexneri 2a str. 301
gugggcgaaggcgca

SEQ ID NO: 3930047 - RNA, 16 nt, Shigella flexneri 2a str. 301
guggggaaugauauuu

SEQ ID NO: 3930048 - RNA, 16 nt, Shigella flexneri 2a str. 301
guggguaggaucagaa

SEQ ID NO: 3930049 - RNA, 20 nt, Shigella flexneri 2a str. 301
gugggucugucccauuuuaa

SEQ ID NO: 3930050 - RNA, 13 nt, Shigella flexneri 2a str. 301
gugguagcggcuc

SEQ ID NO: 3930051 - RNA, 23 nt, Shigella flexneri 2a str. 301
guggucaaacggcgcuuccagca

SEQ ID NO: 3930052 - RNA, 13 nt, Shigella flexneri 2a str. 301
guggucagcacaa

SEQ ID NO: 3930053 - RNA, 19 nt, Shigella flexneri 2a str. 301
guggucagcagcuuucuuu

SEQ ID NO: 3930054 - RNA, 17 nt, Shigella flexneri 2a str. 301
guggucauaucaauagu

SEQ ID NO: 3930055 - RNA, 18 nt, Shigella flexneri 2a str. 301
guggucuuuagacugcca

SEQ ID NO: 3930056 - RNA, 18 nt, Shigella flexneri 2a str. 301
guggugagauugcugcgu

SEQ ID NO: 3930057 - RNA, 18 nt, Shigella flexneri 2a str. 301
guggugcgcgagcuggug

SEQ ID NO: 3930058 - RNA, 13 nt, Shigella flexneri 2a str. 301
guggugcguacca

SEQ ID NO: 3930059 - RNA, 21 nt, Shigella flexneri 2a str. 301
guggugcguaccaggcgugga

SEQ ID NO: 3930060 - RNA, 16 nt, Shigella flexneri 2a str. 301
guggugggggaaggau

SEQ ID NO: 3930061 - RNA, 15 nt, Shigella flexneri 2a str. 301
gugguguagggcagg

SEQ ID NO: 3930062 - RNA, 13 nt, Shigella flexneri 2a str. 301
guggugugggcgg

SEQ ID NO: 3930063 - RNA, 16 nt, Shigella flexneri 2a str. 301
guggugugggcgguga

SEQ ID NO: 3930064 - RNA, 20 nt, Shigella flexneri 2a str. 301
gugguuaacgaccagcggaa

SEQ ID NO: 3930065 - RNA, 14 nt, Shigella flexneri 2a str. 301
gugguugucgcagg

SEQ ID NO: 3930066 - RNA, 15 nt, Shigella flexneri 2a str. 301
gugguugucgcaggc

SEQ ID NO: 3930067 - RNA, 19 nt, Shigella flexneri 2a str. 301
gugguugucgcaggcggug

SEQ ID NO: 3930068 - RNA, 18 nt, Shigella flexneri 2a str. 301
guguaagaaaggcagagu

SEQ ID NO: 3930069 - RNA, 19 nt, Shigella flexneri 2a str. 301
guguacaaacccagccgcc

SEQ ID NO: 3930070 - RNA, 19 nt, Shigella flexneri 2a str. 301
guguacaucucaacaacuu

SEQ ID NO: 3930071 - RNA, 18 nt, Shigella flexneri 2a str. 301
guguaccggauaaauuua

SEQ ID NO: 3930072 - RNA, 14 nt, Shigella flexneri 2a str. 301
guguagcgcaucac

SEQ ID NO: 3930073 - RNA, 23 nt, Shigella flexneri 2a str. 301
guguaguauuugaguucacugcc

SEQ ID NO: 3930074 - RNA, 21 nt, Shigella flexneri 2a str. 301
guguaucugggcgaaacagag

SEQ ID NO: 3930075 - RNA, 17 nt, Shigella flexneri 2a str. 301
guguaucuucagcugca

SEQ ID NO: 3930076 - RNA, 12 nt, Shigella flexneri 2a str. 301
guguaucuucau

SEQ ID NO: 3930077 - RNA, 18 nt, Shigella flexneri 2a str. 301
gugucaauucccgagcug

SEQ ID NO: 3930078 - RNA, 15 nt, Shigella flexneri 2a str. 301
gugucaucaucgcgc

SEQ ID NO: 3930079 - RNA, 13 nt, Shigella flexneri 2a str. 301
guguccacuuccg

SEQ ID NO: 3930080 - RNA, 16 nt, Shigella flexneri 2a str. 301
guguccagccagucca

SEQ ID NO: 3930081 - RNA, 19 nt, Shigella flexneri 2a str. 301
guguccagcggcauaaaac

SEQ ID NO: 3930082 - RNA, 16 nt, Shigella flexneri 2a str. 301
gugucgaugugccgga

SEQ ID NO: 3930083 - RNA, 19 nt, Shigella flexneri 2a str. 301
gugucgccagcaacacaaa

SEQ ID NO: 3930084 - RNA, 17 nt, Shigella flexneri 2a str. 301
gugucguuacgccgcag

SEQ ID NO: 3930085 - RNA, 21 nt, Shigella flexneri 2a str. 301
gugucuuaucuggcauuugca

SEQ ID NO: 3930086 - RNA, 21 nt, Shigella flexneri 2a str. 301
gugugaaaccuuuaugcagcu

SEQ ID NO: 3930087 - RNA, 15 nt, Shigella flexneri 2a str. 301
gugugaaaucagcac

SEQ ID NO: 3930088 - RNA, 17 nt, Shigella flexneri 2a str. 301
guucaauacccacugcg

SEQ ID NO: 3930089 - RNA, 19 nt, Shigella flexneri 2a str. 301
guucaauacccacugcgca

SEQ ID NO: 3930090 - RNA, 22 nt, Shigella flexneri 2a str. 301
guucaauacgcaguuuugucuu

SEQ ID NO: 3930091 - RNA, 19 nt, Shigella flexneri 2a str. 301
guucaaugcgaucuacccg

SEQ ID NO: 3930092 - RNA, 20 nt, Shigella flexneri 2a str. 301
guucaauuuccaguuucaca

SEQ ID NO: 3930093 - RNA, 21 nt, Shigella flexneri 2a str. 301
guucaccauuagacaguuugc

SEQ ID NO: 3930094 - RNA, 15 nt, Shigella flexneri 2a str. 301
guucacgcagcucac

SEQ ID NO: 3930095 - RNA, 22 nt, Shigella flexneri 2a str. 301
guucacgccaucaucggcaaac

SEQ ID NO: 3930096 - RNA, 20 nt, Shigella flexneri 2a str. 301
guucacgccgcauccggcau

SEQ ID NO: 3930097 - RNA, 19 nt, Shigella flexneri 2a str. 301
guucacgccgcaucuggca

SEQ ID NO: 3930098 - RNA, 19 nt, Shigella flexneri 2a str. 301
guucacugccguacaggca

SEQ ID NO: 3930099 - RNA, 18 nt, Shigella flexneri 2a str. 301
guucacuugcuaccgcga

SEQ ID NO: 3930100 - RNA, 19 nt, Shigella flexneri 2a str. 301
guucacuuuugcugcaaaa

SEQ ID NO: 3930101 - RNA, 13 nt, Shigella flexneri 2a str. 301
guucagaauggcg

SEQ ID NO: 3930102 - RNA, 21 nt, Shigella flexneri 2a str. 301
guucagaauggcgcacucaaa

SEQ ID NO: 3930103 - RNA, 16 nt, Shigella flexneri 2a str. 301
guucagauuguugauu

SEQ ID NO: 3930104 - RNA, 22 nt, Shigella flexneri 2a str. 301
guucagcaguucugccaggcug

SEQ ID NO: 3930105 - RNA, 23 nt, Shigella flexneri 2a str. 301
guucagccagugaccuuaaucag

SEQ ID NO: 3930106 - RNA, 18 nt, Shigella flexneri 2a str. 301
guucagccugacagcacg

SEQ ID NO: 3930107 - RNA, 17 nt, Shigella flexneri 2a str. 301
guucagcgcaacuugca

SEQ ID NO: 3930108 - RNA, 23 nt, Shigella flexneri 2a str. 301
guucagcggcccguuggugcggu

SEQ ID NO: 3930109 - RNA, 22 nt, Shigella flexneri 2a str. 301
guucagcgucggcgucaucgac

SEQ ID NO: 3930110 - RNA, 22 nt, Shigella flexneri 2a str. 301
guucaggucggugugaaugacu

SEQ ID NO: 3930111 - RNA, 18 nt, Shigella flexneri 2a str. 301
guucaguacgaaauaacu

SEQ ID NO: 3930112 - RNA, 11 nt, Shigella flexneri 2a str. 301
guucaguucag

SEQ ID NO: 3930113 - RNA, 16 nt, Shigella flexneri 2a str. 301
guucaguucagaaagc

SEQ ID NO: 3930114 - RNA, 22 nt, Shigella flexneri 2a str. 301
guucauauauuccuuacucaua

SEQ ID NO: 3930115 - RNA, 14 nt, Shigella flexneri 2a str. 301
guucauccugcugg

SEQ ID NO: 3930116 - RNA, 16 nt, Shigella flexneri 2a str. 301
guucauccugcuggug

SEQ ID NO: 3930117 - RNA, 13 nt, Shigella flexneri 2a str. 301
guucaucugacca

SEQ ID NO: 3930118 - RNA, 19 nt, Shigella flexneri 2a str. 301
guucaucugcauuccggug

SEQ ID NO: 3930119 - RNA, 19 nt, Shigella flexneri 2a str. 301
guucauggcgcgacauggc

SEQ ID NO: 3930120 - RNA, 16 nt, Shigella flexneri 2a str. 301
guucaugguuagccug

SEQ ID NO: 3930121 - RNA, 21 nt, Shigella flexneri 2a str. 301
guucauuaaugccguuauaca

SEQ ID NO: 3930122 - RNA, 20 nt, Shigella flexneri 2a str. 301
guucauuggguucaucugau

SEQ ID NO: 3930123 - RNA, 20 nt, Shigella flexneri 2a str. 301
guuccacauaaaguagccaa

SEQ ID NO: 3930124 - RNA, 20 nt, Shigella flexneri 2a str. 301
guuccacaucuaccgccagc

SEQ ID NO: 3930125 - RNA, 22 nt, Shigella flexneri 2a str. 301
guuccacaucuaccgccagcca

SEQ ID NO: 3930126 - RNA, 18 nt, Shigella flexneri 2a str. 301
guuccaccgcguuuucca

SEQ ID NO: 3930127 - RNA, 21 nt, Shigella flexneri 2a str. 301
guuccacggaauauuucaccg

SEQ ID NO: 3930128 - RNA, 20 nt, Shigella flexneri 2a str. 301
guuccacugguuucgaucug

SEQ ID NO: 3930129 - RNA, 19 nt, Shigella flexneri 2a str. 301
guuccacuucugcggguga

SEQ ID NO: 3930130 - RNA, 12 nt, Shigella flexneri 2a str. 301
guuccagcagaa

SEQ ID NO: 3930131 - RNA, 17 nt, Shigella flexneri 2a str. 301
guuccagcaucuccugc

SEQ ID NO: 3930132 - RNA, 22 nt, Shigella flexneri 2a str. 301
guuccagcuucagauucagcgu

SEQ ID NO: 3930133 - RNA, 18 nt, Shigella flexneri 2a str. 301
guuccagggccuccugca

SEQ ID NO: 3930134 - RNA, 17 nt, Shigella flexneri 2a str. 301
guuccagugcgguaacg

SEQ ID NO: 3930135 - RNA, 18 nt, Shigella flexneri 2a str. 301
guuccagugcgguaacgu

SEQ ID NO: 3930136 - RNA, 17 nt, Shigella flexneri 2a str. 301
guuccagugcguaccca

SEQ ID NO: 3930137 - RNA, 14 nt, Shigella flexneri 2a str. 301
guuccaguggcuga

SEQ ID NO: 3930138 - RNA, 16 nt, Shigella flexneri 2a str. 301
guuccauaugaauucc

SEQ ID NO: 3930139 - RNA, 13 nt, Shigella flexneri 2a str. 301
guuccaucaccag

SEQ ID NO: 3930140 - RNA, 14 nt, Shigella flexneri 2a str. 301
guucccaacaacag

SEQ ID NO: 3930141 - RNA, 21 nt, Shigella flexneri 2a str. 301
guucccccugccagaccauuu

SEQ ID NO: 3930142 - RNA, 22 nt, Shigella flexneri 2a str. 301
guuccccuguugugccagacca

SEQ ID NO: 3930143 - RNA, 11 nt, Shigella flexneri 2a str. 301
guuccgccagc

SEQ ID NO: 3930144 - RNA, 23 nt, Shigella flexneri 2a str. 301
guuccggagaagcguagguguua

SEQ ID NO: 3930145 - RNA, 17 nt, Shigella flexneri 2a str. 301
guuccggcguacgggca

SEQ ID NO: 3930146 - RNA, 15 nt, Shigella flexneri 2a str. 301
guuccgugagcggaa

SEQ ID NO: 3930147 - RNA, 18 nt, Shigella flexneri 2a str. 301
guuccguucauauggagc

SEQ ID NO: 3930148 - RNA, 22 nt, Shigella flexneri 2a str. 301
guuccguucauauggagcaaaa

SEQ ID NO: 3930149 - RNA, 16 nt, Shigella flexneri 2a str. 301
guuccucaccuuccac

SEQ ID NO: 3930150 - RNA, 17 nt, Shigella flexneri 2a str. 301
guuccugcuuggcgcga

SEQ ID NO: 3930151 - RNA, 20 nt, Shigella flexneri 2a str. 301
guuccuuaacuucaucagca

SEQ ID NO: 3930152 - RNA, 13 nt, Shigella flexneri 2a str. 301
guucgagcaucac

SEQ ID NO: 3930153 - RNA, 14 nt, Shigella flexneri 2a str. 301
guucgagcaucaca

SEQ ID NO: 3930154 - RNA, 15 nt, Shigella flexneri 2a str. 301
guucgauauccaguc

SEQ ID NO: 3930155 - RNA, 15 nt, Shigella flexneri 2a str. 301
guucgauuucauuca

SEQ ID NO: 3930156 - RNA, 14 nt, Shigella flexneri 2a str. 301
guucgauuucccag

SEQ ID NO: 3930157 - RNA, 22 nt, Shigella flexneri 2a str. 301
guucgcaaagguuuuaccgcac

SEQ ID NO: 3930158 - RNA, 22 nt, Shigella flexneri 2a str. 301
guucgcaccaucaaaguuuuua

SEQ ID NO: 3930159 - RNA, 23 nt, Shigella flexneri 2a str. 301
guucgcauacggguuuuccccuu

SEQ ID NO: 3930160 - RNA, 22 nt, Shigella flexneri 2a str. 301
guucgcccacgcgcauucccag

SEQ ID NO: 3930161 - RNA, 16 nt, Shigella flexneri 2a str. 301
guucgccugcaccaug

SEQ ID NO: 3930162 - RNA, 22 nt, Shigella flexneri 2a str. 301
guucgcgaaaguuaccgcgcca

SEQ ID NO: 3930163 - RNA, 18 nt, Shigella flexneri 2a str. 301
guucgcgcgcugccagaa

SEQ ID NO: 3930164 - RNA, 23 nt, Shigella flexneri 2a str. 301
guucgcggcguacgacguucagg

SEQ ID NO: 3930165 - RNA, 17 nt, Shigella flexneri 2a str. 301
guucgcguacugcugac

SEQ ID NO: 3930166 - RNA, 16 nt, Shigella flexneri 2a str. 301
guucgcuaaagacuuu

SEQ ID NO: 3930167 - RNA, 21 nt, Shigella flexneri 2a str. 301
guucggacauguuuuccagca

SEQ ID NO: 3930168 - RNA, 15 nt, Shigella flexneri 2a str. 301
guucggcaauccagu

SEQ ID NO: 3930169 - RNA, 15 nt, Shigella flexneri 2a str. 301
guucggcgguuuuuu

SEQ ID NO: 3930170 - RNA, 20 nt, Shigella flexneri 2a str. 301
guucgguauuaaucugccag

SEQ ID NO: 3930171 - RNA, 15 nt, Shigella flexneri 2a str. 301
guucguaggccagau

SEQ ID NO: 3930172 - RNA, 11 nt, Shigella flexneri 2a str. 301
guucguccauu

SEQ ID NO: 3930173 - RNA, 20 nt, Shigella flexneri 2a str. 301
guucgucgucuuuauccuga

SEQ ID NO: 3930174 - RNA, 16 nt, Shigella flexneri 2a str. 301
guucguugauaauaaa

SEQ ID NO: 3930175 - RNA, 14 nt, Shigella flexneri 2a str. 301
guucuacauaaaac

SEQ ID NO: 3930176 - RNA, 22 nt, Shigella flexneri 2a str. 301
guucuacgugcgcuauguguua

SEQ ID NO: 3930177 - RNA, 23 nt, Shigella flexneri 2a str. 301
guucucaucgccaucaauaacca

SEQ ID NO: 3930178 - RNA, 20 nt, Shigella flexneri 2a str. 301
guucucccauaggaugaggu

SEQ ID NO: 3930179 - RNA, 21 nt, Shigella flexneri 2a str. 301
guucucccauaggaugagguu

SEQ ID NO: 3930180 - RNA, 22 nt, Shigella flexneri 2a str. 301
guucuccuggcccggaauggug

SEQ ID NO: 3930181 - RNA, 14 nt, Shigella flexneri 2a str. 301
guucucuggcccgc

SEQ ID NO: 3930182 - RNA, 13 nt, Shigella flexneri 2a str. 301
guucucuuuaaaa

SEQ ID NO: 3930183 - RNA, 15 nt, Shigella flexneri 2a str. 301
guucugaaucacgcc

SEQ ID NO: 3930184 - RNA, 16 nt, Shigella flexneri 2a str. 301
guucugauaguuaaaa

SEQ ID NO: 3930185 - RNA, 14 nt, Shigella flexneri 2a str. 301
guucugaucuuucu

SEQ ID NO: 3930186 - RNA, 16 nt, Shigella flexneri 2a str. 301
guucugcaaggcgagc

SEQ ID NO: 3930187 - RNA, 16 nt, Shigella flexneri 2a str. 301
guugucaucaacgacg

SEQ ID NO: 3930188 - RNA, 18 nt, Shigella flexneri 2a str. 301
guugucaucggucagauc

SEQ ID NO: 3930189 - RNA, 15 nt, Shigella flexneri 2a str. 301
guugucauuacaaca

SEQ ID NO: 3930190 - RNA, 17 nt, Shigella flexneri 2a str. 301
guugucauuacaacaag

SEQ ID NO: 3930191 - RNA, 15 nt, Shigella flexneri 2a str. 301
guuguccucgccguu

SEQ ID NO: 3930192 - RNA, 20 nt, Shigella flexneri 2a str. 301
guugucgacacccucgacca

SEQ ID NO: 3930193 - RNA, 16 nt, Shigella flexneri 2a str. 301
guugucgccgcuggug

SEQ ID NO: 3930194 - RNA, 18 nt, Shigella flexneri 2a str. 301
guugucucagcuucagau

SEQ ID NO: 3930195 - RNA, 16 nt, Shigella flexneri 2a str. 301
guugucugaauccauc

SEQ ID NO: 3930196 - RNA, 19 nt, Shigella flexneri 2a str. 301
guugucugaauccaucugu

SEQ ID NO: 3930197 - RNA, 17 nt, Shigella flexneri 2a str. 301
guugucuuuccagacuc

SEQ ID NO: 3930198 - RNA, 23 nt, Shigella flexneri 2a str. 301
guugugauuaaacuucaccagca

SEQ ID NO: 3930199 - RNA, 11 nt, Shigella flexneri 2a str. 301
guugugccaga

SEQ ID NO: 3930200 - RNA, 14 nt, Shigella flexneri 2a str. 301
guuguggguaacgu

SEQ ID NO: 3930201 - RNA, 16 nt, Shigella flexneri 2a str. 301
guuguuaaccaccagu

SEQ ID NO: 3930202 - RNA, 20 nt, Shigella flexneri 2a str. 301
guuguuaaccaccaguaaau

SEQ ID NO: 3930203 - RNA, 14 nt, Shigella flexneri 2a str. 301
guuguucgcgcaca

SEQ ID NO: 3930204 - RNA, 20 nt, Shigella flexneri 2a str. 301
guuguugaacggcaaacgca

SEQ ID NO: 3930205 - RNA, 17 nt, Shigella flexneri 2a str. 301
guuguuuacaguaugag

SEQ ID NO: 3930206 - RNA, 14 nt, Shigella flexneri 2a str. 301
guuguuucagaaau

SEQ ID NO: 3930207 - RNA, 15 nt, Shigella flexneri 2a str. 301
guuguuuucagaagc

SEQ ID NO: 3930208 - RNA, 22 nt, Shigella flexneri 2a str. 301
guuuaacgccuucccuuucagc

SEQ ID NO: 3930209 - RNA, 14 nt, Shigella flexneri 2a str. 301
guuuaagacgccgc

SEQ ID NO: 3930210 - RNA, 14 nt, Shigella flexneri 2a str. 301
guuuaaggaaaaac

SEQ ID NO: 3930211 - RNA, 14 nt, Shigella flexneri 2a str. 301
guuuaauaaauuua

SEQ ID NO: 3930212 - RNA, 17 nt, Shigella flexneri 2a str. 301
guuuaauaaauuuagcu

SEQ ID NO: 3930213 - RNA, 20 nt, Shigella flexneri 2a str. 301
guuuaauaugcaauucacac

SEQ ID NO: 3930214 - RNA, 21 nt, Shigella flexneri 2a str. 301
guuuaauucugcggcaaugcg

SEQ ID NO: 3930215 - RNA, 13 nt, Shigella flexneri 2a str. 301
guuuacaaccuga

SEQ ID NO: 3930216 - RNA, 14 nt, Shigella flexneri 2a str. 301
guuuaccggugcca

SEQ ID NO: 3930217 - RNA, 16 nt, Shigella flexneri 2a str. 301
guuuacgaauacggcg

SEQ ID NO: 3930218 - RNA, 19 nt, Shigella flexneri 2a str. 301
guuuacgaauacggcggau

SEQ ID NO: 3930219 - RNA, 20 nt, Shigella flexneri 2a str. 301
guuuacgccgcauccggcau

SEQ ID NO: 3930220 - RNA, 19 nt, Shigella flexneri 2a str. 301
guuuacugucugcuucugc

SEQ ID NO: 3930221 - RNA, 22 nt, Shigella flexneri 2a str. 301
guuuagagacgcauugauaaug

SEQ ID NO: 3930222 - RNA, 20 nt, Shigella flexneri 2a str. 301
guuuagccgcuucugcagcu

SEQ ID NO: 3930223 - RNA, 23 nt, Shigella flexneri 2a str. 301
guuuagcgcggcaauuagcggcu

SEQ ID NO: 3930224 - RNA, 13 nt, Shigella flexneri 2a str. 301
guuuauccauccc

SEQ ID NO: 3930225 - RNA, 21 nt, Shigella flexneri 2a str. 301
guuuauccauccccagagcac

SEQ ID NO: 3930226 - RNA, 18 nt, Shigella flexneri 2a str. 301
guuuaucccaauuaucug

SEQ ID NO: 3930227 - RNA, 21 nt, Shigella flexneri 2a str. 301
guuuaucgaccgcuucaucga

SEQ ID NO: 3930228 - RNA, 20 nt, Shigella flexneri 2a str. 301
guuuaucgucuggaucggca

SEQ ID NO: 3930229 - RNA, 14 nt, Shigella flexneri 2a str. 301
guuuaucuucccag

SEQ ID NO: 3930230 - RNA, 13 nt, Shigella flexneri 2a str. 301
guuuaugccuggu

SEQ ID NO: 3930231 - RNA, 16 nt, Shigella flexneri 2a str. 301
guuucaaacaggcugc

SEQ ID NO: 3930232 - RNA, 20 nt, Shigella flexneri 2a str. 301
guuucaacaucaucucccac

SEQ ID NO: 3930233 - RNA, 23 nt, Shigella flexneri 2a str. 301
guuucaacggaccaauaaacgcc

SEQ ID NO: 3930234 - RNA, 18 nt, Shigella flexneri 2a str. 301
guuucaauauccgguuca

SEQ ID NO: 3930235 - RNA, 15 nt, Shigella flexneri 2a str. 301
guuucaauccaggua

SEQ ID NO: 3930236 - RNA, 16 nt, Shigella flexneri 2a str. 301
guuucaaugcucugca

SEQ ID NO: 3930237 - RNA, 22 nt, Shigella flexneri 2a str. 301
guuucaccagcaguaaaccgcu

SEQ ID NO: 3930238 - RNA, 19 nt, Shigella flexneri 2a str. 301
guuucaccuuuuuccagau

SEQ ID NO: 3930239 - RNA, 16 nt, Shigella flexneri 2a str. 301
guuucacguaccagau

SEQ ID NO: 3930240 - RNA, 20 nt, Shigella flexneri 2a str. 301
guuucagccccaucaacgcc

SEQ ID NO: 3930241 - RNA, 14 nt, Shigella flexneri 2a str. 301
guuucaguaauccu

SEQ ID NO: 3930242 - RNA, 20 nt, Shigella flexneri 2a str. 301
guuucauaucugccagauaa

SEQ ID NO: 3930243 - RNA, 13 nt, Shigella flexneri 2a str. 301
guuuccagauuuu

SEQ ID NO: 3930244 - RNA, 12 nt, Shigella flexneri 2a str. 301
guuuccagcacc

SEQ ID NO: 3930245 - RNA, 13 nt, Shigella flexneri 2a str. 301
guuuccagcacca

SEQ ID NO: 3930246 - RNA, 11 nt, Shigella flexneri 2a str. 301
guuuccagcag

SEQ ID NO: 3930247 - RNA, 21 nt, Shigella flexneri 2a str. 301
guuuccagcaucgaccaggau

SEQ ID NO: 3930248 - RNA, 22 nt, Shigella flexneri 2a str. 301
guuuccagcucggcaaucuguu

SEQ ID NO: 3930249 - RNA, 21 nt, Shigella flexneri 2a str. 301
guuuccgccagcgggccggag

SEQ ID NO: 3930250 - RNA, 16 nt, Shigella flexneri 2a str. 301
guuuccgcuucugcuu

SEQ ID NO: 3930251 - RNA, 21 nt, Shigella flexneri 2a str. 301
guuucgaucagcaauuucucc

SEQ ID NO: 3930252 - RNA, 18 nt, Shigella flexneri 2a str. 301
guuucgauuucugacugu

SEQ ID NO: 3930253 - RNA, 16 nt, Shigella flexneri 2a str. 301
guuucgccagcaccgg

SEQ ID NO: 3930254 - RNA, 17 nt, Shigella flexneri 2a str. 301
guuucgccagccgaugc

SEQ ID NO: 3930255 - RNA, 21 nt, Shigella flexneri 2a str. 301
guuucgccagccgaugcaggu

SEQ ID NO: 3930256 - RNA, 15 nt, Shigella flexneri 2a str. 301
guuucgcgguuggug

SEQ ID NO: 3930257 - RNA, 19 nt, Shigella flexneri 2a str. 301
guuucgcuucuucagccug

SEQ ID NO: 3930258 - RNA, 18 nt, Shigella flexneri 2a str. 301
guuucgugcaucauggaa

SEQ ID NO: 3930259 - RNA, 18 nt, Shigella flexneri 2a str. 301
guuucguggauaacaccg

SEQ ID NO: 3930260 - RNA, 14 nt, Shigella flexneri 2a str. 301
guuucguucgccgu

SEQ ID NO: 3930261 - RNA, 14 nt, Shigella flexneri 2a str. 301
guuucucuguucag

SEQ ID NO: 3930262 - RNA, 18 nt, Shigella flexneri 2a str. 301
guuucucuguucagccug

SEQ ID NO: 3930263 - RNA, 12 nt, Shigella flexneri 2a str. 301
guuucucuucug

SEQ ID NO: 3930264 - RNA, 13 nt, Shigella flexneri 2a str. 301
guuucucuuucuu

SEQ ID NO: 3930265 - RNA, 21 nt, Shigella flexneri 2a str. 301
guuucugaauuucagcgccug

SEQ ID NO: 3930266 - RNA, 19 nt, Shigella flexneri 2a str. 301
guuucugauacagcucaug

SEQ ID NO: 3930267 - RNA, 16 nt, Shigella flexneri 2a str. 301
guuucugauacugcuc

SEQ ID NO: 3930268 - RNA, 17 nt, Shigella flexneri 2a str. 301
guuucugcuuguggcgg

SEQ ID NO: 3930269 - RNA, 17 nt, Shigella flexneri 2a str. 301
guuucuggaugauccug

SEQ ID NO: 3930270 - RNA, 22 nt, Shigella flexneri 2a str. 301
guuucuggaugauccuggccug

SEQ ID NO: 3930271 - RNA, 16 nt, Shigella flexneri 2a str. 301
guuucuggucauugcc

SEQ ID NO: 3930272 - RNA, 20 nt, Shigella flexneri 2a str. 301
guuucuucgauggcuggggu

SEQ ID NO: 3930273 - RNA, 21 nt, Shigella flexneri 2a str. 301
guuugaaaugaugucgcuguc

SEQ ID NO: 3930274 - RNA, 13 nt, Shigella flexneri 2a str. 301
guuugaaauuaau

SEQ ID NO: 3930275 - RNA, 19 nt, Shigella flexneri 2a str. 301
guuugacauaaauuccgcu

SEQ ID NO: 3930276 - RNA, 17 nt, Shigella flexneri 2a str. 301
guuugauuauucacaau

SEQ ID NO: 3930277 - RNA, 18 nt, Shigella flexneri 2a str. 301
guuugcagaugcgcuuca

SEQ ID NO: 3930278 - RNA, 15 nt, Shigella flexneri 2a str. 301
guuugcaggccugau

SEQ ID NO: 3930279 - RNA, 21 nt, Shigella flexneri 2a str. 301
guuugcagugaucgugugcca

SEQ ID NO: 3930280 - RNA, 16 nt, Shigella flexneri 2a str. 301
guuugcaucgccauaa

SEQ ID NO: 3930281 - RNA, 16 nt, Shigella flexneri 2a str. 301
guuugccccggcugcg

SEQ ID NO: 3930282 - RNA, 22 nt, Shigella flexneri 2a str. 301
guuugccguaccacgccacugc

SEQ ID NO: 3930283 - RNA, 15 nt, Shigella flexneri 2a str. 301
guuugcgucauggua

SEQ ID NO: 3930284 - RNA, 12 nt, Shigella flexneri 2a str. 301
guuugcugcaug

SEQ ID NO: 3930285 - RNA, 13 nt, Shigella flexneri 2a str. 301
guuuggcaaauac

SEQ ID NO: 3930286 - RNA, 17 nt, Shigella flexneri 2a str. 301
guuugguaaugaagccu

SEQ ID NO: 3930287 - RNA, 22 nt, Shigella flexneri 2a str. 301
uaaaacgcgcccucagcccaca

SEQ ID NO: 3930288 - RNA, 18 nt, Shigella flexneri 2a str. 301
uaaaacuaacgccaggaa

SEQ ID NO: 3930289 - RNA, 17 nt, Shigella flexneri 2a str. 301
uaaaacuuuauucagug

SEQ ID NO: 3930290 - RNA, 12 nt, Shigella flexneri 2a str. 301
uaaaacuuucca

SEQ ID NO: 3930291 - RNA, 19 nt, Shigella flexneri 2a str. 301
uaaaacuuuuagcaucuua

SEQ ID NO: 3930292 - RNA, 19 nt, Shigella flexneri 2a str. 301
uaaaagaaggcgauguucu

SEQ ID NO: 3930293 - RNA, 12 nt, Shigella flexneri 2a str. 301
uaaaagcaaaaa

SEQ ID NO: 3930294 - RNA, 21 nt, Shigella flexneri 2a str. 301
uaaaagcacagaaucuaagau

SEQ ID NO: 3930295 - RNA, 13 nt, Shigella flexneri 2a str. 301
uaaaagccaggag

SEQ ID NO: 3930296 - RNA, 14 nt, Shigella flexneri 2a str. 301
uaaaagccccuucg

SEQ ID NO: 3930297 - RNA, 21 nt, Shigella flexneri 2a str. 301
uaaaagcgugaaacaaaucac

SEQ ID NO: 3930298 - RNA, 22 nt, Shigella flexneri 2a str. 301
uaaaagcgugaaacaaaucacu

SEQ ID NO: 3930299 - RNA, 12 nt, Shigella flexneri 2a str. 301
uaaaaggaaaca

SEQ ID NO: 3930300 - RNA, 18 nt, Shigella flexneri 2a str. 301
uaaaaggaaacagcguau

SEQ ID NO: 3930301 - RNA, 15 nt, Shigella flexneri 2a str. 301
uaaaaggauguuuau

SEQ ID NO: 3930302 - RNA, 18 nt, Shigella flexneri 2a str. 301
uaaaaggcgccauuuuca

SEQ ID NO: 3930303 - RNA, 20 nt, Shigella flexneri 2a str. 301
uaaaaggcgccauuuucaua

SEQ ID NO: 3930304 - RNA, 20 nt, Shigella flexneri 2a str. 301
uaaaauagcgugaaacgcgu

SEQ ID NO: 3930305 - RNA, 14 nt, Shigella flexneri 2a str. 301
uaaaauaucacucg

SEQ ID NO: 3930306 - RNA, 12 nt, Shigella flexneri 2a str. 301
uaaaauaucuuc

SEQ ID NO: 3930307 - RNA, 15 nt, Shigella flexneri 2a str. 301
uaaaauaucuuccac

SEQ ID NO: 3930308 - RNA, 12 nt, Shigella flexneri 2a str. 301
uaaaaucacagg

SEQ ID NO: 3930309 - RNA, 18 nt, Shigella flexneri 2a str. 301
uaaaaucagaaaucacca

SEQ ID NO: 3930310 - RNA, 21 nt, Shigella flexneri 2a str. 301
uaaaaucaucacgcgguuacg

SEQ ID NO: 3930311 - RNA, 16 nt, Shigella flexneri 2a str. 301
uaaaaucccauaagug

SEQ ID NO: 3930312 - RNA, 18 nt, Shigella flexneri 2a str. 301
uaaaaucgacaucugcaa

SEQ ID NO: 3930313 - RNA, 15 nt, Shigella flexneri 2a str. 301
uaaaaucuucacuaa

SEQ ID NO: 3930314 - RNA, 20 nt, Shigella flexneri 2a str. 301
uaaaaugagugccaaaaaaa

SEQ ID NO: 3930315 - RNA, 22 nt, Shigella flexneri 2a str. 301
uaaaaugagugccaaaaaaaua

SEQ ID NO: 3930316 - RNA, 17 nt, Shigella flexneri 2a str. 301
uaaaaugauacgcuccc

SEQ ID NO: 3930317 - RNA, 18 nt, Shigella flexneri 2a str. 301
uaaaaugauuucgcaacg

SEQ ID NO: 3930318 - RNA, 14 nt, Shigella flexneri 2a str. 301
uaaaaugcgaaaaa

SEQ ID NO: 3930319 - RNA, 14 nt, Shigella flexneri 2a str. 301
uaaaauguacaugu

SEQ ID NO: 3930320 - RNA, 12 nt, Shigella flexneri 2a str. 301
uaaaauuaucca

SEQ ID NO: 3930321 - RNA, 22 nt, Shigella flexneri 2a str. 301
uaaaauuauccagcuuuuccca

SEQ ID NO: 3930322 - RNA, 15 nt, Shigella flexneri 2a str. 301
uaaaauucaucaaau

SEQ ID NO: 3930323 - RNA, 16 nt, Shigella flexneri 2a str. 301
uaaaauucuacagaaa

SEQ ID NO: 3930324 - RNA, 20 nt, Shigella flexneri 2a str. 301
uaaaauucuacagaaaugaa

SEQ ID NO: 3930325 - RNA, 22 nt, Shigella flexneri 2a str. 301
uaaaauucuuacguaauuuaua

SEQ ID NO: 3930326 - RNA, 22 nt, Shigella flexneri 2a str. 301
uaaaauuggcuucguuauugaa

SEQ ID NO: 3930327 - RNA, 20 nt, Shigella flexneri 2a str. 301
uaaacaaagcgcacuuuacu

SEQ ID NO: 3930328 - RNA, 23 nt, Shigella flexneri 2a str. 301
uaaacaaagugcacuuugucaau

SEQ ID NO: 3930329 - RNA, 20 nt, Shigella flexneri 2a str. 301
uaaacaagcguacaaaauua

SEQ ID NO: 3930330 - RNA, 17 nt, Shigella flexneri 2a str. 301
uaaacaagguuugaaaa

SEQ ID NO: 3930331 - RNA, 21 nt, Shigella flexneri 2a str. 301
uaaacaaugagauauuuaaau

SEQ ID NO: 3930332 - RNA, 20 nt, Shigella flexneri 2a str. 301
uaaacaauguuauccggcua

SEQ ID NO: 3930333 - RNA, 18 nt, Shigella flexneri 2a str. 301
uaaacaccagcaauaaug

SEQ ID NO: 3930334 - RNA, 21 nt, Shigella flexneri 2a str. 301
uaaacaccugggcaaugguga

SEQ ID NO: 3930335 - RNA, 12 nt, Shigella flexneri 2a str. 301
uaaacaccuuca

SEQ ID NO: 3930336 - RNA, 17 nt, Shigella flexneri 2a str. 301
uaaacaccuucauccag

SEQ ID NO: 3930337 - RNA, 18 nt, Shigella flexneri 2a str. 301
uaaacaccuucauccagc

SEQ ID NO: 3930338 - RNA, 19 nt, Shigella flexneri 2a str. 301
uaaacaccuucauccagca

SEQ ID NO: 3930339 - RNA, 17 nt, Shigella flexneri 2a str. 301
uaaacagcgcugcgaaa

SEQ ID NO: 3930340 - RNA, 17 nt, Shigella flexneri 2a str. 301
uaaacagguaaagacca

SEQ ID NO: 3930341 - RNA, 20 nt, Shigella flexneri 2a str. 301
uaaacaguacgagagaagag

SEQ ID NO: 3930342 - RNA, 15 nt, Shigella flexneri 2a str. 301
uaaacaguuuucgca

SEQ ID NO: 3930343 - RNA, 18 nt, Shigella flexneri 2a str. 301
uaaacaucaaaccacuua

SEQ ID NO: 3930344 - RNA, 19 nt, Shigella flexneri 2a str. 301
uaaaccaaucaccgccacu

SEQ ID NO: 3930345 - RNA, 20 nt, Shigella flexneri 2a str. 301
uaaaccacccaccagcgccg

SEQ ID NO: 3930346 - RNA, 16 nt, Shigella flexneri 2a str. 301
uaaaccacugacacag

SEQ ID NO: 3930347 - RNA, 13 nt, Shigella flexneri 2a str. 301
uaaaccaggccaa

SEQ ID NO: 3930348 - RNA, 19 nt, Shigella flexneri 2a str. 301
uaaaccaggcgagaucggc

SEQ ID NO: 3930349 - RNA, 16 nt, Shigella flexneri 2a str. 301
uaaacccuggccgcac

SEQ ID NO: 3930350 - RNA, 19 nt, Shigella flexneri 2a str. 301
uaaaccggacaauaaaaaa

SEQ ID NO: 3930351 - RNA, 13 nt, Shigella flexneri 2a str. 301
uaaaccuccagca

SEQ ID NO: 3930352 - RNA, 17 nt, Shigella flexneri 2a str. 301
uaaaccuccagcaucag

SEQ ID NO: 3930353 - RNA, 16 nt, Shigella flexneri 2a str. 301
uaaaccugauuuugcc

SEQ ID NO: 3930354 - RNA, 12 nt, Shigella flexneri 2a str. 301
uaaaccuucauc

SEQ ID NO: 3930355 - RNA, 22 nt, Shigella flexneri 2a str. 301
uaaacgcagagacaucaccaau

SEQ ID NO: 3930356 - RNA, 20 nt, Shigella flexneri 2a str. 301
uaaacgcccaauccggccua

SEQ ID NO: 3930357 - RNA, 19 nt, Shigella flexneri 2a str. 301
uaaacgccggaugacacau

SEQ ID NO: 3930358 - RNA, 22 nt, Shigella flexneri 2a str. 301
uaaacgccggaugacacaucac

SEQ ID NO: 3930359 - RNA, 17 nt, Shigella flexneri 2a str. 301
uaaacgccguucuucag

SEQ ID NO: 3930360 - RNA, 19 nt, Shigella flexneri 2a str. 301
uaaacgccugcuuaucgcc

SEQ ID NO: 3930361 - RNA, 21 nt, Shigella flexneri 2a str. 301
uaaacgccugcuuaucgcccu

SEQ ID NO: 3930362 - RNA, 20 nt, Shigella flexneri 2a str. 301
uaaacgccuuauccggcuua

SEQ ID NO: 3930363 - RNA, 20 nt, Shigella flexneri 2a str. 301
uaaacgccuuauccguccua

SEQ ID NO: 3930364 - RNA, 15 nt, Shigella flexneri 2a str. 301
uaaacgcuauuugcc

SEQ ID NO: 3930365 - RNA, 20 nt, Shigella flexneri 2a str. 301
uaaacggcguaaaauucaca

SEQ ID NO: 3930366 - RNA, 12 nt, Shigella flexneri 2a str. 301
uaaacgguaccg

SEQ ID NO: 3930367 - RNA, 14 nt, Shigella flexneri 2a str. 301
uaaacguuuaaaaa

SEQ ID NO: 3930368 - RNA, 12 nt, Shigella flexneri 2a str. 301
uaaacucaaagu

SEQ ID NO: 3930369 - RNA, 21 nt, Shigella flexneri 2a str. 301
uaaacucgaacauacgcugca

SEQ ID NO: 3930370 - RNA, 14 nt, Shigella flexneri 2a str. 301
uaaacugagccaaa

SEQ ID NO: 3930371 - RNA, 23 nt, Shigella flexneri 2a str. 301
uaaacuggauggcucugauugau

SEQ ID NO: 3930372 - RNA, 13 nt, Shigella flexneri 2a str. 301
uaaacuggcugug

SEQ ID NO: 3930373 - RNA, 12 nt, Shigella flexneri 2a str. 301
uaaacuuggcua

SEQ ID NO: 3930374 - RNA, 12 nt, Shigella flexneri 2a str. 301
uaaacuuucaua

SEQ ID NO: 3930375 - RNA, 15 nt, Shigella flexneri 2a str. 301
uaaagaaccucuuca

SEQ ID NO: 3930376 - RNA, 22 nt, Shigella flexneri 2a str. 301
uaaagaacucgaggauaaauuu

SEQ ID NO: 3930377 - RNA, 21 nt, Shigella flexneri 2a str. 301
uaaagaagauaccgaacauac

SEQ ID NO: 3930378 - RNA, 17 nt, Shigella flexneri 2a str. 301
uaaagaagguaagucca

SEQ ID NO: 3930379 - RNA, 22 nt, Shigella flexneri 2a str. 301
uaaagacguuaacuacaaucac

SEQ ID NO: 3930380 - RNA, 15 nt, Shigella flexneri 2a str. 301
uaaagaguaaauugc

SEQ ID NO: 3930381 - RNA, 24 nt, Shigella flexneri 2a str. 301
uaaagaguaaauugcaaaccucag

SEQ ID NO: 3930382 - RNA, 15 nt, Shigella flexneri 2a str. 301
uaaagauaauguaaa

SEQ ID NO: 3930383 - RNA, 22 nt, Shigella flexneri 2a str. 301
uaaagaugccauuggcauaaau

SEQ ID NO: 3930384 - RNA, 19 nt, Shigella flexneri 2a str. 301
uaaagauugauuauugagc

SEQ ID NO: 3930385 - RNA, 21 nt, Shigella flexneri 2a str. 301
uaaagcaucaauugcuaccga

SEQ ID NO: 3930386 - RNA, 23 nt, Shigella flexneri 2a str. 301
uaaagcauuuucauccauuacca

SEQ ID NO: 3930387 - RNA, 18 nt, Shigella flexneri 2a str. 301
uaacaauuuaucagacaa

SEQ ID NO: 3930388 - RNA, 14 nt, Shigella flexneri 2a str. 301
uaacacacaauuac

SEQ ID NO: 3930389 - RNA, 19 nt, Shigella flexneri 2a str. 301
uaacacagaggcagcaucu

SEQ ID NO: 3930390 - RNA, 15 nt, Shigella flexneri 2a str. 301
uaacaccaguaaaua

SEQ ID NO: 3930391 - RNA, 13 nt, Shigella flexneri 2a str. 301
uaacaccaucagu

SEQ ID NO: 3930392 - RNA, 13 nt, Shigella flexneri 2a str. 301
uaacaccauccau

SEQ ID NO: 3930393 - RNA, 19 nt, Shigella flexneri 2a str. 301
uaacacgcucuggcaggcu

SEQ ID NO: 3930394 - RNA, 18 nt, Shigella flexneri 2a str. 301
uaacacgcuucaaguuca

SEQ ID NO: 3930395 - RNA, 13 nt, Shigella flexneri 2a str. 301
uaacacugauaac

SEQ ID NO: 3930396 - RNA, 18 nt, Shigella flexneri 2a str. 301
uaacacuucaucacuacc

SEQ ID NO: 3930397 - RNA, 19 nt, Shigella flexneri 2a str. 301
uaacagaacgcauaacagc

SEQ ID NO: 3930398 - RNA, 20 nt, Shigella flexneri 2a str. 301
uaacagagccgcgauaaaau

SEQ ID NO: 3930399 - RNA, 21 nt, Shigella flexneri 2a str. 301
uaacagcaaucccaaaauaau

SEQ ID NO: 3930400 - RNA, 11 nt, Shigella flexneri 2a str. 301
uaacagcagca

SEQ ID NO: 3930401 - RNA, 14 nt, Shigella flexneri 2a str. 301
uaacagcagcagcg

SEQ ID NO: 3930402 - RNA, 16 nt, Shigella flexneri 2a str. 301
uaacagcgaaaucgcc

SEQ ID NO: 3930403 - RNA, 18 nt, Shigella flexneri 2a str. 301
uaacagcgaaaucgccuu

SEQ ID NO: 3930404 - RNA, 15 nt, Shigella flexneri 2a str. 301
uaacaggaagcagcu

SEQ ID NO: 3930405 - RNA, 15 nt, Shigella flexneri 2a str. 301
uaacagguuuaaaca

SEQ ID NO: 3930406 - RNA, 16 nt, Shigella flexneri 2a str. 301
uaacagguuuaaacag

SEQ ID NO: 3930407 - RNA, 20 nt, Shigella flexneri 2a str. 301
uaacaucgccagaaaucagc

SEQ ID NO: 3930408 - RNA, 21 nt, Shigella flexneri 2a str. 301
uaacauguuuuuugaugucau

SEQ ID NO: 3930409 - RNA, 14 nt, Shigella flexneri 2a str. 301
uaacauuuuacuua

SEQ ID NO: 3930410 - RNA, 16 nt, Shigella flexneri 2a str. 301
uaaccaacaauaaaau

SEQ ID NO: 3930411 - RNA, 17 nt, Shigella flexneri 2a str. 301
uaaccaacaauaaaauu

SEQ ID NO: 3930412 - RNA, 17 nt, Shigella flexneri 2a str. 301
uaaccaacaaugcaaaa

SEQ ID NO: 3930413 - RNA, 22 nt, Shigella flexneri 2a str. 301
uaaccaacaauugucgccacaa

SEQ ID NO: 3930414 - RNA, 12 nt, Shigella flexneri 2a str. 301
uaaccaaucacg

SEQ ID NO: 3930415 - RNA, 16 nt, Shigella flexneri 2a str. 301
uaaccaccaguaaauu

SEQ ID NO: 3930416 - RNA, 16 nt, Shigella flexneri 2a str. 301
uaaccacgcucagcaa

SEQ ID NO: 3930417 - RNA, 19 nt, Shigella flexneri 2a str. 301
uaaccacguucauuucaua

SEQ ID NO: 3930418 - RNA, 12 nt, Shigella flexneri 2a str. 301
uaaccacuucag

SEQ ID NO: 3930419 - RNA, 20 nt, Shigella flexneri 2a str. 301
uaaccagagagcuuauccag

SEQ ID NO: 3930420 - RNA, 20 nt, Shigella flexneri 2a str. 301
uaaccagaugucgcgcacug

SEQ ID NO: 3930421 - RNA, 21 nt, Shigella flexneri 2a str. 301
uaaccagaugucgcgcacugg

SEQ ID NO: 3930422 - RNA, 15 nt, Shigella flexneri 2a str. 301
uaaccagcaccagcu

SEQ ID NO: 3930423 - RNA, 14 nt, Shigella flexneri 2a str. 301
uaaccagccaaaua

SEQ ID NO: 3930424 - RNA, 18 nt, Shigella flexneri 2a str. 301
uaaccagccaaauaaaau

SEQ ID NO: 3930425 - RNA, 20 nt, Shigella flexneri 2a str. 301
uaaccagcgcagacaccaga

SEQ ID NO: 3930426 - RNA, 21 nt, Shigella flexneri 2a str. 301
uaaccagcguuuccagcacca

SEQ ID NO: 3930427 - RNA, 19 nt, Shigella flexneri 2a str. 301
uaaccagucggaaacauga

SEQ ID NO: 3930428 - RNA, 18 nt, Shigella flexneri 2a str. 301
uaaccaguugucgcacau

SEQ ID NO: 3930429 - RNA, 21 nt, Shigella flexneri 2a str. 301
uaaccauauaugauaauuauu

SEQ ID NO: 3930430 - RNA, 20 nt, Shigella flexneri 2a str. 301
uaaccauccauauuuggcau

SEQ ID NO: 3930431 - RNA, 12 nt, Shigella flexneri 2a str. 301
uaaccaucccuu

SEQ ID NO: 3930432 - RNA, 16 nt, Shigella flexneri 2a str. 301
uaaccaucuucuucac

SEQ ID NO: 3930433 - RNA, 20 nt, Shigella flexneri 2a str. 301
uaacccacugacuucucugg

SEQ ID NO: 3930434 - RNA, 20 nt, Shigella flexneri 2a str. 301
uaacccaggggucaguuccc

SEQ ID NO: 3930435 - RNA, 20 nt, Shigella flexneri 2a str. 301
uaaccccacagggugagcag

SEQ ID NO: 3930436 - RNA, 14 nt, Shigella flexneri 2a str. 301
uaaccccaccagca

SEQ ID NO: 3930437 - RNA, 13 nt, Shigella flexneri 2a str. 301
uaaccccagacca

SEQ ID NO: 3930438 - RNA, 15 nt, Shigella flexneri 2a str. 301
uaaccccgggcugga

SEQ ID NO: 3930439 - RNA, 18 nt, Shigella flexneri 2a str. 301
uaacccggcaccaacaaa

SEQ ID NO: 3930440 - RNA, 20 nt, Shigella flexneri 2a str. 301
uaacccugcauauaaucgau

SEQ ID NO: 3930441 - RNA, 13 nt, Shigella flexneri 2a str. 301
uaacccuuccaga

SEQ ID NO: 3930442 - RNA, 22 nt, Shigella flexneri 2a str. 301
uaaccgccaguaaucuggccaa

SEQ ID NO: 3930443 - RNA, 17 nt, Shigella flexneri 2a str. 301
uaaccgccuaauuacau

SEQ ID NO: 3930444 - RNA, 20 nt, Shigella flexneri 2a str. 301
uaaccgcgcucagccagccg

SEQ ID NO: 3930445 - RNA, 17 nt, Shigella flexneri 2a str. 301
uaaccgcggcuaagcug

SEQ ID NO: 3930446 - RNA, 17 nt, Shigella flexneri 2a str. 301
uaaccgcugcaaaaaau

SEQ ID NO: 3930447 - RNA, 23 nt, Shigella flexneri 2a str. 301
uaaccgcuucgcuggcagcugcu

SEQ ID NO: 3930448 - RNA, 12 nt, Shigella flexneri 2a str. 301
uaaccgcuuuuu

SEQ ID NO: 3930449 - RNA, 22 nt, Shigella flexneri 2a str. 301
uaaccgcuuuuucaauuuccag

SEQ ID NO: 3930450 - RNA, 21 nt, Shigella flexneri 2a str. 301
uaaccgguacgccgcguuuau

SEQ ID NO: 3930451 - RNA, 14 nt, Shigella flexneri 2a str. 301
uaaccguccaguug

SEQ ID NO: 3930452 - RNA, 16 nt, Shigella flexneri 2a str. 301
uaaccguccaguugug

SEQ ID NO: 3930453 - RNA, 14 nt, Shigella flexneri 2a str. 301
uaaccguugaccag

SEQ ID NO: 3930454 - RNA, 19 nt, Shigella flexneri 2a str. 301
uaaccguuucuaauauuag

SEQ ID NO: 3930455 - RNA, 13 nt, Shigella flexneri 2a str. 301
uaaccguuuugug

SEQ ID NO: 3930456 - RNA, 14 nt, Shigella flexneri 2a str. 301
uaaccuaaaugcuc

SEQ ID NO: 3930457 - RNA, 15 nt, Shigella flexneri 2a str. 301
uaaccuggcaguucg

SEQ ID NO: 3930458 - RNA, 20 nt, Shigella flexneri 2a str. 301
uaaccuugcaauaguuucag

SEQ ID NO: 3930459 - RNA, 23 nt, Shigella flexneri 2a str. 301
uaaccuuguccaccgugauucac

SEQ ID NO: 3930460 - RNA, 20 nt, Shigella flexneri 2a str. 301
uaaccuuugcgguuaaaaau

SEQ ID NO: 3930461 - RNA, 17 nt, Shigella flexneri 2a str. 301
uaacgaaagaacaguua

SEQ ID NO: 3930462 - RNA, 13 nt, Shigella flexneri 2a str. 301
uaacgaaagcgcc

SEQ ID NO: 3930463 - RNA, 20 nt, Shigella flexneri 2a str. 301
uaacgaacgcagugauaacu

SEQ ID NO: 3930464 - RNA, 18 nt, Shigella flexneri 2a str. 301
uaacgaacucuuugccca

SEQ ID NO: 3930465 - RNA, 13 nt, Shigella flexneri 2a str. 301
uaacgaccaccac

SEQ ID NO: 3930466 - RNA, 23 nt, Shigella flexneri 2a str. 301
uaacgaccaccaccgcaguaauc

SEQ ID NO: 3930467 - RNA, 17 nt, Shigella flexneri 2a str. 301
uaacgcacacauccaca

SEQ ID NO: 3930468 - RNA, 20 nt, Shigella flexneri 2a str. 301
uaacgcagaaucuucuucuc

SEQ ID NO: 3930469 - RNA, 22 nt, Shigella flexneri 2a str. 301
uaacgcagggcuguuuaucgug

SEQ ID NO: 3930470 - RNA, 22 nt, Shigella flexneri 2a str. 301
uaacgcaucggcuaaaccauca

SEQ ID NO: 3930471 - RNA, 14 nt, Shigella flexneri 2a str. 301
uaacgccagacucg

SEQ ID NO: 3930472 - RNA, 16 nt, Shigella flexneri 2a str. 301
uaacgccauauugcug

SEQ ID NO: 3930473 - RNA, 17 nt, Shigella flexneri 2a str. 301
uaacgccauauugcugu

SEQ ID NO: 3930474 - RNA, 15 nt, Shigella flexneri 2a str. 301
uaacgccccacaaac

SEQ ID NO: 3930475 - RNA, 16 nt, Shigella flexneri 2a str. 301
uaacgccccacaaacc

SEQ ID NO: 3930476 - RNA, 17 nt, Shigella flexneri 2a str. 301
uaacgccccggcaaaac

SEQ ID NO: 3930477 - RNA, 21 nt, Shigella flexneri 2a str. 301
uaacgccggagagaaaaaccu

SEQ ID NO: 3930478 - RNA, 21 nt, Shigella flexneri 2a str. 301
uaacgccguuauuaaaaagcc

SEQ ID NO: 3930479 - RNA, 14 nt, Shigella flexneri 2a str. 301
uaacgccuggcagu

SEQ ID NO: 3930480 - RNA, 19 nt, Shigella flexneri 2a str. 301
uaacgccuuauccggccua

SEQ ID NO: 3930481 - RNA, 22 nt, Shigella flexneri 2a str. 301
uaacgccuucccuuucagcaaa

SEQ ID NO: 3930482 - RNA, 16 nt, Shigella flexneri 2a str. 301
uaacgccuuuuccagc

SEQ ID NO: 3930483 - RNA, 17 nt, Shigella flexneri 2a str. 301
uaacgccuuuuccagcg

SEQ ID NO: 3930484 - RNA, 19 nt, Shigella flexneri 2a str. 301
uaacgcguacccagcagcg

SEQ ID NO: 3930485 - RNA, 14 nt, Shigella flexneri 2a str. 301
uaacgcgucucaug

SEQ ID NO: 3930486 - RNA, 21 nt, Shigella flexneri 2a str. 301
uaacgcgucuuaucuggccua

SEQ ID NO: 3930487 - RNA, 17 nt, Shigella flexneri 2a str. 301
uaaggaaacuccagccc

SEQ ID NO: 3930488 - RNA, 15 nt, Shigella flexneri 2a str. 301
uaaggaaauucagca

SEQ ID NO: 3930489 - RNA, 22 nt, Shigella flexneri 2a str. 301
uaaggaacggggguuuuacuuu

SEQ ID NO: 3930490 - RNA, 17 nt, Shigella flexneri 2a str. 301
uaaggcaacgccccuuc

SEQ ID NO: 3930491 - RNA, 14 nt, Shigella flexneri 2a str. 301
uaaggcaagaaaau

SEQ ID NO: 3930492 - RNA, 20 nt, Shigella flexneri 2a str. 301
uaaggcgcaauaaucagugc

SEQ ID NO: 3930493 - RNA, 22 nt, Shigella flexneri 2a str. 301
uaaggcgcgagguuuuccuuca

SEQ ID NO: 3930494 - RNA, 15 nt, Shigella flexneri 2a str. 301
uaaggcuguucccac

SEQ ID NO: 3930495 - RNA, 14 nt, Shigella flexneri 2a str. 301
uaaggguaaaagga

SEQ ID NO: 3930496 - RNA, 15 nt, Shigella flexneri 2a str. 301
uaaggguaaaaggau

SEQ ID NO: 3930497 - RNA, 17 nt, Shigella flexneri 2a str. 301
uaaggguauagaagcca

SEQ ID NO: 3930498 - RNA, 23 nt, Shigella flexneri 2a str. 301
uaagggugucuguuaaucgcauu

SEQ ID NO: 3930499 - RNA, 18 nt, Shigella flexneri 2a str. 301
uaaggguuuuuuuaugcc

SEQ ID NO: 3930500 - RNA, 19 nt, Shigella flexneri 2a str. 301
uaagguaucgcgaaaaaaa

SEQ ID NO: 3930501 - RNA, 22 nt, Shigella flexneri 2a str. 301
uaagguaucgcgaaaaaaaaga

SEQ ID NO: 3930502 - RNA, 16 nt, Shigella flexneri 2a str. 301
uaaggucaccaguuca

SEQ ID NO: 3930503 - RNA, 23 nt, Shigella flexneri 2a str. 301
uaaggucagacgaagucaacaag

SEQ ID NO: 3930504 - RNA, 16 nt, Shigella flexneri 2a str. 301
uaagguccuccagcuc

SEQ ID NO: 3930505 - RNA, 20 nt, Shigella flexneri 2a str. 301
uaaggugguagcugcccccg

SEQ ID NO: 3930506 - RNA, 19 nt, Shigella flexneri 2a str. 301
uaagguguuuacaccgcau

SEQ ID NO: 3930507 - RNA, 14 nt, Shigella flexneri 2a str. 301
uaaguacauuaaaa

SEQ ID NO: 3930508 - RNA, 16 nt, Shigella flexneri 2a str. 301
uaaguacauuaaaauu

SEQ ID NO: 3930509 - RNA, 13 nt, Shigella flexneri 2a str. 301
uaaguacauuaag

SEQ ID NO: 3930510 - RNA, 15 nt, Shigella flexneri 2a str. 301
uaaguagccuuuaac

SEQ ID NO: 3930511 - RNA, 15 nt, Shigella flexneri 2a str. 301
uaaguaugcaauaac

SEQ ID NO: 3930512 - RNA, 18 nt, Shigella flexneri 2a str. 301
uaaguccauacugucucc

SEQ ID NO: 3930513 - RNA, 21 nt, Shigella flexneri 2a str. 301
uaaguguuucacuuucaucac

SEQ ID NO: 3930514 - RNA, 22 nt, Shigella flexneri 2a str. 301
uaaguguuucacuuucaucacc

SEQ ID NO: 3930515 - RNA, 20 nt, Shigella flexneri 2a str. 301
uaaguuaauucugagagcau

SEQ ID NO: 3930516 - RNA, 17 nt, Shigella flexneri 2a str. 301
uaaguuagaggcacaua

SEQ ID NO: 3930517 - RNA, 19 nt, Shigella flexneri 2a str. 301
uaaguucaaguuugcuuca

SEQ ID NO: 3930518 - RNA, 24 nt, Shigella flexneri 2a str. 301
uaaguugccacgcuucaaucugau

SEQ ID NO: 3930519 - RNA, 23 nt, Shigella flexneri 2a str. 301
uaaguuuaucccaauuaucugga

SEQ ID NO: 3930520 - RNA, 20 nt, Shigella flexneri 2a str. 301
uaauaaaauacuuuuacucu

SEQ ID NO: 3930521 - RNA, 20 nt, Shigella flexneri 2a str. 301
uaauaaaauuuacaguauaa

SEQ ID NO: 3930522 - RNA, 15 nt, Shigella flexneri 2a str. 301
uaauaaacaucagcu

SEQ ID NO: 3930523 - RNA, 15 nt, Shigella flexneri 2a str. 301
uaauaaagaugccau

SEQ ID NO: 3930524 - RNA, 22 nt, Shigella flexneri 2a str. 301
uaauaaagcccccuguuugucu

SEQ ID NO: 3930525 - RNA, 13 nt, Shigella flexneri 2a str. 301
uaauaaagccuau

SEQ ID NO: 3930526 - RNA, 19 nt, Shigella flexneri 2a str. 301
uaauaaaucgugaaacaau

SEQ ID NO: 3930527 - RNA, 21 nt, Shigella flexneri 2a str. 301
uaauaaaugccggaagcugca

SEQ ID NO: 3930528 - RNA, 13 nt, Shigella flexneri 2a str. 301
uaauaaauuaacu

SEQ ID NO: 3930529 - RNA, 22 nt, Shigella flexneri 2a str. 301
uaauaagcgcaaggguaaacgu

SEQ ID NO: 3930530 - RNA, 21 nt, Shigella flexneri 2a str. 301
uaauaagguucauugagcgca

SEQ ID NO: 3930531 - RNA, 14 nt, Shigella flexneri 2a str. 301
uaauaaucagcaca

SEQ ID NO: 3930532 - RNA, 15 nt, Shigella flexneri 2a str. 301
uaauaaugagcagaa

SEQ ID NO: 3930533 - RNA, 14 nt, Shigella flexneri 2a str. 301
uaauaauuucugca

SEQ ID NO: 3930534 - RNA, 21 nt, Shigella flexneri 2a str. 301
uaauacacuaacagaacaaua

SEQ ID NO: 3930535 - RNA, 12 nt, Shigella flexneri 2a str. 301
uaauacaggcua

SEQ ID NO: 3930536 - RNA, 14 nt, Shigella flexneri 2a str. 301
uaauaccagccuuc

SEQ ID NO: 3930537 - RNA, 13 nt, Shigella flexneri 2a str. 301
uaauaccaucggc

SEQ ID NO: 3930538 - RNA, 21 nt, Shigella flexneri 2a str. 301
uaauaccgacuccguagaacc

SEQ ID NO: 3930539 - RNA, 11 nt, Shigella flexneri 2a str. 301
uaauaccguag

SEQ ID NO: 3930540 - RNA, 16 nt, Shigella flexneri 2a str. 301
uaauacgcaucgacau

SEQ ID NO: 3930541 - RNA, 12 nt, Shigella flexneri 2a str. 301
uaauacgccaga

SEQ ID NO: 3930542 - RNA, 17 nt, Shigella flexneri 2a str. 301
uaauacugcuccccgaa

SEQ ID NO: 3930543 - RNA, 18 nt, Shigella flexneri 2a str. 301
uaauagauccuuuuuccc

SEQ ID NO: 3930544 - RNA, 14 nt, Shigella flexneri 2a str. 301
uaauagccaucaca

SEQ ID NO: 3930545 - RNA, 14 nt, Shigella flexneri 2a str. 301
uaauagguaaacau

SEQ ID NO: 3930546 - RNA, 18 nt, Shigella flexneri 2a str. 301
uaauaguauuaagccagu

SEQ ID NO: 3930547 - RNA, 23 nt, Shigella flexneri 2a str. 301
uaauaguauuaagccaguucuca

SEQ ID NO: 3930548 - RNA, 13 nt, Shigella flexneri 2a str. 301
uaauaguuucuga

SEQ ID NO: 3930549 - RNA, 21 nt, Shigella flexneri 2a str. 301
uaauauacagccuuaacaaga

SEQ ID NO: 3930550 - RNA, 23 nt, Shigella flexneri 2a str. 301
uaauauauccccccaugaaauaa

SEQ ID NO: 3930551 - RNA, 15 nt, Shigella flexneri 2a str. 301
uaauaucaggcauuc

SEQ ID NO: 3930552 - RNA, 18 nt, Shigella flexneri 2a str. 301
uaauauccaacgauauag

SEQ ID NO: 3930553 - RNA, 17 nt, Shigella flexneri 2a str. 301
uaauauccugccguuuu

SEQ ID NO: 3930554 - RNA, 17 nt, Shigella flexneri 2a str. 301
uaauaucuccagcuaua

SEQ ID NO: 3930555 - RNA, 22 nt, Shigella flexneri 2a str. 301
uaauaucuuucugccaccagua

SEQ ID NO: 3930556 - RNA, 17 nt, Shigella flexneri 2a str. 301
uaauaucuuuucuuaac

SEQ ID NO: 3930557 - RNA, 14 nt, Shigella flexneri 2a str. 301
uaauaugcaauuca

SEQ ID NO: 3930558 - RNA, 16 nt, Shigella flexneri 2a str. 301
uaauaugcaauucaca

SEQ ID NO: 3930559 - RNA, 13 nt, Shigella flexneri 2a str. 301
uaauaugcugguu

SEQ ID NO: 3930560 - RNA, 21 nt, Shigella flexneri 2a str. 301
uaauauucaacgucacugggu

SEQ ID NO: 3930561 - RNA, 13 nt, Shigella flexneri 2a str. 301
uaauauuuaucuu

SEQ ID NO: 3930562 - RNA, 14 nt, Shigella flexneri 2a str. 301
uaaucaagcccugg

SEQ ID NO: 3930563 - RNA, 20 nt, Shigella flexneri 2a str. 301
uaaucaaucuuuacacacaa

SEQ ID NO: 3930564 - RNA, 14 nt, Shigella flexneri 2a str. 301
uaaucaauuuaucg

SEQ ID NO: 3930565 - RNA, 12 nt, Shigella flexneri 2a str. 301
uaaucaccagcg

SEQ ID NO: 3930566 - RNA, 17 nt, Shigella flexneri 2a str. 301
uaaucagaauuuuucgc

SEQ ID NO: 3930567 - RNA, 18 nt, Shigella flexneri 2a str. 301
uaaucagaucguugaccu

SEQ ID NO: 3930568 - RNA, 12 nt, Shigella flexneri 2a str. 301
uaaucagcacaa

SEQ ID NO: 3930569 - RNA, 19 nt, Shigella flexneri 2a str. 301
uaaucagcgaguuaccuua

SEQ ID NO: 3930570 - RNA, 18 nt, Shigella flexneri 2a str. 301
uaaucagcuaauggcugc

SEQ ID NO: 3930571 - RNA, 15 nt, Shigella flexneri 2a str. 301
uaaucagcuuuucca

SEQ ID NO: 3930572 - RNA, 13 nt, Shigella flexneri 2a str. 301
uaaucaggcuauc

SEQ ID NO: 3930573 - RNA, 14 nt, Shigella flexneri 2a str. 301
uaaucaggcuaucu

SEQ ID NO: 3930574 - RNA, 13 nt, Shigella flexneri 2a str. 301
uaaucauauuaaa

SEQ ID NO: 3930575 - RNA, 16 nt, Shigella flexneri 2a str. 301
uaaucauauuaaauuu

SEQ ID NO: 3930576 - RNA, 11 nt, Shigella flexneri 2a str. 301
uaaucaucauu

SEQ ID NO: 3930577 - RNA, 19 nt, Shigella flexneri 2a str. 301
uaaucaucauuaauaucuu

SEQ ID NO: 3930578 - RNA, 21 nt, Shigella flexneri 2a str. 301
uaaucauccaccuuaaaacaa

SEQ ID NO: 3930579 - RNA, 18 nt, Shigella flexneri 2a str. 301
uaaucaucccacaugaau

SEQ ID NO: 3930580 - RNA, 22 nt, Shigella flexneri 2a str. 301
uaaucaucgcgugacagccuug

SEQ ID NO: 3930581 - RNA, 15 nt, Shigella flexneri 2a str. 301
uaaucaucucuccuu

SEQ ID NO: 3930582 - RNA, 18 nt, Shigella flexneri 2a str. 301
uaaucaucuguugugcca

SEQ ID NO: 3930583 - RNA, 17 nt, Shigella flexneri 2a str. 301
uaauccacagcaaugca

SEQ ID NO: 3930584 - RNA, 16 nt, Shigella flexneri 2a str. 301
uaauccaccuggccug

SEQ ID NO: 3930585 - RNA, 12 nt, Shigella flexneri 2a str. 301
uaauccacuuuc

SEQ ID NO: 3930586 - RNA, 14 nt, Shigella flexneri 2a str. 301
uaauccacuuucuu

SEQ ID NO: 3930587 - RNA, 13 nt, Shigella flexneri 2a str. 301
uaauuuuaaauau

SEQ ID NO: 3930588 - RNA, 22 nt, Shigella flexneri 2a str. 301
uaauuuuaaauaucaucaaaau

SEQ ID NO: 3930589 - RNA, 21 nt, Shigella flexneri 2a str. 301
uaauuuugugcagcaugcacc

SEQ ID NO: 3930590 - RNA, 19 nt, Shigella flexneri 2a str. 301
uaauuuuuaugcguuauac

SEQ ID NO: 3930591 - RNA, 14 nt, Shigella flexneri 2a str. 301
uaauuuuuccagca

SEQ ID NO: 3930592 - RNA, 15 nt, Shigella flexneri 2a str. 301
uaauuuuuugcgcca

SEQ ID NO: 3930593 - RNA, 15 nt, Shigella flexneri 2a str. 301
uacaaaaaaugugaa

SEQ ID NO: 3930594 - RNA, 23 nt, Shigella flexneri 2a str. 301
uacaaaaccacacuucuucagcc

SEQ ID NO: 3930595 - RNA, 16 nt, Shigella flexneri 2a str. 301
uacaaaagcaauaauu

SEQ ID NO: 3930596 - RNA, 16 nt, Shigella flexneri 2a str. 301
uacaaaaucuauugca

SEQ ID NO: 3930597 - RNA, 18 nt, Shigella flexneri 2a str. 301
uacaaaauuuaacaccau

SEQ ID NO: 3930598 - RNA, 13 nt, Shigella flexneri 2a str. 301
uacaaacccagcc

SEQ ID NO: 3930599 - RNA, 23 nt, Shigella flexneri 2a str. 301
uacaaacggcugacgggaaaacg

SEQ ID NO: 3930600 - RNA, 19 nt, Shigella flexneri 2a str. 301
uacaaaugggcacaauuca

SEQ ID NO: 3930601 - RNA, 20 nt, Shigella flexneri 2a str. 301
uacaaaugggcacaauucau

SEQ ID NO: 3930602 - RNA, 22 nt, Shigella flexneri 2a str. 301
uacaaauuugugcaaauucaau

SEQ ID NO: 3930603 - RNA, 18 nt, Shigella flexneri 2a str. 301
uacaacaucguaucuggc

SEQ ID NO: 3930604 - RNA, 11 nt, Shigella flexneri 2a str. 301
uacaaccaucc

SEQ ID NO: 3930605 - RNA, 18 nt, Shigella flexneri 2a str. 301
uacaacgcaauauccgcc

SEQ ID NO: 3930606 - RNA, 20 nt, Shigella flexneri 2a str. 301
uacaacgccguuuaauauua

SEQ ID NO: 3930607 - RNA, 15 nt, Shigella flexneri 2a str. 301
uacaacgcgcgguga

SEQ ID NO: 3930608 - RNA, 16 nt, Shigella flexneri 2a str. 301
uacaacguauugaaau

SEQ ID NO: 3930609 - RNA, 13 nt, Shigella flexneri 2a str. 301
uacaacguuaccg

SEQ ID NO: 3930610 - RNA, 19 nt, Shigella flexneri 2a str. 301
uacaacucgcuuaagccau

SEQ ID NO: 3930611 - RNA, 21 nt, Shigella flexneri 2a str. 301
uacaacugccgcgccugaauc

SEQ ID NO: 3930612 - RNA, 20 nt, Shigella flexneri 2a str. 301
uacaacugcuuuuugcucuc

SEQ ID NO: 3930613 - RNA, 15 nt, Shigella flexneri 2a str. 301
uacaacuuacgcagu

SEQ ID NO: 3930614 - RNA, 21 nt, Shigella flexneri 2a str. 301
uacaagaaccaaagaaaucag

SEQ ID NO: 3930615 - RNA, 17 nt, Shigella flexneri 2a str. 301
uacaagaaucaugccaa

SEQ ID NO: 3930616 - RNA, 13 nt, Shigella flexneri 2a str. 301
uacaagcagagag

SEQ ID NO: 3930617 - RNA, 13 nt, Shigella flexneri 2a str. 301
uacaagcggaaac

SEQ ID NO: 3930618 - RNA, 18 nt, Shigella flexneri 2a str. 301
uacaaggccaauccagcc

SEQ ID NO: 3930619 - RNA, 21 nt, Shigella flexneri 2a str. 301
uacaaguccguugaaaaugcu

SEQ ID NO: 3930620 - RNA, 13 nt, Shigella flexneri 2a str. 301
uacaauauccagc

SEQ ID NO: 3930621 - RNA, 19 nt, Shigella flexneri 2a str. 301
uacaaucacgauagccaga

SEQ ID NO: 3930622 - RNA, 16 nt, Shigella flexneri 2a str. 301
uacaaucaggccaauc

SEQ ID NO: 3930623 - RNA, 22 nt, Shigella flexneri 2a str. 301
uacaauguuucugcaauauauu

SEQ ID NO: 3930624 - RNA, 16 nt, Shigella flexneri 2a str. 301
uacacaacaugcagcc

SEQ ID NO: 3930625 - RNA, 21 nt, Shigella flexneri 2a str. 301
uacacaagccaggacgcaguc

SEQ ID NO: 3930626 - RNA, 23 nt, Shigella flexneri 2a str. 301
uacacaagccaggacgcagucca

SEQ ID NO: 3930627 - RNA, 17 nt, Shigella flexneri 2a str. 301
uacacacuuuccaggcg

SEQ ID NO: 3930628 - RNA, 16 nt, Shigella flexneri 2a str. 301
uacacagacgguuuuu

SEQ ID NO: 3930629 - RNA, 13 nt, Shigella flexneri 2a str. 301
uacacaugcugcc

SEQ ID NO: 3930630 - RNA, 14 nt, Shigella flexneri 2a str. 301
uacaccaucaugga

SEQ ID NO: 3930631 - RNA, 18 nt, Shigella flexneri 2a str. 301
uacaccaugccggugaug

SEQ ID NO: 3930632 - RNA, 12 nt, Shigella flexneri 2a str. 301
uacacccagccc

SEQ ID NO: 3930633 - RNA, 20 nt, Shigella flexneri 2a str. 301
uacaccggcaacguuuucaa

SEQ ID NO: 3930634 - RNA, 20 nt, Shigella flexneri 2a str. 301
uacacgauaaucucugcuuu

SEQ ID NO: 3930635 - RNA, 18 nt, Shigella flexneri 2a str. 301
uacacuaaacgucucacu

SEQ ID NO: 3930636 - RNA, 14 nt, Shigella flexneri 2a str. 301
uacacuauuuccuu

SEQ ID NO: 3930637 - RNA, 14 nt, Shigella flexneri 2a str. 301
uacacucaaauauc

SEQ ID NO: 3930638 - RNA, 15 nt, Shigella flexneri 2a str. 301
uacacucaaauaucu

SEQ ID NO: 3930639 - RNA, 16 nt, Shigella flexneri 2a str. 301
uacagaaaugaaaaaa

SEQ ID NO: 3930640 - RNA, 23 nt, Shigella flexneri 2a str. 301
uacagacacccaccauaagcccg

SEQ ID NO: 3930641 - RNA, 16 nt, Shigella flexneri 2a str. 301
uacagacagauaaaau

SEQ ID NO: 3930642 - RNA, 23 nt, Shigella flexneri 2a str. 301
uacagaccggagccaaacaugca

SEQ ID NO: 3930643 - RNA, 15 nt, Shigella flexneri 2a str. 301
uacagacucaaacca

SEQ ID NO: 3930644 - RNA, 15 nt, Shigella flexneri 2a str. 301
uacagauccgccauu

SEQ ID NO: 3930645 - RNA, 22 nt, Shigella flexneri 2a str. 301
uacagauccgccauuucuccuc

SEQ ID NO: 3930646 - RNA, 20 nt, Shigella flexneri 2a str. 301
uacagaucgugcaucuccug

SEQ ID NO: 3930647 - RNA, 20 nt, Shigella flexneri 2a str. 301
uacagcagccauucauucaa

SEQ ID NO: 3930648 - RNA, 19 nt, Shigella flexneri 2a str. 301
uacagcaguacgccgagaa

SEQ ID NO: 3930649 - RNA, 13 nt, Shigella flexneri 2a str. 301
uacagccaaauca

SEQ ID NO: 3930650 - RNA, 23 nt, Shigella flexneri 2a str. 301
uacagccagccagcaccaggcuu

SEQ ID NO: 3930651 - RNA, 23 nt, Shigella flexneri 2a str. 301
uacagccagccgcuaacuuccug

SEQ ID NO: 3930652 - RNA, 13 nt, Shigella flexneri 2a str. 301
uacagccagguga

SEQ ID NO: 3930653 - RNA, 19 nt, Shigella flexneri 2a str. 301
uacagccaugcgaaugcca

SEQ ID NO: 3930654 - RNA, 18 nt, Shigella flexneri 2a str. 301
uacagcccagacaaauga

SEQ ID NO: 3930655 - RNA, 19 nt, Shigella flexneri 2a str. 301
uacagccgacaaugccaca

SEQ ID NO: 3930656 - RNA, 15 nt, Shigella flexneri 2a str. 301
uacagccgccagaca

SEQ ID NO: 3930657 - RNA, 16 nt, Shigella flexneri 2a str. 301
uacagccgccagacaa

SEQ ID NO: 3930658 - RNA, 13 nt, Shigella flexneri 2a str. 301
uacagccggaacg

SEQ ID NO: 3930659 - RNA, 16 nt, Shigella flexneri 2a str. 301
uacagccggacccaca

SEQ ID NO: 3930660 - RNA, 17 nt, Shigella flexneri 2a str. 301
uacagccggacccacac

SEQ ID NO: 3930661 - RNA, 14 nt, Shigella flexneri 2a str. 301
uacagccugccagc

SEQ ID NO: 3930662 - RNA, 22 nt, Shigella flexneri 2a str. 301
uacagcgacuucuucccaccau

SEQ ID NO: 3930663 - RNA, 19 nt, Shigella flexneri 2a str. 301
uacagcgcccgccagcacc

SEQ ID NO: 3930664 - RNA, 16 nt, Shigella flexneri 2a str. 301
uacagcggacagccau

SEQ ID NO: 3930665 - RNA, 15 nt, Shigella flexneri 2a str. 301
uacagcguuaaaaag

SEQ ID NO: 3930666 - RNA, 16 nt, Shigella flexneri 2a str. 301
uacagcucucacuuau

SEQ ID NO: 3930667 - RNA, 16 nt, Shigella flexneri 2a str. 301
uacagcuuagcgccuu

SEQ ID NO: 3930668 - RNA, 15 nt, Shigella flexneri 2a str. 301
uacaggaacagccac

SEQ ID NO: 3930669 - RNA, 20 nt, Shigella flexneri 2a str. 301
uacaggauauauuucaucaa

SEQ ID NO: 3930670 - RNA, 22 nt, Shigella flexneri 2a str. 301
uacaggauauauuucaucaacu

SEQ ID NO: 3930671 - RNA, 19 nt, Shigella flexneri 2a str. 301
uacaggcaacgaccagaaa

SEQ ID NO: 3930672 - RNA, 15 nt, Shigella flexneri 2a str. 301
uacaggcagcuuaga

SEQ ID NO: 3930673 - RNA, 21 nt, Shigella flexneri 2a str. 301
uacaggcuacucccaguagug

SEQ ID NO: 3930674 - RNA, 18 nt, Shigella flexneri 2a str. 301
uacaggcucaaagacugu

SEQ ID NO: 3930675 - RNA, 14 nt, Shigella flexneri 2a str. 301
uacaggguaaaaag

SEQ ID NO: 3930676 - RNA, 16 nt, Shigella flexneri 2a str. 301
uacaggguaaaaagag

SEQ ID NO: 3930677 - RNA, 19 nt, Shigella flexneri 2a str. 301
uacaguauaaguaaugaac

SEQ ID NO: 3930678 - RNA, 17 nt, Shigella flexneri 2a str. 301
uacagucugcucccuuu

SEQ ID NO: 3930679 - RNA, 13 nt, Shigella flexneri 2a str. 301
uacaguuuuacaa

SEQ ID NO: 3930680 - RNA, 17 nt, Shigella flexneri 2a str. 301
uacauaaagucuuucuu

SEQ ID NO: 3930681 - RNA, 14 nt, Shigella flexneri 2a str. 301
uacauaacgcagcg

SEQ ID NO: 3930682 - RNA, 15 nt, Shigella flexneri 2a str. 301
uacauacugagaacc

SEQ ID NO: 3930683 - RNA, 13 nt, Shigella flexneri 2a str. 301
uacauacuuaaau

SEQ ID NO: 3930684 - RNA, 20 nt, Shigella flexneri 2a str. 301
uacauacuuaaauaaugcuu

SEQ ID NO: 3930685 - RNA, 21 nt, Shigella flexneri 2a str. 301
uacauagccaucugccugauc

SEQ ID NO: 3930686 - RNA, 20 nt, Shigella flexneri 2a str. 301
uacauagcgccucuuuauaa

SEQ ID NO: 3930687 - RNA, 14 nt, Shigella flexneri 2a str. 301
uaccgcgaagaaca

SEQ ID NO: 3930688 - RNA, 13 nt, Shigella flexneri 2a str. 301
uaccgcgguugau

SEQ ID NO: 3930689 - RNA, 17 nt, Shigella flexneri 2a str. 301
uaccgcguaauacauca

SEQ ID NO: 3930690 - RNA, 22 nt, Shigella flexneri 2a str. 301
uaccgcugaagguguaauggau

SEQ ID NO: 3930691 - RNA, 21 nt, Shigella flexneri 2a str. 301
uaccggaacacucuuccaguc

SEQ ID NO: 3930692 - RNA, 13 nt, Shigella flexneri 2a str. 301
uaccggacuccag

SEQ ID NO: 3930693 - RNA, 17 nt, Shigella flexneri 2a str. 301
uaccggcaaagaaccaa

SEQ ID NO: 3930694 - RNA, 19 nt, Shigella flexneri 2a str. 301
uaccggcuggcgcauacca

SEQ ID NO: 3930695 - RNA, 13 nt, Shigella flexneri 2a str. 301
uaccgggaugcug

SEQ ID NO: 3930696 - RNA, 20 nt, Shigella flexneri 2a str. 301
uaccgggcaguaccaccgga

SEQ ID NO: 3930697 - RNA, 14 nt, Shigella flexneri 2a str. 301
uaccgggcguccug

SEQ ID NO: 3930698 - RNA, 17 nt, Shigella flexneri 2a str. 301
uaccggugacagcggug

SEQ ID NO: 3930699 - RNA, 17 nt, Shigella flexneri 2a str. 301
uaccggugccagcaacu

SEQ ID NO: 3930700 - RNA, 15 nt, Shigella flexneri 2a str. 301
uaccgucaucgccca

SEQ ID NO: 3930701 - RNA, 15 nt, Shigella flexneri 2a str. 301
uaccgucgaugccaa

SEQ ID NO: 3930702 - RNA, 23 nt, Shigella flexneri 2a str. 301
uaccgucgccagacgcagcaagg

SEQ ID NO: 3930703 - RNA, 13 nt, Shigella flexneri 2a str. 301
uaccgucuguaac

SEQ ID NO: 3930704 - RNA, 20 nt, Shigella flexneri 2a str. 301
uaccgugucggaugcggcgu

SEQ ID NO: 3930705 - RNA, 14 nt, Shigella flexneri 2a str. 301
uaccguugcggcgu

SEQ ID NO: 3930706 - RNA, 16 nt, Shigella flexneri 2a str. 301
uaccuaaggaauccag

SEQ ID NO: 3930707 - RNA, 17 nt, Shigella flexneri 2a str. 301
uaccucagcagacugau

SEQ ID NO: 3930708 - RNA, 15 nt, Shigella flexneri 2a str. 301
uaccucauggagaua

SEQ ID NO: 3930709 - RNA, 15 nt, Shigella flexneri 2a str. 301
uaccugacagcagag

SEQ ID NO: 3930710 - RNA, 20 nt, Shigella flexneri 2a str. 301
uaccugccuggcaguggaau

SEQ ID NO: 3930711 - RNA, 18 nt, Shigella flexneri 2a str. 301
uaccugcuuaaucauauu

SEQ ID NO: 3930712 - RNA, 17 nt, Shigella flexneri 2a str. 301
uaccugguccuucaucu

SEQ ID NO: 3930713 - RNA, 13 nt, Shigella flexneri 2a str. 301
uaccuuaaccguu

SEQ ID NO: 3930714 - RNA, 19 nt, Shigella flexneri 2a str. 301
uaccuuaacgguaucuuuc

SEQ ID NO: 3930715 - RNA, 22 nt, Shigella flexneri 2a str. 301
uaccuuaucaaucucagcaaga

SEQ ID NO: 3930716 - RNA, 14 nt, Shigella flexneri 2a str. 301
uaccuuccuccggc

SEQ ID NO: 3930717 - RNA, 22 nt, Shigella flexneri 2a str. 301
uaccuucguuauauccaggcag

SEQ ID NO: 3930718 - RNA, 14 nt, Shigella flexneri 2a str. 301
uaccuugcugcucc

SEQ ID NO: 3930719 - RNA, 18 nt, Shigella flexneri 2a str. 301
uaccuuuuucuucaccaa

SEQ ID NO: 3930720 - RNA, 22 nt, Shigella flexneri 2a str. 301
uacgaaacauccugccagagcc

SEQ ID NO: 3930721 - RNA, 18 nt, Shigella flexneri 2a str. 301
uacgaaguuuaauucuuu

SEQ ID NO: 3930722 - RNA, 19 nt, Shigella flexneri 2a str. 301
uacgaaucgccggagacgu

SEQ ID NO: 3930723 - RNA, 19 nt, Shigella flexneri 2a str. 301
uacgaauucuaucaugcaa

SEQ ID NO: 3930724 - RNA, 16 nt, Shigella flexneri 2a str. 301
uacgacauugaagaau

SEQ ID NO: 3930725 - RNA, 17 nt, Shigella flexneri 2a str. 301
uacgacuguugaagaac

SEQ ID NO: 3930726 - RNA, 18 nt, Shigella flexneri 2a str. 301
uacgaggauucgaaccuc

SEQ ID NO: 3930727 - RNA, 22 nt, Shigella flexneri 2a str. 301
uacgagucgccuguacuuccug

SEQ ID NO: 3930728 - RNA, 18 nt, Shigella flexneri 2a str. 301
uacgauacagaagcaccg

SEQ ID NO: 3930729 - RNA, 18 nt, Shigella flexneri 2a str. 301
uacgauagaauauuucua

SEQ ID NO: 3930730 - RNA, 16 nt, Shigella flexneri 2a str. 301
uacgauccugguggua

SEQ ID NO: 3930731 - RNA, 17 nt, Shigella flexneri 2a str. 301
uacgauguguggcaucg

SEQ ID NO: 3930732 - RNA, 19 nt, Shigella flexneri 2a str. 301
uacgauuaacguaaggcgc

SEQ ID NO: 3930733 - RNA, 15 nt, Shigella flexneri 2a str. 301
uacgcaaaaccucuu

SEQ ID NO: 3930734 - RNA, 21 nt, Shigella flexneri 2a str. 301
uacgcaacugccaguaaagca

SEQ ID NO: 3930735 - RNA, 20 nt, Shigella flexneri 2a str. 301
uacgcaccagauaagcagcg

SEQ ID NO: 3930736 - RNA, 18 nt, Shigella flexneri 2a str. 301
uacgcagaaccagaagcg

SEQ ID NO: 3930737 - RNA, 18 nt, Shigella flexneri 2a str. 301
uacgcagauauucguuca

SEQ ID NO: 3930738 - RNA, 12 nt, Shigella flexneri 2a str. 301
uacgcagcauca

SEQ ID NO: 3930739 - RNA, 14 nt, Shigella flexneri 2a str. 301
uacgcaucaccaga

SEQ ID NO: 3930740 - RNA, 17 nt, Shigella flexneri 2a str. 301
uacgcaucaccagacaa

SEQ ID NO: 3930741 - RNA, 13 nt, Shigella flexneri 2a str. 301
uacgccacaucau

SEQ ID NO: 3930742 - RNA, 14 nt, Shigella flexneri 2a str. 301
uacgccagacugcg

SEQ ID NO: 3930743 - RNA, 20 nt, Shigella flexneri 2a str. 301
uacgccagucacggugcagc

SEQ ID NO: 3930744 - RNA, 15 nt, Shigella flexneri 2a str. 301
uacgccaucgccagc

SEQ ID NO: 3930745 - RNA, 18 nt, Shigella flexneri 2a str. 301
uacgccaucgccagcagc

SEQ ID NO: 3930746 - RNA, 21 nt, Shigella flexneri 2a str. 301
uacgccaucgccagcagccau

SEQ ID NO: 3930747 - RNA, 16 nt, Shigella flexneri 2a str. 301
uacgcccaucauucag

SEQ ID NO: 3930748 - RNA, 16 nt, Shigella flexneri 2a str. 301
uacgcccucacccgua

SEQ ID NO: 3930749 - RNA, 15 nt, Shigella flexneri 2a str. 301
uacgccgcaucaggc

SEQ ID NO: 3930750 - RNA, 18 nt, Shigella flexneri 2a str. 301
uacgccgcaucuggcaua

SEQ ID NO: 3930751 - RNA, 15 nt, Shigella flexneri 2a str. 301
uacgccgccacagcg

SEQ ID NO: 3930752 - RNA, 18 nt, Shigella flexneri 2a str. 301
uacgccgccgcaaccgua

SEQ ID NO: 3930753 - RNA, 16 nt, Shigella flexneri 2a str. 301
uacgccucacagggcu

SEQ ID NO: 3930754 - RNA, 20 nt, Shigella flexneri 2a str. 301
uacgccugccagcucuuucg

SEQ ID NO: 3930755 - RNA, 15 nt, Shigella flexneri 2a str. 301
uacgcgacauugaug

SEQ ID NO: 3930756 - RNA, 18 nt, Shigella flexneri 2a str. 301
uacgcgcaauauccugcg

SEQ ID NO: 3930757 - RNA, 21 nt, Shigella flexneri 2a str. 301
uacgcggcaauccccgccagc

SEQ ID NO: 3930758 - RNA, 20 nt, Shigella flexneri 2a str. 301
uacgcgggucguugaucggc

SEQ ID NO: 3930759 - RNA, 22 nt, Shigella flexneri 2a str. 301
uacgcguaaaugcguugcuggc

SEQ ID NO: 3930760 - RNA, 18 nt, Shigella flexneri 2a str. 301
uacgcguacacuuuccug

SEQ ID NO: 3930761 - RNA, 11 nt, Shigella flexneri 2a str. 301
uacgcuaccau

SEQ ID NO: 3930762 - RNA, 14 nt, Shigella flexneri 2a str. 301
uacgcuaccggaca

SEQ ID NO: 3930763 - RNA, 16 nt, Shigella flexneri 2a str. 301
uacgcucaucaggccu

SEQ ID NO: 3930764 - RNA, 17 nt, Shigella flexneri 2a str. 301
uacgcucaucaggccua

SEQ ID NO: 3930765 - RNA, 23 nt, Shigella flexneri 2a str. 301
uacgcucaucaggccuacaaaau

SEQ ID NO: 3930766 - RNA, 12 nt, Shigella flexneri 2a str. 301
uacgcucggcaa

SEQ ID NO: 3930767 - RNA, 21 nt, Shigella flexneri 2a str. 301
uacgcugaggauuuucaucuu

SEQ ID NO: 3930768 - RNA, 17 nt, Shigella flexneri 2a str. 301
uacgcuuaucaggccua

SEQ ID NO: 3930769 - RNA, 13 nt, Shigella flexneri 2a str. 301
uacgcuuuccagc

SEQ ID NO: 3930770 - RNA, 12 nt, Shigella flexneri 2a str. 301
uacgcuuuucuu

SEQ ID NO: 3930771 - RNA, 22 nt, Shigella flexneri 2a str. 301
uacggaaugauauuggucacca

SEQ ID NO: 3930772 - RNA, 19 nt, Shigella flexneri 2a str. 301
uacggacgcggcauuuuua

SEQ ID NO: 3930773 - RNA, 15 nt, Shigella flexneri 2a str. 301
uacggcacuccucuu

SEQ ID NO: 3930774 - RNA, 17 nt, Shigella flexneri 2a str. 301
uacggcguuaacuuguu

SEQ ID NO: 3930775 - RNA, 20 nt, Shigella flexneri 2a str. 301
uacggcguuucacuucugag

SEQ ID NO: 3930776 - RNA, 14 nt, Shigella flexneri 2a str. 301
uacggcuaaaaaaa

SEQ ID NO: 3930777 - RNA, 19 nt, Shigella flexneri 2a str. 301
uacggcuccgcaagcgaau

SEQ ID NO: 3930778 - RNA, 20 nt, Shigella flexneri 2a str. 301
uacggcugauggcgccaguu

SEQ ID NO: 3930779 - RNA, 16 nt, Shigella flexneri 2a str. 301
uacggcuggaagguga

SEQ ID NO: 3930780 - RNA, 16 nt, Shigella flexneri 2a str. 301
uacgggcaaucuccug

SEQ ID NO: 3930781 - RNA, 19 nt, Shigella flexneri 2a str. 301
uacgggcaccaguaacgau

SEQ ID NO: 3930782 - RNA, 18 nt, Shigella flexneri 2a str. 301
uacgguacugaaaccuga

SEQ ID NO: 3930783 - RNA, 20 nt, Shigella flexneri 2a str. 301
uacggugaacucacacagcg

SEQ ID NO: 3930784 - RNA, 15 nt, Shigella flexneri 2a str. 301
uacgguguaccggau

SEQ ID NO: 3930785 - RNA, 21 nt, Shigella flexneri 2a str. 301
uacgguguaccggauaaauuu

SEQ ID NO: 3930786 - RNA, 15 nt, Shigella flexneri 2a str. 301
uacgguucgggcaca

SEQ ID NO: 3930787 - RNA, 17 nt, Shigella flexneri 2a str. 301
uagaaaacgaaagcgcc

SEQ ID NO: 3930788 - RNA, 19 nt, Shigella flexneri 2a str. 301
uagaaaauaaaaaacauuc

SEQ ID NO: 3930789 - RNA, 16 nt, Shigella flexneri 2a str. 301
uagaaaauggaacgcg

SEQ ID NO: 3930790 - RNA, 18 nt, Shigella flexneri 2a str. 301
uagaaacagucuggagca

SEQ ID NO: 3930791 - RNA, 21 nt, Shigella flexneri 2a str. 301
uagaaacgagguauguuucug

SEQ ID NO: 3930792 - RNA, 14 nt, Shigella flexneri 2a str. 301
uagaaacuggcccu

SEQ ID NO: 3930793 - RNA, 16 nt, Shigella flexneri 2a str. 301
uagaaagugacugcug

SEQ ID NO: 3930794 - RNA, 13 nt, Shigella flexneri 2a str. 301
uagaaaucauuca

SEQ ID NO: 3930795 - RNA, 14 nt, Shigella flexneri 2a str. 301
uagaaauuauuucu

SEQ ID NO: 3930796 - RNA, 15 nt, Shigella flexneri 2a str. 301
uagaaauuauuucuu

SEQ ID NO: 3930797 - RNA, 15 nt, Shigella flexneri 2a str. 301
uagaacaucucuucc

SEQ ID NO: 3930798 - RNA, 16 nt, Shigella flexneri 2a str. 301
uagaaccuaagaacca

SEQ ID NO: 3930799 - RNA, 16 nt, Shigella flexneri 2a str. 301
uagaacggcagagaaa

SEQ ID NO: 3930800 - RNA, 22 nt, Shigella flexneri 2a str. 301
uagaacuaaugggccguuagga

SEQ ID NO: 3930801 - RNA, 22 nt, Shigella flexneri 2a str. 301
uagaagccauuaaacaccagua

SEQ ID NO: 3930802 - RNA, 23 nt, Shigella flexneri 2a str. 301
uagaagccauuaaacaccaguac

SEQ ID NO: 3930803 - RNA, 20 nt, Shigella flexneri 2a str. 301
uagaagucacguacaaaacg

SEQ ID NO: 3930804 - RNA, 15 nt, Shigella flexneri 2a str. 301
uagaauaaggcuuuc

SEQ ID NO: 3930805 - RNA, 16 nt, Shigella flexneri 2a str. 301
uagaauaccugccugu

SEQ ID NO: 3930806 - RNA, 17 nt, Shigella flexneri 2a str. 301
uagaaugccaaguaaua

SEQ ID NO: 3930807 - RNA, 23 nt, Shigella flexneri 2a str. 301
uagaaugccaaguaauagaacua

SEQ ID NO: 3930808 - RNA, 12 nt, Shigella flexneri 2a str. 301
uagaaugcgccu

SEQ ID NO: 3930809 - RNA, 13 nt, Shigella flexneri 2a str. 301
uagaauuguaauc

SEQ ID NO: 3930810 - RNA, 15 nt, Shigella flexneri 2a str. 301
uagacaaaaauuucu

SEQ ID NO: 3930811 - RNA, 18 nt, Shigella flexneri 2a str. 301
uagacaguucuuccuggc

SEQ ID NO: 3930812 - RNA, 23 nt, Shigella flexneri 2a str. 301
uagacaugcccggaaguaccaau

SEQ ID NO: 3930813 - RNA, 14 nt, Shigella flexneri 2a str. 301
uagacauuacgcau

SEQ ID NO: 3930814 - RNA, 23 nt, Shigella flexneri 2a str. 301
uagacauuacgcauuugcgcgua

SEQ ID NO: 3930815 - RNA, 16 nt, Shigella flexneri 2a str. 301
uagaccggaccugucg

SEQ ID NO: 3930816 - RNA, 15 nt, Shigella flexneri 2a str. 301
uagaccugauacaua

SEQ ID NO: 3930817 - RNA, 20 nt, Shigella flexneri 2a str. 301
uagacgcguuuacagagccg

SEQ ID NO: 3930818 - RNA, 14 nt, Shigella flexneri 2a str. 301
uagacggcgcugcc

SEQ ID NO: 3930819 - RNA, 12 nt, Shigella flexneri 2a str. 301
uagacugcagcg

SEQ ID NO: 3930820 - RNA, 20 nt, Shigella flexneri 2a str. 301
uagacuuuagcgcaaucgca

SEQ ID NO: 3930821 - RNA, 13 nt, Shigella flexneri 2a str. 301
uagagaauuaauc

SEQ ID NO: 3930822 - RNA, 15 nt, Shigella flexneri 2a str. 301
uagagauagccugau

SEQ ID NO: 3930823 - RNA, 22 nt, Shigella flexneri 2a str. 301
uagagauuuuuccccaccucau

SEQ ID NO: 3930824 - RNA, 13 nt, Shigella flexneri 2a str. 301
uagagcacaucac

SEQ ID NO: 3930825 - RNA, 19 nt, Shigella flexneri 2a str. 301
uagagcacaucacucauaa

SEQ ID NO: 3930826 - RNA, 22 nt, Shigella flexneri 2a str. 301
uagagccgguuuugguuuucug

SEQ ID NO: 3930827 - RNA, 19 nt, Shigella flexneri 2a str. 301
uagagcuugugcaccagcu

SEQ ID NO: 3930828 - RNA, 16 nt, Shigella flexneri 2a str. 301
uagaggaauggcagau

SEQ ID NO: 3930829 - RNA, 14 nt, Shigella flexneri 2a str. 301
uagagguuauaaau

SEQ ID NO: 3930830 - RNA, 15 nt, Shigella flexneri 2a str. 301
uagauaaaaaugaag

SEQ ID NO: 3930831 - RNA, 15 nt, Shigella flexneri 2a str. 301
uagauaaaacacucu

SEQ ID NO: 3930832 - RNA, 13 nt, Shigella flexneri 2a str. 301
uagauaagcaagg

SEQ ID NO: 3930833 - RNA, 18 nt, Shigella flexneri 2a str. 301
uagauaaucgcuuucgga

SEQ ID NO: 3930834 - RNA, 12 nt, Shigella flexneri 2a str. 301
uagauccaggaa

SEQ ID NO: 3930835 - RNA, 21 nt, Shigella flexneri 2a str. 301
uagaucuaaaugccacugaau

SEQ ID NO: 3930836 - RNA, 19 nt, Shigella flexneri 2a str. 301
uagaucuccauacuuccac

SEQ ID NO: 3930837 - RNA, 15 nt, Shigella flexneri 2a str. 301
uagaucuugauuuac

SEQ ID NO: 3930838 - RNA, 20 nt, Shigella flexneri 2a str. 301
uagauggggccaugauuuga

SEQ ID NO: 3930839 - RNA, 16 nt, Shigella flexneri 2a str. 301
uagaugugcaguuccu

SEQ ID NO: 3930840 - RNA, 19 nt, Shigella flexneri 2a str. 301
uagaugugcaguuccugca

SEQ ID NO: 3930841 - RNA, 18 nt, Shigella flexneri 2a str. 301
uagaugugggcaaucuca

SEQ ID NO: 3930842 - RNA, 22 nt, Shigella flexneri 2a str. 301
uagaugugggcaaucucacucc

SEQ ID NO: 3930843 - RNA, 21 nt, Shigella flexneri 2a str. 301
uagauuaauuucccaccacua

SEQ ID NO: 3930844 - RNA, 17 nt, Shigella flexneri 2a str. 301
uagauuuacgcucuucc

SEQ ID NO: 3930845 - RNA, 23 nt, Shigella flexneri 2a str. 301
uagauuuacuauuauuuuucaua

SEQ ID NO: 3930846 - RNA, 23 nt, Shigella flexneri 2a str. 301
uagauuuauuuauuauuaaagag

SEQ ID NO: 3930847 - RNA, 17 nt, Shigella flexneri 2a str. 301
uagauuugguggggcuu

SEQ ID NO: 3930848 - RNA, 18 nt, Shigella flexneri 2a str. 301
uagauuuugaguaagcag

SEQ ID NO: 3930849 - RNA, 20 nt, Shigella flexneri 2a str. 301
uagauuuugcagaucgccaa

SEQ ID NO: 3930850 - RNA, 20 nt, Shigella flexneri 2a str. 301
uagcaaacuaucuguguaau

SEQ ID NO: 3930851 - RNA, 13 nt, Shigella flexneri 2a str. 301
uagcaaaguaaua

SEQ ID NO: 3930852 - RNA, 14 nt, Shigella flexneri 2a str. 301
uagcaacaggccag

SEQ ID NO: 3930853 - RNA, 15 nt, Shigella flexneri 2a str. 301
uagcaacugauuuau

SEQ ID NO: 3930854 - RNA, 11 nt, Shigella flexneri 2a str. 301
uagcaaggcga

SEQ ID NO: 3930855 - RNA, 18 nt, Shigella flexneri 2a str. 301
uagcaauauuuuuaugcc

SEQ ID NO: 3930856 - RNA, 18 nt, Shigella flexneri 2a str. 301
uagcacgacguuucuuuc

SEQ ID NO: 3930857 - RNA, 14 nt, Shigella flexneri 2a str. 301
uagcacgucaucug

SEQ ID NO: 3930858 - RNA, 16 nt, Shigella flexneri 2a str. 301
uagcacgucaucugca

SEQ ID NO: 3930859 - RNA, 14 nt, Shigella flexneri 2a str. 301
uagcacugcuuucc

SEQ ID NO: 3930860 - RNA, 21 nt, Shigella flexneri 2a str. 301
uagcacuguaaaccucuuucg

SEQ ID NO: 3930861 - RNA, 16 nt, Shigella flexneri 2a str. 301
uagcagcacaccacau

SEQ ID NO: 3930862 - RNA, 11 nt, Shigella flexneri 2a str. 301
uagcagcagcg

SEQ ID NO: 3930863 - RNA, 22 nt, Shigella flexneri 2a str. 301
uagcagcccgcagcgccuggcg

SEQ ID NO: 3930864 - RNA, 15 nt, Shigella flexneri 2a str. 301
uagcagcuccgccag

SEQ ID NO: 3930865 - RNA, 15 nt, Shigella flexneri 2a str. 301
uagcagcuuucagca

SEQ ID NO: 3930866 - RNA, 13 nt, Shigella flexneri 2a str. 301
uagcaguuccagc

SEQ ID NO: 3930867 - RNA, 14 nt, Shigella flexneri 2a str. 301
uagcaguuccagca

SEQ ID NO: 3930868 - RNA, 13 nt, Shigella flexneri 2a str. 301
uagcauccaccac

SEQ ID NO: 3930869 - RNA, 14 nt, Shigella flexneri 2a str. 301
uagcauccaccaca

SEQ ID NO: 3930870 - RNA, 13 nt, Shigella flexneri 2a str. 301
uagcaucccaaua

SEQ ID NO: 3930871 - RNA, 20 nt, Shigella flexneri 2a str. 301
uagcaucgcaucaggcaaug

SEQ ID NO: 3930872 - RNA, 14 nt, Shigella flexneri 2a str. 301
uagcaucuuccagc

SEQ ID NO: 3930873 - RNA, 17 nt, Shigella flexneri 2a str. 301
uagcauguuccaguucg

SEQ ID NO: 3930874 - RNA, 12 nt, Shigella flexneri 2a str. 301
uagcauuaagua

SEQ ID NO: 3930875 - RNA, 16 nt, Shigella flexneri 2a str. 301
uagccaauaaaugcca

SEQ ID NO: 3930876 - RNA, 14 nt, Shigella flexneri 2a str. 301
uagccaaugcggca

SEQ ID NO: 3930877 - RNA, 20 nt, Shigella flexneri 2a str. 301
uagccaauuacgcaggcaau

SEQ ID NO: 3930878 - RNA, 11 nt, Shigella flexneri 2a str. 301
uagccaauucc

SEQ ID NO: 3930879 - RNA, 20 nt, Shigella flexneri 2a str. 301
uagccacaaagcagggcugg

SEQ ID NO: 3930880 - RNA, 22 nt, Shigella flexneri 2a str. 301
uagccacaaagcagggcuggca

SEQ ID NO: 3930881 - RNA, 16 nt, Shigella flexneri 2a str. 301
uagccacauugcugca

SEQ ID NO: 3930882 - RNA, 14 nt, Shigella flexneri 2a str. 301
uagccagcaacuga

SEQ ID NO: 3930883 - RNA, 12 nt, Shigella flexneri 2a str. 301
uagccagcgcac

SEQ ID NO: 3930884 - RNA, 16 nt, Shigella flexneri 2a str. 301
uagccaguaccacccc

SEQ ID NO: 3930885 - RNA, 16 nt, Shigella flexneri 2a str. 301
uagccauuugauucac

SEQ ID NO: 3930886 - RNA, 15 nt, Shigella flexneri 2a str. 301
uagcccaccuacacc

SEQ ID NO: 3930887 - RNA, 12 nt, Shigella flexneri 2a str. 301
uagccccagucu

SEQ ID NO: 3930888 - RNA, 19 nt, Shigella flexneri 2a str. 301
uagugacucuuuauuucau

SEQ ID NO: 3930889 - RNA, 11 nt, Shigella flexneri 2a str. 301
uagugccaacg

SEQ ID NO: 3930890 - RNA, 14 nt, Shigella flexneri 2a str. 301
uagugccgucagca

SEQ ID NO: 3930891 - RNA, 18 nt, Shigella flexneri 2a str. 301
uagugcggcaugguuccg

SEQ ID NO: 3930892 - RNA, 15 nt, Shigella flexneri 2a str. 301
uaguggaacaaagaa

SEQ ID NO: 3930893 - RNA, 20 nt, Shigella flexneri 2a str. 301
uaguggauucauugagcugc

SEQ ID NO: 3930894 - RNA, 16 nt, Shigella flexneri 2a str. 301
uaguggcaaauucuug

SEQ ID NO: 3930895 - RNA, 14 nt, Shigella flexneri 2a str. 301
uaguggcucagacu

SEQ ID NO: 3930896 - RNA, 17 nt, Shigella flexneri 2a str. 301
uaguggcucagacucuc

SEQ ID NO: 3930897 - RNA, 17 nt, Shigella flexneri 2a str. 301
uaguggguuucugccgc

SEQ ID NO: 3930898 - RNA, 14 nt, Shigella flexneri 2a str. 301
uagugucuuaucug

SEQ ID NO: 3930899 - RNA, 16 nt, Shigella flexneri 2a str. 301
uaguuaugaaaauagg

SEQ ID NO: 3930900 - RNA, 16 nt, Shigella flexneri 2a str. 301
uaguucauccagugcu

SEQ ID NO: 3930901 - RNA, 22 nt, Shigella flexneri 2a str. 301
uaguucauccccucuuccauuu

SEQ ID NO: 3930902 - RNA, 17 nt, Shigella flexneri 2a str. 301
uaguucgcguaacugcu

SEQ ID NO: 3930903 - RNA, 17 nt, Shigella flexneri 2a str. 301
uaguugauuaauuucau

SEQ ID NO: 3930904 - RNA, 22 nt, Shigella flexneri 2a str. 301
uaguuggguuucauccugccau

SEQ ID NO: 3930905 - RNA, 16 nt, Shigella flexneri 2a str. 301
uaguuguaaucauauu

SEQ ID NO: 3930906 - RNA, 16 nt, Shigella flexneri 2a str. 301
uaguuguacaacugcu

SEQ ID NO: 3930907 - RNA, 13 nt, Shigella flexneri 2a str. 301
uaguuucucccca

SEQ ID NO: 3930908 - RNA, 17 nt, Shigella flexneri 2a str. 301
uaguuugauaauuuuag

SEQ ID NO: 3930909 - RNA, 19 nt, Shigella flexneri 2a str. 301
uaguuugauaauuuuagau

SEQ ID NO: 3930910 - RNA, 14 nt, Shigella flexneri 2a str. 301
uauaaaaaaacaau

SEQ ID NO: 3930911 - RNA, 12 nt, Shigella flexneri 2a str. 301
uauaaaaaaacc

SEQ ID NO: 3930912 - RNA, 14 nt, Shigella flexneri 2a str. 301
uauaaaaaacccuc

SEQ ID NO: 3930913 - RNA, 11 nt, Shigella flexneri 2a str. 301
uauaaaaaccg

SEQ ID NO: 3930914 - RNA, 21 nt, Shigella flexneri 2a str. 301
uauaaaauuuaacauuuggau

SEQ ID NO: 3930915 - RNA, 19 nt, Shigella flexneri 2a str. 301
uauaaaccacgcaauaaac

SEQ ID NO: 3930916 - RNA, 15 nt, Shigella flexneri 2a str. 301
uauaaaccugagaac

SEQ ID NO: 3930917 - RNA, 17 nt, Shigella flexneri 2a str. 301
uauaaagaaaaucugaa

SEQ ID NO: 3930918 - RNA, 14 nt, Shigella flexneri 2a str. 301
uauaaauaaaaauu

SEQ ID NO: 3930919 - RNA, 21 nt, Shigella flexneri 2a str. 301
uauaaauaaaaauugaaucac

SEQ ID NO: 3930920 - RNA, 22 nt, Shigella flexneri 2a str. 301
uauaaauguguaaucaggcaau

SEQ ID NO: 3930921 - RNA, 22 nt, Shigella flexneri 2a str. 301
uauaacccccuccuuuuaucau

SEQ ID NO: 3930922 - RNA, 18 nt, Shigella flexneri 2a str. 301
uauaaccggcaacagaac

SEQ ID NO: 3930923 - RNA, 18 nt, Shigella flexneri 2a str. 301
uauaaccugaauauuagu

SEQ ID NO: 3930924 - RNA, 13 nt, Shigella flexneri 2a str. 301
uauaacugcgguc

SEQ ID NO: 3930925 - RNA, 16 nt, Shigella flexneri 2a str. 301
uauaagccaguaagac

SEQ ID NO: 3930926 - RNA, 22 nt, Shigella flexneri 2a str. 301
uauaaguggcgcucucaagcca

SEQ ID NO: 3930927 - RNA, 15 nt, Shigella flexneri 2a str. 301
uauaaguguaaaauu

SEQ ID NO: 3930928 - RNA, 17 nt, Shigella flexneri 2a str. 301
uauaauaucuuuucuua

SEQ ID NO: 3930929 - RNA, 20 nt, Shigella flexneri 2a str. 301
uauaauaucuuuucuuaaca

SEQ ID NO: 3930930 - RNA, 22 nt, Shigella flexneri 2a str. 301
uauaaucgcgaauagcuucaaa

SEQ ID NO: 3930931 - RNA, 12 nt, Shigella flexneri 2a str. 301
uauaauuaaaaa

SEQ ID NO: 3930932 - RNA, 14 nt, Shigella flexneri 2a str. 301
uauaauuaaaaaua

SEQ ID NO: 3930933 - RNA, 15 nt, Shigella flexneri 2a str. 301
uauaauuaaaaauag

SEQ ID NO: 3930934 - RNA, 17 nt, Shigella flexneri 2a str. 301
uauacaaccagauaacc

SEQ ID NO: 3930935 - RNA, 16 nt, Shigella flexneri 2a str. 301
uauacaccuguuccau

SEQ ID NO: 3930936 - RNA, 16 nt, Shigella flexneri 2a str. 301
uauacagacucaaacc

SEQ ID NO: 3930937 - RNA, 15 nt, Shigella flexneri 2a str. 301
uauacagccuuaaca

SEQ ID NO: 3930938 - RNA, 22 nt, Shigella flexneri 2a str. 301
uauacaggcggguaaucuuucc

SEQ ID NO: 3930939 - RNA, 19 nt, Shigella flexneri 2a str. 301
uauacauaaagucuuucuu

SEQ ID NO: 3930940 - RNA, 18 nt, Shigella flexneri 2a str. 301
uauaccgccgccagcaac

SEQ ID NO: 3930941 - RNA, 22 nt, Shigella flexneri 2a str. 301
uauaccggaccaauaacgcuuu

SEQ ID NO: 3930942 - RNA, 22 nt, Shigella flexneri 2a str. 301
uauacgccucacagggcucuua

SEQ ID NO: 3930943 - RNA, 22 nt, Shigella flexneri 2a str. 301
uauacggauagcagaaaacuca

SEQ ID NO: 3930944 - RNA, 20 nt, Shigella flexneri 2a str. 301
uauacggcguuuccagcucg

SEQ ID NO: 3930945 - RNA, 14 nt, Shigella flexneri 2a str. 301
uauacucagucagg

SEQ ID NO: 3930946 - RNA, 14 nt, Shigella flexneri 2a str. 301
uauacuccugaugg

SEQ ID NO: 3930947 - RNA, 21 nt, Shigella flexneri 2a str. 301
uauagaagccauccagcagac

SEQ ID NO: 3930948 - RNA, 15 nt, Shigella flexneri 2a str. 301
uauagaaugccugug

SEQ ID NO: 3930949 - RNA, 22 nt, Shigella flexneri 2a str. 301
uauagaaugccugugcgacaga

SEQ ID NO: 3930950 - RNA, 15 nt, Shigella flexneri 2a str. 301
uauagagauuuuucc

SEQ ID NO: 3930951 - RNA, 14 nt, Shigella flexneri 2a str. 301
uauagauuuacuau

SEQ ID NO: 3930952 - RNA, 13 nt, Shigella flexneri 2a str. 301
uauagcauagcgu

SEQ ID NO: 3930953 - RNA, 21 nt, Shigella flexneri 2a str. 301
uauagccagccucauccauac

SEQ ID NO: 3930954 - RNA, 21 nt, Shigella flexneri 2a str. 301
uauaguaucguuaaauucuaa

SEQ ID NO: 3930955 - RNA, 22 nt, Shigella flexneri 2a str. 301
uauagugauccugcauacugac

SEQ ID NO: 3930956 - RNA, 21 nt, Shigella flexneri 2a str. 301
uauagugugcaaucacuuccu

SEQ ID NO: 3930957 - RNA, 13 nt, Shigella flexneri 2a str. 301
uauauaauuaaaa

SEQ ID NO: 3930958 - RNA, 13 nt, Shigella flexneri 2a str. 301
uauauacaccaac

SEQ ID NO: 3930959 - RNA, 20 nt, Shigella flexneri 2a str. 301
uauauauugggaucaaaaau

SEQ ID NO: 3930960 - RNA, 22 nt, Shigella flexneri 2a str. 301
uauauauugggaucaaaaaugu

SEQ ID NO: 3930961 - RNA, 16 nt, Shigella flexneri 2a str. 301
uauauccgaaaaagga

SEQ ID NO: 3930962 - RNA, 22 nt, Shigella flexneri 2a str. 301
uauaucucagauaaaugcaaac

SEQ ID NO: 3930963 - RNA, 22 nt, Shigella flexneri 2a str. 301
uauaucugacgccgccgguguc

SEQ ID NO: 3930964 - RNA, 17 nt, Shigella flexneri 2a str. 301
uauaugacgcucgcgca

SEQ ID NO: 3930965 - RNA, 19 nt, Shigella flexneri 2a str. 301
uauauuacaacguauuaua

SEQ ID NO: 3930966 - RNA, 22 nt, Shigella flexneri 2a str. 301
uauauuacgagucacaaacauc

SEQ ID NO: 3930967 - RNA, 21 nt, Shigella flexneri 2a str. 301
uauauuccccggucagcagca

SEQ ID NO: 3930968 - RNA, 19 nt, Shigella flexneri 2a str. 301
uauauuccuuacucauaaa

SEQ ID NO: 3930969 - RNA, 13 nt, Shigella flexneri 2a str. 301
uauauuucaucaa

SEQ ID NO: 3930970 - RNA, 21 nt, Shigella flexneri 2a str. 301
uauauuuccagacaucuguua

SEQ ID NO: 3930971 - RNA, 21 nt, Shigella flexneri 2a str. 301
uauauuuccccuguugcaaac

SEQ ID NO: 3930972 - RNA, 15 nt, Shigella flexneri 2a str. 301
uauauuuuuaaauau

SEQ ID NO: 3930973 - RNA, 21 nt, Shigella flexneri 2a str. 301
uaucaaaacgcucugagcugc

SEQ ID NO: 3930974 - RNA, 12 nt, Shigella flexneri 2a str. 301
uaucaaacguga

SEQ ID NO: 3930975 - RNA, 20 nt, Shigella flexneri 2a str. 301
uaucaaacgugacauucuga

SEQ ID NO: 3930976 - RNA, 23 nt, Shigella flexneri 2a str. 301
uaucaacagcgguuuugcuaucc

SEQ ID NO: 3930977 - RNA, 20 nt, Shigella flexneri 2a str. 301
uaucaagaucaucaaacuuu

SEQ ID NO: 3930978 - RNA, 18 nt, Shigella flexneri 2a str. 301
uaucaaucucagcaagag

SEQ ID NO: 3930979 - RNA, 12 nt, Shigella flexneri 2a str. 301
uaucacagcaga

SEQ ID NO: 3930980 - RNA, 12 nt, Shigella flexneri 2a str. 301
uaucacauccag

SEQ ID NO: 3930981 - RNA, 14 nt, Shigella flexneri 2a str. 301
uaucaccaaucaca

SEQ ID NO: 3930982 - RNA, 15 nt, Shigella flexneri 2a str. 301
uaucaccaaugauaa

SEQ ID NO: 3930983 - RNA, 17 nt, Shigella flexneri 2a str. 301
uaucacccuuuucugcc

SEQ ID NO: 3930984 - RNA, 18 nt, Shigella flexneri 2a str. 301
uaucacgaugcuaaaaac

SEQ ID NO: 3930985 - RNA, 20 nt, Shigella flexneri 2a str. 301
uaucacgaugcuaaaaacau

SEQ ID NO: 3930986 - RNA, 22 nt, Shigella flexneri 2a str. 301
uaucacgggggaggacguucac

SEQ ID NO: 3930987 - RNA, 17 nt, Shigella flexneri 2a str. 301
uaucagaagauuaagag

SEQ ID NO: 3930988 - RNA, 17 nt, Shigella flexneri 2a str. 301
uaucugcugcuugcggu

SEQ ID NO: 3930989 - RNA, 11 nt, Shigella flexneri 2a str. 301
uaucuggcaag

SEQ ID NO: 3930990 - RNA, 15 nt, Shigella flexneri 2a str. 301
uaucuggccuacaaa

SEQ ID NO: 3930991 - RNA, 20 nt, Shigella flexneri 2a str. 301
uaucuguggcgcuaugcugg

SEQ ID NO: 3930992 - RNA, 13 nt, Shigella flexneri 2a str. 301
uaucuguguaaug

SEQ ID NO: 3930993 - RNA, 14 nt, Shigella flexneri 2a str. 301
uaucuguugcugcc

SEQ ID NO: 3930994 - RNA, 19 nt, Shigella flexneri 2a str. 301
uaucuuauagacuaaauuu

SEQ ID NO: 3930995 - RNA, 18 nt, Shigella flexneri 2a str. 301
uaucuucaaucagaugug

SEQ ID NO: 3930996 - RNA, 23 nt, Shigella flexneri 2a str. 301
uaucuucauccgccccggcuuca

SEQ ID NO: 3930997 - RNA, 13 nt, Shigella flexneri 2a str. 301
uaucuucccagcc

SEQ ID NO: 3930998 - RNA, 15 nt, Shigella flexneri 2a str. 301
uaucuucccagccca

SEQ ID NO: 3930999 - RNA, 19 nt, Shigella flexneri 2a str. 301
uaucuucgauaaacucaau

SEQ ID NO: 3931000 - RNA, 15 nt, Shigella flexneri 2a str. 301
uaucuuuccggcaga

SEQ ID NO: 3931001 - RNA, 20 nt, Shigella flexneri 2a str. 301
uaucuuugauugaagaaauc

SEQ ID NO: 3931002 - RNA, 13 nt, Shigella flexneri 2a str. 301
uaucuuuucaggu

SEQ ID NO: 3931003 - RNA, 11 nt, Shigella flexneri 2a str. 301
uaugaaacaac

SEQ ID NO: 3931004 - RNA, 17 nt, Shigella flexneri 2a str. 301
uaugaaagaaaaucaau

SEQ ID NO: 3931005 - RNA, 17 nt, Shigella flexneri 2a str. 301
uaugaagaacaaguuca

SEQ ID NO: 3931006 - RNA, 19 nt, Shigella flexneri 2a str. 301
uaugaauagcggaaaucuc

SEQ ID NO: 3931007 - RNA, 20 nt, Shigella flexneri 2a str. 301
uaugaauagcggaaaucucc

SEQ ID NO: 3931008 - RNA, 22 nt, Shigella flexneri 2a str. 301
uaugaauagcggaaaucuccag

SEQ ID NO: 3931009 - RNA, 22 nt, Shigella flexneri 2a str. 301
uaugaauauauccgaaaaagga

SEQ ID NO: 3931010 - RNA, 18 nt, Shigella flexneri 2a str. 301
uaugaauuugcagccaua

SEQ ID NO: 3931011 - RNA, 18 nt, Shigella flexneri 2a str. 301
uaugacguaucaccgaga

SEQ ID NO: 3931012 - RNA, 13 nt, Shigella flexneri 2a str. 301
uaugacuccagcg

SEQ ID NO: 3931013 - RNA, 22 nt, Shigella flexneri 2a str. 301
uaugagaaaauuucauuaauau

SEQ ID NO: 3931014 - RNA, 20 nt, Shigella flexneri 2a str. 301
uaugagcgauuuuuuauagu

SEQ ID NO: 3931015 - RNA, 23 nt, Shigella flexneri 2a str. 301
uaugagucgccugcucuaaccac

SEQ ID NO: 3931016 - RNA, 17 nt, Shigella flexneri 2a str. 301
uaugagucguaaacaac

SEQ ID NO: 3931017 - RNA, 21 nt, Shigella flexneri 2a str. 301
uaugauaggucauaucacaaa

SEQ ID NO: 3931018 - RNA, 20 nt, Shigella flexneri 2a str. 301
uaugaucaaaaucauauaau

SEQ ID NO: 3931019 - RNA, 14 nt, Shigella flexneri 2a str. 301
uaugaugaaacuga

SEQ ID NO: 3931020 - RNA, 23 nt, Shigella flexneri 2a str. 301
uaugaugaaggcuaaugcugucg

SEQ ID NO: 3931021 - RNA, 15 nt, Shigella flexneri 2a str. 301
uaugauuuaaaaaau

SEQ ID NO: 3931022 - RNA, 15 nt, Shigella flexneri 2a str. 301
uaugcagugcaucca

SEQ ID NO: 3931023 - RNA, 19 nt, Shigella flexneri 2a str. 301
uaugcagugcauccagcag

SEQ ID NO: 3931024 - RNA, 20 nt, Shigella flexneri 2a str. 301
uaugcauaauuugcggaauu

SEQ ID NO: 3931025 - RNA, 14 nt, Shigella flexneri 2a str. 301
uaugccacgugagc

SEQ ID NO: 3931026 - RNA, 12 nt, Shigella flexneri 2a str. 301
uaugccagcccc

SEQ ID NO: 3931027 - RNA, 15 nt, Shigella flexneri 2a str. 301
uaugccagccccagc

SEQ ID NO: 3931028 - RNA, 21 nt, Shigella flexneri 2a str. 301
uaugccagccccagcgucagc

SEQ ID NO: 3931029 - RNA, 13 nt, Shigella flexneri 2a str. 301
uaugcccagggca

SEQ ID NO: 3931030 - RNA, 17 nt, Shigella flexneri 2a str. 301
uaugcccagggcaaugu

SEQ ID NO: 3931031 - RNA, 22 nt, Shigella flexneri 2a str. 301
uaugcccuggcucguggcugag

SEQ ID NO: 3931032 - RNA, 15 nt, Shigella flexneri 2a str. 301
uaugccucaacccuu

SEQ ID NO: 3931033 - RNA, 16 nt, Shigella flexneri 2a str. 301
uaugccugauuacggu

SEQ ID NO: 3931034 - RNA, 14 nt, Shigella flexneri 2a str. 301
uaugccuggcauuu

SEQ ID NO: 3931035 - RNA, 13 nt, Shigella flexneri 2a str. 301
uaugcgcauugcc

SEQ ID NO: 3931036 - RNA, 13 nt, Shigella flexneri 2a str. 301
uaugcgccacagg

SEQ ID NO: 3931037 - RNA, 13 nt, Shigella flexneri 2a str. 301
uaugcgccagacu

SEQ ID NO: 3931038 - RNA, 15 nt, Shigella flexneri 2a str. 301
uaugcgccuuuacca

SEQ ID NO: 3931039 - RNA, 16 nt, Shigella flexneri 2a str. 301
uaugcgccuuucgcuu

SEQ ID NO: 3931040 - RNA, 17 nt, Shigella flexneri 2a str. 301
uaugcgcgucagagauu

SEQ ID NO: 3931041 - RNA, 17 nt, Shigella flexneri 2a str. 301
uaugcgggcguuuugcu

SEQ ID NO: 3931042 - RNA, 11 nt, Shigella flexneri 2a str. 301
uaugcgucagc

SEQ ID NO: 3931043 - RNA, 18 nt, Shigella flexneri 2a str. 301
uaugcugaaucgccaaaa

SEQ ID NO: 3931044 - RNA, 22 nt, Shigella flexneri 2a str. 301
uaugcugaaugaucggauaucu

SEQ ID NO: 3931045 - RNA, 13 nt, Shigella flexneri 2a str. 301
uaugcugauucgu

SEQ ID NO: 3931046 - RNA, 20 nt, Shigella flexneri 2a str. 301
uaugcuggagaagauauugc

SEQ ID NO: 3931047 - RNA, 17 nt, Shigella flexneri 2a str. 301
uaugcuguaaacaacau

SEQ ID NO: 3931048 - RNA, 13 nt, Shigella flexneri 2a str. 301
uaugcuuaauguu

SEQ ID NO: 3931049 - RNA, 18 nt, Shigella flexneri 2a str. 301
uauggacuuuaugaaccu

SEQ ID NO: 3931050 - RNA, 22 nt, Shigella flexneri 2a str. 301
uauggaucagaguugaaaaaca

SEQ ID NO: 3931051 - RNA, 14 nt, Shigella flexneri 2a str. 301
uauggcaccuguug

SEQ ID NO: 3931052 - RNA, 14 nt, Shigella flexneri 2a str. 301
uauggcauugucug

SEQ ID NO: 3931053 - RNA, 19 nt, Shigella flexneri 2a str. 301
uauggccguuuuccccaac

SEQ ID NO: 3931054 - RNA, 17 nt, Shigella flexneri 2a str. 301
uauggcgaacuggucug

SEQ ID NO: 3931055 - RNA, 21 nt, Shigella flexneri 2a str. 301
uaugggcgaauaaaaagccua

SEQ ID NO: 3931056 - RNA, 20 nt, Shigella flexneri 2a str. 301
uaugggguggaacggugaaa

SEQ ID NO: 3931057 - RNA, 18 nt, Shigella flexneri 2a str. 301
uauggugaaaguaaaaaa

SEQ ID NO: 3931058 - RNA, 17 nt, Shigella flexneri 2a str. 301
uaugguuagagaacaac

SEQ ID NO: 3931059 - RNA, 15 nt, Shigella flexneri 2a str. 301
uaugguucacuugcu

SEQ ID NO: 3931060 - RNA, 18 nt, Shigella flexneri 2a str. 301
uaugugcuucuaccauga

SEQ ID NO: 3931061 - RNA, 18 nt, Shigella flexneri 2a str. 301
uauguggaaacagugauu

SEQ ID NO: 3931062 - RNA, 16 nt, Shigella flexneri 2a str. 301
uaugugguuaugccau

SEQ ID NO: 3931063 - RNA, 22 nt, Shigella flexneri 2a str. 301
uauguucagaaagcgccagcaa

SEQ ID NO: 3931064 - RNA, 23 nt, Shigella flexneri 2a str. 301
uauguucagccgucauccaggaa

SEQ ID NO: 3931065 - RNA, 13 nt, Shigella flexneri 2a str. 301
uauguuccccuca

SEQ ID NO: 3931066 - RNA, 13 nt, Shigella flexneri 2a str. 301
uauguugaaaagc

SEQ ID NO: 3931067 - RNA, 16 nt, Shigella flexneri 2a str. 301
uauguuuaucaggcca

SEQ ID NO: 3931068 - RNA, 16 nt, Shigella flexneri 2a str. 301
uauuaaaauucaucaa

SEQ ID NO: 3931069 - RNA, 15 nt, Shigella flexneri 2a str. 301
uauuaaauuugcuuu

SEQ ID NO: 3931070 - RNA, 14 nt, Shigella flexneri 2a str. 301
uauuaaauuuuuuc

SEQ ID NO: 3931071 - RNA, 19 nt, Shigella flexneri 2a str. 301
uauuaacagucagucucaa

SEQ ID NO: 3931072 - RNA, 21 nt, Shigella flexneri 2a str. 301
uauuaacccgcaacagcaaua

SEQ ID NO: 3931073 - RNA, 14 nt, Shigella flexneri 2a str. 301
uauuaacggcucug

SEQ ID NO: 3931074 - RNA, 19 nt, Shigella flexneri 2a str. 301
uauuaacucagcauuauuu

SEQ ID NO: 3931075 - RNA, 15 nt, Shigella flexneri 2a str. 301
uauuaacuuaauaaa

SEQ ID NO: 3931076 - RNA, 17 nt, Shigella flexneri 2a str. 301
uauuaacuuaauaaaca

SEQ ID NO: 3931077 - RNA, 13 nt, Shigella flexneri 2a str. 301
uauuaaucaucau

SEQ ID NO: 3931078 - RNA, 22 nt, Shigella flexneri 2a str. 301
uauuaauccagggaucaacauu

SEQ ID NO: 3931079 - RNA, 23 nt, Shigella flexneri 2a str. 301
uauuaccgaugugaacccugauu

SEQ ID NO: 3931080 - RNA, 15 nt, Shigella flexneri 2a str. 301
uauuaccggcagagu

SEQ ID NO: 3931081 - RNA, 22 nt, Shigella flexneri 2a str. 301
uauuacgagucacaaacaucau

SEQ ID NO: 3931082 - RNA, 21 nt, Shigella flexneri 2a str. 301
uauuacguuccuuuacgguga

SEQ ID NO: 3931083 - RNA, 22 nt, Shigella flexneri 2a str. 301
uauuacugagauggcuucaucc

SEQ ID NO: 3931084 - RNA, 20 nt, Shigella flexneri 2a str. 301
uauuacuuaucccugucuaa

SEQ ID NO: 3931085 - RNA, 22 nt, Shigella flexneri 2a str. 301
uauuacuuaucccugucuaacc

SEQ ID NO: 3931086 - RNA, 15 nt, Shigella flexneri 2a str. 301
uauuaucggcaccau

SEQ ID NO: 3931087 - RNA, 16 nt, Shigella flexneri 2a str. 301
uauuaucggcaccauu

SEQ ID NO: 3931088 - RNA, 21 nt, Shigella flexneri 2a str. 301
uauuuuccgagguuaauauuu

SEQ ID NO: 3931089 - RNA, 12 nt, Shigella flexneri 2a str. 301
uauuuucugaaa

SEQ ID NO: 3931090 - RNA, 13 nt, Shigella flexneri 2a str. 301
uauuuucugaaac

SEQ ID NO: 3931091 - RNA, 20 nt, Shigella flexneri 2a str. 301
uauuuugccggacgcugagc

SEQ ID NO: 3931092 - RNA, 17 nt, Shigella flexneri 2a str. 301
uauuuugcuuccggcaa

SEQ ID NO: 3931093 - RNA, 15 nt, Shigella flexneri 2a str. 301
uauuuugcuuuaagu

SEQ ID NO: 3931094 - RNA, 17 nt, Shigella flexneri 2a str. 301
uauuuuuaaacaucaaa

SEQ ID NO: 3931095 - RNA, 20 nt, Shigella flexneri 2a str. 301
uauuuuuaaauauaaaacaa

SEQ ID NO: 3931096 - RNA, 20 nt, Shigella flexneri 2a str. 301
uauuuuuaaccguauuuugg

SEQ ID NO: 3931097 - RNA, 21 nt, Shigella flexneri 2a str. 301
uauuuuucacccuucaauccc

SEQ ID NO: 3931098 - RNA, 20 nt, Shigella flexneri 2a str. 301
uauuuuuguugaaauaauac

SEQ ID NO: 3931099 - RNA, 18 nt, Shigella flexneri 2a str. 301
uauuuuuuuccuaaaccc

SEQ ID NO: 3931100 - RNA, 22 nt, Shigella flexneri 2a str. 301
uauuuuuuuucaggaaauaaau

SEQ ID NO: 3931101 - RNA, 24 nt, Shigella flexneri 2a str. 301
ucaaaaaaauucugaacaauugga

SEQ ID NO: 3931102 - RNA, 12 nt, Shigella flexneri 2a str. 301
ucaaaaaacugg

SEQ ID NO: 3931103 - RNA, 19 nt, Shigella flexneri 2a str. 301
ucaaaaaacuggaaaaaua

SEQ ID NO: 3931104 - RNA, 20 nt, Shigella flexneri 2a str. 301
ucaaaaaacuggaaaaauaa

SEQ ID NO: 3931105 - RNA, 19 nt, Shigella flexneri 2a str. 301
ucaaaaaaggcugacaaau

SEQ ID NO: 3931106 - RNA, 22 nt, Shigella flexneri 2a str. 301
ucaaaaaaggcugacaaaucag

SEQ ID NO: 3931107 - RNA, 14 nt, Shigella flexneri 2a str. 301
ucaaaaaagucaga

SEQ ID NO: 3931108 - RNA, 15 nt, Shigella flexneri 2a str. 301
ucaaaaacaaagaac

SEQ ID NO: 3931109 - RNA, 16 nt, Shigella flexneri 2a str. 301
ucaaaaaugucaucgu

SEQ ID NO: 3931110 - RNA, 13 nt, Shigella flexneri 2a str. 301
ucaaaacaacaca

SEQ ID NO: 3931111 - RNA, 18 nt, Shigella flexneri 2a str. 301
ucaaaacagcccuuuccu

SEQ ID NO: 3931112 - RNA, 18 nt, Shigella flexneri 2a str. 301
ucaaaacgcucugagcug

SEQ ID NO: 3931113 - RNA, 19 nt, Shigella flexneri 2a str. 301
ucaaaacggucacggcugu

SEQ ID NO: 3931114 - RNA, 16 nt, Shigella flexneri 2a str. 301
ucaaaacggugaucaa

SEQ ID NO: 3931115 - RNA, 19 nt, Shigella flexneri 2a str. 301
ucaaaacggugaucaaaac

SEQ ID NO: 3931116 - RNA, 14 nt, Shigella flexneri 2a str. 301
ucaaaauaauacac

SEQ ID NO: 3931117 - RNA, 23 nt, Shigella flexneri 2a str. 301
ucaaaauauccguagugaaaaag

SEQ ID NO: 3931118 - RNA, 19 nt, Shigella flexneri 2a str. 301
ucaaaauaucgacauucaa

SEQ ID NO: 3931119 - RNA, 16 nt, Shigella flexneri 2a str. 301
ucaaaaucaucaucuu

SEQ ID NO: 3931120 - RNA, 17 nt, Shigella flexneri 2a str. 301
ucaaaaucaucauugcu

SEQ ID NO: 3931121 - RNA, 15 nt, Shigella flexneri 2a str. 301
ucaaaauuaacaccu

SEQ ID NO: 3931122 - RNA, 13 nt, Shigella flexneri 2a str. 301
ucaaacaauuuuc

SEQ ID NO: 3931123 - RNA, 13 nt, Shigella flexneri 2a str. 301
ucaaacaggcugc

SEQ ID NO: 3931124 - RNA, 18 nt, Shigella flexneri 2a str. 301
ucaaacaguucuggaaga

SEQ ID NO: 3931125 - RNA, 22 nt, Shigella flexneri 2a str. 301
ucaaaccaauggcauuggcaga

SEQ ID NO: 3931126 - RNA, 15 nt, Shigella flexneri 2a str. 301
ucaaaccacuuaauu

SEQ ID NO: 3931127 - RNA, 17 nt, Shigella flexneri 2a str. 301
ucaaaccacuuaauuau

SEQ ID NO: 3931128 - RNA, 19 nt, Shigella flexneri 2a str. 301
ucaaaccacuuaauuauua

SEQ ID NO: 3931129 - RNA, 21 nt, Shigella flexneri 2a str. 301
ucaaaccacuuaauuauuaac

SEQ ID NO: 3931130 - RNA, 19 nt, Shigella flexneri 2a str. 301
ucaaaccauucccugcuuu

SEQ ID NO: 3931131 - RNA, 22 nt, Shigella flexneri 2a str. 301
ucaaaccauuuugcaaggcuuc

SEQ ID NO: 3931132 - RNA, 12 nt, Shigella flexneri 2a str. 301
ucaaacccuucc

SEQ ID NO: 3931133 - RNA, 17 nt, Shigella flexneri 2a str. 301
ucaaacccuucuucaau

SEQ ID NO: 3931134 - RNA, 16 nt, Shigella flexneri 2a str. 301
ucaaacgaagcggcug

SEQ ID NO: 3931135 - RNA, 17 nt, Shigella flexneri 2a str. 301
ucaaacgcacgucugau

SEQ ID NO: 3931136 - RNA, 14 nt, Shigella flexneri 2a str. 301
ucaaacgccacagc

SEQ ID NO: 3931137 - RNA, 16 nt, Shigella flexneri 2a str. 301
ucaaacgccagaucac

SEQ ID NO: 3931138 - RNA, 20 nt, Shigella flexneri 2a str. 301
ucaaacgcugacggugccag

SEQ ID NO: 3931139 - RNA, 21 nt, Shigella flexneri 2a str. 301
ucaaacggcgcuuccagcaaa

SEQ ID NO: 3931140 - RNA, 19 nt, Shigella flexneri 2a str. 301
ucaaacggcguuuucucau

SEQ ID NO: 3931141 - RNA, 16 nt, Shigella flexneri 2a str. 301
ucaaacgguugauaaa

SEQ ID NO: 3931142 - RNA, 14 nt, Shigella flexneri 2a str. 301
ucaaacucaauuac

SEQ ID NO: 3931143 - RNA, 12 nt, Shigella flexneri 2a str. 301
ucaaacucuuca

SEQ ID NO: 3931144 - RNA, 20 nt, Shigella flexneri 2a str. 301
ucaaacugaccuuuagcgcg

SEQ ID NO: 3931145 - RNA, 23 nt, Shigella flexneri 2a str. 301
ucaaacuggguuuugaucuccag

SEQ ID NO: 3931146 - RNA, 21 nt, Shigella flexneri 2a str. 301
ucaaacuucgucacagcggcu

SEQ ID NO: 3931147 - RNA, 18 nt, Shigella flexneri 2a str. 301
ucaaacuuuuaaauugaa

SEQ ID NO: 3931148 - RNA, 21 nt, Shigella flexneri 2a str. 301
ucaaagaugaugucacagccg

SEQ ID NO: 3931149 - RNA, 23 nt, Shigella flexneri 2a str. 301
ucaaagaugcaggaguagaacgg

SEQ ID NO: 3931150 - RNA, 15 nt, Shigella flexneri 2a str. 301
ucaaagccaggcaga

SEQ ID NO: 3931151 - RNA, 20 nt, Shigella flexneri 2a str. 301
ucaaagcgugcccccguuuu

SEQ ID NO: 3931152 - RNA, 18 nt, Shigella flexneri 2a str. 301
ucaaaggccgacagcagg

SEQ ID NO: 3931153 - RNA, 20 nt, Shigella flexneri 2a str. 301
ucaaaggccgacagcaggcu

SEQ ID NO: 3931154 - RNA, 13 nt, Shigella flexneri 2a str. 301
ucaaaguaaucaa

SEQ ID NO: 3931155 - RNA, 18 nt, Shigella flexneri 2a str. 301
ucaaagucuccuuugcca

SEQ ID NO: 3931156 - RNA, 22 nt, Shigella flexneri 2a str. 301
ucaaaguuugcaccucugcugc

SEQ ID NO: 3931157 - RNA, 16 nt, Shigella flexneri 2a str. 301
ucaaaguuuuuaugag

SEQ ID NO: 3931158 - RNA, 22 nt, Shigella flexneri 2a str. 301
ucaaauaaaaagguccuguaau

SEQ ID NO: 3931159 - RNA, 14 nt, Shigella flexneri 2a str. 301
ucaaauaaaaauac

SEQ ID NO: 3931160 - RNA, 19 nt, Shigella flexneri 2a str. 301
ucaaauacaccuauacuuu

SEQ ID NO: 3931161 - RNA, 15 nt, Shigella flexneri 2a str. 301
ucaaauacuucaaua

SEQ ID NO: 3931162 - RNA, 20 nt, Shigella flexneri 2a str. 301
ucaaauaucuauauacaauc

SEQ ID NO: 3931163 - RNA, 23 nt, Shigella flexneri 2a str. 301
ucaaauaucuauauacaaucaca

SEQ ID NO: 3931164 - RNA, 14 nt, Shigella flexneri 2a str. 301
ucaaauaucugccg

SEQ ID NO: 3931165 - RNA, 16 nt, Shigella flexneri 2a str. 301
ucaaaucaacaaccug

SEQ ID NO: 3931166 - RNA, 16 nt, Shigella flexneri 2a str. 301
ucaaaucacuaaaccc

SEQ ID NO: 3931167 - RNA, 21 nt, Shigella flexneri 2a str. 301
ucaaaucgaaaucaacauguu

SEQ ID NO: 3931168 - RNA, 23 nt, Shigella flexneri 2a str. 301
ucaaaucuuauaugaugaaacug

SEQ ID NO: 3931169 - RNA, 16 nt, Shigella flexneri 2a str. 301
ucaaauggcgcuucgu

SEQ ID NO: 3931170 - RNA, 17 nt, Shigella flexneri 2a str. 301
ucaaauggcgcuuuaua

SEQ ID NO: 3931171 - RNA, 20 nt, Shigella flexneri 2a str. 301
ucaaauguugcguucaucag

SEQ ID NO: 3931172 - RNA, 24 nt, Shigella flexneri 2a str. 301
ucaaauuacagcaccuuaugcggg

SEQ ID NO: 3931173 - RNA, 20 nt, Shigella flexneri 2a str. 301
ucaaauuacgauccaccacc

SEQ ID NO: 3931174 - RNA, 13 nt, Shigella flexneri 2a str. 301
ucaaauucauugu

SEQ ID NO: 3931175 - RNA, 22 nt, Shigella flexneri 2a str. 301
ucaaauuugucgccaacuucau

SEQ ID NO: 3931176 - RNA, 18 nt, Shigella flexneri 2a str. 301
ucaacaaaccaaaaccgc

SEQ ID NO: 3931177 - RNA, 13 nt, Shigella flexneri 2a str. 301
ucaacaacacucu

SEQ ID NO: 3931178 - RNA, 16 nt, Shigella flexneri 2a str. 301
ucaacaaccuugcguu

SEQ ID NO: 3931179 - RNA, 16 nt, Shigella flexneri 2a str. 301
ucaacaauacgcaccg

SEQ ID NO: 3931180 - RNA, 16 nt, Shigella flexneri 2a str. 301
ucaacaauugaagaau

SEQ ID NO: 3931181 - RNA, 20 nt, Shigella flexneri 2a str. 301
ucaacacacugaauaaaaau

SEQ ID NO: 3931182 - RNA, 21 nt, Shigella flexneri 2a str. 301
ucaacacagugaugaaaacga

SEQ ID NO: 3931183 - RNA, 22 nt, Shigella flexneri 2a str. 301
ucaacacagugaugaaaacgaa

SEQ ID NO: 3931184 - RNA, 13 nt, Shigella flexneri 2a str. 301
ucaacacauccag

SEQ ID NO: 3931185 - RNA, 16 nt, Shigella flexneri 2a str. 301
ucaacacauccagugg

SEQ ID NO: 3931186 - RNA, 12 nt, Shigella flexneri 2a str. 301
ucaacaccacug

SEQ ID NO: 3931187 - RNA, 20 nt, Shigella flexneri 2a str. 301
ucaauaccgccugcaaauaa

SEQ ID NO: 3931188 - RNA, 19 nt, Shigella flexneri 2a str. 301
ucaauaccgcguaauacau

SEQ ID NO: 3931189 - RNA, 20 nt, Shigella flexneri 2a str. 301
ucaauacucgcacuaucgaa

SEQ ID NO: 3931190 - RNA, 20 nt, Shigella flexneri 2a str. 301
ucaauacuuucacaaaaaua

SEQ ID NO: 3931191 - RNA, 14 nt, Shigella flexneri 2a str. 301
ucaauacuuuccag

SEQ ID NO: 3931192 - RNA, 13 nt, Shigella flexneri 2a str. 301
ucaauauauugca

SEQ ID NO: 3931193 - RNA, 18 nt, Shigella flexneri 2a str. 301
ucaauauauugcaaucuc

SEQ ID NO: 3931194 - RNA, 23 nt, Shigella flexneri 2a str. 301
ucaauaucauuacgccagucacg

SEQ ID NO: 3931195 - RNA, 16 nt, Shigella flexneri 2a str. 301
ucaauaugauaaaccu

SEQ ID NO: 3931196 - RNA, 20 nt, Shigella flexneri 2a str. 301
ucaauauuaagaaucucuga

SEQ ID NO: 3931197 - RNA, 20 nt, Shigella flexneri 2a str. 301
ucaauauuagcauuaaguaa

SEQ ID NO: 3931198 - RNA, 18 nt, Shigella flexneri 2a str. 301
ucaauauuugcaccuaaa

SEQ ID NO: 3931199 - RNA, 16 nt, Shigella flexneri 2a str. 301
ucaauauuuucaaucu

SEQ ID NO: 3931200 - RNA, 15 nt, Shigella flexneri 2a str. 301
ucaaucauccauauu

SEQ ID NO: 3931201 - RNA, 19 nt, Shigella flexneri 2a str. 301
ucaaucauccauauuuuca

SEQ ID NO: 3931202 - RNA, 12 nt, Shigella flexneri 2a str. 301
ucaaucauuuuu

SEQ ID NO: 3931203 - RNA, 13 nt, Shigella flexneri 2a str. 301
ucaauccacgguu

SEQ ID NO: 3931204 - RNA, 20 nt, Shigella flexneri 2a str. 301
ucaauccaguguaaaacagc

SEQ ID NO: 3931205 - RNA, 21 nt, Shigella flexneri 2a str. 301
ucaaucccagacguuucgcca

SEQ ID NO: 3931206 - RNA, 21 nt, Shigella flexneri 2a str. 301
ucaaucccuucgacuuucagu

SEQ ID NO: 3931207 - RNA, 14 nt, Shigella flexneri 2a str. 301
ucaaucgagauacg

SEQ ID NO: 3931208 - RNA, 15 nt, Shigella flexneri 2a str. 301
ucaaucgcaaucugg

SEQ ID NO: 3931209 - RNA, 22 nt, Shigella flexneri 2a str. 301
ucaaucgcacccgccaucaucc

SEQ ID NO: 3931210 - RNA, 15 nt, Shigella flexneri 2a str. 301
ucaaucgccaccaca

SEQ ID NO: 3931211 - RNA, 18 nt, Shigella flexneri 2a str. 301
ucaaucguaugaucaucc

SEQ ID NO: 3931212 - RNA, 14 nt, Shigella flexneri 2a str. 301
ucaaucucagcaag

SEQ ID NO: 3931213 - RNA, 14 nt, Shigella flexneri 2a str. 301
ucaaucucuucaca

SEQ ID NO: 3931214 - RNA, 18 nt, Shigella flexneri 2a str. 301
ucaaucucuucacagaca

SEQ ID NO: 3931215 - RNA, 16 nt, Shigella flexneri 2a str. 301
ucaaucucuuuuucca

SEQ ID NO: 3931216 - RNA, 13 nt, Shigella flexneri 2a str. 301
ucaaucuggccug

SEQ ID NO: 3931217 - RNA, 13 nt, Shigella flexneri 2a str. 301
ucaaucuucucuu

SEQ ID NO: 3931218 - RNA, 17 nt, Shigella flexneri 2a str. 301
ucaaucuuuacacacaa

SEQ ID NO: 3931219 - RNA, 21 nt, Shigella flexneri 2a str. 301
ucaaucuuuuucaugcuauuc

SEQ ID NO: 3931220 - RNA, 14 nt, Shigella flexneri 2a str. 301
ucaaugauaagccu

SEQ ID NO: 3931221 - RNA, 20 nt, Shigella flexneri 2a str. 301
ucaaugcauuaucagagauu

SEQ ID NO: 3931222 - RNA, 23 nt, Shigella flexneri 2a str. 301
ucaaugcccaucacuaucgccau

SEQ ID NO: 3931223 - RNA, 18 nt, Shigella flexneri 2a str. 301
ucaaugccggacuguaaa

SEQ ID NO: 3931224 - RNA, 12 nt, Shigella flexneri 2a str. 301
ucaaugcgaucu

SEQ ID NO: 3931225 - RNA, 19 nt, Shigella flexneri 2a str. 301
ucaaugcggcggcgcaccg

SEQ ID NO: 3931226 - RNA, 17 nt, Shigella flexneri 2a str. 301
ucaaugcuuuuugcauu

SEQ ID NO: 3931227 - RNA, 15 nt, Shigella flexneri 2a str. 301
ucaauggaugcaauc

SEQ ID NO: 3931228 - RNA, 22 nt, Shigella flexneri 2a str. 301
ucaauggcugcaaagcauuuuu

SEQ ID NO: 3931229 - RNA, 16 nt, Shigella flexneri 2a str. 301
ucaauggucagcgcca

SEQ ID NO: 3931230 - RNA, 14 nt, Shigella flexneri 2a str. 301
ucaaugucugucau

SEQ ID NO: 3931231 - RNA, 19 nt, Shigella flexneri 2a str. 301
ucaauuaccacaaguaaaa

SEQ ID NO: 3931232 - RNA, 17 nt, Shigella flexneri 2a str. 301
ucaauuagauuuaauaa

SEQ ID NO: 3931233 - RNA, 23 nt, Shigella flexneri 2a str. 301
ucaauucccgagcugcucgucag

SEQ ID NO: 3931234 - RNA, 13 nt, Shigella flexneri 2a str. 301
ucaauuccuucug

SEQ ID NO: 3931235 - RNA, 17 nt, Shigella flexneri 2a str. 301
ucaauucggaaauaauc

SEQ ID NO: 3931236 - RNA, 14 nt, Shigella flexneri 2a str. 301
ucaauuucacagua

SEQ ID NO: 3931237 - RNA, 18 nt, Shigella flexneri 2a str. 301
ucaauuuccaguuucaca

SEQ ID NO: 3931238 - RNA, 20 nt, Shigella flexneri 2a str. 301
ucaauuuccgucgcaugggg

SEQ ID NO: 3931239 - RNA, 18 nt, Shigella flexneri 2a str. 301
ucacaaaacgaauaauug

SEQ ID NO: 3931240 - RNA, 12 nt, Shigella flexneri 2a str. 301
ucacaagaccua

SEQ ID NO: 3931241 - RNA, 16 nt, Shigella flexneri 2a str. 301
ucacaagacuguaaau

SEQ ID NO: 3931242 - RNA, 20 nt, Shigella flexneri 2a str. 301
ucacaaugccaccaauaaug

SEQ ID NO: 3931243 - RNA, 21 nt, Shigella flexneri 2a str. 301
ucacaaugccaccaauaauga

SEQ ID NO: 3931244 - RNA, 20 nt, Shigella flexneri 2a str. 301
ucacaauggcacaaauggca

SEQ ID NO: 3931245 - RNA, 23 nt, Shigella flexneri 2a str. 301
ucacaauggcacaaauggcaaug

SEQ ID NO: 3931246 - RNA, 22 nt, Shigella flexneri 2a str. 301
ucacaauuacugagagaaaaaa

SEQ ID NO: 3931247 - RNA, 17 nt, Shigella flexneri 2a str. 301
ucacaauucaucaucag

SEQ ID NO: 3931248 - RNA, 15 nt, Shigella flexneri 2a str. 301
ucacacaaccaugca

SEQ ID NO: 3931249 - RNA, 18 nt, Shigella flexneri 2a str. 301
ucacacacuuuuauuaac

SEQ ID NO: 3931250 - RNA, 15 nt, Shigella flexneri 2a str. 301
ucacacagugaaucu

SEQ ID NO: 3931251 - RNA, 17 nt, Shigella flexneri 2a str. 301
ucacacagugaaucucu

SEQ ID NO: 3931252 - RNA, 20 nt, Shigella flexneri 2a str. 301
ucacacauaucacaauugau

SEQ ID NO: 3931253 - RNA, 17 nt, Shigella flexneri 2a str. 301
ucacaccacagcagcca

SEQ ID NO: 3931254 - RNA, 14 nt, Shigella flexneri 2a str. 301
ucacaccagcgaug

SEQ ID NO: 3931255 - RNA, 13 nt, Shigella flexneri 2a str. 301
ucacaccagucca

SEQ ID NO: 3931256 - RNA, 20 nt, Shigella flexneri 2a str. 301
ucacaccauugauaauccau

SEQ ID NO: 3931257 - RNA, 18 nt, Shigella flexneri 2a str. 301
ucacacccgguaucaaac

SEQ ID NO: 3931258 - RNA, 19 nt, Shigella flexneri 2a str. 301
ucacacccgguaucaaacc

SEQ ID NO: 3931259 - RNA, 18 nt, Shigella flexneri 2a str. 301
ucacaccugcucagcccg

SEQ ID NO: 3931260 - RNA, 19 nt, Shigella flexneri 2a str. 301
ucacacucaugauccugga

SEQ ID NO: 3931261 - RNA, 19 nt, Shigella flexneri 2a str. 301
ucacagaggucuuuucucg

SEQ ID NO: 3931262 - RNA, 17 nt, Shigella flexneri 2a str. 301
ucacagaguauuuccag

SEQ ID NO: 3931263 - RNA, 19 nt, Shigella flexneri 2a str. 301
ucacagaguauuuccagcu

SEQ ID NO: 3931264 - RNA, 16 nt, Shigella flexneri 2a str. 301
ucacagcggcuuccac

SEQ ID NO: 3931265 - RNA, 20 nt, Shigella flexneri 2a str. 301
ucacagcuaaucaucaucag

SEQ ID NO: 3931266 - RNA, 22 nt, Shigella flexneri 2a str. 301
ucacaguaaugauuuaaaacca

SEQ ID NO: 3931267 - RNA, 14 nt, Shigella flexneri 2a str. 301
ucacauaacugccu

SEQ ID NO: 3931268 - RNA, 15 nt, Shigella flexneri 2a str. 301
ucacauauugcagcu

SEQ ID NO: 3931269 - RNA, 15 nt, Shigella flexneri 2a str. 301
ucacaucaaaucccc

SEQ ID NO: 3931270 - RNA, 14 nt, Shigella flexneri 2a str. 301
ucacaucaccaaca

SEQ ID NO: 3931271 - RNA, 13 nt, Shigella flexneri 2a str. 301
ucacaucaccaua

SEQ ID NO: 3931272 - RNA, 15 nt, Shigella flexneri 2a str. 301
ucacaucaccauagc

SEQ ID NO: 3931273 - RNA, 17 nt, Shigella flexneri 2a str. 301
ucacaucaccgcaccac

SEQ ID NO: 3931274 - RNA, 20 nt, Shigella flexneri 2a str. 301
ucacauccagcguuaccggc

SEQ ID NO: 3931275 - RNA, 14 nt, Shigella flexneri 2a str. 301
ucacaucgcuaccg

SEQ ID NO: 3931276 - RNA, 17 nt, Shigella flexneri 2a str. 301
ucacaucgcuaccgcgc

SEQ ID NO: 3931277 - RNA, 17 nt, Shigella flexneri 2a str. 301
ucacaugaguugcugga

SEQ ID NO: 3931278 - RNA, 11 nt, Shigella flexneri 2a str. 301
ucaccaaagcu

SEQ ID NO: 3931279 - RNA, 22 nt, Shigella flexneri 2a str. 301
ucaccaacaguacgguaaagcc

SEQ ID NO: 3931280 - RNA, 16 nt, Shigella flexneri 2a str. 301
ucaccaaucagaaagg

SEQ ID NO: 3931281 - RNA, 14 nt, Shigella flexneri 2a str. 301
ucaccaaugaaagc

SEQ ID NO: 3931282 - RNA, 16 nt, Shigella flexneri 2a str. 301
ucaccacagacaaaca

SEQ ID NO: 3931283 - RNA, 15 nt, Shigella flexneri 2a str. 301
ucaccacauccagcu

SEQ ID NO: 3931284 - RNA, 15 nt, Shigella flexneri 2a str. 301
ucaccaccuggguga

SEQ ID NO: 3931285 - RNA, 20 nt, Shigella flexneri 2a str. 301
ucaccacgcugagagaagca

SEQ ID NO: 3931286 - RNA, 22 nt, Shigella flexneri 2a str. 301
ucaccacugacgggaaacucug

SEQ ID NO: 3931287 - RNA, 18 nt, Shigella flexneri 2a str. 301
ucaccacuucggcaaaaa

SEQ ID NO: 3931288 - RNA, 22 nt, Shigella flexneri 2a str. 301
ucaccacuucggcaaaaaaguc

SEQ ID NO: 3931289 - RNA, 19 nt, Shigella flexneri 2a str. 301
ucaccacuuugucugucaa

SEQ ID NO: 3931290 - RNA, 18 nt, Shigella flexneri 2a str. 301
ucaccagaaguaucguua

SEQ ID NO: 3931291 - RNA, 18 nt, Shigella flexneri 2a str. 301
ucaccagacaauggcccg

SEQ ID NO: 3931292 - RNA, 14 nt, Shigella flexneri 2a str. 301
ucaccagacaucaa

SEQ ID NO: 3931293 - RNA, 20 nt, Shigella flexneri 2a str. 301
ucaccagcaaauccagcggu

SEQ ID NO: 3931294 - RNA, 22 nt, Shigella flexneri 2a str. 301
ucaccagcaaauccagcgguug

SEQ ID NO: 3931295 - RNA, 15 nt, Shigella flexneri 2a str. 301
ucaccagcacuucac

SEQ ID NO: 3931296 - RNA, 19 nt, Shigella flexneri 2a str. 301
ucaccagcaguaaaccgcu

SEQ ID NO: 3931297 - RNA, 18 nt, Shigella flexneri 2a str. 301
ucaccagcaucgccggua

SEQ ID NO: 3931298 - RNA, 15 nt, Shigella flexneri 2a str. 301
ucaccagcgcacgca

SEQ ID NO: 3931299 - RNA, 14 nt, Shigella flexneri 2a str. 301
ucaccagcgcauug

SEQ ID NO: 3931300 - RNA, 19 nt, Shigella flexneri 2a str. 301
ucaccagcgcauugacgau

SEQ ID NO: 3931301 - RNA, 12 nt, Shigella flexneri 2a str. 301
ucaccagcgcga

SEQ ID NO: 3931302 - RNA, 21 nt, Shigella flexneri 2a str. 301
ucaccauaaaacgcgcuacug

SEQ ID NO: 3931303 - RNA, 13 nt, Shigella flexneri 2a str. 301
ucaccauaaauca

SEQ ID NO: 3931304 - RNA, 16 nt, Shigella flexneri 2a str. 301
ucaccauauucagcag

SEQ ID NO: 3931305 - RNA, 13 nt, Shigella flexneri 2a str. 301
ucaccaucuucac

SEQ ID NO: 3931306 - RNA, 17 nt, Shigella flexneri 2a str. 301
ucaccaugagcggcgcu

SEQ ID NO: 3931307 - RNA, 22 nt, Shigella flexneri 2a str. 301
ucaccauuacgcaaugcguacu

SEQ ID NO: 3931308 - RNA, 16 nt, Shigella flexneri 2a str. 301
ucaccauuccgcauga

SEQ ID NO: 3931309 - RNA, 23 nt, Shigella flexneri 2a str. 301
ucaccauucugcgcugacucuac

SEQ ID NO: 3931310 - RNA, 22 nt, Shigella flexneri 2a str. 301
ucaccauuggugauccgaggcc

SEQ ID NO: 3931311 - RNA, 23 nt, Shigella flexneri 2a str. 301
ucaccauuuccgguacuggcuau

SEQ ID NO: 3931312 - RNA, 12 nt, Shigella flexneri 2a str. 301
ucacccaacaau

SEQ ID NO: 3931313 - RNA, 13 nt, Shigella flexneri 2a str. 301
ucacccacacuuc

SEQ ID NO: 3931314 - RNA, 18 nt, Shigella flexneri 2a str. 301
ucacccacgguuacgcua

SEQ ID NO: 3931315 - RNA, 22 nt, Shigella flexneri 2a str. 301
ucacccacguuacgcgaucguc

SEQ ID NO: 3931316 - RNA, 15 nt, Shigella flexneri 2a str. 301
ucacccacuaaucgu

SEQ ID NO: 3931317 - RNA, 20 nt, Shigella flexneri 2a str. 301
ucacccaucacuaccugauu

SEQ ID NO: 3931318 - RNA, 15 nt, Shigella flexneri 2a str. 301
ucacccaugaagaau

SEQ ID NO: 3931319 - RNA, 22 nt, Shigella flexneri 2a str. 301
ucacccccguuaaccacuucag

SEQ ID NO: 3931320 - RNA, 19 nt, Shigella flexneri 2a str. 301
ucaccccgccgggcuuacc

SEQ ID NO: 3931321 - RNA, 20 nt, Shigella flexneri 2a str. 301
ucaccccgcgcucacaccac

SEQ ID NO: 3931322 - RNA, 22 nt, Shigella flexneri 2a str. 301
ucacccgccgguggcguuucca

SEQ ID NO: 3931323 - RNA, 19 nt, Shigella flexneri 2a str. 301
ucacccggaucaauuaauc

SEQ ID NO: 3931324 - RNA, 23 nt, Shigella flexneri 2a str. 301
ucacccgugagaacugcugcauc

SEQ ID NO: 3931325 - RNA, 14 nt, Shigella flexneri 2a str. 301
ucaccgaacucgau

SEQ ID NO: 3931326 - RNA, 23 nt, Shigella flexneri 2a str. 301
ucaccgaagacgugcgccacaac

SEQ ID NO: 3931327 - RNA, 23 nt, Shigella flexneri 2a str. 301
ucaccgaagcggccgucagaucg

SEQ ID NO: 3931328 - RNA, 22 nt, Shigella flexneri 2a str. 301
ucaccgacguuugcgcccagcc

SEQ ID NO: 3931329 - RNA, 17 nt, Shigella flexneri 2a str. 301
ucaccgaugaucgccau

SEQ ID NO: 3931330 - RNA, 19 nt, Shigella flexneri 2a str. 301
ucaccgaugcacagaaccg

SEQ ID NO: 3931331 - RNA, 19 nt, Shigella flexneri 2a str. 301
ucaccgauguuguugucua

SEQ ID NO: 3931332 - RNA, 19 nt, Shigella flexneri 2a str. 301
ucaccgcaccacaccugau

SEQ ID NO: 3931333 - RNA, 23 nt, Shigella flexneri 2a str. 301
ucaccgcagcaucgucaucagcu

SEQ ID NO: 3931334 - RNA, 15 nt, Shigella flexneri 2a str. 301
ucaccgcaucgucac

SEQ ID NO: 3931335 - RNA, 22 nt, Shigella flexneri 2a str. 301
ucaccgcaucgucacugauagu

SEQ ID NO: 3931336 - RNA, 14 nt, Shigella flexneri 2a str. 301
ucaccgccaccagc

SEQ ID NO: 3931337 - RNA, 13 nt, Shigella flexneri 2a str. 301
ucaccgccgccuu

SEQ ID NO: 3931338 - RNA, 16 nt, Shigella flexneri 2a str. 301
ucaccgcgaaauaauc

SEQ ID NO: 3931339 - RNA, 14 nt, Shigella flexneri 2a str. 301
ucaccgcgaccaga

SEQ ID NO: 3931340 - RNA, 21 nt, Shigella flexneri 2a str. 301
ucaccgcguaugcccagcgca

SEQ ID NO: 3931341 - RNA, 21 nt, Shigella flexneri 2a str. 301
ucaccgcgucuucgcugcuuu

SEQ ID NO: 3931342 - RNA, 22 nt, Shigella flexneri 2a str. 301
ucaccgcuaaagcgguuacaca

SEQ ID NO: 3931343 - RNA, 22 nt, Shigella flexneri 2a str. 301
ucaccgcuggcguaguuucgua

SEQ ID NO: 3931344 - RNA, 12 nt, Shigella flexneri 2a str. 301
ucaccggucaga

SEQ ID NO: 3931345 - RNA, 17 nt, Shigella flexneri 2a str. 301
ucaccguucacugccac

SEQ ID NO: 3931346 - RNA, 18 nt, Shigella flexneri 2a str. 301
ucaccguugacgauaacc

SEQ ID NO: 3931347 - RNA, 15 nt, Shigella flexneri 2a str. 301
ucaccuacgcuggca

SEQ ID NO: 3931348 - RNA, 18 nt, Shigella flexneri 2a str. 301
ucaccucaucaccacaga

SEQ ID NO: 3931349 - RNA, 14 nt, Shigella flexneri 2a str. 301
ucaccucugucgau

SEQ ID NO: 3931350 - RNA, 22 nt, Shigella flexneri 2a str. 301
ucaccucugucgaugcgcucug

SEQ ID NO: 3931351 - RNA, 19 nt, Shigella flexneri 2a str. 301
ucaccucuucauuaaacca

SEQ ID NO: 3931352 - RNA, 20 nt, Shigella flexneri 2a str. 301
ucaccugcacaccaaccgcu

SEQ ID NO: 3931353 - RNA, 13 nt, Shigella flexneri 2a str. 301
ucaccugcacaug

SEQ ID NO: 3931354 - RNA, 21 nt, Shigella flexneri 2a str. 301
ucaccugcccgguauccauca

SEQ ID NO: 3931355 - RNA, 15 nt, Shigella flexneri 2a str. 301
ucaccugcccuccgg

SEQ ID NO: 3931356 - RNA, 17 nt, Shigella flexneri 2a str. 301
ucaccugcggugcagcc

SEQ ID NO: 3931357 - RNA, 18 nt, Shigella flexneri 2a str. 301
ucaccuucucgcugauuc

SEQ ID NO: 3931358 - RNA, 13 nt, Shigella flexneri 2a str. 301
ucaccuuuaaccu

SEQ ID NO: 3931359 - RNA, 15 nt, Shigella flexneri 2a str. 301
ucaccuuuaaccucc

SEQ ID NO: 3931360 - RNA, 22 nt, Shigella flexneri 2a str. 301
ucacgaaaacagcgcagcucug

SEQ ID NO: 3931361 - RNA, 15 nt, Shigella flexneri 2a str. 301
ucacgaacacagugg

SEQ ID NO: 3931362 - RNA, 15 nt, Shigella flexneri 2a str. 301
ucacgaagcucucug

SEQ ID NO: 3931363 - RNA, 15 nt, Shigella flexneri 2a str. 301
ucacgaaucuauuca

SEQ ID NO: 3931364 - RNA, 18 nt, Shigella flexneri 2a str. 301
ucacgaaucuauucauuu

SEQ ID NO: 3931365 - RNA, 18 nt, Shigella flexneri 2a str. 301
ucacgacaaagacaucaa

SEQ ID NO: 3931366 - RNA, 18 nt, Shigella flexneri 2a str. 301
ucacgaccuguaccuuca

SEQ ID NO: 3931367 - RNA, 14 nt, Shigella flexneri 2a str. 301
ucacgauagccacg

SEQ ID NO: 3931368 - RNA, 15 nt, Shigella flexneri 2a str. 301
ucacgauagccagaa

SEQ ID NO: 3931369 - RNA, 14 nt, Shigella flexneri 2a str. 301
ucacgaucacagca

SEQ ID NO: 3931370 - RNA, 15 nt, Shigella flexneri 2a str. 301
ucacgaucacagcag

SEQ ID NO: 3931371 - RNA, 14 nt, Shigella flexneri 2a str. 301
ucacgaugcuaaaa

SEQ ID NO: 3931372 - RNA, 21 nt, Shigella flexneri 2a str. 301
ucacgauuguuaaucacaucg

SEQ ID NO: 3931373 - RNA, 21 nt, Shigella flexneri 2a str. 301
ucacgcaaaacgcugcaacgu

SEQ ID NO: 3931374 - RNA, 13 nt, Shigella flexneri 2a str. 301
ucacgcaaccaca

SEQ ID NO: 3931375 - RNA, 14 nt, Shigella flexneri 2a str. 301
ucacgcaauaccug

SEQ ID NO: 3931376 - RNA, 16 nt, Shigella flexneri 2a str. 301
ucacgcaggcgagaau

SEQ ID NO: 3931377 - RNA, 23 nt, Shigella flexneri 2a str. 301
ucacgcagggugugcuccagucg

SEQ ID NO: 3931378 - RNA, 15 nt, Shigella flexneri 2a str. 301
ucacgcagugcugca

SEQ ID NO: 3931379 - RNA, 13 nt, Shigella flexneri 2a str. 301
ucacgcaucacuu

SEQ ID NO: 3931380 - RNA, 13 nt, Shigella flexneri 2a str. 301
ucacgccaaccag

SEQ ID NO: 3931381 - RNA, 15 nt, Shigella flexneri 2a str. 301
ucacgccaauaaucg

SEQ ID NO: 3931382 - RNA, 19 nt, Shigella flexneri 2a str. 301
ucacgccaauaauggccuu

SEQ ID NO: 3931383 - RNA, 12 nt, Shigella flexneri 2a str. 301
ucacgccaauac

SEQ ID NO: 3931384 - RNA, 18 nt, Shigella flexneri 2a str. 301
ucacgccaucaucggcaa

SEQ ID NO: 3931385 - RNA, 23 nt, Shigella flexneri 2a str. 301
ucacgcccauugagcuggucuga

SEQ ID NO: 3931386 - RNA, 15 nt, Shigella flexneri 2a str. 301
ucacgcccgccccag

SEQ ID NO: 3931387 - RNA, 22 nt, Shigella flexneri 2a str. 301
ucagaccaguuuuuucaccagc

SEQ ID NO: 3931388 - RNA, 17 nt, Shigella flexneri 2a str. 301
ucagaccgcuucugcgu

SEQ ID NO: 3931389 - RNA, 23 nt, Shigella flexneri 2a str. 301
ucagaccgcuucugcguucugau

SEQ ID NO: 3931390 - RNA, 18 nt, Shigella flexneri 2a str. 301
ucagaccggcaaccagca

SEQ ID NO: 3931391 - RNA, 18 nt, Shigella flexneri 2a str. 301
ucagacggcugucuuccu

SEQ ID NO: 3931392 - RNA, 19 nt, Shigella flexneri 2a str. 301
ucagacggcugucuuccug

SEQ ID NO: 3931393 - RNA, 13 nt, Shigella flexneri 2a str. 301
ucagacguucuuc

SEQ ID NO: 3931394 - RNA, 19 nt, Shigella flexneri 2a str. 301
ucagacuauucagcucuuc

SEQ ID NO: 3931395 - RNA, 16 nt, Shigella flexneri 2a str. 301
ucagacucucauuuuu

SEQ ID NO: 3931396 - RNA, 17 nt, Shigella flexneri 2a str. 301
ucagacuuaauccgggc

SEQ ID NO: 3931397 - RNA, 17 nt, Shigella flexneri 2a str. 301
ucagacuuugcgccauc

SEQ ID NO: 3931398 - RNA, 22 nt, Shigella flexneri 2a str. 301
ucagagagccagccccacagca

SEQ ID NO: 3931399 - RNA, 17 nt, Shigella flexneri 2a str. 301
ucagagauucuuuuccu

SEQ ID NO: 3931400 - RNA, 17 nt, Shigella flexneri 2a str. 301
ucagaggcgaaccgcug

SEQ ID NO: 3931401 - RNA, 16 nt, Shigella flexneri 2a str. 301
ucagagugccgaagaa

SEQ ID NO: 3931402 - RNA, 18 nt, Shigella flexneri 2a str. 301
ucagagugccgaagaaca

SEQ ID NO: 3931403 - RNA, 20 nt, Shigella flexneri 2a str. 301
ucagagugccgaagaacaua

SEQ ID NO: 3931404 - RNA, 13 nt, Shigella flexneri 2a str. 301
ucagauaaaugca

SEQ ID NO: 3931405 - RNA, 21 nt, Shigella flexneri 2a str. 301
ucagauaaaugcaaacgcauc

SEQ ID NO: 3931406 - RNA, 18 nt, Shigella flexneri 2a str. 301
ucagauaauagguaaaca

SEQ ID NO: 3931407 - RNA, 18 nt, Shigella flexneri 2a str. 301
ucagauaauccccaauga

SEQ ID NO: 3931408 - RNA, 22 nt, Shigella flexneri 2a str. 301
ucagauaaugcccgaugaccuu

SEQ ID NO: 3931409 - RNA, 20 nt, Shigella flexneri 2a str. 301
ucagaucccaauucauuccu

SEQ ID NO: 3931410 - RNA, 23 nt, Shigella flexneri 2a str. 301
ucagauccgccaguuuguagcca

SEQ ID NO: 3931411 - RNA, 18 nt, Shigella flexneri 2a str. 301
ucagaucgcgaccgccuu

SEQ ID NO: 3931412 - RNA, 21 nt, Shigella flexneri 2a str. 301
ucagaucuaauguugguguga

SEQ ID NO: 3931413 - RNA, 12 nt, Shigella flexneri 2a str. 301
ucagaucuuuaa

SEQ ID NO: 3931414 - RNA, 18 nt, Shigella flexneri 2a str. 301
ucagaucuuucacgaaca

SEQ ID NO: 3931415 - RNA, 22 nt, Shigella flexneri 2a str. 301
ucagaugcggcgugaacgccuu

SEQ ID NO: 3931416 - RNA, 16 nt, Shigella flexneri 2a str. 301
ucagauggcggcuggc

SEQ ID NO: 3931417 - RNA, 15 nt, Shigella flexneri 2a str. 301
ucagaugugcggugg

SEQ ID NO: 3931418 - RNA, 22 nt, Shigella flexneri 2a str. 301
ucagauuauagugauccugcau

SEQ ID NO: 3931419 - RNA, 23 nt, Shigella flexneri 2a str. 301
ucagauuguugauuaacaggcug

SEQ ID NO: 3931420 - RNA, 14 nt, Shigella flexneri 2a str. 301
ucagcaaauccauc

SEQ ID NO: 3931421 - RNA, 23 nt, Shigella flexneri 2a str. 301
ucagcaacaaaauggcaaagcga

SEQ ID NO: 3931422 - RNA, 13 nt, Shigella flexneri 2a str. 301
ucagcaacaugcc

SEQ ID NO: 3931423 - RNA, 17 nt, Shigella flexneri 2a str. 301
ucagcaagcgauaauuu

SEQ ID NO: 3931424 - RNA, 14 nt, Shigella flexneri 2a str. 301
ucagcaauacgcuu

SEQ ID NO: 3931425 - RNA, 17 nt, Shigella flexneri 2a str. 301
ucagcaaucgcgccagc

SEQ ID NO: 3931426 - RNA, 19 nt, Shigella flexneri 2a str. 301
ucagcaaucugaagccgca

SEQ ID NO: 3931427 - RNA, 13 nt, Shigella flexneri 2a str. 301
ucagcaaucugau

SEQ ID NO: 3931428 - RNA, 16 nt, Shigella flexneri 2a str. 301
ucagcaauguuucucu

SEQ ID NO: 3931429 - RNA, 22 nt, Shigella flexneri 2a str. 301
ucagcacuuaucucuuccgcau

SEQ ID NO: 3931430 - RNA, 22 nt, Shigella flexneri 2a str. 301
ucagcacuucacccaucgccag

SEQ ID NO: 3931431 - RNA, 14 nt, Shigella flexneri 2a str. 301
ucagcagcaccacc

SEQ ID NO: 3931432 - RNA, 17 nt, Shigella flexneri 2a str. 301
ucagcagcagacagccu

SEQ ID NO: 3931433 - RNA, 23 nt, Shigella flexneri 2a str. 301
ucagcagcggcucggucagaccc

SEQ ID NO: 3931434 - RNA, 19 nt, Shigella flexneri 2a str. 301
ucagcagcguggugcugau

SEQ ID NO: 3931435 - RNA, 18 nt, Shigella flexneri 2a str. 301
ucagcagcuuugcccgau

SEQ ID NO: 3931436 - RNA, 20 nt, Shigella flexneri 2a str. 301
ucagcaggaauguuguccag

SEQ ID NO: 3931437 - RNA, 15 nt, Shigella flexneri 2a str. 301
ucagcagugccagua

SEQ ID NO: 3931438 - RNA, 20 nt, Shigella flexneri 2a str. 301
ucagcaguucagucagcagu

SEQ ID NO: 3931439 - RNA, 17 nt, Shigella flexneri 2a str. 301
ucagcaguucugccagg

SEQ ID NO: 3931440 - RNA, 15 nt, Shigella flexneri 2a str. 301
ucagcauaaaaauau

SEQ ID NO: 3931441 - RNA, 17 nt, Shigella flexneri 2a str. 301
ucagcauaaucaccagu

SEQ ID NO: 3931442 - RNA, 18 nt, Shigella flexneri 2a str. 301
ucagcauaaucaccagua

SEQ ID NO: 3931443 - RNA, 17 nt, Shigella flexneri 2a str. 301
ucagcaucaagauaaac

SEQ ID NO: 3931444 - RNA, 17 nt, Shigella flexneri 2a str. 301
ucagcaucaaugaccug

SEQ ID NO: 3931445 - RNA, 19 nt, Shigella flexneri 2a str. 301
ucagcauccauaucgccau

SEQ ID NO: 3931446 - RNA, 22 nt, Shigella flexneri 2a str. 301
ucagcaucccaccugaaauggu

SEQ ID NO: 3931447 - RNA, 13 nt, Shigella flexneri 2a str. 301
ucagcaucucauc

SEQ ID NO: 3931448 - RNA, 12 nt, Shigella flexneri 2a str. 301
ucagcaugacaa

SEQ ID NO: 3931449 - RNA, 15 nt, Shigella flexneri 2a str. 301
ucagcaugacaaaaa

SEQ ID NO: 3931450 - RNA, 16 nt, Shigella flexneri 2a str. 301
ucagcaugacaaaaaa

SEQ ID NO: 3931451 - RNA, 15 nt, Shigella flexneri 2a str. 301
ucagcauuauuuuua

SEQ ID NO: 3931452 - RNA, 16 nt, Shigella flexneri 2a str. 301
ucagcauucucaucac

SEQ ID NO: 3931453 - RNA, 22 nt, Shigella flexneri 2a str. 301
ucagcauuucgcgauauugcug

SEQ ID NO: 3931454 - RNA, 14 nt, Shigella flexneri 2a str. 301
ucagccaacgcauu

SEQ ID NO: 3931455 - RNA, 13 nt, Shigella flexneri 2a str. 301
ucagccacuuccu

SEQ ID NO: 3931456 - RNA, 14 nt, Shigella flexneri 2a str. 301
ucagccagaaagaa

SEQ ID NO: 3931457 - RNA, 18 nt, Shigella flexneri 2a str. 301
ucagccaucauccauucg

SEQ ID NO: 3931458 - RNA, 18 nt, Shigella flexneri 2a str. 301
ucagcccacauccaugug

SEQ ID NO: 3931459 - RNA, 19 nt, Shigella flexneri 2a str. 301
ucagccccuugcugacucc

SEQ ID NO: 3931460 - RNA, 14 nt, Shigella flexneri 2a str. 301
ucagcccgaugaua

SEQ ID NO: 3931461 - RNA, 22 nt, Shigella flexneri 2a str. 301
ucagcccgcgauacaccugaug

SEQ ID NO: 3931462 - RNA, 13 nt, Shigella flexneri 2a str. 301
ucagcccuuuaau

SEQ ID NO: 3931463 - RNA, 22 nt, Shigella flexneri 2a str. 301
ucagccgcccgcgauaaaaauc

SEQ ID NO: 3931464 - RNA, 18 nt, Shigella flexneri 2a str. 301
ucagccguacccaggccc

SEQ ID NO: 3931465 - RNA, 17 nt, Shigella flexneri 2a str. 301
ucagccgucauccagga

SEQ ID NO: 3931466 - RNA, 11 nt, Shigella flexneri 2a str. 301
ucagccucugc

SEQ ID NO: 3931467 - RNA, 14 nt, Shigella flexneri 2a str. 301
ucagccugacagca

SEQ ID NO: 3931468 - RNA, 20 nt, Shigella flexneri 2a str. 301
ucagccugcucaguugcauc

SEQ ID NO: 3931469 - RNA, 22 nt, Shigella flexneri 2a str. 301
ucagcgagacgugcguaccauu

SEQ ID NO: 3931470 - RNA, 17 nt, Shigella flexneri 2a str. 301
ucagcgagagcaaugcg

SEQ ID NO: 3931471 - RNA, 19 nt, Shigella flexneri 2a str. 301
ucagcgaucguuuuuaacc

SEQ ID NO: 3931472 - RNA, 19 nt, Shigella flexneri 2a str. 301
ucagcgcaaagagugaagu

SEQ ID NO: 3931473 - RNA, 20 nt, Shigella flexneri 2a str. 301
ucagcgcaacuugcagaucc

SEQ ID NO: 3931474 - RNA, 12 nt, Shigella flexneri 2a str. 301
ucagcgcagaca

SEQ ID NO: 3931475 - RNA, 16 nt, Shigella flexneri 2a str. 301
ucagcgcagcacccag

SEQ ID NO: 3931476 - RNA, 13 nt, Shigella flexneri 2a str. 301
ucagcgcaugauu

SEQ ID NO: 3931477 - RNA, 16 nt, Shigella flexneri 2a str. 301
ucagcgcaugauuccc

SEQ ID NO: 3931478 - RNA, 13 nt, Shigella flexneri 2a str. 301
ucagcgccaaccc

SEQ ID NO: 3931479 - RNA, 15 nt, Shigella flexneri 2a str. 301
ucagcgccagcgcga

SEQ ID NO: 3931480 - RNA, 18 nt, Shigella flexneri 2a str. 301
ucagcgccagcgcggaag

SEQ ID NO: 3931481 - RNA, 14 nt, Shigella flexneri 2a str. 301
ucagcgccuucaga

SEQ ID NO: 3931482 - RNA, 19 nt, Shigella flexneri 2a str. 301
ucagcgcgacgcucggcug

SEQ ID NO: 3931483 - RNA, 12 nt, Shigella flexneri 2a str. 301
ucagcgcuaccg

SEQ ID NO: 3931484 - RNA, 16 nt, Shigella flexneri 2a str. 301
ucagcggcaauucuuu

SEQ ID NO: 3931485 - RNA, 20 nt, Shigella flexneri 2a str. 301
ucagcggcguaucuuccagg

SEQ ID NO: 3931486 - RNA, 19 nt, Shigella flexneri 2a str. 301
ucagcggugccgcgauacc

SEQ ID NO: 3931487 - RNA, 21 nt, Shigella flexneri 2a str. 301
ucagugaccgaaccuguuuuc

SEQ ID NO: 3931488 - RNA, 14 nt, Shigella flexneri 2a str. 301
ucagugagcacauc

SEQ ID NO: 3931489 - RNA, 15 nt, Shigella flexneri 2a str. 301
ucagugcaaaugcca

SEQ ID NO: 3931490 - RNA, 15 nt, Shigella flexneri 2a str. 301
ucagugcgucgcugc

SEQ ID NO: 3931491 - RNA, 13 nt, Shigella flexneri 2a str. 301
ucagugcuucacc

SEQ ID NO: 3931492 - RNA, 17 nt, Shigella flexneri 2a str. 301
ucaguggcuauuuacca

SEQ ID NO: 3931493 - RNA, 15 nt, Shigella flexneri 2a str. 301
ucagugggcgcugcu

SEQ ID NO: 3931494 - RNA, 18 nt, Shigella flexneri 2a str. 301
ucaguggguuaugaaacu

SEQ ID NO: 3931495 - RNA, 21 nt, Shigella flexneri 2a str. 301
ucaguggguuaugaaacucca

SEQ ID NO: 3931496 - RNA, 17 nt, Shigella flexneri 2a str. 301
ucagugucgcaguagcc

SEQ ID NO: 3931497 - RNA, 10 nt, Shigella flexneri 2a str. 301
ucagugucuu

SEQ ID NO: 3931498 - RNA, 15 nt, Shigella flexneri 2a str. 301
ucagugucuuaucug

SEQ ID NO: 3931499 - RNA, 20 nt, Shigella flexneri 2a str. 301
ucagugucuuaucuggcauu

SEQ ID NO: 3931500 - RNA, 13 nt, Shigella flexneri 2a str. 301
ucaguuaacggca

SEQ ID NO: 3931501 - RNA, 20 nt, Shigella flexneri 2a str. 301
ucaguuaaucgcgaaauaac

SEQ ID NO: 3931502 - RNA, 14 nt, Shigella flexneri 2a str. 301
ucaguuaccugaau

SEQ ID NO: 3931503 - RNA, 13 nt, Shigella flexneri 2a str. 301
ucaguucaccacu

SEQ ID NO: 3931504 - RNA, 12 nt, Shigella flexneri 2a str. 301
ucaguucaccau

SEQ ID NO: 3931505 - RNA, 13 nt, Shigella flexneri 2a str. 301
ucaguucaccauu

SEQ ID NO: 3931506 - RNA, 15 nt, Shigella flexneri 2a str. 301
ucaguuccagcagcg

SEQ ID NO: 3931507 - RNA, 14 nt, Shigella flexneri 2a str. 301
ucaguuccgcugca

SEQ ID NO: 3931508 - RNA, 18 nt, Shigella flexneri 2a str. 301
ucaguuccgcuucgccaa

SEQ ID NO: 3931509 - RNA, 18 nt, Shigella flexneri 2a str. 301
ucaguuccgggaucacca

SEQ ID NO: 3931510 - RNA, 15 nt, Shigella flexneri 2a str. 301
ucaguuccugaucga

SEQ ID NO: 3931511 - RNA, 21 nt, Shigella flexneri 2a str. 301
ucaguuccugaucgauaaauu

SEQ ID NO: 3931512 - RNA, 17 nt, Shigella flexneri 2a str. 301
ucaguugcaccugaucc

SEQ ID NO: 3931513 - RNA, 22 nt, Shigella flexneri 2a str. 301
ucaguugguuagagcacaucac

SEQ ID NO: 3931514 - RNA, 14 nt, Shigella flexneri 2a str. 301
ucaguugucugaau

SEQ ID NO: 3931515 - RNA, 17 nt, Shigella flexneri 2a str. 301
ucaguuuaaccgggaga

SEQ ID NO: 3931516 - RNA, 18 nt, Shigella flexneri 2a str. 301
ucaguuuauagaacggca

SEQ ID NO: 3931517 - RNA, 18 nt, Shigella flexneri 2a str. 301
ucaguuugcaaacccuga

SEQ ID NO: 3931518 - RNA, 22 nt, Shigella flexneri 2a str. 301
ucaguuugccguaccacgccac

SEQ ID NO: 3931519 - RNA, 21 nt, Shigella flexneri 2a str. 301
ucauaaacacgguuuuucauu

SEQ ID NO: 3931520 - RNA, 24 nt, Shigella flexneri 2a str. 301
ucauaaagauaauguaaagcaggu

SEQ ID NO: 3931521 - RNA, 19 nt, Shigella flexneri 2a str. 301
ucauaaagcagccuauuuc

SEQ ID NO: 3931522 - RNA, 14 nt, Shigella flexneri 2a str. 301
ucauaaauacagag

SEQ ID NO: 3931523 - RNA, 17 nt, Shigella flexneri 2a str. 301
ucauaaauucaaagugu

SEQ ID NO: 3931524 - RNA, 18 nt, Shigella flexneri 2a str. 301
ucauaaccgagcauuuuu

SEQ ID NO: 3931525 - RNA, 22 nt, Shigella flexneri 2a str. 301
ucauaacucuccuguuuaauau

SEQ ID NO: 3931526 - RNA, 16 nt, Shigella flexneri 2a str. 301
ucauaauacaggcuac

SEQ ID NO: 3931527 - RNA, 17 nt, Shigella flexneri 2a str. 301
ucauaauaugaccugac

SEQ ID NO: 3931528 - RNA, 23 nt, Shigella flexneri 2a str. 301
ucauaaugauggggucacagguu

SEQ ID NO: 3931529 - RNA, 17 nt, Shigella flexneri 2a str. 301
ucauacaagcggaaacg

SEQ ID NO: 3931530 - RNA, 13 nt, Shigella flexneri 2a str. 301
ucauacaccagcg

SEQ ID NO: 3931531 - RNA, 23 nt, Shigella flexneri 2a str. 301
ucauacaccguuuuacaacgcug

SEQ ID NO: 3931532 - RNA, 21 nt, Shigella flexneri 2a str. 301
ucauacacuucacacacuuuu

SEQ ID NO: 3931533 - RNA, 21 nt, Shigella flexneri 2a str. 301
ucauacaucgcgcuuaucgcc

SEQ ID NO: 3931534 - RNA, 18 nt, Shigella flexneri 2a str. 301
ucauaccccacauaguuu

SEQ ID NO: 3931535 - RNA, 13 nt, Shigella flexneri 2a str. 301
ucauacccugaau

SEQ ID NO: 3931536 - RNA, 14 nt, Shigella flexneri 2a str. 301
ucauaccugagugg

SEQ ID NO: 3931537 - RNA, 13 nt, Shigella flexneri 2a str. 301
ucauacucugucu

SEQ ID NO: 3931538 - RNA, 19 nt, Shigella flexneri 2a str. 301
ucauacugagcaaggcaua

SEQ ID NO: 3931539 - RNA, 17 nt, Shigella flexneri 2a str. 301
ucauacugauuguacug

SEQ ID NO: 3931540 - RNA, 16 nt, Shigella flexneri 2a str. 301
ucauagacuucccucc

SEQ ID NO: 3931541 - RNA, 22 nt, Shigella flexneri 2a str. 301
ucauagauuaauuucccaccac

SEQ ID NO: 3931542 - RNA, 22 nt, Shigella flexneri 2a str. 301
ucauagcaggcauccugaucgu

SEQ ID NO: 3931543 - RNA, 22 nt, Shigella flexneri 2a str. 301
ucauagcaguaccuccuucaca

SEQ ID NO: 3931544 - RNA, 15 nt, Shigella flexneri 2a str. 301
ucauagccuuucaau

SEQ ID NO: 3931545 - RNA, 18 nt, Shigella flexneri 2a str. 301
ucauagcgcccuuucagc

SEQ ID NO: 3931546 - RNA, 23 nt, Shigella flexneri 2a str. 301
ucauagcgcccuuucagcgccuu

SEQ ID NO: 3931547 - RNA, 22 nt, Shigella flexneri 2a str. 301
ucauagggugugacgacaccau

SEQ ID NO: 3931548 - RNA, 14 nt, Shigella flexneri 2a str. 301
ucauagugccugau

SEQ ID NO: 3931549 - RNA, 18 nt, Shigella flexneri 2a str. 301
ucauaguggguuucugcc

SEQ ID NO: 3931550 - RNA, 14 nt, Shigella flexneri 2a str. 301
ucauauaacgcagg

SEQ ID NO: 3931551 - RNA, 14 nt, Shigella flexneri 2a str. 301
ucauaucacaaauu

SEQ ID NO: 3931552 - RNA, 16 nt, Shigella flexneri 2a str. 301
ucauaucacaaauucu

SEQ ID NO: 3931553 - RNA, 14 nt, Shigella flexneri 2a str. 301
ucauauggagcaaa

SEQ ID NO: 3931554 - RNA, 20 nt, Shigella flexneri 2a str. 301
ucauauggagcaaaaguggu

SEQ ID NO: 3931555 - RNA, 14 nt, Shigella flexneri 2a str. 301
ucauauuaaauuuu

SEQ ID NO: 3931556 - RNA, 15 nt, Shigella flexneri 2a str. 301
ucauauuaaauuuuu

SEQ ID NO: 3931557 - RNA, 15 nt, Shigella flexneri 2a str. 301
ucauauuaucuaucg

SEQ ID NO: 3931558 - RNA, 15 nt, Shigella flexneri 2a str. 301
ucauauugcucugga

SEQ ID NO: 3931559 - RNA, 17 nt, Shigella flexneri 2a str. 301
ucaucaaaaucaucauu

SEQ ID NO: 3931560 - RNA, 23 nt, Shigella flexneri 2a str. 301
ucaucaaacaacggcacuucaau

SEQ ID NO: 3931561 - RNA, 14 nt, Shigella flexneri 2a str. 301
ucaucaaacgucuu

SEQ ID NO: 3931562 - RNA, 21 nt, Shigella flexneri 2a str. 301
ucaucaaauuacgauaaucag

SEQ ID NO: 3931563 - RNA, 13 nt, Shigella flexneri 2a str. 301
ucaucaacgccau

SEQ ID NO: 3931564 - RNA, 14 nt, Shigella flexneri 2a str. 301
ucaucaacguuuuu

SEQ ID NO: 3931565 - RNA, 21 nt, Shigella flexneri 2a str. 301
ucaucaacugacuauccugga

SEQ ID NO: 3931566 - RNA, 22 nt, Shigella flexneri 2a str. 301
ucaucaacugacuauccuggac

SEQ ID NO: 3931567 - RNA, 20 nt, Shigella flexneri 2a str. 301
ucaucaagcaaggccagguu

SEQ ID NO: 3931568 - RNA, 18 nt, Shigella flexneri 2a str. 301
ucaucaagcugugccuga

SEQ ID NO: 3931569 - RNA, 19 nt, Shigella flexneri 2a str. 301
ucaucaagcuguucuuccc

SEQ ID NO: 3931570 - RNA, 20 nt, Shigella flexneri 2a str. 301
ucaucaaucgcaaucuggca

SEQ ID NO: 3931571 - RNA, 21 nt, Shigella flexneri 2a str. 301
ucaucaauugcgcaccagcuu

SEQ ID NO: 3931572 - RNA, 12 nt, Shigella flexneri 2a str. 301
ucaucacaccag

SEQ ID NO: 3931573 - RNA, 12 nt, Shigella flexneri 2a str. 301
ucaucacaccgc

SEQ ID NO: 3931574 - RNA, 16 nt, Shigella flexneri 2a str. 301
ucaucacaucccagca

SEQ ID NO: 3931575 - RNA, 20 nt, Shigella flexneri 2a str. 301
ucaucaccauuccgcaugau

SEQ ID NO: 3931576 - RNA, 22 nt, Shigella flexneri 2a str. 301
ucaucacccaacgccuuucgcu

SEQ ID NO: 3931577 - RNA, 21 nt, Shigella flexneri 2a str. 301
ucaucaccccgcgcucacacc

SEQ ID NO: 3931578 - RNA, 17 nt, Shigella flexneri 2a str. 301
ucaucaccggggauaac

SEQ ID NO: 3931579 - RNA, 19 nt, Shigella flexneri 2a str. 301
ucaucaccggggauaacgu

SEQ ID NO: 3931580 - RNA, 15 nt, Shigella flexneri 2a str. 301
ucaucacgcaucacu

SEQ ID NO: 3931581 - RNA, 19 nt, Shigella flexneri 2a str. 301
ucaucacgcgguuacgcac

SEQ ID NO: 3931582 - RNA, 23 nt, Shigella flexneri 2a str. 301
ucaucacuccccgcaacagugaa

SEQ ID NO: 3931583 - RNA, 15 nt, Shigella flexneri 2a str. 301
ucaucacugaauuuc

SEQ ID NO: 3931584 - RNA, 14 nt, Shigella flexneri 2a str. 301
ucaucacugccagg

SEQ ID NO: 3931585 - RNA, 18 nt, Shigella flexneri 2a str. 301
ucaucagaaaugccagua

SEQ ID NO: 3931586 - RNA, 20 nt, Shigella flexneri 2a str. 301
ucaucagcauaaucaccagu

SEQ ID NO: 3931587 - RNA, 13 nt, Shigella flexneri 2a str. 301
ucaugcaucagga

SEQ ID NO: 3931588 - RNA, 17 nt, Shigella flexneri 2a str. 301
ucaugcaucaggaccug

SEQ ID NO: 3931589 - RNA, 18 nt, Shigella flexneri 2a str. 301
ucaugccaaaaauaaucu

SEQ ID NO: 3931590 - RNA, 23 nt, Shigella flexneri 2a str. 301
ucaugcccugcccguugccagga

SEQ ID NO: 3931591 - RNA, 19 nt, Shigella flexneri 2a str. 301
ucaugccgaucgucugggc

SEQ ID NO: 3931592 - RNA, 21 nt, Shigella flexneri 2a str. 301
ucaugccgccgcagaaaaaga

SEQ ID NO: 3931593 - RNA, 22 nt, Shigella flexneri 2a str. 301
ucaugccggccagcgccaccac

SEQ ID NO: 3931594 - RNA, 22 nt, Shigella flexneri 2a str. 301
ucaugccuacagguuugugccg

SEQ ID NO: 3931595 - RNA, 15 nt, Shigella flexneri 2a str. 301
ucaugcguuuguagg

SEQ ID NO: 3931596 - RNA, 20 nt, Shigella flexneri 2a str. 301
ucaugcucagaugccugaug

SEQ ID NO: 3931597 - RNA, 22 nt, Shigella flexneri 2a str. 301
ucaugcugcggcuguccggcac

SEQ ID NO: 3931598 - RNA, 16 nt, Shigella flexneri 2a str. 301
ucauggcagucuuaau

SEQ ID NO: 3931599 - RNA, 16 nt, Shigella flexneri 2a str. 301
ucaugguuagccugua

SEQ ID NO: 3931600 - RNA, 19 nt, Shigella flexneri 2a str. 301
ucauguauauuauccauca

SEQ ID NO: 3931601 - RNA, 21 nt, Shigella flexneri 2a str. 301
ucaugucacccacugugguau

SEQ ID NO: 3931602 - RNA, 17 nt, Shigella flexneri 2a str. 301
ucaugucggcagugauu

SEQ ID NO: 3931603 - RNA, 14 nt, Shigella flexneri 2a str. 301
ucaugugcaggauu

SEQ ID NO: 3931604 - RNA, 16 nt, Shigella flexneri 2a str. 301
ucauuaagaacuccug

SEQ ID NO: 3931605 - RNA, 19 nt, Shigella flexneri 2a str. 301
ucauuaagaacuccugaaa

SEQ ID NO: 3931606 - RNA, 23 nt, Shigella flexneri 2a str. 301
ucauuaagaugcauuuauauuac

SEQ ID NO: 3931607 - RNA, 15 nt, Shigella flexneri 2a str. 301
ucauuacaaccgcug

SEQ ID NO: 3931608 - RNA, 14 nt, Shigella flexneri 2a str. 301
ucauuaccaagaaa

SEQ ID NO: 3931609 - RNA, 14 nt, Shigella flexneri 2a str. 301
ucauuaccagcgag

SEQ ID NO: 3931610 - RNA, 17 nt, Shigella flexneri 2a str. 301
ucauuaccgaacaacaa

SEQ ID NO: 3931611 - RNA, 23 nt, Shigella flexneri 2a str. 301
ucauuaccgaacaacaagaagcg

SEQ ID NO: 3931612 - RNA, 16 nt, Shigella flexneri 2a str. 301
ucauuaccugaaaaaa

SEQ ID NO: 3931613 - RNA, 12 nt, Shigella flexneri 2a str. 301
ucauuaccuuca

SEQ ID NO: 3931614 - RNA, 13 nt, Shigella flexneri 2a str. 301
ucauuaccuucaa

SEQ ID NO: 3931615 - RNA, 15 nt, Shigella flexneri 2a str. 301
ucauuaccuucaaca

SEQ ID NO: 3931616 - RNA, 12 nt, Shigella flexneri 2a str. 301
ucauuagcccaa

SEQ ID NO: 3931617 - RNA, 22 nt, Shigella flexneri 2a str. 301
ucauuaugagugaugugcucua

SEQ ID NO: 3931618 - RNA, 21 nt, Shigella flexneri 2a str. 301
ucauuaugaucaaaaucauau

SEQ ID NO: 3931619 - RNA, 16 nt, Shigella flexneri 2a str. 301
ucauuauuaauauuca

SEQ ID NO: 3931620 - RNA, 13 nt, Shigella flexneri 2a str. 301
ucauuauuaauuu

SEQ ID NO: 3931621 - RNA, 17 nt, Shigella flexneri 2a str. 301
ucauuauuuucagaagg

SEQ ID NO: 3931622 - RNA, 18 nt, Shigella flexneri 2a str. 301
ucauucaacuuaagucuc

SEQ ID NO: 3931623 - RNA, 12 nt, Shigella flexneri 2a str. 301
ucauucaagauu

SEQ ID NO: 3931624 - RNA, 12 nt, Shigella flexneri 2a str. 301
ucauucaccagc

SEQ ID NO: 3931625 - RNA, 13 nt, Shigella flexneri 2a str. 301
ucauuccuggagc

SEQ ID NO: 3931626 - RNA, 14 nt, Shigella flexneri 2a str. 301
ucauucgacaacug

SEQ ID NO: 3931627 - RNA, 19 nt, Shigella flexneri 2a str. 301
ucauucgcgccagauggca

SEQ ID NO: 3931628 - RNA, 16 nt, Shigella flexneri 2a str. 301
ucauucgguuuucaau

SEQ ID NO: 3931629 - RNA, 23 nt, Shigella flexneri 2a str. 301
ucauucucgcgauagaacuucug

SEQ ID NO: 3931630 - RNA, 21 nt, Shigella flexneri 2a str. 301
ucauucucuauucuuaaaaua

SEQ ID NO: 3931631 - RNA, 22 nt, Shigella flexneri 2a str. 301
ucauugaacgggugauuucccc

SEQ ID NO: 3931632 - RNA, 14 nt, Shigella flexneri 2a str. 301
ucauugaaggcggc

SEQ ID NO: 3931633 - RNA, 21 nt, Shigella flexneri 2a str. 301
ucauugagcgcaaauggugac

SEQ ID NO: 3931634 - RNA, 18 nt, Shigella flexneri 2a str. 301
ucauugagcugcaaccau

SEQ ID NO: 3931635 - RNA, 24 nt, Shigella flexneri 2a str. 301
ucauugccagcccuuuggcuguca

SEQ ID NO: 3931636 - RNA, 19 nt, Shigella flexneri 2a str. 301
ucauugccaguccuaaaaa

SEQ ID NO: 3931637 - RNA, 13 nt, Shigella flexneri 2a str. 301
ucauugccgcauc

SEQ ID NO: 3931638 - RNA, 22 nt, Shigella flexneri 2a str. 301
ucauugcugguauuuccagucc

SEQ ID NO: 3931639 - RNA, 19 nt, Shigella flexneri 2a str. 301
ucauuggccggaauaccac

SEQ ID NO: 3931640 - RNA, 21 nt, Shigella flexneri 2a str. 301
ucauuggccggaauaccacuu

SEQ ID NO: 3931641 - RNA, 22 nt, Shigella flexneri 2a str. 301
ucauuuaaaaagaaaaaacuaa

SEQ ID NO: 3931642 - RNA, 21 nt, Shigella flexneri 2a str. 301
ucauuuacaucacgcagcugc

SEQ ID NO: 3931643 - RNA, 15 nt, Shigella flexneri 2a str. 301
ucauuuacuggaugg

SEQ ID NO: 3931644 - RNA, 14 nt, Shigella flexneri 2a str. 301
ucauuuaugcuguc

SEQ ID NO: 3931645 - RNA, 22 nt, Shigella flexneri 2a str. 301
ucauuuaugcuguccuaaaaaa

SEQ ID NO: 3931646 - RNA, 19 nt, Shigella flexneri 2a str. 301
ucauuucccuguugccugc

SEQ ID NO: 3931647 - RNA, 22 nt, Shigella flexneri 2a str. 301
ucauuugcgcggcagucacauu

SEQ ID NO: 3931648 - RNA, 20 nt, Shigella flexneri 2a str. 301
ucauuuucggcagugaaaac

SEQ ID NO: 3931649 - RNA, 16 nt, Shigella flexneri 2a str. 301
ucauuuucucuuucag

SEQ ID NO: 3931650 - RNA, 19 nt, Shigella flexneri 2a str. 301
ucauuuuuucccauuacca

SEQ ID NO: 3931651 - RNA, 22 nt, Shigella flexneri 2a str. 301
ucauuuuuucgacaucaagaaa

SEQ ID NO: 3931652 - RNA, 22 nt, Shigella flexneri 2a str. 301
ucauuuuuuuaaucgucaguuu

SEQ ID NO: 3931653 - RNA, 14 nt, Shigella flexneri 2a str. 301
uccaaaauaaaaau

SEQ ID NO: 3931654 - RNA, 18 nt, Shigella flexneri 2a str. 301
uccaaaccgacugccugc

SEQ ID NO: 3931655 - RNA, 19 nt, Shigella flexneri 2a str. 301
uccaaauccuucagcaacu

SEQ ID NO: 3931656 - RNA, 22 nt, Shigella flexneri 2a str. 301
uccaaaucgcaguagcgggcgu

SEQ ID NO: 3931657 - RNA, 13 nt, Shigella flexneri 2a str. 301
uccaacaccaggc

SEQ ID NO: 3931658 - RNA, 13 nt, Shigella flexneri 2a str. 301
uccaacaggcgag

SEQ ID NO: 3931659 - RNA, 21 nt, Shigella flexneri 2a str. 301
uccaacaggcgagaaacgcuu

SEQ ID NO: 3931660 - RNA, 19 nt, Shigella flexneri 2a str. 301
uccaagcgcggcaggcauc

SEQ ID NO: 3931661 - RNA, 18 nt, Shigella flexneri 2a str. 301
uccaauaugcgguacugc

SEQ ID NO: 3931662 - RNA, 11 nt, Shigella flexneri 2a str. 301
uccacaaaccg

SEQ ID NO: 3931663 - RNA, 15 nt, Shigella flexneri 2a str. 301
uccacaagaaugccu

SEQ ID NO: 3931664 - RNA, 18 nt, Shigella flexneri 2a str. 301
uccacaagcuccggcuuu

SEQ ID NO: 3931665 - RNA, 23 nt, Shigella flexneri 2a str. 301
uccacacggagaguaaugccagu

SEQ ID NO: 3931666 - RNA, 16 nt, Shigella flexneri 2a str. 301
uccacagcaaugcauu

SEQ ID NO: 3931667 - RNA, 15 nt, Shigella flexneri 2a str. 301
uccacagucaggcug

SEQ ID NO: 3931668 - RNA, 15 nt, Shigella flexneri 2a str. 301
uccacauaaaguagc

SEQ ID NO: 3931669 - RNA, 20 nt, Shigella flexneri 2a str. 301
uccacauauuauugaaauca

SEQ ID NO: 3931670 - RNA, 19 nt, Shigella flexneri 2a str. 301
uccacaucuaccgccagcc

SEQ ID NO: 3931671 - RNA, 21 nt, Shigella flexneri 2a str. 301
uccacaugguuuucaauuauc

SEQ ID NO: 3931672 - RNA, 23 nt, Shigella flexneri 2a str. 301
uccaccaauggcggaaaagcucc

SEQ ID NO: 3931673 - RNA, 22 nt, Shigella flexneri 2a str. 301
uccaccaccgcaaaauagguau

SEQ ID NO: 3931674 - RNA, 16 nt, Shigella flexneri 2a str. 301
uccaccacgcugcaug

SEQ ID NO: 3931675 - RNA, 23 nt, Shigella flexneri 2a str. 301
uccaccacgcuguagccgccguc

SEQ ID NO: 3931676 - RNA, 14 nt, Shigella flexneri 2a str. 301
uccaccacguuuuu

SEQ ID NO: 3931677 - RNA, 17 nt, Shigella flexneri 2a str. 301
uccaccacguuuuucaa

SEQ ID NO: 3931678 - RNA, 16 nt, Shigella flexneri 2a str. 301
uccaccagauggcuuu

SEQ ID NO: 3931679 - RNA, 15 nt, Shigella flexneri 2a str. 301
uccaccagcgcguag

SEQ ID NO: 3931680 - RNA, 13 nt, Shigella flexneri 2a str. 301
uccaccagcggcu

SEQ ID NO: 3931681 - RNA, 14 nt, Shigella flexneri 2a str. 301
uccaccagcggcug

SEQ ID NO: 3931682 - RNA, 15 nt, Shigella flexneri 2a str. 301
uccaccccagcagaa

SEQ ID NO: 3931683 - RNA, 16 nt, Shigella flexneri 2a str. 301
uccaccgaaauaauca

SEQ ID NO: 3931684 - RNA, 19 nt, Shigella flexneri 2a str. 301
uccaccgcguucagcagcu

SEQ ID NO: 3931685 - RNA, 16 nt, Shigella flexneri 2a str. 301
uccaccuccagcuccg

SEQ ID NO: 3931686 - RNA, 21 nt, Shigella flexneri 2a str. 301
uccaguaaugcgcccaugccg

SEQ ID NO: 3931687 - RNA, 22 nt, Shigella flexneri 2a str. 301
uccaguacaugaagcacugcau

SEQ ID NO: 3931688 - RNA, 13 nt, Shigella flexneri 2a str. 301
uccaguacgccuu

SEQ ID NO: 3931689 - RNA, 22 nt, Shigella flexneri 2a str. 301
uccaguacgcguacacuuuccu

SEQ ID NO: 3931690 - RNA, 14 nt, Shigella flexneri 2a str. 301
uccaguccccccca

SEQ ID NO: 3931691 - RNA, 16 nt, Shigella flexneri 2a str. 301
uccagucgagaaccug

SEQ ID NO: 3931692 - RNA, 17 nt, Shigella flexneri 2a str. 301
uccagucgagaaccuga

SEQ ID NO: 3931693 - RNA, 20 nt, Shigella flexneri 2a str. 301
uccagucgcaaaccuggcau

SEQ ID NO: 3931694 - RNA, 13 nt, Shigella flexneri 2a str. 301
uccagucgcgugu

SEQ ID NO: 3931695 - RNA, 15 nt, Shigella flexneri 2a str. 301
uccagucgcugcuga

SEQ ID NO: 3931696 - RNA, 22 nt, Shigella flexneri 2a str. 301
uccagucggcguaauccugaaa

SEQ ID NO: 3931697 - RNA, 19 nt, Shigella flexneri 2a str. 301
uccagucguuaugcacgcu

SEQ ID NO: 3931698 - RNA, 16 nt, Shigella flexneri 2a str. 301
uccagucugcuggcga

SEQ ID NO: 3931699 - RNA, 16 nt, Shigella flexneri 2a str. 301
uccagugcauccagca

SEQ ID NO: 3931700 - RNA, 17 nt, Shigella flexneri 2a str. 301
uccagugccucaagaau

SEQ ID NO: 3931701 - RNA, 21 nt, Shigella flexneri 2a str. 301
uccagugcguacccagcgugu

SEQ ID NO: 3931702 - RNA, 12 nt, Shigella flexneri 2a str. 301
uccaguggcuga

SEQ ID NO: 3931703 - RNA, 13 nt, Shigella flexneri 2a str. 301
uccaguggcugug

SEQ ID NO: 3931704 - RNA, 20 nt, Shigella flexneri 2a str. 301
uccaguuaucgcgauacacc

SEQ ID NO: 3931705 - RNA, 21 nt, Shigella flexneri 2a str. 301
uccaguuccuucaacccauca

SEQ ID NO: 3931706 - RNA, 14 nt, Shigella flexneri 2a str. 301
uccaguugaaguga

SEQ ID NO: 3931707 - RNA, 16 nt, Shigella flexneri 2a str. 301
uccaguugcccgguaa

SEQ ID NO: 3931708 - RNA, 14 nt, Shigella flexneri 2a str. 301
uccaguugguugau

SEQ ID NO: 3931709 - RNA, 14 nt, Shigella flexneri 2a str. 301
uccaguuucacaaa

SEQ ID NO: 3931710 - RNA, 22 nt, Shigella flexneri 2a str. 301
uccaguuuucuuugccacuccu

SEQ ID NO: 3931711 - RNA, 14 nt, Shigella flexneri 2a str. 301
uccauaaaacaucc

SEQ ID NO: 3931712 - RNA, 16 nt, Shigella flexneri 2a str. 301
uccauaacggaggcuu

SEQ ID NO: 3931713 - RNA, 17 nt, Shigella flexneri 2a str. 301
uccauaacggaggcuuc

SEQ ID NO: 3931714 - RNA, 15 nt, Shigella flexneri 2a str. 301
uccauaagauugcau

SEQ ID NO: 3931715 - RNA, 18 nt, Shigella flexneri 2a str. 301
uccauaagcccagaacaa

SEQ ID NO: 3931716 - RNA, 22 nt, Shigella flexneri 2a str. 301
uccauacagcucagguucaacc

SEQ ID NO: 3931717 - RNA, 15 nt, Shigella flexneri 2a str. 301
uccauacaucuucau

SEQ ID NO: 3931718 - RNA, 16 nt, Shigella flexneri 2a str. 301
uccauacccagcauca

SEQ ID NO: 3931719 - RNA, 16 nt, Shigella flexneri 2a str. 301
uccauaccuaaaaaau

SEQ ID NO: 3931720 - RNA, 23 nt, Shigella flexneri 2a str. 301
uccauaguguguuccucugcucc

SEQ ID NO: 3931721 - RNA, 18 nt, Shigella flexneri 2a str. 301
uccauauggcugcauuca

SEQ ID NO: 3931722 - RNA, 16 nt, Shigella flexneri 2a str. 301
uccauauugucuucaa

SEQ ID NO: 3931723 - RNA, 19 nt, Shigella flexneri 2a str. 301
uccaucaaagguuuuucag

SEQ ID NO: 3931724 - RNA, 18 nt, Shigella flexneri 2a str. 301
uccaucaauacaggcgac

SEQ ID NO: 3931725 - RNA, 18 nt, Shigella flexneri 2a str. 301
uccaucacgcugaauuua

SEQ ID NO: 3931726 - RNA, 16 nt, Shigella flexneri 2a str. 301
uccaucauaugcgcca

SEQ ID NO: 3931727 - RNA, 13 nt, Shigella flexneri 2a str. 301
uccauccagcaac

SEQ ID NO: 3931728 - RNA, 18 nt, Shigella flexneri 2a str. 301
uccauccauacgggcaug

SEQ ID NO: 3931729 - RNA, 18 nt, Shigella flexneri 2a str. 301
uccaucccgcucuguaag

SEQ ID NO: 3931730 - RNA, 22 nt, Shigella flexneri 2a str. 301
uccauccggcuggucagcaacu

SEQ ID NO: 3931731 - RNA, 17 nt, Shigella flexneri 2a str. 301
uccaucggcauuaaucu

SEQ ID NO: 3931732 - RNA, 14 nt, Shigella flexneri 2a str. 301
uccaucgggcuauu

SEQ ID NO: 3931733 - RNA, 19 nt, Shigella flexneri 2a str. 301
uccaucguccgugaagaaa

SEQ ID NO: 3931734 - RNA, 23 nt, Shigella flexneri 2a str. 301
uccaucucgccauccuuacgcag

SEQ ID NO: 3931735 - RNA, 19 nt, Shigella flexneri 2a str. 301
uccaucuuuaugaaauauc

SEQ ID NO: 3931736 - RNA, 15 nt, Shigella flexneri 2a str. 301
uccaugcacucccau

SEQ ID NO: 3931737 - RNA, 14 nt, Shigella flexneri 2a str. 301
uccaugccaucugc

SEQ ID NO: 3931738 - RNA, 22 nt, Shigella flexneri 2a str. 301
uccaugccgaguggcauuucgc

SEQ ID NO: 3931739 - RNA, 20 nt, Shigella flexneri 2a str. 301
uccaugcgcauuaagccaug

SEQ ID NO: 3931740 - RNA, 14 nt, Shigella flexneri 2a str. 301
uccaugugggcugc

SEQ ID NO: 3931741 - RNA, 17 nt, Shigella flexneri 2a str. 301
uccauguugcuggaaga

SEQ ID NO: 3931742 - RNA, 21 nt, Shigella flexneri 2a str. 301
uccauucaccauuuuuuaauu

SEQ ID NO: 3931743 - RNA, 18 nt, Shigella flexneri 2a str. 301
uccauucaucgccuuuca

SEQ ID NO: 3931744 - RNA, 14 nt, Shigella flexneri 2a str. 301
uccauucgaugaga

SEQ ID NO: 3931745 - RNA, 16 nt, Shigella flexneri 2a str. 301
uccauucgcugcugcg

SEQ ID NO: 3931746 - RNA, 20 nt, Shigella flexneri 2a str. 301
uccauucgcugcugcggcga

SEQ ID NO: 3931747 - RNA, 17 nt, Shigella flexneri 2a str. 301
uccauucuugcgcggau

SEQ ID NO: 3931748 - RNA, 20 nt, Shigella flexneri 2a str. 301
uccauugccgcuuuccaggc

SEQ ID NO: 3931749 - RNA, 16 nt, Shigella flexneri 2a str. 301
uccauugcucuggcaa

SEQ ID NO: 3931750 - RNA, 21 nt, Shigella flexneri 2a str. 301
uccauuggcggcguccuggaa

SEQ ID NO: 3931751 - RNA, 18 nt, Shigella flexneri 2a str. 301
uccauuucccugacaaau

SEQ ID NO: 3931752 - RNA, 22 nt, Shigella flexneri 2a str. 301
ucccaaaagcucggucauugcc

SEQ ID NO: 3931753 - RNA, 21 nt, Shigella flexneri 2a str. 301
ucccaaauaugaaaucucuug

SEQ ID NO: 3931754 - RNA, 13 nt, Shigella flexneri 2a str. 301
ucccaacaacagc

SEQ ID NO: 3931755 - RNA, 17 nt, Shigella flexneri 2a str. 301
ucccaacaacagcgcgc

SEQ ID NO: 3931756 - RNA, 24 nt, Shigella flexneri 2a str. 301
ucccaaccuuguuucugagcauga

SEQ ID NO: 3931757 - RNA, 20 nt, Shigella flexneri 2a str. 301
ucccaacugacgaaugcguu

SEQ ID NO: 3931758 - RNA, 17 nt, Shigella flexneri 2a str. 301
ucccaagugauuuuuaa

SEQ ID NO: 3931759 - RNA, 13 nt, Shigella flexneri 2a str. 301
ucccaauauugca

SEQ ID NO: 3931760 - RNA, 20 nt, Shigella flexneri 2a str. 301
ucccacggcggugucgccag

SEQ ID NO: 3931761 - RNA, 14 nt, Shigella flexneri 2a str. 301
ucccacggugcagc

SEQ ID NO: 3931762 - RNA, 23 nt, Shigella flexneri 2a str. 301
ucccacugacgcucggcgcaauc

SEQ ID NO: 3931763 - RNA, 11 nt, Shigella flexneri 2a str. 301
ucccacugcca

SEQ ID NO: 3931764 - RNA, 22 nt, Shigella flexneri 2a str. 301
ucccacugcgccacgguguugu

SEQ ID NO: 3931765 - RNA, 19 nt, Shigella flexneri 2a str. 301
ucccagaauguuaacgcca

SEQ ID NO: 3931766 - RNA, 21 nt, Shigella flexneri 2a str. 301
ucccagacguuucgccagccg

SEQ ID NO: 3931767 - RNA, 17 nt, Shigella flexneri 2a str. 301
ucccagagcgggcagac

SEQ ID NO: 3931768 - RNA, 17 nt, Shigella flexneri 2a str. 301
ucccagauagcaacagc

SEQ ID NO: 3931769 - RNA, 13 nt, Shigella flexneri 2a str. 301
ucccagcagagau

SEQ ID NO: 3931770 - RNA, 13 nt, Shigella flexneri 2a str. 301
ucccagccacgau

SEQ ID NO: 3931771 - RNA, 22 nt, Shigella flexneri 2a str. 301
ucccagccacgaugauagccau

SEQ ID NO: 3931772 - RNA, 13 nt, Shigella flexneri 2a str. 301
ucccagcccagcg

SEQ ID NO: 3931773 - RNA, 22 nt, Shigella flexneri 2a str. 301
ucccagcccccgcaauuccggu

SEQ ID NO: 3931774 - RNA, 20 nt, Shigella flexneri 2a str. 301
ucccagcccccuguguugau

SEQ ID NO: 3931775 - RNA, 13 nt, Shigella flexneri 2a str. 301
ucccagccgggua

SEQ ID NO: 3931776 - RNA, 20 nt, Shigella flexneri 2a str. 301
ucccagccggguaagaaaag

SEQ ID NO: 3931777 - RNA, 14 nt, Shigella flexneri 2a str. 301
ucccagccuugcca

SEQ ID NO: 3931778 - RNA, 14 nt, Shigella flexneri 2a str. 301
ucccaggcagaagc

SEQ ID NO: 3931779 - RNA, 16 nt, Shigella flexneri 2a str. 301
ucccaggucaggcugc

SEQ ID NO: 3931780 - RNA, 20 nt, Shigella flexneri 2a str. 301
ucccaguaagccuaaaugua

SEQ ID NO: 3931781 - RNA, 17 nt, Shigella flexneri 2a str. 301
ucccaguagugcuuuca

SEQ ID NO: 3931782 - RNA, 13 nt, Shigella flexneri 2a str. 301
ucccagucauccg

SEQ ID NO: 3931783 - RNA, 19 nt, Shigella flexneri 2a str. 301
ucccagucgcgcaauugcc

SEQ ID NO: 3931784 - RNA, 12 nt, Shigella flexneri 2a str. 301
ucccagucuuca

SEQ ID NO: 3931785 - RNA, 15 nt, Shigella flexneri 2a str. 301
ucccagucuucauca

SEQ ID NO: 3931786 - RNA, 21 nt, Shigella flexneri 2a str. 301
ucccuuccgcaauacagccag

SEQ ID NO: 3931787 - RNA, 19 nt, Shigella flexneri 2a str. 301
ucccuuccggugcaaucag

SEQ ID NO: 3931788 - RNA, 16 nt, Shigella flexneri 2a str. 301
ucccuugcucugguuc

SEQ ID NO: 3931789 - RNA, 22 nt, Shigella flexneri 2a str. 301
ucccuuucagcaaaccacugau

SEQ ID NO: 3931790 - RNA, 11 nt, Shigella flexneri 2a str. 301
ucccuuuggcc

SEQ ID NO: 3931791 - RNA, 13 nt, Shigella flexneri 2a str. 301
uccgaaaaaggau

SEQ ID NO: 3931792 - RNA, 20 nt, Shigella flexneri 2a str. 301
uccgaagccggacugggcgc

SEQ ID NO: 3931793 - RNA, 18 nt, Shigella flexneri 2a str. 301
uccgacaaauguguucag

SEQ ID NO: 3931794 - RNA, 15 nt, Shigella flexneri 2a str. 301
uccgacaucaaccgc

SEQ ID NO: 3931795 - RNA, 22 nt, Shigella flexneri 2a str. 301
uccgaccaggcguucugccugg

SEQ ID NO: 3931796 - RNA, 20 nt, Shigella flexneri 2a str. 301
uccgacuuaucacugccagu

SEQ ID NO: 3931797 - RNA, 23 nt, Shigella flexneri 2a str. 301
uccgagaaucguacucaccagac

SEQ ID NO: 3931798 - RNA, 15 nt, Shigella flexneri 2a str. 301
uccgauauucaauug

SEQ ID NO: 3931799 - RNA, 15 nt, Shigella flexneri 2a str. 301
uccgaucgcgcauca

SEQ ID NO: 3931800 - RNA, 17 nt, Shigella flexneri 2a str. 301
uccgaucgcgcaucagc

SEQ ID NO: 3931801 - RNA, 16 nt, Shigella flexneri 2a str. 301
uccgauuaccggcaac

SEQ ID NO: 3931802 - RNA, 15 nt, Shigella flexneri 2a str. 301
uccgauucccgcaac

SEQ ID NO: 3931803 - RNA, 22 nt, Shigella flexneri 2a str. 301
uccgauuuguucucuucugcuu

SEQ ID NO: 3931804 - RNA, 15 nt, Shigella flexneri 2a str. 301
uccgcaaacaggcgc

SEQ ID NO: 3931805 - RNA, 13 nt, Shigella flexneri 2a str. 301
uccgcaaagccca

SEQ ID NO: 3931806 - RNA, 16 nt, Shigella flexneri 2a str. 301
uccgcaaauaacguaa

SEQ ID NO: 3931807 - RNA, 21 nt, Shigella flexneri 2a str. 301
uccgcaaugcggagguuucuu

SEQ ID NO: 3931808 - RNA, 13 nt, Shigella flexneri 2a str. 301
uccgcaaugugua

SEQ ID NO: 3931809 - RNA, 22 nt, Shigella flexneri 2a str. 301
uccgcaccaacuccacuucacc

SEQ ID NO: 3931810 - RNA, 20 nt, Shigella flexneri 2a str. 301
uccgcaccugaguaauuaau

SEQ ID NO: 3931811 - RNA, 23 nt, Shigella flexneri 2a str. 301
uccgcaggugacgcgggcagcag

SEQ ID NO: 3931812 - RNA, 19 nt, Shigella flexneri 2a str. 301
uccgcaugauucugagaaa

SEQ ID NO: 3931813 - RNA, 17 nt, Shigella flexneri 2a str. 301
uccgccaauagcuggca

SEQ ID NO: 3931814 - RNA, 18 nt, Shigella flexneri 2a str. 301
uccgccagauuuauuuac

SEQ ID NO: 3931815 - RNA, 11 nt, Shigella flexneri 2a str. 301
uccgccagcga

SEQ ID NO: 3931816 - RNA, 13 nt, Shigella flexneri 2a str. 301
uccgccagcggcg

SEQ ID NO: 3931817 - RNA, 18 nt, Shigella flexneri 2a str. 301
uccgccagcggcggcaaa

SEQ ID NO: 3931818 - RNA, 15 nt, Shigella flexneri 2a str. 301
uccgccagcgggccg

SEQ ID NO: 3931819 - RNA, 21 nt, Shigella flexneri 2a str. 301
uccgccagcguagucggcaga

SEQ ID NO: 3931820 - RNA, 21 nt, Shigella flexneri 2a str. 301
uccgccagcuccgggcugguu

SEQ ID NO: 3931821 - RNA, 17 nt, Shigella flexneri 2a str. 301
uccgccagugccaaagc

SEQ ID NO: 3931822 - RNA, 16 nt, Shigella flexneri 2a str. 301
uccgccaguuuguagc

SEQ ID NO: 3931823 - RNA, 18 nt, Shigella flexneri 2a str. 301
uccgccauccaccagcau

SEQ ID NO: 3931824 - RNA, 21 nt, Shigella flexneri 2a str. 301
uccgccauuuuaaucaucuga

SEQ ID NO: 3931825 - RNA, 22 nt, Shigella flexneri 2a str. 301
uccgcccuacgcguuaaagagc

SEQ ID NO: 3931826 - RNA, 18 nt, Shigella flexneri 2a str. 301
uccgccgcccauauuagc

SEQ ID NO: 3931827 - RNA, 19 nt, Shigella flexneri 2a str. 301
uccgccgcuguggcaggua

SEQ ID NO: 3931828 - RNA, 17 nt, Shigella flexneri 2a str. 301
uccgccguggaugcgau

SEQ ID NO: 3931829 - RNA, 14 nt, Shigella flexneri 2a str. 301
uccgcgaaggcggc

SEQ ID NO: 3931830 - RNA, 20 nt, Shigella flexneri 2a str. 301
uccgcgaauuaugcagccuu

SEQ ID NO: 3931831 - RNA, 15 nt, Shigella flexneri 2a str. 301
uccgcgccgcgguac

SEQ ID NO: 3931832 - RNA, 16 nt, Shigella flexneri 2a str. 301
uccgcgucauucagcu

SEQ ID NO: 3931833 - RNA, 17 nt, Shigella flexneri 2a str. 301
uccgcguccgcuggacc

SEQ ID NO: 3931834 - RNA, 17 nt, Shigella flexneri 2a str. 301
uccgcgucuuaucaggc

SEQ ID NO: 3931835 - RNA, 17 nt, Shigella flexneri 2a str. 301
uccgcgugacgcuggca

SEQ ID NO: 3931836 - RNA, 22 nt, Shigella flexneri 2a str. 301
uccgcuaccggaucgcuuucuu

SEQ ID NO: 3931837 - RNA, 21 nt, Shigella flexneri 2a str. 301
uccgcuaucaguucagaagcu

SEQ ID NO: 3931838 - RNA, 18 nt, Shigella flexneri 2a str. 301
uccgcucgccgcagagau

SEQ ID NO: 3931839 - RNA, 18 nt, Shigella flexneri 2a str. 301
uccgcucucauccauucg

SEQ ID NO: 3931840 - RNA, 13 nt, Shigella flexneri 2a str. 301
uccgcucuuucac

SEQ ID NO: 3931841 - RNA, 16 nt, Shigella flexneri 2a str. 301
uccgcugacagcgcgu

SEQ ID NO: 3931842 - RNA, 23 nt, Shigella flexneri 2a str. 301
uccgcuggagcggggaacaccuc

SEQ ID NO: 3931843 - RNA, 17 nt, Shigella flexneri 2a str. 301
uccgcuggcgucugggc

SEQ ID NO: 3931844 - RNA, 21 nt, Shigella flexneri 2a str. 301
uccgcuuacucauccacugcc

SEQ ID NO: 3931845 - RNA, 17 nt, Shigella flexneri 2a str. 301
uccgcuuaucaggccua

SEQ ID NO: 3931846 - RNA, 13 nt, Shigella flexneri 2a str. 301
uccgcuucaaucu

SEQ ID NO: 3931847 - RNA, 13 nt, Shigella flexneri 2a str. 301
uccgcuucugcuu

SEQ ID NO: 3931848 - RNA, 13 nt, Shigella flexneri 2a str. 301
uccggaaagcaca

SEQ ID NO: 3931849 - RNA, 21 nt, Shigella flexneri 2a str. 301
uccggacugcucacgccacgg

SEQ ID NO: 3931850 - RNA, 19 nt, Shigella flexneri 2a str. 301
uccggaucccaccagacgu

SEQ ID NO: 3931851 - RNA, 21 nt, Shigella flexneri 2a str. 301
uccggcaaucggugcaaaugc

SEQ ID NO: 3931852 - RNA, 15 nt, Shigella flexneri 2a str. 301
uccggcaauggcugc

SEQ ID NO: 3931853 - RNA, 12 nt, Shigella flexneri 2a str. 301
uccggcaccauu

SEQ ID NO: 3931854 - RNA, 15 nt, Shigella flexneri 2a str. 301
uccggcaccuuuuca

SEQ ID NO: 3931855 - RNA, 18 nt, Shigella flexneri 2a str. 301
uccggcagcagaaagcga

SEQ ID NO: 3931856 - RNA, 16 nt, Shigella flexneri 2a str. 301
uccggcagcaugugua

SEQ ID NO: 3931857 - RNA, 17 nt, Shigella flexneri 2a str. 301
uccggcagccaggcaau

SEQ ID NO: 3931858 - RNA, 13 nt, Shigella flexneri 2a str. 301
uccggcagcgaac

SEQ ID NO: 3931859 - RNA, 20 nt, Shigella flexneri 2a str. 301
uccggcaguaauaccagacc

SEQ ID NO: 3931860 - RNA, 22 nt, Shigella flexneri 2a str. 301
uccggcauaaacaaagugcacu

SEQ ID NO: 3931861 - RNA, 17 nt, Shigella flexneri 2a str. 301
uccggcauacaguaacu

SEQ ID NO: 3931862 - RNA, 20 nt, Shigella flexneri 2a str. 301
uccggcaucaacaaagugca

SEQ ID NO: 3931863 - RNA, 15 nt, Shigella flexneri 2a str. 301
uccggcauccagcgu

SEQ ID NO: 3931864 - RNA, 18 nt, Shigella flexneri 2a str. 301
uccggcaugaacaaagcg

SEQ ID NO: 3931865 - RNA, 20 nt, Shigella flexneri 2a str. 301
uccggcaugaacaaagcgca

SEQ ID NO: 3931866 - RNA, 21 nt, Shigella flexneri 2a str. 301
uccggcauuaucacaucagcg

SEQ ID NO: 3931867 - RNA, 22 nt, Shigella flexneri 2a str. 301
uccggcauucagugcaaaugcc

SEQ ID NO: 3931868 - RNA, 21 nt, Shigella flexneri 2a str. 301
uccggcauuugagcaggaugc

SEQ ID NO: 3931869 - RNA, 20 nt, Shigella flexneri 2a str. 301
uccggcgaaaaucccggcaa

SEQ ID NO: 3931870 - RNA, 12 nt, Shigella flexneri 2a str. 301
uccggcgcaauu

SEQ ID NO: 3931871 - RNA, 21 nt, Shigella flexneri 2a str. 301
uccggcgcaauucccggaccg

SEQ ID NO: 3931872 - RNA, 23 nt, Shigella flexneri 2a str. 301
uccggcgcgauaucgacgaccug

SEQ ID NO: 3931873 - RNA, 14 nt, Shigella flexneri 2a str. 301
uccggcgcguugau

SEQ ID NO: 3931874 - RNA, 19 nt, Shigella flexneri 2a str. 301
uccggcggcacagccagcg

SEQ ID NO: 3931875 - RNA, 22 nt, Shigella flexneri 2a str. 301
uccggcggcacagccagcgcug

SEQ ID NO: 3931876 - RNA, 18 nt, Shigella flexneri 2a str. 301
uccggcgggucgcugccg

SEQ ID NO: 3931877 - RNA, 23 nt, Shigella flexneri 2a str. 301
uccggcgguaaaugcucauacca

SEQ ID NO: 3931878 - RNA, 17 nt, Shigella flexneri 2a str. 301
uccggcguuuucaacca

SEQ ID NO: 3931879 - RNA, 20 nt, Shigella flexneri 2a str. 301
uccggcguuuucaaccagcc

SEQ ID NO: 3931880 - RNA, 20 nt, Shigella flexneri 2a str. 301
uccggcguuuugauuuucac

SEQ ID NO: 3931881 - RNA, 16 nt, Shigella flexneri 2a str. 301
uccggcuccacuucgu

SEQ ID NO: 3931882 - RNA, 22 nt, Shigella flexneri 2a str. 301
uccggcucgccuuucggcugca

SEQ ID NO: 3931883 - RNA, 13 nt, Shigella flexneri 2a str. 301
uccggcugccagc

SEQ ID NO: 3931884 - RNA, 17 nt, Shigella flexneri 2a str. 301
uccggcugccagccagg

SEQ ID NO: 3931885 - RNA, 19 nt, Shigella flexneri 2a str. 301
uccuggauuuccucggcug

SEQ ID NO: 3931886 - RNA, 20 nt, Shigella flexneri 2a str. 301
uccuggcccggaauggugcu

SEQ ID NO: 3931887 - RNA, 17 nt, Shigella flexneri 2a str. 301
uccuggccgugaagaag

SEQ ID NO: 3931888 - RNA, 21 nt, Shigella flexneri 2a str. 301
uccuggccguuguugaacggc

SEQ ID NO: 3931889 - RNA, 23 nt, Shigella flexneri 2a str. 301
uccuggcgaaaacgcccggcauu

SEQ ID NO: 3931890 - RNA, 18 nt, Shigella flexneri 2a str. 301
uccuggcgaucgggcauu

SEQ ID NO: 3931891 - RNA, 21 nt, Shigella flexneri 2a str. 301
uccuggcgggaauaaaagcca

SEQ ID NO: 3931892 - RNA, 19 nt, Shigella flexneri 2a str. 301
uccuggcggggauuauugc

SEQ ID NO: 3931893 - RNA, 20 nt, Shigella flexneri 2a str. 301
uccuggcgguuaauaaugau

SEQ ID NO: 3931894 - RNA, 21 nt, Shigella flexneri 2a str. 301
uccuggcuguuacucaacuga

SEQ ID NO: 3931895 - RNA, 16 nt, Shigella flexneri 2a str. 301
uccuggcuuggcuggc

SEQ ID NO: 3931896 - RNA, 18 nt, Shigella flexneri 2a str. 301
uccuggggguucaucacc

SEQ ID NO: 3931897 - RNA, 20 nt, Shigella flexneri 2a str. 301
uccuguaucgucacugguuc

SEQ ID NO: 3931898 - RNA, 18 nt, Shigella flexneri 2a str. 301
uccuguauuguuccacuc

SEQ ID NO: 3931899 - RNA, 16 nt, Shigella flexneri 2a str. 301
uccugucuucccugcu

SEQ ID NO: 3931900 - RNA, 20 nt, Shigella flexneri 2a str. 301
uccugugacucaaugaaauc

SEQ ID NO: 3931901 - RNA, 22 nt, Shigella flexneri 2a str. 301
uccuguucaaacauuagcgcau

SEQ ID NO: 3931902 - RNA, 15 nt, Shigella flexneri 2a str. 301
uccuguugaaaaacc

SEQ ID NO: 3931903 - RNA, 18 nt, Shigella flexneri 2a str. 301
uccuguugaaaaaccaga

SEQ ID NO: 3931904 - RNA, 17 nt, Shigella flexneri 2a str. 301
uccuguugcguuaagcc

SEQ ID NO: 3931905 - RNA, 20 nt, Shigella flexneri 2a str. 301
uccuguugugaugcaacugu

SEQ ID NO: 3931906 - RNA, 13 nt, Shigella flexneri 2a str. 301
uccuguuucacuu

SEQ ID NO: 3931907 - RNA, 18 nt, Shigella flexneri 2a str. 301
uccuuaacuccucgccuu

SEQ ID NO: 3931908 - RNA, 11 nt, Shigella flexneri 2a str. 301
uccuuaauaaa

SEQ ID NO: 3931909 - RNA, 13 nt, Shigella flexneri 2a str. 301
uccuuagaagcac

SEQ ID NO: 3931910 - RNA, 13 nt, Shigella flexneri 2a str. 301
uccuucaacccgc

SEQ ID NO: 3931911 - RNA, 16 nt, Shigella flexneri 2a str. 301
uccuucacacugccuc

SEQ ID NO: 3931912 - RNA, 19 nt, Shigella flexneri 2a str. 301
uccuucacuuuugccagac

SEQ ID NO: 3931913 - RNA, 12 nt, Shigella flexneri 2a str. 301
uccuuccagcuc

SEQ ID NO: 3931914 - RNA, 22 nt, Shigella flexneri 2a str. 301
uccuuccuuggauauuuuaauc

SEQ ID NO: 3931915 - RNA, 21 nt, Shigella flexneri 2a str. 301
uccuucgauaaaagccauccc

SEQ ID NO: 3931916 - RNA, 19 nt, Shigella flexneri 2a str. 301
uccuucgcagacugggcaa

SEQ ID NO: 3931917 - RNA, 19 nt, Shigella flexneri 2a str. 301
uccuucuauaaggccccuu

SEQ ID NO: 3931918 - RNA, 16 nt, Shigella flexneri 2a str. 301
uccuucugucaugauu

SEQ ID NO: 3931919 - RNA, 17 nt, Shigella flexneri 2a str. 301
uccuucuguucuuauaa

SEQ ID NO: 3931920 - RNA, 17 nt, Shigella flexneri 2a str. 301
uccuugaaauggcguua

SEQ ID NO: 3931921 - RNA, 16 nt, Shigella flexneri 2a str. 301
uccuuuaccucgaaaa

SEQ ID NO: 3931922 - RNA, 18 nt, Shigella flexneri 2a str. 301
uccuuuacggugaacuca

SEQ ID NO: 3931923 - RNA, 20 nt, Shigella flexneri 2a str. 301
uccuuuuaccacuacaucaa

SEQ ID NO: 3931924 - RNA, 13 nt, Shigella flexneri 2a str. 301
ucgaaaaaaaaga

SEQ ID NO: 3931925 - RNA, 16 nt, Shigella flexneri 2a str. 301
ucgaaaaccacuccug

SEQ ID NO: 3931926 - RNA, 14 nt, Shigella flexneri 2a str. 301
ucgaaaaucucaua

SEQ ID NO: 3931927 - RNA, 14 nt, Shigella flexneri 2a str. 301
ucgaaaaucugccc

SEQ ID NO: 3931928 - RNA, 23 nt, Shigella flexneri 2a str. 301
ucgaaaccaagaccaauccgcca

SEQ ID NO: 3931929 - RNA, 15 nt, Shigella flexneri 2a str. 301
ucgaaagccccagcc

SEQ ID NO: 3931930 - RNA, 17 nt, Shigella flexneri 2a str. 301
ucgaacagcagcagguc

SEQ ID NO: 3931931 - RNA, 16 nt, Shigella flexneri 2a str. 301
ucgaacauacacaagc

SEQ ID NO: 3931932 - RNA, 17 nt, Shigella flexneri 2a str. 301
ucgaacauacacaagcc

SEQ ID NO: 3931933 - RNA, 16 nt, Shigella flexneri 2a str. 301
ucgaacauacgcugca

SEQ ID NO: 3931934 - RNA, 14 nt, Shigella flexneri 2a str. 301
ucgaacaucugcgu

SEQ ID NO: 3931935 - RNA, 15 nt, Shigella flexneri 2a str. 301
ucgaacaugcggguc

SEQ ID NO: 3931936 - RNA, 19 nt, Shigella flexneri 2a str. 301
ucgaaccaaacagcgccag

SEQ ID NO: 3931937 - RNA, 20 nt, Shigella flexneri 2a str. 301
ucgaaccaucggcuuuggca

SEQ ID NO: 3931938 - RNA, 22 nt, Shigella flexneri 2a str. 301
ucgaacggguuaaauccugucu

SEQ ID NO: 3931939 - RNA, 22 nt, Shigella flexneri 2a str. 301
ucgaacgguaacaggaagcagc

SEQ ID NO: 3931940 - RNA, 16 nt, Shigella flexneri 2a str. 301
ucgaagccguugucga

SEQ ID NO: 3931941 - RNA, 14 nt, Shigella flexneri 2a str. 301
ucgaagcuucucau

SEQ ID NO: 3931942 - RNA, 21 nt, Shigella flexneri 2a str. 301
ucgaaggauaaugaaggauga

SEQ ID NO: 3931943 - RNA, 23 nt, Shigella flexneri 2a str. 301
ucgaaguuuucacgguugaugua

SEQ ID NO: 3931944 - RNA, 14 nt, Shigella flexneri 2a str. 301
ucgaaguuuuccuc

SEQ ID NO: 3931945 - RNA, 17 nt, Shigella flexneri 2a str. 301
ucgaauauaucagccug

SEQ ID NO: 3931946 - RNA, 14 nt, Shigella flexneri 2a str. 301
ucgaauccucccgg

SEQ ID NO: 3931947 - RNA, 14 nt, Shigella flexneri 2a str. 301
ucgaauuacacagc

SEQ ID NO: 3931948 - RNA, 15 nt, Shigella flexneri 2a str. 301
ucgaauuacacagcc

SEQ ID NO: 3931949 - RNA, 14 nt, Shigella flexneri 2a str. 301
ucgacaaaaucccg

SEQ ID NO: 3931950 - RNA, 18 nt, Shigella flexneri 2a str. 301
ucgacaaaaucggaaaca

SEQ ID NO: 3931951 - RNA, 13 nt, Shigella flexneri 2a str. 301
ucgacaaaaugag

SEQ ID NO: 3931952 - RNA, 23 nt, Shigella flexneri 2a str. 301
ucgacaaacaccgaaccagagau

SEQ ID NO: 3931953 - RNA, 13 nt, Shigella flexneri 2a str. 301
ucgacaacugcug

SEQ ID NO: 3931954 - RNA, 14 nt, Shigella flexneri 2a str. 301
ucgacaauaaucaa

SEQ ID NO: 3931955 - RNA, 22 nt, Shigella flexneri 2a str. 301
ucgacaaugucguccgguacga

SEQ ID NO: 3931956 - RNA, 18 nt, Shigella flexneri 2a str. 301
ucgacagacgccagcgcu

SEQ ID NO: 3931957 - RNA, 12 nt, Shigella flexneri 2a str. 301
ucgacagcagcc

SEQ ID NO: 3931958 - RNA, 13 nt, Shigella flexneri 2a str. 301
ucgacagcaggau

SEQ ID NO: 3931959 - RNA, 13 nt, Shigella flexneri 2a str. 301
ucgacagccaguu

SEQ ID NO: 3931960 - RNA, 14 nt, Shigella flexneri 2a str. 301
ucgacauauucacc

SEQ ID NO: 3931961 - RNA, 21 nt, Shigella flexneri 2a str. 301
ucgacaucaacgaugccuuau

SEQ ID NO: 3931962 - RNA, 15 nt, Shigella flexneri 2a str. 301
ucgacaucaagaaau

SEQ ID NO: 3931963 - RNA, 22 nt, Shigella flexneri 2a str. 301
ucgacaucgucuuuuucucccu

SEQ ID NO: 3931964 - RNA, 21 nt, Shigella flexneri 2a str. 301
ucgacaugguuggccaucgua

SEQ ID NO: 3931965 - RNA, 14 nt, Shigella flexneri 2a str. 301
ucgaccgcugccgu

SEQ ID NO: 3931966 - RNA, 22 nt, Shigella flexneri 2a str. 301
ucgaccugcgccugcaccauug

SEQ ID NO: 3931967 - RNA, 22 nt, Shigella flexneri 2a str. 301
ucgacgaugaucaagcgcacaa

SEQ ID NO: 3931968 - RNA, 16 nt, Shigella flexneri 2a str. 301
ucgacgauugcuuuua

SEQ ID NO: 3931969 - RNA, 16 nt, Shigella flexneri 2a str. 301
ucgacgcccuggaaga

SEQ ID NO: 3931970 - RNA, 19 nt, Shigella flexneri 2a str. 301
ucgacgcgccagcaccgca

SEQ ID NO: 3931971 - RNA, 12 nt, Shigella flexneri 2a str. 301
ucgacgggccca

SEQ ID NO: 3931972 - RNA, 13 nt, Shigella flexneri 2a str. 301
ucgacgggcuggu

SEQ ID NO: 3931973 - RNA, 18 nt, Shigella flexneri 2a str. 301
ucgacggggauguuccau

SEQ ID NO: 3931974 - RNA, 20 nt, Shigella flexneri 2a str. 301
ucgacggggugcgguaaaac

SEQ ID NO: 3931975 - RNA, 13 nt, Shigella flexneri 2a str. 301
ucgacuccuauua

SEQ ID NO: 3931976 - RNA, 13 nt, Shigella flexneri 2a str. 301
ucgacuuaacgcg

SEQ ID NO: 3931977 - RNA, 20 nt, Shigella flexneri 2a str. 301
ucgacuucuucauucauccg

SEQ ID NO: 3931978 - RNA, 23 nt, Shigella flexneri 2a str. 301
ucgacuuuuuucggguuauuggu

SEQ ID NO: 3931979 - RNA, 16 nt, Shigella flexneri 2a str. 301
ucgagaaggcgcugac

SEQ ID NO: 3931980 - RNA, 14 nt, Shigella flexneri 2a str. 301
ucgagaauauucac

SEQ ID NO: 3931981 - RNA, 18 nt, Shigella flexneri 2a str. 301
ucgagauaccuaacauuu

SEQ ID NO: 3931982 - RNA, 15 nt, Shigella flexneri 2a str. 301
ucgagcgcgagcagg

SEQ ID NO: 3931983 - RNA, 16 nt, Shigella flexneri 2a str. 301
ucgagcgcgagcaggc

SEQ ID NO: 3931984 - RNA, 19 nt, Shigella flexneri 2a str. 301
ucgagcgguaaaccguuau

SEQ ID NO: 3931985 - RNA, 22 nt, Shigella flexneri 2a str. 301
ucgccaucgcuuuuaccagcau

SEQ ID NO: 3931986 - RNA, 22 nt, Shigella flexneri 2a str. 301
ucgccaucuuuacaccuuacuu

SEQ ID NO: 3931987 - RNA, 22 nt, Shigella flexneri 2a str. 301
ucgccauuccuggggucaucag

SEQ ID NO: 3931988 - RNA, 16 nt, Shigella flexneri 2a str. 301
ucgccauuucgucguc

SEQ ID NO: 3931989 - RNA, 18 nt, Shigella flexneri 2a str. 301
ucgccauuuugcgcggca

SEQ ID NO: 3931990 - RNA, 14 nt, Shigella flexneri 2a str. 301
ucgccauuuuucag

SEQ ID NO: 3931991 - RNA, 13 nt, Shigella flexneri 2a str. 301
ucgcccagcgcgu

SEQ ID NO: 3931992 - RNA, 19 nt, Shigella flexneri 2a str. 301
ucgcccaguugaucaccag

SEQ ID NO: 3931993 - RNA, 23 nt, Shigella flexneri 2a str. 301
ucgcccaguugaucaccagugcg

SEQ ID NO: 3931994 - RNA, 18 nt, Shigella flexneri 2a str. 301
ucgccccgagaaaaauag

SEQ ID NO: 3931995 - RNA, 20 nt, Shigella flexneri 2a str. 301
ucgccccgugaugaacugcg

SEQ ID NO: 3931996 - RNA, 17 nt, Shigella flexneri 2a str. 301
ucgccccugcccuuuca

SEQ ID NO: 3931997 - RNA, 15 nt, Shigella flexneri 2a str. 301
ucgcccggauaucca

SEQ ID NO: 3931998 - RNA, 14 nt, Shigella flexneri 2a str. 301
ucgcccggauuaca

SEQ ID NO: 3931999 - RNA, 18 nt, Shigella flexneri 2a str. 301
ucgcccugccaaaucagu

SEQ ID NO: 3932000 - RNA, 17 nt, Shigella flexneri 2a str. 301
ucgcccugcuccagcaa

SEQ ID NO: 3932001 - RNA, 16 nt, Shigella flexneri 2a str. 301
ucgcccuggaugcagu

SEQ ID NO: 3932002 - RNA, 14 nt, Shigella flexneri 2a str. 301
ucgccgaggcgcug

SEQ ID NO: 3932003 - RNA, 17 nt, Shigella flexneri 2a str. 301
ucgccgaggcgcuggca

SEQ ID NO: 3932004 - RNA, 18 nt, Shigella flexneri 2a str. 301
ucgccgaggcgcuggcag

SEQ ID NO: 3932005 - RNA, 20 nt, Shigella flexneri 2a str. 301
ucgccgaugaaguacagccc

SEQ ID NO: 3932006 - RNA, 21 nt, Shigella flexneri 2a str. 301
ucgccgaugaaguacagccca

SEQ ID NO: 3932007 - RNA, 16 nt, Shigella flexneri 2a str. 301
ucgccgauuuugccuu

SEQ ID NO: 3932008 - RNA, 15 nt, Shigella flexneri 2a str. 301
ucgccgcacgcucaa

SEQ ID NO: 3932009 - RNA, 17 nt, Shigella flexneri 2a str. 301
ucgccgcacuuucuccu

SEQ ID NO: 3932010 - RNA, 18 nt, Shigella flexneri 2a str. 301
ucgccgccgcaaacaucg

SEQ ID NO: 3932011 - RNA, 17 nt, Shigella flexneri 2a str. 301
ucgccgccgcuggcgug

SEQ ID NO: 3932012 - RNA, 17 nt, Shigella flexneri 2a str. 301
ucgccgcggacaaacgg

SEQ ID NO: 3932013 - RNA, 22 nt, Shigella flexneri 2a str. 301
ucgccgcguagagaaaaccaau

SEQ ID NO: 3932014 - RNA, 15 nt, Shigella flexneri 2a str. 301
ucgccgcugccuguu

SEQ ID NO: 3932015 - RNA, 23 nt, Shigella flexneri 2a str. 301
ucgccggaaccugaucagacacg

SEQ ID NO: 3932016 - RNA, 20 nt, Shigella flexneri 2a str. 301
ucgccggaugaaaagucauc

SEQ ID NO: 3932017 - RNA, 17 nt, Shigella flexneri 2a str. 301
ucgccgggcuaaccgcu

SEQ ID NO: 3932018 - RNA, 22 nt, Shigella flexneri 2a str. 301
ucgccgguaguuucagcggcgu

SEQ ID NO: 3932019 - RNA, 20 nt, Shigella flexneri 2a str. 301
ucgccgguuccagcuucaga

SEQ ID NO: 3932020 - RNA, 21 nt, Shigella flexneri 2a str. 301
ucgccguuuucuggggcgggg

SEQ ID NO: 3932021 - RNA, 17 nt, Shigella flexneri 2a str. 301
ucgccugcaccaugucc

SEQ ID NO: 3932022 - RNA, 16 nt, Shigella flexneri 2a str. 301
ucgccugcaucaccau

SEQ ID NO: 3932023 - RNA, 12 nt, Shigella flexneri 2a str. 301
ucgccugccaga

SEQ ID NO: 3932024 - RNA, 19 nt, Shigella flexneri 2a str. 301
ucgccugguaccagcaccg

SEQ ID NO: 3932025 - RNA, 17 nt, Shigella flexneri 2a str. 301
ucgccugguacuggauu

SEQ ID NO: 3932026 - RNA, 12 nt, Shigella flexneri 2a str. 301
ucgccuuaauaa

SEQ ID NO: 3932027 - RNA, 13 nt, Shigella flexneri 2a str. 301
ucgccuuaauaac

SEQ ID NO: 3932028 - RNA, 21 nt, Shigella flexneri 2a str. 301
ucgccuuaugcugcuucauug

SEQ ID NO: 3932029 - RNA, 19 nt, Shigella flexneri 2a str. 301
ucgccuucagguuuuucag

SEQ ID NO: 3932030 - RNA, 15 nt, Shigella flexneri 2a str. 301
ucgccuuccagcgau

SEQ ID NO: 3932031 - RNA, 20 nt, Shigella flexneri 2a str. 301
ucgcgaauggccugcgcauu

SEQ ID NO: 3932032 - RNA, 18 nt, Shigella flexneri 2a str. 301
ucgcgaccgccuucaguc

SEQ ID NO: 3932033 - RNA, 21 nt, Shigella flexneri 2a str. 301
ucgcgaccucaagcucgccac

SEQ ID NO: 3932034 - RNA, 18 nt, Shigella flexneri 2a str. 301
ucgcgacgaccacccacc

SEQ ID NO: 3932035 - RNA, 13 nt, Shigella flexneri 2a str. 301
ucgcgacggcauc

SEQ ID NO: 3932036 - RNA, 17 nt, Shigella flexneri 2a str. 301
ucgcgaggagaggccuu

SEQ ID NO: 3932037 - RNA, 19 nt, Shigella flexneri 2a str. 301
ucgcgauagaacuucugca

SEQ ID NO: 3932038 - RNA, 21 nt, Shigella flexneri 2a str. 301
ucgcgauagccgcuuucuaac

SEQ ID NO: 3932039 - RNA, 16 nt, Shigella flexneri 2a str. 301
ucgcgauagcgcaccg

SEQ ID NO: 3932040 - RNA, 15 nt, Shigella flexneri 2a str. 301
ucgcgauauugcugc

SEQ ID NO: 3932041 - RNA, 15 nt, Shigella flexneri 2a str. 301
ucgcgcaaccagucc

SEQ ID NO: 3932042 - RNA, 24 nt, Shigella flexneri 2a str. 301
ucgcgcaauugccagacaacauga

SEQ ID NO: 3932043 - RNA, 24 nt, Shigella flexneri 2a str. 301
ucgcgcacgaggaacagcgcgcug

SEQ ID NO: 3932044 - RNA, 13 nt, Shigella flexneri 2a str. 301
ucgcgcagcacuu

SEQ ID NO: 3932045 - RNA, 16 nt, Shigella flexneri 2a str. 301
ucgcgcagcacuugca

SEQ ID NO: 3932046 - RNA, 16 nt, Shigella flexneri 2a str. 301
ucgcgcaucagcaguu

SEQ ID NO: 3932047 - RNA, 20 nt, Shigella flexneri 2a str. 301
ucgcgccaaucagcgcagca

SEQ ID NO: 3932048 - RNA, 18 nt, Shigella flexneri 2a str. 301
ucgcgccagaaagcagca

SEQ ID NO: 3932049 - RNA, 12 nt, Shigella flexneri 2a str. 301
ucgcgccagcca

SEQ ID NO: 3932050 - RNA, 14 nt, Shigella flexneri 2a str. 301
ucgcgccagccagu

SEQ ID NO: 3932051 - RNA, 17 nt, Shigella flexneri 2a str. 301
ucgcgccaucaaaucug

SEQ ID NO: 3932052 - RNA, 18 nt, Shigella flexneri 2a str. 301
ucgcgcccaaaccaccca

SEQ ID NO: 3932053 - RNA, 19 nt, Shigella flexneri 2a str. 301
ucgcgccgcauccggcauu

SEQ ID NO: 3932054 - RNA, 12 nt, Shigella flexneri 2a str. 301
ucgcgcgcugcc

SEQ ID NO: 3932055 - RNA, 15 nt, Shigella flexneri 2a str. 301
ucgcgcuaauuccag

SEQ ID NO: 3932056 - RNA, 18 nt, Shigella flexneri 2a str. 301
ucgcgcuaauuccagucg

SEQ ID NO: 3932057 - RNA, 15 nt, Shigella flexneri 2a str. 301
ucgcgcucaucagcg

SEQ ID NO: 3932058 - RNA, 17 nt, Shigella flexneri 2a str. 301
ucgcgcuuaucgccagc

SEQ ID NO: 3932059 - RNA, 17 nt, Shigella flexneri 2a str. 301
ucgcggcagcagagaaa

SEQ ID NO: 3932060 - RNA, 19 nt, Shigella flexneri 2a str. 301
ucgcggcggccugggcauu

SEQ ID NO: 3932061 - RNA, 17 nt, Shigella flexneri 2a str. 301
ucgcgguaaacugcaug

SEQ ID NO: 3932062 - RNA, 23 nt, Shigella flexneri 2a str. 301
ucgcguaacugcugcucaaucug

SEQ ID NO: 3932063 - RNA, 19 nt, Shigella flexneri 2a str. 301
ucgcgucuuauccggccuu

SEQ ID NO: 3932064 - RNA, 19 nt, Shigella flexneri 2a str. 301
ucgcguuacuaccggcgug

SEQ ID NO: 3932065 - RNA, 17 nt, Shigella flexneri 2a str. 301
ucgcguugucauacgag

SEQ ID NO: 3932066 - RNA, 22 nt, Shigella flexneri 2a str. 301
ucgcuaauuucgccgaggcgcu

SEQ ID NO: 3932067 - RNA, 14 nt, Shigella flexneri 2a str. 301
ucgcuacugauaau

SEQ ID NO: 3932068 - RNA, 23 nt, Shigella flexneri 2a str. 301
ucgcuauagacaccuugcaacuc

SEQ ID NO: 3932069 - RNA, 19 nt, Shigella flexneri 2a str. 301
ucgcucaauauccugaccu

SEQ ID NO: 3932070 - RNA, 22 nt, Shigella flexneri 2a str. 301
ucgcucaaugcgcugaguguaa

SEQ ID NO: 3932071 - RNA, 16 nt, Shigella flexneri 2a str. 301
ucgcucaucagcuccg

SEQ ID NO: 3932072 - RNA, 21 nt, Shigella flexneri 2a str. 301
ucgcucaucgaagagacaaaa

SEQ ID NO: 3932073 - RNA, 18 nt, Shigella flexneri 2a str. 301
ucgcuccagucaucgcuu

SEQ ID NO: 3932074 - RNA, 23 nt, Shigella flexneri 2a str. 301
ucgcuccaugagaagcugaaauc

SEQ ID NO: 3932075 - RNA, 20 nt, Shigella flexneri 2a str. 301
ucgcuccauuccaucgccug

SEQ ID NO: 3932076 - RNA, 12 nt, Shigella flexneri 2a str. 301
ucgcuccggcua

SEQ ID NO: 3932077 - RNA, 21 nt, Shigella flexneri 2a str. 301
ucgcucgcgccgcauccgaca

SEQ ID NO: 3932078 - RNA, 18 nt, Shigella flexneri 2a str. 301
ucgcugaagucucgccag

SEQ ID NO: 3932079 - RNA, 21 nt, Shigella flexneri 2a str. 301
ucgcugaauaccgauucccag

SEQ ID NO: 3932080 - RNA, 15 nt, Shigella flexneri 2a str. 301
ucgcugaauaucuuu

SEQ ID NO: 3932081 - RNA, 23 nt, Shigella flexneri 2a str. 301
ucgcugaauaucuuucucgcggc

SEQ ID NO: 3932082 - RNA, 20 nt, Shigella flexneri 2a str. 301
ucgcugauauacccuucauc

SEQ ID NO: 3932083 - RNA, 23 nt, Shigella flexneri 2a str. 301
ucgcugauccucuaucuguuugc

SEQ ID NO: 3932084 - RNA, 14 nt, Shigella flexneri 2a str. 301
ucggugcaaaugcc

SEQ ID NO: 3932085 - RNA, 19 nt, Shigella flexneri 2a str. 301
ucggugcacuguaugaaac

SEQ ID NO: 3932086 - RNA, 15 nt, Shigella flexneri 2a str. 301
ucggugcgcugugug

SEQ ID NO: 3932087 - RNA, 14 nt, Shigella flexneri 2a str. 301
ucgguguccacuuc

SEQ ID NO: 3932088 - RNA, 13 nt, Shigella flexneri 2a str. 301
ucggugugcagcg

SEQ ID NO: 3932089 - RNA, 24 nt, Shigella flexneri 2a str. 301
ucgguguuaaaacgcacgcuguca

SEQ ID NO: 3932090 - RNA, 20 nt, Shigella flexneri 2a str. 301
ucgguucaagauucaguuca

SEQ ID NO: 3932091 - RNA, 16 nt, Shigella flexneri 2a str. 301
ucgguucaauacccac

SEQ ID NO: 3932092 - RNA, 19 nt, Shigella flexneri 2a str. 301
ucgguugcacagacuuaau

SEQ ID NO: 3932093 - RNA, 12 nt, Shigella flexneri 2a str. 301
ucgguugccaua

SEQ ID NO: 3932094 - RNA, 14 nt, Shigella flexneri 2a str. 301
ucgguuguuuucag

SEQ ID NO: 3932095 - RNA, 14 nt, Shigella flexneri 2a str. 301
ucgguuucaucaca

SEQ ID NO: 3932096 - RNA, 20 nt, Shigella flexneri 2a str. 301
ucgguuuucgcgccagccag

SEQ ID NO: 3932097 - RNA, 16 nt, Shigella flexneri 2a str. 301
ucgguuuuuuuacguc

SEQ ID NO: 3932098 - RNA, 20 nt, Shigella flexneri 2a str. 301
ucguaaguggcguuuacggu

SEQ ID NO: 3932099 - RNA, 15 nt, Shigella flexneri 2a str. 301
ucguacucaccagac

SEQ ID NO: 3932100 - RNA, 16 nt, Shigella flexneri 2a str. 301
ucguacucaccagaca

SEQ ID NO: 3932101 - RNA, 16 nt, Shigella flexneri 2a str. 301
ucguagccaccaucuu

SEQ ID NO: 3932102 - RNA, 17 nt, Shigella flexneri 2a str. 301
ucguagcguuuuuucau

SEQ ID NO: 3932103 - RNA, 20 nt, Shigella flexneri 2a str. 301
ucguaggccugauaagacgc

SEQ ID NO: 3932104 - RNA, 20 nt, Shigella flexneri 2a str. 301
ucguaggucggauaagacgc

SEQ ID NO: 3932105 - RNA, 15 nt, Shigella flexneri 2a str. 301
ucguagugaugccau

SEQ ID NO: 3932106 - RNA, 20 nt, Shigella flexneri 2a str. 301
ucguauuaaagagaucgaac

SEQ ID NO: 3932107 - RNA, 15 nt, Shigella flexneri 2a str. 301
ucguauuuaaaaccc

SEQ ID NO: 3932108 - RNA, 21 nt, Shigella flexneri 2a str. 301
ucgucaacaaacgugaagaac

SEQ ID NO: 3932109 - RNA, 13 nt, Shigella flexneri 2a str. 301
ucgucaaccugua

SEQ ID NO: 3932110 - RNA, 23 nt, Shigella flexneri 2a str. 301
ucgucaagaaugacaacugcauu

SEQ ID NO: 3932111 - RNA, 22 nt, Shigella flexneri 2a str. 301
ucgucaaucagcgugaccaguu

SEQ ID NO: 3932112 - RNA, 21 nt, Shigella flexneri 2a str. 301
ucgucacgcgcgccaagcccg

SEQ ID NO: 3932113 - RNA, 14 nt, Shigella flexneri 2a str. 301
ucgucaguuuauac

SEQ ID NO: 3932114 - RNA, 15 nt, Shigella flexneri 2a str. 301
ucgucaucagcucca

SEQ ID NO: 3932115 - RNA, 13 nt, Shigella flexneri 2a str. 301
ucgucauccgcca

SEQ ID NO: 3932116 - RNA, 16 nt, Shigella flexneri 2a str. 301
ucguccacuugaaaau

SEQ ID NO: 3932117 - RNA, 19 nt, Shigella flexneri 2a str. 301
ucguccauuucagcgcaga

SEQ ID NO: 3932118 - RNA, 12 nt, Shigella flexneri 2a str. 301
ucgucccagucg

SEQ ID NO: 3932119 - RNA, 15 nt, Shigella flexneri 2a str. 301
ucguccgcguccagc

SEQ ID NO: 3932120 - RNA, 14 nt, Shigella flexneri 2a str. 301
ucguccuucacauu

SEQ ID NO: 3932121 - RNA, 14 nt, Shigella flexneri 2a str. 301
ucgucgccagacca

SEQ ID NO: 3932122 - RNA, 19 nt, Shigella flexneri 2a str. 301
ucgucgggcuggugcugaa

SEQ ID NO: 3932123 - RNA, 16 nt, Shigella flexneri 2a str. 301
ucgucguacugaccgu

SEQ ID NO: 3932124 - RNA, 16 nt, Shigella flexneri 2a str. 301
ucgucguuuauauaga

SEQ ID NO: 3932125 - RNA, 14 nt, Shigella flexneri 2a str. 301
ucgucuccuggccg

SEQ ID NO: 3932126 - RNA, 21 nt, Shigella flexneri 2a str. 301
ucgucugggcauugaaggcag

SEQ ID NO: 3932127 - RNA, 21 nt, Shigella flexneri 2a str. 301
ucgugaaaggaaaaaauacag

SEQ ID NO: 3932128 - RNA, 22 nt, Shigella flexneri 2a str. 301
ucgugaacauguccuuucaggg

SEQ ID NO: 3932129 - RNA, 22 nt, Shigella flexneri 2a str. 301
ucgugaagcuggcagaaguugu

SEQ ID NO: 3932130 - RNA, 13 nt, Shigella flexneri 2a str. 301
ucgugcaccaauu

SEQ ID NO: 3932131 - RNA, 15 nt, Shigella flexneri 2a str. 301
ucgugcaucauggaa

SEQ ID NO: 3932132 - RNA, 16 nt, Shigella flexneri 2a str. 301
ucgugcgccuuucgag

SEQ ID NO: 3932133 - RNA, 18 nt, Shigella flexneri 2a str. 301
ucgugcggguaaccagcc

SEQ ID NO: 3932134 - RNA, 15 nt, Shigella flexneri 2a str. 301
ucgugcguuuguagg

SEQ ID NO: 3932135 - RNA, 17 nt, Shigella flexneri 2a str. 301
ucgugcucgacagcgcu

SEQ ID NO: 3932136 - RNA, 14 nt, Shigella flexneri 2a str. 301
ucguggagaacaau

SEQ ID NO: 3932137 - RNA, 21 nt, Shigella flexneri 2a str. 301
ucguggcaaucguagcccagc

SEQ ID NO: 3932138 - RNA, 18 nt, Shigella flexneri 2a str. 301
ucguguggaguaauaauu

SEQ ID NO: 3932139 - RNA, 22 nt, Shigella flexneri 2a str. 301
ucguguggaguaauaauuucug

SEQ ID NO: 3932140 - RNA, 21 nt, Shigella flexneri 2a str. 301
ucguguugaugcuccuggcga

SEQ ID NO: 3932141 - RNA, 16 nt, Shigella flexneri 2a str. 301
ucguuaaacucugccg

SEQ ID NO: 3932142 - RNA, 15 nt, Shigella flexneri 2a str. 301
ucguuaaauucuaau

SEQ ID NO: 3932143 - RNA, 16 nt, Shigella flexneri 2a str. 301
ucguuaaauucuaaug

SEQ ID NO: 3932144 - RNA, 17 nt, Shigella flexneri 2a str. 301
ucguuaacgugucauaa

SEQ ID NO: 3932145 - RNA, 23 nt, Shigella flexneri 2a str. 301
ucguucacaugagagaaaaucac

SEQ ID NO: 3932146 - RNA, 12 nt, Shigella flexneri 2a str. 301
ucguucagaucu

SEQ ID NO: 3932147 - RNA, 22 nt, Shigella flexneri 2a str. 301
ucguucauaccacgccaucaac

SEQ ID NO: 3932148 - RNA, 18 nt, Shigella flexneri 2a str. 301
ucguucgcaccaaaucca

SEQ ID NO: 3932149 - RNA, 12 nt, Shigella flexneri 2a str. 301
ucguucgccguu

SEQ ID NO: 3932150 - RNA, 13 nt, Shigella flexneri 2a str. 301
ucguucgcugcau

SEQ ID NO: 3932151 - RNA, 12 nt, Shigella flexneri 2a str. 301
ucguucuucccu

SEQ ID NO: 3932152 - RNA, 19 nt, Shigella flexneri 2a str. 301
ucguugauaauaaagcuac

SEQ ID NO: 3932153 - RNA, 19 nt, Shigella flexneri 2a str. 301
ucguugcagaaugauggcu

SEQ ID NO: 3932154 - RNA, 23 nt, Shigella flexneri 2a str. 301
ucguugccugcgaagcucuuucg

SEQ ID NO: 3932155 - RNA, 21 nt, Shigella flexneri 2a str. 301
ucguugcguugaccaucugac

SEQ ID NO: 3932156 - RNA, 18 nt, Shigella flexneri 2a str. 301
ucguugguguccacgccg

SEQ ID NO: 3932157 - RNA, 15 nt, Shigella flexneri 2a str. 301
ucguuguaacugucu

SEQ ID NO: 3932158 - RNA, 15 nt, Shigella flexneri 2a str. 301
ucguuuuggcagaaa

SEQ ID NO: 3932159 - RNA, 21 nt, Shigella flexneri 2a str. 301
ucuaacaaccuugccauucca

SEQ ID NO: 3932160 - RNA, 16 nt, Shigella flexneri 2a str. 301
ucuaaccauuauuaaa

SEQ ID NO: 3932161 - RNA, 16 nt, Shigella flexneri 2a str. 301
ucuaacucuucugaaa

SEQ ID NO: 3932162 - RNA, 21 nt, Shigella flexneri 2a str. 301
ucuaauauuagucaauuaaaa

SEQ ID NO: 3932163 - RNA, 22 nt, Shigella flexneri 2a str. 301
ucuaauggugaacugacagcca

SEQ ID NO: 3932164 - RNA, 17 nt, Shigella flexneri 2a str. 301
ucuaaugucauaagcau

SEQ ID NO: 3932165 - RNA, 15 nt, Shigella flexneri 2a str. 301
ucuacaaaaaacugg

SEQ ID NO: 3932166 - RNA, 21 nt, Shigella flexneri 2a str. 301
ucuacaaccagcuuaugccug

SEQ ID NO: 3932167 - RNA, 21 nt, Shigella flexneri 2a str. 301
ucuacacagacgguuuuucaa

SEQ ID NO: 3932168 - RNA, 12 nt, Shigella flexneri 2a str. 301
ucuacaccaacg

SEQ ID NO: 3932169 - RNA, 22 nt, Shigella flexneri 2a str. 301
ucuacacgcuaccaaaaaauca

SEQ ID NO: 3932170 - RNA, 16 nt, Shigella flexneri 2a str. 301
ucuacagcauuuccuu

SEQ ID NO: 3932171 - RNA, 14 nt, Shigella flexneri 2a str. 301
ucuacauucauaga

SEQ ID NO: 3932172 - RNA, 14 nt, Shigella flexneri 2a str. 301
ucuaccacaugauu

SEQ ID NO: 3932173 - RNA, 23 nt, Shigella flexneri 2a str. 301
ucuaccagaugcucuuuucugaa

SEQ ID NO: 3932174 - RNA, 13 nt, Shigella flexneri 2a str. 301
ucuaccagcaccu

SEQ ID NO: 3932175 - RNA, 22 nt, Shigella flexneri 2a str. 301
ucuaccaugaugauaucacugg

SEQ ID NO: 3932176 - RNA, 15 nt, Shigella flexneri 2a str. 301
ucuaccguuggccug

SEQ ID NO: 3932177 - RNA, 22 nt, Shigella flexneri 2a str. 301
ucuaccuuaacgguaucuuucc

SEQ ID NO: 3932178 - RNA, 18 nt, Shigella flexneri 2a str. 301
ucuauauacaaucacacu

SEQ ID NO: 3932179 - RNA, 16 nt, Shigella flexneri 2a str. 301
ucuaucaacaguuugu

SEQ ID NO: 3932180 - RNA, 18 nt, Shigella flexneri 2a str. 301
ucuaucaacaguuuguug

SEQ ID NO: 3932181 - RNA, 17 nt, Shigella flexneri 2a str. 301
ucuauccagcucaucca

SEQ ID NO: 3932182 - RNA, 10 nt, Shigella flexneri 2a str. 301
ucuaucugcc

SEQ ID NO: 3932183 - RNA, 13 nt, Shigella flexneri 2a str. 301
ucuaucuuucaga

SEQ ID NO: 3932184 - RNA, 17 nt, Shigella flexneri 2a str. 301
ucugaauccaucuguau

SEQ ID NO: 3932185 - RNA, 18 nt, Shigella flexneri 2a str. 301
ucugaauggcugcauucc

SEQ ID NO: 3932186 - RNA, 12 nt, Shigella flexneri 2a str. 301
ucugaauuucag

SEQ ID NO: 3932187 - RNA, 19 nt, Shigella flexneri 2a str. 301
ucugacauccgaccaaugc

SEQ ID NO: 3932188 - RNA, 19 nt, Shigella flexneri 2a str. 301
ucugacauuuuuacuccuu

SEQ ID NO: 3932189 - RNA, 20 nt, Shigella flexneri 2a str. 301
ucugaccacggccacagcca

SEQ ID NO: 3932190 - RNA, 16 nt, Shigella flexneri 2a str. 301
ucugaccgucuuucau

SEQ ID NO: 3932191 - RNA, 14 nt, Shigella flexneri 2a str. 301
ucugacgaaaucaa

SEQ ID NO: 3932192 - RNA, 16 nt, Shigella flexneri 2a str. 301
ucugacgccaccauuc

SEQ ID NO: 3932193 - RNA, 18 nt, Shigella flexneri 2a str. 301
ucugacgcugaauacgca

SEQ ID NO: 3932194 - RNA, 22 nt, Shigella flexneri 2a str. 301
ucugacuauauaaauuacccuu

SEQ ID NO: 3932195 - RNA, 17 nt, Shigella flexneri 2a str. 301
ucugagagcaugaaaug

SEQ ID NO: 3932196 - RNA, 19 nt, Shigella flexneri 2a str. 301
ucugagagcaugaaaugaa

SEQ ID NO: 3932197 - RNA, 16 nt, Shigella flexneri 2a str. 301
ucugagcaugaugccu

SEQ ID NO: 3932198 - RNA, 19 nt, Shigella flexneri 2a str. 301
ucugagcaugaugccugau

SEQ ID NO: 3932199 - RNA, 20 nt, Shigella flexneri 2a str. 301
ucugagcaugaugccugaug

SEQ ID NO: 3932200 - RNA, 20 nt, Shigella flexneri 2a str. 301
ucugagccagcuucccaaag

SEQ ID NO: 3932201 - RNA, 21 nt, Shigella flexneri 2a str. 301
ucugagcugggccguuguucu

SEQ ID NO: 3932202 - RNA, 19 nt, Shigella flexneri 2a str. 301
ucugauacuaaugccauau

SEQ ID NO: 3932203 - RNA, 20 nt, Shigella flexneri 2a str. 301
ucugauagugauccaucagg

SEQ ID NO: 3932204 - RNA, 14 nt, Shigella flexneri 2a str. 301
ucugauaguuaaaa

SEQ ID NO: 3932205 - RNA, 23 nt, Shigella flexneri 2a str. 301
ucugauaguuaaaauucaagaca

SEQ ID NO: 3932206 - RNA, 14 nt, Shigella flexneri 2a str. 301
ucugaugauauuuu

SEQ ID NO: 3932207 - RNA, 21 nt, Shigella flexneri 2a str. 301
ucugaugauauuuuucccuga

SEQ ID NO: 3932208 - RNA, 15 nt, Shigella flexneri 2a str. 301
ucugaugcauaaaaa

SEQ ID NO: 3932209 - RNA, 16 nt, Shigella flexneri 2a str. 301
ucugaugcauaaaaaa

SEQ ID NO: 3932210 - RNA, 17 nt, Shigella flexneri 2a str. 301
ucugauguuguuuuuaa

SEQ ID NO: 3932211 - RNA, 22 nt, Shigella flexneri 2a str. 301
ucugauuacuuccuucaugggg

SEQ ID NO: 3932212 - RNA, 17 nt, Shigella flexneri 2a str. 301
ucugauugauucagggu

SEQ ID NO: 3932213 - RNA, 14 nt, Shigella flexneri 2a str. 301
ucugauugccuucc

SEQ ID NO: 3932214 - RNA, 22 nt, Shigella flexneri 2a str. 301
ucugauuuuccuccagcagcac

SEQ ID NO: 3932215 - RNA, 14 nt, Shigella flexneri 2a str. 301
ucugcaaaaaugcc

SEQ ID NO: 3932216 - RNA, 16 nt, Shigella flexneri 2a str. 301
ucugcaaaaaugccuu

SEQ ID NO: 3932217 - RNA, 23 nt, Shigella flexneri 2a str. 301
ucugcaaugcugcgaucagugca

SEQ ID NO: 3932218 - RNA, 15 nt, Shigella flexneri 2a str. 301
ucugcaauuuaccuu

SEQ ID NO: 3932219 - RNA, 17 nt, Shigella flexneri 2a str. 301
ucugcaauuuaccuuuc

SEQ ID NO: 3932220 - RNA, 18 nt, Shigella flexneri 2a str. 301
ucugcacaucuaaccauu

SEQ ID NO: 3932221 - RNA, 20 nt, Shigella flexneri 2a str. 301
ucugcacguuuugcugaugc

SEQ ID NO: 3932222 - RNA, 15 nt, Shigella flexneri 2a str. 301
ucugcaugacggcug

SEQ ID NO: 3932223 - RNA, 13 nt, Shigella flexneri 2a str. 301
ucugccacuucuu

SEQ ID NO: 3932224 - RNA, 22 nt, Shigella flexneri 2a str. 301
ucugcccaucauaccugagugg

SEQ ID NO: 3932225 - RNA, 21 nt, Shigella flexneri 2a str. 301
ucugcccgagauacaucaccg

SEQ ID NO: 3932226 - RNA, 12 nt, Shigella flexneri 2a str. 301
ucugccgcaauu

SEQ ID NO: 3932227 - RNA, 13 nt, Shigella flexneri 2a str. 301
ucugccgcaauuc

SEQ ID NO: 3932228 - RNA, 22 nt, Shigella flexneri 2a str. 301
ucugccgcauggaaccaguuca

SEQ ID NO: 3932229 - RNA, 22 nt, Shigella flexneri 2a str. 301
ucugccgggaagcucucuucca

SEQ ID NO: 3932230 - RNA, 20 nt, Shigella flexneri 2a str. 301
ucugccguaccaucgccagc

SEQ ID NO: 3932231 - RNA, 14 nt, Shigella flexneri 2a str. 301
ucugccucugccag

SEQ ID NO: 3932232 - RNA, 21 nt, Shigella flexneri 2a str. 301
ucugcgaauugagaugacgcc

SEQ ID NO: 3932233 - RNA, 14 nt, Shigella flexneri 2a str. 301
ucugcgacuguucg

SEQ ID NO: 3932234 - RNA, 16 nt, Shigella flexneri 2a str. 301
ucugcgcacacacgcc

SEQ ID NO: 3932235 - RNA, 21 nt, Shigella flexneri 2a str. 301
ucugcgcauaacugccggaug

SEQ ID NO: 3932236 - RNA, 23 nt, Shigella flexneri 2a str. 301
ucugcgccaccacaacauuccca

SEQ ID NO: 3932237 - RNA, 13 nt, Shigella flexneri 2a str. 301
ucugcgccagcga

SEQ ID NO: 3932238 - RNA, 20 nt, Shigella flexneri 2a str. 301
ucugcgccgagggaaauaga

SEQ ID NO: 3932239 - RNA, 21 nt, Shigella flexneri 2a str. 301
ucugcgccuuuuuucgccgca

SEQ ID NO: 3932240 - RNA, 14 nt, Shigella flexneri 2a str. 301
ucugcgcgugcagu

SEQ ID NO: 3932241 - RNA, 23 nt, Shigella flexneri 2a str. 301
ucugcgcuauccagcgcauagcu

SEQ ID NO: 3932242 - RNA, 13 nt, Shigella flexneri 2a str. 301
ucugcgcuugguu

SEQ ID NO: 3932243 - RNA, 12 nt, Shigella flexneri 2a str. 301
ucugcgcuuugu

SEQ ID NO: 3932244 - RNA, 16 nt, Shigella flexneri 2a str. 301
ucugcggaucuuuuuc

SEQ ID NO: 3932245 - RNA, 14 nt, Shigella flexneri 2a str. 301
ucugcggcaucaua

SEQ ID NO: 3932246 - RNA, 18 nt, Shigella flexneri 2a str. 301
ucugcggguuagucugca

SEQ ID NO: 3932247 - RNA, 20 nt, Shigella flexneri 2a str. 301
ucugcggguuagucugcauu

SEQ ID NO: 3932248 - RNA, 15 nt, Shigella flexneri 2a str. 301
ucugcguaauguuua

SEQ ID NO: 3932249 - RNA, 15 nt, Shigella flexneri 2a str. 301
ucugcguacccggau

SEQ ID NO: 3932250 - RNA, 19 nt, Shigella flexneri 2a str. 301
ucugcguaucgcccugcca

SEQ ID NO: 3932251 - RNA, 22 nt, Shigella flexneri 2a str. 301
ucugcgugaucuaaaaucgcuu

SEQ ID NO: 3932252 - RNA, 13 nt, Shigella flexneri 2a str. 301
ucugcugaacagu

SEQ ID NO: 3932253 - RNA, 15 nt, Shigella flexneri 2a str. 301
ucugcugauuaaccc

SEQ ID NO: 3932254 - RNA, 12 nt, Shigella flexneri 2a str. 301
ucugcuggcaaa

SEQ ID NO: 3932255 - RNA, 18 nt, Shigella flexneri 2a str. 301
ucugcuucgcgacggcau

SEQ ID NO: 3932256 - RNA, 20 nt, Shigella flexneri 2a str. 301
ucugcuucugccugggccug

SEQ ID NO: 3932257 - RNA, 22 nt, Shigella flexneri 2a str. 301
ucugcuuucauucgguuuucaa

SEQ ID NO: 3932258 - RNA, 18 nt, Shigella flexneri 2a str. 301
ucugcuuuucccuccacu

SEQ ID NO: 3932259 - RNA, 21 nt, Shigella flexneri 2a str. 301
ucuggauagagcucauuucau

SEQ ID NO: 3932260 - RNA, 23 nt, Shigella flexneri 2a str. 301
ucuggauccacgauuaucaccug

SEQ ID NO: 3932261 - RNA, 15 nt, Shigella flexneri 2a str. 301
ucuggauuuggcugc

SEQ ID NO: 3932262 - RNA, 21 nt, Shigella flexneri 2a str. 301
ucuggcaccuguaccagcccg

SEQ ID NO: 3932263 - RNA, 17 nt, Shigella flexneri 2a str. 301
ucuggcagauccugaaa

SEQ ID NO: 3932264 - RNA, 16 nt, Shigella flexneri 2a str. 301
ucuggcaucacuucuu

SEQ ID NO: 3932265 - RNA, 15 nt, Shigella flexneri 2a str. 301
ucuggcauuuggcuc

SEQ ID NO: 3932266 - RNA, 18 nt, Shigella flexneri 2a str. 301
ucuggccugagacugaug

SEQ ID NO: 3932267 - RNA, 18 nt, Shigella flexneri 2a str. 301
ucuggcgaaccgcuuugc

SEQ ID NO: 3932268 - RNA, 19 nt, Shigella flexneri 2a str. 301
ucuggcgacauuuucucua

SEQ ID NO: 3932269 - RNA, 17 nt, Shigella flexneri 2a str. 301
ucuggcgagucaccaua

SEQ ID NO: 3932270 - RNA, 15 nt, Shigella flexneri 2a str. 301
ucuggcgauuuugaa

SEQ ID NO: 3932271 - RNA, 14 nt, Shigella flexneri 2a str. 301
ucuggcgcgaacag

SEQ ID NO: 3932272 - RNA, 17 nt, Shigella flexneri 2a str. 301
ucuggcguacagagggc

SEQ ID NO: 3932273 - RNA, 18 nt, Shigella flexneri 2a str. 301
ucuggcgucaaagcugcu

SEQ ID NO: 3932274 - RNA, 22 nt, Shigella flexneri 2a str. 301
ucuggcuacugaugguuuuaau

SEQ ID NO: 3932275 - RNA, 19 nt, Shigella flexneri 2a str. 301
ucuggcucaucgccuucca

SEQ ID NO: 3932276 - RNA, 23 nt, Shigella flexneri 2a str. 301
ucuggcugacauaaacaccagca

SEQ ID NO: 3932277 - RNA, 16 nt, Shigella flexneri 2a str. 301
ucuggcuguuucgcuu

SEQ ID NO: 3932278 - RNA, 16 nt, Shigella flexneri 2a str. 301
ucuggcuugccagcag

SEQ ID NO: 3932279 - RNA, 17 nt, Shigella flexneri 2a str. 301
ucuggcuugccagcagg

SEQ ID NO: 3932280 - RNA, 20 nt, Shigella flexneri 2a str. 301
ucugggcaaaaucaucacuc

SEQ ID NO: 3932281 - RNA, 17 nt, Shigella flexneri 2a str. 301
ucuggggcguguuuugu

SEQ ID NO: 3932282 - RNA, 16 nt, Shigella flexneri 2a str. 301
ucuggguggcguucca

SEQ ID NO: 3932283 - RNA, 17 nt, Shigella flexneri 2a str. 301
ucugguaaaccuuccac

SEQ ID NO: 3932284 - RNA, 22 nt, Shigella flexneri 2a str. 301
ucuuccucacacccuugccaga

SEQ ID NO: 3932285 - RNA, 23 nt, Shigella flexneri 2a str. 301
ucuuccuuaacauccaucgccag

SEQ ID NO: 3932286 - RNA, 23 nt, Shigella flexneri 2a str. 301
ucuucgaagaucucgguaacgau

SEQ ID NO: 3932287 - RNA, 19 nt, Shigella flexneri 2a str. 301
ucuucgaguaaaaauauuu

SEQ ID NO: 3932288 - RNA, 23 nt, Shigella flexneri 2a str. 301
ucuucgauuuaaccgcuuucacc

SEQ ID NO: 3932289 - RNA, 18 nt, Shigella flexneri 2a str. 301
ucuucgccgaacacacau

SEQ ID NO: 3932290 - RNA, 23 nt, Shigella flexneri 2a str. 301
ucuucgccugccugcagcugcuc

SEQ ID NO: 3932291 - RNA, 18 nt, Shigella flexneri 2a str. 301
ucuucggccauugaauau

SEQ ID NO: 3932292 - RNA, 17 nt, Shigella flexneri 2a str. 301
ucuucgguucaaguccc

SEQ ID NO: 3932293 - RNA, 20 nt, Shigella flexneri 2a str. 301
ucuucguagcguuuuuucau

SEQ ID NO: 3932294 - RNA, 13 nt, Shigella flexneri 2a str. 301
ucuucgucgucuu

SEQ ID NO: 3932295 - RNA, 14 nt, Shigella flexneri 2a str. 301
ucuucguucgcugc

SEQ ID NO: 3932296 - RNA, 22 nt, Shigella flexneri 2a str. 301
ucuucuagcgcaauaacccuga

SEQ ID NO: 3932297 - RNA, 22 nt, Shigella flexneri 2a str. 301
ucuucucaaccuuuccuuguaa

SEQ ID NO: 3932298 - RNA, 15 nt, Shigella flexneri 2a str. 301
ucuucucgauaaaac

SEQ ID NO: 3932299 - RNA, 21 nt, Shigella flexneri 2a str. 301
ucuucugaaaaggucacuccc

SEQ ID NO: 3932300 - RNA, 18 nt, Shigella flexneri 2a str. 301
ucuucugcagucaccugc

SEQ ID NO: 3932301 - RNA, 18 nt, Shigella flexneri 2a str. 301
ucuucuggguugccugau

SEQ ID NO: 3932302 - RNA, 19 nt, Shigella flexneri 2a str. 301
ucuucugucgggcaucacu

SEQ ID NO: 3932303 - RNA, 18 nt, Shigella flexneri 2a str. 301
ucuucuucacuucuucaa

SEQ ID NO: 3932304 - RNA, 13 nt, Shigella flexneri 2a str. 301
ucuucuucgcugc

SEQ ID NO: 3932305 - RNA, 15 nt, Shigella flexneri 2a str. 301
ucuucuucggucaga

SEQ ID NO: 3932306 - RNA, 15 nt, Shigella flexneri 2a str. 301
ucuucuugaccguuu

SEQ ID NO: 3932307 - RNA, 20 nt, Shigella flexneri 2a str. 301
ucuucuugaccguuuuacuc

SEQ ID NO: 3932308 - RNA, 14 nt, Shigella flexneri 2a str. 301
ucuucuugcagcuu

SEQ ID NO: 3932309 - RNA, 14 nt, Shigella flexneri 2a str. 301
ucuucuuucaucau

SEQ ID NO: 3932310 - RNA, 23 nt, Shigella flexneri 2a str. 301
ucuugacgcugauuuuuuuucaa

SEQ ID NO: 3932311 - RNA, 13 nt, Shigella flexneri 2a str. 301
ucuugauaccaaa

SEQ ID NO: 3932312 - RNA, 21 nt, Shigella flexneri 2a str. 301
ucuugauuugcuuguuucauu

SEQ ID NO: 3932313 - RNA, 18 nt, Shigella flexneri 2a str. 301
ucuugcaaaaucaauaaa

SEQ ID NO: 3932314 - RNA, 16 nt, Shigella flexneri 2a str. 301
ucuugcagcuuaauca

SEQ ID NO: 3932315 - RNA, 22 nt, Shigella flexneri 2a str. 301
ucuugcaggaagggauugugca

SEQ ID NO: 3932316 - RNA, 20 nt, Shigella flexneri 2a str. 301
ucuugccuuuccuccugucu

SEQ ID NO: 3932317 - RNA, 22 nt, Shigella flexneri 2a str. 301
ucuugcgaacaggucgagaaca

SEQ ID NO: 3932318 - RNA, 22 nt, Shigella flexneri 2a str. 301
ucuugcgcggauggccucugcc

SEQ ID NO: 3932319 - RNA, 18 nt, Shigella flexneri 2a str. 301
ucuugcugauacuccuca

SEQ ID NO: 3932320 - RNA, 23 nt, Shigella flexneri 2a str. 301
ucuugcuggcauuacaagaauca

SEQ ID NO: 3932321 - RNA, 22 nt, Shigella flexneri 2a str. 301
ucuugcuucugacuauauaaau

SEQ ID NO: 3932322 - RNA, 16 nt, Shigella flexneri 2a str. 301
ucuuguaaauuuccca

SEQ ID NO: 3932323 - RNA, 17 nt, Shigella flexneri 2a str. 301
ucuuguaaauuucccac

SEQ ID NO: 3932324 - RNA, 21 nt, Shigella flexneri 2a str. 301
ucuuguucauagugccugaug

SEQ ID NO: 3932325 - RNA, 15 nt, Shigella flexneri 2a str. 301
ucuuuaaaaaguaaa

SEQ ID NO: 3932326 - RNA, 11 nt, Shigella flexneri 2a str. 301
ucuuuaaacag

SEQ ID NO: 3932327 - RNA, 17 nt, Shigella flexneri 2a str. 301
ucuuuaaugcacggcag

SEQ ID NO: 3932328 - RNA, 13 nt, Shigella flexneri 2a str. 301
ucuuuacacacaa

SEQ ID NO: 3932329 - RNA, 21 nt, Shigella flexneri 2a str. 301
ucuuuaccgcgaccaccacca

SEQ ID NO: 3932330 - RNA, 15 nt, Shigella flexneri 2a str. 301
ucuuuacgcaaaauc

SEQ ID NO: 3932331 - RNA, 16 nt, Shigella flexneri 2a str. 301
ucuuuacgcaaaauca

SEQ ID NO: 3932332 - RNA, 13 nt, Shigella flexneri 2a str. 301
ucuuuacuaaacg

SEQ ID NO: 3932333 - RNA, 21 nt, Shigella flexneri 2a str. 301
ucuuuacuaaacggucccuca

SEQ ID NO: 3932334 - RNA, 16 nt, Shigella flexneri 2a str. 301
ucuuuaguuaauuucg

SEQ ID NO: 3932335 - RNA, 17 nt, Shigella flexneri 2a str. 301
ucuuuaguuaauuucgc

SEQ ID NO: 3932336 - RNA, 19 nt, Shigella flexneri 2a str. 301
ucuuuauagagauuuuucc

SEQ ID NO: 3932337 - RNA, 11 nt, Shigella flexneri 2a str. 301
ucuuuaucugc

SEQ ID NO: 3932338 - RNA, 19 nt, Shigella flexneri 2a str. 301
ucuuuauggguuucuaauu

SEQ ID NO: 3932339 - RNA, 14 nt, Shigella flexneri 2a str. 301
ucuuucaaugcuuu

SEQ ID NO: 3932340 - RNA, 17 nt, Shigella flexneri 2a str. 301
ucuuucaccucuucauu

SEQ ID NO: 3932341 - RNA, 18 nt, Shigella flexneri 2a str. 301
ucuuucacggccacucug

SEQ ID NO: 3932342 - RNA, 20 nt, Shigella flexneri 2a str. 301
ucuuucacggccacucugcc

SEQ ID NO: 3932343 - RNA, 22 nt, Shigella flexneri 2a str. 301
ucuuucacuucagcaacgugcu

SEQ ID NO: 3932344 - RNA, 17 nt, Shigella flexneri 2a str. 301
ucuuucagcaccgcgaa

SEQ ID NO: 3932345 - RNA, 11 nt, Shigella flexneri 2a str. 301
ucuuucaguac

SEQ ID NO: 3932346 - RNA, 15 nt, Shigella flexneri 2a str. 301
ucuuucauauucaau

SEQ ID NO: 3932347 - RNA, 22 nt, Shigella flexneri 2a str. 301
ucuuucauauucaauuugcaau

SEQ ID NO: 3932348 - RNA, 13 nt, Shigella flexneri 2a str. 301
ucuuucaucuccc

SEQ ID NO: 3932349 - RNA, 23 nt, Shigella flexneri 2a str. 301
ucuuuccagcaaccaaugccacc

SEQ ID NO: 3932350 - RNA, 15 nt, Shigella flexneri 2a str. 301
ucuuucccggcaauc

SEQ ID NO: 3932351 - RNA, 19 nt, Shigella flexneri 2a str. 301
ucuuucccggcaaucaccg

SEQ ID NO: 3932352 - RNA, 21 nt, Shigella flexneri 2a str. 301
ucuuucgaauguggcagcaac

SEQ ID NO: 3932353 - RNA, 19 nt, Shigella flexneri 2a str. 301
ucuuucgcccaauaaaaaa

SEQ ID NO: 3932354 - RNA, 14 nt, Shigella flexneri 2a str. 301
ucuuucuaugagaa

SEQ ID NO: 3932355 - RNA, 15 nt, Shigella flexneri 2a str. 301
ucuuucuaugagaaa

SEQ ID NO: 3932356 - RNA, 14 nt, Shigella flexneri 2a str. 301
ucuuucucaaucug

SEQ ID NO: 3932357 - RNA, 20 nt, Shigella flexneri 2a str. 301
ucuuucucgccuuucuuaaa

SEQ ID NO: 3932358 - RNA, 21 nt, Shigella flexneri 2a str. 301
ucuuucucugcaaauauuaau

SEQ ID NO: 3932359 - RNA, 13 nt, Shigella flexneri 2a str. 301
ucuuugaaaucac

SEQ ID NO: 3932360 - RNA, 18 nt, Shigella flexneri 2a str. 301
ucuuugaugaaacaugau

SEQ ID NO: 3932361 - RNA, 21 nt, Shigella flexneri 2a str. 301
ucuuugauugaagaaaucagu

SEQ ID NO: 3932362 - RNA, 16 nt, Shigella flexneri 2a str. 301
ucuuugcccgcagauc

SEQ ID NO: 3932363 - RNA, 22 nt, Shigella flexneri 2a str. 301
ucuuugcgcccccgauccagcg

SEQ ID NO: 3932364 - RNA, 15 nt, Shigella flexneri 2a str. 301
ucuuugcuuccugag

SEQ ID NO: 3932365 - RNA, 14 nt, Shigella flexneri 2a str. 301
ucuuuggcaucaau

SEQ ID NO: 3932366 - RNA, 19 nt, Shigella flexneri 2a str. 301
ucuuuguauuuauuuucag

SEQ ID NO: 3932367 - RNA, 12 nt, Shigella flexneri 2a str. 301
ucuuugucggug

SEQ ID NO: 3932368 - RNA, 20 nt, Shigella flexneri 2a str. 301
ucuuuguguugcugaacuua

SEQ ID NO: 3932369 - RNA, 22 nt, Shigella flexneri 2a str. 301
ucuuuuacaucuacaaaaaacu

SEQ ID NO: 3932370 - RNA, 14 nt, Shigella flexneri 2a str. 301
ucuuuucacgcaau

SEQ ID NO: 3932371 - RNA, 13 nt, Shigella flexneri 2a str. 301
ucuuuuccuuucg

SEQ ID NO: 3932372 - RNA, 11 nt, Shigella flexneri 2a str. 301
ucuuuucugag

SEQ ID NO: 3932373 - RNA, 23 nt, Shigella flexneri 2a str. 301
ucuuuugcuaucgggaauauuaa

SEQ ID NO: 3932374 - RNA, 19 nt, Shigella flexneri 2a str. 301
ucuuuuucauuaugaucaa

SEQ ID NO: 3932375 - RNA, 20 nt, Shigella flexneri 2a str. 301
ucuuuuugggguuuuaauuc

SEQ ID NO: 3932376 - RNA, 15 nt, Shigella flexneri 2a str. 301
ucuuuuuucacuggc

SEQ ID NO: 3932377 - RNA, 14 nt, Shigella flexneri 2a str. 301
ucuuuuuuccgcuu

SEQ ID NO: 3932378 - RNA, 23 nt, Shigella flexneri 2a str. 301
ugaaaaaaaggcgaaaggcuggc

SEQ ID NO: 3932379 - RNA, 15 nt, Shigella flexneri 2a str. 301
ugaaaaaaccugcac

SEQ ID NO: 3932380 - RNA, 14 nt, Shigella flexneri 2a str. 301
ugaaaaaacuggcu

SEQ ID NO: 3932381 - RNA, 14 nt, Shigella flexneri 2a str. 301
ugaaaaaccaaucu

SEQ ID NO: 3932382 - RNA, 12 nt, Shigella flexneri 2a str. 301
ugaaaaauaaaa

SEQ ID NO: 3932383 - RNA, 18 nt, Shigella flexneri 2a str. 301
ugaaaaaucaaaaaacug

SEQ ID NO: 3932384 - RNA, 18 nt, Shigella flexneri 2a str. 301
ugaagaaaucaguugauu

SEQ ID NO: 3932385 - RNA, 23 nt, Shigella flexneri 2a str. 301
ugaagaaaucaguugauuaugau

SEQ ID NO: 3932386 - RNA, 18 nt, Shigella flexneri 2a str. 301
ugaagaaccgcaccaggc

SEQ ID NO: 3932387 - RNA, 16 nt, Shigella flexneri 2a str. 301
ugaagaauuuuugcgg

SEQ ID NO: 3932388 - RNA, 17 nt, Shigella flexneri 2a str. 301
ugaagaguuugaucaug

SEQ ID NO: 3932389 - RNA, 21 nt, Shigella flexneri 2a str. 301
ugaagauggucuguaccacca

SEQ ID NO: 3932390 - RNA, 16 nt, Shigella flexneri 2a str. 301
ugaagcaaacuugaac

SEQ ID NO: 3932391 - RNA, 22 nt, Shigella flexneri 2a str. 301
ugaagcaauccauaccagcaca

SEQ ID NO: 3932392 - RNA, 16 nt, Shigella flexneri 2a str. 301
ugaagcagagcagacg

SEQ ID NO: 3932393 - RNA, 17 nt, Shigella flexneri 2a str. 301
ugaagcaguuucaccag

SEQ ID NO: 3932394 - RNA, 12 nt, Shigella flexneri 2a str. 301
ugaagccaaauc

SEQ ID NO: 3932395 - RNA, 18 nt, Shigella flexneri 2a str. 301
ugaagccaaaucauccag

SEQ ID NO: 3932396 - RNA, 22 nt, Shigella flexneri 2a str. 301
ugaagccaaaucauccagaccg

SEQ ID NO: 3932397 - RNA, 20 nt, Shigella flexneri 2a str. 301
ugaagcccaguaccgccagu

SEQ ID NO: 3932398 - RNA, 19 nt, Shigella flexneri 2a str. 301
ugaagccuucgccuuucag

SEQ ID NO: 3932399 - RNA, 19 nt, Shigella flexneri 2a str. 301
ugaagcuggcagaaguugu

SEQ ID NO: 3932400 - RNA, 15 nt, Shigella flexneri 2a str. 301
ugaaggauaagacgu

SEQ ID NO: 3932401 - RNA, 22 nt, Shigella flexneri 2a str. 301
ugaagguuguuaaccaccagua

SEQ ID NO: 3932402 - RNA, 15 nt, Shigella flexneri 2a str. 301
ugaaguacacauaaa

SEQ ID NO: 3932403 - RNA, 21 nt, Shigella flexneri 2a str. 301
ugaaguacgaaaaaaccggga

SEQ ID NO: 3932404 - RNA, 13 nt, Shigella flexneri 2a str. 301
ugaaguagccagu

SEQ ID NO: 3932405 - RNA, 21 nt, Shigella flexneri 2a str. 301
ugaagucagggucuuccagca

SEQ ID NO: 3932406 - RNA, 20 nt, Shigella flexneri 2a str. 301
ugaagucgcgcucaucagcg

SEQ ID NO: 3932407 - RNA, 15 nt, Shigella flexneri 2a str. 301
ugaagucucaauuag

SEQ ID NO: 3932408 - RNA, 17 nt, Shigella flexneri 2a str. 301
ugaagucucaauuagua

SEQ ID NO: 3932409 - RNA, 22 nt, Shigella flexneri 2a str. 301
ugaagucuuuuuucaacuuuau

SEQ ID NO: 3932410 - RNA, 20 nt, Shigella flexneri 2a str. 301
ugaagugagaauuuuucacu

SEQ ID NO: 3932411 - RNA, 23 nt, Shigella flexneri 2a str. 301
ugaagugugcaaacgauaaaagu

SEQ ID NO: 3932412 - RNA, 17 nt, Shigella flexneri 2a str. 301
ugaauaaaauucuccag

SEQ ID NO: 3932413 - RNA, 17 nt, Shigella flexneri 2a str. 301
ugaauaaacucaccaaa

SEQ ID NO: 3932414 - RNA, 20 nt, Shigella flexneri 2a str. 301
ugaauaaaguuuuaguugcc

SEQ ID NO: 3932415 - RNA, 19 nt, Shigella flexneri 2a str. 301
ugaauaaauuggcuggggu

SEQ ID NO: 3932416 - RNA, 16 nt, Shigella flexneri 2a str. 301
ugaauaacaccagcca

SEQ ID NO: 3932417 - RNA, 18 nt, Shigella flexneri 2a str. 301
ugaauaccaagucucaag

SEQ ID NO: 3932418 - RNA, 17 nt, Shigella flexneri 2a str. 301
ugaauaucuccucugcu

SEQ ID NO: 3932419 - RNA, 14 nt, Shigella flexneri 2a str. 301
ugaauaucuuucuc

SEQ ID NO: 3932420 - RNA, 16 nt, Shigella flexneri 2a str. 301
ugaauauuccuuaugg

SEQ ID NO: 3932421 - RNA, 17 nt, Shigella flexneri 2a str. 301
ugaauauucggcuccag

SEQ ID NO: 3932422 - RNA, 22 nt, Shigella flexneri 2a str. 301
ugaauauugccggaugugaugc

SEQ ID NO: 3932423 - RNA, 17 nt, Shigella flexneri 2a str. 301
ugaaucaaaaucaucau

SEQ ID NO: 3932424 - RNA, 18 nt, Shigella flexneri 2a str. 301
ugaaucaaaaucaucauc

SEQ ID NO: 3932425 - RNA, 22 nt, Shigella flexneri 2a str. 301
ugaaucaaaaucaucaucuuua

SEQ ID NO: 3932426 - RNA, 13 nt, Shigella flexneri 2a str. 301
ugaaucaacacca

SEQ ID NO: 3932427 - RNA, 16 nt, Shigella flexneri 2a str. 301
ugaaucaaucagagcc

SEQ ID NO: 3932428 - RNA, 18 nt, Shigella flexneri 2a str. 301
ugaaucagaagacgauaa

SEQ ID NO: 3932429 - RNA, 23 nt, Shigella flexneri 2a str. 301
ugaaucaucguucauauauuccu

SEQ ID NO: 3932430 - RNA, 14 nt, Shigella flexneri 2a str. 301
ugaauccaucugua

SEQ ID NO: 3932431 - RNA, 22 nt, Shigella flexneri 2a str. 301
ugaaucccugcgaacugcgcag

SEQ ID NO: 3932432 - RNA, 23 nt, Shigella flexneri 2a str. 301
ugaaucgggaucaccuguucguc

SEQ ID NO: 3932433 - RNA, 20 nt, Shigella flexneri 2a str. 301
ugaaucgggcgugauuccag

SEQ ID NO: 3932434 - RNA, 22 nt, Shigella flexneri 2a str. 301
ugaaucgucagacgaugcgucu

SEQ ID NO: 3932435 - RNA, 23 nt, Shigella flexneri 2a str. 301
ugaaucucuuaucauccagguga

SEQ ID NO: 3932436 - RNA, 16 nt, Shigella flexneri 2a str. 301
ugaaucuuuucaucgc

SEQ ID NO: 3932437 - RNA, 12 nt, Shigella flexneri 2a str. 301
ugaaugaggcuu

SEQ ID NO: 3932438 - RNA, 14 nt, Shigella flexneri 2a str. 301
ugaaugaguacuga

SEQ ID NO: 3932439 - RNA, 16 nt, Shigella flexneri 2a str. 301
ugaaugaguacugaug

SEQ ID NO: 3932440 - RNA, 18 nt, Shigella flexneri 2a str. 301
ugaaugauaaaauucauu

SEQ ID NO: 3932441 - RNA, 22 nt, Shigella flexneri 2a str. 301
ugaaugccaaauccggcaaaua

SEQ ID NO: 3932442 - RNA, 19 nt, Shigella flexneri 2a str. 301
ugaaugccccuuuaaauac

SEQ ID NO: 3932443 - RNA, 15 nt, Shigella flexneri 2a str. 301
ugaaugccgcuaccg

SEQ ID NO: 3932444 - RNA, 19 nt, Shigella flexneri 2a str. 301
ugaaugccggaugcggcgu

SEQ ID NO: 3932445 - RNA, 19 nt, Shigella flexneri 2a str. 301
ugaaugccguaggcccagc

SEQ ID NO: 3932446 - RNA, 12 nt, Shigella flexneri 2a str. 301
ugaaugccugau

SEQ ID NO: 3932447 - RNA, 17 nt, Shigella flexneri 2a str. 301
ugaaugcggcaggcaca

SEQ ID NO: 3932448 - RNA, 14 nt, Shigella flexneri 2a str. 301
ugaaugcuuucaua

SEQ ID NO: 3932449 - RNA, 15 nt, Shigella flexneri 2a str. 301
ugaauguugcgcggu

SEQ ID NO: 3932450 - RNA, 21 nt, Shigella flexneri 2a str. 301
ugaauuaaacacgggguuaaa

SEQ ID NO: 3932451 - RNA, 14 nt, Shigella flexneri 2a str. 301
ugaauuaaugccuc

SEQ ID NO: 3932452 - RNA, 15 nt, Shigella flexneri 2a str. 301
ugaauuacuucucuu

SEQ ID NO: 3932453 - RNA, 19 nt, Shigella flexneri 2a str. 301
ugaauuccgaauuucaucc

SEQ ID NO: 3932454 - RNA, 23 nt, Shigella flexneri 2a str. 301
ugaauuccgaauuucauccugua

SEQ ID NO: 3932455 - RNA, 23 nt, Shigella flexneri 2a str. 301
ugaauugaaaaguccaggcugca

SEQ ID NO: 3932456 - RNA, 20 nt, Shigella flexneri 2a str. 301
ugaauugcacgaaggugcau

SEQ ID NO: 3932457 - RNA, 14 nt, Shigella flexneri 2a str. 301
ugaauuguuuuaua

SEQ ID NO: 3932458 - RNA, 23 nt, Shigella flexneri 2a str. 301
ugaauuuuaggaugcugcaauaa

SEQ ID NO: 3932459 - RNA, 16 nt, Shigella flexneri 2a str. 301
ugacaaacacaaaacu

SEQ ID NO: 3932460 - RNA, 22 nt, Shigella flexneri 2a str. 301
ugacaaacgcaaaacugccuga

SEQ ID NO: 3932461 - RNA, 23 nt, Shigella flexneri 2a str. 301
ugacaaacgcaacauugccugau

SEQ ID NO: 3932462 - RNA, 18 nt, Shigella flexneri 2a str. 301
ugacaaagugcgcguugu

SEQ ID NO: 3932463 - RNA, 23 nt, Shigella flexneri 2a str. 301
ugacaaaucagaggcuguuccgg

SEQ ID NO: 3932464 - RNA, 22 nt, Shigella flexneri 2a str. 301
ugacaaaucaugcggauauaaa

SEQ ID NO: 3932465 - RNA, 20 nt, Shigella flexneri 2a str. 301
ugacaacaucuuugcggcua

SEQ ID NO: 3932466 - RNA, 20 nt, Shigella flexneri 2a str. 301
ugacaacguagcguuaaaac

SEQ ID NO: 3932467 - RNA, 18 nt, Shigella flexneri 2a str. 301
ugacaacucaucacugua

SEQ ID NO: 3932468 - RNA, 18 nt, Shigella flexneri 2a str. 301
ugacaacuuucaucagca

SEQ ID NO: 3932469 - RNA, 21 nt, Shigella flexneri 2a str. 301
ugacaacuuucaucagcacaa

SEQ ID NO: 3932470 - RNA, 23 nt, Shigella flexneri 2a str. 301
ugacaagcguaugauugccugau

SEQ ID NO: 3932471 - RNA, 15 nt, Shigella flexneri 2a str. 301
ugacacaaucaaauc

SEQ ID NO: 3932472 - RNA, 16 nt, Shigella flexneri 2a str. 301
ugacacaaucaaaucc

SEQ ID NO: 3932473 - RNA, 19 nt, Shigella flexneri 2a str. 301
ugacacaaucaaauccugc

SEQ ID NO: 3932474 - RNA, 18 nt, Shigella flexneri 2a str. 301
ugacacaucaccuccagc

SEQ ID NO: 3932475 - RNA, 11 nt, Shigella flexneri 2a str. 301
ugacaccagca

SEQ ID NO: 3932476 - RNA, 16 nt, Shigella flexneri 2a str. 301
ugacaccagcacauca

SEQ ID NO: 3932477 - RNA, 16 nt, Shigella flexneri 2a str. 301
ugacaccagcauaaua

SEQ ID NO: 3932478 - RNA, 16 nt, Shigella flexneri 2a str. 301
ugacacgaauacggga

SEQ ID NO: 3932479 - RNA, 24 nt, Shigella flexneri 2a str. 301
ugacacgggaaaccaacuccagcg

SEQ ID NO: 3932480 - RNA, 22 nt, Shigella flexneri 2a str. 301
ugacacuucauuaaccacgauc

SEQ ID NO: 3932481 - RNA, 18 nt, Shigella flexneri 2a str. 301
ugacagaaacuggcugau

SEQ ID NO: 3932482 - RNA, 16 nt, Shigella flexneri 2a str. 301
ugacagacuccgccuc

SEQ ID NO: 3932483 - RNA, 20 nt, Shigella flexneri 2a str. 301
ugacucaaugaaauccauug

SEQ ID NO: 3932484 - RNA, 20 nt, Shigella flexneri 2a str. 301
ugacucaauggcauccgcca

SEQ ID NO: 3932485 - RNA, 19 nt, Shigella flexneri 2a str. 301
ugacucagaccauauuccc

SEQ ID NO: 3932486 - RNA, 12 nt, Shigella flexneri 2a str. 301
ugacuccccgau

SEQ ID NO: 3932487 - RNA, 21 nt, Shigella flexneri 2a str. 301
ugacucggagucgacuucaga

SEQ ID NO: 3932488 - RNA, 14 nt, Shigella flexneri 2a str. 301
ugacucucauccaa

SEQ ID NO: 3932489 - RNA, 21 nt, Shigella flexneri 2a str. 301
ugacucuccccguuuuccggg

SEQ ID NO: 3932490 - RNA, 12 nt, Shigella flexneri 2a str. 301
ugacucuuguaa

SEQ ID NO: 3932491 - RNA, 18 nt, Shigella flexneri 2a str. 301
ugacucuuguaacagagu

SEQ ID NO: 3932492 - RNA, 23 nt, Shigella flexneri 2a str. 301
ugacugaagaaaucccccagcau

SEQ ID NO: 3932493 - RNA, 21 nt, Shigella flexneri 2a str. 301
ugacugaaucaggaaccacaa

SEQ ID NO: 3932494 - RNA, 17 nt, Shigella flexneri 2a str. 301
ugacugauaacgcggca

SEQ ID NO: 3932495 - RNA, 18 nt, Shigella flexneri 2a str. 301
ugacugaugcuuuccgcc

SEQ ID NO: 3932496 - RNA, 20 nt, Shigella flexneri 2a str. 301
ugacugcgccacuucccagc

SEQ ID NO: 3932497 - RNA, 15 nt, Shigella flexneri 2a str. 301
ugacugcggcguggg

SEQ ID NO: 3932498 - RNA, 19 nt, Shigella flexneri 2a str. 301
ugacugcuuugcacaggca

SEQ ID NO: 3932499 - RNA, 22 nt, Shigella flexneri 2a str. 301
ugacugcuuuuacaaaaucuuc

SEQ ID NO: 3932500 - RNA, 16 nt, Shigella flexneri 2a str. 301
ugacuggcucuuuuuc

SEQ ID NO: 3932501 - RNA, 19 nt, Shigella flexneri 2a str. 301
ugacuguaggccggauaag

SEQ ID NO: 3932502 - RNA, 17 nt, Shigella flexneri 2a str. 301
ugacuucugccagcugc

SEQ ID NO: 3932503 - RNA, 21 nt, Shigella flexneri 2a str. 301
ugacuuucuggcacgaccugg

SEQ ID NO: 3932504 - RNA, 18 nt, Shigella flexneri 2a str. 301
ugacuuuuacagcuuagc

SEQ ID NO: 3932505 - RNA, 16 nt, Shigella flexneri 2a str. 301
ugacuuuugcccggca

SEQ ID NO: 3932506 - RNA, 19 nt, Shigella flexneri 2a str. 301
ugacuuuugcccggcauga

SEQ ID NO: 3932507 - RNA, 14 nt, Shigella flexneri 2a str. 301
ugagaaaauuucau

SEQ ID NO: 3932508 - RNA, 16 nt, Shigella flexneri 2a str. 301
ugagaaaauuucauua

SEQ ID NO: 3932509 - RNA, 17 nt, Shigella flexneri 2a str. 301
ugagaaacucaguugau

SEQ ID NO: 3932510 - RNA, 18 nt, Shigella flexneri 2a str. 301
ugagaaacucauuugauu

SEQ ID NO: 3932511 - RNA, 21 nt, Shigella flexneri 2a str. 301
ugagaaauuaacgucaccauc

SEQ ID NO: 3932512 - RNA, 22 nt, Shigella flexneri 2a str. 301
ugagaacaagauugccugaugc

SEQ ID NO: 3932513 - RNA, 17 nt, Shigella flexneri 2a str. 301
ugagaacaccaccugcc

SEQ ID NO: 3932514 - RNA, 19 nt, Shigella flexneri 2a str. 301
ugagaaccuuuaucacugu

SEQ ID NO: 3932515 - RNA, 17 nt, Shigella flexneri 2a str. 301
ugagaacgacagugacu

SEQ ID NO: 3932516 - RNA, 18 nt, Shigella flexneri 2a str. 301
ugagaacgacagugacuu

SEQ ID NO: 3932517 - RNA, 14 nt, Shigella flexneri 2a str. 301
ugagaacgcccauc

SEQ ID NO: 3932518 - RNA, 14 nt, Shigella flexneri 2a str. 301
ugagacgcacccuc

SEQ ID NO: 3932519 - RNA, 16 nt, Shigella flexneri 2a str. 301
ugagagaaaaaaaagc

SEQ ID NO: 3932520 - RNA, 15 nt, Shigella flexneri 2a str. 301
ugagagcaugaaaug

SEQ ID NO: 3932521 - RNA, 19 nt, Shigella flexneri 2a str. 301
ugagagcaugaaaugaaaa

SEQ ID NO: 3932522 - RNA, 22 nt, Shigella flexneri 2a str. 301
ugagaggaaaaaaauuaacgca

SEQ ID NO: 3932523 - RNA, 17 nt, Shigella flexneri 2a str. 301
ugagagggcgauaaauc

SEQ ID NO: 3932524 - RNA, 20 nt, Shigella flexneri 2a str. 301
ugagauagcaucuuccagcg

SEQ ID NO: 3932525 - RNA, 14 nt, Shigella flexneri 2a str. 301
ugagauauuuaaau

SEQ ID NO: 3932526 - RNA, 14 nt, Shigella flexneri 2a str. 301
ugagaucacugcaa

SEQ ID NO: 3932527 - RNA, 22 nt, Shigella flexneri 2a str. 301
ugagaugacgccacuggcuggg

SEQ ID NO: 3932528 - RNA, 20 nt, Shigella flexneri 2a str. 301
ugagauggcuucaucccagu

SEQ ID NO: 3932529 - RNA, 15 nt, Shigella flexneri 2a str. 301
ugagauucaaauaag

SEQ ID NO: 3932530 - RNA, 21 nt, Shigella flexneri 2a str. 301
ugagauuuauuuaccgcuacu

SEQ ID NO: 3932531 - RNA, 13 nt, Shigella flexneri 2a str. 301
ugagcaaacaguu

SEQ ID NO: 3932532 - RNA, 19 nt, Shigella flexneri 2a str. 301
ugagcaaacaguucugcag

SEQ ID NO: 3932533 - RNA, 20 nt, Shigella flexneri 2a str. 301
ugagcaaacaguucugcagc

SEQ ID NO: 3932534 - RNA, 22 nt, Shigella flexneri 2a str. 301
ugagcaaauccgcacucaucuu

SEQ ID NO: 3932535 - RNA, 20 nt, Shigella flexneri 2a str. 301
ugagcaccuuuuuucugucu

SEQ ID NO: 3932536 - RNA, 13 nt, Shigella flexneri 2a str. 301
ugagcacuggggc

SEQ ID NO: 3932537 - RNA, 13 nt, Shigella flexneri 2a str. 301
ugagcacuuuucu

SEQ ID NO: 3932538 - RNA, 12 nt, Shigella flexneri 2a str. 301
ugagcagaaaaa

SEQ ID NO: 3932539 - RNA, 17 nt, Shigella flexneri 2a str. 301
ugagcagaaccuuuuuu

SEQ ID NO: 3932540 - RNA, 16 nt, Shigella flexneri 2a str. 301
ugagcagaccaauaac

SEQ ID NO: 3932541 - RNA, 16 nt, Shigella flexneri 2a str. 301
ugagcagccaccacuu

SEQ ID NO: 3932542 - RNA, 17 nt, Shigella flexneri 2a str. 301
ugagcaggagcagcagg

SEQ ID NO: 3932543 - RNA, 17 nt, Shigella flexneri 2a str. 301
ugagcaguccccacauc

SEQ ID NO: 3932544 - RNA, 18 nt, Shigella flexneri 2a str. 301
ugagcaguuuucacccuu

SEQ ID NO: 3932545 - RNA, 12 nt, Shigella flexneri 2a str. 301
ugagcaugaugc

SEQ ID NO: 3932546 - RNA, 19 nt, Shigella flexneri 2a str. 301
ugagccaggacgauaaacc

SEQ ID NO: 3932547 - RNA, 21 nt, Shigella flexneri 2a str. 301
ugagccagugccgaaaugucu

SEQ ID NO: 3932548 - RNA, 21 nt, Shigella flexneri 2a str. 301
ugagccggaguugcagauuug

SEQ ID NO: 3932549 - RNA, 17 nt, Shigella flexneri 2a str. 301
ugagcgauuaucgccau

SEQ ID NO: 3932550 - RNA, 17 nt, Shigella flexneri 2a str. 301
ugagcggacugaacgcg

SEQ ID NO: 3932551 - RNA, 21 nt, Shigella flexneri 2a str. 301
ugagcggacugaacgcggccc

SEQ ID NO: 3932552 - RNA, 18 nt, Shigella flexneri 2a str. 301
ugagcgguuucgccuccu

SEQ ID NO: 3932553 - RNA, 16 nt, Shigella flexneri 2a str. 301
ugagcguaaagaaccu

SEQ ID NO: 3932554 - RNA, 21 nt, Shigella flexneri 2a str. 301
ugagcguaaagaaccucuuca

SEQ ID NO: 3932555 - RNA, 15 nt, Shigella flexneri 2a str. 301
ugagcguauccagca

SEQ ID NO: 3932556 - RNA, 13 nt, Shigella flexneri 2a str. 301
ugagcgucauuau

SEQ ID NO: 3932557 - RNA, 17 nt, Shigella flexneri 2a str. 301
ugagcgucgcaucuggc

SEQ ID NO: 3932558 - RNA, 12 nt, Shigella flexneri 2a str. 301
ugagcguuaccc

SEQ ID NO: 3932559 - RNA, 14 nt, Shigella flexneri 2a str. 301
ugagcguuucaaaa

SEQ ID NO: 3932560 - RNA, 18 nt, Shigella flexneri 2a str. 301
ugagcuaaugcaaaucac

SEQ ID NO: 3932561 - RNA, 23 nt, Shigella flexneri 2a str. 301
ugagcuaaugcaaaucacgcugc

SEQ ID NO: 3932562 - RNA, 17 nt, Shigella flexneri 2a str. 301
ugagcuggucugaauca

SEQ ID NO: 3932563 - RNA, 22 nt, Shigella flexneri 2a str. 301
ugaggaucaccaguccaucggc

SEQ ID NO: 3932564 - RNA, 14 nt, Shigella flexneri 2a str. 301
ugaggaugcggguc

SEQ ID NO: 3932565 - RNA, 17 nt, Shigella flexneri 2a str. 301
ugaggaugcuaaggcug

SEQ ID NO: 3932566 - RNA, 20 nt, Shigella flexneri 2a str. 301
ugaggauuacgucuuuacua

SEQ ID NO: 3932567 - RNA, 21 nt, Shigella flexneri 2a str. 301
ugaggauuacgucuuuacuaa

SEQ ID NO: 3932568 - RNA, 16 nt, Shigella flexneri 2a str. 301
ugaggauucacacagu

SEQ ID NO: 3932569 - RNA, 17 nt, Shigella flexneri 2a str. 301
ugaggcagcaaggaaaa

SEQ ID NO: 3932570 - RNA, 23 nt, Shigella flexneri 2a str. 301
ugaggcggucuggauuuggcugc

SEQ ID NO: 3932571 - RNA, 16 nt, Shigella flexneri 2a str. 301
ugaggcugaccccaac

SEQ ID NO: 3932572 - RNA, 22 nt, Shigella flexneri 2a str. 301
ugaggcuuuaauaccugccugg

SEQ ID NO: 3932573 - RNA, 16 nt, Shigella flexneri 2a str. 301
ugagggcaaacaccgc

SEQ ID NO: 3932574 - RNA, 23 nt, Shigella flexneri 2a str. 301
ugaggguguuggaacccgcagcc

SEQ ID NO: 3932575 - RNA, 16 nt, Shigella flexneri 2a str. 301
ugagguccagcgagcc

SEQ ID NO: 3932576 - RNA, 20 nt, Shigella flexneri 2a str. 301
ugagguggccgagaggcuga

SEQ ID NO: 3932577 - RNA, 23 nt, Shigella flexneri 2a str. 301
ugagguuguggcauuagauauuu

SEQ ID NO: 3932578 - RNA, 16 nt, Shigella flexneri 2a str. 301
ugaguaauaacuuccu

SEQ ID NO: 3932579 - RNA, 13 nt, Shigella flexneri 2a str. 301
ugaguacugauga

SEQ ID NO: 3932580 - RNA, 18 nt, Shigella flexneri 2a str. 301
ugaguacugaugaauaaa

SEQ ID NO: 3932581 - RNA, 14 nt, Shigella flexneri 2a str. 301
ugaguaucaauuau

SEQ ID NO: 3932582 - RNA, 19 nt, Shigella flexneri 2a str. 301
ugaguauuacuuuguaaau

SEQ ID NO: 3932583 - RNA, 11 nt, Shigella flexneri 2a str. 301
ugaugaaucag

SEQ ID NO: 3932584 - RNA, 18 nt, Shigella flexneri 2a str. 301
ugaugacguaauccgccu

SEQ ID NO: 3932585 - RNA, 16 nt, Shigella flexneri 2a str. 301
ugaugagcgauaaaca

SEQ ID NO: 3932586 - RNA, 17 nt, Shigella flexneri 2a str. 301
ugaugaggcauaagcga

SEQ ID NO: 3932587 - RNA, 15 nt, Shigella flexneri 2a str. 301
ugaugaguugaaaac

SEQ ID NO: 3932588 - RNA, 16 nt, Shigella flexneri 2a str. 301
ugaugauuaacagcaa

SEQ ID NO: 3932589 - RNA, 14 nt, Shigella flexneri 2a str. 301
ugaugcauaaaaaa

SEQ ID NO: 3932590 - RNA, 17 nt, Shigella flexneri 2a str. 301
ugaugcauuguuugcaa

SEQ ID NO: 3932591 - RNA, 22 nt, Shigella flexneri 2a str. 301
ugaugcauuuuuuagugauuaa

SEQ ID NO: 3932592 - RNA, 16 nt, Shigella flexneri 2a str. 301
ugaugccagcgaggua

SEQ ID NO: 3932593 - RNA, 11 nt, Shigella flexneri 2a str. 301
ugaugccaucg

SEQ ID NO: 3932594 - RNA, 14 nt, Shigella flexneri 2a str. 301
ugaugccaucgggc

SEQ ID NO: 3932595 - RNA, 21 nt, Shigella flexneri 2a str. 301
ugaugccgccagacugcgaga

SEQ ID NO: 3932596 - RNA, 16 nt, Shigella flexneri 2a str. 301
ugaugccgguuuuaca

SEQ ID NO: 3932597 - RNA, 19 nt, Shigella flexneri 2a str. 301
ugaugccgguuuuacagaa

SEQ ID NO: 3932598 - RNA, 15 nt, Shigella flexneri 2a str. 301
ugaugccguuuaugc

SEQ ID NO: 3932599 - RNA, 15 nt, Shigella flexneri 2a str. 301
ugaugcgacgcuggc

SEQ ID NO: 3932600 - RNA, 21 nt, Shigella flexneri 2a str. 301
ugaugcgacgcuugacgcguc

SEQ ID NO: 3932601 - RNA, 14 nt, Shigella flexneri 2a str. 301
ugaugcgacuuguc

SEQ ID NO: 3932602 - RNA, 19 nt, Shigella flexneri 2a str. 301
ugaugcgacuugucaucau

SEQ ID NO: 3932603 - RNA, 18 nt, Shigella flexneri 2a str. 301
ugaugcgaguaaucaggc

SEQ ID NO: 3932604 - RNA, 22 nt, Shigella flexneri 2a str. 301
ugaugcgcuacgcuuaucaggc

SEQ ID NO: 3932605 - RNA, 14 nt, Shigella flexneri 2a str. 301
ugaugcgcuaugcu

SEQ ID NO: 3932606 - RNA, 21 nt, Shigella flexneri 2a str. 301
ugaugcgcugcgcuuaucagg

SEQ ID NO: 3932607 - RNA, 23 nt, Shigella flexneri 2a str. 301
ugaugcgcuucgcuuaccaugcc

SEQ ID NO: 3932608 - RNA, 19 nt, Shigella flexneri 2a str. 301
ugaugcgcuucgcuuauca

SEQ ID NO: 3932609 - RNA, 22 nt, Shigella flexneri 2a str. 301
ugaugcgugagguaacaauaaa

SEQ ID NO: 3932610 - RNA, 20 nt, Shigella flexneri 2a str. 301
ugaugcguugcgcuucucag

SEQ ID NO: 3932611 - RNA, 16 nt, Shigella flexneri 2a str. 301
ugaugcucuugaaaug

SEQ ID NO: 3932612 - RNA, 14 nt, Shigella flexneri 2a str. 301
ugauggaauuucau

SEQ ID NO: 3932613 - RNA, 17 nt, Shigella flexneri 2a str. 301
ugauggaauuucaucau

SEQ ID NO: 3932614 - RNA, 21 nt, Shigella flexneri 2a str. 301
ugauggacauucuccggcagg

SEQ ID NO: 3932615 - RNA, 22 nt, Shigella flexneri 2a str. 301
ugauggccagauaacccagggg

SEQ ID NO: 3932616 - RNA, 13 nt, Shigella flexneri 2a str. 301
ugaugggcagaau

SEQ ID NO: 3932617 - RNA, 16 nt, Shigella flexneri 2a str. 301
ugaugggcagaauaac

SEQ ID NO: 3932618 - RNA, 15 nt, Shigella flexneri 2a str. 301
ugaugggcgaagaga

SEQ ID NO: 3932619 - RNA, 23 nt, Shigella flexneri 2a str. 301
ugaugguaugcgaagguggcgga

SEQ ID NO: 3932620 - RNA, 13 nt, Shigella flexneri 2a str. 301
ugauggugguggg

SEQ ID NO: 3932621 - RNA, 16 nt, Shigella flexneri 2a str. 301
ugauggugguggggga

SEQ ID NO: 3932622 - RNA, 14 nt, Shigella flexneri 2a str. 301
ugaugucacagccg

SEQ ID NO: 3932623 - RNA, 15 nt, Shigella flexneri 2a str. 301
ugauguccugcaucc

SEQ ID NO: 3932624 - RNA, 19 nt, Shigella flexneri 2a str. 301
ugaugucggcauaaagcug

SEQ ID NO: 3932625 - RNA, 16 nt, Shigella flexneri 2a str. 301
ugaugugauccaucag

SEQ ID NO: 3932626 - RNA, 18 nt, Shigella flexneri 2a str. 301
ugauguuggcgaaucgac

SEQ ID NO: 3932627 - RNA, 14 nt, Shigella flexneri 2a str. 301
ugauuaacaggcug

SEQ ID NO: 3932628 - RNA, 11 nt, Shigella flexneri 2a str. 301
ugauuaacgca

SEQ ID NO: 3932629 - RNA, 19 nt, Shigella flexneri 2a str. 301
ugauuaacgcuuguaaaug

SEQ ID NO: 3932630 - RNA, 20 nt, Shigella flexneri 2a str. 301
ugauuaacgcuuguaaauga

SEQ ID NO: 3932631 - RNA, 23 nt, Shigella flexneri 2a str. 301
ugauuaacgcuuguaaaugaacu

SEQ ID NO: 3932632 - RNA, 20 nt, Shigella flexneri 2a str. 301
ugauuacacaaauccagcac

SEQ ID NO: 3932633 - RNA, 16 nt, Shigella flexneri 2a str. 301
ugauuaccaauaucaa

SEQ ID NO: 3932634 - RNA, 20 nt, Shigella flexneri 2a str. 301
ugauuaccaauaucaaauaa

SEQ ID NO: 3932635 - RNA, 15 nt, Shigella flexneri 2a str. 301
ugauuacuaaaugug

SEQ ID NO: 3932636 - RNA, 23 nt, Shigella flexneri 2a str. 301
ugauuacuuccuucauggggaug

SEQ ID NO: 3932637 - RNA, 14 nt, Shigella flexneri 2a str. 301
ugauuaucgaucau

SEQ ID NO: 3932638 - RNA, 15 nt, Shigella flexneri 2a str. 301
ugauuaugucaucau

SEQ ID NO: 3932639 - RNA, 22 nt, Shigella flexneri 2a str. 301
ugauuauuggacgguaaaaaga

SEQ ID NO: 3932640 - RNA, 11 nt, Shigella flexneri 2a str. 301
ugauucacaag

SEQ ID NO: 3932641 - RNA, 14 nt, Shigella flexneri 2a str. 301
ugauucacaguuaa

SEQ ID NO: 3932642 - RNA, 12 nt, Shigella flexneri 2a str. 301
ugauucagauaa

SEQ ID NO: 3932643 - RNA, 20 nt, Shigella flexneri 2a str. 301
ugauucauaaagcagccuau

SEQ ID NO: 3932644 - RNA, 20 nt, Shigella flexneri 2a str. 301
ugauucauaguaagcagauu

SEQ ID NO: 3932645 - RNA, 19 nt, Shigella flexneri 2a str. 301
ugauucaucucuucuuccg

SEQ ID NO: 3932646 - RNA, 19 nt, Shigella flexneri 2a str. 301
ugauucauggcauuuucuc

SEQ ID NO: 3932647 - RNA, 18 nt, Shigella flexneri 2a str. 301
ugauuccggcaaauaaca

SEQ ID NO: 3932648 - RNA, 11 nt, Shigella flexneri 2a str. 301
ugauuccugca

SEQ ID NO: 3932649 - RNA, 22 nt, Shigella flexneri 2a str. 301
ugauucgaucaaacaauuuuca

SEQ ID NO: 3932650 - RNA, 16 nt, Shigella flexneri 2a str. 301
ugauucgauucacauu

SEQ ID NO: 3932651 - RNA, 17 nt, Shigella flexneri 2a str. 301
ugauucucccucaucau

SEQ ID NO: 3932652 - RNA, 17 nt, Shigella flexneri 2a str. 301
ugauucugagaaacuca

SEQ ID NO: 3932653 - RNA, 16 nt, Shigella flexneri 2a str. 301
ugauucugauccugca

SEQ ID NO: 3932654 - RNA, 14 nt, Shigella flexneri 2a str. 301
ugauugaacugugg

SEQ ID NO: 3932655 - RNA, 18 nt, Shigella flexneri 2a str. 301
ugauugagcugcccggcu

SEQ ID NO: 3932656 - RNA, 13 nt, Shigella flexneri 2a str. 301
ugauugccucagu

SEQ ID NO: 3932657 - RNA, 15 nt, Shigella flexneri 2a str. 301
ugauugccuuccacc

SEQ ID NO: 3932658 - RNA, 19 nt, Shigella flexneri 2a str. 301
ugauugcuuuaucaaucac

SEQ ID NO: 3932659 - RNA, 16 nt, Shigella flexneri 2a str. 301
ugauuggcaucaucag

SEQ ID NO: 3932660 - RNA, 22 nt, Shigella flexneri 2a str. 301
ugauuggcgcgaaccaucaccu

SEQ ID NO: 3932661 - RNA, 18 nt, Shigella flexneri 2a str. 301
ugauugggucauuuccca

SEQ ID NO: 3932662 - RNA, 12 nt, Shigella flexneri 2a str. 301
ugauugucggug

SEQ ID NO: 3932663 - RNA, 18 nt, Shigella flexneri 2a str. 301
ugauuguggcaaucauau

SEQ ID NO: 3932664 - RNA, 20 nt, Shigella flexneri 2a str. 301
ugauuuaaaaccacuaccca

SEQ ID NO: 3932665 - RNA, 14 nt, Shigella flexneri 2a str. 301
ugauuucacacaua

SEQ ID NO: 3932666 - RNA, 20 nt, Shigella flexneri 2a str. 301
ugauuucaccugcauuugcu

SEQ ID NO: 3932667 - RNA, 20 nt, Shigella flexneri 2a str. 301
ugauuuccugcgugacuaaa

SEQ ID NO: 3932668 - RNA, 21 nt, Shigella flexneri 2a str. 301
ugauuucguccauguuggaga

SEQ ID NO: 3932669 - RNA, 20 nt, Shigella flexneri 2a str. 301
ugauuucuggcggauuuuua

SEQ ID NO: 3932670 - RNA, 18 nt, Shigella flexneri 2a str. 301
ugauuuucaccagcaucg

SEQ ID NO: 3932671 - RNA, 17 nt, Shigella flexneri 2a str. 301
ugauuuugauggaagaa

SEQ ID NO: 3932672 - RNA, 20 nt, Shigella flexneri 2a str. 301
ugauuuugccugugcaaccu

SEQ ID NO: 3932673 - RNA, 18 nt, Shigella flexneri 2a str. 301
ugauuuuucguuuuaaug

SEQ ID NO: 3932674 - RNA, 19 nt, Shigella flexneri 2a str. 301
ugauuuuuuccaacaggcg

SEQ ID NO: 3932675 - RNA, 22 nt, Shigella flexneri 2a str. 301
ugcaaaaaauugcgucaguauu

SEQ ID NO: 3932676 - RNA, 13 nt, Shigella flexneri 2a str. 301
ugcaaaaccuggu

SEQ ID NO: 3932677 - RNA, 17 nt, Shigella flexneri 2a str. 301
ugcaaaauaccaauaau

SEQ ID NO: 3932678 - RNA, 22 nt, Shigella flexneri 2a str. 301
ugcaaaauagucaucucuuccg

SEQ ID NO: 3932679 - RNA, 16 nt, Shigella flexneri 2a str. 301
ugcaaaauauggggca

SEQ ID NO: 3932680 - RNA, 12 nt, Shigella flexneri 2a str. 301
ugcaaaaucaaa

SEQ ID NO: 3932681 - RNA, 22 nt, Shigella flexneri 2a str. 301
ugcaaaauuuucauugccgcau

SEQ ID NO: 3932682 - RNA, 13 nt, Shigella flexneri 2a str. 301
ugcaaacauuuca

SEQ ID NO: 3932683 - RNA, 18 nt, Shigella flexneri 2a str. 301
ugcagaccgcugacggca

SEQ ID NO: 3932684 - RNA, 20 nt, Shigella flexneri 2a str. 301
ugcagaguauccaugcgcau

SEQ ID NO: 3932685 - RNA, 15 nt, Shigella flexneri 2a str. 301
ugcagauaccacauc

SEQ ID NO: 3932686 - RNA, 22 nt, Shigella flexneri 2a str. 301
ugcagauauucaugcaggccau

SEQ ID NO: 3932687 - RNA, 22 nt, Shigella flexneri 2a str. 301
ugcagaucguuuuccugcauua

SEQ ID NO: 3932688 - RNA, 13 nt, Shigella flexneri 2a str. 301
ugcagauuaagcg

SEQ ID NO: 3932689 - RNA, 19 nt, Shigella flexneri 2a str. 301
ugcagauuugccaguaccg

SEQ ID NO: 3932690 - RNA, 20 nt, Shigella flexneri 2a str. 301
ugcagcaaacgauucaaaag

SEQ ID NO: 3932691 - RNA, 14 nt, Shigella flexneri 2a str. 301
ugcagcaagccauc

SEQ ID NO: 3932692 - RNA, 17 nt, Shigella flexneri 2a str. 301
ugcagcacggagagacg

SEQ ID NO: 3932693 - RNA, 19 nt, Shigella flexneri 2a str. 301
ugcagccagcgucacccag

SEQ ID NO: 3932694 - RNA, 14 nt, Shigella flexneri 2a str. 301
ugcagccaggccau

SEQ ID NO: 3932695 - RNA, 20 nt, Shigella flexneri 2a str. 301
ugcagccagugauuaacgcg

SEQ ID NO: 3932696 - RNA, 16 nt, Shigella flexneri 2a str. 301
ugcagcccagcaucag

SEQ ID NO: 3932697 - RNA, 17 nt, Shigella flexneri 2a str. 301
ugcagcccagcaucaga

SEQ ID NO: 3932698 - RNA, 16 nt, Shigella flexneri 2a str. 301
ugcagcccguaagcaa

SEQ ID NO: 3932699 - RNA, 15 nt, Shigella flexneri 2a str. 301
ugcagccggagcuuc

SEQ ID NO: 3932700 - RNA, 22 nt, Shigella flexneri 2a str. 301
ugcagccuucauucaggcauug

SEQ ID NO: 3932701 - RNA, 19 nt, Shigella flexneri 2a str. 301
ugcagcgcaaucgccucca

SEQ ID NO: 3932702 - RNA, 22 nt, Shigella flexneri 2a str. 301
ugcagcggaucgccgccggaga

SEQ ID NO: 3932703 - RNA, 21 nt, Shigella flexneri 2a str. 301
ugcagcggucacauguuccag

SEQ ID NO: 3932704 - RNA, 13 nt, Shigella flexneri 2a str. 301
ugcagcguuucca

SEQ ID NO: 3932705 - RNA, 18 nt, Shigella flexneri 2a str. 301
ugcagcguuucgcgcgcg

SEQ ID NO: 3932706 - RNA, 21 nt, Shigella flexneri 2a str. 301
ugcagcucaucuaaugcaggg

SEQ ID NO: 3932707 - RNA, 14 nt, Shigella flexneri 2a str. 301
ugcagcuccaccga

SEQ ID NO: 3932708 - RNA, 21 nt, Shigella flexneri 2a str. 301
ugcagcuccaccgauuuugag

SEQ ID NO: 3932709 - RNA, 22 nt, Shigella flexneri 2a str. 301
ugcagcuuucccuucaggcgug

SEQ ID NO: 3932710 - RNA, 17 nt, Shigella flexneri 2a str. 301
ugcaggacuuaaccguu

SEQ ID NO: 3932711 - RNA, 23 nt, Shigella flexneri 2a str. 301
ugcaggagcgauuaugaaacaag

SEQ ID NO: 3932712 - RNA, 18 nt, Shigella flexneri 2a str. 301
ugcaggauuaauaaauuu

SEQ ID NO: 3932713 - RNA, 16 nt, Shigella flexneri 2a str. 301
ugcaggcaacagggaa

SEQ ID NO: 3932714 - RNA, 15 nt, Shigella flexneri 2a str. 301
ugcaggccaccaggc

SEQ ID NO: 3932715 - RNA, 23 nt, Shigella flexneri 2a str. 301
ugcaggccauguuuaccaucugc

SEQ ID NO: 3932716 - RNA, 18 nt, Shigella flexneri 2a str. 301
ugcaggcuucuggcggcg

SEQ ID NO: 3932717 - RNA, 14 nt, Shigella flexneri 2a str. 301
ugcaggucguccug

SEQ ID NO: 3932718 - RNA, 14 nt, Shigella flexneri 2a str. 301
ugcagguuaccggu

SEQ ID NO: 3932719 - RNA, 23 nt, Shigella flexneri 2a str. 301
ugcaguacaucguagugaugcca

SEQ ID NO: 3932720 - RNA, 20 nt, Shigella flexneri 2a str. 301
ugcagucauaaccaguccau

SEQ ID NO: 3932721 - RNA, 20 nt, Shigella flexneri 2a str. 301
ugcagucgcuguauuuugcg

SEQ ID NO: 3932722 - RNA, 21 nt, Shigella flexneri 2a str. 301
ugcagugaucgugugccacca

SEQ ID NO: 3932723 - RNA, 15 nt, Shigella flexneri 2a str. 301
ugcagugcaaugacu

SEQ ID NO: 3932724 - RNA, 19 nt, Shigella flexneri 2a str. 301
ugcagugcauccagcagcc

SEQ ID NO: 3932725 - RNA, 15 nt, Shigella flexneri 2a str. 301
ugcaguuccugcaac

SEQ ID NO: 3932726 - RNA, 17 nt, Shigella flexneri 2a str. 301
ugcaguuccugcaacuu

SEQ ID NO: 3932727 - RNA, 21 nt, Shigella flexneri 2a str. 301
ugcauaaacgccgucaucaca

SEQ ID NO: 3932728 - RNA, 18 nt, Shigella flexneri 2a str. 301
ugcauaaagcgguuuuca

SEQ ID NO: 3932729 - RNA, 19 nt, Shigella flexneri 2a str. 301
ugcauaacagauaaaucau

SEQ ID NO: 3932730 - RNA, 18 nt, Shigella flexneri 2a str. 301
ugcauaauccgccgcugu

SEQ ID NO: 3932731 - RNA, 13 nt, Shigella flexneri 2a str. 301
ugcauaauuucuu

SEQ ID NO: 3932732 - RNA, 17 nt, Shigella flexneri 2a str. 301
ugcauaauuucuucguu

SEQ ID NO: 3932733 - RNA, 16 nt, Shigella flexneri 2a str. 301
ugcauacaguacgugu

SEQ ID NO: 3932734 - RNA, 16 nt, Shigella flexneri 2a str. 301
ugcauaucucccagua

SEQ ID NO: 3932735 - RNA, 11 nt, Shigella flexneri 2a str. 301
ugcaucaacca

SEQ ID NO: 3932736 - RNA, 17 nt, Shigella flexneri 2a str. 301
ugcaucagaucggcagg

SEQ ID NO: 3932737 - RNA, 19 nt, Shigella flexneri 2a str. 301
ugcaucagcacgacuauua

SEQ ID NO: 3932738 - RNA, 13 nt, Shigella flexneri 2a str. 301
ugcaucagugaca

SEQ ID NO: 3932739 - RNA, 15 nt, Shigella flexneri 2a str. 301
ugcaucaugaaaacc

SEQ ID NO: 3932740 - RNA, 14 nt, Shigella flexneri 2a str. 301
ugcauccagcagcc

SEQ ID NO: 3932741 - RNA, 13 nt, Shigella flexneri 2a str. 301
ugcauccagcucg

SEQ ID NO: 3932742 - RNA, 20 nt, Shigella flexneri 2a str. 301
ugcaucccgccguaccggca

SEQ ID NO: 3932743 - RNA, 23 nt, Shigella flexneri 2a str. 301
ugcaucccucuuugucuuuugcu

SEQ ID NO: 3932744 - RNA, 23 nt, Shigella flexneri 2a str. 301
ugcauccggucagacaacuuccc

SEQ ID NO: 3932745 - RNA, 15 nt, Shigella flexneri 2a str. 301
ugcauccguucuucg

SEQ ID NO: 3932746 - RNA, 16 nt, Shigella flexneri 2a str. 301
ugcaucgaggaaaacc

SEQ ID NO: 3932747 - RNA, 14 nt, Shigella flexneri 2a str. 301
ugcaucgccaaucu

SEQ ID NO: 3932748 - RNA, 21 nt, Shigella flexneri 2a str. 301
ugcaucgccaaucugcugaua

SEQ ID NO: 3932749 - RNA, 18 nt, Shigella flexneri 2a str. 301
ugcaucguauugguacau

SEQ ID NO: 3932750 - RNA, 22 nt, Shigella flexneri 2a str. 301
ugcaucgucuguuuuaucuccc

SEQ ID NO: 3932751 - RNA, 23 nt, Shigella flexneri 2a str. 301
ugcaucgucuguuuuaucucccu

SEQ ID NO: 3932752 - RNA, 23 nt, Shigella flexneri 2a str. 301
ugcaucuccggcgcauccaugau

SEQ ID NO: 3932753 - RNA, 15 nt, Shigella flexneri 2a str. 301
ugcaucuccugacac

SEQ ID NO: 3932754 - RNA, 12 nt, Shigella flexneri 2a str. 301
ugcaucugaaac

SEQ ID NO: 3932755 - RNA, 13 nt, Shigella flexneri 2a str. 301
ugcaucugaaacu

SEQ ID NO: 3932756 - RNA, 17 nt, Shigella flexneri 2a str. 301
ugcaucuucacacugau

SEQ ID NO: 3932757 - RNA, 14 nt, Shigella flexneri 2a str. 301
ugcaugacagcgcc

SEQ ID NO: 3932758 - RNA, 16 nt, Shigella flexneri 2a str. 301
ugcaugauuacuggcg

SEQ ID NO: 3932759 - RNA, 14 nt, Shigella flexneri 2a str. 301
ugcaugcccggcau

SEQ ID NO: 3932760 - RNA, 17 nt, Shigella flexneri 2a str. 301
ugcauggucgauucuua

SEQ ID NO: 3932761 - RNA, 16 nt, Shigella flexneri 2a str. 301
ugcauguaaaucaagc

SEQ ID NO: 3932762 - RNA, 20 nt, Shigella flexneri 2a str. 301
ugcauguaaaucaagcgccg

SEQ ID NO: 3932763 - RNA, 22 nt, Shigella flexneri 2a str. 301
ugcauguuggcgauugccguug

SEQ ID NO: 3932764 - RNA, 22 nt, Shigella flexneri 2a str. 301
ugcauuccaguccacaucaacc

SEQ ID NO: 3932765 - RNA, 14 nt, Shigella flexneri 2a str. 301
ugcauuguuugcaa

SEQ ID NO: 3932766 - RNA, 15 nt, Shigella flexneri 2a str. 301
ugcauuuauauuaca

SEQ ID NO: 3932767 - RNA, 15 nt, Shigella flexneri 2a str. 301
ugcauuucauugagc

SEQ ID NO: 3932768 - RNA, 18 nt, Shigella flexneri 2a str. 301
ugcauuuccauaaauugc

SEQ ID NO: 3932769 - RNA, 19 nt, Shigella flexneri 2a str. 301
ugcauuuccgcugauucaa

SEQ ID NO: 3932770 - RNA, 23 nt, Shigella flexneri 2a str. 301
ugcauuuucgucaaccaccgggc

SEQ ID NO: 3932771 - RNA, 13 nt, Shigella flexneri 2a str. 301
ugccaaagccagu

SEQ ID NO: 3932772 - RNA, 14 nt, Shigella flexneri 2a str. 301
ugccaaauauuucu

SEQ ID NO: 3932773 - RNA, 20 nt, Shigella flexneri 2a str. 301
ugccaaauauuucuuuauca

SEQ ID NO: 3932774 - RNA, 21 nt, Shigella flexneri 2a str. 301
ugccaaucaguucaccacuuu

SEQ ID NO: 3932775 - RNA, 16 nt, Shigella flexneri 2a str. 301
ugccaauggcaggcuc

SEQ ID NO: 3932776 - RNA, 11 nt, Shigella flexneri 2a str. 301
ugccacaaacg

SEQ ID NO: 3932777 - RNA, 16 nt, Shigella flexneri 2a str. 301
ugccacacaggccauu

SEQ ID NO: 3932778 - RNA, 19 nt, Shigella flexneri 2a str. 301
ugccacacgcccaacuaaa

SEQ ID NO: 3932779 - RNA, 23 nt, Shigella flexneri 2a str. 301
ugccacaguuuuacugcagccag

SEQ ID NO: 3932780 - RNA, 11 nt, Shigella flexneri 2a str. 301
ugccacaucac

SEQ ID NO: 3932781 - RNA, 13 nt, Shigella flexneri 2a str. 301
ugccacaucacug

SEQ ID NO: 3932782 - RNA, 23 nt, Shigella flexneri 2a str. 301
ugccacauuagauaaaaaugaag

SEQ ID NO: 3932783 - RNA, 22 nt, Shigella flexneri 2a str. 301
ugcccagcucaaucaacuccau

SEQ ID NO: 3932784 - RNA, 19 nt, Shigella flexneri 2a str. 301
ugcccaggugugucucaag

SEQ ID NO: 3932785 - RNA, 13 nt, Shigella flexneri 2a str. 301
ugcccaucucuuc

SEQ ID NO: 3932786 - RNA, 19 nt, Shigella flexneri 2a str. 301
ugcccaugcgcucgacgau

SEQ ID NO: 3932787 - RNA, 12 nt, Shigella flexneri 2a str. 301
ugcccaugcuuc

SEQ ID NO: 3932788 - RNA, 18 nt, Shigella flexneri 2a str. 301
ugcccauguccgcggccu

SEQ ID NO: 3932789 - RNA, 14 nt, Shigella flexneri 2a str. 301
ugccccauauggcc

SEQ ID NO: 3932790 - RNA, 22 nt, Shigella flexneri 2a str. 301
ugcccccaacuuugugcaauug

SEQ ID NO: 3932791 - RNA, 14 nt, Shigella flexneri 2a str. 301
ugcccccagcagcg

SEQ ID NO: 3932792 - RNA, 21 nt, Shigella flexneri 2a str. 301
ugcccccgcaugccuaccaaa

SEQ ID NO: 3932793 - RNA, 19 nt, Shigella flexneri 2a str. 301
ugcccccgcucuuccaggc

SEQ ID NO: 3932794 - RNA, 16 nt, Shigella flexneri 2a str. 301
ugcccccucacaugag

SEQ ID NO: 3932795 - RNA, 19 nt, Shigella flexneri 2a str. 301
ugcccgacuugagcgcagu

SEQ ID NO: 3932796 - RNA, 19 nt, Shigella flexneri 2a str. 301
ugcccgagauacaucaccg

SEQ ID NO: 3932797 - RNA, 22 nt, Shigella flexneri 2a str. 301
ugcccgagauacaucaccgcca

SEQ ID NO: 3932798 - RNA, 18 nt, Shigella flexneri 2a str. 301
ugcccgaugaccuuguca

SEQ ID NO: 3932799 - RNA, 22 nt, Shigella flexneri 2a str. 301
ugcccgaugaccuugucaugca

SEQ ID NO: 3932800 - RNA, 19 nt, Shigella flexneri 2a str. 301
ugcccgcaacggcugcuuc

SEQ ID NO: 3932801 - RNA, 14 nt, Shigella flexneri 2a str. 301
ugcccgcagaucca

SEQ ID NO: 3932802 - RNA, 17 nt, Shigella flexneri 2a str. 301
ugcccgcauuauuuccc

SEQ ID NO: 3932803 - RNA, 17 nt, Shigella flexneri 2a str. 301
ugcccgcuuaacguacu

SEQ ID NO: 3932804 - RNA, 22 nt, Shigella flexneri 2a str. 301
ugcccgcuuaacguacugcuga

SEQ ID NO: 3932805 - RNA, 21 nt, Shigella flexneri 2a str. 301
ugcccggaaguaccaauggca

SEQ ID NO: 3932806 - RNA, 20 nt, Shigella flexneri 2a str. 301
ugcccggagcagcagucagg

SEQ ID NO: 3932807 - RNA, 15 nt, Shigella flexneri 2a str. 301
ugcccggucaggaug

SEQ ID NO: 3932808 - RNA, 18 nt, Shigella flexneri 2a str. 301
ugcccggucgggugcuca

SEQ ID NO: 3932809 - RNA, 23 nt, Shigella flexneri 2a str. 301
ugcccguaaaaaauggcuggcua

SEQ ID NO: 3932810 - RNA, 14 nt, Shigella flexneri 2a str. 301
ugcccgugcugaca

SEQ ID NO: 3932811 - RNA, 17 nt, Shigella flexneri 2a str. 301
ugcccguuccaggcgau

SEQ ID NO: 3932812 - RNA, 21 nt, Shigella flexneri 2a str. 301
ugcccuaucacgccaccagca

SEQ ID NO: 3932813 - RNA, 17 nt, Shigella flexneri 2a str. 301
ugcccucaauaucuuuc

SEQ ID NO: 3932814 - RNA, 13 nt, Shigella flexneri 2a str. 301
ugcccugcuggug

SEQ ID NO: 3932815 - RNA, 22 nt, Shigella flexneri 2a str. 301
ugcccuguuugucgaucaucag

SEQ ID NO: 3932816 - RNA, 14 nt, Shigella flexneri 2a str. 301
ugcccuugccaacg

SEQ ID NO: 3932817 - RNA, 12 nt, Shigella flexneri 2a str. 301
ugcccuuucaac

SEQ ID NO: 3932818 - RNA, 19 nt, Shigella flexneri 2a str. 301
ugcccuuuucaccaugggc

SEQ ID NO: 3932819 - RNA, 12 nt, Shigella flexneri 2a str. 301
ugccgaaaaaag

SEQ ID NO: 3932820 - RNA, 13 nt, Shigella flexneri 2a str. 301
ugccgaaccguag

SEQ ID NO: 3932821 - RNA, 22 nt, Shigella flexneri 2a str. 301
ugccgaacguaggcuggauaag

SEQ ID NO: 3932822 - RNA, 13 nt, Shigella flexneri 2a str. 301
ugccgacaaaugc

SEQ ID NO: 3932823 - RNA, 16 nt, Shigella flexneri 2a str. 301
ugccgacaaaugcagu

SEQ ID NO: 3932824 - RNA, 23 nt, Shigella flexneri 2a str. 301
ugccgacaaaugcaguuuuuaau

SEQ ID NO: 3932825 - RNA, 17 nt, Shigella flexneri 2a str. 301
ugccgaccaucuguucu

SEQ ID NO: 3932826 - RNA, 17 nt, Shigella flexneri 2a str. 301
ugccgagaguaacacau

SEQ ID NO: 3932827 - RNA, 18 nt, Shigella flexneri 2a str. 301
ugccgaucaauuucacag

SEQ ID NO: 3932828 - RNA, 20 nt, Shigella flexneri 2a str. 301
ugccgauggcgcaaacuuaa

SEQ ID NO: 3932829 - RNA, 13 nt, Shigella flexneri 2a str. 301
ugccgauggucac

SEQ ID NO: 3932830 - RNA, 17 nt, Shigella flexneri 2a str. 301
ugccgcaaaacccaggc

SEQ ID NO: 3932831 - RNA, 19 nt, Shigella flexneri 2a str. 301
ugccgcaaaacccaggcuu

SEQ ID NO: 3932832 - RNA, 13 nt, Shigella flexneri 2a str. 301
ugccgcacaucac

SEQ ID NO: 3932833 - RNA, 15 nt, Shigella flexneri 2a str. 301
ugccgcacaucaccg

SEQ ID NO: 3932834 - RNA, 15 nt, Shigella flexneri 2a str. 301
ugccgcacauuuccc

SEQ ID NO: 3932835 - RNA, 20 nt, Shigella flexneri 2a str. 301
ugccgcacuuugagcagcug

SEQ ID NO: 3932836 - RNA, 20 nt, Shigella flexneri 2a str. 301
ugccgcagaagaucagaaau

SEQ ID NO: 3932837 - RNA, 13 nt, Shigella flexneri 2a str. 301
ugccgcagcaccc

SEQ ID NO: 3932838 - RNA, 13 nt, Shigella flexneri 2a str. 301
ugccgcagcuucu

SEQ ID NO: 3932839 - RNA, 22 nt, Shigella flexneri 2a str. 301
ugccgcagcuucuguuauucca

SEQ ID NO: 3932840 - RNA, 16 nt, Shigella flexneri 2a str. 301
ugccgcauccggcaua

SEQ ID NO: 3932841 - RNA, 20 nt, Shigella flexneri 2a str. 301
ugccgcauggaaccaguuca

SEQ ID NO: 3932842 - RNA, 18 nt, Shigella flexneri 2a str. 301
ugccgccaguucuuccag

SEQ ID NO: 3932843 - RNA, 15 nt, Shigella flexneri 2a str. 301
ugccgcccagaagca

SEQ ID NO: 3932844 - RNA, 23 nt, Shigella flexneri 2a str. 301
ugccgcccagaagcacugccaga

SEQ ID NO: 3932845 - RNA, 16 nt, Shigella flexneri 2a str. 301
ugccgcccguuuucuc

SEQ ID NO: 3932846 - RNA, 20 nt, Shigella flexneri 2a str. 301
ugccgcccuaaagggcggca

SEQ ID NO: 3932847 - RNA, 22 nt, Shigella flexneri 2a str. 301
ugccgccgcagaaaaagagcau

SEQ ID NO: 3932848 - RNA, 17 nt, Shigella flexneri 2a str. 301
ugccgccggaaacauaa

SEQ ID NO: 3932849 - RNA, 18 nt, Shigella flexneri 2a str. 301
ugccgccggaaacauaaa

SEQ ID NO: 3932850 - RNA, 13 nt, Shigella flexneri 2a str. 301
ugccgccucugcc

SEQ ID NO: 3932851 - RNA, 16 nt, Shigella flexneri 2a str. 301
ugccgccucugccgca

SEQ ID NO: 3932852 - RNA, 22 nt, Shigella flexneri 2a str. 301
ugccgcgcagggacacucgcug

SEQ ID NO: 3932853 - RNA, 16 nt, Shigella flexneri 2a str. 301
ugccgcgccagaucag

SEQ ID NO: 3932854 - RNA, 16 nt, Shigella flexneri 2a str. 301
ugccgcguaaucaaca

SEQ ID NO: 3932855 - RNA, 21 nt, Shigella flexneri 2a str. 301
ugccgcguaaucaacauauuc

SEQ ID NO: 3932856 - RNA, 22 nt, Shigella flexneri 2a str. 301
ugccgcuaauggugcgcgcacu

SEQ ID NO: 3932857 - RNA, 14 nt, Shigella flexneri 2a str. 301
ugccgcucaccuga

SEQ ID NO: 3932858 - RNA, 13 nt, Shigella flexneri 2a str. 301
ugccgcugacauc

SEQ ID NO: 3932859 - RNA, 19 nt, Shigella flexneri 2a str. 301
ugccgcuucauugaccuuu

SEQ ID NO: 3932860 - RNA, 16 nt, Shigella flexneri 2a str. 301
ugccgcuuccagcaga

SEQ ID NO: 3932861 - RNA, 17 nt, Shigella flexneri 2a str. 301
ugccgcuuccagcagac

SEQ ID NO: 3932862 - RNA, 23 nt, Shigella flexneri 2a str. 301
ugccgcuuuaugugcuucuacca

SEQ ID NO: 3932863 - RNA, 15 nt, Shigella flexneri 2a str. 301
ugccgcuuuuuccag

SEQ ID NO: 3932864 - RNA, 18 nt, Shigella flexneri 2a str. 301
ugccggaacuauuggucu

SEQ ID NO: 3932865 - RNA, 21 nt, Shigella flexneri 2a str. 301
ugccggaaggcagccuuucuc

SEQ ID NO: 3932866 - RNA, 22 nt, Shigella flexneri 2a str. 301
ugccggaaggcagccuuucuca

SEQ ID NO: 3932867 - RNA, 20 nt, Shigella flexneri 2a str. 301
ugccggacagaucugccugu

SEQ ID NO: 3932868 - RNA, 17 nt, Shigella flexneri 2a str. 301
ugccggacaugcugccu

SEQ ID NO: 3932869 - RNA, 21 nt, Shigella flexneri 2a str. 301
ugccggagcgccaccacccug

SEQ ID NO: 3932870 - RNA, 21 nt, Shigella flexneri 2a str. 301
ugccggaggaguaucugcugu

SEQ ID NO: 3932871 - RNA, 15 nt, Shigella flexneri 2a str. 301
ugccggagucgcauu

SEQ ID NO: 3932872 - RNA, 15 nt, Shigella flexneri 2a str. 301
ugccggauagcgugu

SEQ ID NO: 3932873 - RNA, 21 nt, Shigella flexneri 2a str. 301
ugccggauauacccgccaaac

SEQ ID NO: 3932874 - RNA, 20 nt, Shigella flexneri 2a str. 301
ugccggaucacguacacaac

SEQ ID NO: 3932875 - RNA, 15 nt, Shigella flexneri 2a str. 301
ugccggaucaggcgu

SEQ ID NO: 3932876 - RNA, 15 nt, Shigella flexneri 2a str. 301
ugccggaugcaugau

SEQ ID NO: 3932877 - RNA, 20 nt, Shigella flexneri 2a str. 301
ugccggaugcaugauccggc

SEQ ID NO: 3932878 - RNA, 21 nt, Shigella flexneri 2a str. 301
ugccggaugcaugauccggca

SEQ ID NO: 3932879 - RNA, 13 nt, Shigella flexneri 2a str. 301
ugccggaugcggc

SEQ ID NO: 3932880 - RNA, 23 nt, Shigella flexneri 2a str. 301
ugccggaugcggcguaaaugccu

SEQ ID NO: 3932881 - RNA, 18 nt, Shigella flexneri 2a str. 301
ugccggaugcggcgugaa

SEQ ID NO: 3932882 - RNA, 12 nt, Shigella flexneri 2a str. 301
ugcgccaauacc

SEQ ID NO: 3932883 - RNA, 17 nt, Shigella flexneri 2a str. 301
ugcgccacaccacugcg

SEQ ID NO: 3932884 - RNA, 19 nt, Shigella flexneri 2a str. 301
ugcgccacaggucagcagg

SEQ ID NO: 3932885 - RNA, 12 nt, Shigella flexneri 2a str. 301
ugcgccacaucc

SEQ ID NO: 3932886 - RNA, 16 nt, Shigella flexneri 2a str. 301
ugcgccacgcagcgau

SEQ ID NO: 3932887 - RNA, 14 nt, Shigella flexneri 2a str. 301
ugcgccagagcgcg

SEQ ID NO: 3932888 - RNA, 13 nt, Shigella flexneri 2a str. 301
ugcgccagcgcgc

SEQ ID NO: 3932889 - RNA, 18 nt, Shigella flexneri 2a str. 301
ugcgccagcguuacuuca

SEQ ID NO: 3932890 - RNA, 12 nt, Shigella flexneri 2a str. 301
ugcgccagcucg

SEQ ID NO: 3932891 - RNA, 21 nt, Shigella flexneri 2a str. 301
ugcgccaggauaagcgccgcu

SEQ ID NO: 3932892 - RNA, 21 nt, Shigella flexneri 2a str. 301
ugcgccaucgccacaccagua

SEQ ID NO: 3932893 - RNA, 21 nt, Shigella flexneri 2a str. 301
ugcgccauuuuuuugucugcu

SEQ ID NO: 3932894 - RNA, 11 nt, Shigella flexneri 2a str. 301
ugcgcccaguu

SEQ ID NO: 3932895 - RNA, 14 nt, Shigella flexneri 2a str. 301
ugcgcccaguuaga

SEQ ID NO: 3932896 - RNA, 16 nt, Shigella flexneri 2a str. 301
ugcgcccaucaucauc

SEQ ID NO: 3932897 - RNA, 21 nt, Shigella flexneri 2a str. 301
ugcgccccacaccaccaugcu

SEQ ID NO: 3932898 - RNA, 13 nt, Shigella flexneri 2a str. 301
ugcgcccgccagc

SEQ ID NO: 3932899 - RNA, 20 nt, Shigella flexneri 2a str. 301
ugcgcccgcuuuucgccagc

SEQ ID NO: 3932900 - RNA, 21 nt, Shigella flexneri 2a str. 301
ugcgcccugggcuucauccag

SEQ ID NO: 3932901 - RNA, 14 nt, Shigella flexneri 2a str. 301
ugcgcccuguucug

SEQ ID NO: 3932902 - RNA, 16 nt, Shigella flexneri 2a str. 301
ugcgccguuuuuuuuc

SEQ ID NO: 3932903 - RNA, 18 nt, Shigella flexneri 2a str. 301
ugcgccucgccgcugccu

SEQ ID NO: 3932904 - RNA, 17 nt, Shigella flexneri 2a str. 301
ugcgccuggauuuucuc

SEQ ID NO: 3932905 - RNA, 13 nt, Shigella flexneri 2a str. 301
ugcgccugggccg

SEQ ID NO: 3932906 - RNA, 18 nt, Shigella flexneri 2a str. 301
ugcgccuuucgagaagca

SEQ ID NO: 3932907 - RNA, 21 nt, Shigella flexneri 2a str. 301
ugcgcgaccaacugcaaggcc

SEQ ID NO: 3932908 - RNA, 14 nt, Shigella flexneri 2a str. 301
ugcgcgaccacgau

SEQ ID NO: 3932909 - RNA, 18 nt, Shigella flexneri 2a str. 301
ugcgcgacuucauucaga

SEQ ID NO: 3932910 - RNA, 15 nt, Shigella flexneri 2a str. 301
ugcgcgagcuggugc

SEQ ID NO: 3932911 - RNA, 18 nt, Shigella flexneri 2a str. 301
ugcgcgcaaucagcaccg

SEQ ID NO: 3932912 - RNA, 19 nt, Shigella flexneri 2a str. 301
ugcgcggauggccucugcc

SEQ ID NO: 3932913 - RNA, 22 nt, Shigella flexneri 2a str. 301
ugcgcggauggccucugccagc

SEQ ID NO: 3932914 - RNA, 13 nt, Shigella flexneri 2a str. 301
ugcgcggcuccag

SEQ ID NO: 3932915 - RNA, 23 nt, Shigella flexneri 2a str. 301
ugcgcgucuuaucaggccugugg

SEQ ID NO: 3932916 - RNA, 18 nt, Shigella flexneri 2a str. 301
ugcgcuacgcuuaucagg

SEQ ID NO: 3932917 - RNA, 20 nt, Shigella flexneri 2a str. 301
ugcgcuacgcuuaucaggcc

SEQ ID NO: 3932918 - RNA, 17 nt, Shigella flexneri 2a str. 301
ugcgcuauccagcgcau

SEQ ID NO: 3932919 - RNA, 11 nt, Shigella flexneri 2a str. 301
ugcgcucuccc

SEQ ID NO: 3932920 - RNA, 21 nt, Shigella flexneri 2a str. 301
ugcgcucuucaacuucagcag

SEQ ID NO: 3932921 - RNA, 22 nt, Shigella flexneri 2a str. 301
ugcgcucuucaacuucagcagc

SEQ ID NO: 3932922 - RNA, 12 nt, Shigella flexneri 2a str. 301
ugcgcucuuccg

SEQ ID NO: 3932923 - RNA, 14 nt, Shigella flexneri 2a str. 301
ugcgcugacucuac

SEQ ID NO: 3932924 - RNA, 16 nt, Shigella flexneri 2a str. 301
ugcgcuuauccggccc

SEQ ID NO: 3932925 - RNA, 24 nt, Shigella flexneri 2a str. 301
ugcgcuuccugcaacgagugcauc

SEQ ID NO: 3932926 - RNA, 14 nt, Shigella flexneri 2a str. 301
ugcgcuuccugcag

SEQ ID NO: 3932927 - RNA, 19 nt, Shigella flexneri 2a str. 301
ugcgcuuccugcagcuuca

SEQ ID NO: 3932928 - RNA, 22 nt, Shigella flexneri 2a str. 301
ugcgcuucucgcucgcuaucau

SEQ ID NO: 3932929 - RNA, 17 nt, Shigella flexneri 2a str. 301
ugcgcuucuuccagcau

SEQ ID NO: 3932930 - RNA, 17 nt, Shigella flexneri 2a str. 301
ugcgcuuuaucgccgcu

SEQ ID NO: 3932931 - RNA, 16 nt, Shigella flexneri 2a str. 301
ugcgcuuuauucagau

SEQ ID NO: 3932932 - RNA, 15 nt, Shigella flexneri 2a str. 301
ugcgcuuucuuaaau

SEQ ID NO: 3932933 - RNA, 20 nt, Shigella flexneri 2a str. 301
ugcggaaaaaagaaagaagc

SEQ ID NO: 3932934 - RNA, 21 nt, Shigella flexneri 2a str. 301
ugcggaaaaaagaaagaagcc

SEQ ID NO: 3932935 - RNA, 23 nt, Shigella flexneri 2a str. 301
ugcggaaccaucgagaaucagcg

SEQ ID NO: 3932936 - RNA, 22 nt, Shigella flexneri 2a str. 301
ugcggaagcaaccggugucauc

SEQ ID NO: 3932937 - RNA, 19 nt, Shigella flexneri 2a str. 301
ugcggaagucgcagcugcc

SEQ ID NO: 3932938 - RNA, 16 nt, Shigella flexneri 2a str. 301
ugcggacaaaacguga

SEQ ID NO: 3932939 - RNA, 22 nt, Shigella flexneri 2a str. 301
ugcggacaaaacgugacagcau

SEQ ID NO: 3932940 - RNA, 22 nt, Shigella flexneri 2a str. 301
ugcggacagucacguagcggcg

SEQ ID NO: 3932941 - RNA, 16 nt, Shigella flexneri 2a str. 301
ugcggauccugcggau

SEQ ID NO: 3932942 - RNA, 17 nt, Shigella flexneri 2a str. 301
ugcggauuccggagcaa

SEQ ID NO: 3932943 - RNA, 22 nt, Shigella flexneri 2a str. 301
ugcggcacccauuuauccagcg

SEQ ID NO: 3932944 - RNA, 13 nt, Shigella flexneri 2a str. 301
ugcggcagcucca

SEQ ID NO: 3932945 - RNA, 21 nt, Shigella flexneri 2a str. 301
ugcggcaggacagucagaccg

SEQ ID NO: 3932946 - RNA, 22 nt, Shigella flexneri 2a str. 301
ugcggcaggucaucgugcguca

SEQ ID NO: 3932947 - RNA, 13 nt, Shigella flexneri 2a str. 301
ugcggcaucgggc

SEQ ID NO: 3932948 - RNA, 13 nt, Shigella flexneri 2a str. 301
ugcggccagcagc

SEQ ID NO: 3932949 - RNA, 14 nt, Shigella flexneri 2a str. 301
ugcggccagcagcu

SEQ ID NO: 3932950 - RNA, 18 nt, Shigella flexneri 2a str. 301
ugcggcgcaccagcaggc

SEQ ID NO: 3932951 - RNA, 16 nt, Shigella flexneri 2a str. 301
ugcggcggaacaucaa

SEQ ID NO: 3932952 - RNA, 18 nt, Shigella flexneri 2a str. 301
ugcggcggcgcaccggcc

SEQ ID NO: 3932953 - RNA, 22 nt, Shigella flexneri 2a str. 301
ugcggcgguaucgucgggcugg

SEQ ID NO: 3932954 - RNA, 15 nt, Shigella flexneri 2a str. 301
ugcggcguauccggc

SEQ ID NO: 3932955 - RNA, 19 nt, Shigella flexneri 2a str. 301
ugcggcgucauaauccggc

SEQ ID NO: 3932956 - RNA, 15 nt, Shigella flexneri 2a str. 301
ugcggcguuaacgcc

SEQ ID NO: 3932957 - RNA, 19 nt, Shigella flexneri 2a str. 301
ugcggcucucuuucuccag

SEQ ID NO: 3932958 - RNA, 19 nt, Shigella flexneri 2a str. 301
ugcggcuguagagcuaccg

SEQ ID NO: 3932959 - RNA, 19 nt, Shigella flexneri 2a str. 301
ugcggcuuauucauuacuu

SEQ ID NO: 3932960 - RNA, 15 nt, Shigella flexneri 2a str. 301
ugcgggaguggcgaa

SEQ ID NO: 3932961 - RNA, 15 nt, Shigella flexneri 2a str. 301
ugcgggcaucaucuu

SEQ ID NO: 3932962 - RNA, 19 nt, Shigella flexneri 2a str. 301
ugcgggcgaaagcagaaaa

SEQ ID NO: 3932963 - RNA, 23 nt, Shigella flexneri 2a str. 301
ugcgggcgaccaaucaaauaccc

SEQ ID NO: 3932964 - RNA, 15 nt, Shigella flexneri 2a str. 301
ugcgggucaggccag

SEQ ID NO: 3932965 - RNA, 20 nt, Shigella flexneri 2a str. 301
ugcggguggcucucgccagc

SEQ ID NO: 3932966 - RNA, 17 nt, Shigella flexneri 2a str. 301
ugcggguuuucgcugcc

SEQ ID NO: 3932967 - RNA, 20 nt, Shigella flexneri 2a str. 301
ugcggguuuucucgcuccau

SEQ ID NO: 3932968 - RNA, 18 nt, Shigella flexneri 2a str. 301
ugcgguaaccuggcaguu

SEQ ID NO: 3932969 - RNA, 22 nt, Shigella flexneri 2a str. 301
ugcgguaagguugucgauacca

SEQ ID NO: 3932970 - RNA, 18 nt, Shigella flexneri 2a str. 301
ugcgguaaucgcccggau

SEQ ID NO: 3932971 - RNA, 20 nt, Shigella flexneri 2a str. 301
ugcgguccaugcgaagaccg

SEQ ID NO: 3932972 - RNA, 19 nt, Shigella flexneri 2a str. 301
ugcggugccauuaaaccaa

SEQ ID NO: 3932973 - RNA, 14 nt, Shigella flexneri 2a str. 301
ugcgguuaaugguu

SEQ ID NO: 3932974 - RNA, 15 nt, Shigella flexneri 2a str. 301
ugcgguuaaugguug

SEQ ID NO: 3932975 - RNA, 16 nt, Shigella flexneri 2a str. 301
ugcgguuucagcucac

SEQ ID NO: 3932976 - RNA, 14 nt, Shigella flexneri 2a str. 301
ugcguacaccaaca

SEQ ID NO: 3932977 - RNA, 15 nt, Shigella flexneri 2a str. 301
ugcguacaccaacau

SEQ ID NO: 3932978 - RNA, 19 nt, Shigella flexneri 2a str. 301
ugcguaccauuaucaccaa

SEQ ID NO: 3932979 - RNA, 13 nt, Shigella flexneri 2a str. 301
ugcguacccggau

SEQ ID NO: 3932980 - RNA, 17 nt, Shigella flexneri 2a str. 301
ugcguacuggcauuuau

SEQ ID NO: 3932981 - RNA, 18 nt, Shigella flexneri 2a str. 301
ugcguagccgauccgcgu

SEQ ID NO: 3932982 - RNA, 15 nt, Shigella flexneri 2a str. 301
ugcugaccaccagca

SEQ ID NO: 3932983 - RNA, 20 nt, Shigella flexneri 2a str. 301
ugcugacgcagauccugauu

SEQ ID NO: 3932984 - RNA, 17 nt, Shigella flexneri 2a str. 301
ugcugacgcaucuucuc

SEQ ID NO: 3932985 - RNA, 22 nt, Shigella flexneri 2a str. 301
ugcugacgcuacuggacauucc

SEQ ID NO: 3932986 - RNA, 17 nt, Shigella flexneri 2a str. 301
ugcugacggugauaauc

SEQ ID NO: 3932987 - RNA, 19 nt, Shigella flexneri 2a str. 301
ugcugacuuugauccagcc

SEQ ID NO: 3932988 - RNA, 21 nt, Shigella flexneri 2a str. 301
ugcugagcggcguaccuucag

SEQ ID NO: 3932989 - RNA, 15 nt, Shigella flexneri 2a str. 301
ugcugaggcugaccc

SEQ ID NO: 3932990 - RNA, 21 nt, Shigella flexneri 2a str. 301
ugcugaguguaacgcuugcug

SEQ ID NO: 3932991 - RNA, 19 nt, Shigella flexneri 2a str. 301
ugcugauaacgugcagcuu

SEQ ID NO: 3932992 - RNA, 14 nt, Shigella flexneri 2a str. 301
ugcugaucggcaag

SEQ ID NO: 3932993 - RNA, 16 nt, Shigella flexneri 2a str. 301
ugcugaugcacgcaga

SEQ ID NO: 3932994 - RNA, 22 nt, Shigella flexneri 2a str. 301
ugcugaugcaggcgaucgacgu

SEQ ID NO: 3932995 - RNA, 21 nt, Shigella flexneri 2a str. 301
ugcugauggcgggauguguaa

SEQ ID NO: 3932996 - RNA, 17 nt, Shigella flexneri 2a str. 301
ugcugauguucgccaga

SEQ ID NO: 3932997 - RNA, 17 nt, Shigella flexneri 2a str. 301
ugcugauucgucaauau

SEQ ID NO: 3932998 - RNA, 18 nt, Shigella flexneri 2a str. 301
ugcugcaauuccacaccc

SEQ ID NO: 3932999 - RNA, 18 nt, Shigella flexneri 2a str. 301
ugcugcaauugcggcagg

SEQ ID NO: 3933000 - RNA, 22 nt, Shigella flexneri 2a str. 301
ugcugcacauacugcaucagcg

SEQ ID NO: 3933001 - RNA, 21 nt, Shigella flexneri 2a str. 301
ugcugcaccaacaucaugcca

SEQ ID NO: 3933002 - RNA, 14 nt, Shigella flexneri 2a str. 301
ugcugcacgaaauu

SEQ ID NO: 3933003 - RNA, 19 nt, Shigella flexneri 2a str. 301
ugcugccaaagugacacaa

SEQ ID NO: 3933004 - RNA, 19 nt, Shigella flexneri 2a str. 301
ugcugccgacaaaugcagu

SEQ ID NO: 3933005 - RNA, 13 nt, Shigella flexneri 2a str. 301
ugcugccgcgcca

SEQ ID NO: 3933006 - RNA, 16 nt, Shigella flexneri 2a str. 301
ugcugccguuuuuauu

SEQ ID NO: 3933007 - RNA, 17 nt, Shigella flexneri 2a str. 301
ugcugcgccgagcaaua

SEQ ID NO: 3933008 - RNA, 22 nt, Shigella flexneri 2a str. 301
ugcugcguuugcccuaaagcgc

SEQ ID NO: 3933009 - RNA, 18 nt, Shigella flexneri 2a str. 301
ugcugcucaaaggcauua

SEQ ID NO: 3933010 - RNA, 18 nt, Shigella flexneri 2a str. 301
ugcugcugauccagcuuc

SEQ ID NO: 3933011 - RNA, 19 nt, Shigella flexneri 2a str. 301
ugcugcuuuugcuucuaug

SEQ ID NO: 3933012 - RNA, 16 nt, Shigella flexneri 2a str. 301
ugcuggacgcauugca

SEQ ID NO: 3933013 - RNA, 20 nt, Shigella flexneri 2a str. 301
ugcuggacgcauugcauuuc

SEQ ID NO: 3933014 - RNA, 20 nt, Shigella flexneri 2a str. 301
ugcuggacucccagaacaac

SEQ ID NO: 3933015 - RNA, 14 nt, Shigella flexneri 2a str. 301
ugcuggacuugaac

SEQ ID NO: 3933016 - RNA, 14 nt, Shigella flexneri 2a str. 301
ugcuggauaagaug

SEQ ID NO: 3933017 - RNA, 19 nt, Shigella flexneri 2a str. 301
ugcuggaucaaggauugca

SEQ ID NO: 3933018 - RNA, 14 nt, Shigella flexneri 2a str. 301
ugcuggcaaaucag

SEQ ID NO: 3933019 - RNA, 16 nt, Shigella flexneri 2a str. 301
ugcuggcagauaaauu

SEQ ID NO: 3933020 - RNA, 18 nt, Shigella flexneri 2a str. 301
ugcuggcaugaaugguca

SEQ ID NO: 3933021 - RNA, 11 nt, Shigella flexneri 2a str. 301
ugcuggccaac

SEQ ID NO: 3933022 - RNA, 17 nt, Shigella flexneri 2a str. 301
ugcuggcguugucaucg

SEQ ID NO: 3933023 - RNA, 22 nt, Shigella flexneri 2a str. 301
ugcuggcugcgggaguugcucc

SEQ ID NO: 3933024 - RNA, 21 nt, Shigella flexneri 2a str. 301
ugcuggggauucguuuuucuu

SEQ ID NO: 3933025 - RNA, 16 nt, Shigella flexneri 2a str. 301
ugcuggggccaauacc

SEQ ID NO: 3933026 - RNA, 16 nt, Shigella flexneri 2a str. 301
ugcuggggccgucauu

SEQ ID NO: 3933027 - RNA, 17 nt, Shigella flexneri 2a str. 301
ugcuggguuauuucauu

SEQ ID NO: 3933028 - RNA, 14 nt, Shigella flexneri 2a str. 301
ugcugguacuggug

SEQ ID NO: 3933029 - RNA, 15 nt, Shigella flexneri 2a str. 301
ugcugguacuuucac

SEQ ID NO: 3933030 - RNA, 18 nt, Shigella flexneri 2a str. 301
ugcugguauuuccagucc

SEQ ID NO: 3933031 - RNA, 16 nt, Shigella flexneri 2a str. 301
ugcuggucgucucgug

SEQ ID NO: 3933032 - RNA, 21 nt, Shigella flexneri 2a str. 301
ugcugguucugcggguuaguc

SEQ ID NO: 3933033 - RNA, 11 nt, Shigella flexneri 2a str. 301
ugcugguuuug

SEQ ID NO: 3933034 - RNA, 21 nt, Shigella flexneri 2a str. 301
ugcuguaaacaacaugguccu

SEQ ID NO: 3933035 - RNA, 19 nt, Shigella flexneri 2a str. 301
ugcuguaaauucucaauau

SEQ ID NO: 3933036 - RNA, 21 nt, Shigella flexneri 2a str. 301
ugcuguaauuucacaccauca

SEQ ID NO: 3933037 - RNA, 16 nt, Shigella flexneri 2a str. 301
ugcuguaucacuauga

SEQ ID NO: 3933038 - RNA, 18 nt, Shigella flexneri 2a str. 301
ugcuguaucacuaugaaa

SEQ ID NO: 3933039 - RNA, 21 nt, Shigella flexneri 2a str. 301
ugcuguaucgccggugguugc

SEQ ID NO: 3933040 - RNA, 17 nt, Shigella flexneri 2a str. 301
ugcugucaccgaagcgg

SEQ ID NO: 3933041 - RNA, 17 nt, Shigella flexneri 2a str. 301
ugcugucggcaaaucaa

SEQ ID NO: 3933042 - RNA, 17 nt, Shigella flexneri 2a str. 301
ugcugucggcugccagc

SEQ ID NO: 3933043 - RNA, 17 nt, Shigella flexneri 2a str. 301
ugcuguggauucagcac

SEQ ID NO: 3933044 - RNA, 18 nt, Shigella flexneri 2a str. 301
ugcuguggauucagcacc

SEQ ID NO: 3933045 - RNA, 15 nt, Shigella flexneri 2a str. 301
ugcugugguuugccc

SEQ ID NO: 3933046 - RNA, 15 nt, Shigella flexneri 2a str. 301
ugcugugugccgcga

SEQ ID NO: 3933047 - RNA, 15 nt, Shigella flexneri 2a str. 301
ugcuguuacgccaga

SEQ ID NO: 3933048 - RNA, 22 nt, Shigella flexneri 2a str. 301
ugcuguuacgccagaacagcua

SEQ ID NO: 3933049 - RNA, 18 nt, Shigella flexneri 2a str. 301
ugcuguuccuaucuucau

SEQ ID NO: 3933050 - RNA, 19 nt, Shigella flexneri 2a str. 301
ugcuguucgagcaucacau

SEQ ID NO: 3933051 - RNA, 20 nt, Shigella flexneri 2a str. 301
ugcuguucgguuuugcccac

SEQ ID NO: 3933052 - RNA, 16 nt, Shigella flexneri 2a str. 301
ugcuguucuucugcug

SEQ ID NO: 3933053 - RNA, 12 nt, Shigella flexneri 2a str. 301
ugcuguuuuaca

SEQ ID NO: 3933054 - RNA, 18 nt, Shigella flexneri 2a str. 301
ugcuuaaaccauuccagc

SEQ ID NO: 3933055 - RNA, 18 nt, Shigella flexneri 2a str. 301
ugcuuaaauuucuuacca

SEQ ID NO: 3933056 - RNA, 14 nt, Shigella flexneri 2a str. 301
ugcuuaaucgcggc

SEQ ID NO: 3933057 - RNA, 23 nt, Shigella flexneri 2a str. 301
ugcuuaucgcccugcuccagcaa

SEQ ID NO: 3933058 - RNA, 22 nt, Shigella flexneri 2a str. 301
ugcuuaucgcgaugauuuucgc

SEQ ID NO: 3933059 - RNA, 14 nt, Shigella flexneri 2a str. 301
ugcuucacacuggg

SEQ ID NO: 3933060 - RNA, 13 nt, Shigella flexneri 2a str. 301
ugcuucaccagca

SEQ ID NO: 3933061 - RNA, 16 nt, Shigella flexneri 2a str. 301
ugcuucaccagcagcg

SEQ ID NO: 3933062 - RNA, 12 nt, Shigella flexneri 2a str. 301
ugcuucaccgau

SEQ ID NO: 3933063 - RNA, 14 nt, Shigella flexneri 2a str. 301
ugcuucaccgauau

SEQ ID NO: 3933064 - RNA, 19 nt, Shigella flexneri 2a str. 301
ugcuucaggacuucuuugc

SEQ ID NO: 3933065 - RNA, 16 nt, Shigella flexneri 2a str. 301
ugcuucaguuccugau

SEQ ID NO: 3933066 - RNA, 17 nt, Shigella flexneri 2a str. 301
ugcuuccgccagcggcg

SEQ ID NO: 3933067 - RNA, 19 nt, Shigella flexneri 2a str. 301
ugcuuccggcaagcaaaug

SEQ ID NO: 3933068 - RNA, 12 nt, Shigella flexneri 2a str. 301
ugcuuccugaac

SEQ ID NO: 3933069 - RNA, 13 nt, Shigella flexneri 2a str. 301
ugcuucgcucucu

SEQ ID NO: 3933070 - RNA, 22 nt, Shigella flexneri 2a str. 301
ugcuucggucagaauuucgacu

SEQ ID NO: 3933071 - RNA, 15 nt, Shigella flexneri 2a str. 301
ugcuucggucagcac

SEQ ID NO: 3933072 - RNA, 20 nt, Shigella flexneri 2a str. 301
ugcuucuccguguucgucac

SEQ ID NO: 3933073 - RNA, 20 nt, Shigella flexneri 2a str. 301
ugcuucugccaguuguugcu

SEQ ID NO: 3933074 - RNA, 18 nt, Shigella flexneri 2a str. 301
ugcuugacgugucuuauc

SEQ ID NO: 3933075 - RNA, 18 nt, Shigella flexneri 2a str. 301
ugcuugccagauacgaug

SEQ ID NO: 3933076 - RNA, 14 nt, Shigella flexneri 2a str. 301
ugcuugucccaacc

SEQ ID NO: 3933077 - RNA, 20 nt, Shigella flexneri 2a str. 301
ugcuugucccaaccuuguuu

SEQ ID NO: 3933078 - RNA, 18 nt, Shigella flexneri 2a str. 301
ugcuuguggcggaaagac

SEQ ID NO: 3933079 - RNA, 11 nt, Shigella flexneri 2a str. 301
ugcuuuaaaag

SEQ ID NO: 3933080 - RNA, 15 nt, Shigella flexneri 2a str. 301
ugcuuuaaucgccuu

SEQ ID NO: 3933081 - RNA, 19 nt, Shigella flexneri 2a str. 301
ugcuuuauacgaugccugc

SEQ ID NO: 3933082 - RNA, 22 nt, Shigella flexneri 2a str. 301
uggcaauacuggcagcagucgc

SEQ ID NO: 3933083 - RNA, 18 nt, Shigella flexneri 2a str. 301
uggcaauagcggacacua

SEQ ID NO: 3933084 - RNA, 19 nt, Shigella flexneri 2a str. 301
uggcaaucagcggcaguuc

SEQ ID NO: 3933085 - RNA, 16 nt, Shigella flexneri 2a str. 301
uggcaaucuuccucgc

SEQ ID NO: 3933086 - RNA, 20 nt, Shigella flexneri 2a str. 301
uggcaaugcccgguguuccc

SEQ ID NO: 3933087 - RNA, 18 nt, Shigella flexneri 2a str. 301
uggcaauggcgacuucug

SEQ ID NO: 3933088 - RNA, 21 nt, Shigella flexneri 2a str. 301
uggcacaagaaguaacaacug

SEQ ID NO: 3933089 - RNA, 22 nt, Shigella flexneri 2a str. 301
uggcacaaucucggcgcucaau

SEQ ID NO: 3933090 - RNA, 16 nt, Shigella flexneri 2a str. 301
uggcacagaagucacc

SEQ ID NO: 3933091 - RNA, 20 nt, Shigella flexneri 2a str. 301
uggcacaugcauaaagcggu

SEQ ID NO: 3933092 - RNA, 18 nt, Shigella flexneri 2a str. 301
uggcacauucugacuggg

SEQ ID NO: 3933093 - RNA, 23 nt, Shigella flexneri 2a str. 301
uggcacauuuuguaggccugaua

SEQ ID NO: 3933094 - RNA, 17 nt, Shigella flexneri 2a str. 301
uggcaccaguaaaccaa

SEQ ID NO: 3933095 - RNA, 17 nt, Shigella flexneri 2a str. 301
uggcaccgcagaucaga

SEQ ID NO: 3933096 - RNA, 18 nt, Shigella flexneri 2a str. 301
uggcaccuguaccagccc

SEQ ID NO: 3933097 - RNA, 18 nt, Shigella flexneri 2a str. 301
uggcacguaccaugcgca

SEQ ID NO: 3933098 - RNA, 15 nt, Shigella flexneri 2a str. 301
uggcagaaacagcca

SEQ ID NO: 3933099 - RNA, 16 nt, Shigella flexneri 2a str. 301
uggcagaaacagccau

SEQ ID NO: 3933100 - RNA, 18 nt, Shigella flexneri 2a str. 301
uggcagaaacagccauaa

SEQ ID NO: 3933101 - RNA, 22 nt, Shigella flexneri 2a str. 301
uggcagaauuugaggaagcugc

SEQ ID NO: 3933102 - RNA, 19 nt, Shigella flexneri 2a str. 301
uggcagaguaucgccaucc

SEQ ID NO: 3933103 - RNA, 18 nt, Shigella flexneri 2a str. 301
uggcagcaagugcggcgc

SEQ ID NO: 3933104 - RNA, 19 nt, Shigella flexneri 2a str. 301
uggcagccagccaugcggc

SEQ ID NO: 3933105 - RNA, 13 nt, Shigella flexneri 2a str. 301
uggcagccaggcg

SEQ ID NO: 3933106 - RNA, 18 nt, Shigella flexneri 2a str. 301
uggcagccauaaucacuc

SEQ ID NO: 3933107 - RNA, 22 nt, Shigella flexneri 2a str. 301
uggcagcguuaugucccgcugg

SEQ ID NO: 3933108 - RNA, 19 nt, Shigella flexneri 2a str. 301
uggcagggaaucagauuca

SEQ ID NO: 3933109 - RNA, 18 nt, Shigella flexneri 2a str. 301
uggcaguacgcugggcga

SEQ ID NO: 3933110 - RNA, 13 nt, Shigella flexneri 2a str. 301
uggcagucuuaau

SEQ ID NO: 3933111 - RNA, 23 nt, Shigella flexneri 2a str. 301
uggcagugggccagaaaaaacgu

SEQ ID NO: 3933112 - RNA, 18 nt, Shigella flexneri 2a str. 301
uggcauaaacaaagcgca

SEQ ID NO: 3933113 - RNA, 23 nt, Shigella flexneri 2a str. 301
uggcauagcgggcauuuuuucca

SEQ ID NO: 3933114 - RNA, 22 nt, Shigella flexneri 2a str. 301
uggcaucaaacacugaaccgaa

SEQ ID NO: 3933115 - RNA, 14 nt, Shigella flexneri 2a str. 301
uggcaucacuucuu

SEQ ID NO: 3933116 - RNA, 13 nt, Shigella flexneri 2a str. 301
uggcauccuugcu

SEQ ID NO: 3933117 - RNA, 13 nt, Shigella flexneri 2a str. 301
uggcaucggcaaa

SEQ ID NO: 3933118 - RNA, 19 nt, Shigella flexneri 2a str. 301
uggcaucgggcacagcggu

SEQ ID NO: 3933119 - RNA, 18 nt, Shigella flexneri 2a str. 301
uggcaucugauaagccca

SEQ ID NO: 3933120 - RNA, 19 nt, Shigella flexneri 2a str. 301
uggcaucugauaagcccag

SEQ ID NO: 3933121 - RNA, 20 nt, Shigella flexneri 2a str. 301
uggcaucugauaagcccagc

SEQ ID NO: 3933122 - RNA, 20 nt, Shigella flexneri 2a str. 301
uggcaugcuguccagcaggc

SEQ ID NO: 3933123 - RNA, 17 nt, Shigella flexneri 2a str. 301
uggcauuaauaugcuca

SEQ ID NO: 3933124 - RNA, 14 nt, Shigella flexneri 2a str. 301
uggcauucucacuc

SEQ ID NO: 3933125 - RNA, 17 nt, Shigella flexneri 2a str. 301
uggcauuggcagagcga

SEQ ID NO: 3933126 - RNA, 17 nt, Shigella flexneri 2a str. 301
uggcauuuugcaguaac

SEQ ID NO: 3933127 - RNA, 20 nt, Shigella flexneri 2a str. 301
uggccaauuggcuggcccuu

SEQ ID NO: 3933128 - RNA, 14 nt, Shigella flexneri 2a str. 301
uggccacagauaau

SEQ ID NO: 3933129 - RNA, 22 nt, Shigella flexneri 2a str. 301
uggccagagugcguuccccgaa

SEQ ID NO: 3933130 - RNA, 13 nt, Shigella flexneri 2a str. 301
uggcccaucaucu

SEQ ID NO: 3933131 - RNA, 14 nt, Shigella flexneri 2a str. 301
uggcccaucgccag

SEQ ID NO: 3933132 - RNA, 15 nt, Shigella flexneri 2a str. 301
uggcccaucgccagu

SEQ ID NO: 3933133 - RNA, 22 nt, Shigella flexneri 2a str. 301
uggccccgcuuacgcugauuaa

SEQ ID NO: 3933134 - RNA, 17 nt, Shigella flexneri 2a str. 301
uggcccuaggcauagaa

SEQ ID NO: 3933135 - RNA, 15 nt, Shigella flexneri 2a str. 301
uggcccuugcucaau

SEQ ID NO: 3933136 - RNA, 16 nt, Shigella flexneri 2a str. 301
uggccgagaggcugaa

SEQ ID NO: 3933137 - RNA, 16 nt, Shigella flexneri 2a str. 301
uggccgauaccaucac

SEQ ID NO: 3933138 - RNA, 21 nt, Shigella flexneri 2a str. 301
uggccgauccggacaugcugc

SEQ ID NO: 3933139 - RNA, 23 nt, Shigella flexneri 2a str. 301
uggccgauccggacaugcugcac

SEQ ID NO: 3933140 - RNA, 21 nt, Shigella flexneri 2a str. 301
uggccgcacgcaguuaacgcg

SEQ ID NO: 3933141 - RNA, 19 nt, Shigella flexneri 2a str. 301
uggccgcgucuuauccggc

SEQ ID NO: 3933142 - RNA, 23 nt, Shigella flexneri 2a str. 301
uggccgucaggguugccauacag

SEQ ID NO: 3933143 - RNA, 23 nt, Shigella flexneri 2a str. 301
uggccuacgguucgggcacagau

SEQ ID NO: 3933144 - RNA, 14 nt, Shigella flexneri 2a str. 301
uggccucugccagc

SEQ ID NO: 3933145 - RNA, 15 nt, Shigella flexneri 2a str. 301
uggccugauaaacau

SEQ ID NO: 3933146 - RNA, 18 nt, Shigella flexneri 2a str. 301
uggccuuuaauaugccac

SEQ ID NO: 3933147 - RNA, 22 nt, Shigella flexneri 2a str. 301
uggccuuuuugugcuuaucgcg

SEQ ID NO: 3933148 - RNA, 15 nt, Shigella flexneri 2a str. 301
uggcgaaaucgcugc

SEQ ID NO: 3933149 - RNA, 18 nt, Shigella flexneri 2a str. 301
uggcgaaauguguuggca

SEQ ID NO: 3933150 - RNA, 19 nt, Shigella flexneri 2a str. 301
uggcgaacccaaccgugag

SEQ ID NO: 3933151 - RNA, 14 nt, Shigella flexneri 2a str. 301
uggcgacaaggcgu

SEQ ID NO: 3933152 - RNA, 22 nt, Shigella flexneri 2a str. 301
uggcgacgccgcgguucuucca

SEQ ID NO: 3933153 - RNA, 20 nt, Shigella flexneri 2a str. 301
uggcgacggcgaaucaaccg

SEQ ID NO: 3933154 - RNA, 22 nt, Shigella flexneri 2a str. 301
uggcgacgucaguuuccagcau

SEQ ID NO: 3933155 - RNA, 15 nt, Shigella flexneri 2a str. 301
uggcgacuucugcuu

SEQ ID NO: 3933156 - RNA, 16 nt, Shigella flexneri 2a str. 301
uggcgacuucugcuuu

SEQ ID NO: 3933157 - RNA, 13 nt, Shigella flexneri 2a str. 301
uggcgaggaacga

SEQ ID NO: 3933158 - RNA, 22 nt, Shigella flexneri 2a str. 301
uggcgaggaacgaucccagcgu

SEQ ID NO: 3933159 - RNA, 20 nt, Shigella flexneri 2a str. 301
uggcgauaaucagcgccagc

SEQ ID NO: 3933160 - RNA, 22 nt, Shigella flexneri 2a str. 301
uggcgaucgucgcuccaugaga

SEQ ID NO: 3933161 - RNA, 16 nt, Shigella flexneri 2a str. 301
uggcgauguaauucag

SEQ ID NO: 3933162 - RNA, 16 nt, Shigella flexneri 2a str. 301
uggcgauuauuuuccg

SEQ ID NO: 3933163 - RNA, 19 nt, Shigella flexneri 2a str. 301
uggcgauuuugaagucuuu

SEQ ID NO: 3933164 - RNA, 17 nt, Shigella flexneri 2a str. 301
uggcgcacauccgcguc

SEQ ID NO: 3933165 - RNA, 13 nt, Shigella flexneri 2a str. 301
uggcgcauccagc

SEQ ID NO: 3933166 - RNA, 16 nt, Shigella flexneri 2a str. 301
uggcgcaucggucaga

SEQ ID NO: 3933167 - RNA, 21 nt, Shigella flexneri 2a str. 301
uggcgcgaaaacaacuggcaa

SEQ ID NO: 3933168 - RNA, 18 nt, Shigella flexneri 2a str. 301
uggcgcgaacagcacauc

SEQ ID NO: 3933169 - RNA, 19 nt, Shigella flexneri 2a str. 301
uggcgcgaaccaucaccuc

SEQ ID NO: 3933170 - RNA, 22 nt, Shigella flexneri 2a str. 301
uggcgcgaagcccucaaacaac

SEQ ID NO: 3933171 - RNA, 18 nt, Shigella flexneri 2a str. 301
uggcgcguuuaaucacac

SEQ ID NO: 3933172 - RNA, 16 nt, Shigella flexneri 2a str. 301
uggcgcuaucaauacu

SEQ ID NO: 3933173 - RNA, 17 nt, Shigella flexneri 2a str. 301
uggcgcuaugcuggaug

SEQ ID NO: 3933174 - RNA, 22 nt, Shigella flexneri 2a str. 301
uggcgcucugguagauaagcaa

SEQ ID NO: 3933175 - RNA, 12 nt, Shigella flexneri 2a str. 301
uggcgcugcuca

SEQ ID NO: 3933176 - RNA, 23 nt, Shigella flexneri 2a str. 301
uggcgcuucacuggcgacaugca

SEQ ID NO: 3933177 - RNA, 16 nt, Shigella flexneri 2a str. 301
uggcggaauaccgaca

SEQ ID NO: 3933178 - RNA, 15 nt, Shigella flexneri 2a str. 301
uggcggaauugguag

SEQ ID NO: 3933179 - RNA, 17 nt, Shigella flexneri 2a str. 301
uggcgggaucaccugca

SEQ ID NO: 3933180 - RNA, 23 nt, Shigella flexneri 2a str. 301
uggcgggaucaccugcacaugca

SEQ ID NO: 3933181 - RNA, 20 nt, Shigella flexneri 2a str. 301
ugguaaagccgguuuugguu

SEQ ID NO: 3933182 - RNA, 22 nt, Shigella flexneri 2a str. 301
ugguaaaggagaggcccuggaa

SEQ ID NO: 3933183 - RNA, 22 nt, Shigella flexneri 2a str. 301
ugguaaauggcugaccagaauu

SEQ ID NO: 3933184 - RNA, 21 nt, Shigella flexneri 2a str. 301
ugguaacagugcaccggacac

SEQ ID NO: 3933185 - RNA, 17 nt, Shigella flexneri 2a str. 301
ugguaaucaccacccau

SEQ ID NO: 3933186 - RNA, 20 nt, Shigella flexneri 2a str. 301
ugguacuucaaucgccacca

SEQ ID NO: 3933187 - RNA, 16 nt, Shigella flexneri 2a str. 301
ugguagauaagcaagg

SEQ ID NO: 3933188 - RNA, 20 nt, Shigella flexneri 2a str. 301
ugguaggccggauaaggcgu

SEQ ID NO: 3933189 - RNA, 21 nt, Shigella flexneri 2a str. 301
ugguaucgccacaauaacugc

SEQ ID NO: 3933190 - RNA, 16 nt, Shigella flexneri 2a str. 301
ugguauuaaauuugcu

SEQ ID NO: 3933191 - RNA, 17 nt, Shigella flexneri 2a str. 301
ugguauuaaauuugcuu

SEQ ID NO: 3933192 - RNA, 18 nt, Shigella flexneri 2a str. 301
ugguauuuccaguccagc

SEQ ID NO: 3933193 - RNA, 19 nt, Shigella flexneri 2a str. 301
uggucagaaaaguaaacca

SEQ ID NO: 3933194 - RNA, 14 nt, Shigella flexneri 2a str. 301
uggucagaacgacc

SEQ ID NO: 3933195 - RNA, 15 nt, Shigella flexneri 2a str. 301
uggucaguuggcugg

SEQ ID NO: 3933196 - RNA, 21 nt, Shigella flexneri 2a str. 301
uggucauucggcgcagguuua

SEQ ID NO: 3933197 - RNA, 18 nt, Shigella flexneri 2a str. 301
ugguccacauccguccuc

SEQ ID NO: 3933198 - RNA, 16 nt, Shigella flexneri 2a str. 301
uggucccgacaaccug

SEQ ID NO: 3933199 - RNA, 19 nt, Shigella flexneri 2a str. 301
ugguccgcuuguaggccug

SEQ ID NO: 3933200 - RNA, 16 nt, Shigella flexneri 2a str. 301
uggucugaaucaacac

SEQ ID NO: 3933201 - RNA, 23 nt, Shigella flexneri 2a str. 301
uggucugacgcugaauacgcacc

SEQ ID NO: 3933202 - RNA, 18 nt, Shigella flexneri 2a str. 301
uggucuggaacuggcugc

SEQ ID NO: 3933203 - RNA, 19 nt, Shigella flexneri 2a str. 301
uggucuggaacuggcugcc

SEQ ID NO: 3933204 - RNA, 17 nt, Shigella flexneri 2a str. 301
uggucuguaccaccaga

SEQ ID NO: 3933205 - RNA, 21 nt, Shigella flexneri 2a str. 301
uggucuuguagguuuuggcgc

SEQ ID NO: 3933206 - RNA, 21 nt, Shigella flexneri 2a str. 301
uggugaauuugucgauuucca

SEQ ID NO: 3933207 - RNA, 15 nt, Shigella flexneri 2a str. 301
uggugacaccaugcc

SEQ ID NO: 3933208 - RNA, 20 nt, Shigella flexneri 2a str. 301
uggugacuuuugcccggcau

SEQ ID NO: 3933209 - RNA, 22 nt, Shigella flexneri 2a str. 301
uggugagccacauugcaucuga

SEQ ID NO: 3933210 - RNA, 17 nt, Shigella flexneri 2a str. 301
uggugagccugcugucc

SEQ ID NO: 3933211 - RNA, 23 nt, Shigella flexneri 2a str. 301
uggugauggacaacgcuuuuugg

SEQ ID NO: 3933212 - RNA, 20 nt, Shigella flexneri 2a str. 301
uggugauugccggaauggug

SEQ ID NO: 3933213 - RNA, 20 nt, Shigella flexneri 2a str. 301
uggugcaagaaaugacagag

SEQ ID NO: 3933214 - RNA, 17 nt, Shigella flexneri 2a str. 301
uggugcaaggaaauaau

SEQ ID NO: 3933215 - RNA, 19 nt, Shigella flexneri 2a str. 301
uggugcaauuucagcgucc

SEQ ID NO: 3933216 - RNA, 22 nt, Shigella flexneri 2a str. 301
uggugccagauuuaacggcagc

SEQ ID NO: 3933217 - RNA, 20 nt, Shigella flexneri 2a str. 301
uggugccgaugauuuacauc

SEQ ID NO: 3933218 - RNA, 17 nt, Shigella flexneri 2a str. 301
uggugcuuugcuguguu

SEQ ID NO: 3933219 - RNA, 16 nt, Shigella flexneri 2a str. 301
ugguggacaaccauaa

SEQ ID NO: 3933220 - RNA, 14 nt, Shigella flexneri 2a str. 301
ugguggcagccagc

SEQ ID NO: 3933221 - RNA, 20 nt, Shigella flexneri 2a str. 301
uggugguuuguucgcucuau

SEQ ID NO: 3933222 - RNA, 22 nt, Shigella flexneri 2a str. 301
ugguguaacuuuagucgcccau

SEQ ID NO: 3933223 - RNA, 20 nt, Shigella flexneri 2a str. 301
ugguguggagugcagcaugc

SEQ ID NO: 3933224 - RNA, 16 nt, Shigella flexneri 2a str. 301
ugguguggcugcacac

SEQ ID NO: 3933225 - RNA, 13 nt, Shigella flexneri 2a str. 301
ugguguuaaaucu

SEQ ID NO: 3933226 - RNA, 18 nt, Shigella flexneri 2a str. 301
ugguguuaaaucuguuca

SEQ ID NO: 3933227 - RNA, 18 nt, Shigella flexneri 2a str. 301
ugguguucggcauucugc

SEQ ID NO: 3933228 - RNA, 22 nt, Shigella flexneri 2a str. 301
ugguuaacaaucacaauagaaa

SEQ ID NO: 3933229 - RNA, 17 nt, Shigella flexneri 2a str. 301
ugguuaacgaaucaauc

SEQ ID NO: 3933230 - RNA, 12 nt, Shigella flexneri 2a str. 301
ugguuacacggg

SEQ ID NO: 3933231 - RNA, 15 nt, Shigella flexneri 2a str. 301
ugguuaccaucaacc

SEQ ID NO: 3933232 - RNA, 21 nt, Shigella flexneri 2a str. 301
ugguuacgcauaaaaccagca

SEQ ID NO: 3933233 - RNA, 23 nt, Shigella flexneri 2a str. 301
ugguuagcggcgguaaaaucauc

SEQ ID NO: 3933234 - RNA, 14 nt, Shigella flexneri 2a str. 301
ugguuauauuuccc

SEQ ID NO: 3933235 - RNA, 15 nt, Shigella flexneri 2a str. 301
ugguuauauuucccc

SEQ ID NO: 3933236 - RNA, 19 nt, Shigella flexneri 2a str. 301
ugguuaucuuccaccacca

SEQ ID NO: 3933237 - RNA, 14 nt, Shigella flexneri 2a str. 301
ugguuaugccauuu

SEQ ID NO: 3933238 - RNA, 16 nt, Shigella flexneri 2a str. 301
ugguucccaacaacag

SEQ ID NO: 3933239 - RNA, 18 nt, Shigella flexneri 2a str. 301
ugguucccaacaacagcg

SEQ ID NO: 3933240 - RNA, 18 nt, Shigella flexneri 2a str. 301
ugguucgacggccaguca

SEQ ID NO: 3933241 - RNA, 22 nt, Shigella flexneri 2a str. 301
ugguucggcaaaaucuuccaga

SEQ ID NO: 3933242 - RNA, 14 nt, Shigella flexneri 2a str. 301
ugguugcaugauga

SEQ ID NO: 3933243 - RNA, 14 nt, Shigella flexneri 2a str. 301
ugguugccagccac

SEQ ID NO: 3933244 - RNA, 20 nt, Shigella flexneri 2a str. 301
ugguugccagccacaccugg

SEQ ID NO: 3933245 - RNA, 12 nt, Shigella flexneri 2a str. 301
ugguuggccauc

SEQ ID NO: 3933246 - RNA, 15 nt, Shigella flexneri 2a str. 301
ugguuguaauccacc

SEQ ID NO: 3933247 - RNA, 14 nt, Shigella flexneri 2a str. 301
ugguugucaccgcc

SEQ ID NO: 3933248 - RNA, 17 nt, Shigella flexneri 2a str. 301
ugguugucaccgccagg

SEQ ID NO: 3933249 - RNA, 15 nt, Shigella flexneri 2a str. 301
ugguuuaugcaauau

SEQ ID NO: 3933250 - RNA, 17 nt, Shigella flexneri 2a str. 301
ugguuucagccggaucg

SEQ ID NO: 3933251 - RNA, 16 nt, Shigella flexneri 2a str. 301
ugguuucaguaauccu

SEQ ID NO: 3933252 - RNA, 15 nt, Shigella flexneri 2a str. 301
ugguuuccagcaucg

SEQ ID NO: 3933253 - RNA, 16 nt, Shigella flexneri 2a str. 301
ugguuucgccagcacc

SEQ ID NO: 3933254 - RNA, 17 nt, Shigella flexneri 2a str. 301
ugguuugauagcaauac

SEQ ID NO: 3933255 - RNA, 14 nt, Shigella flexneri 2a str. 301
ugguuuggaucugu

SEQ ID NO: 3933256 - RNA, 14 nt, Shigella flexneri 2a str. 301
ugguuuguuuucag

SEQ ID NO: 3933257 - RNA, 16 nt, Shigella flexneri 2a str. 301
ugguuuuccugagcaa

SEQ ID NO: 3933258 - RNA, 17 nt, Shigella flexneri 2a str. 301
ugguuuugaacagcggu

SEQ ID NO: 3933259 - RNA, 20 nt, Shigella flexneri 2a str. 301
ugguuuuucgauuuaaauga

SEQ ID NO: 3933260 - RNA, 19 nt, Shigella flexneri 2a str. 301
uguaaaacagcacuccugc

SEQ ID NO: 3933261 - RNA, 23 nt, Shigella flexneri 2a str. 301
uguaaaaccaacaguaucugaau

SEQ ID NO: 3933262 - RNA, 23 nt, Shigella flexneri 2a str. 301
uguaaaaugagugccaaaaaaau

SEQ ID NO: 3933263 - RNA, 13 nt, Shigella flexneri 2a str. 301
uguaaaccucuuu

SEQ ID NO: 3933264 - RNA, 14 nt, Shigella flexneri 2a str. 301
uguaaaccucuuuc

SEQ ID NO: 3933265 - RNA, 18 nt, Shigella flexneri 2a str. 301
uguaaacgaagcgccauu

SEQ ID NO: 3933266 - RNA, 14 nt, Shigella flexneri 2a str. 301
uguaaaugaacuca

SEQ ID NO: 3933267 - RNA, 13 nt, Shigella flexneri 2a str. 301
uguaaaugcugcu

SEQ ID NO: 3933268 - RNA, 19 nt, Shigella flexneri 2a str. 301
uguaaauucucaauaucau

SEQ ID NO: 3933269 - RNA, 14 nt, Shigella flexneri 2a str. 301
uguaacaaaaaaca

SEQ ID NO: 3933270 - RNA, 13 nt, Shigella flexneri 2a str. 301
uguaacaacuggc

SEQ ID NO: 3933271 - RNA, 15 nt, Shigella flexneri 2a str. 301
uguaacauaccuaaa

SEQ ID NO: 3933272 - RNA, 18 nt, Shigella flexneri 2a str. 301
uguaacgccggguaaaug

SEQ ID NO: 3933273 - RNA, 18 nt, Shigella flexneri 2a str. 301
uguaacgccuuuuccagc

SEQ ID NO: 3933274 - RNA, 19 nt, Shigella flexneri 2a str. 301
uguaacgccuuuuccagcg

SEQ ID NO: 3933275 - RNA, 17 nt, Shigella flexneri 2a str. 301
uguaacggagguacaac

SEQ ID NO: 3933276 - RNA, 20 nt, Shigella flexneri 2a str. 301
uguaacuggguuuguccaua

SEQ ID NO: 3933277 - RNA, 21 nt, Shigella flexneri 2a str. 301
uguaagacauuuaacccuuca

SEQ ID NO: 3933278 - RNA, 16 nt, Shigella flexneri 2a str. 301
uguaagcagaaaagcc

SEQ ID NO: 3933279 - RNA, 16 nt, Shigella flexneri 2a str. 301
uguaagucggucacag

SEQ ID NO: 3933280 - RNA, 19 nt, Shigella flexneri 2a str. 301
uguaauacggcucucaccu

SEQ ID NO: 3933281 - RNA, 17 nt, Shigella flexneri 2a str. 301
uguccggcgcacuggug

SEQ ID NO: 3933282 - RNA, 15 nt, Shigella flexneri 2a str. 301
uguccguuuguggug

SEQ ID NO: 3933283 - RNA, 19 nt, Shigella flexneri 2a str. 301
uguccuaaaaaauuaacaa

SEQ ID NO: 3933284 - RNA, 15 nt, Shigella flexneri 2a str. 301
ugucgaaaccgacag

SEQ ID NO: 3933285 - RNA, 19 nt, Shigella flexneri 2a str. 301
ugucgagauuaaacaaggu

SEQ ID NO: 3933286 - RNA, 12 nt, Shigella flexneri 2a str. 301
ugucgagugaau

SEQ ID NO: 3933287 - RNA, 22 nt, Shigella flexneri 2a str. 301
ugucgauaaaguuagagccagg

SEQ ID NO: 3933288 - RNA, 15 nt, Shigella flexneri 2a str. 301
ugucgaucuccgccu

SEQ ID NO: 3933289 - RNA, 14 nt, Shigella flexneri 2a str. 301
ugucgcagccagcg

SEQ ID NO: 3933290 - RNA, 22 nt, Shigella flexneri 2a str. 301
ugucgcauccgacaaggcauca

SEQ ID NO: 3933291 - RNA, 15 nt, Shigella flexneri 2a str. 301
ugucgcauccggcaa

SEQ ID NO: 3933292 - RNA, 22 nt, Shigella flexneri 2a str. 301
ugucgcauccggcaauuggugc

SEQ ID NO: 3933293 - RNA, 16 nt, Shigella flexneri 2a str. 301
ugucgccgcuaacauc

SEQ ID NO: 3933294 - RNA, 14 nt, Shigella flexneri 2a str. 301
ugucgcgccaggcg

SEQ ID NO: 3933295 - RNA, 20 nt, Shigella flexneri 2a str. 301
ugucgcucaaugcgcugagu

SEQ ID NO: 3933296 - RNA, 15 nt, Shigella flexneri 2a str. 301
ugucgcuguuucugg

SEQ ID NO: 3933297 - RNA, 16 nt, Shigella flexneri 2a str. 301
ugucgcuguuucugga

SEQ ID NO: 3933298 - RNA, 15 nt, Shigella flexneri 2a str. 301
ugucggcaagauacu

SEQ ID NO: 3933299 - RNA, 14 nt, Shigella flexneri 2a str. 301
ugucggcgauaaua

SEQ ID NO: 3933300 - RNA, 17 nt, Shigella flexneri 2a str. 301
ugucgggcaggcuucaa

SEQ ID NO: 3933301 - RNA, 18 nt, Shigella flexneri 2a str. 301
ugucgggccgcacgcugu

SEQ ID NO: 3933302 - RNA, 19 nt, Shigella flexneri 2a str. 301
ugucgggcguuucgccagg

SEQ ID NO: 3933303 - RNA, 20 nt, Shigella flexneri 2a str. 301
ugucgguggcgggcaagcgg

SEQ ID NO: 3933304 - RNA, 15 nt, Shigella flexneri 2a str. 301
ugucgguuuguacuc

SEQ ID NO: 3933305 - RNA, 14 nt, Shigella flexneri 2a str. 301
ugucguuauauaaa

SEQ ID NO: 3933306 - RNA, 23 nt, Shigella flexneri 2a str. 301
ugucuaacaugagguccagcgag

SEQ ID NO: 3933307 - RNA, 20 nt, Shigella flexneri 2a str. 301
ugucuaacccgcgacuggcg

SEQ ID NO: 3933308 - RNA, 15 nt, Shigella flexneri 2a str. 301
ugucuaccagcaccu

SEQ ID NO: 3933309 - RNA, 20 nt, Shigella flexneri 2a str. 301
ugucuacgcccggcaguucg

SEQ ID NO: 3933310 - RNA, 15 nt, Shigella flexneri 2a str. 301
ugucuauuuccaccc

SEQ ID NO: 3933311 - RNA, 13 nt, Shigella flexneri 2a str. 301
ugucucagcuuca

SEQ ID NO: 3933312 - RNA, 18 nt, Shigella flexneri 2a str. 301
ugucuccggcauccagcg

SEQ ID NO: 3933313 - RNA, 22 nt, Shigella flexneri 2a str. 301
ugucugaugcgcugcgcuuauc

SEQ ID NO: 3933314 - RNA, 15 nt, Shigella flexneri 2a str. 301
ugucugcuucugccu

SEQ ID NO: 3933315 - RNA, 23 nt, Shigella flexneri 2a str. 301
ugucuggacgcucaggcuacuuu

SEQ ID NO: 3933316 - RNA, 17 nt, Shigella flexneri 2a str. 301
ugucuguacggcaguga

SEQ ID NO: 3933317 - RNA, 15 nt, Shigella flexneri 2a str. 301
ugucuuaucaggccu

SEQ ID NO: 3933318 - RNA, 16 nt, Shigella flexneri 2a str. 301
ugucuuaucuggcauu

SEQ ID NO: 3933319 - RNA, 16 nt, Shigella flexneri 2a str. 301
ugucuuccuguggugc

SEQ ID NO: 3933320 - RNA, 12 nt, Shigella flexneri 2a str. 301
ugucuuuacccg

SEQ ID NO: 3933321 - RNA, 22 nt, Shigella flexneri 2a str. 301
ugucuuucucaucuuucagaau

SEQ ID NO: 3933322 - RNA, 23 nt, Shigella flexneri 2a str. 301
ugucuuuugaucugcuaaacgua

SEQ ID NO: 3933323 - RNA, 17 nt, Shigella flexneri 2a str. 301
ugucuuuuuacucccgc

SEQ ID NO: 3933324 - RNA, 14 nt, Shigella flexneri 2a str. 301
ugugaaccucacag

SEQ ID NO: 3933325 - RNA, 17 nt, Shigella flexneri 2a str. 301
ugugaacgagaaaauga

SEQ ID NO: 3933326 - RNA, 23 nt, Shigella flexneri 2a str. 301
ugugaacucaggcugccagauca

SEQ ID NO: 3933327 - RNA, 16 nt, Shigella flexneri 2a str. 301
ugugacuggaaaucaa

SEQ ID NO: 3933328 - RNA, 14 nt, Shigella flexneri 2a str. 301
ugugaucuuuuucg

SEQ ID NO: 3933329 - RNA, 15 nt, Shigella flexneri 2a str. 301
ugugaucuuuuucgc

SEQ ID NO: 3933330 - RNA, 14 nt, Shigella flexneri 2a str. 301
ugugauggcuauua

SEQ ID NO: 3933331 - RNA, 17 nt, Shigella flexneri 2a str. 301
ugugcaaauucaauaaa

SEQ ID NO: 3933332 - RNA, 15 nt, Shigella flexneri 2a str. 301
ugugcaaccuuuucc

SEQ ID NO: 3933333 - RNA, 14 nt, Shigella flexneri 2a str. 301
ugugcaccuuuucc

SEQ ID NO: 3933334 - RNA, 15 nt, Shigella flexneri 2a str. 301
ugugcagcaugcacc

SEQ ID NO: 3933335 - RNA, 17 nt, Shigella flexneri 2a str. 301
ugugcagcguacuucau

SEQ ID NO: 3933336 - RNA, 20 nt, Shigella flexneri 2a str. 301
ugugcaucaggcaaacuuca

SEQ ID NO: 3933337 - RNA, 12 nt, Shigella flexneri 2a str. 301
ugugccagaacc

SEQ ID NO: 3933338 - RNA, 19 nt, Shigella flexneri 2a str. 301
ugugccagcucgugcagaa

SEQ ID NO: 3933339 - RNA, 13 nt, Shigella flexneri 2a str. 301
ugugccaggacuu

SEQ ID NO: 3933340 - RNA, 16 nt, Shigella flexneri 2a str. 301
ugugccgcgacagauu

SEQ ID NO: 3933341 - RNA, 18 nt, Shigella flexneri 2a str. 301
ugugccgcgaugauuggg

SEQ ID NO: 3933342 - RNA, 23 nt, Shigella flexneri 2a str. 301
ugugccugucgggacacgaacgu

SEQ ID NO: 3933343 - RNA, 17 nt, Shigella flexneri 2a str. 301
ugugcgagcaaagcgca

SEQ ID NO: 3933344 - RNA, 20 nt, Shigella flexneri 2a str. 301
ugugcgccacauccggcaua

SEQ ID NO: 3933345 - RNA, 21 nt, Shigella flexneri 2a str. 301
ugugcgccauuuuuuugucug

SEQ ID NO: 3933346 - RNA, 21 nt, Shigella flexneri 2a str. 301
ugugcguuacccacaguuuca

SEQ ID NO: 3933347 - RNA, 16 nt, Shigella flexneri 2a str. 301
ugugcuggcaaaucag

SEQ ID NO: 3933348 - RNA, 14 nt, Shigella flexneri 2a str. 301
ugugcuuuguucau

SEQ ID NO: 3933349 - RNA, 15 nt, Shigella flexneri 2a str. 301
uguggaacgugcugc

SEQ ID NO: 3933350 - RNA, 19 nt, Shigella flexneri 2a str. 301
uguggagugcagcaugcac

SEQ ID NO: 3933351 - RNA, 20 nt, Shigella flexneri 2a str. 301
uguggagugcagcaugcacc

SEQ ID NO: 3933352 - RNA, 17 nt, Shigella flexneri 2a str. 301
uguggaucgauuucaau

SEQ ID NO: 3933353 - RNA, 19 nt, Shigella flexneri 2a str. 301
uguggauuaugcgcggcau

SEQ ID NO: 3933354 - RNA, 15 nt, Shigella flexneri 2a str. 301
uguggcagcaacugg

SEQ ID NO: 3933355 - RNA, 15 nt, Shigella flexneri 2a str. 301
uguggcccagccuuu

SEQ ID NO: 3933356 - RNA, 18 nt, Shigella flexneri 2a str. 301
uguggcggcgcgaggcga

SEQ ID NO: 3933357 - RNA, 18 nt, Shigella flexneri 2a str. 301
uguggcugcacaccuucu

SEQ ID NO: 3933358 - RNA, 17 nt, Shigella flexneri 2a str. 301
ugugggauuccagcgcc

SEQ ID NO: 3933359 - RNA, 15 nt, Shigella flexneri 2a str. 301
ugugggauugcuuca

SEQ ID NO: 3933360 - RNA, 23 nt, Shigella flexneri 2a str. 301
uguggggaacagaauguuugcca

SEQ ID NO: 3933361 - RNA, 16 nt, Shigella flexneri 2a str. 301
ugugggucgaggaaau

SEQ ID NO: 3933362 - RNA, 16 nt, Shigella flexneri 2a str. 301
uguggugcaggcgcag

SEQ ID NO: 3933363 - RNA, 23 nt, Shigella flexneri 2a str. 301
ugugguguaacgagacaaugcaa

SEQ ID NO: 3933364 - RNA, 15 nt, Shigella flexneri 2a str. 301
ugugguguuuuuuua

SEQ ID NO: 3933365 - RNA, 21 nt, Shigella flexneri 2a str. 301
ugugguuggcguguuucagcu

SEQ ID NO: 3933366 - RNA, 20 nt, Shigella flexneri 2a str. 301
ugugguuugucauuggcagc

SEQ ID NO: 3933367 - RNA, 23 nt, Shigella flexneri 2a str. 301
uguguaggcguugaugccggaug

SEQ ID NO: 3933368 - RNA, 13 nt, Shigella flexneri 2a str. 301
uguguauacggca

SEQ ID NO: 3933369 - RNA, 15 nt, Shigella flexneri 2a str. 301
ugugucagcgccaga

SEQ ID NO: 3933370 - RNA, 12 nt, Shigella flexneri 2a str. 301
ugugucgccagc

SEQ ID NO: 3933371 - RNA, 14 nt, Shigella flexneri 2a str. 301
ugugucuuauuggc

SEQ ID NO: 3933372 - RNA, 12 nt, Shigella flexneri 2a str. 301
ugugugaaaguc

SEQ ID NO: 3933373 - RNA, 15 nt, Shigella flexneri 2a str. 301
ugugugccagguucg

SEQ ID NO: 3933374 - RNA, 20 nt, Shigella flexneri 2a str. 301
uguguugcugaacuuaugca

SEQ ID NO: 3933375 - RNA, 23 nt, Shigella flexneri 2a str. 301
uguguuggcaccaucccuaugca

SEQ ID NO: 3933376 - RNA, 13 nt, Shigella flexneri 2a str. 301
uguguuuuuauuu

SEQ ID NO: 3933377 - RNA, 19 nt, Shigella flexneri 2a str. 301
uguuaaaacgcacgcuguc

SEQ ID NO: 3933378 - RNA, 14 nt, Shigella flexneri 2a str. 301
uguuacaaccuccu

SEQ ID NO: 3933379 - RNA, 21 nt, Shigella flexneri 2a str. 301
uguuacgauagaauauuucua

SEQ ID NO: 3933380 - RNA, 21 nt, Shigella flexneri 2a str. 301
uguuacgcaaaaccucuucca

SEQ ID NO: 3933381 - RNA, 17 nt, Shigella flexneri 2a str. 301
uuaaacagcuuggauuc

SEQ ID NO: 3933382 - RNA, 15 nt, Shigella flexneri 2a str. 301
uuaaacauuaaaauu

SEQ ID NO: 3933383 - RNA, 12 nt, Shigella flexneri 2a str. 301
uuaaaccugauu

SEQ ID NO: 3933384 - RNA, 18 nt, Shigella flexneri 2a str. 301
uuaaacgauuccacuuuu

SEQ ID NO: 3933385 - RNA, 22 nt, Shigella flexneri 2a str. 301
uuaaacgcaguaagcgccaggg

SEQ ID NO: 3933386 - RNA, 18 nt, Shigella flexneri 2a str. 301
uuaaacgggucaucaaaa

SEQ ID NO: 3933387 - RNA, 20 nt, Shigella flexneri 2a str. 301
uuaaacgggucaucaaaauc

SEQ ID NO: 3933388 - RNA, 15 nt, Shigella flexneri 2a str. 301
uuaaacucugccgca

SEQ ID NO: 3933389 - RNA, 23 nt, Shigella flexneri 2a str. 301
uuaaagacggcggcaacauggca

SEQ ID NO: 3933390 - RNA, 17 nt, Shigella flexneri 2a str. 301
uuaaagagacagaauca

SEQ ID NO: 3933391 - RNA, 19 nt, Shigella flexneri 2a str. 301
uuaaagccgccaaacggau

SEQ ID NO: 3933392 - RNA, 12 nt, Shigella flexneri 2a str. 301
uuaaagccggug

SEQ ID NO: 3933393 - RNA, 18 nt, Shigella flexneri 2a str. 301
uuaaaggaaggucaucca

SEQ ID NO: 3933394 - RNA, 14 nt, Shigella flexneri 2a str. 301
uuaaaguuaucgcc

SEQ ID NO: 3933395 - RNA, 21 nt, Shigella flexneri 2a str. 301
uuaaaguugagcgaaaacgaa

SEQ ID NO: 3933396 - RNA, 17 nt, Shigella flexneri 2a str. 301
uuaaauacagcuuaauc

SEQ ID NO: 3933397 - RNA, 18 nt, Shigella flexneri 2a str. 301
uuaaauacagcuuaauca

SEQ ID NO: 3933398 - RNA, 15 nt, Shigella flexneri 2a str. 301
uuaaauauaaaacaa

SEQ ID NO: 3933399 - RNA, 16 nt, Shigella flexneri 2a str. 301
uuaaauaucaucaaaa

SEQ ID NO: 3933400 - RNA, 23 nt, Shigella flexneri 2a str. 301
uuaaauauuaaggguaaaaggau

SEQ ID NO: 3933401 - RNA, 21 nt, Shigella flexneri 2a str. 301
uuaaaucccgcuucaacgacc

SEQ ID NO: 3933402 - RNA, 18 nt, Shigella flexneri 2a str. 301
uuaaauccugucuggcga

SEQ ID NO: 3933403 - RNA, 20 nt, Shigella flexneri 2a str. 301
uuaaaucgguauuuccauuu

SEQ ID NO: 3933404 - RNA, 17 nt, Shigella flexneri 2a str. 301
uuaaauggacgcaaaaa

SEQ ID NO: 3933405 - RNA, 22 nt, Shigella flexneri 2a str. 301
uuaaauucgcugcggacaaaac

SEQ ID NO: 3933406 - RNA, 13 nt, Shigella flexneri 2a str. 301
uuaaauuuaauaa

SEQ ID NO: 3933407 - RNA, 23 nt, Shigella flexneri 2a str. 301
uuaacaacacccggucagccauu

SEQ ID NO: 3933408 - RNA, 16 nt, Shigella flexneri 2a str. 301
uuaacacacaauuacc

SEQ ID NO: 3933409 - RNA, 18 nt, Shigella flexneri 2a str. 301
uuaacaccugcaacgguu

SEQ ID NO: 3933410 - RNA, 20 nt, Shigella flexneri 2a str. 301
uuaacacugagaauugaagu

SEQ ID NO: 3933411 - RNA, 15 nt, Shigella flexneri 2a str. 301
uuaacauccaucgcc

SEQ ID NO: 3933412 - RNA, 11 nt, Shigella flexneri 2a str. 301
uuaacauuaac

SEQ ID NO: 3933413 - RNA, 14 nt, Shigella flexneri 2a str. 301
uuaaccaacaauaa

SEQ ID NO: 3933414 - RNA, 23 nt, Shigella flexneri 2a str. 301
uuaaccaccaguaaauugucgcc

SEQ ID NO: 3933415 - RNA, 17 nt, Shigella flexneri 2a str. 301
uuaaccacuucagaacc

SEQ ID NO: 3933416 - RNA, 15 nt, Shigella flexneri 2a str. 301
uuaaccagcaccagc

SEQ ID NO: 3933417 - RNA, 17 nt, Shigella flexneri 2a str. 301
uuaacccgcaacagcaa

SEQ ID NO: 3933418 - RNA, 14 nt, Shigella flexneri 2a str. 301
uuaaccuuauauug

SEQ ID NO: 3933419 - RNA, 22 nt, Shigella flexneri 2a str. 301
uuaaccuuugcgguuaaaaaua

SEQ ID NO: 3933420 - RNA, 14 nt, Shigella flexneri 2a str. 301
uuaacgaaagcgcc

SEQ ID NO: 3933421 - RNA, 20 nt, Shigella flexneri 2a str. 301
uuaacgcagaaucuucuucu

SEQ ID NO: 3933422 - RNA, 15 nt, Shigella flexneri 2a str. 301
uuaacgggcagguca

SEQ ID NO: 3933423 - RNA, 21 nt, Shigella flexneri 2a str. 301
uuaacgguaucuuuccagccc

SEQ ID NO: 3933424 - RNA, 18 nt, Shigella flexneri 2a str. 301
uuaacuccuucuaaagca

SEQ ID NO: 3933425 - RNA, 23 nt, Shigella flexneri 2a str. 301
uuaacugacuuucguuugaaaac

SEQ ID NO: 3933426 - RNA, 21 nt, Shigella flexneri 2a str. 301
uuaacugcccgaucaacggau

SEQ ID NO: 3933427 - RNA, 19 nt, Shigella flexneri 2a str. 301
uuaacugcgcgauuaucau

SEQ ID NO: 3933428 - RNA, 20 nt, Shigella flexneri 2a str. 301
uuaacugcgcgauuaucauu

SEQ ID NO: 3933429 - RNA, 17 nt, Shigella flexneri 2a str. 301
uuaacugcuuaucauca

SEQ ID NO: 3933430 - RNA, 22 nt, Shigella flexneri 2a str. 301
uuaacugggcgucaaagugaaa

SEQ ID NO: 3933431 - RNA, 17 nt, Shigella flexneri 2a str. 301
uuaacuguaugcaugca

SEQ ID NO: 3933432 - RNA, 22 nt, Shigella flexneri 2a str. 301
uuaagaagaucguggagaacaa

SEQ ID NO: 3933433 - RNA, 22 nt, Shigella flexneri 2a str. 301
uuaagauaacguugaugcaggc

SEQ ID NO: 3933434 - RNA, 17 nt, Shigella flexneri 2a str. 301
uuaagcaacugacuggc

SEQ ID NO: 3933435 - RNA, 22 nt, Shigella flexneri 2a str. 301
uuaagcaacugacuggcucuuu

SEQ ID NO: 3933436 - RNA, 21 nt, Shigella flexneri 2a str. 301
uuaagcaagugcaaucuacaa

SEQ ID NO: 3933437 - RNA, 22 nt, Shigella flexneri 2a str. 301
uuaagcaagugcaaucuacaaa

SEQ ID NO: 3933438 - RNA, 20 nt, Shigella flexneri 2a str. 301
uuaagcaauaccgcgaauca

SEQ ID NO: 3933439 - RNA, 18 nt, Shigella flexneri 2a str. 301
uuaagccaguucucacca

SEQ ID NO: 3933440 - RNA, 20 nt, Shigella flexneri 2a str. 301
uuaagcccaguucagcggcu

SEQ ID NO: 3933441 - RNA, 14 nt, Shigella flexneri 2a str. 301
uuaagccgcugugu

SEQ ID NO: 3933442 - RNA, 15 nt, Shigella flexneri 2a str. 301
uuaaggaaaaacgaa

SEQ ID NO: 3933443 - RNA, 13 nt, Shigella flexneri 2a str. 301
uuaaggguaaaaa

SEQ ID NO: 3933444 - RNA, 13 nt, Shigella flexneri 2a str. 301
uuaagggugauca

SEQ ID NO: 3933445 - RNA, 14 nt, Shigella flexneri 2a str. 301
uuaaguaugcaaua

SEQ ID NO: 3933446 - RNA, 20 nt, Shigella flexneri 2a str. 301
uuaaguguccgccaauuuca

SEQ ID NO: 3933447 - RNA, 13 nt, Shigella flexneri 2a str. 301
uuaaguuuauccc

SEQ ID NO: 3933448 - RNA, 19 nt, Shigella flexneri 2a str. 301
uuaauaaaauacuuuuacu

SEQ ID NO: 3933449 - RNA, 21 nt, Shigella flexneri 2a str. 301
uuaauaaaauuauccagcuuu

SEQ ID NO: 3933450 - RNA, 14 nt, Shigella flexneri 2a str. 301
uuaauaaacaucag

SEQ ID NO: 3933451 - RNA, 15 nt, Shigella flexneri 2a str. 301
uuaauaaauauuaau

SEQ ID NO: 3933452 - RNA, 20 nt, Shigella flexneri 2a str. 301
uuaauaaauuuagcuguccc

SEQ ID NO: 3933453 - RNA, 18 nt, Shigella flexneri 2a str. 301
uuaauaacacauauauua

SEQ ID NO: 3933454 - RNA, 20 nt, Shigella flexneri 2a str. 301
uuaauaacacauauauuaau

SEQ ID NO: 3933455 - RNA, 18 nt, Shigella flexneri 2a str. 301
uuaauaacgacauauaca

SEQ ID NO: 3933456 - RNA, 19 nt, Shigella flexneri 2a str. 301
uuaauaugcucaacaauaa

SEQ ID NO: 3933457 - RNA, 18 nt, Shigella flexneri 2a str. 301
uuaauauuaacuuaauaa

SEQ ID NO: 3933458 - RNA, 14 nt, Shigella flexneri 2a str. 301
uuaaucaacucacg

SEQ ID NO: 3933459 - RNA, 20 nt, Shigella flexneri 2a str. 301
uuaaucagcgaguuaccuua

SEQ ID NO: 3933460 - RNA, 13 nt, Shigella flexneri 2a str. 301
uuaaucagugcaa

SEQ ID NO: 3933461 - RNA, 13 nt, Shigella flexneri 2a str. 301
uuaaucaucaaug

SEQ ID NO: 3933462 - RNA, 13 nt, Shigella flexneri 2a str. 301
uuaaucaucauua

SEQ ID NO: 3933463 - RNA, 21 nt, Shigella flexneri 2a str. 301
uuaaucauccaccuuaaaaca

SEQ ID NO: 3933464 - RNA, 23 nt, Shigella flexneri 2a str. 301
uuaauccgcaaauaacguaaaaa

SEQ ID NO: 3933465 - RNA, 22 nt, Shigella flexneri 2a str. 301
uuaaucgccguauaauaucuuu

SEQ ID NO: 3933466 - RNA, 13 nt, Shigella flexneri 2a str. 301
uuaaucgcuucau

SEQ ID NO: 3933467 - RNA, 21 nt, Shigella flexneri 2a str. 301
uuaaucgucgguuccguucau

SEQ ID NO: 3933468 - RNA, 13 nt, Shigella flexneri 2a str. 301
uuaaucuuuuugg

SEQ ID NO: 3933469 - RNA, 23 nt, Shigella flexneri 2a str. 301
uuaaugaucgcgccgccgcccau

SEQ ID NO: 3933470 - RNA, 19 nt, Shigella flexneri 2a str. 301
uuaaugccacauuagauaa

SEQ ID NO: 3933471 - RNA, 19 nt, Shigella flexneri 2a str. 301
uuaaugccucuccccagcg

SEQ ID NO: 3933472 - RNA, 20 nt, Shigella flexneri 2a str. 301
uuaaugcgcuuccugcagcu

SEQ ID NO: 3933473 - RNA, 13 nt, Shigella flexneri 2a str. 301
uuaaugcgcuuuu

SEQ ID NO: 3933474 - RNA, 23 nt, Shigella flexneri 2a str. 301
uuaaugcggcaguaagcgcggcu

SEQ ID NO: 3933475 - RNA, 20 nt, Shigella flexneri 2a str. 301
uuaauggcagauaauccaga

SEQ ID NO: 3933476 - RNA, 20 nt, Shigella flexneri 2a str. 301
uuaauggcgauaaucgaacc

SEQ ID NO: 3933477 - RNA, 17 nt, Shigella flexneri 2a str. 301
uuaaugugucugaaagc

SEQ ID NO: 3933478 - RNA, 18 nt, Shigella flexneri 2a str. 301
uuaauuacugagaacgca

SEQ ID NO: 3933479 - RNA, 19 nt, Shigella flexneri 2a str. 301
uuaauuauccccucaaccu

SEQ ID NO: 3933480 - RNA, 12 nt, Shigella flexneri 2a str. 301
uuacuuuccuua

SEQ ID NO: 3933481 - RNA, 20 nt, Shigella flexneri 2a str. 301
uuacuuucggugacuucaaa

SEQ ID NO: 3933482 - RNA, 15 nt, Shigella flexneri 2a str. 301
uuagaaacaaaaaaa

SEQ ID NO: 3933483 - RNA, 16 nt, Shigella flexneri 2a str. 301
uuagaaacaaaaaaac

SEQ ID NO: 3933484 - RNA, 23 nt, Shigella flexneri 2a str. 301
uuagaaacaaaaaaaccgccuca

SEQ ID NO: 3933485 - RNA, 21 nt, Shigella flexneri 2a str. 301
uuagaaauucacagguaacau

SEQ ID NO: 3933486 - RNA, 19 nt, Shigella flexneri 2a str. 301
uuagacggcgcaacauccg

SEQ ID NO: 3933487 - RNA, 13 nt, Shigella flexneri 2a str. 301
uuagacuuuaguc

SEQ ID NO: 3933488 - RNA, 16 nt, Shigella flexneri 2a str. 301
uuagaggucaguuuga

SEQ ID NO: 3933489 - RNA, 16 nt, Shigella flexneri 2a str. 301
uuagaugauggcauuc

SEQ ID NO: 3933490 - RNA, 13 nt, Shigella flexneri 2a str. 301
uuagaugcuuuca

SEQ ID NO: 3933491 - RNA, 18 nt, Shigella flexneri 2a str. 301
uuagcaaaauagcuguuu

SEQ ID NO: 3933492 - RNA, 19 nt, Shigella flexneri 2a str. 301
uuagcaaauuaucccccag

SEQ ID NO: 3933493 - RNA, 19 nt, Shigella flexneri 2a str. 301
uuagcaaccaaaaaaagaa

SEQ ID NO: 3933494 - RNA, 16 nt, Shigella flexneri 2a str. 301
uuagcaauauuuuuau

SEQ ID NO: 3933495 - RNA, 20 nt, Shigella flexneri 2a str. 301
uuagcagcaugauaucaaaa

SEQ ID NO: 3933496 - RNA, 14 nt, Shigella flexneri 2a str. 301
uuagcaucagucuc

SEQ ID NO: 3933497 - RNA, 17 nt, Shigella flexneri 2a str. 301
uuagccacaaagcaggg

SEQ ID NO: 3933498 - RNA, 13 nt, Shigella flexneri 2a str. 301
uuagccauaaaac

SEQ ID NO: 3933499 - RNA, 14 nt, Shigella flexneri 2a str. 301
uuagcccuuuguag

SEQ ID NO: 3933500 - RNA, 13 nt, Shigella flexneri 2a str. 301
uuagccgguuuuu

SEQ ID NO: 3933501 - RNA, 23 nt, Shigella flexneri 2a str. 301
uuagcguugcgccuguucccuuc

SEQ ID NO: 3933502 - RNA, 14 nt, Shigella flexneri 2a str. 301
uuagcuuuaaucca

SEQ ID NO: 3933503 - RNA, 15 nt, Shigella flexneri 2a str. 301
uuaggcacaucaaca

SEQ ID NO: 3933504 - RNA, 13 nt, Shigella flexneri 2a str. 301
uuaggggacauuu

SEQ ID NO: 3933505 - RNA, 13 nt, Shigella flexneri 2a str. 301
uuagggugagggg

SEQ ID NO: 3933506 - RNA, 21 nt, Shigella flexneri 2a str. 301
uuagggugagggggcguucac

SEQ ID NO: 3933507 - RNA, 12 nt, Shigella flexneri 2a str. 301
uuagguggaaga

SEQ ID NO: 3933508 - RNA, 14 nt, Shigella flexneri 2a str. 301
uuagguucucucag

SEQ ID NO: 3933509 - RNA, 15 nt, Shigella flexneri 2a str. 301
uuaguaacaacggau

SEQ ID NO: 3933510 - RNA, 12 nt, Shigella flexneri 2a str. 301
uuaguaucuauu

SEQ ID NO: 3933511 - RNA, 13 nt, Shigella flexneri 2a str. 301
uuaguaugaagaa

SEQ ID NO: 3933512 - RNA, 21 nt, Shigella flexneri 2a str. 301
uuaguauuguuaaauauuaag

SEQ ID NO: 3933513 - RNA, 18 nt, Shigella flexneri 2a str. 301
uuagucaauuaaaaaauu

SEQ ID NO: 3933514 - RNA, 16 nt, Shigella flexneri 2a str. 301
uuagucugcauuuucu

SEQ ID NO: 3933515 - RNA, 22 nt, Shigella flexneri 2a str. 301
uuagugccgcuggcauacaguu

SEQ ID NO: 3933516 - RNA, 18 nt, Shigella flexneri 2a str. 301
uuaguggcaaccacaacc

SEQ ID NO: 3933517 - RNA, 13 nt, Shigella flexneri 2a str. 301
uuaguucaaugcg

SEQ ID NO: 3933518 - RNA, 16 nt, Shigella flexneri 2a str. 301
uuaguuuuauacucag

SEQ ID NO: 3933519 - RNA, 13 nt, Shigella flexneri 2a str. 301
uuauaaauaaaaa

SEQ ID NO: 3933520 - RNA, 12 nt, Shigella flexneri 2a str. 301
uuauaagccaug

SEQ ID NO: 3933521 - RNA, 16 nt, Shigella flexneri 2a str. 301
uuauaagccauguuua

SEQ ID NO: 3933522 - RNA, 19 nt, Shigella flexneri 2a str. 301
uuauaaucuuuaaaaaaag

SEQ ID NO: 3933523 - RNA, 21 nt, Shigella flexneri 2a str. 301
uuauacagacucaaaccaaug

SEQ ID NO: 3933524 - RNA, 15 nt, Shigella flexneri 2a str. 301
uuauacaucgcuuuc

SEQ ID NO: 3933525 - RNA, 19 nt, Shigella flexneri 2a str. 301
uuauagcaguaauugcagc

SEQ ID NO: 3933526 - RNA, 20 nt, Shigella flexneri 2a str. 301
uuauagccguaacuguaagc

SEQ ID NO: 3933527 - RNA, 17 nt, Shigella flexneri 2a str. 301
uuauagcucaacgcugc

SEQ ID NO: 3933528 - RNA, 17 nt, Shigella flexneri 2a str. 301
uuauauaacgccauauu

SEQ ID NO: 3933529 - RNA, 15 nt, Shigella flexneri 2a str. 301
uuauauaaugccagg

SEQ ID NO: 3933530 - RNA, 18 nt, Shigella flexneri 2a str. 301
uuauauauuaaucaucau

SEQ ID NO: 3933531 - RNA, 20 nt, Shigella flexneri 2a str. 301
uuauauauugggaucaaaaa

SEQ ID NO: 3933532 - RNA, 16 nt, Shigella flexneri 2a str. 301
uuauaucccauuuuug

SEQ ID NO: 3933533 - RNA, 18 nt, Shigella flexneri 2a str. 301
uuauauccggugcaacug

SEQ ID NO: 3933534 - RNA, 14 nt, Shigella flexneri 2a str. 301
uuauaucucagaua

SEQ ID NO: 3933535 - RNA, 20 nt, Shigella flexneri 2a str. 301
uuauaugaugaaacugauaa

SEQ ID NO: 3933536 - RNA, 16 nt, Shigella flexneri 2a str. 301
uuauauuugaacaucg

SEQ ID NO: 3933537 - RNA, 13 nt, Shigella flexneri 2a str. 301
uuaucaaaucacc

SEQ ID NO: 3933538 - RNA, 16 nt, Shigella flexneri 2a str. 301
uuaucaacuaucagau

SEQ ID NO: 3933539 - RNA, 13 nt, Shigella flexneri 2a str. 301
uuaucaagauauu

SEQ ID NO: 3933540 - RNA, 19 nt, Shigella flexneri 2a str. 301
uuaucaauuccuauuuugu

SEQ ID NO: 3933541 - RNA, 15 nt, Shigella flexneri 2a str. 301
uuaucacagcagaac

SEQ ID NO: 3933542 - RNA, 19 nt, Shigella flexneri 2a str. 301
uuaucaccgcauuuugacu

SEQ ID NO: 3933543 - RNA, 22 nt, Shigella flexneri 2a str. 301
uuaucacgcaaccacaacgcac

SEQ ID NO: 3933544 - RNA, 21 nt, Shigella flexneri 2a str. 301
uuaucagacaccgauugcccc

SEQ ID NO: 3933545 - RNA, 13 nt, Shigella flexneri 2a str. 301
uuaucagaucacg

SEQ ID NO: 3933546 - RNA, 18 nt, Shigella flexneri 2a str. 301
uuaucaggccuacaaaau

SEQ ID NO: 3933547 - RNA, 22 nt, Shigella flexneri 2a str. 301
uuaucaggccuacaauguuucu

SEQ ID NO: 3933548 - RNA, 21 nt, Shigella flexneri 2a str. 301
uuaucaggccuacauuggugc

SEQ ID NO: 3933549 - RNA, 15 nt, Shigella flexneri 2a str. 301
uuaucaggccugcaa

SEQ ID NO: 3933550 - RNA, 15 nt, Shigella flexneri 2a str. 301
uuaucaucgggcuga

SEQ ID NO: 3933551 - RNA, 11 nt, Shigella flexneri 2a str. 301
uuaucaugccu

SEQ ID NO: 3933552 - RNA, 21 nt, Shigella flexneri 2a str. 301
uuauccaccgaaauaaucaga

SEQ ID NO: 3933553 - RNA, 11 nt, Shigella flexneri 2a str. 301
uuauccagcaa

SEQ ID NO: 3933554 - RNA, 17 nt, Shigella flexneri 2a str. 301
uuauccagccuacaaaa

SEQ ID NO: 3933555 - RNA, 19 nt, Shigella flexneri 2a str. 301
uuauccagcuucacuuuca

SEQ ID NO: 3933556 - RNA, 20 nt, Shigella flexneri 2a str. 301
uuaucccaauuaucuggaau

SEQ ID NO: 3933557 - RNA, 12 nt, Shigella flexneri 2a str. 301
uuaucccauccc

SEQ ID NO: 3933558 - RNA, 15 nt, Shigella flexneri 2a str. 301
uuauccccucaaccu

SEQ ID NO: 3933559 - RNA, 16 nt, Shigella flexneri 2a str. 301
uuaucccuguuaaaac

SEQ ID NO: 3933560 - RNA, 17 nt, Shigella flexneri 2a str. 301
uuauccgaccuacaaaa

SEQ ID NO: 3933561 - RNA, 18 nt, Shigella flexneri 2a str. 301
uuauccgaccuacaaaac

SEQ ID NO: 3933562 - RNA, 22 nt, Shigella flexneri 2a str. 301
uuauccgcaucacuccacacca

SEQ ID NO: 3933563 - RNA, 23 nt, Shigella flexneri 2a str. 301
uuauccgccagugccaaagccag

SEQ ID NO: 3933564 - RNA, 11 nt, Shigella flexneri 2a str. 301
uuauccggccu

SEQ ID NO: 3933565 - RNA, 18 nt, Shigella flexneri 2a str. 301
uuauccggccuacaaaau

SEQ ID NO: 3933566 - RNA, 11 nt, Shigella flexneri 2a str. 301
uuauccggcua

SEQ ID NO: 3933567 - RNA, 17 nt, Shigella flexneri 2a str. 301
uuauccggcuaacaaaa

SEQ ID NO: 3933568 - RNA, 12 nt, Shigella flexneri 2a str. 301
uuauccggugag

SEQ ID NO: 3933569 - RNA, 16 nt, Shigella flexneri 2a str. 301
uuauccguccuacgaa

SEQ ID NO: 3933570 - RNA, 14 nt, Shigella flexneri 2a str. 301
uuauccucuguaaa

SEQ ID NO: 3933571 - RNA, 20 nt, Shigella flexneri 2a str. 301
uuaucgacugccagagucaa

SEQ ID NO: 3933572 - RNA, 14 nt, Shigella flexneri 2a str. 301
uuaucgccagcgcc

SEQ ID NO: 3933573 - RNA, 19 nt, Shigella flexneri 2a str. 301
uuaucgcgauacaccagau

SEQ ID NO: 3933574 - RNA, 18 nt, Shigella flexneri 2a str. 301
uuaucgcgaugauuuucg

SEQ ID NO: 3933575 - RNA, 16 nt, Shigella flexneri 2a str. 301
uuaucgcgccaucaaa

SEQ ID NO: 3933576 - RNA, 17 nt, Shigella flexneri 2a str. 301
uuaucgcgcugaauaau

SEQ ID NO: 3933577 - RNA, 22 nt, Shigella flexneri 2a str. 301
uuaucgcgucuaaauuuugcau

SEQ ID NO: 3933578 - RNA, 19 nt, Shigella flexneri 2a str. 301
uuaucggcucgaucuggug

SEQ ID NO: 3933579 - RNA, 20 nt, Shigella flexneri 2a str. 301
uuaucgugaauucacucuau

SEQ ID NO: 3933580 - RNA, 24 nt, Shigella flexneri 2a str. 301
uuaucgugccuacacauuaucuca

SEQ ID NO: 3933581 - RNA, 18 nt, Shigella flexneri 2a str. 301
uucaaucccgccaaugca

SEQ ID NO: 3933582 - RNA, 22 nt, Shigella flexneri 2a str. 301
uucaaugauaaaggucaucaca

SEQ ID NO: 3933583 - RNA, 17 nt, Shigella flexneri 2a str. 301
uucaaugcauuaucaga

SEQ ID NO: 3933584 - RNA, 17 nt, Shigella flexneri 2a str. 301
uucaaugcgaucuaccc

SEQ ID NO: 3933585 - RNA, 23 nt, Shigella flexneri 2a str. 301
uucaaugcugccgggguaaagcg

SEQ ID NO: 3933586 - RNA, 16 nt, Shigella flexneri 2a str. 301
uucaauuaauugugaa

SEQ ID NO: 3933587 - RNA, 20 nt, Shigella flexneri 2a str. 301
uucaauuagcgccucggggc

SEQ ID NO: 3933588 - RNA, 20 nt, Shigella flexneri 2a str. 301
uucaauuagcuuuaauccau

SEQ ID NO: 3933589 - RNA, 22 nt, Shigella flexneri 2a str. 301
uucaauuauaguaucguuaaau

SEQ ID NO: 3933590 - RNA, 16 nt, Shigella flexneri 2a str. 301
uucacaaacagcgccu

SEQ ID NO: 3933591 - RNA, 19 nt, Shigella flexneri 2a str. 301
uucacaaccgggcauuuuu

SEQ ID NO: 3933592 - RNA, 21 nt, Shigella flexneri 2a str. 301
uucacacacaucgacccagaa

SEQ ID NO: 3933593 - RNA, 17 nt, Shigella flexneri 2a str. 301
uucacacacuuuuauua

SEQ ID NO: 3933594 - RNA, 23 nt, Shigella flexneri 2a str. 301
uucacacccgguaucaaacccuu

SEQ ID NO: 3933595 - RNA, 20 nt, Shigella flexneri 2a str. 301
uucacacugaugacaggcua

SEQ ID NO: 3933596 - RNA, 17 nt, Shigella flexneri 2a str. 301
uucacagaaggccagga

SEQ ID NO: 3933597 - RNA, 19 nt, Shigella flexneri 2a str. 301
uucacaggccgccaggcag

SEQ ID NO: 3933598 - RNA, 23 nt, Shigella flexneri 2a str. 301
uucacaggccgccaggcagagcu

SEQ ID NO: 3933599 - RNA, 23 nt, Shigella flexneri 2a str. 301
uucacaguaaugauuuaaaacca

SEQ ID NO: 3933600 - RNA, 22 nt, Shigella flexneri 2a str. 301
uucacaguuaaguuaauucuga

SEQ ID NO: 3933601 - RNA, 13 nt, Shigella flexneri 2a str. 301
uucacaucaucau

SEQ ID NO: 3933602 - RNA, 11 nt, Shigella flexneri 2a str. 301
uucacauguuc

SEQ ID NO: 3933603 - RNA, 21 nt, Shigella flexneri 2a str. 301
uucaccaaucagaaaggcguu

SEQ ID NO: 3933604 - RNA, 17 nt, Shigella flexneri 2a str. 301
uucaccaaucggcagaa

SEQ ID NO: 3933605 - RNA, 16 nt, Shigella flexneri 2a str. 301
uucaccagaccugaaa

SEQ ID NO: 3933606 - RNA, 18 nt, Shigella flexneri 2a str. 301
uucaccagcacuucacug

SEQ ID NO: 3933607 - RNA, 14 nt, Shigella flexneri 2a str. 301
uucaccagcgcacg

SEQ ID NO: 3933608 - RNA, 17 nt, Shigella flexneri 2a str. 301
uucaccagcgcgaggau

SEQ ID NO: 3933609 - RNA, 15 nt, Shigella flexneri 2a str. 301
uucaccaguuuacug

SEQ ID NO: 3933610 - RNA, 18 nt, Shigella flexneri 2a str. 301
uucaccauaaaacgcgcu

SEQ ID NO: 3933611 - RNA, 19 nt, Shigella flexneri 2a str. 301
uucaccaucgcgaucauca

SEQ ID NO: 3933612 - RNA, 16 nt, Shigella flexneri 2a str. 301
uucacccaucgccaga

SEQ ID NO: 3933613 - RNA, 13 nt, Shigella flexneri 2a str. 301
uucaccgacguga

SEQ ID NO: 3933614 - RNA, 19 nt, Shigella flexneri 2a str. 301
uucaccgauaaaagcccug

SEQ ID NO: 3933615 - RNA, 18 nt, Shigella flexneri 2a str. 301
uucaccgcaucgucacug

SEQ ID NO: 3933616 - RNA, 14 nt, Shigella flexneri 2a str. 301
uucaccgcuaaagc

SEQ ID NO: 3933617 - RNA, 23 nt, Shigella flexneri 2a str. 301
uucaccggauaaucggcaauacu

SEQ ID NO: 3933618 - RNA, 12 nt, Shigella flexneri 2a str. 301
uucaccggugag

SEQ ID NO: 3933619 - RNA, 20 nt, Shigella flexneri 2a str. 301
uucaccguaauaguuucuga

SEQ ID NO: 3933620 - RNA, 19 nt, Shigella flexneri 2a str. 301
uucaccguucgcuggaagc

SEQ ID NO: 3933621 - RNA, 23 nt, Shigella flexneri 2a str. 301
uucaccucugcggcaagaucgcg

SEQ ID NO: 3933622 - RNA, 20 nt, Shigella flexneri 2a str. 301
uucaccucuucauuaaacca

SEQ ID NO: 3933623 - RNA, 13 nt, Shigella flexneri 2a str. 301
uucaccuuuuucc

SEQ ID NO: 3933624 - RNA, 16 nt, Shigella flexneri 2a str. 301
uucaccuuuuuccaga

SEQ ID NO: 3933625 - RNA, 18 nt, Shigella flexneri 2a str. 301
uucacgaaaacagcgcag

SEQ ID NO: 3933626 - RNA, 15 nt, Shigella flexneri 2a str. 301
uucacgaauauuucc

SEQ ID NO: 3933627 - RNA, 16 nt, Shigella flexneri 2a str. 301
uucacgaauauuuccc

SEQ ID NO: 3933628 - RNA, 23 nt, Shigella flexneri 2a str. 301
uucacgacauaaacauuccacuu

SEQ ID NO: 3933629 - RNA, 22 nt, Shigella flexneri 2a str. 301
uucacgagagauacgcuugccg

SEQ ID NO: 3933630 - RNA, 15 nt, Shigella flexneri 2a str. 301
uucacgcaaggcaca

SEQ ID NO: 3933631 - RNA, 22 nt, Shigella flexneri 2a str. 301
uucacgcauuuacacucgcccc

SEQ ID NO: 3933632 - RNA, 18 nt, Shigella flexneri 2a str. 301
uucacgccaaccagcuga

SEQ ID NO: 3933633 - RNA, 16 nt, Shigella flexneri 2a str. 301
uucacgcccagaucca

SEQ ID NO: 3933634 - RNA, 18 nt, Shigella flexneri 2a str. 301
uucacgccgcauccggca

SEQ ID NO: 3933635 - RNA, 19 nt, Shigella flexneri 2a str. 301
uucacgccgcauccggcaa

SEQ ID NO: 3933636 - RNA, 23 nt, Shigella flexneri 2a str. 301
uucacgccgcauccggcaauaag

SEQ ID NO: 3933637 - RNA, 18 nt, Shigella flexneri 2a str. 301
uucacgccgcaucuggca

SEQ ID NO: 3933638 - RNA, 15 nt, Shigella flexneri 2a str. 301
uucacgccgggaaau

SEQ ID NO: 3933639 - RNA, 22 nt, Shigella flexneri 2a str. 301
uucacgccgggaaauuuuuccg

SEQ ID NO: 3933640 - RNA, 18 nt, Shigella flexneri 2a str. 301
uucacgcggguugccacc

SEQ ID NO: 3933641 - RNA, 19 nt, Shigella flexneri 2a str. 301
uucacgcuuugcaggcugg

SEQ ID NO: 3933642 - RNA, 17 nt, Shigella flexneri 2a str. 301
uucacggcaccagccau

SEQ ID NO: 3933643 - RNA, 20 nt, Shigella flexneri 2a str. 301
uucacggcuuugucauuaaa

SEQ ID NO: 3933644 - RNA, 20 nt, Shigella flexneri 2a str. 301
uucacgguauuauucaucgc

SEQ ID NO: 3933645 - RNA, 21 nt, Shigella flexneri 2a str. 301
uucacguugacgcauacagcc

SEQ ID NO: 3933646 - RNA, 23 nt, Shigella flexneri 2a str. 301
uucacuaaucaauuuuucaucgg

SEQ ID NO: 3933647 - RNA, 13 nt, Shigella flexneri 2a str. 301
uucacuauuucuu

SEQ ID NO: 3933648 - RNA, 17 nt, Shigella flexneri 2a str. 301
uucacucugcugccaca

SEQ ID NO: 3933649 - RNA, 16 nt, Shigella flexneri 2a str. 301
uucacugacgcccguu

SEQ ID NO: 3933650 - RNA, 19 nt, Shigella flexneri 2a str. 301
uucacugccaccagcagcg

SEQ ID NO: 3933651 - RNA, 22 nt, Shigella flexneri 2a str. 301
uucacugccaccagcagcguuu

SEQ ID NO: 3933652 - RNA, 12 nt, Shigella flexneri 2a str. 301
uucacugcccac

SEQ ID NO: 3933653 - RNA, 21 nt, Shigella flexneri 2a str. 301
uucacugccguacaggcagcu

SEQ ID NO: 3933654 - RNA, 13 nt, Shigella flexneri 2a str. 301
uucacuucgucag

SEQ ID NO: 3933655 - RNA, 17 nt, Shigella flexneri 2a str. 301
uucacuucuucaauaaa

SEQ ID NO: 3933656 - RNA, 14 nt, Shigella flexneri 2a str. 301
uucacuuucugaag

SEQ ID NO: 3933657 - RNA, 17 nt, Shigella flexneri 2a str. 301
uucacuuuugcugcaaa

SEQ ID NO: 3933658 - RNA, 19 nt, Shigella flexneri 2a str. 301
uucacuuuugcugcaaaau

SEQ ID NO: 3933659 - RNA, 13 nt, Shigella flexneri 2a str. 301
uucagaaaaagcg

SEQ ID NO: 3933660 - RNA, 13 nt, Shigella flexneri 2a str. 301
uucagaaagcgcc

SEQ ID NO: 3933661 - RNA, 12 nt, Shigella flexneri 2a str. 301
uucagaaaguaa

SEQ ID NO: 3933662 - RNA, 19 nt, Shigella flexneri 2a str. 301
uucagaaauuuggcuccuc

SEQ ID NO: 3933663 - RNA, 18 nt, Shigella flexneri 2a str. 301
uucagaacacaaaaccga

SEQ ID NO: 3933664 - RNA, 17 nt, Shigella flexneri 2a str. 301
uucagaagcugaagcag

SEQ ID NO: 3933665 - RNA, 18 nt, Shigella flexneri 2a str. 301
uucagaauagacaaaaau

SEQ ID NO: 3933666 - RNA, 14 nt, Shigella flexneri 2a str. 301
uucagaaucaaguc

SEQ ID NO: 3933667 - RNA, 16 nt, Shigella flexneri 2a str. 301
uucagauaauagguaa

SEQ ID NO: 3933668 - RNA, 23 nt, Shigella flexneri 2a str. 301
uucagauaauccccaaugaccuu

SEQ ID NO: 3933669 - RNA, 15 nt, Shigella flexneri 2a str. 301
uucagauaaugcccg

SEQ ID NO: 3933670 - RNA, 23 nt, Shigella flexneri 2a str. 301
uucagaucgguuuuuuucgaacc

SEQ ID NO: 3933671 - RNA, 13 nt, Shigella flexneri 2a str. 301
uucagaucuuuca

SEQ ID NO: 3933672 - RNA, 13 nt, Shigella flexneri 2a str. 301
uucagauguuccg

SEQ ID NO: 3933673 - RNA, 20 nt, Shigella flexneri 2a str. 301
uucagauucagcgucgucag

SEQ ID NO: 3933674 - RNA, 20 nt, Shigella flexneri 2a str. 301
uucagauugcagacaaagug

SEQ ID NO: 3933675 - RNA, 21 nt, Shigella flexneri 2a str. 301
uucagauuguugacaaagugc

SEQ ID NO: 3933676 - RNA, 22 nt, Shigella flexneri 2a str. 301
uucagauuguugauuaacaggc

SEQ ID NO: 3933677 - RNA, 22 nt, Shigella flexneri 2a str. 301
uucagcaagcgauaauuuaugc

SEQ ID NO: 3933678 - RNA, 11 nt, Shigella flexneri 2a str. 301
uucagcaauac

SEQ ID NO: 3933679 - RNA, 17 nt, Shigella flexneri 2a str. 301
uucagcaaucucuucaa

SEQ ID NO: 3933680 - RNA, 20 nt, Shigella flexneri 2a str. 301
uuccaagauuaaaggcacca

SEQ ID NO: 3933681 - RNA, 19 nt, Shigella flexneri 2a str. 301
uuccaccaccacagacaau

SEQ ID NO: 3933682 - RNA, 20 nt, Shigella flexneri 2a str. 301
uuccaccagcggcugaauau

SEQ ID NO: 3933683 - RNA, 16 nt, Shigella flexneri 2a str. 301
uuccaccaucacgcca

SEQ ID NO: 3933684 - RNA, 13 nt, Shigella flexneri 2a str. 301
uuccaccgcuauu

SEQ ID NO: 3933685 - RNA, 14 nt, Shigella flexneri 2a str. 301
uuccaccucccccu

SEQ ID NO: 3933686 - RNA, 14 nt, Shigella flexneri 2a str. 301
uuccacgcagauua

SEQ ID NO: 3933687 - RNA, 21 nt, Shigella flexneri 2a str. 301
uuccacgcagauuaugccgcu

SEQ ID NO: 3933688 - RNA, 16 nt, Shigella flexneri 2a str. 301
uuccacgcaucaagca

SEQ ID NO: 3933689 - RNA, 21 nt, Shigella flexneri 2a str. 301
uuccacgccauagcggagcaa

SEQ ID NO: 3933690 - RNA, 23 nt, Shigella flexneri 2a str. 301
uuccacgccguuuuuacccagca

SEQ ID NO: 3933691 - RNA, 21 nt, Shigella flexneri 2a str. 301
uuccacgccugcauccgccau

SEQ ID NO: 3933692 - RNA, 23 nt, Shigella flexneri 2a str. 301
uuccacgggcaauaucgacgcca

SEQ ID NO: 3933693 - RNA, 19 nt, Shigella flexneri 2a str. 301
uuccacucauuaauuuccu

SEQ ID NO: 3933694 - RNA, 19 nt, Shigella flexneri 2a str. 301
uuccacucuuucagcacca

SEQ ID NO: 3933695 - RNA, 15 nt, Shigella flexneri 2a str. 301
uuccacuucacggcu

SEQ ID NO: 3933696 - RNA, 13 nt, Shigella flexneri 2a str. 301
uuccacuucauca

SEQ ID NO: 3933697 - RNA, 17 nt, Shigella flexneri 2a str. 301
uuccacuuucacgccca

SEQ ID NO: 3933698 - RNA, 17 nt, Shigella flexneri 2a str. 301
uuccagaaaagagacgc

SEQ ID NO: 3933699 - RNA, 15 nt, Shigella flexneri 2a str. 301
uuccagaauaucuuc

SEQ ID NO: 3933700 - RNA, 18 nt, Shigella flexneri 2a str. 301
uuccagacucaacaggcc

SEQ ID NO: 3933701 - RNA, 19 nt, Shigella flexneri 2a str. 301
uuccagacucaacaggccc

SEQ ID NO: 3933702 - RNA, 23 nt, Shigella flexneri 2a str. 301
uuccagaucaccgcagaagcgau

SEQ ID NO: 3933703 - RNA, 15 nt, Shigella flexneri 2a str. 301
uuccagcaacucgau

SEQ ID NO: 3933704 - RNA, 15 nt, Shigella flexneri 2a str. 301
uuccagcaagccacu

SEQ ID NO: 3933705 - RNA, 12 nt, Shigella flexneri 2a str. 301
uuccagcaauua

SEQ ID NO: 3933706 - RNA, 15 nt, Shigella flexneri 2a str. 301
uuccagcaauuacac

SEQ ID NO: 3933707 - RNA, 17 nt, Shigella flexneri 2a str. 301
uuccagcacaaagcgau

SEQ ID NO: 3933708 - RNA, 13 nt, Shigella flexneri 2a str. 301
uuccagcacaccc

SEQ ID NO: 3933709 - RNA, 16 nt, Shigella flexneri 2a str. 301
uuccagcagaccagca

SEQ ID NO: 3933710 - RNA, 20 nt, Shigella flexneri 2a str. 301
uuccagcagaccagcaauaa

SEQ ID NO: 3933711 - RNA, 22 nt, Shigella flexneri 2a str. 301
uuccagcagaccagcaauaacu

SEQ ID NO: 3933712 - RNA, 19 nt, Shigella flexneri 2a str. 301
uuccagcagauauugcccc

SEQ ID NO: 3933713 - RNA, 14 nt, Shigella flexneri 2a str. 301
uuccagcaucagca

SEQ ID NO: 3933714 - RNA, 19 nt, Shigella flexneri 2a str. 301
uuccagccgaccauugcca

SEQ ID NO: 3933715 - RNA, 23 nt, Shigella flexneri 2a str. 301
uuccagccgaccauugccaguaa

SEQ ID NO: 3933716 - RNA, 12 nt, Shigella flexneri 2a str. 301
uuccagcggcag

SEQ ID NO: 3933717 - RNA, 18 nt, Shigella flexneri 2a str. 301
uuccagcgguaacuuauc

SEQ ID NO: 3933718 - RNA, 18 nt, Shigella flexneri 2a str. 301
uuccagcucaaccagauu

SEQ ID NO: 3933719 - RNA, 12 nt, Shigella flexneri 2a str. 301
uuccagcucuua

SEQ ID NO: 3933720 - RNA, 18 nt, Shigella flexneri 2a str. 301
uuccaggcccgcguggau

SEQ ID NO: 3933721 - RNA, 21 nt, Shigella flexneri 2a str. 301
uuccaggcuggucgcgcggaa

SEQ ID NO: 3933722 - RNA, 14 nt, Shigella flexneri 2a str. 301
uuccagggcagcag

SEQ ID NO: 3933723 - RNA, 16 nt, Shigella flexneri 2a str. 301
uuccagggccucuccu

SEQ ID NO: 3933724 - RNA, 17 nt, Shigella flexneri 2a str. 301
uuccaguagauucaaca

SEQ ID NO: 3933725 - RNA, 22 nt, Shigella flexneri 2a str. 301
uuccagucggcguaauccugaa

SEQ ID NO: 3933726 - RNA, 23 nt, Shigella flexneri 2a str. 301
uuccagucggcguaauccugaaa

SEQ ID NO: 3933727 - RNA, 22 nt, Shigella flexneri 2a str. 301
uuccaguguuuccggaauuaaa

SEQ ID NO: 3933728 - RNA, 22 nt, Shigella flexneri 2a str. 301
uuccaguucaauagcaccauua

SEQ ID NO: 3933729 - RNA, 21 nt, Shigella flexneri 2a str. 301
uuccaguuccggcaucgacag

SEQ ID NO: 3933730 - RNA, 18 nt, Shigella flexneri 2a str. 301
uuccaguuccggcauuaa

SEQ ID NO: 3933731 - RNA, 19 nt, Shigella flexneri 2a str. 301
uuccaguugaagugaaaag

SEQ ID NO: 3933732 - RNA, 20 nt, Shigella flexneri 2a str. 301
uuccaguugaagugaaaagc

SEQ ID NO: 3933733 - RNA, 17 nt, Shigella flexneri 2a str. 301
uuccaguugcacgccac

SEQ ID NO: 3933734 - RNA, 19 nt, Shigella flexneri 2a str. 301
uuccaguuugcucaaaucc

SEQ ID NO: 3933735 - RNA, 18 nt, Shigella flexneri 2a str. 301
uuccauaagcccagaaca

SEQ ID NO: 3933736 - RNA, 15 nt, Shigella flexneri 2a str. 301
uuccauaccuaaaaa

SEQ ID NO: 3933737 - RNA, 14 nt, Shigella flexneri 2a str. 301
uuccauaucaagca

SEQ ID NO: 3933738 - RNA, 20 nt, Shigella flexneri 2a str. 301
uuccaucguccgugaagaaa

SEQ ID NO: 3933739 - RNA, 14 nt, Shigella flexneri 2a str. 301
uuccaucuccagcu

SEQ ID NO: 3933740 - RNA, 17 nt, Shigella flexneri 2a str. 301
uuccaucuuuccucacu

SEQ ID NO: 3933741 - RNA, 22 nt, Shigella flexneri 2a str. 301
uuccauugagaaagcccuggcg

SEQ ID NO: 3933742 - RNA, 16 nt, Shigella flexneri 2a str. 301
uuccauuucaucgcca

SEQ ID NO: 3933743 - RNA, 17 nt, Shigella flexneri 2a str. 301
uuccauuucccugacaa

SEQ ID NO: 3933744 - RNA, 14 nt, Shigella flexneri 2a str. 301
uucccaacaacagc

SEQ ID NO: 3933745 - RNA, 15 nt, Shigella flexneri 2a str. 301
uucccaacaacagcg

SEQ ID NO: 3933746 - RNA, 13 nt, Shigella flexneri 2a str. 301
uucccacucuuga

SEQ ID NO: 3933747 - RNA, 19 nt, Shigella flexneri 2a str. 301
uucccacucuugagcucca

SEQ ID NO: 3933748 - RNA, 20 nt, Shigella flexneri 2a str. 301
uucccacugcucaaucauca

SEQ ID NO: 3933749 - RNA, 15 nt, Shigella flexneri 2a str. 301
uucccagcaagaacc

SEQ ID NO: 3933750 - RNA, 18 nt, Shigella flexneri 2a str. 301
uucccaucucaauauuag

SEQ ID NO: 3933751 - RNA, 12 nt, Shigella flexneri 2a str. 301
uuccccagacga

SEQ ID NO: 3933752 - RNA, 12 nt, Shigella flexneri 2a str. 301
uucccccacagc

SEQ ID NO: 3933753 - RNA, 17 nt, Shigella flexneri 2a str. 301
uuccccccacaaucagc

SEQ ID NO: 3933754 - RNA, 14 nt, Shigella flexneri 2a str. 301
uucccccugccaga

SEQ ID NO: 3933755 - RNA, 19 nt, Shigella flexneri 2a str. 301
uuccccgcuucagcccgcg

SEQ ID NO: 3933756 - RNA, 17 nt, Shigella flexneri 2a str. 301
uuccccggaugaguaca

SEQ ID NO: 3933757 - RNA, 15 nt, Shigella flexneri 2a str. 301
uuccccuaacucuuu

SEQ ID NO: 3933758 - RNA, 12 nt, Shigella flexneri 2a str. 301
uuccccucugcg

SEQ ID NO: 3933759 - RNA, 23 nt, Shigella flexneri 2a str. 301
uuccccuguaacgagaaguuuuu

SEQ ID NO: 3933760 - RNA, 18 nt, Shigella flexneri 2a str. 301
uuccccuguugcaaacug

SEQ ID NO: 3933761 - RNA, 23 nt, Shigella flexneri 2a str. 301
uuccccuguugugccagaccaaa

SEQ ID NO: 3933762 - RNA, 15 nt, Shigella flexneri 2a str. 301
uuccccuugauaacg

SEQ ID NO: 3933763 - RNA, 21 nt, Shigella flexneri 2a str. 301
uucccgagacauuccuuuacu

SEQ ID NO: 3933764 - RNA, 13 nt, Shigella flexneri 2a str. 301
uucccgcaacacc

SEQ ID NO: 3933765 - RNA, 15 nt, Shigella flexneri 2a str. 301
uucccgcagcuccag

SEQ ID NO: 3933766 - RNA, 22 nt, Shigella flexneri 2a str. 301
uucccgcagguugggcaauuca

SEQ ID NO: 3933767 - RNA, 21 nt, Shigella flexneri 2a str. 301
uucccgccagcggcccggaga

SEQ ID NO: 3933768 - RNA, 20 nt, Shigella flexneri 2a str. 301
uucccggaauaauugcgguu

SEQ ID NO: 3933769 - RNA, 21 nt, Shigella flexneri 2a str. 301
uucccucaaaauggacgcaac

SEQ ID NO: 3933770 - RNA, 20 nt, Shigella flexneri 2a str. 301
uucccucccguuucccuguc

SEQ ID NO: 3933771 - RNA, 21 nt, Shigella flexneri 2a str. 301
uucccugcugaauccccuucu

SEQ ID NO: 3933772 - RNA, 20 nt, Shigella flexneri 2a str. 301
uucccuucaggcgugauuca

SEQ ID NO: 3933773 - RNA, 11 nt, Shigella flexneri 2a str. 301
uucccuuucag

SEQ ID NO: 3933774 - RNA, 19 nt, Shigella flexneri 2a str. 301
uuccgacagaauauaaguc

SEQ ID NO: 3933775 - RNA, 14 nt, Shigella flexneri 2a str. 301
uuccgcaccugcca

SEQ ID NO: 3933776 - RNA, 23 nt, Shigella flexneri 2a str. 301
uuccgcacguuagaaacaaaaaa

SEQ ID NO: 3933777 - RNA, 13 nt, Shigella flexneri 2a str. 301
uuccgccgucacc

SEQ ID NO: 3933778 - RNA, 18 nt, Shigella flexneri 2a str. 301
uuccgcgcaaucgcccag

SEQ ID NO: 3933779 - RNA, 16 nt, Shigella flexneri 2a str. 301
uuccgcgccaaacauu

SEQ ID NO: 3933780 - RNA, 19 nt, Shigella flexneri 2a str. 301
uucggcaaccgcauccaga

SEQ ID NO: 3933781 - RNA, 13 nt, Shigella flexneri 2a str. 301
uucggcaaucacc

SEQ ID NO: 3933782 - RNA, 13 nt, Shigella flexneri 2a str. 301
uucggcaauccag

SEQ ID NO: 3933783 - RNA, 19 nt, Shigella flexneri 2a str. 301
uucggcagaaaauccacca

SEQ ID NO: 3933784 - RNA, 20 nt, Shigella flexneri 2a str. 301
uucggcauacauaaucaaua

SEQ ID NO: 3933785 - RNA, 20 nt, Shigella flexneri 2a str. 301
uucggcaucacgaauccgca

SEQ ID NO: 3933786 - RNA, 17 nt, Shigella flexneri 2a str. 301
uucggccauauccagcc

SEQ ID NO: 3933787 - RNA, 18 nt, Shigella flexneri 2a str. 301
uucggcgucuuguugaac

SEQ ID NO: 3933788 - RNA, 21 nt, Shigella flexneri 2a str. 301
uucggcgucuuguugaacagg

SEQ ID NO: 3933789 - RNA, 21 nt, Shigella flexneri 2a str. 301
uucgggauauggcgagaagag

SEQ ID NO: 3933790 - RNA, 23 nt, Shigella flexneri 2a str. 301
uucgggauggcguagcagcagcg

SEQ ID NO: 3933791 - RNA, 18 nt, Shigella flexneri 2a str. 301
uucgguaaccauccauuc

SEQ ID NO: 3933792 - RNA, 16 nt, Shigella flexneri 2a str. 301
uucgguaaugacucca

SEQ ID NO: 3933793 - RNA, 20 nt, Shigella flexneri 2a str. 301
uucgguaaugacuccaacuu

SEQ ID NO: 3933794 - RNA, 22 nt, Shigella flexneri 2a str. 301
uucgguauuaaucugccagcgu

SEQ ID NO: 3933795 - RNA, 18 nt, Shigella flexneri 2a str. 301
uucggugauauacgucac

SEQ ID NO: 3933796 - RNA, 23 nt, Shigella flexneri 2a str. 301
uucggugauauacgucacuucau

SEQ ID NO: 3933797 - RNA, 22 nt, Shigella flexneri 2a str. 301
uucgguguuuuuacgaaacaga

SEQ ID NO: 3933798 - RNA, 19 nt, Shigella flexneri 2a str. 301
uucguaaguacauuaaaau

SEQ ID NO: 3933799 - RNA, 14 nt, Shigella flexneri 2a str. 301
uucguaauaauuca

SEQ ID NO: 3933800 - RNA, 20 nt, Shigella flexneri 2a str. 301
uucguaauaauucacggccc

SEQ ID NO: 3933801 - RNA, 14 nt, Shigella flexneri 2a str. 301
uucguagcguuuuu

SEQ ID NO: 3933802 - RNA, 20 nt, Shigella flexneri 2a str. 301
uucguaggcagcauccggca

SEQ ID NO: 3933803 - RNA, 22 nt, Shigella flexneri 2a str. 301
uucgucaccugguagcggguga

SEQ ID NO: 3933804 - RNA, 21 nt, Shigella flexneri 2a str. 301
uucgucccagucgucauccca

SEQ ID NO: 3933805 - RNA, 22 nt, Shigella flexneri 2a str. 301
uucgucgaguuuauagccuguc

SEQ ID NO: 3933806 - RNA, 19 nt, Shigella flexneri 2a str. 301
uucguguggaguaauaauu

SEQ ID NO: 3933807 - RNA, 23 nt, Shigella flexneri 2a str. 301
uucguucgggcagguuucaccuu

SEQ ID NO: 3933808 - RNA, 15 nt, Shigella flexneri 2a str. 301
uucguucuucagacu

SEQ ID NO: 3933809 - RNA, 15 nt, Shigella flexneri 2a str. 301
uucguugaagucagg

SEQ ID NO: 3933810 - RNA, 17 nt, Shigella flexneri 2a str. 301
uucguuuuaaugcgauc

SEQ ID NO: 3933811 - RNA, 13 nt, Shigella flexneri 2a str. 301
uucuaaagccuga

SEQ ID NO: 3933812 - RNA, 12 nt, Shigella flexneri 2a str. 301
uucuaaauguuc

SEQ ID NO: 3933813 - RNA, 16 nt, Shigella flexneri 2a str. 301
uucuaacucauuuuuu

SEQ ID NO: 3933814 - RNA, 20 nt, Shigella flexneri 2a str. 301
uucuaauuuuuccagcauuu

SEQ ID NO: 3933815 - RNA, 15 nt, Shigella flexneri 2a str. 301
uucuacgaugcgaua

SEQ ID NO: 3933816 - RNA, 20 nt, Shigella flexneri 2a str. 301
uucuacggguaaguguuuca

SEQ ID NO: 3933817 - RNA, 18 nt, Shigella flexneri 2a str. 301
uucuacgugcgcuaugug

SEQ ID NO: 3933818 - RNA, 14 nt, Shigella flexneri 2a str. 301
uucuaugaagaacu

SEQ ID NO: 3933819 - RNA, 17 nt, Shigella flexneri 2a str. 301
uucuauuuugcauuauu

SEQ ID NO: 3933820 - RNA, 20 nt, Shigella flexneri 2a str. 301
uucucaauaaaaggaaacag

SEQ ID NO: 3933821 - RNA, 16 nt, Shigella flexneri 2a str. 301
uucucaaucccuuucu

SEQ ID NO: 3933822 - RNA, 16 nt, Shigella flexneri 2a str. 301
uucucaaucugcuugc

SEQ ID NO: 3933823 - RNA, 22 nt, Shigella flexneri 2a str. 301
uucucaccuauguggaaacagu

SEQ ID NO: 3933824 - RNA, 15 nt, Shigella flexneri 2a str. 301
uucucaccuugcucu

SEQ ID NO: 3933825 - RNA, 22 nt, Shigella flexneri 2a str. 301
uucucagagacucuuaaaauau

SEQ ID NO: 3933826 - RNA, 15 nt, Shigella flexneri 2a str. 301
uucucagcaguuuuu

SEQ ID NO: 3933827 - RNA, 17 nt, Shigella flexneri 2a str. 301
uucucagcgguaauggu

SEQ ID NO: 3933828 - RNA, 20 nt, Shigella flexneri 2a str. 301
uucucagguagcgcauaagc

SEQ ID NO: 3933829 - RNA, 12 nt, Shigella flexneri 2a str. 301
uucucauaaaac

SEQ ID NO: 3933830 - RNA, 17 nt, Shigella flexneri 2a str. 301
uucucaucaccauuccg

SEQ ID NO: 3933831 - RNA, 14 nt, Shigella flexneri 2a str. 301
uucuccaaauacau

SEQ ID NO: 3933832 - RNA, 19 nt, Shigella flexneri 2a str. 301
uucuccacaccguugccgc

SEQ ID NO: 3933833 - RNA, 21 nt, Shigella flexneri 2a str. 301
uucuccagcgaauccguucuu

SEQ ID NO: 3933834 - RNA, 11 nt, Shigella flexneri 2a str. 301
uucuccagcuu

SEQ ID NO: 3933835 - RNA, 21 nt, Shigella flexneri 2a str. 301
uucucccugguucaagagaga

SEQ ID NO: 3933836 - RNA, 16 nt, Shigella flexneri 2a str. 301
uucucccuuaaaaaau

SEQ ID NO: 3933837 - RNA, 17 nt, Shigella flexneri 2a str. 301
uucuccgcguucaauac

SEQ ID NO: 3933838 - RNA, 19 nt, Shigella flexneri 2a str. 301
uucuccguguucgucacug

SEQ ID NO: 3933839 - RNA, 15 nt, Shigella flexneri 2a str. 301
uucuccugaaguagc

SEQ ID NO: 3933840 - RNA, 17 nt, Shigella flexneri 2a str. 301
uucuccuucacucuaua

SEQ ID NO: 3933841 - RNA, 16 nt, Shigella flexneri 2a str. 301
uucucgauaaaaccuu

SEQ ID NO: 3933842 - RNA, 12 nt, Shigella flexneri 2a str. 301
uucucgcaaaac

SEQ ID NO: 3933843 - RNA, 13 nt, Shigella flexneri 2a str. 301
uucucgccaccgg

SEQ ID NO: 3933844 - RNA, 18 nt, Shigella flexneri 2a str. 301
uucucgcggacugccugg

SEQ ID NO: 3933845 - RNA, 21 nt, Shigella flexneri 2a str. 301
uucucgcuccauuccaucgcc

SEQ ID NO: 3933846 - RNA, 16 nt, Shigella flexneri 2a str. 301
uucucgggagguaaug

SEQ ID NO: 3933847 - RNA, 15 nt, Shigella flexneri 2a str. 301
uucucuacgcccucg

SEQ ID NO: 3933848 - RNA, 17 nt, Shigella flexneri 2a str. 301
uucucugacgcucucua

SEQ ID NO: 3933849 - RNA, 15 nt, Shigella flexneri 2a str. 301
uucucugagaauaaa

SEQ ID NO: 3933850 - RNA, 17 nt, Shigella flexneri 2a str. 301
uucucuguucagccuga

SEQ ID NO: 3933851 - RNA, 14 nt, Shigella flexneri 2a str. 301
uucucuucugcuuu

SEQ ID NO: 3933852 - RNA, 16 nt, Shigella flexneri 2a str. 301
uucucuuuccagcaac

SEQ ID NO: 3933853 - RNA, 14 nt, Shigella flexneri 2a str. 301
uucugaaaacuguu

SEQ ID NO: 3933854 - RNA, 16 nt, Shigella flexneri 2a str. 301
uucugaacugaacaaa

SEQ ID NO: 3933855 - RNA, 18 nt, Shigella flexneri 2a str. 301
uucugaacugaacaaaaa

SEQ ID NO: 3933856 - RNA, 22 nt, Shigella flexneri 2a str. 301
uucugaacugaacaaaaaagag

SEQ ID NO: 3933857 - RNA, 17 nt, Shigella flexneri 2a str. 301
uucugacuauauaaauu

SEQ ID NO: 3933858 - RNA, 19 nt, Shigella flexneri 2a str. 301
uucugagaucaaugcgcca

SEQ ID NO: 3933859 - RNA, 14 nt, Shigella flexneri 2a str. 301
uucugagcaucaca

SEQ ID NO: 3933860 - RNA, 20 nt, Shigella flexneri 2a str. 301
uucugagcggccuuuuccuu

SEQ ID NO: 3933861 - RNA, 21 nt, Shigella flexneri 2a str. 301
uucugagucaauuucugcaaa

SEQ ID NO: 3933862 - RNA, 23 nt, Shigella flexneri 2a str. 301
uucugcaauauauugaauuugga

SEQ ID NO: 3933863 - RNA, 21 nt, Shigella flexneri 2a str. 301
uucugccacgccacgcugccg

SEQ ID NO: 3933864 - RNA, 14 nt, Shigella flexneri 2a str. 301
uucugccagcugcu

SEQ ID NO: 3933865 - RNA, 21 nt, Shigella flexneri 2a str. 301
uucugccaguuguugcugaau

SEQ ID NO: 3933866 - RNA, 19 nt, Shigella flexneri 2a str. 301
uucugccaguuugccgaac

SEQ ID NO: 3933867 - RNA, 19 nt, Shigella flexneri 2a str. 301
uucugccgcgcacgucagc

SEQ ID NO: 3933868 - RNA, 15 nt, Shigella flexneri 2a str. 301
uucugccgcuguuuu

SEQ ID NO: 3933869 - RNA, 18 nt, Shigella flexneri 2a str. 301
uucugccgcuuccagcag

SEQ ID NO: 3933870 - RNA, 22 nt, Shigella flexneri 2a str. 301
uucugccuguccaccacgcugc

SEQ ID NO: 3933871 - RNA, 16 nt, Shigella flexneri 2a str. 301
uucugcgauagcagca

SEQ ID NO: 3933872 - RNA, 18 nt, Shigella flexneri 2a str. 301
uucugcgcacacacgccc

SEQ ID NO: 3933873 - RNA, 19 nt, Shigella flexneri 2a str. 301
uucugcguucugauuuaau

SEQ ID NO: 3933874 - RNA, 15 nt, Shigella flexneri 2a str. 301
uucugcuucugccag

SEQ ID NO: 3933875 - RNA, 22 nt, Shigella flexneri 2a str. 301
uucuggcaccggacgcuuguca

SEQ ID NO: 3933876 - RNA, 12 nt, Shigella flexneri 2a str. 301
uucuggcaucac

SEQ ID NO: 3933877 - RNA, 14 nt, Shigella flexneri 2a str. 301
uucuggcggcggug

SEQ ID NO: 3933878 - RNA, 12 nt, Shigella flexneri 2a str. 301
uucuggcugcca

SEQ ID NO: 3933879 - RNA, 14 nt, Shigella flexneri 2a str. 301
uucuggucauugcc

SEQ ID NO: 3933880 - RNA, 22 nt, Shigella flexneri 2a str. 301
uugaggaaguuauacagacuca

SEQ ID NO: 3933881 - RNA, 17 nt, Shigella flexneri 2a str. 301
uugaggaguuuaauaaa

SEQ ID NO: 3933882 - RNA, 14 nt, Shigella flexneri 2a str. 301
uugaggaucacaaa

SEQ ID NO: 3933883 - RNA, 17 nt, Shigella flexneri 2a str. 301
uugaggaugcuaaggcu

SEQ ID NO: 3933884 - RNA, 19 nt, Shigella flexneri 2a str. 301
uugaguggcgcaucuucau

SEQ ID NO: 3933885 - RNA, 19 nt, Shigella flexneri 2a str. 301
uugaguuuuucaucccucu

SEQ ID NO: 3933886 - RNA, 12 nt, Shigella flexneri 2a str. 301
uugauaaaaaaa

SEQ ID NO: 3933887 - RNA, 16 nt, Shigella flexneri 2a str. 301
uugauaaccacggcgc

SEQ ID NO: 3933888 - RNA, 20 nt, Shigella flexneri 2a str. 301
uugauacaggcgcuguaugc

SEQ ID NO: 3933889 - RNA, 13 nt, Shigella flexneri 2a str. 301
uugauacgagagc

SEQ ID NO: 3933890 - RNA, 13 nt, Shigella flexneri 2a str. 301
uugauagaacaaa

SEQ ID NO: 3933891 - RNA, 13 nt, Shigella flexneri 2a str. 301
uugauagcaauac

SEQ ID NO: 3933892 - RNA, 13 nt, Shigella flexneri 2a str. 301
uugauauccaccu

SEQ ID NO: 3933893 - RNA, 19 nt, Shigella flexneri 2a str. 301
uugaucaaauacuucaaua

SEQ ID NO: 3933894 - RNA, 19 nt, Shigella flexneri 2a str. 301
uugaucaauucuaaauguu

SEQ ID NO: 3933895 - RNA, 13 nt, Shigella flexneri 2a str. 301
uugaucaccagug

SEQ ID NO: 3933896 - RNA, 22 nt, Shigella flexneri 2a str. 301
uugaucacccacaucagcggca

SEQ ID NO: 3933897 - RNA, 13 nt, Shigella flexneri 2a str. 301
uugaucauaaaaa

SEQ ID NO: 3933898 - RNA, 17 nt, Shigella flexneri 2a str. 301
uugauccaggagcucca

SEQ ID NO: 3933899 - RNA, 21 nt, Shigella flexneri 2a str. 301
uugaucccggcuccaaugacu

SEQ ID NO: 3933900 - RNA, 20 nt, Shigella flexneri 2a str. 301
uugauccguccccaccuguc

SEQ ID NO: 3933901 - RNA, 17 nt, Shigella flexneri 2a str. 301
uugaugaaaaaaccaga

SEQ ID NO: 3933902 - RNA, 19 nt, Shigella flexneri 2a str. 301
uugaugaaaaaaccagaaa

SEQ ID NO: 3933903 - RNA, 21 nt, Shigella flexneri 2a str. 301
uugaugcacugggagaacgcu

SEQ ID NO: 3933904 - RNA, 21 nt, Shigella flexneri 2a str. 301
uugaugccaguaauccggcuu

SEQ ID NO: 3933905 - RNA, 14 nt, Shigella flexneri 2a str. 301
uugaugccguucca

SEQ ID NO: 3933906 - RNA, 23 nt, Shigella flexneri 2a str. 301
uugaugcgugagguaacaauaaa

SEQ ID NO: 3933907 - RNA, 18 nt, Shigella flexneri 2a str. 301
uugaugcuguaaaaugag

SEQ ID NO: 3933908 - RNA, 15 nt, Shigella flexneri 2a str. 301
uugauggggguccug

SEQ ID NO: 3933909 - RNA, 17 nt, Shigella flexneri 2a str. 301
uugauuacacaaaucca

SEQ ID NO: 3933910 - RNA, 20 nt, Shigella flexneri 2a str. 301
uugauuacacaaauccagca

SEQ ID NO: 3933911 - RNA, 17 nt, Shigella flexneri 2a str. 301
uugauuacagcuggagu

SEQ ID NO: 3933912 - RNA, 22 nt, Shigella flexneri 2a str. 301
uugauuaccaauaucaaauaaa

SEQ ID NO: 3933913 - RNA, 20 nt, Shigella flexneri 2a str. 301
uugauucaucucuucuuccg

SEQ ID NO: 3933914 - RNA, 14 nt, Shigella flexneri 2a str. 301
uugauucuguucag

SEQ ID NO: 3933915 - RNA, 12 nt, Shigella flexneri 2a str. 301
uugauuuuauug

SEQ ID NO: 3933916 - RNA, 17 nt, Shigella flexneri 2a str. 301
uugauuuucgaaaaaaa

SEQ ID NO: 3933917 - RNA, 18 nt, Shigella flexneri 2a str. 301
uugauuuucgaaaaaaaa

SEQ ID NO: 3933918 - RNA, 18 nt, Shigella flexneri 2a str. 301
uugauuuuuuugauaaac

SEQ ID NO: 3933919 - RNA, 14 nt, Shigella flexneri 2a str. 301
uugcaaaaucaaau

SEQ ID NO: 3933920 - RNA, 13 nt, Shigella flexneri 2a str. 301
uugcaaaaucaau

SEQ ID NO: 3933921 - RNA, 20 nt, Shigella flexneri 2a str. 301
uugcaaagagaacugagcga

SEQ ID NO: 3933922 - RNA, 24 nt, Shigella flexneri 2a str. 301
uugcaacgaacgcauccgcuggcc

SEQ ID NO: 3933923 - RNA, 13 nt, Shigella flexneri 2a str. 301
uugcaacgcccau

SEQ ID NO: 3933924 - RNA, 18 nt, Shigella flexneri 2a str. 301
uugcaacgcccaucaaca

SEQ ID NO: 3933925 - RNA, 16 nt, Shigella flexneri 2a str. 301
uugcaagaucgcucau

SEQ ID NO: 3933926 - RNA, 21 nt, Shigella flexneri 2a str. 301
uugcaauaauggaaccuaacg

SEQ ID NO: 3933927 - RNA, 16 nt, Shigella flexneri 2a str. 301
uugcacacuuuccaua

SEQ ID NO: 3933928 - RNA, 16 nt, Shigella flexneri 2a str. 301
uugcaccagcaacaag

SEQ ID NO: 3933929 - RNA, 21 nt, Shigella flexneri 2a str. 301
uugcaccagcaacaagccagu

SEQ ID NO: 3933930 - RNA, 17 nt, Shigella flexneri 2a str. 301
uugcaccgggcuuuuuu

SEQ ID NO: 3933931 - RNA, 14 nt, Shigella flexneri 2a str. 301
uugcaccugaucca

SEQ ID NO: 3933932 - RNA, 20 nt, Shigella flexneri 2a str. 301
uugcacgaaggugcauugcu

SEQ ID NO: 3933933 - RNA, 22 nt, Shigella flexneri 2a str. 301
uugcagaggugcugaaagggca

SEQ ID NO: 3933934 - RNA, 14 nt, Shigella flexneri 2a str. 301
uugcaggaaaaacu

SEQ ID NO: 3933935 - RNA, 23 nt, Shigella flexneri 2a str. 301
uugcaggcgauccuguucaaaca

SEQ ID NO: 3933936 - RNA, 21 nt, Shigella flexneri 2a str. 301
uugcaggucguccugcaaagc

SEQ ID NO: 3933937 - RNA, 14 nt, Shigella flexneri 2a str. 301
uugcagguucugcu

SEQ ID NO: 3933938 - RNA, 22 nt, Shigella flexneri 2a str. 301
uugcauaaugguggaguggccc

SEQ ID NO: 3933939 - RNA, 21 nt, Shigella flexneri 2a str. 301
uugcauagcuucgaaguuuuc

SEQ ID NO: 3933940 - RNA, 17 nt, Shigella flexneri 2a str. 301
uugcaucccagaaaaaa

SEQ ID NO: 3933941 - RNA, 13 nt, Shigella flexneri 2a str. 301
uugcauccgguca

SEQ ID NO: 3933942 - RNA, 16 nt, Shigella flexneri 2a str. 301
uugcaucgucuguuuu

SEQ ID NO: 3933943 - RNA, 17 nt, Shigella flexneri 2a str. 301
uugcauuuccauaaauu

SEQ ID NO: 3933944 - RNA, 15 nt, Shigella flexneri 2a str. 301
uugccaaauaucuua

SEQ ID NO: 3933945 - RNA, 16 nt, Shigella flexneri 2a str. 301
uugccaaauguugucu

SEQ ID NO: 3933946 - RNA, 19 nt, Shigella flexneri 2a str. 301
uugccaccccuuuugacuu

SEQ ID NO: 3933947 - RNA, 11 nt, Shigella flexneri 2a str. 301
uugccacccug

SEQ ID NO: 3933948 - RNA, 16 nt, Shigella flexneri 2a str. 301
uugccacccugcggcu

SEQ ID NO: 3933949 - RNA, 14 nt, Shigella flexneri 2a str. 301
uugccacugccggu

SEQ ID NO: 3933950 - RNA, 21 nt, Shigella flexneri 2a str. 301
uugccagagcagcaacaagcc

SEQ ID NO: 3933951 - RNA, 15 nt, Shigella flexneri 2a str. 301
uugccagauaaacau

SEQ ID NO: 3933952 - RNA, 14 nt, Shigella flexneri 2a str. 301
uugccagauaaaua

SEQ ID NO: 3933953 - RNA, 13 nt, Shigella flexneri 2a str. 301
uugccagaucgcc

SEQ ID NO: 3933954 - RNA, 11 nt, Shigella flexneri 2a str. 301
uugccagccgu

SEQ ID NO: 3933955 - RNA, 18 nt, Shigella flexneri 2a str. 301
uugccagugaaaguuuuc

SEQ ID NO: 3933956 - RNA, 21 nt, Shigella flexneri 2a str. 301
uugccaugcauauccaggcua

SEQ ID NO: 3933957 - RNA, 16 nt, Shigella flexneri 2a str. 301
uugccauguugauccc

SEQ ID NO: 3933958 - RNA, 21 nt, Shigella flexneri 2a str. 301
uugccauuucugcugccacuu

SEQ ID NO: 3933959 - RNA, 14 nt, Shigella flexneri 2a str. 301
uugcccaucgccac

SEQ ID NO: 3933960 - RNA, 19 nt, Shigella flexneri 2a str. 301
uugccccagcgggaucggc

SEQ ID NO: 3933961 - RNA, 17 nt, Shigella flexneri 2a str. 301
uugcccccugaagcagu

SEQ ID NO: 3933962 - RNA, 21 nt, Shigella flexneri 2a str. 301
uugcccccugaagcaguuuca

SEQ ID NO: 3933963 - RNA, 17 nt, Shigella flexneri 2a str. 301
uugccccucuaacucuu

SEQ ID NO: 3933964 - RNA, 16 nt, Shigella flexneri 2a str. 301
uugcccgcaagcugcg

SEQ ID NO: 3933965 - RNA, 20 nt, Shigella flexneri 2a str. 301
uugcccgcgcguuaacuccc

SEQ ID NO: 3933966 - RNA, 17 nt, Shigella flexneri 2a str. 301
uugcccgguuucgccac

SEQ ID NO: 3933967 - RNA, 21 nt, Shigella flexneri 2a str. 301
uugcccucugaauaacaccca

SEQ ID NO: 3933968 - RNA, 15 nt, Shigella flexneri 2a str. 301
uugccgcacuuaaua

SEQ ID NO: 3933969 - RNA, 18 nt, Shigella flexneri 2a str. 301
uugccgcagcaguugcca

SEQ ID NO: 3933970 - RNA, 13 nt, Shigella flexneri 2a str. 301
uugccgccaccuu

SEQ ID NO: 3933971 - RNA, 14 nt, Shigella flexneri 2a str. 301
uugccgcuacauca

SEQ ID NO: 3933972 - RNA, 19 nt, Shigella flexneri 2a str. 301
uugccgcuuaaauuuccac

SEQ ID NO: 3933973 - RNA, 17 nt, Shigella flexneri 2a str. 301
uugccggacgcugagca

SEQ ID NO: 3933974 - RNA, 24 nt, Shigella flexneri 2a str. 301
uugccggaugcaugauccggcauc

SEQ ID NO: 3933975 - RNA, 15 nt, Shigella flexneri 2a str. 301
uugccggaugcgaca

SEQ ID NO: 3933976 - RNA, 22 nt, Shigella flexneri 2a str. 301
uugccggaugcggcguaaaugc

SEQ ID NO: 3933977 - RNA, 17 nt, Shigella flexneri 2a str. 301
uugccggaugugaugca

SEQ ID NO: 3933978 - RNA, 18 nt, Shigella flexneri 2a str. 301
uugccgggcgugcugccg

SEQ ID NO: 3933979 - RNA, 15 nt, Shigella flexneri 2a str. 301
uugccguucuucccg

SEQ ID NO: 3933980 - RNA, 15 nt, Shigella flexneri 2a str. 301
uugggugacaaucac

SEQ ID NO: 3933981 - RNA, 18 nt, Shigella flexneri 2a str. 301
uugguaaaugcgaauagc

SEQ ID NO: 3933982 - RNA, 15 nt, Shigella flexneri 2a str. 301
uugguaaugacucca

SEQ ID NO: 3933983 - RNA, 15 nt, Shigella flexneri 2a str. 301
uugguauucugggaa

SEQ ID NO: 3933984 - RNA, 16 nt, Shigella flexneri 2a str. 301
uuggugaaaaaaugau

SEQ ID NO: 3933985 - RNA, 14 nt, Shigella flexneri 2a str. 301
uugguuaacugaau

SEQ ID NO: 3933986 - RNA, 22 nt, Shigella flexneri 2a str. 301
uugguuaacugaauauuccagu

SEQ ID NO: 3933987 - RNA, 17 nt, Shigella flexneri 2a str. 301
uugguucaucgugcugu

SEQ ID NO: 3933988 - RNA, 13 nt, Shigella flexneri 2a str. 301
uuguaaaagaagg

SEQ ID NO: 3933989 - RNA, 19 nt, Shigella flexneri 2a str. 301
uuguaaagaccauugaugc

SEQ ID NO: 3933990 - RNA, 14 nt, Shigella flexneri 2a str. 301
uuguaaagcgccaa

SEQ ID NO: 3933991 - RNA, 12 nt, Shigella flexneri 2a str. 301
uuguaaaugaac

SEQ ID NO: 3933992 - RNA, 21 nt, Shigella flexneri 2a str. 301
uuguaagccggaucggaggca

SEQ ID NO: 3933993 - RNA, 21 nt, Shigella flexneri 2a str. 301
uuguaagcugucgaaaagaua

SEQ ID NO: 3933994 - RNA, 13 nt, Shigella flexneri 2a str. 301
uuguagagcagca

SEQ ID NO: 3933995 - RNA, 21 nt, Shigella flexneri 2a str. 301
uuguagccaauaaaugccacc

SEQ ID NO: 3933996 - RNA, 20 nt, Shigella flexneri 2a str. 301
uuguaggccagauaagacgu

SEQ ID NO: 3933997 - RNA, 19 nt, Shigella flexneri 2a str. 301
uuguaggccggauaagcgu

SEQ ID NO: 3933998 - RNA, 20 nt, Shigella flexneri 2a str. 301
uuguaggccggauaaggcgc

SEQ ID NO: 3933999 - RNA, 20 nt, Shigella flexneri 2a str. 301
uuguaggccggauaaggcgu

SEQ ID NO: 3934000 - RNA, 19 nt, Shigella flexneri 2a str. 301
uuguaggccugauaagcgu

SEQ ID NO: 3934001 - RNA, 23 nt, Shigella flexneri 2a str. 301
uuguaggcggauaaggcguuuuc

SEQ ID NO: 3934002 - RNA, 20 nt, Shigella flexneri 2a str. 301
uuguaggcuggauaaggcgu

SEQ ID NO: 3934003 - RNA, 20 nt, Shigella flexneri 2a str. 301
uuguaggucggauaaggcgu

SEQ ID NO: 3934004 - RNA, 16 nt, Shigella flexneri 2a str. 301
uuguauaacgugguga

SEQ ID NO: 3934005 - RNA, 15 nt, Shigella flexneri 2a str. 301
uuguauccuguuuuu

SEQ ID NO: 3934006 - RNA, 23 nt, Shigella flexneri 2a str. 301
uuguaugucacaggccuuuugcg

SEQ ID NO: 3934007 - RNA, 19 nt, Shigella flexneri 2a str. 301
uuguauuuuaucugaggca

SEQ ID NO: 3934008 - RNA, 12 nt, Shigella flexneri 2a str. 301
uugucaauaauc

SEQ ID NO: 3934009 - RNA, 23 nt, Shigella flexneri 2a str. 301
uugucaccgccaggugaaauccg

SEQ ID NO: 3934010 - RNA, 18 nt, Shigella flexneri 2a str. 301
uugucagcccuuuuucac

SEQ ID NO: 3934011 - RNA, 16 nt, Shigella flexneri 2a str. 301
uugucauaaccaaugu

SEQ ID NO: 3934012 - RNA, 19 nt, Shigella flexneri 2a str. 301
uugucauagcgacuaccac

SEQ ID NO: 3934013 - RNA, 23 nt, Shigella flexneri 2a str. 301
uugucaugcagcuccaccgauuu

SEQ ID NO: 3934014 - RNA, 12 nt, Shigella flexneri 2a str. 301
uugucauuggca

SEQ ID NO: 3934015 - RNA, 14 nt, Shigella flexneri 2a str. 301
uuguccaguugccc

SEQ ID NO: 3934016 - RNA, 17 nt, Shigella flexneri 2a str. 301
uuguccgcuauuucuug

SEQ ID NO: 3934017 - RNA, 15 nt, Shigella flexneri 2a str. 301
uuguccgucugaaaa

SEQ ID NO: 3934018 - RNA, 17 nt, Shigella flexneri 2a str. 301
uugucgauaaacaguuu

SEQ ID NO: 3934019 - RNA, 19 nt, Shigella flexneri 2a str. 301
uugucgauaaacaguuucg

SEQ ID NO: 3934020 - RNA, 13 nt, Shigella flexneri 2a str. 301
uugucgaucuccg

SEQ ID NO: 3934021 - RNA, 19 nt, Shigella flexneri 2a str. 301
uugucgcacauuucaauca

SEQ ID NO: 3934022 - RNA, 14 nt, Shigella flexneri 2a str. 301
uugucgggcaggcu

SEQ ID NO: 3934023 - RNA, 21 nt, Shigella flexneri 2a str. 301
uugucgugggcaggaaaauca

SEQ ID NO: 3934024 - RNA, 16 nt, Shigella flexneri 2a str. 301
uugucucuucaugccu

SEQ ID NO: 3934025 - RNA, 19 nt, Shigella flexneri 2a str. 301
uugucugaauccaucugua

SEQ ID NO: 3934026 - RNA, 14 nt, Shigella flexneri 2a str. 301
uugucuguuugccu

SEQ ID NO: 3934027 - RNA, 11 nt, Shigella flexneri 2a str. 301
uugucuucaau

SEQ ID NO: 3934028 - RNA, 16 nt, Shigella flexneri 2a str. 301
uugugaagguaguccc

SEQ ID NO: 3934029 - RNA, 20 nt, Shigella flexneri 2a str. 301
uugugacauuaaccaaccac

SEQ ID NO: 3934030 - RNA, 15 nt, Shigella flexneri 2a str. 301
uugugacuuugugaa

SEQ ID NO: 3934031 - RNA, 16 nt, Shigella flexneri 2a str. 301
uugugagcauaacgua

SEQ ID NO: 3934032 - RNA, 11 nt, Shigella flexneri 2a str. 301
uugugaugcaa

SEQ ID NO: 3934033 - RNA, 11 nt, Shigella flexneri 2a str. 301
uugugauucga

SEQ ID NO: 3934034 - RNA, 14 nt, Shigella flexneri 2a str. 301
uugugcaccaccaa

SEQ ID NO: 3934035 - RNA, 17 nt, Shigella flexneri 2a str. 301
uugugcaccagcuggcu

SEQ ID NO: 3934036 - RNA, 16 nt, Shigella flexneri 2a str. 301
uugugcagcaugcacc

SEQ ID NO: 3934037 - RNA, 12 nt, Shigella flexneri 2a str. 301
uugugccagacc

SEQ ID NO: 3934038 - RNA, 13 nt, Shigella flexneri 2a str. 301
uugugccaguuca

SEQ ID NO: 3934039 - RNA, 13 nt, Shigella flexneri 2a str. 301
uugugcuggcaaa

SEQ ID NO: 3934040 - RNA, 16 nt, Shigella flexneri 2a str. 301
uugugcugugacagau

SEQ ID NO: 3934041 - RNA, 17 nt, Shigella flexneri 2a str. 301
uuguguaaguuuaaccu

SEQ ID NO: 3934042 - RNA, 16 nt, Shigella flexneri 2a str. 301
uugugugaaaucagca

SEQ ID NO: 3934043 - RNA, 16 nt, Shigella flexneri 2a str. 301
uuguguuuauuuaaug

SEQ ID NO: 3934044 - RNA, 20 nt, Shigella flexneri 2a str. 301
uuguguuuuuuauuucagua

SEQ ID NO: 3934045 - RNA, 20 nt, Shigella flexneri 2a str. 301
uuguuaaugugacagagcca

SEQ ID NO: 3934046 - RNA, 20 nt, Shigella flexneri 2a str. 301
uuguuauccaccgaaauaau

SEQ ID NO: 3934047 - RNA, 14 nt, Shigella flexneri 2a str. 301
uuguuaucccucaa

SEQ ID NO: 3934048 - RNA, 16 nt, Shigella flexneri 2a str. 301
uuguucaugccggaug

SEQ ID NO: 3934049 - RNA, 20 nt, Shigella flexneri 2a str. 301
uuguucucuucugcuuugcc

SEQ ID NO: 3934050 - RNA, 13 nt, Shigella flexneri 2a str. 301
uuguucugaauca

SEQ ID NO: 3934051 - RNA, 19 nt, Shigella flexneri 2a str. 301
uuguugccgcccguuuucu

SEQ ID NO: 3934052 - RNA, 20 nt, Shigella flexneri 2a str. 301
uuguugcgcuaagccugcug

SEQ ID NO: 3934053 - RNA, 18 nt, Shigella flexneri 2a str. 301
uuguuggcgaaaaucuuu

SEQ ID NO: 3934054 - RNA, 21 nt, Shigella flexneri 2a str. 301
uuguuggcgaaaaucuuugca

SEQ ID NO: 3934055 - RNA, 19 nt, Shigella flexneri 2a str. 301
uuguuuaauggcaaaaacu

SEQ ID NO: 3934056 - RNA, 22 nt, Shigella flexneri 2a str. 301
uuguuucaacacaggauacgca

SEQ ID NO: 3934057 - RNA, 15 nt, Shigella flexneri 2a str. 301
uuguuuccauaugua

SEQ ID NO: 3934058 - RNA, 23 nt, Shigella flexneri 2a str. 301
uuguuucggugaauucagcgacu

SEQ ID NO: 3934059 - RNA, 14 nt, Shigella flexneri 2a str. 301
uuguuuucaugccg

SEQ ID NO: 3934060 - RNA, 12 nt, Shigella flexneri 2a str. 301
uuguuuuuucaa

SEQ ID NO: 3934061 - RNA, 22 nt, Shigella flexneri 2a str. 301
uuguuuuuugagcgguacacca

SEQ ID NO: 3934062 - RNA, 15 nt, Shigella flexneri 2a str. 301
uuuaaaaaguaaaac

SEQ ID NO: 3934063 - RNA, 20 nt, Shigella flexneri 2a str. 301
uuuaaaaccacuacccauau

SEQ ID NO: 3934064 - RNA, 17 nt, Shigella flexneri 2a str. 301
uuuaaaacugccugaua

SEQ ID NO: 3934065 - RNA, 13 nt, Shigella flexneri 2a str. 301
uuuaaacagagau

SEQ ID NO: 3934066 - RNA, 22 nt, Shigella flexneri 2a str. 301
uuuaaacaucaaaccacuuaau

SEQ ID NO: 3934067 - RNA, 23 nt, Shigella flexneri 2a str. 301
uuuaaacaucaaaccacuuaauu

SEQ ID NO: 3934068 - RNA, 12 nt, Shigella flexneri 2a str. 301
uuuaaacauuaa

SEQ ID NO: 3934069 - RNA, 14 nt, Shigella flexneri 2a str. 301
uuuaaaccugauuu

SEQ ID NO: 3934070 - RNA, 19 nt, Shigella flexneri 2a str. 301
uuuaaauaccuuacacuca

SEQ ID NO: 3934071 - RNA, 21 nt, Shigella flexneri 2a str. 301
uuuaaaucaaacggugguugu

SEQ ID NO: 3934072 - RNA, 13 nt, Shigella flexneri 2a str. 301
uuuaaauuuccca

SEQ ID NO: 3934073 - RNA, 17 nt, Shigella flexneri 2a str. 301
uuuaacaauuuaucaga

SEQ ID NO: 3934074 - RNA, 20 nt, Shigella flexneri 2a str. 301
uuuaacaguuguccaaacgu

SEQ ID NO: 3934075 - RNA, 16 nt, Shigella flexneri 2a str. 301
uuuaaccagucgcuga

SEQ ID NO: 3934076 - RNA, 18 nt, Shigella flexneri 2a str. 301
uuuaaccgccuaauuaca

SEQ ID NO: 3934077 - RNA, 20 nt, Shigella flexneri 2a str. 301
uuuaacgaagccguugcuga

SEQ ID NO: 3934078 - RNA, 16 nt, Shigella flexneri 2a str. 301
uuuaacggaugaugcu

SEQ ID NO: 3934079 - RNA, 22 nt, Shigella flexneri 2a str. 301
uuuaacguuacuaauaaaucgu

SEQ ID NO: 3934080 - RNA, 16 nt, Shigella flexneri 2a str. 301
uuucaaucgacuuuuc

SEQ ID NO: 3934081 - RNA, 23 nt, Shigella flexneri 2a str. 301
uuucaaugauaaaggucaucaca

SEQ ID NO: 3934082 - RNA, 15 nt, Shigella flexneri 2a str. 301
uuucaaugcacaauc

SEQ ID NO: 3934083 - RNA, 13 nt, Shigella flexneri 2a str. 301
uuucaaugcuuuu

SEQ ID NO: 3934084 - RNA, 12 nt, Shigella flexneri 2a str. 301
uuucaauuauca

SEQ ID NO: 3934085 - RNA, 18 nt, Shigella flexneri 2a str. 301
uuucaauuaucaccgcac

SEQ ID NO: 3934086 - RNA, 16 nt, Shigella flexneri 2a str. 301
uuucaauuccauuucc

SEQ ID NO: 3934087 - RNA, 19 nt, Shigella flexneri 2a str. 301
uuucaauuccauuucccug

SEQ ID NO: 3934088 - RNA, 14 nt, Shigella flexneri 2a str. 301
uuucacaauugacg

SEQ ID NO: 3934089 - RNA, 19 nt, Shigella flexneri 2a str. 301
uuucacagaagugaagcau

SEQ ID NO: 3934090 - RNA, 18 nt, Shigella flexneri 2a str. 301
uuucacaggaaaaacuuu

SEQ ID NO: 3934091 - RNA, 11 nt, Shigella flexneri 2a str. 301
uuucaccagcg

SEQ ID NO: 3934092 - RNA, 15 nt, Shigella flexneri 2a str. 301
uuucacccacuaauc

SEQ ID NO: 3934093 - RNA, 19 nt, Shigella flexneri 2a str. 301
uuucacccgcgaccaccag

SEQ ID NO: 3934094 - RNA, 19 nt, Shigella flexneri 2a str. 301
uuucaccugauuaccguga

SEQ ID NO: 3934095 - RNA, 23 nt, Shigella flexneri 2a str. 301
uuucaccugcugauuauccgcau

SEQ ID NO: 3934096 - RNA, 19 nt, Shigella flexneri 2a str. 301
uuucacgaagcucucugcu

SEQ ID NO: 3934097 - RNA, 21 nt, Shigella flexneri 2a str. 301
uuucacgagagauacgcuugc

SEQ ID NO: 3934098 - RNA, 14 nt, Shigella flexneri 2a str. 301
uuucacgaugaacu

SEQ ID NO: 3934099 - RNA, 23 nt, Shigella flexneri 2a str. 301
uuucacgccugcggcuuccagag

SEQ ID NO: 3934100 - RNA, 15 nt, Shigella flexneri 2a str. 301
uuucacuauuucuuu

SEQ ID NO: 3934101 - RNA, 20 nt, Shigella flexneri 2a str. 301
uuucacuucaaccacauuca

SEQ ID NO: 3934102 - RNA, 20 nt, Shigella flexneri 2a str. 301
uuucacuucgucagaaaugg

SEQ ID NO: 3934103 - RNA, 19 nt, Shigella flexneri 2a str. 301
uuucagaaaacgguugaua

SEQ ID NO: 3934104 - RNA, 22 nt, Shigella flexneri 2a str. 301
uuucagaaauuuggcuccucug

SEQ ID NO: 3934105 - RNA, 22 nt, Shigella flexneri 2a str. 301
uuucagaagcaugaacauugcu

SEQ ID NO: 3934106 - RNA, 17 nt, Shigella flexneri 2a str. 301
uuucagaauagacaaaa

SEQ ID NO: 3934107 - RNA, 16 nt, Shigella flexneri 2a str. 301
uuucagaccagacugc

SEQ ID NO: 3934108 - RNA, 23 nt, Shigella flexneri 2a str. 301
uuucagacggcugucuuccugug

SEQ ID NO: 3934109 - RNA, 19 nt, Shigella flexneri 2a str. 301
uuucagauuauugacaaag

SEQ ID NO: 3934110 - RNA, 20 nt, Shigella flexneri 2a str. 301
uuucagauuggugacaaagu

SEQ ID NO: 3934111 - RNA, 19 nt, Shigella flexneri 2a str. 301
uuucagauuguugacaaag

SEQ ID NO: 3934112 - RNA, 19 nt, Shigella flexneri 2a str. 301
uuucagcaccagauaauga

SEQ ID NO: 3934113 - RNA, 17 nt, Shigella flexneri 2a str. 301
uuucagcgaaugaaaga

SEQ ID NO: 3934114 - RNA, 18 nt, Shigella flexneri 2a str. 301
uuucagcggcguguuauu

SEQ ID NO: 3934115 - RNA, 17 nt, Shigella flexneri 2a str. 301
uuucaggaacaccgcac

SEQ ID NO: 3934116 - RNA, 16 nt, Shigella flexneri 2a str. 301
uuucaggccagcggcu

SEQ ID NO: 3934117 - RNA, 20 nt, Shigella flexneri 2a str. 301
uuucaggcuuuuuuccagcu

SEQ ID NO: 3934118 - RNA, 16 nt, Shigella flexneri 2a str. 301
uuucagguuacgcccu

SEQ ID NO: 3934119 - RNA, 17 nt, Shigella flexneri 2a str. 301
uuucagguuguuuucug

SEQ ID NO: 3934120 - RNA, 14 nt, Shigella flexneri 2a str. 301
uuucaguaacauca

SEQ ID NO: 3934121 - RNA, 15 nt, Shigella flexneri 2a str. 301
uuucaguaauccuuu

SEQ ID NO: 3934122 - RNA, 19 nt, Shigella flexneri 2a str. 301
uuucaguuggcugacaaag

SEQ ID NO: 3934123 - RNA, 13 nt, Shigella flexneri 2a str. 301
uuucaguuugccg

SEQ ID NO: 3934124 - RNA, 17 nt, Shigella flexneri 2a str. 301
uuucaguuuuacucuuu

SEQ ID NO: 3934125 - RNA, 20 nt, Shigella flexneri 2a str. 301
uuucauaccccacauaguuu

SEQ ID NO: 3934126 - RNA, 14 nt, Shigella flexneri 2a str. 301
uuucauacugccga

SEQ ID NO: 3934127 - RNA, 20 nt, Shigella flexneri 2a str. 301
uuucauagauuaauuuccca

SEQ ID NO: 3934128 - RNA, 18 nt, Shigella flexneri 2a str. 301
uuucauauuauuugcuau

SEQ ID NO: 3934129 - RNA, 21 nt, Shigella flexneri 2a str. 301
uuucaucaacugacuauccug

SEQ ID NO: 3934130 - RNA, 21 nt, Shigella flexneri 2a str. 301
uuucaucagcacaaaucggca

SEQ ID NO: 3934131 - RNA, 19 nt, Shigella flexneri 2a str. 301
uuucaucccgagucgcuga

SEQ ID NO: 3934132 - RNA, 14 nt, Shigella flexneri 2a str. 301
uuucauccugccau

SEQ ID NO: 3934133 - RNA, 22 nt, Shigella flexneri 2a str. 301
uuucaucgcccaggcaaguagc

SEQ ID NO: 3934134 - RNA, 23 nt, Shigella flexneri 2a str. 301
uuucaucggcaacgguaugaaau

SEQ ID NO: 3934135 - RNA, 17 nt, Shigella flexneri 2a str. 301
uuucaugccauccgcau

SEQ ID NO: 3934136 - RNA, 16 nt, Shigella flexneri 2a str. 301
uuucaugcuauuccuu

SEQ ID NO: 3934137 - RNA, 18 nt, Shigella flexneri 2a str. 301
uuucaugcuauuccuuga

SEQ ID NO: 3934138 - RNA, 21 nt, Shigella flexneri 2a str. 301
uuucaugguuacgccggugau

SEQ ID NO: 3934139 - RNA, 16 nt, Shigella flexneri 2a str. 301
uuucaugguugucacc

SEQ ID NO: 3934140 - RNA, 21 nt, Shigella flexneri 2a str. 301
uuucauugaaugcggcaggca

SEQ ID NO: 3934141 - RNA, 20 nt, Shigella flexneri 2a str. 301
uuucauuugcgcggcaguca

SEQ ID NO: 3934142 - RNA, 19 nt, Shigella flexneri 2a str. 301
uuucauuuugauauuucgu

SEQ ID NO: 3934143 - RNA, 18 nt, Shigella flexneri 2a str. 301
uuuccaagcgcggcaggc

SEQ ID NO: 3934144 - RNA, 17 nt, Shigella flexneri 2a str. 301
uuuccacgcugauugca

SEQ ID NO: 3934145 - RNA, 13 nt, Shigella flexneri 2a str. 301
uuuccacuuccac

SEQ ID NO: 3934146 - RNA, 14 nt, Shigella flexneri 2a str. 301
uuuccacuuccacc

SEQ ID NO: 3934147 - RNA, 21 nt, Shigella flexneri 2a str. 301
uuuccagacugaugugaucca

SEQ ID NO: 3934148 - RNA, 15 nt, Shigella flexneri 2a str. 301
uuuccagcacaaagc

SEQ ID NO: 3934149 - RNA, 14 nt, Shigella flexneri 2a str. 301
uuuccagcaguucc

SEQ ID NO: 3934150 - RNA, 19 nt, Shigella flexneri 2a str. 301
uuuccagcaguuccagcau

SEQ ID NO: 3934151 - RNA, 15 nt, Shigella flexneri 2a str. 301
uuuccagcauuucuu

SEQ ID NO: 3934152 - RNA, 21 nt, Shigella flexneri 2a str. 301
uuuccaggcuggcaggccuca

SEQ ID NO: 3934153 - RNA, 23 nt, Shigella flexneri 2a str. 301
uuuccaguucacgaauauuuccc

SEQ ID NO: 3934154 - RNA, 14 nt, Shigella flexneri 2a str. 301
uuuccauccggcaa

SEQ ID NO: 3934155 - RNA, 16 nt, Shigella flexneri 2a str. 301
uuuccaucuuuccuca

SEQ ID NO: 3934156 - RNA, 13 nt, Shigella flexneri 2a str. 301
uuuccauugcauc

SEQ ID NO: 3934157 - RNA, 13 nt, Shigella flexneri 2a str. 301
uuuccauuuuuca

SEQ ID NO: 3934158 - RNA, 13 nt, Shigella flexneri 2a str. 301
uuucccaccacua

SEQ ID NO: 3934159 - RNA, 23 nt, Shigella flexneri 2a str. 301
uuucccccacagcucugcuguca

SEQ ID NO: 3934160 - RNA, 18 nt, Shigella flexneri 2a str. 301
uuuccccuaacucuuuca

SEQ ID NO: 3934161 - RNA, 18 nt, Shigella flexneri 2a str. 301
uuucccggguaaacacca

SEQ ID NO: 3934162 - RNA, 14 nt, Shigella flexneri 2a str. 301
uuucccuguugccu

SEQ ID NO: 3934163 - RNA, 16 nt, Shigella flexneri 2a str. 301
uuucccuguugcgcuc

SEQ ID NO: 3934164 - RNA, 13 nt, Shigella flexneri 2a str. 301
uuucccuucucgu

SEQ ID NO: 3934165 - RNA, 23 nt, Shigella flexneri 2a str. 301
uuuccgaccaggcguucugccug

SEQ ID NO: 3934166 - RNA, 23 nt, Shigella flexneri 2a str. 301
uuuccgccaccugauccaucguc

SEQ ID NO: 3934167 - RNA, 17 nt, Shigella flexneri 2a str. 301
uuuccgccucaucaucg

SEQ ID NO: 3934168 - RNA, 21 nt, Shigella flexneri 2a str. 301
uuuccgcgaauuaugcagccu

SEQ ID NO: 3934169 - RNA, 14 nt, Shigella flexneri 2a str. 301
uuuccgcuucugcu

SEQ ID NO: 3934170 - RNA, 18 nt, Shigella flexneri 2a str. 301
uuuccggaucgccaaagc

SEQ ID NO: 3934171 - RNA, 17 nt, Shigella flexneri 2a str. 301
uuuccggcagaagcaau

SEQ ID NO: 3934172 - RNA, 17 nt, Shigella flexneri 2a str. 301
uuuccgggagcaauuug

SEQ ID NO: 3934173 - RNA, 17 nt, Shigella flexneri 2a str. 301
uuuccggucgcaggcag

SEQ ID NO: 3934174 - RNA, 14 nt, Shigella flexneri 2a str. 301
uuuccguuaaccua

SEQ ID NO: 3934175 - RNA, 19 nt, Shigella flexneri 2a str. 301
uuuccguugugcgauccac

SEQ ID NO: 3934176 - RNA, 17 nt, Shigella flexneri 2a str. 301
uuuccuauugcugcuga

SEQ ID NO: 3934177 - RNA, 21 nt, Shigella flexneri 2a str. 301
uuuccucaguaccgugcagcg

SEQ ID NO: 3934178 - RNA, 15 nt, Shigella flexneri 2a str. 301
uuuccugagcacugg

SEQ ID NO: 3934179 - RNA, 16 nt, Shigella flexneri 2a str. 301
uuuccugagcacuggg

SEQ ID NO: 3934180 - RNA, 20 nt, Shigella flexneri 2a str. 301
uuugcgucauaccgcaucuu

SEQ ID NO: 3934181 - RNA, 22 nt, Shigella flexneri 2a str. 301
uuugcguccgguaauuuuuaua

SEQ ID NO: 3934182 - RNA, 20 nt, Shigella flexneri 2a str. 301
uuugcguugcacgcagacac

SEQ ID NO: 3934183 - RNA, 16 nt, Shigella flexneri 2a str. 301
uuugcugauauuuauc

SEQ ID NO: 3934184 - RNA, 13 nt, Shigella flexneri 2a str. 301
uuugcugaugcag

SEQ ID NO: 3934185 - RNA, 15 nt, Shigella flexneri 2a str. 301
uuugcugauucuccc

SEQ ID NO: 3934186 - RNA, 15 nt, Shigella flexneri 2a str. 301
uuugcuguugccgcc

SEQ ID NO: 3934187 - RNA, 13 nt, Shigella flexneri 2a str. 301
uuugcuuccugag

SEQ ID NO: 3934188 - RNA, 19 nt, Shigella flexneri 2a str. 301
uuugcuugccggaagcaaa

SEQ ID NO: 3934189 - RNA, 14 nt, Shigella flexneri 2a str. 301
uuugcuuuguaaag

SEQ ID NO: 3934190 - RNA, 20 nt, Shigella flexneri 2a str. 301
uuugcuuuugucaucagacu

SEQ ID NO: 3934191 - RNA, 12 nt, Shigella flexneri 2a str. 301
uuugcuuuuguu

SEQ ID NO: 3934192 - RNA, 16 nt, Shigella flexneri 2a str. 301
uuuggcaaacuacaaa

SEQ ID NO: 3934193 - RNA, 20 nt, Shigella flexneri 2a str. 301
uuuggcagacaaccauauuu

SEQ ID NO: 3934194 - RNA, 22 nt, Shigella flexneri 2a str. 301
uuuggcgaauuguucugcgcca

SEQ ID NO: 3934195 - RNA, 11 nt, Shigella flexneri 2a str. 301
uuuggcucuuc

SEQ ID NO: 3934196 - RNA, 14 nt, Shigella flexneri 2a str. 301
uuuggcugccgcca

SEQ ID NO: 3934197 - RNA, 18 nt, Shigella flexneri 2a str. 301
uuuggucuggcaaaaaua

SEQ ID NO: 3934198 - RNA, 23 nt, Shigella flexneri 2a str. 301
uuuggugaagugagaauuuuuca

SEQ ID NO: 3934199 - RNA, 17 nt, Shigella flexneri 2a str. 301
uuuggugagaacaccaa

SEQ ID NO: 3934200 - RNA, 15 nt, Shigella flexneri 2a str. 301
uuuguacuccagcag

SEQ ID NO: 3934201 - RNA, 19 nt, Shigella flexneri 2a str. 301
uuuguagauugcacuugcu

SEQ ID NO: 3934202 - RNA, 15 nt, Shigella flexneri 2a str. 301
uuuguaggccggaua

SEQ ID NO: 3934203 - RNA, 15 nt, Shigella flexneri 2a str. 301
uuuguaggccugaua

SEQ ID NO: 3934204 - RNA, 13 nt, Shigella flexneri 2a str. 301
uuuguaucgcuga

SEQ ID NO: 3934205 - RNA, 18 nt, Shigella flexneri 2a str. 301
uuuguauuagaugcuagu

SEQ ID NO: 3934206 - RNA, 16 nt, Shigella flexneri 2a str. 301
uuuguauuuauuuuca

SEQ ID NO: 3934207 - RNA, 13 nt, Shigella flexneri 2a str. 301
uuugucaaaaauc

SEQ ID NO: 3934208 - RNA, 20 nt, Shigella flexneri 2a str. 301
uuugucaguucggcaucauc

SEQ ID NO: 3934209 - RNA, 22 nt, Shigella flexneri 2a str. 301
uuugucaugacuacacuaaacg

SEQ ID NO: 3934210 - RNA, 14 nt, Shigella flexneri 2a str. 301
uuugucauuacuua

SEQ ID NO: 3934211 - RNA, 17 nt, Shigella flexneri 2a str. 301
uuuguccauaaaaugca

SEQ ID NO: 3934212 - RNA, 16 nt, Shigella flexneri 2a str. 301
uuuguccgcuauuucu

SEQ ID NO: 3934213 - RNA, 20 nt, Shigella flexneri 2a str. 301
uuugucgccaacuucaugac

SEQ ID NO: 3934214 - RNA, 23 nt, Shigella flexneri 2a str. 301
uuugucgugggcaggaaaaucag

SEQ ID NO: 3934215 - RNA, 21 nt, Shigella flexneri 2a str. 301
uuugucguugcuaacaaugga

SEQ ID NO: 3934216 - RNA, 17 nt, Shigella flexneri 2a str. 301
uuugucucuucaugccu

SEQ ID NO: 3934217 - RNA, 12 nt, Shigella flexneri 2a str. 301
uuugucuucaau

SEQ ID NO: 3934218 - RNA, 15 nt, Shigella flexneri 2a str. 301
uuugugaucuuuuuc

SEQ ID NO: 3934219 - RNA, 16 nt, Shigella flexneri 2a str. 301
uuugugcagcaugcac

SEQ ID NO: 3934220 - RNA, 20 nt, Shigella flexneri 2a str. 301
uuugugccugaauuuugguc

SEQ ID NO: 3934221 - RNA, 16 nt, Shigella flexneri 2a str. 301
uuugugggaauaacca

SEQ ID NO: 3934222 - RNA, 16 nt, Shigella flexneri 2a str. 301
uuuguuacgauagaau

SEQ ID NO: 3934223 - RNA, 22 nt, Shigella flexneri 2a str. 301
uuuguuacgauagaauauuucu

SEQ ID NO: 3934224 - RNA, 19 nt, Shigella flexneri 2a str. 301
uuuguuagcgaauaaagua

SEQ ID NO: 3934225 - RNA, 20 nt, Shigella flexneri 2a str. 301
uuuguuauccaccgaaauaa

SEQ ID NO: 3934226 - RNA, 23 nt, Shigella flexneri 2a str. 301
uuuguuauuacugcguauuuccu

SEQ ID NO: 3934227 - RNA, 13 nt, Shigella flexneri 2a str. 301
uuuguucucuucu

SEQ ID NO: 3934228 - RNA, 12 nt, Shigella flexneri 2a str. 301
uuuguugccgcc

SEQ ID NO: 3934229 - RNA, 20 nt, Shigella flexneri 2a str. 301
uuuguuguucugucagccca

SEQ ID NO: 3934230 - RNA, 14 nt, Shigella flexneri 2a str. 301
uuuuaaauauaaaa

SEQ ID NO: 3934231 - RNA, 13 nt, Shigella flexneri 2a str. 301
uuuuaaauugaag

SEQ ID NO: 3934232 - RNA, 22 nt, Shigella flexneri 2a str. 301
uuuuaacgccugacuggcuacu

SEQ ID NO: 3934233 - RNA, 13 nt, Shigella flexneri 2a str. 301
uuuuaacuuuaau

SEQ ID NO: 3934234 - RNA, 20 nt, Shigella flexneri 2a str. 301
uuuuaagauccaguugaccu

SEQ ID NO: 3934235 - RNA, 16 nt, Shigella flexneri 2a str. 301
uuuuaagcagccaucu

SEQ ID NO: 3934236 - RNA, 20 nt, Shigella flexneri 2a str. 301
uuuuaaucgucaguuuuuca

SEQ ID NO: 3934237 - RNA, 19 nt, Shigella flexneri 2a str. 301
uuuuacaacguauugaaau

SEQ ID NO: 3934238 - RNA, 12 nt, Shigella flexneri 2a str. 301
uuuuacaucauc

SEQ ID NO: 3934239 - RNA, 22 nt, Shigella flexneri 2a str. 301
uuuuacaucuacaaaaaacugg

SEQ ID NO: 3934240 - RNA, 20 nt, Shigella flexneri 2a str. 301
uuuuacauuauccagcgacu

SEQ ID NO: 3934241 - RNA, 14 nt, Shigella flexneri 2a str. 301
uuuuaccagcgccu

SEQ ID NO: 3934242 - RNA, 20 nt, Shigella flexneri 2a str. 301
uuuuacccagcagcagcggu

SEQ ID NO: 3934243 - RNA, 16 nt, Shigella flexneri 2a str. 301
uuuuacccaugacuuu

SEQ ID NO: 3934244 - RNA, 23 nt, Shigella flexneri 2a str. 301
uuuuaccggucaggauuuccagc

SEQ ID NO: 3934245 - RNA, 22 nt, Shigella flexneri 2a str. 301
uuuuaccucuuucucauaaaac

SEQ ID NO: 3934246 - RNA, 21 nt, Shigella flexneri 2a str. 301
uuuuacgcaaccacaaaacac

SEQ ID NO: 3934247 - RNA, 21 nt, Shigella flexneri 2a str. 301
uuuuacgccuguuaaucagcu

SEQ ID NO: 3934248 - RNA, 22 nt, Shigella flexneri 2a str. 301
uuuuacguugcauuuccauaaa

SEQ ID NO: 3934249 - RNA, 15 nt, Shigella flexneri 2a str. 301
uuuuacguuuuaauc

SEQ ID NO: 3934250 - RNA, 17 nt, Shigella flexneri 2a str. 301
uuuuacuaucuugccga

SEQ ID NO: 3934251 - RNA, 21 nt, Shigella flexneri 2a str. 301
uuuuauaaagaacucgaggau

SEQ ID NO: 3934252 - RNA, 23 nt, Shigella flexneri 2a str. 301
uuuuauacaagggaaauaagaaa

SEQ ID NO: 3934253 - RNA, 14 nt, Shigella flexneri 2a str. 301
uuuuauaguacuuc

SEQ ID NO: 3934254 - RNA, 20 nt, Shigella flexneri 2a str. 301
uuuuaucggagaacaggaau

SEQ ID NO: 3934255 - RNA, 14 nt, Shigella flexneri 2a str. 301
uuuuaucugugaac

SEQ ID NO: 3934256 - RNA, 15 nt, Shigella flexneri 2a str. 301
uuuuaucugugaacu

SEQ ID NO: 3934257 - RNA, 23 nt, Shigella flexneri 2a str. 301
uuuuaugauaggucauaucacaa

SEQ ID NO: 3934258 - RNA, 17 nt, Shigella flexneri 2a str. 301
uuuuauuaaauguguuu

SEQ ID NO: 3934259 - RNA, 19 nt, Shigella flexneri 2a str. 301
uuuuauugcuucaccagca

SEQ ID NO: 3934260 - RNA, 13 nt, Shigella flexneri 2a str. 301
uuuuauuuacacu

SEQ ID NO: 3934261 - RNA, 20 nt, Shigella flexneri 2a str. 301
uuuuauuugugguuggcgug

SEQ ID NO: 3934262 - RNA, 21 nt, Shigella flexneri 2a str. 301
uuuucaagcucaaaauaauac

SEQ ID NO: 3934263 - RNA, 23 nt, Shigella flexneri 2a str. 301
uuuucaauucacgaauauuuccc

SEQ ID NO: 3934264 - RNA, 12 nt, Shigella flexneri 2a str. 301
uuuucaccaguu

SEQ ID NO: 3934265 - RNA, 17 nt, Shigella flexneri 2a str. 301
uuuucacgccugcggcu

SEQ ID NO: 3934266 - RNA, 17 nt, Shigella flexneri 2a str. 301
uuuucacuccgaaguaa

SEQ ID NO: 3934267 - RNA, 16 nt, Shigella flexneri 2a str. 301
uuuucagccaucaucc

SEQ ID NO: 3934268 - RNA, 23 nt, Shigella flexneri 2a str. 301
uuuucagcgagagcaaugcgcau

SEQ ID NO: 3934269 - RNA, 17 nt, Shigella flexneri 2a str. 301
uuuucaguccacgguug

SEQ ID NO: 3934270 - RNA, 13 nt, Shigella flexneri 2a str. 301
uuuucaguuguug

SEQ ID NO: 3934271 - RNA, 19 nt, Shigella flexneri 2a str. 301
uuuuccaguagauucaaca

SEQ ID NO: 3934272 - RNA, 20 nt, Shigella flexneri 2a str. 301
uuuucccaacgugaccagua

SEQ ID NO: 3934273 - RNA, 18 nt, Shigella flexneri 2a str. 301
uuuucccugguaaaaaau

SEQ ID NO: 3934274 - RNA, 22 nt, Shigella flexneri 2a str. 301
uuuuccuauugcugcugaucca

SEQ ID NO: 3934275 - RNA, 14 nt, Shigella flexneri 2a str. 301
uuuuccugcugcau

SEQ ID NO: 3934276 - RNA, 21 nt, Shigella flexneri 2a str. 301
uuuuccugcugcaucugaaac

SEQ ID NO: 3934277 - RNA, 17 nt, Shigella flexneri 2a str. 301
uuuuccuugaaaaagag

SEQ ID NO: 3934278 - RNA, 12 nt, Shigella flexneri 2a str. 301
uuuucgaaaaaa

SEQ ID NO: 3934279 - RNA, 17 nt, Shigella flexneri 2a str. 301
uuuucgagcaggucagu

SEQ ID NO: 3934280 - RNA, 21 nt, Shigella flexneri 2a str. 301
ccuguugugcgagcaaagcgc

SEQ ID NO: 3934281 - RNA, 22 nt, Shigella flexneri 2a str. 301
ccuguugugcgagcaaagcgca

SEQ ID NO: 3934282 - RNA, 20 nt, Shigella flexneri 2a str. 301
ccuguuuagccgcuucugca

SEQ ID NO: 3934283 - RNA, 18 nt, Shigella flexneri 2a str. 301
ccuguuucggacuucugu

SEQ ID NO: 3934284 - RNA, 21 nt, Shigella flexneri 2a str. 301
ccuguuugguugccagccaca

SEQ ID NO: 3934285 - RNA, 23 nt, Shigella flexneri 2a str. 301
ccuguuuugucuuuuuaaugacu

SEQ ID NO: 3934286 - RNA, 14 nt, Shigella flexneri 2a str. 301
ccuuaaaacaauau

SEQ ID NO: 3934287 - RNA, 17 nt, Shigella flexneri 2a str. 301
ccuuaaaagugaggugu

SEQ ID NO: 3934288 - RNA, 13 nt, Shigella flexneri 2a str. 301
ccuuaaacaccug

SEQ ID NO: 3934289 - RNA, 18 nt, Shigella flexneri 2a str. 301
ccuuaacgguaucuuucc

SEQ ID NO: 3934290 - RNA, 17 nt, Shigella flexneri 2a str. 301
ccuuaacuggcgcgacg

SEQ ID NO: 3934291 - RNA, 19 nt, Shigella flexneri 2a str. 301
ccuuaacuucaucagcaaa

SEQ ID NO: 3934292 - RNA, 16 nt, Shigella flexneri 2a str. 301
ccuuaauaaaauacuu

SEQ ID NO: 3934293 - RNA, 19 nt, Shigella flexneri 2a str. 301
ccuuaauaaaauacuuuua

SEQ ID NO: 3934294 - RNA, 15 nt, Shigella flexneri 2a str. 301
ccuuaaucagaauuu

SEQ ID NO: 3934295 - RNA, 22 nt, Shigella flexneri 2a str. 301
ccuuacgcagcgguauaaucug

SEQ ID NO: 3934296 - RNA, 21 nt, Shigella flexneri 2a str. 301
ccuuacgcguucauacuuuuc

SEQ ID NO: 3934297 - RNA, 18 nt, Shigella flexneri 2a str. 301
ccuuacucaguugguguc

SEQ ID NO: 3934298 - RNA, 23 nt, Shigella flexneri 2a str. 301
ccuuagcaaaauagcuguuuauu

SEQ ID NO: 3934299 - RNA, 17 nt, Shigella flexneri 2a str. 301
ccuuagcaacaggccag

SEQ ID NO: 3934300 - RNA, 17 nt, Shigella flexneri 2a str. 301
ccuuagcuaauuuuugu

SEQ ID NO: 3934301 - RNA, 23 nt, Shigella flexneri 2a str. 301
ccuuaguaacgccagcggucaua

SEQ ID NO: 3934302 - RNA, 22 nt, Shigella flexneri 2a str. 301
ccuuauccagccuacaaaaacu

SEQ ID NO: 3934303 - RNA, 19 nt, Shigella flexneri 2a str. 301
ccuuauccgacauuucugc

SEQ ID NO: 3934304 - RNA, 22 nt, Shigella flexneri 2a str. 301
ccuuauccgaccuacaaaaccu

SEQ ID NO: 3934305 - RNA, 20 nt, Shigella flexneri 2a str. 301
ccuuauccggcuuaccgcuc

SEQ ID NO: 3934306 - RNA, 13 nt, Shigella flexneri 2a str. 301
ccuucaauaucau

SEQ ID NO: 3934307 - RNA, 14 nt, Shigella flexneri 2a str. 301
ccuucacacugccu

SEQ ID NO: 3934308 - RNA, 17 nt, Shigella flexneri 2a str. 301
ccuucacaggccgccag

SEQ ID NO: 3934309 - RNA, 22 nt, Shigella flexneri 2a str. 301
ccuucacauuucccggaauaau

SEQ ID NO: 3934310 - RNA, 19 nt, Shigella flexneri 2a str. 301
ccuucacccauugccgccu

SEQ ID NO: 3934311 - RNA, 22 nt, Shigella flexneri 2a str. 301
ccuucacgaucgaagccgucag

SEQ ID NO: 3934312 - RNA, 16 nt, Shigella flexneri 2a str. 301
ccuucacuuuugccag

SEQ ID NO: 3934313 - RNA, 14 nt, Shigella flexneri 2a str. 301
ccuucagccaccag

SEQ ID NO: 3934314 - RNA, 19 nt, Shigella flexneri 2a str. 301
ccuucaggugguuagcugc

SEQ ID NO: 3934315 - RNA, 16 nt, Shigella flexneri 2a str. 301
ccuucagguuuuucag

SEQ ID NO: 3934316 - RNA, 19 nt, Shigella flexneri 2a str. 301
ccuucagucauauuucugu

SEQ ID NO: 3934317 - RNA, 23 nt, Shigella flexneri 2a str. 301
ccuucauauuccugacccagcac

SEQ ID NO: 3934318 - RNA, 19 nt, Shigella flexneri 2a str. 301
ccuucaucuucauccggcu

SEQ ID NO: 3934319 - RNA, 20 nt, Shigella flexneri 2a str. 301
ccuucauuugccagcuucag

SEQ ID NO: 3934320 - RNA, 15 nt, Shigella flexneri 2a str. 301
ccuuccacaccacuu

SEQ ID NO: 3934321 - RNA, 18 nt, Shigella flexneri 2a str. 301
ccuuccagcgcguucugu

SEQ ID NO: 3934322 - RNA, 22 nt, Shigella flexneri 2a str. 301
ccuuccaucgcaucuucgccca

SEQ ID NO: 3934323 - RNA, 12 nt, Shigella flexneri 2a str. 301
ccuucccagccg

SEQ ID NO: 3934324 - RNA, 12 nt, Shigella flexneri 2a str. 301
ccuuccccgagc

SEQ ID NO: 3934325 - RNA, 20 nt, Shigella flexneri 2a str. 301
ccuuccgcaauacagccagc

SEQ ID NO: 3934326 - RNA, 19 nt, Shigella flexneri 2a str. 301
ccuuccugaacggucgagg

SEQ ID NO: 3934327 - RNA, 18 nt, Shigella flexneri 2a str. 301
ccuuccuuagcaaaauag

SEQ ID NO: 3934328 - RNA, 16 nt, Shigella flexneri 2a str. 301
ccuuccuuauuucuug

SEQ ID NO: 3934329 - RNA, 18 nt, Shigella flexneri 2a str. 301
ccuucgaagaucagcaua

SEQ ID NO: 3934330 - RNA, 15 nt, Shigella flexneri 2a str. 301
ccuucgaaucccgca

SEQ ID NO: 3934331 - RNA, 19 nt, Shigella flexneri 2a str. 301
ccuucgaaugccgcagcac

SEQ ID NO: 3934332 - RNA, 13 nt, Shigella flexneri 2a str. 301
ccuucgccaccgu

SEQ ID NO: 3934333 - RNA, 20 nt, Shigella flexneri 2a str. 301
ccuucgcgguaaugacucca

SEQ ID NO: 3934334 - RNA, 14 nt, Shigella flexneri 2a str. 301
ccuucggauuuccg

SEQ ID NO: 3934335 - RNA, 14 nt, Shigella flexneri 2a str. 301
ccuucggccccauc

SEQ ID NO: 3934336 - RNA, 23 nt, Shigella flexneri 2a str. 301
ccuucggggcggcuaucccaaag

SEQ ID NO: 3934337 - RNA, 20 nt, Shigella flexneri 2a str. 301
ccuucgguagcagcuuucag

SEQ ID NO: 3934338 - RNA, 22 nt, Shigella flexneri 2a str. 301
ccuucgguagcagcuuucagca

SEQ ID NO: 3934339 - RNA, 14 nt, Shigella flexneri 2a str. 301
ccuucggucagagu

SEQ ID NO: 3934340 - RNA, 19 nt, Shigella flexneri 2a str. 301
ccuucugagaucaaugcgc

SEQ ID NO: 3934341 - RNA, 18 nt, Shigella flexneri 2a str. 301
ccuucugcgcccgcccgc

SEQ ID NO: 3934342 - RNA, 15 nt, Shigella flexneri 2a str. 301
ccuucuggcgacccg

SEQ ID NO: 3934343 - RNA, 14 nt, Shigella flexneri 2a str. 301
ccuucuuccugcug

SEQ ID NO: 3934344 - RNA, 13 nt, Shigella flexneri 2a str. 301
ccuucuucugccg

SEQ ID NO: 3934345 - RNA, 13 nt, Shigella flexneri 2a str. 301
ccuucuucuuuca

SEQ ID NO: 3934346 - RNA, 16 nt, Shigella flexneri 2a str. 301
ccuucuuuaugucgca

SEQ ID NO: 3934347 - RNA, 18 nt, Shigella flexneri 2a str. 301
ccuucuuugaacugaaua

SEQ ID NO: 3934348 - RNA, 23 nt, Shigella flexneri 2a str. 301
ccuugaaaucguuugcauccagc

SEQ ID NO: 3934349 - RNA, 13 nt, Shigella flexneri 2a str. 301
ccuugaguuucgu

SEQ ID NO: 3934350 - RNA, 18 nt, Shigella flexneri 2a str. 301
ccuugauaaacgccgcca

SEQ ID NO: 3934351 - RNA, 16 nt, Shigella flexneri 2a str. 301
ccuugauauaaauccc

SEQ ID NO: 3934352 - RNA, 14 nt, Shigella flexneri 2a str. 301
ccuugaugaaaaaa

SEQ ID NO: 3934353 - RNA, 18 nt, Shigella flexneri 2a str. 301
ccuugauuauuucccucg

SEQ ID NO: 3934354 - RNA, 13 nt, Shigella flexneri 2a str. 301
ccuugcaacuccg

SEQ ID NO: 3934355 - RNA, 15 nt, Shigella flexneri 2a str. 301
ccuugcacucgcaga

SEQ ID NO: 3934356 - RNA, 16 nt, Shigella flexneri 2a str. 301
ccuugccagauguugu

SEQ ID NO: 3934357 - RNA, 21 nt, Shigella flexneri 2a str. 301
ccuugcgcgcagugccggugg

SEQ ID NO: 3934358 - RNA, 17 nt, Shigella flexneri 2a str. 301
ccuugcggaaauuccag

SEQ ID NO: 3934359 - RNA, 20 nt, Shigella flexneri 2a str. 301
ccuugcggaaauuccagcgg

SEQ ID NO: 3934360 - RNA, 21 nt, Shigella flexneri 2a str. 301
ccuugcggaaauuccagcggc

SEQ ID NO: 3934361 - RNA, 23 nt, Shigella flexneri 2a str. 301
ccuugcggcuuaacugucgcuga

SEQ ID NO: 3934362 - RNA, 19 nt, Shigella flexneri 2a str. 301
ccuugcucauccauugcuu

SEQ ID NO: 3934363 - RNA, 18 nt, Shigella flexneri 2a str. 301
ccuugcugacuccccgau

SEQ ID NO: 3934364 - RNA, 13 nt, Shigella flexneri 2a str. 301
ccuugcuucgcca

SEQ ID NO: 3934365 - RNA, 22 nt, Shigella flexneri 2a str. 301
ccuugucaucgucggccuuaau

SEQ ID NO: 3934366 - RNA, 18 nt, Shigella flexneri 2a str. 301
ccuugucaugcagcucca

SEQ ID NO: 3934367 - RNA, 19 nt, Shigella flexneri 2a str. 301
ccuugucaugcagcuccac

SEQ ID NO: 3934368 - RNA, 15 nt, Shigella flexneri 2a str. 301
ccuugugcacgcgcu

SEQ ID NO: 3934369 - RNA, 18 nt, Shigella flexneri 2a str. 301
ccuuguuguaaugacaac

SEQ ID NO: 3934370 - RNA, 11 nt, Shigella flexneri 2a str. 301
ccuuguuucuu

SEQ ID NO: 3934371 - RNA, 13 nt, Shigella flexneri 2a str. 301
ccuuuaacgaagc

SEQ ID NO: 3934372 - RNA, 11 nt, Shigella flexneri 2a str. 301
ccuuuaccaga

SEQ ID NO: 3934373 - RNA, 14 nt, Shigella flexneri 2a str. 301
ccuuuaccaugcuu

SEQ ID NO: 3934374 - RNA, 19 nt, Shigella flexneri 2a str. 301
ccuuuacggcgcgucagau

SEQ ID NO: 3934375 - RNA, 23 nt, Shigella flexneri 2a str. 301
ccuuuaucgaaguacuccugcuc

SEQ ID NO: 3934376 - RNA, 18 nt, Shigella flexneri 2a str. 301
ccuuuaucgcgcagcaga

SEQ ID NO: 3934377 - RNA, 12 nt, Shigella flexneri 2a str. 301
ccuuuauuuucu

SEQ ID NO: 3934378 - RNA, 23 nt, Shigella flexneri 2a str. 301
ccuuucacgccgggaaauuuuuc

SEQ ID NO: 3934379 - RNA, 20 nt, Shigella flexneri 2a str. 301
ccuuucagaguuguaccagc

SEQ ID NO: 3934380 - RNA, 21 nt, Shigella flexneri 2a str. 301
ccuuucagauguuccgccauu

SEQ ID NO: 3934381 - RNA, 22 nt, Shigella flexneri 2a str. 301
ccuuucaugguugucaccgcca

SEQ ID NO: 3934382 - RNA, 18 nt, Shigella flexneri 2a str. 301
ccuuuccagucuucuugc

SEQ ID NO: 3934383 - RNA, 17 nt, Shigella flexneri 2a str. 301
ccuuuccccucuaccgc

SEQ ID NO: 3934384 - RNA, 16 nt, Shigella flexneri 2a str. 301
ccuuucccuauuuuuu

SEQ ID NO: 3934385 - RNA, 12 nt, Shigella flexneri 2a str. 301
ccuuuccuccug

SEQ ID NO: 3934386 - RNA, 13 nt, Shigella flexneri 2a str. 301
ccuuuccugacuc

SEQ ID NO: 3934387 - RNA, 14 nt, Shigella flexneri 2a str. 301
ccuuuccugacuca

SEQ ID NO: 3934388 - RNA, 13 nt, Shigella flexneri 2a str. 301
ccuuucggccaug

SEQ ID NO: 3934389 - RNA, 13 nt, Shigella flexneri 2a str. 301
ccuuucugcaucc

SEQ ID NO: 3934390 - RNA, 21 nt, Shigella flexneri 2a str. 301
ccuuugaaaauaacaucgcca

SEQ ID NO: 3934391 - RNA, 16 nt, Shigella flexneri 2a str. 301
ccuuugaacaaccaga

SEQ ID NO: 3934392 - RNA, 21 nt, Shigella flexneri 2a str. 301
ccuuugaccagccagucagua

SEQ ID NO: 3934393 - RNA, 15 nt, Shigella flexneri 2a str. 301
ccuuugccuuccagc

SEQ ID NO: 3934394 - RNA, 17 nt, Shigella flexneri 2a str. 301
ccuuugccuuccagcga

SEQ ID NO: 3934395 - RNA, 15 nt, Shigella flexneri 2a str. 301
ccuuugcuggcauga

SEQ ID NO: 3934396 - RNA, 22 nt, Shigella flexneri 2a str. 301
ccuuuguaggccagauaagacg

SEQ ID NO: 3934397 - RNA, 15 nt, Shigella flexneri 2a str. 301
ccuuuuauuuaaccg

SEQ ID NO: 3934398 - RNA, 24 nt, Shigella flexneri 2a str. 301
ccuuuucgccaccggcaaucugcu

SEQ ID NO: 3934399 - RNA, 23 nt, Shigella flexneri 2a str. 301
ccuuuuggcaaagguucaagcag

SEQ ID NO: 3934400 - RNA, 18 nt, Shigella flexneri 2a str. 301
ccuuuuucucugguccaa

SEQ ID NO: 3934401 - RNA, 17 nt, Shigella flexneri 2a str. 301
ccuuuuuuacagguguu

SEQ ID NO: 3934402 - RNA, 20 nt, Shigella flexneri 2a str. 301
ccuuuuuugcggcuacacua

SEQ ID NO: 3934403 - RNA, 14 nt, Shigella flexneri 2a str. 301
cgaaaaaaaagaag

SEQ ID NO: 3934404 - RNA, 19 nt, Shigella flexneri 2a str. 301
cgaaaaaaaagaagaccug

SEQ ID NO: 3934405 - RNA, 13 nt, Shigella flexneri 2a str. 301
cgaaaaaaaagau

SEQ ID NO: 3934406 - RNA, 14 nt, Shigella flexneri 2a str. 301
cgaaaaaaauuacu

SEQ ID NO: 3934407 - RNA, 17 nt, Shigella flexneri 2a str. 301
cgaaaaaaauuacucau

SEQ ID NO: 3934408 - RNA, 23 nt, Shigella flexneri 2a str. 301
cgaaaaagaaucgauuaucuucg

SEQ ID NO: 3934409 - RNA, 20 nt, Shigella flexneri 2a str. 301
cgaaaaagucccuucccagc

SEQ ID NO: 3934410 - RNA, 18 nt, Shigella flexneri 2a str. 301
cgaaaaccacuccugacg

SEQ ID NO: 3934411 - RNA, 18 nt, Shigella flexneri 2a str. 301
cgaaaaucaccgcgacca

SEQ ID NO: 3934412 - RNA, 23 nt, Shigella flexneri 2a str. 301
cgaaaaugcccgccgugcugcca

SEQ ID NO: 3934413 - RNA, 15 nt, Shigella flexneri 2a str. 301
cgaaaaugcgcauga

SEQ ID NO: 3934414 - RNA, 16 nt, Shigella flexneri 2a str. 301
cgaaacauacaggcua

SEQ ID NO: 3934415 - RNA, 16 nt, Shigella flexneri 2a str. 301
cgaaacaucaaaaagc

SEQ ID NO: 3934416 - RNA, 13 nt, Shigella flexneri 2a str. 301
cgaaaccacugca

SEQ ID NO: 3934417 - RNA, 16 nt, Shigella flexneri 2a str. 301
cgaaaccgacugccau

SEQ ID NO: 3934418 - RNA, 21 nt, Shigella flexneri 2a str. 301
cgaaaccgcgcgcgcuagcgu

SEQ ID NO: 3934419 - RNA, 19 nt, Shigella flexneri 2a str. 301
cgaaaccggauacccugcc

SEQ ID NO: 3934420 - RNA, 18 nt, Shigella flexneri 2a str. 301
cgaaaccguggcggaaau

SEQ ID NO: 3934421 - RNA, 19 nt, Shigella flexneri 2a str. 301
cgaaacgaaagucccgaua

SEQ ID NO: 3934422 - RNA, 14 nt, Shigella flexneri 2a str. 301
cgaaacgauuaauu

SEQ ID NO: 3934423 - RNA, 17 nt, Shigella flexneri 2a str. 301
cgaaacguuccagcgcg

SEQ ID NO: 3934424 - RNA, 11 nt, Shigella flexneri 2a str. 301
cgaaagaaaag

SEQ ID NO: 3934425 - RNA, 17 nt, Shigella flexneri 2a str. 301
cgaaagaggcgcagaug

SEQ ID NO: 3934426 - RNA, 16 nt, Shigella flexneri 2a str. 301
cgaaagcagggcggca

SEQ ID NO: 3934427 - RNA, 13 nt, Shigella flexneri 2a str. 301
cgaaagcccauca

SEQ ID NO: 3934428 - RNA, 13 nt, Shigella flexneri 2a str. 301
cgaaagccccagc

SEQ ID NO: 3934429 - RNA, 19 nt, Shigella flexneri 2a str. 301
cgaaagcuggcacugggau

SEQ ID NO: 3934430 - RNA, 16 nt, Shigella flexneri 2a str. 301
cgaaauaacugcuauu

SEQ ID NO: 3934431 - RNA, 17 nt, Shigella flexneri 2a str. 301
cgaaaugagauauuuca

SEQ ID NO: 3934432 - RNA, 17 nt, Shigella flexneri 2a str. 301
cgaaauggccauccauu

SEQ ID NO: 3934433 - RNA, 20 nt, Shigella flexneri 2a str. 301
cgaaauggcugccaaugaua

SEQ ID NO: 3934434 - RNA, 23 nt, Shigella flexneri 2a str. 301
cgaaauggugugcaugguguuca

SEQ ID NO: 3934435 - RNA, 14 nt, Shigella flexneri 2a str. 301
cgaacaacagauca

SEQ ID NO: 3934436 - RNA, 13 nt, Shigella flexneri 2a str. 301
cgaacaccagcag

SEQ ID NO: 3934437 - RNA, 14 nt, Shigella flexneri 2a str. 301
cgaacaccagcagu

SEQ ID NO: 3934438 - RNA, 15 nt, Shigella flexneri 2a str. 301
cgaacaccagcagua

SEQ ID NO: 3934439 - RNA, 18 nt, Shigella flexneri 2a str. 301
cgaacagacaaaaagaau

SEQ ID NO: 3934440 - RNA, 14 nt, Shigella flexneri 2a str. 301
cgaacagcacaacg

SEQ ID NO: 3934441 - RNA, 14 nt, Shigella flexneri 2a str. 301
cgaacagcacauca

SEQ ID NO: 3934442 - RNA, 15 nt, Shigella flexneri 2a str. 301
cgaacagcugguuga

SEQ ID NO: 3934443 - RNA, 18 nt, Shigella flexneri 2a str. 301
cgaacaggccgacuggca

SEQ ID NO: 3934444 - RNA, 15 nt, Shigella flexneri 2a str. 301
cgaacauccagcagc

SEQ ID NO: 3934445 - RNA, 13 nt, Shigella flexneri 2a str. 301
cgaacauccggcu

SEQ ID NO: 3934446 - RNA, 14 nt, Shigella flexneri 2a str. 301
cgaacaugcggguc

SEQ ID NO: 3934447 - RNA, 15 nt, Shigella flexneri 2a str. 301
cgaaccaaacagcgc

SEQ ID NO: 3934448 - RNA, 24 nt, Shigella flexneri 2a str. 301
cgaaccagccguugucagucauca

SEQ ID NO: 3934449 - RNA, 13 nt, Shigella flexneri 2a str. 301
cgaaccaggaaga

SEQ ID NO: 3934450 - RNA, 16 nt, Shigella flexneri 2a str. 301
cgaaccaggaagaugu

SEQ ID NO: 3934451 - RNA, 13 nt, Shigella flexneri 2a str. 301
cgaaccagugcuc

SEQ ID NO: 3934452 - RNA, 17 nt, Shigella flexneri 2a str. 301
cgaaccagugcuccacc

SEQ ID NO: 3934453 - RNA, 15 nt, Shigella flexneri 2a str. 301
cgaaccauaaaauca

SEQ ID NO: 3934454 - RNA, 13 nt, Shigella flexneri 2a str. 301
cgaacccagcagg

SEQ ID NO: 3934455 - RNA, 14 nt, Shigella flexneri 2a str. 301
cgaacccagcaggu

SEQ ID NO: 3934456 - RNA, 21 nt, Shigella flexneri 2a str. 301
cgaaccgccuggcgcugcuca

SEQ ID NO: 3934457 - RNA, 22 nt, Shigella flexneri 2a str. 301
cgaaccggaaauccaggucagc

SEQ ID NO: 3934458 - RNA, 22 nt, Shigella flexneri 2a str. 301
cgaaccguugaggauggcgucg

SEQ ID NO: 3934459 - RNA, 15 nt, Shigella flexneri 2a str. 301
cgaaccuucgaaguc

SEQ ID NO: 3934460 - RNA, 17 nt, Shigella flexneri 2a str. 301
cgaaccuuggucgaagc

SEQ ID NO: 3934461 - RNA, 16 nt, Shigella flexneri 2a str. 301
cgaacgcgcacaggcg

SEQ ID NO: 3934462 - RNA, 18 nt, Shigella flexneri 2a str. 301
cgaacgcguucacugccg

SEQ ID NO: 3934463 - RNA, 14 nt, Shigella flexneri 2a str. 301
cgaacgcugcacgc

SEQ ID NO: 3934464 - RNA, 16 nt, Shigella flexneri 2a str. 301
cgaacggguaaggaac

SEQ ID NO: 3934465 - RNA, 15 nt, Shigella flexneri 2a str. 301
cgaacguacgcaauc

SEQ ID NO: 3934466 - RNA, 17 nt, Shigella flexneri 2a str. 301
cgaacguuuaauaaaac

SEQ ID NO: 3934467 - RNA, 19 nt, Shigella flexneri 2a str. 301
cgaacucauacaccagcgg

SEQ ID NO: 3934468 - RNA, 22 nt, Shigella flexneri 2a str. 301
cgaacucauacaccagcggcac

SEQ ID NO: 3934469 - RNA, 17 nt, Shigella flexneri 2a str. 301
cgaacuccgaucccugc

SEQ ID NO: 3934470 - RNA, 21 nt, Shigella flexneri 2a str. 301
cgaacugucgguuuguacucu

SEQ ID NO: 3934471 - RNA, 17 nt, Shigella flexneri 2a str. 301
cgaagaaagcgggugaa

SEQ ID NO: 3934472 - RNA, 20 nt, Shigella flexneri 2a str. 301
cgaagaaauagaaacuggcc

SEQ ID NO: 3934473 - RNA, 22 nt, Shigella flexneri 2a str. 301
cgaagaagugguucauguugcg

SEQ ID NO: 3934474 - RNA, 22 nt, Shigella flexneri 2a str. 301
cgaagacaaauuguuuaaucaa

SEQ ID NO: 3934475 - RNA, 17 nt, Shigella flexneri 2a str. 301
cgaagagaucgauguuu

SEQ ID NO: 3934476 - RNA, 11 nt, Shigella flexneri 2a str. 301
cgaagaggggg

SEQ ID NO: 3934477 - RNA, 18 nt, Shigella flexneri 2a str. 301
cgaagauauucaucagcg

SEQ ID NO: 3934478 - RNA, 15 nt, Shigella flexneri 2a str. 301
cgaagaucucgguaa

SEQ ID NO: 3934479 - RNA, 17 nt, Shigella flexneri 2a str. 301
cgaagaucucgguaacg

SEQ ID NO: 3934480 - RNA, 18 nt, Shigella flexneri 2a str. 301
cgaagauuucguuuucua

SEQ ID NO: 3934481 - RNA, 14 nt, Shigella flexneri 2a str. 301
cgaagcaagcggag

SEQ ID NO: 3934482 - RNA, 18 nt, Shigella flexneri 2a str. 301
cgaagcauucagacacgc

SEQ ID NO: 3934483 - RNA, 23 nt, Shigella flexneri 2a str. 301
cgaagcauucagacacgccgcca

SEQ ID NO: 3934484 - RNA, 14 nt, Shigella flexneri 2a str. 301
cgaagcauugcgcc

SEQ ID NO: 3934485 - RNA, 23 nt, Shigella flexneri 2a str. 301
cgaagccauaucguucugccaga

SEQ ID NO: 3934486 - RNA, 21 nt, Shigella flexneri 2a str. 301
cgaagcccaucaguacaccac

SEQ ID NO: 3934487 - RNA, 23 nt, Shigella flexneri 2a str. 301
cgaagcccucaaacaacacagcg

SEQ ID NO: 3934488 - RNA, 12 nt, Shigella flexneri 2a str. 301
cgaagccgcauc

SEQ ID NO: 3934489 - RNA, 16 nt, Shigella flexneri 2a str. 301
cgaagccggacugggc

SEQ ID NO: 3934490 - RNA, 19 nt, Shigella flexneri 2a str. 301
cgaagcucuguauauaaau

SEQ ID NO: 3934491 - RNA, 19 nt, Shigella flexneri 2a str. 301
cgaaggaauuuuacagccc

SEQ ID NO: 3934492 - RNA, 13 nt, Shigella flexneri 2a str. 301
cgaaggugcauug

SEQ ID NO: 3934493 - RNA, 15 nt, Shigella flexneri 2a str. 301
cgaagguggcggaau

SEQ ID NO: 3934494 - RNA, 21 nt, Shigella flexneri 2a str. 301
cgaagguggcggaauugguag

SEQ ID NO: 3934495 - RNA, 21 nt, Shigella flexneri 2a str. 301
cgaaguauggaaaucacccag

SEQ ID NO: 3934496 - RNA, 23 nt, Shigella flexneri 2a str. 301
cgaagucgaugacggcagauuua

SEQ ID NO: 3934497 - RNA, 18 nt, Shigella flexneri 2a str. 301
cgaagucguucagaucuu

SEQ ID NO: 3934498 - RNA, 12 nt, Shigella flexneri 2a str. 301
cgaagugccagu

SEQ ID NO: 3934499 - RNA, 20 nt, Shigella flexneri 2a str. 301
cgaaguuguagcuggcuucg

SEQ ID NO: 3934500 - RNA, 16 nt, Shigella flexneri 2a str. 301
cgaaguuuuccucagu

SEQ ID NO: 3934501 - RNA, 15 nt, Shigella flexneri 2a str. 301
cgaauaagcugcgug

SEQ ID NO: 3934502 - RNA, 17 nt, Shigella flexneri 2a str. 301
cgaauaccguaacgacu

SEQ ID NO: 3934503 - RNA, 13 nt, Shigella flexneri 2a str. 301
cgaauaccuucuu

SEQ ID NO: 3934504 - RNA, 22 nt, Shigella flexneri 2a str. 301
cgaauacuccccuuucuuauuu

SEQ ID NO: 3934505 - RNA, 16 nt, Shigella flexneri 2a str. 301
cgaauauguuuuugca

SEQ ID NO: 3934506 - RNA, 23 nt, Shigella flexneri 2a str. 301
cgaauauucugaagcaaacuuga

SEQ ID NO: 3934507 - RNA, 18 nt, Shigella flexneri 2a str. 301
cgaaucagauucacggua

SEQ ID NO: 3934508 - RNA, 17 nt, Shigella flexneri 2a str. 301
cgaaucgcuucauuuac

SEQ ID NO: 3934509 - RNA, 16 nt, Shigella flexneri 2a str. 301
cgaaucugauuagccu

SEQ ID NO: 3934510 - RNA, 23 nt, Shigella flexneri 2a str. 301
cgaaugaaagaagcuuuccacgc

SEQ ID NO: 3934511 - RNA, 13 nt, Shigella flexneri 2a str. 301
cgaaugacaugcc

SEQ ID NO: 3934512 - RNA, 20 nt, Shigella flexneri 2a str. 301
cgaaugacccgagccacguc

SEQ ID NO: 3934513 - RNA, 17 nt, Shigella flexneri 2a str. 301
cgaaugaccgccccugc

SEQ ID NO: 3934514 - RNA, 21 nt, Shigella flexneri 2a str. 301
cgaauggaaagcccgccccgc

SEQ ID NO: 3934515 - RNA, 22 nt, Shigella flexneri 2a str. 301
cgaauggcaucuacgcucucuu

SEQ ID NO: 3934516 - RNA, 17 nt, Shigella flexneri 2a str. 301
cgaauggguucgauuuc

SEQ ID NO: 3934517 - RNA, 16 nt, Shigella flexneri 2a str. 301
cgaaugucguuuccau

SEQ ID NO: 3934518 - RNA, 22 nt, Shigella flexneri 2a str. 301
cgaauguggcagcaacuggcga

SEQ ID NO: 3934519 - RNA, 15 nt, Shigella flexneri 2a str. 301
cgaauuagcauggcu

SEQ ID NO: 3934520 - RNA, 21 nt, Shigella flexneri 2a str. 301
cgaauuauaauuccuucacgu

SEQ ID NO: 3934521 - RNA, 16 nt, Shigella flexneri 2a str. 301
cgaauucuaucaugca

SEQ ID NO: 3934522 - RNA, 14 nt, Shigella flexneri 2a str. 301
cgaauucuggcuga

SEQ ID NO: 3934523 - RNA, 24 nt, Shigella flexneri 2a str. 301
cgaauuucauccuguacgacaaaa

SEQ ID NO: 3934524 - RNA, 22 nt, Shigella flexneri 2a str. 301
cgaauuuuccaugaccugccag

SEQ ID NO: 3934525 - RNA, 23 nt, Shigella flexneri 2a str. 301
cgaauuuuccaugaccugccagg

SEQ ID NO: 3934526 - RNA, 20 nt, Shigella flexneri 2a str. 301
cgacaaaaauaccaccaaug

SEQ ID NO: 3934527 - RNA, 16 nt, Shigella flexneri 2a str. 301
cgacaaaaauuacugc

SEQ ID NO: 3934528 - RNA, 22 nt, Shigella flexneri 2a str. 301
cgacaaaaucggaaacaaauac

SEQ ID NO: 3934529 - RNA, 18 nt, Shigella flexneri 2a str. 301
cgacaaacuccgcgacca

SEQ ID NO: 3934530 - RNA, 23 nt, Shigella flexneri 2a str. 301
cgacaaauaccaccgugccgccg

SEQ ID NO: 3934531 - RNA, 17 nt, Shigella flexneri 2a str. 301
cgacaaaugcgccgcca

SEQ ID NO: 3934532 - RNA, 14 nt, Shigella flexneri 2a str. 301
cgacaaauguugca

SEQ ID NO: 3934533 - RNA, 22 nt, Shigella flexneri 2a str. 301
cgacaaauuucaucgcuacacc

SEQ ID NO: 3934534 - RNA, 23 nt, Shigella flexneri 2a str. 301
cgacaacagaaauaaucgcaauu

SEQ ID NO: 3934535 - RNA, 19 nt, Shigella flexneri 2a str. 301
cgacaaccugaccuuuuuu

SEQ ID NO: 3934536 - RNA, 18 nt, Shigella flexneri 2a str. 301
cgacaacugacgaaucaa

SEQ ID NO: 3934537 - RNA, 17 nt, Shigella flexneri 2a str. 301
cgacaacuggcagcacc

SEQ ID NO: 3934538 - RNA, 18 nt, Shigella flexneri 2a str. 301
cgacaacuggcagcaccg

SEQ ID NO: 3934539 - RNA, 18 nt, Shigella flexneri 2a str. 301
cgacaauaaucaccacac

SEQ ID NO: 3934540 - RNA, 17 nt, Shigella flexneri 2a str. 301
cgacaauaugcucucca

SEQ ID NO: 3934541 - RNA, 14 nt, Shigella flexneri 2a str. 301
cgacaauauugaug

SEQ ID NO: 3934542 - RNA, 19 nt, Shigella flexneri 2a str. 301
cgacaauccgguagguuca

SEQ ID NO: 3934543 - RNA, 16 nt, Shigella flexneri 2a str. 301
cgacaaucgcaaauau

SEQ ID NO: 3934544 - RNA, 21 nt, Shigella flexneri 2a str. 301
cgacaaucucaauuuucacuu

SEQ ID NO: 3934545 - RNA, 13 nt, Shigella flexneri 2a str. 301
cgacaaugccaca

SEQ ID NO: 3934546 - RNA, 13 nt, Shigella flexneri 2a str. 301
cgacaauucgcgu

SEQ ID NO: 3934547 - RNA, 23 nt, Shigella flexneri 2a str. 301
cgacaauucgcguaguaaagccu

SEQ ID NO: 3934548 - RNA, 16 nt, Shigella flexneri 2a str. 301
cgacacaaccaccguu

SEQ ID NO: 3934549 - RNA, 13 nt, Shigella flexneri 2a str. 301
cgacacaacgcuu

SEQ ID NO: 3934550 - RNA, 14 nt, Shigella flexneri 2a str. 301
cgacaccagccauc

SEQ ID NO: 3934551 - RNA, 11 nt, Shigella flexneri 2a str. 301
cgacaccgccu

SEQ ID NO: 3934552 - RNA, 16 nt, Shigella flexneri 2a str. 301
cgacacugcucgcaga

SEQ ID NO: 3934553 - RNA, 21 nt, Shigella flexneri 2a str. 301
cgacagaacggauaucgagaa

SEQ ID NO: 3934554 - RNA, 16 nt, Shigella flexneri 2a str. 301
cgacagacgacgacgc

SEQ ID NO: 3934555 - RNA, 14 nt, Shigella flexneri 2a str. 301
cgacagaugcucgc

SEQ ID NO: 3934556 - RNA, 20 nt, Shigella flexneri 2a str. 301
cgacagauucaggcgcagca

SEQ ID NO: 3934557 - RNA, 18 nt, Shigella flexneri 2a str. 301
cgacagcaaauugcgcca

SEQ ID NO: 3934558 - RNA, 14 nt, Shigella flexneri 2a str. 301
cgacagcagccccg

SEQ ID NO: 3934559 - RNA, 23 nt, Shigella flexneri 2a str. 301
cgacagccauaaagaaaucaccu

SEQ ID NO: 3934560 - RNA, 18 nt, Shigella flexneri 2a str. 301
cgacagcgaaaucccuuc

SEQ ID NO: 3934561 - RNA, 17 nt, Shigella flexneri 2a str. 301
cgacagcgauuccaguu

SEQ ID NO: 3934562 - RNA, 21 nt, Shigella flexneri 2a str. 301
cgacagcguguuaaugcccau

SEQ ID NO: 3934563 - RNA, 19 nt, Shigella flexneri 2a str. 301
cgacagcguuucgccaccc

SEQ ID NO: 3934564 - RNA, 17 nt, Shigella flexneri 2a str. 301
cgacagggaucucuucc

SEQ ID NO: 3934565 - RNA, 18 nt, Shigella flexneri 2a str. 301
cgacagggaucucuucca

SEQ ID NO: 3934566 - RNA, 22 nt, Shigella flexneri 2a str. 301
cgacagggaucucuuccagugc

SEQ ID NO: 3934567 - RNA, 16 nt, Shigella flexneri 2a str. 301
cgacagugacuuccgu

SEQ ID NO: 3934568 - RNA, 20 nt, Shigella flexneri 2a str. 301
cgacagugacuuccguacca

SEQ ID NO: 3934569 - RNA, 23 nt, Shigella flexneri 2a str. 301
cgacaguugcugcgugaccgcca

SEQ ID NO: 3934570 - RNA, 16 nt, Shigella flexneri 2a str. 301
cgacaguuucaccugc

SEQ ID NO: 3934571 - RNA, 17 nt, Shigella flexneri 2a str. 301
cgacaguuucaccugcu

SEQ ID NO: 3934572 - RNA, 20 nt, Shigella flexneri 2a str. 301
cgacaguuucaccugcugau

SEQ ID NO: 3934573 - RNA, 21 nt, Shigella flexneri 2a str. 301
cgacauacaccgcagccgcca

SEQ ID NO: 3934574 - RNA, 23 nt, Shigella flexneri 2a str. 301
cgacauacucagcgccugcugca

SEQ ID NO: 3934575 - RNA, 14 nt, Shigella flexneri 2a str. 301
cgacauagccaucc

SEQ ID NO: 3934576 - RNA, 16 nt, Shigella flexneri 2a str. 301
cgacauaggccagccg

SEQ ID NO: 3934577 - RNA, 15 nt, Shigella flexneri 2a str. 301
cgacauauucaccau

SEQ ID NO: 3934578 - RNA, 15 nt, Shigella flexneri 2a str. 301
cgacaucugucagug

SEQ ID NO: 3934579 - RNA, 23 nt, Shigella flexneri 2a str. 301
cgacaucuuucugcgcaucuucc

SEQ ID NO: 3934580 - RNA, 16 nt, Shigella flexneri 2a str. 301
cgacaugcaucacgcg

SEQ ID NO: 3934581 - RNA, 12 nt, Shigella flexneri 2a str. 301
cgacauggcaac

SEQ ID NO: 3934582 - RNA, 19 nt, Shigella flexneri 2a str. 301
cgacauggcaauagcuucu

SEQ ID NO: 3934583 - RNA, 16 nt, Shigella flexneri 2a str. 301
cgacauugaccagcca

SEQ ID NO: 3934584 - RNA, 18 nt, Shigella flexneri 2a str. 301
cgacauugauguuuucag

SEQ ID NO: 3934585 - RNA, 14 nt, Shigella flexneri 2a str. 301
cgacauuuccuggc

SEQ ID NO: 3934586 - RNA, 16 nt, Shigella flexneri 2a str. 301
cgacauuuccuggcga

SEQ ID NO: 3934587 - RNA, 23 nt, Shigella flexneri 2a str. 301
cgacauuuccuggcgaacaucca

SEQ ID NO: 3934588 - RNA, 14 nt, Shigella flexneri 2a str. 301
cgaccaaaugaaac

SEQ ID NO: 3934589 - RNA, 12 nt, Shigella flexneri 2a str. 301
cgaccaaugaca

SEQ ID NO: 3934590 - RNA, 13 nt, Shigella flexneri 2a str. 301
cgaccaccaccgc

SEQ ID NO: 3934591 - RNA, 12 nt, Shigella flexneri 2a str. 301
cgaccaccagcg

SEQ ID NO: 3934592 - RNA, 13 nt, Shigella flexneri 2a str. 301
cgaccaccagcgu

SEQ ID NO: 3934593 - RNA, 17 nt, Shigella flexneri 2a str. 301
cgaccacccaccgcagc

SEQ ID NO: 3934594 - RNA, 15 nt, Shigella flexneri 2a str. 301
cgaccacucuuucga

SEQ ID NO: 3934595 - RNA, 12 nt, Shigella flexneri 2a str. 301
cgaccacuucau

SEQ ID NO: 3934596 - RNA, 13 nt, Shigella flexneri 2a str. 301
cgaccacuucaug

SEQ ID NO: 3934597 - RNA, 12 nt, Shigella flexneri 2a str. 301
cgaccagaaaug

SEQ ID NO: 3934598 - RNA, 14 nt, Shigella flexneri 2a str. 301
cgaccagaccaggc

SEQ ID NO: 3934599 - RNA, 21 nt, Shigella flexneri 2a str. 301
cgaccagauaagaacugacuu

SEQ ID NO: 3934600 - RNA, 21 nt, Shigella flexneri 2a str. 301
cgaccagaucggucagugcca

SEQ ID NO: 3934601 - RNA, 22 nt, Shigella flexneri 2a str. 301
cgaccagcggaauucccgcuuc

SEQ ID NO: 3934602 - RNA, 17 nt, Shigella flexneri 2a str. 301
cgaccaggcaaaccagu

SEQ ID NO: 3934603 - RNA, 15 nt, Shigella flexneri 2a str. 301
cgaccauacagcagc

SEQ ID NO: 3934604 - RNA, 19 nt, Shigella flexneri 2a str. 301
cgaccaucggcaccaccaa

SEQ ID NO: 3934605 - RNA, 19 nt, Shigella flexneri 2a str. 301
cgacccagccagacgccag

SEQ ID NO: 3934606 - RNA, 17 nt, Shigella flexneri 2a str. 301
cgaccccaggccgcgua

SEQ ID NO: 3934607 - RNA, 15 nt, Shigella flexneri 2a str. 301
cgaccgaacagauca

SEQ ID NO: 3934608 - RNA, 12 nt, Shigella flexneri 2a str. 301
cgaccgcagcau

SEQ ID NO: 3934609 - RNA, 17 nt, Shigella flexneri 2a str. 301
cgaccgccauuaaacgc

SEQ ID NO: 3934610 - RNA, 21 nt, Shigella flexneri 2a str. 301
cgaccggccauuccagcaccc

SEQ ID NO: 3934611 - RNA, 20 nt, Shigella flexneri 2a str. 301
cgaccguuccauucaaacgu

SEQ ID NO: 3934612 - RNA, 18 nt, Shigella flexneri 2a str. 301
cgaccuacgcgcccgcgc

SEQ ID NO: 3934613 - RNA, 22 nt, Shigella flexneri 2a str. 301
cgaccucaaaggccgacagcag

SEQ ID NO: 3934614 - RNA, 21 nt, Shigella flexneri 2a str. 301
cgaccucaagcucgccaccau

SEQ ID NO: 3934615 - RNA, 12 nt, Shigella flexneri 2a str. 301
cgaccugauuuu

SEQ ID NO: 3934616 - RNA, 18 nt, Shigella flexneri 2a str. 301
cgaccugcgccugcacca

SEQ ID NO: 3934617 - RNA, 20 nt, Shigella flexneri 2a str. 301
cgaccuucgcggucagcgcc

SEQ ID NO: 3934618 - RNA, 22 nt, Shigella flexneri 2a str. 301
cgaccuucgcggucagcgccuc

SEQ ID NO: 3934619 - RNA, 15 nt, Shigella flexneri 2a str. 301
cgaccuugcaauaau

SEQ ID NO: 3934620 - RNA, 15 nt, Shigella flexneri 2a str. 301
cgacgaacaccaacc

SEQ ID NO: 3934621 - RNA, 13 nt, Shigella flexneri 2a str. 301
cgacgacgcgcgc

SEQ ID NO: 3934622 - RNA, 14 nt, Shigella flexneri 2a str. 301
cgacgacgcgcgcg

SEQ ID NO: 3934623 - RNA, 11 nt, Shigella flexneri 2a str. 301
cgacgauaacc

SEQ ID NO: 3934624 - RNA, 15 nt, Shigella flexneri 2a str. 301
cgacgcauacgaucc

SEQ ID NO: 3934625 - RNA, 16 nt, Shigella flexneri 2a str. 301
cgacgcauacgauccu

SEQ ID NO: 3934626 - RNA, 14 nt, Shigella flexneri 2a str. 301
cgacgccaagaaag

SEQ ID NO: 3934627 - RNA, 15 nt, Shigella flexneri 2a str. 301
cgacgcgccagcacc

SEQ ID NO: 3934628 - RNA, 21 nt, Shigella flexneri 2a str. 301
cgacgcgcgcgggucaccgcg

SEQ ID NO: 3934629 - RNA, 19 nt, Shigella flexneri 2a str. 301
cgacgcguccaggcucgcc

SEQ ID NO: 3934630 - RNA, 17 nt, Shigella flexneri 2a str. 301
cgacgcugaugucagca

SEQ ID NO: 3934631 - RNA, 16 nt, Shigella flexneri 2a str. 301
cgacggcaccacauuc

SEQ ID NO: 3934632 - RNA, 15 nt, Shigella flexneri 2a str. 301
cgacggcaucgccau

SEQ ID NO: 3934633 - RNA, 22 nt, Shigella flexneri 2a str. 301
cgacggcgggugacuucccgca

SEQ ID NO: 3934634 - RNA, 21 nt, Shigella flexneri 2a str. 301
cgacggcuggacaaaauacug

SEQ ID NO: 3934635 - RNA, 14 nt, Shigella flexneri 2a str. 301
cgacggcuggcaaa

SEQ ID NO: 3934636 - RNA, 18 nt, Shigella flexneri 2a str. 301
cgacguccaaucagcaca

SEQ ID NO: 3934637 - RNA, 19 nt, Shigella flexneri 2a str. 301
cgacgucgauuucugggug

SEQ ID NO: 3934638 - RNA, 16 nt, Shigella flexneri 2a str. 301
cgacgugcagcaucga

SEQ ID NO: 3934639 - RNA, 13 nt, Shigella flexneri 2a str. 301
cgacgugcgggcg

SEQ ID NO: 3934640 - RNA, 21 nt, Shigella flexneri 2a str. 301
cgacguucaggcgaaugcguu

SEQ ID NO: 3934641 - RNA, 21 nt, Shigella flexneri 2a str. 301
cgacuaauacaccaucaugga

SEQ ID NO: 3934642 - RNA, 13 nt, Shigella flexneri 2a str. 301
cgacuacccgcgc

SEQ ID NO: 3934643 - RNA, 14 nt, Shigella flexneri 2a str. 301
cgacuauuaugaau

SEQ ID NO: 3934644 - RNA, 18 nt, Shigella flexneri 2a str. 301
cgacucaaaucacgcagu

SEQ ID NO: 3934645 - RNA, 23 nt, Shigella flexneri 2a str. 301
cgacucgccauuaacauuaacuc

SEQ ID NO: 3934646 - RNA, 15 nt, Shigella flexneri 2a str. 301
cgacucucugagcca

SEQ ID NO: 3934647 - RNA, 17 nt, Shigella flexneri 2a str. 301
cgacugauaucugcccg

SEQ ID NO: 3934648 - RNA, 23 nt, Shigella flexneri 2a str. 301
cgacugcaaaccaugacgcacuu

SEQ ID NO: 3934649 - RNA, 13 nt, Shigella flexneri 2a str. 301
cgacuguugaaga

SEQ ID NO: 3934650 - RNA, 22 nt, Shigella flexneri 2a str. 301
cgacuucuucauucauccgccg

SEQ ID NO: 3934651 - RNA, 18 nt, Shigella flexneri 2a str. 301
cgacuucuucccaccaua

SEQ ID NO: 3934652 - RNA, 20 nt, Shigella flexneri 2a str. 301
cgacuugggcgauuuuugca

SEQ ID NO: 3934653 - RNA, 20 nt, Shigella flexneri 2a str. 301
cgacuuugccuggcggcaga

SEQ ID NO: 3934654 - RNA, 22 nt, Shigella flexneri 2a str. 301
cgacuuuguuuuuaguuaaauc

SEQ ID NO: 3934655 - RNA, 23 nt, Shigella flexneri 2a str. 301
cgacuuuucauaagcgucagaaa

SEQ ID NO: 3934656 - RNA, 17 nt, Shigella flexneri 2a str. 301
cgagaaaagccaaccug

SEQ ID NO: 3934657 - RNA, 13 nt, Shigella flexneri 2a str. 301
cgagaaaaugacg

SEQ ID NO: 3934658 - RNA, 14 nt, Shigella flexneri 2a str. 301
cgagaaauuuuuau

SEQ ID NO: 3934659 - RNA, 22 nt, Shigella flexneri 2a str. 301
cgagaacgacauggcccagccc

SEQ ID NO: 3934660 - RNA, 13 nt, Shigella flexneri 2a str. 301
cgagaagcaacug

SEQ ID NO: 3934661 - RNA, 18 nt, Shigella flexneri 2a str. 301
cgagaagcaagcauuaua

SEQ ID NO: 3934662 - RNA, 21 nt, Shigella flexneri 2a str. 301
cgagaagcagcaacacaauca

SEQ ID NO: 3934663 - RNA, 23 nt, Shigella flexneri 2a str. 301
cgagaagucggcuuuuagcgaca

SEQ ID NO: 3934664 - RNA, 14 nt, Shigella flexneri 2a str. 301
cgagaauaaaacag

SEQ ID NO: 3934665 - RNA, 22 nt, Shigella flexneri 2a str. 301
cgagaauaaaacaggcagcugc

SEQ ID NO: 3934666 - RNA, 18 nt, Shigella flexneri 2a str. 301
cgagaauacugaagucga

SEQ ID NO: 3934667 - RNA, 16 nt, Shigella flexneri 2a str. 301
cgagaauaucgauauc

SEQ ID NO: 3934668 - RNA, 15 nt, Shigella flexneri 2a str. 301
cgagaaucagcgaga

SEQ ID NO: 3934669 - RNA, 20 nt, Shigella flexneri 2a str. 301
cgagaaucagcgagacaaca

SEQ ID NO: 3934670 - RNA, 21 nt, Shigella flexneri 2a str. 301
cgagaaucagcgagacaacaa

SEQ ID NO: 3934671 - RNA, 21 nt, Shigella flexneri 2a str. 301
cgagaauggacaccagcucag

SEQ ID NO: 3934672 - RNA, 21 nt, Shigella flexneri 2a str. 301
cgagaauuucucgugccacca

SEQ ID NO: 3934673 - RNA, 24 nt, Shigella flexneri 2a str. 301
cgagacgguuaaaaacagccagca

SEQ ID NO: 3934674 - RNA, 19 nt, Shigella flexneri 2a str. 301
cgagacugcgcgccgccgc

SEQ ID NO: 3934675 - RNA, 15 nt, Shigella flexneri 2a str. 301
cgagagaagagacag

SEQ ID NO: 3934676 - RNA, 21 nt, Shigella flexneri 2a str. 301
cgagagaauggggucagcagg

SEQ ID NO: 3934677 - RNA, 22 nt, Shigella flexneri 2a str. 301
cgagagaauggggucagcaggu

SEQ ID NO: 3934678 - RNA, 20 nt, Shigella flexneri 2a str. 301
cgagagacgcuugucaccgu

SEQ ID NO: 3934679 - RNA, 15 nt, Shigella flexneri 2a str. 301
cgagagagaaaauaa

SEQ ID NO: 3934680 - RNA, 21 nt, Shigella flexneri 2a str. 301
cgagagagaaaauaauccgcu

SEQ ID NO: 3934681 - RNA, 13 nt, Shigella flexneri 2a str. 301
cgagaguaacaca

SEQ ID NO: 3934682 - RNA, 19 nt, Shigella flexneri 2a str. 301
cgagauacagguugccgau

SEQ ID NO: 3934683 - RNA, 23 nt, Shigella flexneri 2a str. 301
cgagauccggaucccaccagacg

SEQ ID NO: 3934684 - RNA, 20 nt, Shigella flexneri 2a str. 301
cgagauuacugacaaagugc

SEQ ID NO: 3934685 - RNA, 20 nt, Shigella flexneri 2a str. 301
cgagauuagacggcgcaaca

SEQ ID NO: 3934686 - RNA, 16 nt, Shigella flexneri 2a str. 301
cgagauucuuaaaguc

SEQ ID NO: 3934687 - RNA, 16 nt, Shigella flexneri 2a str. 301
cgagcaaagcgcagcc

SEQ ID NO: 3934688 - RNA, 22 nt, Shigella flexneri 2a str. 301
cgagcaaaucgcggcaguggcu

SEQ ID NO: 3934689 - RNA, 14 nt, Shigella flexneri 2a str. 301
cgagcaacgcagcg

SEQ ID NO: 3934690 - RNA, 22 nt, Shigella flexneri 2a str. 301
cgagcaauaaaaacuccgccgc

SEQ ID NO: 3934691 - RNA, 23 nt, Shigella flexneri 2a str. 301
cgagcaauagacaguucuuccug

SEQ ID NO: 3934692 - RNA, 21 nt, Shigella flexneri 2a str. 301
cgagcaaugagcuauguuuga

SEQ ID NO: 3934693 - RNA, 20 nt, Shigella flexneri 2a str. 301
cgagcacgccgccagugccg

SEQ ID NO: 3934694 - RNA, 23 nt, Shigella flexneri 2a str. 301
cgagcagagaaacgccagcagca

SEQ ID NO: 3934695 - RNA, 16 nt, Shigella flexneri 2a str. 301
cgagcagcacaaugcc

SEQ ID NO: 3934696 - RNA, 13 nt, Shigella flexneri 2a str. 301
cgagcagcugacu

SEQ ID NO: 3934697 - RNA, 18 nt, Shigella flexneri 2a str. 301
cgagcagcugacuuccag

SEQ ID NO: 3934698 - RNA, 19 nt, Shigella flexneri 2a str. 301
cgagcagcugacuuccagc

SEQ ID NO: 3934699 - RNA, 12 nt, Shigella flexneri 2a str. 301
cgagcaggucag

SEQ ID NO: 3934700 - RNA, 16 nt, Shigella flexneri 2a str. 301
cgagcaggucagucag

SEQ ID NO: 3934701 - RNA, 18 nt, Shigella flexneri 2a str. 301
cgagcaggucagucagug

SEQ ID NO: 3934702 - RNA, 16 nt, Shigella flexneri 2a str. 301
cgagcaguacagccgc

SEQ ID NO: 3934703 - RNA, 19 nt, Shigella flexneri 2a str. 301
cgagcauccgauccuggac

SEQ ID NO: 3934704 - RNA, 14 nt, Shigella flexneri 2a str. 301
cgagcauugccagc

SEQ ID NO: 3934705 - RNA, 18 nt, Shigella flexneri 2a str. 301
cgagcauugccagcauug

SEQ ID NO: 3934706 - RNA, 15 nt, Shigella flexneri 2a str. 301
cgagccauaaacuga

SEQ ID NO: 3934707 - RNA, 11 nt, Shigella flexneri 2a str. 301
cgagcccuucg

SEQ ID NO: 3934708 - RNA, 16 nt, Shigella flexneri 2a str. 301
cgagccgguugccuga

SEQ ID NO: 3934709 - RNA, 23 nt, Shigella flexneri 2a str. 301
cgagccguuccuaacaugccacu

SEQ ID NO: 3934710 - RNA, 22 nt, Shigella flexneri 2a str. 301
cgagccuguaccacaaccugca

SEQ ID NO: 3934711 - RNA, 19 nt, Shigella flexneri 2a str. 301
cgagcgacagauucaggcg

SEQ ID NO: 3934712 - RNA, 21 nt, Shigella flexneri 2a str. 301
cgagcgccguugcgcccauca

SEQ ID NO: 3934713 - RNA, 19 nt, Shigella flexneri 2a str. 301
cgagcgccuuauccugccu

SEQ ID NO: 3934714 - RNA, 13 nt, Shigella flexneri 2a str. 301
cgagcguggaacu

SEQ ID NO: 3934715 - RNA, 14 nt, Shigella flexneri 2a str. 301
cgagcugcccgcug

SEQ ID NO: 3934716 - RNA, 13 nt, Shigella flexneri 2a str. 301
cgagcuggaagcc

SEQ ID NO: 3934717 - RNA, 17 nt, Shigella flexneri 2a str. 301
cgagcuuucgaccagcc

SEQ ID NO: 3934718 - RNA, 11 nt, Shigella flexneri 2a str. 301
cgaggaaaaua

SEQ ID NO: 3934719 - RNA, 22 nt, Shigella flexneri 2a str. 301
cgaggaaucguucauaccacgc

SEQ ID NO: 3934720 - RNA, 16 nt, Shigella flexneri 2a str. 301
cgaggacagcaucguc

SEQ ID NO: 3934721 - RNA, 20 nt, Shigella flexneri 2a str. 301
cgaggaucuuugccagaucg

SEQ ID NO: 3934722 - RNA, 15 nt, Shigella flexneri 2a str. 301
cgaggauucgaaccu

SEQ ID NO: 3934723 - RNA, 16 nt, Shigella flexneri 2a str. 301
cgaggcaaccagcacg

SEQ ID NO: 3934724 - RNA, 17 nt, Shigella flexneri 2a str. 301
cgaggcaaccagcacgc

SEQ ID NO: 3934725 - RNA, 13 nt, Shigella flexneri 2a str. 301
cgaggcacagcag

SEQ ID NO: 3934726 - RNA, 18 nt, Shigella flexneri 2a str. 301
cgaggccauauuucacau

SEQ ID NO: 3934727 - RNA, 16 nt, Shigella flexneri 2a str. 301
cgaggccuaacaccau

SEQ ID NO: 3934728 - RNA, 15 nt, Shigella flexneri 2a str. 301
cgaggcgcuggcaga

SEQ ID NO: 3934729 - RNA, 16 nt, Shigella flexneri 2a str. 301
cgaggcgcuggcagaa

SEQ ID NO: 3934730 - RNA, 15 nt, Shigella flexneri 2a str. 301
cgaggcgcuggcgca

SEQ ID NO: 3934731 - RNA, 21 nt, Shigella flexneri 2a str. 301
cgaggcucugauugccuucca

SEQ ID NO: 3934732 - RNA, 16 nt, Shigella flexneri 2a str. 301
cgaggcuuauccggca

SEQ ID NO: 3934733 - RNA, 17 nt, Shigella flexneri 2a str. 301
cgagggcgauauccuga

SEQ ID NO: 3934734 - RNA, 17 nt, Shigella flexneri 2a str. 301
cgaggggaccgccccug

SEQ ID NO: 3934735 - RNA, 19 nt, Shigella flexneri 2a str. 301
cgaggggacuguccgggca

SEQ ID NO: 3934736 - RNA, 16 nt, Shigella flexneri 2a str. 301
cgaggguaaacaacau

SEQ ID NO: 3934737 - RNA, 18 nt, Shigella flexneri 2a str. 301
cgagguacgcccagcgcu

SEQ ID NO: 3934738 - RNA, 19 nt, Shigella flexneri 2a str. 301
cgagguacgcuccagcagg

SEQ ID NO: 3934739 - RNA, 16 nt, Shigella flexneri 2a str. 301
cgaggugcucuccacg

SEQ ID NO: 3934740 - RNA, 18 nt, Shigella flexneri 2a str. 301
cgaggugucuucgcgcac

SEQ ID NO: 3934741 - RNA, 13 nt, Shigella flexneri 2a str. 301
cgaguaaucaggc

SEQ ID NO: 3934742 - RNA, 15 nt, Shigella flexneri 2a str. 301
cgaguaguuauauuc

SEQ ID NO: 3934743 - RNA, 14 nt, Shigella flexneri 2a str. 301
cgagucaacgcuuc

SEQ ID NO: 3934744 - RNA, 11 nt, Shigella flexneri 2a str. 301
cgaguccuguu

SEQ ID NO: 3934745 - RNA, 12 nt, Shigella flexneri 2a str. 301
cgaguccuucca

SEQ ID NO: 3934746 - RNA, 16 nt, Shigella flexneri 2a str. 301
cgaguccuuccagguc

SEQ ID NO: 3934747 - RNA, 15 nt, Shigella flexneri 2a str. 301
cgagucgcugagcgu

SEQ ID NO: 3934748 - RNA, 19 nt, Shigella flexneri 2a str. 301
cgaguggcgauugccgcac

SEQ ID NO: 3934749 - RNA, 14 nt, Shigella flexneri 2a str. 301
cgaguucagaucag

SEQ ID NO: 3934750 - RNA, 18 nt, Shigella flexneri 2a str. 301
cgaguucauuaagcugcg

SEQ ID NO: 3934751 - RNA, 20 nt, Shigella flexneri 2a str. 301
cgaguuugccgcuguccagu

SEQ ID NO: 3934752 - RNA, 15 nt, Shigella flexneri 2a str. 301
cgaguuuuucagucc

SEQ ID NO: 3934753 - RNA, 12 nt, Shigella flexneri 2a str. 301
cgauaaaaccuu

SEQ ID NO: 3934754 - RNA, 14 nt, Shigella flexneri 2a str. 301
cgauaaaccagcaa

SEQ ID NO: 3934755 - RNA, 17 nt, Shigella flexneri 2a str. 301
cgauaaacgccggauga

SEQ ID NO: 3934756 - RNA, 20 nt, Shigella flexneri 2a str. 301
cgauaaaggucgacagcagc

SEQ ID NO: 3934757 - RNA, 20 nt, Shigella flexneri 2a str. 301
cgauaaauggcgcauccagc

SEQ ID NO: 3934758 - RNA, 18 nt, Shigella flexneri 2a str. 301
cgauaacacgcuucaagu

SEQ ID NO: 3934759 - RNA, 22 nt, Shigella flexneri 2a str. 301
cgauaacacgguaaugacucca

SEQ ID NO: 3934760 - RNA, 14 nt, Shigella flexneri 2a str. 301
cgauaaccacgcuc

SEQ ID NO: 3934761 - RNA, 18 nt, Shigella flexneri 2a str. 301
cgauaaccaucuucuuca

SEQ ID NO: 3934762 - RNA, 20 nt, Shigella flexneri 2a str. 301
cgauaaccgucacguucucc

SEQ ID NO: 3934763 - RNA, 17 nt, Shigella flexneri 2a str. 301
cgauaaccuucuucauu

SEQ ID NO: 3934764 - RNA, 21 nt, Shigella flexneri 2a str. 301
cgauaacgccccaauccacgc

SEQ ID NO: 3934765 - RNA, 21 nt, Shigella flexneri 2a str. 301
cgauaacggaucggaacgcga

SEQ ID NO: 3934766 - RNA, 21 nt, Shigella flexneri 2a str. 301
cgauaacucgcuuugcccaga

SEQ ID NO: 3934767 - RNA, 17 nt, Shigella flexneri 2a str. 301
cgauaagcaacgcggcg

SEQ ID NO: 3934768 - RNA, 12 nt, Shigella flexneri 2a str. 301
cgauaagcaccg

SEQ ID NO: 3934769 - RNA, 16 nt, Shigella flexneri 2a str. 301
cgauaaggcgcugaag

SEQ ID NO: 3934770 - RNA, 17 nt, Shigella flexneri 2a str. 301
cgauaaggcgcugaagg

SEQ ID NO: 3934771 - RNA, 23 nt, Shigella flexneri 2a str. 301
cgauaagguaucgcgaaaaaaaa

SEQ ID NO: 3934772 - RNA, 14 nt, Shigella flexneri 2a str. 301
cgauaauaaagccu

SEQ ID NO: 3934773 - RNA, 15 nt, Shigella flexneri 2a str. 301
cgauaaucagcgcca

SEQ ID NO: 3934774 - RNA, 15 nt, Shigella flexneri 2a str. 301
cgauaaucuuuugua

SEQ ID NO: 3934775 - RNA, 13 nt, Shigella flexneri 2a str. 301
cgauaaugcccag

SEQ ID NO: 3934776 - RNA, 23 nt, Shigella flexneri 2a str. 301
cgauaauuaggauacuuaucugg

SEQ ID NO: 3934777 - RNA, 15 nt, Shigella flexneri 2a str. 301
cgauaauuuaugccu

SEQ ID NO: 3934778 - RNA, 14 nt, Shigella flexneri 2a str. 301
cgauacaacgcuuu

SEQ ID NO: 3934779 - RNA, 18 nt, Shigella flexneri 2a str. 301
cgauacagaagcaccgua

SEQ ID NO: 3934780 - RNA, 21 nt, Shigella flexneri 2a str. 301
cgauacaucaucacugccagg

SEQ ID NO: 3934781 - RNA, 22 nt, Shigella flexneri 2a str. 301
cgauacaucaucacugccagga

SEQ ID NO: 3934782 - RNA, 22 nt, Shigella flexneri 2a str. 301
cgauaccaauaucaacguaaug

SEQ ID NO: 3934783 - RNA, 23 nt, Shigella flexneri 2a str. 301
cgauaccacccgcagugauugcc

SEQ ID NO: 3934784 - RNA, 18 nt, Shigella flexneri 2a str. 301
cgauacccccaguaaaug

SEQ ID NO: 3934785 - RNA, 18 nt, Shigella flexneri 2a str. 301
cgauaccgcuguccacgc

SEQ ID NO: 3934786 - RNA, 22 nt, Shigella flexneri 2a str. 301
cgauacgacacgccuccuggcu

SEQ ID NO: 3934787 - RNA, 20 nt, Shigella flexneri 2a str. 301
cgauacgcaguacggcagca

SEQ ID NO: 3934788 - RNA, 14 nt, Shigella flexneri 2a str. 301
cgauacgcugcaca

SEQ ID NO: 3934789 - RNA, 22 nt, Shigella flexneri 2a str. 301
cgauacgcugcacaauugccag

SEQ ID NO: 3934790 - RNA, 18 nt, Shigella flexneri 2a str. 301
cgauacggucgaggaacc

SEQ ID NO: 3934791 - RNA, 20 nt, Shigella flexneri 2a str. 301
cgauacuacguucaaucacc

SEQ ID NO: 3934792 - RNA, 14 nt, Shigella flexneri 2a str. 301
cgauacuuuuucaa

SEQ ID NO: 3934793 - RNA, 17 nt, Shigella flexneri 2a str. 301
cgauagagagcagucag

SEQ ID NO: 3934794 - RNA, 20 nt, Shigella flexneri 2a str. 301
cgauagagcaaccaccugca

SEQ ID NO: 3934795 - RNA, 13 nt, Shigella flexneri 2a str. 301
cgauagcaacgag

SEQ ID NO: 3934796 - RNA, 20 nt, Shigella flexneri 2a str. 301
cgauagccacgcucauaugc

SEQ ID NO: 3934797 - RNA, 14 nt, Shigella flexneri 2a str. 301
cgauagcgccgcca

SEQ ID NO: 3934798 - RNA, 18 nt, Shigella flexneri 2a str. 301
cgauaggcuuccgccauc

SEQ ID NO: 3934799 - RNA, 21 nt, Shigella flexneri 2a str. 301
cgauaggggggauugccgcga

SEQ ID NO: 3934800 - RNA, 23 nt, Shigella flexneri 2a str. 301
cgauauaaaccaucggcgcuggc

SEQ ID NO: 3934801 - RNA, 12 nt, Shigella flexneri 2a str. 301
cgauauaauaaa

SEQ ID NO: 3934802 - RNA, 17 nt, Shigella flexneri 2a str. 301
cgauaucgacgaccuga

SEQ ID NO: 3934803 - RNA, 15 nt, Shigella flexneri 2a str. 301
cgauaucgaugacgc

SEQ ID NO: 3934804 - RNA, 22 nt, Shigella flexneri 2a str. 301
cgauaucgccauuaaacaaccc

SEQ ID NO: 3934805 - RNA, 13 nt, Shigella flexneri 2a str. 301
cgauaugcgucag

SEQ ID NO: 3934806 - RNA, 16 nt, Shigella flexneri 2a str. 301
cgauauucuucaguau

SEQ ID NO: 3934807 - RNA, 16 nt, Shigella flexneri 2a str. 301
cgauauugccaccugc

SEQ ID NO: 3934808 - RNA, 20 nt, Shigella flexneri 2a str. 301
cgaucaagauugauccccgc

SEQ ID NO: 3934809 - RNA, 12 nt, Shigella flexneri 2a str. 301
cgaucacagcag

SEQ ID NO: 3934810 - RNA, 20 nt, Shigella flexneri 2a str. 301
cgaucacagcaguccagcgc

SEQ ID NO: 3934811 - RNA, 15 nt, Shigella flexneri 2a str. 301
cgaucacauccagua

SEQ ID NO: 3934812 - RNA, 17 nt, Shigella flexneri 2a str. 301
cgaucacugcgaaagcg

SEQ ID NO: 3934813 - RNA, 18 nt, Shigella flexneri 2a str. 301
cgaucacuuucugcgcca

SEQ ID NO: 3934814 - RNA, 12 nt, Shigella flexneri 2a str. 301
cgaucagcggac

SEQ ID NO: 3934815 - RNA, 21 nt, Shigella flexneri 2a str. 301
cgaucaggaacuguugcaaaa

SEQ ID NO: 3934816 - RNA, 15 nt, Shigella flexneri 2a str. 301
cgaucauaucgacaa

SEQ ID NO: 3934817 - RNA, 13 nt, Shigella flexneri 2a str. 301
cgaucaucgacag

SEQ ID NO: 3934818 - RNA, 22 nt, Shigella flexneri 2a str. 301
cgaucauguaccguugcugcca

SEQ ID NO: 3934819 - RNA, 18 nt, Shigella flexneri 2a str. 301
cgaucauuaacaccacgc

SEQ ID NO: 3934820 - RNA, 17 nt, Shigella flexneri 2a str. 301
cgauccaccaccgcaaa

SEQ ID NO: 3934821 - RNA, 20 nt, Shigella flexneri 2a str. 301
cgauccagcgcaauaccgau

SEQ ID NO: 3934822 - RNA, 15 nt, Shigella flexneri 2a str. 301
cgauccuguucaaac

SEQ ID NO: 3934823 - RNA, 18 nt, Shigella flexneri 2a str. 301
cgaucgaagccgucagcg

SEQ ID NO: 3934824 - RNA, 15 nt, Shigella flexneri 2a str. 301
cgaucgagaguggua

SEQ ID NO: 3934825 - RNA, 21 nt, Shigella flexneri 2a str. 301
cgaucgaugugauaaauacga

SEQ ID NO: 3934826 - RNA, 14 nt, Shigella flexneri 2a str. 301
cgaucgccagcagg

SEQ ID NO: 3934827 - RNA, 22 nt, Shigella flexneri 2a str. 301
cgaucgccugguaccagcaccg

SEQ ID NO: 3934828 - RNA, 20 nt, Shigella flexneri 2a str. 301
cgaucgcgccaucugccgau

SEQ ID NO: 3934829 - RNA, 22 nt, Shigella flexneri 2a str. 301
cgaucggcgagucgcuccugcc

SEQ ID NO: 3934830 - RNA, 17 nt, Shigella flexneri 2a str. 301
cgaucgggcauuuccau

SEQ ID NO: 3934831 - RNA, 13 nt, Shigella flexneri 2a str. 301
cgaucgguuaaac

SEQ ID NO: 3934832 - RNA, 13 nt, Shigella flexneri 2a str. 301
cgaucucaaucuu

SEQ ID NO: 3934833 - RNA, 18 nt, Shigella flexneri 2a str. 301
cgaucucgccagugacca

SEQ ID NO: 3934834 - RNA, 18 nt, Shigella flexneri 2a str. 301
cgaucucuucgccugccu

SEQ ID NO: 3934835 - RNA, 18 nt, Shigella flexneri 2a str. 301
cgaucuuccacgccugca

SEQ ID NO: 3934836 - RNA, 19 nt, Shigella flexneri 2a str. 301
cgaugaaaaaccguaucca

SEQ ID NO: 3934837 - RNA, 19 nt, Shigella flexneri 2a str. 301
cgaugaaaaagaagcaaau

SEQ ID NO: 3934838 - RNA, 13 nt, Shigella flexneri 2a str. 301
cgaugaaccguuc

SEQ ID NO: 3934839 - RNA, 23 nt, Shigella flexneri 2a str. 301
cgaugaacuacggcaaaagaaua

SEQ ID NO: 3934840 - RNA, 14 nt, Shigella flexneri 2a str. 301
cgaugaaucaccac

SEQ ID NO: 3934841 - RNA, 16 nt, Shigella flexneri 2a str. 301
cgaugacaucgcagca

SEQ ID NO: 3934842 - RNA, 13 nt, Shigella flexneri 2a str. 301
cgaugaccgccac

SEQ ID NO: 3934843 - RNA, 13 nt, Shigella flexneri 2a str. 301
cgaugacggaaau

SEQ ID NO: 3934844 - RNA, 16 nt, Shigella flexneri 2a str. 301
cgaugagacccgccac

SEQ ID NO: 3934845 - RNA, 14 nt, Shigella flexneri 2a str. 301
cgaugagaugacgc

SEQ ID NO: 3934846 - RNA, 16 nt, Shigella flexneri 2a str. 301
cgaugaguuaagaaga

SEQ ID NO: 3934847 - RNA, 15 nt, Shigella flexneri 2a str. 301
cgaugaucaacagca

SEQ ID NO: 3934848 - RNA, 16 nt, Shigella flexneri 2a str. 301
cgaugaucaacagcau

SEQ ID NO: 3934849 - RNA, 13 nt, Shigella flexneri 2a str. 301
cgaugaucgccau

SEQ ID NO: 3934850 - RNA, 14 nt, Shigella flexneri 2a str. 301
cgaugauucccagu

SEQ ID NO: 3934851 - RNA, 17 nt, Shigella flexneri 2a str. 301
cgaugcaaccgagcgcc

SEQ ID NO: 3934852 - RNA, 12 nt, Shigella flexneri 2a str. 301
cgaugcacagca

SEQ ID NO: 3934853 - RNA, 12 nt, Shigella flexneri 2a str. 301
cgaugccagcac

SEQ ID NO: 3934854 - RNA, 20 nt, Shigella flexneri 2a str. 301
cgaugccaguaaucacgauc

SEQ ID NO: 3934855 - RNA, 13 nt, Shigella flexneri 2a str. 301
cgaugccuggcaa

SEQ ID NO: 3934856 - RNA, 22 nt, Shigella flexneri 2a str. 301
cgaugcgcucgccaggaugggc

SEQ ID NO: 3934857 - RNA, 15 nt, Shigella flexneri 2a str. 301
cgaugcugacgcauc

SEQ ID NO: 3934858 - RNA, 23 nt, Shigella flexneri 2a str. 301
cgaugcuguugcuccuuaauaaa

SEQ ID NO: 3934859 - RNA, 21 nt, Shigella flexneri 2a str. 301
cgaugcuuuccaacuguacca

SEQ ID NO: 3934860 - RNA, 18 nt, Shigella flexneri 2a str. 301
cgauggaaccguacagca

SEQ ID NO: 3934861 - RNA, 19 nt, Shigella flexneri 2a str. 301
cgauggcaaacaaacugcg

SEQ ID NO: 3934862 - RNA, 23 nt, Shigella flexneri 2a str. 301
cgaugggagcagccagccagacg

SEQ ID NO: 3934863 - RNA, 17 nt, Shigella flexneri 2a str. 301
cgaugggggaacaacca

SEQ ID NO: 3934864 - RNA, 15 nt, Shigella flexneri 2a str. 301
cgauggucagcuuca

SEQ ID NO: 3934865 - RNA, 20 nt, Shigella flexneri 2a str. 301
cgauggugaagucauugaag

SEQ ID NO: 3934866 - RNA, 13 nt, Shigella flexneri 2a str. 301
cgauggugguggg

SEQ ID NO: 3934867 - RNA, 23 nt, Shigella flexneri 2a str. 301
cgaugguggugggggaaggauua

SEQ ID NO: 3934868 - RNA, 20 nt, Shigella flexneri 2a str. 301
cgaugguugcugucaacuga

SEQ ID NO: 3934869 - RNA, 14 nt, Shigella flexneri 2a str. 301
cgauguaauucagc

SEQ ID NO: 3934870 - RNA, 17 nt, Shigella flexneri 2a str. 301
cgauguacuucaacaua

SEQ ID NO: 3934871 - RNA, 14 nt, Shigella flexneri 2a str. 301
cgauguauccggca

SEQ ID NO: 3934872 - RNA, 16 nt, Shigella flexneri 2a str. 301
cgaugucaaucagggc

SEQ ID NO: 3934873 - RNA, 18 nt, Shigella flexneri 2a str. 301
cgauguccugacgcccga

SEQ ID NO: 3934874 - RNA, 17 nt, Shigella flexneri 2a str. 301
cgauguguugcaaauaa

SEQ ID NO: 3934875 - RNA, 19 nt, Shigella flexneri 2a str. 301
cgauuaaaaacccugcaga

SEQ ID NO: 3934876 - RNA, 16 nt, Shigella flexneri 2a str. 301
cgauuaaauucaccag

SEQ ID NO: 3934877 - RNA, 22 nt, Shigella flexneri 2a str. 301
cgauuaaauucaccaguuuacu

SEQ ID NO: 3934878 - RNA, 22 nt, Shigella flexneri 2a str. 301
cgauuaacgccagacucgccag

SEQ ID NO: 3934879 - RNA, 21 nt, Shigella flexneri 2a str. 301
cgauuaauaaaauuauccagc

SEQ ID NO: 3934880 - RNA, 18 nt, Shigella flexneri 2a str. 301
cgauuaauugccgccaga

SEQ ID NO: 3934881 - RNA, 16 nt, Shigella flexneri 2a str. 301
cgauuaccauuucacc

SEQ ID NO: 3934882 - RNA, 15 nt, Shigella flexneri 2a str. 301
cgauuauccgccagu

SEQ ID NO: 3934883 - RNA, 19 nt, Shigella flexneri 2a str. 301
cgauuaugagucgccugcu

SEQ ID NO: 3934884 - RNA, 15 nt, Shigella flexneri 2a str. 301
cgauucggcaaucac

SEQ ID NO: 3934885 - RNA, 16 nt, Shigella flexneri 2a str. 301
cgauucgguucaauac

SEQ ID NO: 3934886 - RNA, 22 nt, Shigella flexneri 2a str. 301
cgauucucugcguaacccacug

SEQ ID NO: 3934887 - RNA, 23 nt, Shigella flexneri 2a str. 301
cgauugacuggaugccaguauua

SEQ ID NO: 3934888 - RNA, 21 nt, Shigella flexneri 2a str. 301
cgauugaucucguugaucacc

SEQ ID NO: 3934889 - RNA, 21 nt, Shigella flexneri 2a str. 301
cgauugcaggaaauuauggau

SEQ ID NO: 3934890 - RNA, 16 nt, Shigella flexneri 2a str. 301
cgauugcugccgaugg

SEQ ID NO: 3934891 - RNA, 17 nt, Shigella flexneri 2a str. 301
cgauugucagcuggugg

SEQ ID NO: 3934892 - RNA, 20 nt, Shigella flexneri 2a str. 301
cgauugucauucgccugacg

SEQ ID NO: 3934893 - RNA, 23 nt, Shigella flexneri 2a str. 301
cgauugugauucgauucacauuu

SEQ ID NO: 3934894 - RNA, 15 nt, Shigella flexneri 2a str. 301
cgauugugcugguga

SEQ ID NO: 3934895 - RNA, 18 nt, Shigella flexneri 2a str. 301
cgauuuccaucuccagcu

SEQ ID NO: 3934896 - RNA, 19 nt, Shigella flexneri 2a str. 301
cgauuucuacacccagccc

SEQ ID NO: 3934897 - RNA, 11 nt, Shigella flexneri 2a str. 301
cgauuucugac

SEQ ID NO: 3934898 - RNA, 21 nt, Shigella flexneri 2a str. 301
cgauuugccgucucuuucaug

SEQ ID NO: 3934899 - RNA, 19 nt, Shigella flexneri 2a str. 301
cgauuugucgccugcauca

SEQ ID NO: 3934900 - RNA, 22 nt, Shigella flexneri 2a str. 301
cgauuugugcacgugccagaug

SEQ ID NO: 3934901 - RNA, 12 nt, Shigella flexneri 2a str. 301
cgauuuucaaaa

SEQ ID NO: 3934902 - RNA, 18 nt, Shigella flexneri 2a str. 301
cgauuuuccgauucguuu

SEQ ID NO: 3934903 - RNA, 14 nt, Shigella flexneri 2a str. 301
cgauuuuccuccau

SEQ ID NO: 3934904 - RNA, 22 nt, Shigella flexneri 2a str. 301
cgauuuuggguuccacuucugc

SEQ ID NO: 3934905 - RNA, 13 nt, Shigella flexneri 2a str. 301
cgcaaaaccucuu

SEQ ID NO: 3934906 - RNA, 20 nt, Shigella flexneri 2a str. 301
cgcaaaaccucuuccagcag

SEQ ID NO: 3934907 - RNA, 21 nt, Shigella flexneri 2a str. 301
cgcaaaaccucuuccagcaga

SEQ ID NO: 3934908 - RNA, 16 nt, Shigella flexneri 2a str. 301
cgcaaaacugccugau

SEQ ID NO: 3934909 - RNA, 16 nt, Shigella flexneri 2a str. 301
cgcaaaaucagcaauu

SEQ ID NO: 3934910 - RNA, 20 nt, Shigella flexneri 2a str. 301
cgcaaaaucagcaauuuuuc

SEQ ID NO: 3934911 - RNA, 13 nt, Shigella flexneri 2a str. 301
cgcaaacaccagc

SEQ ID NO: 3934912 - RNA, 20 nt, Shigella flexneri 2a str. 301
cgcaaacaggcgcagaacuu

SEQ ID NO: 3934913 - RNA, 23 nt, Shigella flexneri 2a str. 301
cgcaaacaucggcuuauucauau

SEQ ID NO: 3934914 - RNA, 23 nt, Shigella flexneri 2a str. 301
cgcaaacgcccguccaucaacaa

SEQ ID NO: 3934915 - RNA, 14 nt, Shigella flexneri 2a str. 301
cgcaaacugccguu

SEQ ID NO: 3934916 - RNA, 17 nt, Shigella flexneri 2a str. 301
cgcaaagagagaagcca

SEQ ID NO: 3934917 - RNA, 14 nt, Shigella flexneri 2a str. 301
cgcaaagauguugu

SEQ ID NO: 3934918 - RNA, 17 nt, Shigella flexneri 2a str. 301
cgcaaaggccagcaauc

SEQ ID NO: 3934919 - RNA, 18 nt, Shigella flexneri 2a str. 301
cgcaaaggccagcaaucc

SEQ ID NO: 3934920 - RNA, 20 nt, Shigella flexneri 2a str. 301
cgcaaaguagcugaaaauca

SEQ ID NO: 3934921 - RNA, 20 nt, Shigella flexneri 2a str. 301
cgcaaauauuucacccgcga

SEQ ID NO: 3934922 - RNA, 13 nt, Shigella flexneri 2a str. 301
cgcaaauguaaaa

SEQ ID NO: 3934923 - RNA, 13 nt, Shigella flexneri 2a str. 301
cgcaacaaauaaa

SEQ ID NO: 3934924 - RNA, 21 nt, Shigella flexneri 2a str. 301
cgcaacagugaaauacaguua

SEQ ID NO: 3934925 - RNA, 23 nt, Shigella flexneri 2a str. 301
cgcaacauauuccgcaccugcca

SEQ ID NO: 3934926 - RNA, 13 nt, Shigella flexneri 2a str. 301
cgcaacaucgcaa

SEQ ID NO: 3934927 - RNA, 15 nt, Shigella flexneri 2a str. 301
cgcaacauugcgccu

SEQ ID NO: 3934928 - RNA, 16 nt, Shigella flexneri 2a str. 301
cgcaaccaacggccuu

SEQ ID NO: 3934929 - RNA, 14 nt, Shigella flexneri 2a str. 301
cgcaaccagcguca

SEQ ID NO: 3934930 - RNA, 17 nt, Shigella flexneri 2a str. 301
cgcaacgccuaucacca

SEQ ID NO: 3934931 - RNA, 15 nt, Shigella flexneri 2a str. 301
cgcaacgccucaugc

SEQ ID NO: 3934932 - RNA, 17 nt, Shigella flexneri 2a str. 301
cgcaacgccucaugcag

SEQ ID NO: 3934933 - RNA, 14 nt, Shigella flexneri 2a str. 301
cgcaacgcgcguga

SEQ ID NO: 3934934 - RNA, 23 nt, Shigella flexneri 2a str. 301
cgcaacgcgcgugaaguggcaca

SEQ ID NO: 3934935 - RNA, 16 nt, Shigella flexneri 2a str. 301
cgcaacgcuuucccug

SEQ ID NO: 3934936 - RNA, 15 nt, Shigella flexneri 2a str. 301
cgcaacggcugcugc

SEQ ID NO: 3934937 - RNA, 15 nt, Shigella flexneri 2a str. 301
cgcaacgguugcgga

SEQ ID NO: 3934938 - RNA, 16 nt, Shigella flexneri 2a str. 301
cgcaacugaggcaaua

SEQ ID NO: 3934939 - RNA, 18 nt, Shigella flexneri 2a str. 301
cgcaacugguccagcccc

SEQ ID NO: 3934940 - RNA, 19 nt, Shigella flexneri 2a str. 301
cgcaacuuauuggcaaucg

SEQ ID NO: 3934941 - RNA, 17 nt, Shigella flexneri 2a str. 301
cgcaagcagacgcucgu

SEQ ID NO: 3934942 - RNA, 16 nt, Shigella flexneri 2a str. 301
cgcaagccaacauguu

SEQ ID NO: 3934943 - RNA, 15 nt, Shigella flexneri 2a str. 301
cgcaauaaucaucuc

SEQ ID NO: 3934944 - RNA, 15 nt, Shigella flexneri 2a str. 301
cgcaauacagccagc

SEQ ID NO: 3934945 - RNA, 19 nt, Shigella flexneri 2a str. 301
cgcaauacccugacccaga

SEQ ID NO: 3934946 - RNA, 17 nt, Shigella flexneri 2a str. 301
cgcaauaccggcaaaga

SEQ ID NO: 3934947 - RNA, 19 nt, Shigella flexneri 2a str. 301
cgcaauauccugcgcuucc

SEQ ID NO: 3934948 - RNA, 22 nt, Shigella flexneri 2a str. 301
cgcaaucaccgggccgaugcgg

SEQ ID NO: 3934949 - RNA, 16 nt, Shigella flexneri 2a str. 301
cgcaaucagagauaua

SEQ ID NO: 3934950 - RNA, 20 nt, Shigella flexneri 2a str. 301
cgcaaucagagauauagucu

SEQ ID NO: 3934951 - RNA, 14 nt, Shigella flexneri 2a str. 301
cgcaaucagcaccg

SEQ ID NO: 3934952 - RNA, 18 nt, Shigella flexneri 2a str. 301
cgcaaucagcaccgcgcg

SEQ ID NO: 3934953 - RNA, 15 nt, Shigella flexneri 2a str. 301
cgcaaucgcccagcg

SEQ ID NO: 3934954 - RNA, 21 nt, Shigella flexneri 2a str. 301
cgcaaucgccuccagcgcugg

SEQ ID NO: 3934955 - RNA, 18 nt, Shigella flexneri 2a str. 301
cgcaaugauuuugaugga

SEQ ID NO: 3934956 - RNA, 21 nt, Shigella flexneri 2a str. 301
cgcaauggccguuccggcaac

SEQ ID NO: 3934957 - RNA, 16 nt, Shigella flexneri 2a str. 301
cgcaaugguguacuca

SEQ ID NO: 3934958 - RNA, 12 nt, Shigella flexneri 2a str. 301
cgcaauguugcg

SEQ ID NO: 3934959 - RNA, 17 nt, Shigella flexneri 2a str. 301
cgcaauuaacgccccaa

SEQ ID NO: 3934960 - RNA, 13 nt, Shigella flexneri 2a str. 301
cgcaauuccggug

SEQ ID NO: 3934961 - RNA, 19 nt, Shigella flexneri 2a str. 301
cgcaauuuccauugcucug

SEQ ID NO: 3934962 - RNA, 22 nt, Shigella flexneri 2a str. 301
cgcacaauggcggugaucccaa

SEQ ID NO: 3934963 - RNA, 14 nt, Shigella flexneri 2a str. 301
cgcacaccccggcg

SEQ ID NO: 3934964 - RNA, 17 nt, Shigella flexneri 2a str. 301
cgcacaccgagauaaug

SEQ ID NO: 3934965 - RNA, 20 nt, Shigella flexneri 2a str. 301
cgcacaggcggaggaaaaaa

SEQ ID NO: 3934966 - RNA, 15 nt, Shigella flexneri 2a str. 301
cgcacauugguaauc

SEQ ID NO: 3934967 - RNA, 13 nt, Shigella flexneri 2a str. 301
cgcaccaacucca

SEQ ID NO: 3934968 - RNA, 20 nt, Shigella flexneri 2a str. 301
cgcaccaacuccacuucacc

SEQ ID NO: 3934969 - RNA, 14 nt, Shigella flexneri 2a str. 301
cgcaccaccagcag

SEQ ID NO: 3934970 - RNA, 15 nt, Shigella flexneri 2a str. 301
cgcaccaccagcagc

SEQ ID NO: 3934971 - RNA, 16 nt, Shigella flexneri 2a str. 301
cgcaccaccagcagcu

SEQ ID NO: 3934972 - RNA, 18 nt, Shigella flexneri 2a str. 301
cgcaccaccagcagcugc

SEQ ID NO: 3934973 - RNA, 13 nt, Shigella flexneri 2a str. 301
cgcaccacuuccc

SEQ ID NO: 3934974 - RNA, 17 nt, Shigella flexneri 2a str. 301
cgcaccagaaacaauaa

SEQ ID NO: 3934975 - RNA, 12 nt, Shigella flexneri 2a str. 301
cgcaccagcagg

SEQ ID NO: 3934976 - RNA, 22 nt, Shigella flexneri 2a str. 301
cgcaccagcggaaugcagucac

SEQ ID NO: 3934977 - RNA, 13 nt, Shigella flexneri 2a str. 301
cgcaccagcuugc

SEQ ID NO: 3934978 - RNA, 18 nt, Shigella flexneri 2a str. 301
cgcaccccugauaaccgc

SEQ ID NO: 3934979 - RNA, 20 nt, Shigella flexneri 2a str. 301
cgcaccccugauaaccgcau

SEQ ID NO: 3934980 - RNA, 13 nt, Shigella flexneri 2a str. 301
cgcacccgccauc

SEQ ID NO: 3934981 - RNA, 17 nt, Shigella flexneri 2a str. 301
cgcaccgccaccaccga

SEQ ID NO: 3934982 - RNA, 15 nt, Shigella flexneri 2a str. 301
cgcaccgcuggcaga

SEQ ID NO: 3934983 - RNA, 17 nt, Shigella flexneri 2a str. 301
cgcaccgggcuuccggc

SEQ ID NO: 3934984 - RNA, 18 nt, Shigella flexneri 2a str. 301
cgcaccgugacaguaauc

SEQ ID NO: 3934985 - RNA, 16 nt, Shigella flexneri 2a str. 301
cgcaccugaguaauua

SEQ ID NO: 3934986 - RNA, 12 nt, Shigella flexneri 2a str. 301
cgcaccugccag

SEQ ID NO: 3934987 - RNA, 13 nt, Shigella flexneri 2a str. 301
cgcaccugccagc

SEQ ID NO: 3934988 - RNA, 16 nt, Shigella flexneri 2a str. 301
cgcaccugccagcgcc

SEQ ID NO: 3934989 - RNA, 12 nt, Shigella flexneri 2a str. 301
cgcaccuuuacc

SEQ ID NO: 3934990 - RNA, 19 nt, Shigella flexneri 2a str. 301
cgcacgaggaacagcgcgc

SEQ ID NO: 3934991 - RNA, 13 nt, Shigella flexneri 2a str. 301
cgcacgcuggaga

SEQ ID NO: 3934992 - RNA, 16 nt, Shigella flexneri 2a str. 301
cgcacgcugucaccag

SEQ ID NO: 3934993 - RNA, 18 nt, Shigella flexneri 2a str. 301
cgcacggccgcaagcaga

SEQ ID NO: 3934994 - RNA, 15 nt, Shigella flexneri 2a str. 301
cgcacguauaaacau

SEQ ID NO: 3934995 - RNA, 19 nt, Shigella flexneri 2a str. 301
cgcacgucagccucgcugg

SEQ ID NO: 3934996 - RNA, 17 nt, Shigella flexneri 2a str. 301
cgcacuauacaaccaga

SEQ ID NO: 3934997 - RNA, 14 nt, Shigella flexneri 2a str. 301
cgcacucgcccuga

SEQ ID NO: 3934998 - RNA, 23 nt, Shigella flexneri 2a str. 301
cgcacucguaucaccccgcccga

SEQ ID NO: 3934999 - RNA, 13 nt, Shigella flexneri 2a str. 301
cgcacugcuugaa

SEQ ID NO: 3935000 - RNA, 22 nt, Shigella flexneri 2a str. 301
cgcacuggggggcuauccgcgc

SEQ ID NO: 3935001 - RNA, 21 nt, Shigella flexneri 2a str. 301
cgcacuguuggcgaaaauccu

SEQ ID NO: 3935002 - RNA, 13 nt, Shigella flexneri 2a str. 301
cgcacuuaauaua

SEQ ID NO: 3935003 - RNA, 15 nt, Shigella flexneri 2a str. 301
cgcacuuacagcaac

SEQ ID NO: 3935004 - RNA, 14 nt, Shigella flexneri 2a str. 301
cgcacuuaccuuca

SEQ ID NO: 3935005 - RNA, 15 nt, Shigella flexneri 2a str. 301
cgcacuuccgcccau

SEQ ID NO: 3935006 - RNA, 17 nt, Shigella flexneri 2a str. 301
cgcacuuccgcccaucg

SEQ ID NO: 3935007 - RNA, 16 nt, Shigella flexneri 2a str. 301
cgcacuucuuccgggc

SEQ ID NO: 3935008 - RNA, 12 nt, Shigella flexneri 2a str. 301
cgcacuugccag

SEQ ID NO: 3935009 - RNA, 18 nt, Shigella flexneri 2a str. 301
cgcacuuugccagaaauc

SEQ ID NO: 3935010 - RNA, 13 nt, Shigella flexneri 2a str. 301
cgcagaaagaggc

SEQ ID NO: 3935011 - RNA, 15 nt, Shigella flexneri 2a str. 301
cgcagaaccagaagc

SEQ ID NO: 3935012 - RNA, 16 nt, Shigella flexneri 2a str. 301
cgcagaaccagaagcg

SEQ ID NO: 3935013 - RNA, 15 nt, Shigella flexneri 2a str. 301
cgcagaguuuccagg

SEQ ID NO: 3935014 - RNA, 16 nt, Shigella flexneri 2a str. 301
cgcagaucagaccaau

SEQ ID NO: 3935015 - RNA, 18 nt, Shigella flexneri 2a str. 301
cgcagaugaagcuggcaa

SEQ ID NO: 3935016 - RNA, 19 nt, Shigella flexneri 2a str. 301
cgcagaugaagcuggcaaa

SEQ ID NO: 3935017 - RNA, 16 nt, Shigella flexneri 2a str. 301
cgcagauuaugccgcu

SEQ ID NO: 3935018 - RNA, 15 nt, Shigella flexneri 2a str. 301
cgcagauuucuucug

SEQ ID NO: 3935019 - RNA, 20 nt, Shigella flexneri 2a str. 301
cgcagcacccugaguuuuca

SEQ ID NO: 3935020 - RNA, 19 nt, Shigella flexneri 2a str. 301
cgcagcagccaagcaccgc

SEQ ID NO: 3935021 - RNA, 13 nt, Shigella flexneri 2a str. 301
cgcagcagcgcgc

SEQ ID NO: 3935022 - RNA, 16 nt, Shigella flexneri 2a str. 301
cgcagcaguugccagu

SEQ ID NO: 3935023 - RNA, 21 nt, Shigella flexneri 2a str. 301
cgcagccacgucaccugcccg

SEQ ID NO: 3935024 - RNA, 12 nt, Shigella flexneri 2a str. 301
cgcagccagcac

SEQ ID NO: 3935025 - RNA, 15 nt, Shigella flexneri 2a str. 301
cgcagccagcacugc

SEQ ID NO: 3935026 - RNA, 16 nt, Shigella flexneri 2a str. 301
cgcagccagcgcgccu

SEQ ID NO: 3935027 - RNA, 15 nt, Shigella flexneri 2a str. 301
cgcagccaguuaacc

SEQ ID NO: 3935028 - RNA, 13 nt, Shigella flexneri 2a str. 301
cgcagccaucagc

SEQ ID NO: 3935029 - RNA, 19 nt, Shigella flexneri 2a str. 301
cgcagcccagaugcggcgg

SEQ ID NO: 3935030 - RNA, 12 nt, Shigella flexneri 2a str. 301
cgcagcccaucc

SEQ ID NO: 3935031 - RNA, 14 nt, Shigella flexneri 2a str. 301
cgcagccgaguaga

SEQ ID NO: 3935032 - RNA, 17 nt, Shigella flexneri 2a str. 301
cgcagccgccagaaaug

SEQ ID NO: 3935033 - RNA, 13 nt, Shigella flexneri 2a str. 301
cgcagcggcggca

SEQ ID NO: 3935034 - RNA, 18 nt, Shigella flexneri 2a str. 301
cgcagcgguuugcgcauc

SEQ ID NO: 3935035 - RNA, 13 nt, Shigella flexneri 2a str. 301
cgcagcgucagca

SEQ ID NO: 3935036 - RNA, 15 nt, Shigella flexneri 2a str. 301
cgcagcgucagcacc

SEQ ID NO: 3935037 - RNA, 17 nt, Shigella flexneri 2a str. 301
cgcagcucauaaccguc

SEQ ID NO: 3935038 - RNA, 12 nt, Shigella flexneri 2a str. 301
cgcagcuccagc

SEQ ID NO: 3935039 - RNA, 13 nt, Shigella flexneri 2a str. 301
cgcagcuccagcc

SEQ ID NO: 3935040 - RNA, 17 nt, Shigella flexneri 2a str. 301
cgcagcuccagcccgcg

SEQ ID NO: 3935041 - RNA, 13 nt, Shigella flexneri 2a str. 301
cgcagcugaccuu

SEQ ID NO: 3935042 - RNA, 18 nt, Shigella flexneri 2a str. 301
cgcagcuucacuucuuac

SEQ ID NO: 3935043 - RNA, 19 nt, Shigella flexneri 2a str. 301
cgcagcuuugugcuucagu

SEQ ID NO: 3935044 - RNA, 15 nt, Shigella flexneri 2a str. 301
cgcaggauaaccuuc

SEQ ID NO: 3935045 - RNA, 19 nt, Shigella flexneri 2a str. 301
cgcaggauaucguggcacg

SEQ ID NO: 3935046 - RNA, 19 nt, Shigella flexneri 2a str. 301
cgcaggaucugacuggcga

SEQ ID NO: 3935047 - RNA, 14 nt, Shigella flexneri 2a str. 301
cgcaggaugggcaa

SEQ ID NO: 3935048 - RNA, 16 nt, Shigella flexneri 2a str. 301
cgcaggcgcaauggcg

SEQ ID NO: 3935049 - RNA, 19 nt, Shigella flexneri 2a str. 301
cgcaggcgcaauggcgcaa

SEQ ID NO: 3935050 - RNA, 20 nt, Shigella flexneri 2a str. 301
cgcaggcgcaauggcgcaau

SEQ ID NO: 3935051 - RNA, 20 nt, Shigella flexneri 2a str. 301
cgcagggcuguuuaucguga

SEQ ID NO: 3935052 - RNA, 20 nt, Shigella flexneri 2a str. 301
cgcaggguuugcaucgccau

SEQ ID NO: 3935053 - RNA, 21 nt, Shigella flexneri 2a str. 301
cgcagguagguucugcggcgu

SEQ ID NO: 3935054 - RNA, 20 nt, Shigella flexneri 2a str. 301
cgcaggucauccggcacgcu

SEQ ID NO: 3935055 - RNA, 17 nt, Shigella flexneri 2a str. 301
cgcaggugauacugaca

SEQ ID NO: 3935056 - RNA, 19 nt, Shigella flexneri 2a str. 301
cgcaguaaauccgccacuu

SEQ ID NO: 3935057 - RNA, 16 nt, Shigella flexneri 2a str. 301
cgcaguaccagcaacg

SEQ ID NO: 3935058 - RNA, 21 nt, Shigella flexneri 2a str. 301
cgcaguaccagcaacgcuuca

SEQ ID NO: 3935059 - RNA, 13 nt, Shigella flexneri 2a str. 301
cgcagucaccagc

SEQ ID NO: 3935060 - RNA, 15 nt, Shigella flexneri 2a str. 301
cgcagucaccagcau

SEQ ID NO: 3935061 - RNA, 19 nt, Shigella flexneri 2a str. 301
cgcagucaugcgagaagca

SEQ ID NO: 3935062 - RNA, 16 nt, Shigella flexneri 2a str. 301
cgcagucucucuccgu

SEQ ID NO: 3935063 - RNA, 20 nt, Shigella flexneri 2a str. 301
cgcagugaagucgggcagaa

SEQ ID NO: 3935064 - RNA, 21 nt, Shigella flexneri 2a str. 301
cgcagugagaagccaccgcgc

SEQ ID NO: 3935065 - RNA, 21 nt, Shigella flexneri 2a str. 301
cgcaguguagcguaucugugg

SEQ ID NO: 3935066 - RNA, 17 nt, Shigella flexneri 2a str. 301
cgcaguucgcacaccgc

SEQ ID NO: 3935067 - RNA, 17 nt, Shigella flexneri 2a str. 301
cgcaguugcaguaccag

SEQ ID NO: 3935068 - RNA, 21 nt, Shigella flexneri 2a str. 301
cgcaguuuaucgaccgcuuca

SEQ ID NO: 3935069 - RNA, 15 nt, Shigella flexneri 2a str. 301
cgcauaacagcccgc

SEQ ID NO: 3935070 - RNA, 13 nt, Shigella flexneri 2a str. 301
cgcauaagccacc

SEQ ID NO: 3935071 - RNA, 14 nt, Shigella flexneri 2a str. 301
cgcauaagccaccu

SEQ ID NO: 3935072 - RNA, 15 nt, Shigella flexneri 2a str. 301
cgcauaaugccugau

SEQ ID NO: 3935073 - RNA, 19 nt, Shigella flexneri 2a str. 301
cgcauaaugccugaugcga

SEQ ID NO: 3935074 - RNA, 21 nt, Shigella flexneri 2a str. 301
cgcauaccaaaauccaccagu

SEQ ID NO: 3935075 - RNA, 16 nt, Shigella flexneri 2a str. 301
cgcauaccgugucgga

SEQ ID NO: 3935076 - RNA, 14 nt, Shigella flexneri 2a str. 301
cgcauacgcagcau

SEQ ID NO: 3935077 - RNA, 19 nt, Shigella flexneri 2a str. 301
cgcauaugcuuugccguca

SEQ ID NO: 3935078 - RNA, 15 nt, Shigella flexneri 2a str. 301
cgcaucaggcaaugg

SEQ ID NO: 3935079 - RNA, 14 nt, Shigella flexneri 2a str. 301
cgcaucaggcaauu

SEQ ID NO: 3935080 - RNA, 18 nt, Shigella flexneri 2a str. 301
cgcaucaggcaucugcgc

SEQ ID NO: 3935081 - RNA, 14 nt, Shigella flexneri 2a str. 301
cgcaucaggcauga

SEQ ID NO: 3935082 - RNA, 14 nt, Shigella flexneri 2a str. 301
cgcaucaggcaugg

SEQ ID NO: 3935083 - RNA, 16 nt, Shigella flexneri 2a str. 301
cgcaucagggcgcugg

SEQ ID NO: 3935084 - RNA, 21 nt, Shigella flexneri 2a str. 301
cgcauccgacaaauguguuca

SEQ ID NO: 3935085 - RNA, 16 nt, Shigella flexneri 2a str. 301
cgcauccgacauugaa

SEQ ID NO: 3935086 - RNA, 17 nt, Shigella flexneri 2a str. 301
cgcauccgacauuugca

SEQ ID NO: 3935087 - RNA, 17 nt, Shigella flexneri 2a str. 301
cgcauccgaucgcgcau

SEQ ID NO: 3935088 - RNA, 15 nt, Shigella flexneri 2a str. 301
cgcauccgcuugcgu

SEQ ID NO: 3935089 - RNA, 17 nt, Shigella flexneri 2a str. 301
cgcauccggcaauuggu

SEQ ID NO: 3935090 - RNA, 23 nt, Shigella flexneri 2a str. 301
cgcauccggcauucagugcaaau

SEQ ID NO: 3935091 - RNA, 17 nt, Shigella flexneri 2a str. 301
cgcauccggcauuuuac

SEQ ID NO: 3935092 - RNA, 18 nt, Shigella flexneri 2a str. 301
cgcauccggcauuuugug

SEQ ID NO: 3935093 - RNA, 18 nt, Shigella flexneri 2a str. 301
cgcauccggucacuuuca

SEQ ID NO: 3935094 - RNA, 14 nt, Shigella flexneri 2a str. 301
cgcauccgguuuac

SEQ ID NO: 3935095 - RNA, 18 nt, Shigella flexneri 2a str. 301
cgcauccgucgccgcuuu

SEQ ID NO: 3935096 - RNA, 20 nt, Shigella flexneri 2a str. 301
cgcaucgaauugcgcauccg

SEQ ID NO: 3935097 - RNA, 16 nt, Shigella flexneri 2a str. 301
cgcaucgggcaauggc

SEQ ID NO: 3935098 - RNA, 13 nt, Shigella flexneri 2a str. 301
cgcaucgggcgau

SEQ ID NO: 3935099 - RNA, 19 nt, Shigella flexneri 2a str. 301
cgcaucggucagacccagu

SEQ ID NO: 3935100 - RNA, 20 nt, Shigella flexneri 2a str. 301
cgcaucggucagacccaguu

SEQ ID NO: 3935101 - RNA, 21 nt, Shigella flexneri 2a str. 301
cgcaucugccggaaccagcca

SEQ ID NO: 3935102 - RNA, 15 nt, Shigella flexneri 2a str. 301
cgcaucuucgcccac

SEQ ID NO: 3935103 - RNA, 16 nt, Shigella flexneri 2a str. 301
cgcaugaauuacgcaa

SEQ ID NO: 3935104 - RNA, 21 nt, Shigella flexneri 2a str. 301
cgcaugcauuuucaauaacug

SEQ ID NO: 3935105 - RNA, 16 nt, Shigella flexneri 2a str. 301
cgcauggcauuuugca

SEQ ID NO: 3935106 - RNA, 23 nt, Shigella flexneri 2a str. 301
cgcauggccguuauccugaucaa

SEQ ID NO: 3935107 - RNA, 22 nt, Shigella flexneri 2a str. 301
cgcauggcugcgaaucgcuuca

SEQ ID NO: 3935108 - RNA, 24 nt, Shigella flexneri 2a str. 301
cgcauuaaaaacccgccaugcaug

SEQ ID NO: 3935109 - RNA, 19 nt, Shigella flexneri 2a str. 301
cgcauuaagccaugaauga

SEQ ID NO: 3935110 - RNA, 22 nt, Shigella flexneri 2a str. 301
cgcauuaagccaugaaugaugu

SEQ ID NO: 3935111 - RNA, 17 nt, Shigella flexneri 2a str. 301
cgcauucccagcgcguu

SEQ ID NO: 3935112 - RNA, 23 nt, Shigella flexneri 2a str. 301
cgcauugaacucuucuuccggca

SEQ ID NO: 3935113 - RNA, 16 nt, Shigella flexneri 2a str. 301
cgcauugcucacuucc

SEQ ID NO: 3935114 - RNA, 16 nt, Shigella flexneri 2a str. 301
cgcauuuucuucauuc

SEQ ID NO: 3935115 - RNA, 23 nt, Shigella flexneri 2a str. 301
cgcauuuugacuagcucaauaaa

SEQ ID NO: 3935116 - RNA, 19 nt, Shigella flexneri 2a str. 301
cgcauuuuuucuucaguuc

SEQ ID NO: 3935117 - RNA, 17 nt, Shigella flexneri 2a str. 301
cgccaaaacaucuucgg

SEQ ID NO: 3935118 - RNA, 24 nt, Shigella flexneri 2a str. 301
cgccaaaccacuauuauggcgcag

SEQ ID NO: 3935119 - RNA, 17 nt, Shigella flexneri 2a str. 301
cgccaaagaaaccgcgc

SEQ ID NO: 3935120 - RNA, 20 nt, Shigella flexneri 2a str. 301
cgccaaagaaaccgcgcgau

SEQ ID NO: 3935121 - RNA, 23 nt, Shigella flexneri 2a str. 301
cgccaaaucgauaaaacuucccg

SEQ ID NO: 3935122 - RNA, 19 nt, Shigella flexneri 2a str. 301
cgccaacaaucucuuccag

SEQ ID NO: 3935123 - RNA, 14 nt, Shigella flexneri 2a str. 301
cgccaaccagacga

SEQ ID NO: 3935124 - RNA, 16 nt, Shigella flexneri 2a str. 301
cgccaaccagcugacc

SEQ ID NO: 3935125 - RNA, 18 nt, Shigella flexneri 2a str. 301
cgccaaccaguugcgcaa

SEQ ID NO: 3935126 - RNA, 22 nt, Shigella flexneri 2a str. 301
cgccaaccaguugcgcaauacc

SEQ ID NO: 3935127 - RNA, 22 nt, Shigella flexneri 2a str. 301
cgccaaccgauaucuuuccggc

SEQ ID NO: 3935128 - RNA, 15 nt, Shigella flexneri 2a str. 301
cgccaaccugcuggu

SEQ ID NO: 3935129 - RNA, 21 nt, Shigella flexneri 2a str. 301
cgccaacggugaaaaaccaau

SEQ ID NO: 3935130 - RNA, 17 nt, Shigella flexneri 2a str. 301
cgccaacguucaccacg

SEQ ID NO: 3935131 - RNA, 23 nt, Shigella flexneri 2a str. 301
cgccaacuucaugaccuuccagc

SEQ ID NO: 3935132 - RNA, 13 nt, Shigella flexneri 2a str. 301
cgccaagcagcgc

SEQ ID NO: 3935133 - RNA, 17 nt, Shigella flexneri 2a str. 301
cgccaagcagcgcgcag

SEQ ID NO: 3935134 - RNA, 23 nt, Shigella flexneri 2a str. 301
cgccaagcagcgcgcagaacaua

SEQ ID NO: 3935135 - RNA, 22 nt, Shigella flexneri 2a str. 301
cgccaaguuuuuucuucccaag

SEQ ID NO: 3935136 - RNA, 13 nt, Shigella flexneri 2a str. 301
cgccaauaaucag

SEQ ID NO: 3935137 - RNA, 15 nt, Shigella flexneri 2a str. 301
cgccaauagcuggca

SEQ ID NO: 3935138 - RNA, 18 nt, Shigella flexneri 2a str. 301
cgccaauagcuggcaacg

SEQ ID NO: 3935139 - RNA, 13 nt, Shigella flexneri 2a str. 301
cgccaaucagcgc

SEQ ID NO: 3935140 - RNA, 20 nt, Shigella flexneri 2a str. 301
cgccaaucagcgcagcaccc

SEQ ID NO: 3935141 - RNA, 21 nt, Shigella flexneri 2a str. 301
cgccaaugaccgcgccaucca

SEQ ID NO: 3935142 - RNA, 19 nt, Shigella flexneri 2a str. 301
cgccaauuacgcgcaauac

SEQ ID NO: 3935143 - RNA, 19 nt, Shigella flexneri 2a str. 301
cgccaauucguaaguacau

SEQ ID NO: 3935144 - RNA, 15 nt, Shigella flexneri 2a str. 301
cgccaauuucaucac

SEQ ID NO: 3935145 - RNA, 16 nt, Shigella flexneri 2a str. 301
cgccacaaacgccaga

SEQ ID NO: 3935146 - RNA, 15 nt, Shigella flexneri 2a str. 301
cgccacaaccagcgc

SEQ ID NO: 3935147 - RNA, 19 nt, Shigella flexneri 2a str. 301
cgccacaacuucaacguug

SEQ ID NO: 3935148 - RNA, 18 nt, Shigella flexneri 2a str. 301
cgccacaccacugcgcau

SEQ ID NO: 3935149 - RNA, 13 nt, Shigella flexneri 2a str. 301
cgccacagcaauu

SEQ ID NO: 3935150 - RNA, 23 nt, Shigella flexneri 2a str. 301
cgccacagcauucucggcccggc

SEQ ID NO: 3935151 - RNA, 21 nt, Shigella flexneri 2a str. 301
cgccacagccgagcgccacca

SEQ ID NO: 3935152 - RNA, 17 nt, Shigella flexneri 2a str. 301
cgccacauccggcacaa

SEQ ID NO: 3935153 - RNA, 14 nt, Shigella flexneri 2a str. 301
cgccaccacaacau

SEQ ID NO: 3935154 - RNA, 15 nt, Shigella flexneri 2a str. 301
cgccaccacaacauu

SEQ ID NO: 3935155 - RNA, 16 nt, Shigella flexneri 2a str. 301
cgccaccacaacauuc

SEQ ID NO: 3935156 - RNA, 13 nt, Shigella flexneri 2a str. 301
cgccaccaccagc

SEQ ID NO: 3935157 - RNA, 23 nt, Shigella flexneri 2a str. 301
cgccaccacccugacgaccaccc

SEQ ID NO: 3935158 - RNA, 23 nt, Shigella flexneri 2a str. 301
cgccaccagcgguuuuugcgcca

SEQ ID NO: 3935159 - RNA, 22 nt, Shigella flexneri 2a str. 301
cgccaccaggaacgcgccaaga

SEQ ID NO: 3935160 - RNA, 18 nt, Shigella flexneri 2a str. 301
cgccaccauucccuggcg

SEQ ID NO: 3935161 - RNA, 14 nt, Shigella flexneri 2a str. 301
cgccaccccacgau

SEQ ID NO: 3935162 - RNA, 21 nt, Shigella flexneri 2a str. 301
cgccaccgaccaggcaaacca

SEQ ID NO: 3935163 - RNA, 21 nt, Shigella flexneri 2a str. 301
cgccaccggcuuucgcuucaa

SEQ ID NO: 3935164 - RNA, 19 nt, Shigella flexneri 2a str. 301
cgccaccguguucaugacc

SEQ ID NO: 3935165 - RNA, 18 nt, Shigella flexneri 2a str. 301
cgccaccucuuucaccaa

SEQ ID NO: 3935166 - RNA, 23 nt, Shigella flexneri 2a str. 301
cgccaccuuucucggcaucacgc

SEQ ID NO: 3935167 - RNA, 20 nt, Shigella flexneri 2a str. 301
cgccacgaaauugaggaugc

SEQ ID NO: 3935168 - RNA, 12 nt, Shigella flexneri 2a str. 301
cgccacgacuca

SEQ ID NO: 3935169 - RNA, 22 nt, Shigella flexneri 2a str. 301
cgccacgacucaaaucacgcag

SEQ ID NO: 3935170 - RNA, 17 nt, Shigella flexneri 2a str. 301
cgccacgccgaggccaa

SEQ ID NO: 3935171 - RNA, 19 nt, Shigella flexneri 2a str. 301
cgccacgcucacucaucac

SEQ ID NO: 3935172 - RNA, 16 nt, Shigella flexneri 2a str. 301
cgccacgggcaauaag

SEQ ID NO: 3935173 - RNA, 16 nt, Shigella flexneri 2a str. 301
cgccacuaccaucagg

SEQ ID NO: 3935174 - RNA, 22 nt, Shigella flexneri 2a str. 301
cgccacuaucgccaucaggcag

SEQ ID NO: 3935175 - RNA, 23 nt, Shigella flexneri 2a str. 301
cgccacucucgccccuucuucua

SEQ ID NO: 3935176 - RNA, 18 nt, Shigella flexneri 2a str. 301
cgccacuucccagccuuc

SEQ ID NO: 3935177 - RNA, 22 nt, Shigella flexneri 2a str. 301
cgccacuuuaaauucagcauua

SEQ ID NO: 3935178 - RNA, 16 nt, Shigella flexneri 2a str. 301
cgccacuuucacgccg

SEQ ID NO: 3935179 - RNA, 13 nt, Shigella flexneri 2a str. 301
cgccagaaaucag

SEQ ID NO: 3935180 - RNA, 23 nt, Shigella flexneri 2a str. 301
cgccagaacacgcucccagcaga

SEQ ID NO: 3935181 - RNA, 16 nt, Shigella flexneri 2a str. 301
cgccagaacagcuaca

SEQ ID NO: 3935182 - RNA, 19 nt, Shigella flexneri 2a str. 301
cgccagaagcguucggcaa

SEQ ID NO: 3935183 - RNA, 18 nt, Shigella flexneri 2a str. 301
cgccagacaauugccgcc

SEQ ID NO: 3935184 - RNA, 17 nt, Shigella flexneri 2a str. 301
cgccagaccaauagaaa

SEQ ID NO: 3935185 - RNA, 16 nt, Shigella flexneri 2a str. 301
cgccagacccagacgc

SEQ ID NO: 3935186 - RNA, 17 nt, Shigella flexneri 2a str. 301
cgccagaccgcagaagc

SEQ ID NO: 3935187 - RNA, 12 nt, Shigella flexneri 2a str. 301
cgccagaccuga

SEQ ID NO: 3935188 - RNA, 21 nt, Shigella flexneri 2a str. 301
cgccagacugaucaucgccca

SEQ ID NO: 3935189 - RNA, 22 nt, Shigella flexneri 2a str. 301
cgccagacugcgcuaccaggaa

SEQ ID NO: 3935190 - RNA, 17 nt, Shigella flexneri 2a str. 301
cgccagaggcgacaaac

SEQ ID NO: 3935191 - RNA, 21 nt, Shigella flexneri 2a str. 301
cgccagauaugaucgaaaaug

SEQ ID NO: 3935192 - RNA, 11 nt, Shigella flexneri 2a str. 301
cgccagaucag

SEQ ID NO: 3935193 - RNA, 21 nt, Shigella flexneri 2a str. 301
cgccagcaaaaucaccaucac

SEQ ID NO: 3935194 - RNA, 20 nt, Shigella flexneri 2a str. 301
cgccagcaagagcaaauaaa

SEQ ID NO: 3935195 - RNA, 16 nt, Shigella flexneri 2a str. 301
cgccagcacaucaucc

SEQ ID NO: 3935196 - RNA, 11 nt, Shigella flexneri 2a str. 301
cgccagcaccg

SEQ ID NO: 3935197 - RNA, 13 nt, Shigella flexneri 2a str. 301
cgccagcagaguu

SEQ ID NO: 3935198 - RNA, 15 nt, Shigella flexneri 2a str. 301
cgccagcagccauuc

SEQ ID NO: 3935199 - RNA, 19 nt, Shigella flexneri 2a str. 301
cgccagcagggcaaacagc

SEQ ID NO: 3935200 - RNA, 15 nt, Shigella flexneri 2a str. 301
cgccagcaucgcauc

SEQ ID NO: 3935201 - RNA, 20 nt, Shigella flexneri 2a str. 301
cgccagcaucggcagcgcca

SEQ ID NO: 3935202 - RNA, 18 nt, Shigella flexneri 2a str. 301
cgccagcauucccgccag

SEQ ID NO: 3935203 - RNA, 19 nt, Shigella flexneri 2a str. 301
cgccagcauucccgccagc

SEQ ID NO: 3935204 - RNA, 21 nt, Shigella flexneri 2a str. 301
cgccagccaccacaauugacc

SEQ ID NO: 3935205 - RNA, 14 nt, Shigella flexneri 2a str. 301
cgccagccgaugca

SEQ ID NO: 3935206 - RNA, 14 nt, Shigella flexneri 2a str. 301
cgccagccgcaguu

SEQ ID NO: 3935207 - RNA, 20 nt, Shigella flexneri 2a str. 301
cgccagcgaaccaccaaacu

SEQ ID NO: 3935208 - RNA, 16 nt, Shigella flexneri 2a str. 301
cgccagcgaauuccag

SEQ ID NO: 3935209 - RNA, 22 nt, Shigella flexneri 2a str. 301
cgccagcgaauuccaguugauu

SEQ ID NO: 3935210 - RNA, 22 nt, Shigella flexneri 2a str. 301
cgccagcgaucuuucgcggcag

SEQ ID NO: 3935211 - RNA, 11 nt, Shigella flexneri 2a str. 301
cgccagcgcca

SEQ ID NO: 3935212 - RNA, 13 nt, Shigella flexneri 2a str. 301
cgccagcgcgcgu

SEQ ID NO: 3935213 - RNA, 14 nt, Shigella flexneri 2a str. 301
cgccagcgcgcguu

SEQ ID NO: 3935214 - RNA, 23 nt, Shigella flexneri 2a str. 301
cgccagcggagaaacuucugccg

SEQ ID NO: 3935215 - RNA, 13 nt, Shigella flexneri 2a str. 301
cgccagcggcagc

SEQ ID NO: 3935216 - RNA, 14 nt, Shigella flexneri 2a str. 301
cgccagcggcagcu

SEQ ID NO: 3935217 - RNA, 17 nt, Shigella flexneri 2a str. 301
cgccagcggcagcucgc

SEQ ID NO: 3935218 - RNA, 17 nt, Shigella flexneri 2a str. 301
cgccagcggcccggaga

SEQ ID NO: 3935219 - RNA, 14 nt, Shigella flexneri 2a str. 301
cgccagcggcggca

SEQ ID NO: 3935220 - RNA, 18 nt, Shigella flexneri 2a str. 301
cgccagcguagucggcag

SEQ ID NO: 3935221 - RNA, 17 nt, Shigella flexneri 2a str. 301
cgccagcgucucuucaa

SEQ ID NO: 3935222 - RNA, 19 nt, Shigella flexneri 2a str. 301
cgccagcgucucuucaauu

SEQ ID NO: 3935223 - RNA, 14 nt, Shigella flexneri 2a str. 301
cgccagcgugguca

SEQ ID NO: 3935224 - RNA, 18 nt, Shigella flexneri 2a str. 301
cgccagcguuaucccauc

SEQ ID NO: 3935225 - RNA, 13 nt, Shigella flexneri 2a str. 301
cgccagcguugau

SEQ ID NO: 3935226 - RNA, 21 nt, Shigella flexneri 2a str. 301
cgccagcguugauguuccucc

SEQ ID NO: 3935227 - RNA, 18 nt, Shigella flexneri 2a str. 301
cgccagcucacgggcggc

SEQ ID NO: 3935228 - RNA, 22 nt, Shigella flexneri 2a str. 301
cgccagcucacgggcggcaggu

SEQ ID NO: 3935229 - RNA, 18 nt, Shigella flexneri 2a str. 301
cgccagcuugccgcgcuc

SEQ ID NO: 3935230 - RNA, 19 nt, Shigella flexneri 2a str. 301
cgccaggagacgcgcaaau

SEQ ID NO: 3935231 - RNA, 20 nt, Shigella flexneri 2a str. 301
cgccaggagacgcgcaaauc

SEQ ID NO: 3935232 - RNA, 19 nt, Shigella flexneri 2a str. 301
cgccaggcaccgcacuggc

SEQ ID NO: 3935233 - RNA, 14 nt, Shigella flexneri 2a str. 301
cgccaggccagccu

SEQ ID NO: 3935234 - RNA, 16 nt, Shigella flexneri 2a str. 301
cgccaggccagccugg

SEQ ID NO: 3935235 - RNA, 14 nt, Shigella flexneri 2a str. 301
cgccaggcgcugau

SEQ ID NO: 3935236 - RNA, 16 nt, Shigella flexneri 2a str. 301
cgccagggccgcgaau

SEQ ID NO: 3935237 - RNA, 19 nt, Shigella flexneri 2a str. 301
cgccagguaacgaagaugg

SEQ ID NO: 3935238 - RNA, 18 nt, Shigella flexneri 2a str. 301
cgccaggucagagagcca

SEQ ID NO: 3935239 - RNA, 22 nt, Shigella flexneri 2a str. 301
cgccaggucagagagccagccc

SEQ ID NO: 3935240 - RNA, 20 nt, Shigella flexneri 2a str. 301
cgccaggugaaauccggcau

SEQ ID NO: 3935241 - RNA, 15 nt, Shigella flexneri 2a str. 301
cgccagguuucaaua

SEQ ID NO: 3935242 - RNA, 17 nt, Shigella flexneri 2a str. 301
cgccaguaugaggcaaa

SEQ ID NO: 3935243 - RNA, 22 nt, Shigella flexneri 2a str. 301
cgccagugauugcuugccccuu

SEQ ID NO: 3935244 - RNA, 15 nt, Shigella flexneri 2a str. 301
cgccagugccaaagc

SEQ ID NO: 3935245 - RNA, 19 nt, Shigella flexneri 2a str. 301
cgccagugccgcccaccac

SEQ ID NO: 3935246 - RNA, 15 nt, Shigella flexneri 2a str. 301
cgccagugcgcccca

SEQ ID NO: 3935247 - RNA, 19 nt, Shigella flexneri 2a str. 301
cgccaguguuggcgucaga

SEQ ID NO: 3935248 - RNA, 15 nt, Shigella flexneri 2a str. 301
cgccaguuacugcca

SEQ ID NO: 3935249 - RNA, 20 nt, Shigella flexneri 2a str. 301
cgccaguuacugccaccauc

SEQ ID NO: 3935250 - RNA, 20 nt, Shigella flexneri 2a str. 301
cgccaguuacugcugacgcu

SEQ ID NO: 3935251 - RNA, 19 nt, Shigella flexneri 2a str. 301
cgccaguucuuccaguucc

SEQ ID NO: 3935252 - RNA, 23 nt, Shigella flexneri 2a str. 301
cgccaguucuuccaguuccggca

SEQ ID NO: 3935253 - RNA, 14 nt, Shigella flexneri 2a str. 301
cgccaguugcggcu

SEQ ID NO: 3935254 - RNA, 11 nt, Shigella flexneri 2a str. 301
cgccaguuuac

SEQ ID NO: 3935255 - RNA, 20 nt, Shigella flexneri 2a str. 301
cgccaguuuacugucugcuu

SEQ ID NO: 3935256 - RNA, 21 nt, Shigella flexneri 2a str. 301
cgccaguuuacugucugcuuc

SEQ ID NO: 3935257 - RNA, 20 nt, Shigella flexneri 2a str. 301
cgccaguuuggucuggcaaa

SEQ ID NO: 3935258 - RNA, 16 nt, Shigella flexneri 2a str. 301
cgccaguuuuuauacu

SEQ ID NO: 3935259 - RNA, 17 nt, Shigella flexneri 2a str. 301
cgccauaaacagcaggc

SEQ ID NO: 3935260 - RNA, 16 nt, Shigella flexneri 2a str. 301
cgccauaucauucgac

SEQ ID NO: 3935261 - RNA, 13 nt, Shigella flexneri 2a str. 301
cgccauaucggca

SEQ ID NO: 3935262 - RNA, 17 nt, Shigella flexneri 2a str. 301
cgccaucaaugugcuga

SEQ ID NO: 3935263 - RNA, 13 nt, Shigella flexneri 2a str. 301
cgccaucaggcag

SEQ ID NO: 3935264 - RNA, 15 nt, Shigella flexneri 2a str. 301
cgccauccagccggg

SEQ ID NO: 3935265 - RNA, 21 nt, Shigella flexneri 2a str. 301
cgccaucccuaccgcccgcgc

SEQ ID NO: 3935266 - RNA, 12 nt, Shigella flexneri 2a str. 301
cgccauccggca

SEQ ID NO: 3935267 - RNA, 13 nt, Shigella flexneri 2a str. 301
cgccauccggcgu

SEQ ID NO: 3935268 - RNA, 14 nt, Shigella flexneri 2a str. 301
cgccauccuuacgc

SEQ ID NO: 3935269 - RNA, 16 nt, Shigella flexneri 2a str. 301
cgccaucgccagcagc

SEQ ID NO: 3935270 - RNA, 14 nt, Shigella flexneri 2a str. 301
cgccaucgccagga

SEQ ID NO: 3935271 - RNA, 15 nt, Shigella flexneri 2a str. 301
cgccaucgcccaucc

SEQ ID NO: 3935272 - RNA, 18 nt, Shigella flexneri 2a str. 301
cgccaucggcagcaucgc

SEQ ID NO: 3935273 - RNA, 19 nt, Shigella flexneri 2a str. 301
cgccaucugccgauacgcu

SEQ ID NO: 3935274 - RNA, 16 nt, Shigella flexneri 2a str. 301
cgccaucuggcugacg

SEQ ID NO: 3935275 - RNA, 16 nt, Shigella flexneri 2a str. 301
cgccauguugccuggg

SEQ ID NO: 3935276 - RNA, 19 nt, Shigella flexneri 2a str. 301
cgccauguugccuggggag

SEQ ID NO: 3935277 - RNA, 21 nt, Shigella flexneri 2a str. 301
cgccauuaaacaacccaagcg

SEQ ID NO: 3935278 - RNA, 17 nt, Shigella flexneri 2a str. 301
cgccauugaaaccgcug

SEQ ID NO: 3935279 - RNA, 14 nt, Shigella flexneri 2a str. 301
cgccauuucuccuc

SEQ ID NO: 3935280 - RNA, 20 nt, Shigella flexneri 2a str. 301
cgcccaaaccacccagcagc

SEQ ID NO: 3935281 - RNA, 13 nt, Shigella flexneri 2a str. 301
cgcccaacacuuc

SEQ ID NO: 3935282 - RNA, 13 nt, Shigella flexneri 2a str. 301
cgcccaauauccu

SEQ ID NO: 3935283 - RNA, 19 nt, Shigella flexneri 2a str. 301
cgcccacgccagccugcuu

SEQ ID NO: 3935284 - RNA, 22 nt, Shigella flexneri 2a str. 301
cgcccacgcgcauucccagcgc

SEQ ID NO: 3935285 - RNA, 24 nt, Shigella flexneri 2a str. 301
cgcccacgcgcauucccagcgcgu

SEQ ID NO: 3935286 - RNA, 16 nt, Shigella flexneri 2a str. 301
cgcccagaccagaaug

SEQ ID NO: 3935287 - RNA, 13 nt, Shigella flexneri 2a str. 301
cgcccagcgcagg

SEQ ID NO: 3935288 - RNA, 18 nt, Shigella flexneri 2a str. 301
cgcccagcgcaggaaaga

SEQ ID NO: 3935289 - RNA, 20 nt, Shigella flexneri 2a str. 301
cgcccagcguacguaacuuc

SEQ ID NO: 3935290 - RNA, 21 nt, Shigella flexneri 2a str. 301
cgcccagcguacguaacuucu

SEQ ID NO: 3935291 - RNA, 18 nt, Shigella flexneri 2a str. 301
cgcccagcuaaucgagcc

SEQ ID NO: 3935292 - RNA, 12 nt, Shigella flexneri 2a str. 301
cgcccagugcgg

SEQ ID NO: 3935293 - RNA, 20 nt, Shigella flexneri 2a str. 301
cgcccagugcggugccgcga

SEQ ID NO: 3935294 - RNA, 17 nt, Shigella flexneri 2a str. 301
cgcccaguggaugcgcc

SEQ ID NO: 3935295 - RNA, 15 nt, Shigella flexneri 2a str. 301
cgcccaguucuacaa

SEQ ID NO: 3935296 - RNA, 18 nt, Shigella flexneri 2a str. 301
cgcccaguugaucaccag

SEQ ID NO: 3935297 - RNA, 12 nt, Shigella flexneri 2a str. 301
cgcccaucauuc

SEQ ID NO: 3935298 - RNA, 13 nt, Shigella flexneri 2a str. 301
cgcccauugagcc

SEQ ID NO: 3935299 - RNA, 13 nt, Shigella flexneri 2a str. 301
cgccccaacacaa

SEQ ID NO: 3935300 - RNA, 21 nt, Shigella flexneri 2a str. 301
cgccccagaccugaauuugcu

SEQ ID NO: 3935301 - RNA, 14 nt, Shigella flexneri 2a str. 301
cgcccccacaacag

SEQ ID NO: 3935302 - RNA, 18 nt, Shigella flexneri 2a str. 301
cgcccccgggccuccccg

SEQ ID NO: 3935303 - RNA, 15 nt, Shigella flexneri 2a str. 301
cgccccgcucacgca

SEQ ID NO: 3935304 - RNA, 13 nt, Shigella flexneri 2a str. 301
cgccccgcucgcu

SEQ ID NO: 3935305 - RNA, 19 nt, Shigella flexneri 2a str. 301
cgccccggcucgcgaccuc

SEQ ID NO: 3935306 - RNA, 19 nt, Shigella flexneri 2a str. 301
cgccccggcuggcugaccg

SEQ ID NO: 3935307 - RNA, 15 nt, Shigella flexneri 2a str. 301
cgccccgugaugaac

SEQ ID NO: 3935308 - RNA, 11 nt, Shigella flexneri 2a str. 301
cgccccugaca

SEQ ID NO: 3935309 - RNA, 20 nt, Shigella flexneri 2a str. 301
cgccccuucuucuacugcgc

SEQ ID NO: 3935310 - RNA, 22 nt, Shigella flexneri 2a str. 301
cgcccgaaugcgaaaauccuca

SEQ ID NO: 3935311 - RNA, 21 nt, Shigella flexneri 2a str. 301
cgcccgaauugaagccaaauc

SEQ ID NO: 3935312 - RNA, 22 nt, Shigella flexneri 2a str. 301
cgcccgaugcauaauccgccgc

SEQ ID NO: 3935313 - RNA, 11 nt, Shigella flexneri 2a str. 301
cgcccgccaga

SEQ ID NO: 3935314 - RNA, 14 nt, Shigella flexneri 2a str. 301
cgcccgccgccauu

SEQ ID NO: 3935315 - RNA, 15 nt, Shigella flexneri 2a str. 301
cgcccgcgcagcugg

SEQ ID NO: 3935316 - RNA, 13 nt, Shigella flexneri 2a str. 301
cgcccgcuugcga

SEQ ID NO: 3935317 - RNA, 18 nt, Shigella flexneri 2a str. 301
cgcccggaaacgggcgcu

SEQ ID NO: 3935318 - RNA, 20 nt, Shigella flexneri 2a str. 301
cgcccggaaacgggcgcuga

SEQ ID NO: 3935319 - RNA, 22 nt, Shigella flexneri 2a str. 301
cgcccggaauuucaaugcgcgu

SEQ ID NO: 3935320 - RNA, 14 nt, Shigella flexneri 2a str. 301
cgcccggauuacag

SEQ ID NO: 3935321 - RNA, 14 nt, Shigella flexneri 2a str. 301
cgcccgucaacggu

SEQ ID NO: 3935322 - RNA, 16 nt, Shigella flexneri 2a str. 301
cgcccguuaaccgcuc

SEQ ID NO: 3935323 - RNA, 21 nt, Shigella flexneri 2a str. 301
cgcccguuuucuccagcgccg

SEQ ID NO: 3935324 - RNA, 22 nt, Shigella flexneri 2a str. 301
cgcccugauaaaucaccugcgc

SEQ ID NO: 3935325 - RNA, 15 nt, Shigella flexneri 2a str. 301
cgcccugcagcauca

SEQ ID NO: 3935326 - RNA, 12 nt, Shigella flexneri 2a str. 301
cgcccugccuuu

SEQ ID NO: 3935327 - RNA, 16 nt, Shigella flexneri 2a str. 301
cgcccugcggcugacc

SEQ ID NO: 3935328 - RNA, 20 nt, Shigella flexneri 2a str. 301
cgcccugcgucgcacucuca

SEQ ID NO: 3935329 - RNA, 13 nt, Shigella flexneri 2a str. 301
cgcccugcuccag

SEQ ID NO: 3935330 - RNA, 15 nt, Shigella flexneri 2a str. 301
cgcccuggaagaaaa

SEQ ID NO: 3935331 - RNA, 18 nt, Shigella flexneri 2a str. 301
cgcccuggguaccgagaa

SEQ ID NO: 3935332 - RNA, 23 nt, Shigella flexneri 2a str. 301
cgcccuucacccauugccgccuc

SEQ ID NO: 3935333 - RNA, 18 nt, Shigella flexneri 2a str. 301
cgcccuucggcaucacga

SEQ ID NO: 3935334 - RNA, 17 nt, Shigella flexneri 2a str. 301
cgccgaaaccgcgcagc

SEQ ID NO: 3935335 - RNA, 17 nt, Shigella flexneri 2a str. 301
cgccgaauaacgcgcag

SEQ ID NO: 3935336 - RNA, 16 nt, Shigella flexneri 2a str. 301
cgccgacaaagaugca

SEQ ID NO: 3935337 - RNA, 21 nt, Shigella flexneri 2a str. 301
cgccgacggucaggcuaauac

SEQ ID NO: 3935338 - RNA, 16 nt, Shigella flexneri 2a str. 301
cgccgagcaaaccaca

SEQ ID NO: 3935339 - RNA, 16 nt, Shigella flexneri 2a str. 301
cgccgagcaaugagcu

SEQ ID NO: 3935340 - RNA, 15 nt, Shigella flexneri 2a str. 301
cgccgagcaccacgu

SEQ ID NO: 3935341 - RNA, 19 nt, Shigella flexneri 2a str. 301
cgccgagcaguugcuucau

SEQ ID NO: 3935342 - RNA, 16 nt, Shigella flexneri 2a str. 301
cgccgagcgccagcca

SEQ ID NO: 3935343 - RNA, 12 nt, Shigella flexneri 2a str. 301
cgccgagcugga

SEQ ID NO: 3935344 - RNA, 21 nt, Shigella flexneri 2a str. 301
cgccgaggauacagccgaagc

SEQ ID NO: 3935345 - RNA, 14 nt, Shigella flexneri 2a str. 301
cgccgaggcgcugg

SEQ ID NO: 3935346 - RNA, 13 nt, Shigella flexneri 2a str. 301
cgccgcaaaucgu

SEQ ID NO: 3935347 - RNA, 20 nt, Shigella flexneri 2a str. 301
cgccgcaaccguaguggcca

SEQ ID NO: 3935348 - RNA, 20 nt, Shigella flexneri 2a str. 301
cgccgcacaauacauagaaa

SEQ ID NO: 3935349 - RNA, 12 nt, Shigella flexneri 2a str. 301
cgccgcacacgc

SEQ ID NO: 3935350 - RNA, 19 nt, Shigella flexneri 2a str. 301
cgccgcacuuucuccuccc

SEQ ID NO: 3935351 - RNA, 22 nt, Shigella flexneri 2a str. 301
cgccgcauagcgacaggcuuuc

SEQ ID NO: 3935352 - RNA, 19 nt, Shigella flexneri 2a str. 301
cgccgcauccgacacuggc

SEQ ID NO: 3935353 - RNA, 20 nt, Shigella flexneri 2a str. 301
cgccgcaucguccugcgcag

SEQ ID NO: 3935354 - RNA, 14 nt, Shigella flexneri 2a str. 301
cgccgcaucuuccc

SEQ ID NO: 3935355 - RNA, 17 nt, Shigella flexneri 2a str. 301
cgccgccaaucacgccc

SEQ ID NO: 3935356 - RNA, 13 nt, Shigella flexneri 2a str. 301
cgccgccacacgc

SEQ ID NO: 3935357 - RNA, 14 nt, Shigella flexneri 2a str. 301
cgccgccacugcaa

SEQ ID NO: 3935358 - RNA, 15 nt, Shigella flexneri 2a str. 301
cgccgccacugccac

SEQ ID NO: 3935359 - RNA, 15 nt, Shigella flexneri 2a str. 301
cgccgccagcaacau

SEQ ID NO: 3935360 - RNA, 23 nt, Shigella flexneri 2a str. 301
cgccgccagucgaauggcaucua

SEQ ID NO: 3935361 - RNA, 13 nt, Shigella flexneri 2a str. 301
cgccgcccagaga

SEQ ID NO: 3935362 - RNA, 17 nt, Shigella flexneri 2a str. 301
cgccgcccugcagcauc

SEQ ID NO: 3935363 - RNA, 22 nt, Shigella flexneri 2a str. 301
cgccgccguuagcuucagccgg

SEQ ID NO: 3935364 - RNA, 19 nt, Shigella flexneri 2a str. 301
cgccgccuuuuacgcauuc

SEQ ID NO: 3935365 - RNA, 15 nt, Shigella flexneri 2a str. 301
cgccgcgacacaacg

SEQ ID NO: 3935366 - RNA, 15 nt, Shigella flexneri 2a str. 301
cgccgcguguucacg

SEQ ID NO: 3935367 - RNA, 15 nt, Shigella flexneri 2a str. 301
cgccgcuaucggcaa

SEQ ID NO: 3935368 - RNA, 16 nt, Shigella flexneri 2a str. 301
cgccgcuauuauaucg

SEQ ID NO: 3935369 - RNA, 19 nt, Shigella flexneri 2a str. 301
cgccgcugucuaccagcac

SEQ ID NO: 3935370 - RNA, 20 nt, Shigella flexneri 2a str. 301
cgccgcuucuggcggcggca

SEQ ID NO: 3935371 - RNA, 23 nt, Shigella flexneri 2a str. 301
cgccgcuucuguuuuaccugcgc

SEQ ID NO: 3935372 - RNA, 16 nt, Shigella flexneri 2a str. 301
cgccgcuuucgucugg

SEQ ID NO: 3935373 - RNA, 18 nt, Shigella flexneri 2a str. 301
cgccggaaauaucaaccg

SEQ ID NO: 3935374 - RNA, 18 nt, Shigella flexneri 2a str. 301
cgccggaugacacaucac

SEQ ID NO: 3935375 - RNA, 23 nt, Shigella flexneri 2a str. 301
cgccggaugacacaucaccucca

SEQ ID NO: 3935376 - RNA, 14 nt, Shigella flexneri 2a str. 301
cgccggauuaugug

SEQ ID NO: 3935377 - RNA, 18 nt, Shigella flexneri 2a str. 301
cgccgggaaauuuuuccg

SEQ ID NO: 3935378 - RNA, 14 nt, Shigella flexneri 2a str. 301
cgccgggguuaugu

SEQ ID NO: 3935379 - RNA, 16 nt, Shigella flexneri 2a str. 301
cgccggguucgacgcg

SEQ ID NO: 3935380 - RNA, 18 nt, Shigella flexneri 2a str. 301
cgccggucaacgcgcggc

SEQ ID NO: 3935381 - RNA, 19 nt, Shigella flexneri 2a str. 301
cgccggucaacgcgcggcu

SEQ ID NO: 3935382 - RNA, 14 nt, Shigella flexneri 2a str. 301
cgccggucacgccc

SEQ ID NO: 3935383 - RNA, 23 nt, Shigella flexneri 2a str. 301
cgccggugauuacaucgcgaaga

SEQ ID NO: 3935384 - RNA, 21 nt, Shigella flexneri 2a str. 301
cgccggugguugccggucugg

SEQ ID NO: 3935385 - RNA, 16 nt, Shigella flexneri 2a str. 301
cgccgguuccagcuuc

SEQ ID NO: 3935386 - RNA, 17 nt, Shigella flexneri 2a str. 301
cgccgguuccagcuuca

SEQ ID NO: 3935387 - RNA, 19 nt, Shigella flexneri 2a str. 301
cgccgguugccccgcacgc

SEQ ID NO: 3935388 - RNA, 16 nt, Shigella flexneri 2a str. 301
cgccguaaaucccgcc

SEQ ID NO: 3935389 - RNA, 14 nt, Shigella flexneri 2a str. 301
cgccguaagcgcgg

SEQ ID NO: 3935390 - RNA, 20 nt, Shigella flexneri 2a str. 301
cgccguaccgggugcagcgg

SEQ ID NO: 3935391 - RNA, 20 nt, Shigella flexneri 2a str. 301
cgccgucaucacgcaggcug

SEQ ID NO: 3935392 - RNA, 15 nt, Shigella flexneri 2a str. 301
cgccgucuuccccuc

SEQ ID NO: 3935393 - RNA, 14 nt, Shigella flexneri 2a str. 301
cgccgugaacgugg

SEQ ID NO: 3935394 - RNA, 20 nt, Shigella flexneri 2a str. 301
cgccgugcaacugcggcgca

SEQ ID NO: 3935395 - RNA, 18 nt, Shigella flexneri 2a str. 301
cgccgugcacaccgaaga

SEQ ID NO: 3935396 - RNA, 21 nt, Shigella flexneri 2a str. 301
cgccgugcacuucugcgguga

SEQ ID NO: 3935397 - RNA, 20 nt, Shigella flexneri 2a str. 301
cgccguuagcuucagccggg

SEQ ID NO: 3935398 - RNA, 22 nt, Shigella flexneri 2a str. 301
cgccguuagcuucagccgggaa

SEQ ID NO: 3935399 - RNA, 15 nt, Shigella flexneri 2a str. 301
cgccguugccgcagc

SEQ ID NO: 3935400 - RNA, 20 nt, Shigella flexneri 2a str. 301
cgccguuuuuacccagcagc

SEQ ID NO: 3935401 - RNA, 15 nt, Shigella flexneri 2a str. 301
cgccuaaauccgcca

SEQ ID NO: 3935402 - RNA, 15 nt, Shigella flexneri 2a str. 301
cgccuacggcauucu

SEQ ID NO: 3935403 - RNA, 17 nt, Shigella flexneri 2a str. 301
cgccuacggcauucugc

SEQ ID NO: 3935404 - RNA, 20 nt, Shigella flexneri 2a str. 301
cgccucaacgccuaaugcca

SEQ ID NO: 3935405 - RNA, 15 nt, Shigella flexneri 2a str. 301
cgccucacagggcuc

SEQ ID NO: 3935406 - RNA, 13 nt, Shigella flexneri 2a str. 301
cgccucagccaga

SEQ ID NO: 3935407 - RNA, 16 nt, Shigella flexneri 2a str. 301
cgccucccuucgcugc

SEQ ID NO: 3935408 - RNA, 14 nt, Shigella flexneri 2a str. 301
cgccuccuguucug

SEQ ID NO: 3935409 - RNA, 17 nt, Shigella flexneri 2a str. 301
cgccuccuguucugcgc

SEQ ID NO: 3935410 - RNA, 17 nt, Shigella flexneri 2a str. 301
cgccuccuguucugugc

SEQ ID NO: 3935411 - RNA, 16 nt, Shigella flexneri 2a str. 301
cgccucgccgcugccu

SEQ ID NO: 3935412 - RNA, 17 nt, Shigella flexneri 2a str. 301
cgccucgcguccgcguc

SEQ ID NO: 3935413 - RNA, 24 nt, Shigella flexneri 2a str. 301
cgccucguaaugcuccggcuccgc

SEQ ID NO: 3935414 - RNA, 22 nt, Shigella flexneri 2a str. 301
cgccucuaacagaucauccauc

SEQ ID NO: 3935415 - RNA, 23 nt, Shigella flexneri 2a str. 301
cgccucugcaagguucuuugcug

SEQ ID NO: 3935416 - RNA, 14 nt, Shigella flexneri 2a str. 301
cgccugaauuacug

SEQ ID NO: 3935417 - RNA, 17 nt, Shigella flexneri 2a str. 301
cgccugauagcccgcac

SEQ ID NO: 3935418 - RNA, 15 nt, Shigella flexneri 2a str. 301
cgccugauucaauga

SEQ ID NO: 3935419 - RNA, 20 nt, Shigella flexneri 2a str. 301
cgccugcaccauugcugccg

SEQ ID NO: 3935420 - RNA, 14 nt, Shigella flexneri 2a str. 301
cgccugcauacguu

SEQ ID NO: 3935421 - RNA, 15 nt, Shigella flexneri 2a str. 301
cgccugccgccagca

SEQ ID NO: 3935422 - RNA, 14 nt, Shigella flexneri 2a str. 301
cgccugcggccagc

SEQ ID NO: 3935423 - RNA, 16 nt, Shigella flexneri 2a str. 301
cgccugcggccagcag

SEQ ID NO: 3935424 - RNA, 17 nt, Shigella flexneri 2a str. 301
cgccugcggccagcagc

SEQ ID NO: 3935425 - RNA, 15 nt, Shigella flexneri 2a str. 301
cgccuggaccagcgg

SEQ ID NO: 3935426 - RNA, 11 nt, Shigella flexneri 2a str. 301
cgccuggcagu

SEQ ID NO: 3935427 - RNA, 15 nt, Shigella flexneri 2a str. 301
cgccugggaaguuaa

SEQ ID NO: 3935428 - RNA, 16 nt, Shigella flexneri 2a str. 301
cgccugguaccagcac

SEQ ID NO: 3935429 - RNA, 17 nt, Shigella flexneri 2a str. 301
cgccugguaccagcacc

SEQ ID NO: 3935430 - RNA, 17 nt, Shigella flexneri 2a str. 301
cgccugucaccgccucc

SEQ ID NO: 3935431 - RNA, 16 nt, Shigella flexneri 2a str. 301
cgccuguguccuguug

SEQ ID NO: 3935432 - RNA, 14 nt, Shigella flexneri 2a str. 301
cgccuguuccagca

SEQ ID NO: 3935433 - RNA, 17 nt, Shigella flexneri 2a str. 301
cgccuguucccuucuca

SEQ ID NO: 3935434 - RNA, 18 nt, Shigella flexneri 2a str. 301
cgccuuacgcugcggucg

SEQ ID NO: 3935435 - RNA, 14 nt, Shigella flexneri 2a str. 301
cgccuuauccggcu

SEQ ID NO: 3935436 - RNA, 13 nt, Shigella flexneri 2a str. 301
cgccuucaugcca

SEQ ID NO: 3935437 - RNA, 13 nt, Shigella flexneri 2a str. 301
cgccuucauucag

SEQ ID NO: 3935438 - RNA, 17 nt, Shigella flexneri 2a str. 301
cgccuucauucaggcca

SEQ ID NO: 3935439 - RNA, 23 nt, Shigella flexneri 2a str. 301
cgccuuccacuucugcgucgaua

SEQ ID NO: 3935440 - RNA, 16 nt, Shigella flexneri 2a str. 301
cgccuucuacagcuuc

SEQ ID NO: 3935441 - RNA, 12 nt, Shigella flexneri 2a str. 301
cgccuucugcgc

SEQ ID NO: 3935442 - RNA, 17 nt, Shigella flexneri 2a str. 301
cgccuucugcgccgccu

SEQ ID NO: 3935443 - RNA, 13 nt, Shigella flexneri 2a str. 301
cgccuucuugaac

SEQ ID NO: 3935444 - RNA, 23 nt, Shigella flexneri 2a str. 301
cgccuuguuaccugaugcagcgu

SEQ ID NO: 3935445 - RNA, 17 nt, Shigella flexneri 2a str. 301
cgccuuguuccugcuug

SEQ ID NO: 3935446 - RNA, 20 nt, Shigella flexneri 2a str. 301
cgccuuuaaaucccgcuuca

SEQ ID NO: 3935447 - RNA, 22 nt, Shigella flexneri 2a str. 301
cgccuuuaauauuaacgccagc

SEQ ID NO: 3935448 - RNA, 23 nt, Shigella flexneri 2a str. 301
cgccuuucugcaaugcugcgauc

SEQ ID NO: 3935449 - RNA, 14 nt, Shigella flexneri 2a str. 301
cgccuuucuuaaac

SEQ ID NO: 3935450 - RNA, 19 nt, Shigella flexneri 2a str. 301
cgccuuucuuaaacuucac

SEQ ID NO: 3935451 - RNA, 15 nt, Shigella flexneri 2a str. 301
cgccuuuuacgcauu

SEQ ID NO: 3935452 - RNA, 17 nt, Shigella flexneri 2a str. 301
cgccuuuuacgcauucg

SEQ ID NO: 3935453 - RNA, 19 nt, Shigella flexneri 2a str. 301
cgccuuuuuucgccgcagc

SEQ ID NO: 3935454 - RNA, 15 nt, Shigella flexneri 2a str. 301
cgcgaaagaggcgca

SEQ ID NO: 3935455 - RNA, 19 nt, Shigella flexneri 2a str. 301
cgcgaaauaaucaaaugaa

SEQ ID NO: 3935456 - RNA, 22 nt, Shigella flexneri 2a str. 301
cgcgaaaugcagcguuuccagc

SEQ ID NO: 3935457 - RNA, 18 nt, Shigella flexneri 2a str. 301
cgcgaacagcacaucagc

SEQ ID NO: 3935458 - RNA, 13 nt, Shigella flexneri 2a str. 301
cgcgaacuggaug

SEQ ID NO: 3935459 - RNA, 14 nt, Shigella flexneri 2a str. 301
cgcgaacuggauga

SEQ ID NO: 3935460 - RNA, 13 nt, Shigella flexneri 2a str. 301
cgcgaagaaacga

SEQ ID NO: 3935461 - RNA, 16 nt, Shigella flexneri 2a str. 301
cgcgaauaguuuccgc

SEQ ID NO: 3935462 - RNA, 20 nt, Shigella flexneri 2a str. 301
cgcgacacaauccaugccaa

SEQ ID NO: 3935463 - RNA, 21 nt, Shigella flexneri 2a str. 301
cgcgacauggcgaaaauuggu

SEQ ID NO: 3935464 - RNA, 11 nt, Shigella flexneri 2a str. 301
cgcgaccacca

SEQ ID NO: 3935465 - RNA, 13 nt, Shigella flexneri 2a str. 301
cgcgaccaccagc

SEQ ID NO: 3935466 - RNA, 12 nt, Shigella flexneri 2a str. 301
cgcgaccagcgu

SEQ ID NO: 3935467 - RNA, 23 nt, Shigella flexneri 2a str. 301
cgcgaccagcgucgcaucaggca

SEQ ID NO: 3935468 - RNA, 20 nt, Shigella flexneri 2a str. 301
cgcgaccaucggaucggcca

SEQ ID NO: 3935469 - RNA, 12 nt, Shigella flexneri 2a str. 301
cgcgaccgccgc

SEQ ID NO: 3935470 - RNA, 22 nt, Shigella flexneri 2a str. 301
cgcgaccgccucgcgccagcgu

SEQ ID NO: 3935471 - RNA, 23 nt, Shigella flexneri 2a str. 301
cgcgaccucaagcucgccaccau

SEQ ID NO: 3935472 - RNA, 10 nt, Shigella flexneri 2a str. 301
cgcgacguuc

SEQ ID NO: 3935473 - RNA, 22 nt, Shigella flexneri 2a str. 301
cgcgacuuuaaucaccugccag

SEQ ID NO: 3935474 - RNA, 14 nt, Shigella flexneri 2a str. 301
cgcgacuuuuuccu

SEQ ID NO: 3935475 - RNA, 15 nt, Shigella flexneri 2a str. 301
cgcgacuuuuuccug

SEQ ID NO: 3935476 - RNA, 15 nt, Shigella flexneri 2a str. 301
cgcgagcuggugccg

SEQ ID NO: 3935477 - RNA, 21 nt, Shigella flexneri 2a str. 301
cgcgaggaugcguuuuccggc

SEQ ID NO: 3935478 - RNA, 21 nt, Shigella flexneri 2a str. 301
cgcgaggcaaaucgcauugcg

SEQ ID NO: 3935479 - RNA, 14 nt, Shigella flexneri 2a str. 301
cgcgagguaacauc

SEQ ID NO: 3935480 - RNA, 15 nt, Shigella flexneri 2a str. 301
cgcgauaccacccgc

SEQ ID NO: 3935481 - RNA, 15 nt, Shigella flexneri 2a str. 301
cgcgauagccgcuuu

SEQ ID NO: 3935482 - RNA, 15 nt, Shigella flexneri 2a str. 301
cgcgauauugcugca

SEQ ID NO: 3935483 - RNA, 17 nt, Shigella flexneri 2a str. 301
cgcgaucgccugcaggg

SEQ ID NO: 3935484 - RNA, 14 nt, Shigella flexneri 2a str. 301
cgcgcaaacaguga

SEQ ID NO: 3935485 - RNA, 18 nt, Shigella flexneri 2a str. 301
cgcgcaaagaaacgccga

SEQ ID NO: 3935486 - RNA, 15 nt, Shigella flexneri 2a str. 301
cgcgcaaauccacgu

SEQ ID NO: 3935487 - RNA, 18 nt, Shigella flexneri 2a str. 301
cgcgcaaccaacggccuu

SEQ ID NO: 3935488 - RNA, 20 nt, Shigella flexneri 2a str. 301
cgcgcaaccaacggccuugc

SEQ ID NO: 3935489 - RNA, 18 nt, Shigella flexneri 2a str. 301
cgcgcaauauccugcgcu

SEQ ID NO: 3935490 - RNA, 17 nt, Shigella flexneri 2a str. 301
cgcgcaauugccagaca

SEQ ID NO: 3935491 - RNA, 22 nt, Shigella flexneri 2a str. 301
caucaccccgccgggcuuacca

SEQ ID NO: 3935492 - RNA, 14 nt, Shigella flexneri 2a str. 301
caucaccccgcgcu

SEQ ID NO: 3935493 - RNA, 18 nt, Shigella flexneri 2a str. 301
caucaccgacguuugcgc

SEQ ID NO: 3935494 - RNA, 23 nt, Shigella flexneri 2a str. 301
caucaccgaugcccucaauaucu

SEQ ID NO: 3935495 - RNA, 20 nt, Shigella flexneri 2a str. 301
caucaccgcgaaauaaucaa

SEQ ID NO: 3935496 - RNA, 13 nt, Shigella flexneri 2a str. 301
caucaccggcuuc

SEQ ID NO: 3935497 - RNA, 21 nt, Shigella flexneri 2a str. 301
caucaccugagcuggcagacc

SEQ ID NO: 3935498 - RNA, 13 nt, Shigella flexneri 2a str. 301
caucacgaaaucc

SEQ ID NO: 3935499 - RNA, 21 nt, Shigella flexneri 2a str. 301
caucacgaaaucccacauccu

SEQ ID NO: 3935500 - RNA, 17 nt, Shigella flexneri 2a str. 301
caucacgacagcaccac

SEQ ID NO: 3935501 - RNA, 22 nt, Shigella flexneri 2a str. 301
caucacgaucgcuucggucugc

SEQ ID NO: 3935502 - RNA, 14 nt, Shigella flexneri 2a str. 301
caucacgcaaaugu

SEQ ID NO: 3935503 - RNA, 17 nt, Shigella flexneri 2a str. 301
caucacgcagcgucagc

SEQ ID NO: 3935504 - RNA, 22 nt, Shigella flexneri 2a str. 301
caucacgccaauaauggccuuu

SEQ ID NO: 3935505 - RNA, 20 nt, Shigella flexneri 2a str. 301
caucacgcgguuacgcaccg

SEQ ID NO: 3935506 - RNA, 16 nt, Shigella flexneri 2a str. 301
caucacggcagccuga

SEQ ID NO: 3935507 - RNA, 14 nt, Shigella flexneri 2a str. 301
caucacgucggcgu

SEQ ID NO: 3935508 - RNA, 23 nt, Shigella flexneri 2a str. 301
caucacuccauccagcaacaaca

SEQ ID NO: 3935509 - RNA, 17 nt, Shigella flexneri 2a str. 301
caucacucccuuucugc

SEQ ID NO: 3935510 - RNA, 18 nt, Shigella flexneri 2a str. 301
caucacuuucggugacag

SEQ ID NO: 3935511 - RNA, 18 nt, Shigella flexneri 2a str. 301
caucacuuuugaaaucaa

SEQ ID NO: 3935512 - RNA, 19 nt, Shigella flexneri 2a str. 301
caucagaaacacacuuucc

SEQ ID NO: 3935513 - RNA, 16 nt, Shigella flexneri 2a str. 301
aaaacaggcagcugcc

SEQ ID NO: 3935514 - RNA, 19 nt, Shigella flexneri 2a str. 301
aaaacagggcuuacugaaa

SEQ ID NO: 3935515 - RNA, 21 nt, Shigella flexneri 2a str. 301
aaaacagggcuuacugaaaau

SEQ ID NO: 3935516 - RNA, 14 nt, Shigella flexneri 2a str. 301
aaaacaguaccaga

SEQ ID NO: 3935517 - RNA, 16 nt, Shigella flexneri 2a str. 301
aaaacagugauuacua

SEQ ID NO: 3935518 - RNA, 23 nt, Shigella flexneri 2a str. 301
aaaacauagguacagcaccaaaa

SEQ ID NO: 3935519 - RNA, 22 nt, Shigella flexneri 2a str. 301
aaaacaucaugauucacaguua

SEQ ID NO: 3935520 - RNA, 21 nt, Shigella flexneri 2a str. 301
aaaaccagaaagggaagaaca

SEQ ID NO: 3935521 - RNA, 22 nt, Shigella flexneri 2a str. 301
aaaaccagaaagggaagaacau

SEQ ID NO: 3935522 - RNA, 13 nt, Shigella flexneri 2a str. 301
aaaaccagagaau

SEQ ID NO: 3935523 - RNA, 15 nt, Shigella flexneri 2a str. 301
aaaaccccaaaaaga

SEQ ID NO: 3935524 - RNA, 23 nt, Shigella flexneri 2a str. 301
aaaacccguacugccgaacagaa

SEQ ID NO: 3935525 - RNA, 23 nt, Shigella flexneri 2a str. 301
aaaaccgccauucauacccugaa

SEQ ID NO: 3935526 - RNA, 22 nt, Shigella flexneri 2a str. 301
aaaaccuccgccucuuucacuc

SEQ ID NO: 3935527 - RNA, 17 nt, Shigella flexneri 2a str. 301
aaaaccucucuggaaga

SEQ ID NO: 3935528 - RNA, 19 nt, Shigella flexneri 2a str. 301
aaaaccucuuccagcagau

SEQ ID NO: 3935529 - RNA, 18 nt, Shigella flexneri 2a str. 301
aaaaccuguauacgcaua

SEQ ID NO: 3935530 - RNA, 21 nt, Shigella flexneri 2a str. 301
aaaacgaccaccuucaacguu

SEQ ID NO: 3935531 - RNA, 14 nt, Shigella flexneri 2a str. 301
aaaacgaucgccca

SEQ ID NO: 3935532 - RNA, 17 nt, Shigella flexneri 2a str. 301
aaaacgccgccagcuca

SEQ ID NO: 3935533 - RNA, 20 nt, Shigella flexneri 2a str. 301
aaaacgccggagugaaaauu

SEQ ID NO: 3935534 - RNA, 23 nt, Shigella flexneri 2a str. 301
aaaacgcgcccucagcccacauc

SEQ ID NO: 3935535 - RNA, 15 nt, Shigella flexneri 2a str. 301
aaaacggauguuucu

SEQ ID NO: 3935536 - RNA, 16 nt, Shigella flexneri 2a str. 301
aaaacgguaaggacaa

SEQ ID NO: 3935537 - RNA, 16 nt, Shigella flexneri 2a str. 301
aaaacggucacggcug

SEQ ID NO: 3935538 - RNA, 18 nt, Shigella flexneri 2a str. 301
aaaacgucaugguuauuu

SEQ ID NO: 3935539 - RNA, 19 nt, Shigella flexneri 2a str. 301
aaaacguccggcaauauag

SEQ ID NO: 3935540 - RNA, 23 nt, Shigella flexneri 2a str. 301
aaaacgucgcaacuccaccagca

SEQ ID NO: 3935541 - RNA, 17 nt, Shigella flexneri 2a str. 301
aaaacgucgccagcgcc

SEQ ID NO: 3935542 - RNA, 16 nt, Shigella flexneri 2a str. 301
aaaacgugcagcugcc

SEQ ID NO: 3935543 - RNA, 18 nt, Shigella flexneri 2a str. 301
aaaacguggccuccaaaa

SEQ ID NO: 3935544 - RNA, 20 nt, Shigella flexneri 2a str. 301
aaaacguggccuccaaaaaa

SEQ ID NO: 3935545 - RNA, 23 nt, Shigella flexneri 2a str. 301
aaaacuaaacguuagcacgaacc

SEQ ID NO: 3935546 - RNA, 19 nt, Shigella flexneri 2a str. 301
aaaacucgagccuuuacga

SEQ ID NO: 3935547 - RNA, 23 nt, Shigella flexneri 2a str. 301
aaaacucucaucuuugaaaucac

SEQ ID NO: 3935548 - RNA, 16 nt, Shigella flexneri 2a str. 301
aaaacuggaaaaauaa

SEQ ID NO: 3935549 - RNA, 22 nt, Shigella flexneri 2a str. 301
aaaacuggauuacaaauaaaua

SEQ ID NO: 3935550 - RNA, 19 nt, Shigella flexneri 2a str. 301
aaaacuguaguguugcagu

SEQ ID NO: 3935551 - RNA, 17 nt, Shigella flexneri 2a str. 301
aaaacuucguuagguuc

SEQ ID NO: 3935552 - RNA, 12 nt, Shigella flexneri 2a str. 301
aaaagaaaaaac

SEQ ID NO: 3935553 - RNA, 12 nt, Shigella flexneri 2a str. 301
aaaagaaaaaau

SEQ ID NO: 3935554 - RNA, 13 nt, Shigella flexneri 2a str. 301
aaaagaaagaagc

SEQ ID NO: 3935555 - RNA, 11 nt, Shigella flexneri 2a str. 301
aaaagaaaguu

SEQ ID NO: 3935556 - RNA, 21 nt, Shigella flexneri 2a str. 301
aaaagaaaguuugcagaaauu

SEQ ID NO: 3935557 - RNA, 13 nt, Shigella flexneri 2a str. 301
aaaagaagaccug

SEQ ID NO: 3935558 - RNA, 23 nt, Shigella flexneri 2a str. 301
aaaagaagaccugccagaacaac

SEQ ID NO: 3935559 - RNA, 13 nt, Shigella flexneri 2a str. 301
aaaagaauaucag

SEQ ID NO: 3935560 - RNA, 13 nt, Shigella flexneri 2a str. 301
aaaagagcgugga

SEQ ID NO: 3935561 - RNA, 15 nt, Shigella flexneri 2a str. 301
aaaagaguaaaguua

SEQ ID NO: 3935562 - RNA, 16 nt, Shigella flexneri 2a str. 301
aaaagauggucaucgg

SEQ ID NO: 3935563 - RNA, 16 nt, Shigella flexneri 2a str. 301
aaaagauuaaaaaaac

SEQ ID NO: 3935564 - RNA, 13 nt, Shigella flexneri 2a str. 301
aaaagcacagaau

SEQ ID NO: 3935565 - RNA, 15 nt, Shigella flexneri 2a str. 301
aaaagcacagaaucu

SEQ ID NO: 3935566 - RNA, 21 nt, Shigella flexneri 2a str. 301
aaaagcacagaaucuaagauc

SEQ ID NO: 3935567 - RNA, 15 nt, Shigella flexneri 2a str. 301
aaaagccaaugaaau

SEQ ID NO: 3935568 - RNA, 22 nt, Shigella flexneri 2a str. 301
aaaagccgacucacuugcaguc

SEQ ID NO: 3935569 - RNA, 22 nt, Shigella flexneri 2a str. 301
aaaagccgcuuaacgguguuua

SEQ ID NO: 3935570 - RNA, 14 nt, Shigella flexneri 2a str. 301
aaaagccuaagaag

SEQ ID NO: 3935571 - RNA, 17 nt, Shigella flexneri 2a str. 301
aaaagccuaagaaguca

SEQ ID NO: 3935572 - RNA, 22 nt, Shigella flexneri 2a str. 301
aaaagcgcgauggcaguacgcu

SEQ ID NO: 3935573 - RNA, 22 nt, Shigella flexneri 2a str. 301
aaaagcgggcgacgcugcgccg

SEQ ID NO: 3935574 - RNA, 18 nt, Shigella flexneri 2a str. 301
aaaagcucccuaaaauau

SEQ ID NO: 3935575 - RNA, 19 nt, Shigella flexneri 2a str. 301
aaaagcucgccgaagcgag

SEQ ID NO: 3935576 - RNA, 22 nt, Shigella flexneri 2a str. 301
aaaagcugcaaggugaaagcaa

SEQ ID NO: 3935577 - RNA, 17 nt, Shigella flexneri 2a str. 301
aaaagcugugcuugaua

SEQ ID NO: 3935578 - RNA, 12 nt, Shigella flexneri 2a str. 301
aaaaggcagcgg

SEQ ID NO: 3935579 - RNA, 17 nt, Shigella flexneri 2a str. 301
aaaaggcgcuaaaaaua

SEQ ID NO: 3935580 - RNA, 16 nt, Shigella flexneri 2a str. 301
aaaaggcguucacgcc

SEQ ID NO: 3935581 - RNA, 18 nt, Shigella flexneri 2a str. 301
aaaagggagcuaucuccc

SEQ ID NO: 3935582 - RNA, 18 nt, Shigella flexneri 2a str. 301
aaaagguaggccugauaa

SEQ ID NO: 3935583 - RNA, 14 nt, Shigella flexneri 2a str. 301
aaaaggucacuccc

SEQ ID NO: 3935584 - RNA, 17 nt, Shigella flexneri 2a str. 301
aaaaggugcucaaugag

SEQ ID NO: 3935585 - RNA, 22 nt, Shigella flexneri 2a str. 301
aaaaguaaaccagagagaagcu

SEQ ID NO: 3935586 - RNA, 15 nt, Shigella flexneri 2a str. 301
aaaaguccaggcugc

SEQ ID NO: 3935587 - RNA, 16 nt, Shigella flexneri 2a str. 301
aaaagucccuucccag

SEQ ID NO: 3935588 - RNA, 17 nt, Shigella flexneri 2a str. 301
aaaauaaaucaaaguca

SEQ ID NO: 3935589 - RNA, 15 nt, Shigella flexneri 2a str. 301
aaaauaauacacaca

SEQ ID NO: 3935590 - RNA, 16 nt, Shigella flexneri 2a str. 301
aaaauaaugcgacaac

SEQ ID NO: 3935591 - RNA, 18 nt, Shigella flexneri 2a str. 301
aaaauaauuuuaaauauc

SEQ ID NO: 3935592 - RNA, 17 nt, Shigella flexneri 2a str. 301
aaaauacaauucucagc

SEQ ID NO: 3935593 - RNA, 12 nt, Shigella flexneri 2a str. 301
aaaauacacuuu

SEQ ID NO: 3935594 - RNA, 12 nt, Shigella flexneri 2a str. 301
aaaauaccaaua

SEQ ID NO: 3935595 - RNA, 15 nt, Shigella flexneri 2a str. 301
aaaauaccagcaauu

SEQ ID NO: 3935596 - RNA, 14 nt, Shigella flexneri 2a str. 301
aaaauagccaauca

SEQ ID NO: 3935597 - RNA, 21 nt, Shigella flexneri 2a str. 301
aaaauagcuguuuauuuauac

SEQ ID NO: 3935598 - RNA, 23 nt, Shigella flexneri 2a str. 301
aaaauaggaauccgggucuguaa

SEQ ID NO: 3935599 - RNA, 20 nt, Shigella flexneri 2a str. 301
aaaauauccguagugaaaaa

SEQ ID NO: 3935600 - RNA, 20 nt, Shigella flexneri 2a str. 301
aaaauaucguaggccugcuc

SEQ ID NO: 3935601 - RNA, 22 nt, Shigella flexneri 2a str. 301
aaaauaucguaggccugcucaa

SEQ ID NO: 3935602 - RNA, 13 nt, Shigella flexneri 2a str. 301
aaaauauuucugc

SEQ ID NO: 3935603 - RNA, 20 nt, Shigella flexneri 2a str. 301
aaaaucaaccauacggucug

SEQ ID NO: 3935604 - RNA, 15 nt, Shigella flexneri 2a str. 301
aaaaucaacgacaaa

SEQ ID NO: 3935605 - RNA, 13 nt, Shigella flexneri 2a str. 301
aaaaucaccauca

SEQ ID NO: 3935606 - RNA, 13 nt, Shigella flexneri 2a str. 301
aaaaucaccauuu

SEQ ID NO: 3935607 - RNA, 22 nt, Shigella flexneri 2a str. 301
aaaaucaccucaucaccacaga

SEQ ID NO: 3935608 - RNA, 13 nt, Shigella flexneri 2a str. 301
aaaaucagcauca

SEQ ID NO: 3935609 - RNA, 17 nt, Shigella flexneri 2a str. 301
aaaaucaucaauugcca

SEQ ID NO: 3935610 - RNA, 13 nt, Shigella flexneri 2a str. 301
aaaaucaucaucu

SEQ ID NO: 3935611 - RNA, 14 nt, Shigella flexneri 2a str. 301
aaaauccaccagug

SEQ ID NO: 3935612 - RNA, 19 nt, Shigella flexneri 2a str. 301
aaaauccagauuuauaaaa

SEQ ID NO: 3935613 - RNA, 21 nt, Shigella flexneri 2a str. 301
aaaccacgcaauaaacaugau

SEQ ID NO: 3935614 - RNA, 14 nt, Shigella flexneri 2a str. 301
aaaccacugacaca

SEQ ID NO: 3935615 - RNA, 19 nt, Shigella flexneri 2a str. 301
aaaccacugauaagcugag

SEQ ID NO: 3935616 - RNA, 15 nt, Shigella flexneri 2a str. 301
aaaccacuuaauuau

SEQ ID NO: 3935617 - RNA, 17 nt, Shigella flexneri 2a str. 301
aaaccacuuaauuauua

SEQ ID NO: 3935618 - RNA, 20 nt, Shigella flexneri 2a str. 301
aaaccacuuaauuauuaaca

SEQ ID NO: 3935619 - RNA, 22 nt, Shigella flexneri 2a str. 301
aaaccacuuaauuauuaacaaa

SEQ ID NO: 3935620 - RNA, 21 nt, Shigella flexneri 2a str. 301
aaaccagaaagggaagaacau

SEQ ID NO: 3935621 - RNA, 20 nt, Shigella flexneri 2a str. 301
aaaccagacagcacauuuca

SEQ ID NO: 3935622 - RNA, 19 nt, Shigella flexneri 2a str. 301
aaaccagcaaacaggugcu

SEQ ID NO: 3935623 - RNA, 24 nt, Shigella flexneri 2a str. 301
aaaccagcaaccaacgccagcagc

SEQ ID NO: 3935624 - RNA, 19 nt, Shigella flexneri 2a str. 301
aaaccagcccugguuuauc

SEQ ID NO: 3935625 - RNA, 12 nt, Shigella flexneri 2a str. 301
aaaccagcgcau

SEQ ID NO: 3935626 - RNA, 19 nt, Shigella flexneri 2a str. 301
aaaccagcgcauggcggua

SEQ ID NO: 3935627 - RNA, 22 nt, Shigella flexneri 2a str. 301
aaaccaggccaauagugcggca

SEQ ID NO: 3935628 - RNA, 13 nt, Shigella flexneri 2a str. 301
aaaccauguccau

SEQ ID NO: 3935629 - RNA, 17 nt, Shigella flexneri 2a str. 301
aaaccauuccagcauac

SEQ ID NO: 3935630 - RNA, 16 nt, Shigella flexneri 2a str. 301
aaacccaccagcugau

SEQ ID NO: 3935631 - RNA, 17 nt, Shigella flexneri 2a str. 301
aaacccaccagcugaug

SEQ ID NO: 3935632 - RNA, 18 nt, Shigella flexneri 2a str. 301
aaacccgauuuuuaaauu

SEQ ID NO: 3935633 - RNA, 14 nt, Shigella flexneri 2a str. 301
aaacccgcaggcgc

SEQ ID NO: 3935634 - RNA, 15 nt, Shigella flexneri 2a str. 301
aaacccgccagacca

SEQ ID NO: 3935635 - RNA, 16 nt, Shigella flexneri 2a str. 301
aaacccggccacagcg

SEQ ID NO: 3935636 - RNA, 19 nt, Shigella flexneri 2a str. 301
aaacccugccgucugggca

SEQ ID NO: 3935637 - RNA, 13 nt, Shigella flexneri 2a str. 301
aaacccugcgcac

SEQ ID NO: 3935638 - RNA, 15 nt, Shigella flexneri 2a str. 301
aaacccugcgucagg

SEQ ID NO: 3935639 - RNA, 14 nt, Shigella flexneri 2a str. 301
aaaccgaccaauca

SEQ ID NO: 3935640 - RNA, 20 nt, Shigella flexneri 2a str. 301
aaaccgacuuacuuauuucu

SEQ ID NO: 3935641 - RNA, 18 nt, Shigella flexneri 2a str. 301
aaaccgagaagcagcaac

SEQ ID NO: 3935642 - RNA, 17 nt, Shigella flexneri 2a str. 301
aaaccgaugcagugcgg

SEQ ID NO: 3935643 - RNA, 20 nt, Shigella flexneri 2a str. 301
aaaccgaugcagugcggcug

SEQ ID NO: 3935644 - RNA, 19 nt, Shigella flexneri 2a str. 301
aaaccgccucaggcaacau

SEQ ID NO: 3935645 - RNA, 15 nt, Shigella flexneri 2a str. 301
aaaccgccuucugcg

SEQ ID NO: 3935646 - RNA, 23 nt, Shigella flexneri 2a str. 301
aaaccgccuucugcgccgccucu

SEQ ID NO: 3935647 - RNA, 22 nt, Shigella flexneri 2a str. 301
aaaccgcgaugaccaaaaacau

SEQ ID NO: 3935648 - RNA, 17 nt, Shigella flexneri 2a str. 301
aaaccggauacccugcc

SEQ ID NO: 3935649 - RNA, 18 nt, Shigella flexneri 2a str. 301
aaaccgggagaacauugg

SEQ ID NO: 3935650 - RNA, 23 nt, Shigella flexneri 2a str. 301
aaaccgucguuacugucgcgcag

SEQ ID NO: 3935651 - RNA, 19 nt, Shigella flexneri 2a str. 301
aaaccguguuuaugaaagu

SEQ ID NO: 3935652 - RNA, 19 nt, Shigella flexneri 2a str. 301
aaaccucacgcauccucua

SEQ ID NO: 3935653 - RNA, 23 nt, Shigella flexneri 2a str. 301
aaaccucguccuguugaaaaacc

SEQ ID NO: 3935654 - RNA, 15 nt, Shigella flexneri 2a str. 301
aaaccugacaacaaa

SEQ ID NO: 3935655 - RNA, 18 nt, Shigella flexneri 2a str. 301
aaaccuguugaaauuauu

SEQ ID NO: 3935656 - RNA, 20 nt, Shigella flexneri 2a str. 301
aaaccuuagguugugaucau

SEQ ID NO: 3935657 - RNA, 22 nt, Shigella flexneri 2a str. 301
aaaccuuagguugugaucaucc

SEQ ID NO: 3935658 - RNA, 14 nt, Shigella flexneri 2a str. 301
aaacgaaagcaggg

SEQ ID NO: 3935659 - RNA, 22 nt, Shigella flexneri 2a str. 301
aaacgaauggcaaaacggcucu

SEQ ID NO: 3935660 - RNA, 17 nt, Shigella flexneri 2a str. 301
aaacgaccacucuuucg

SEQ ID NO: 3935661 - RNA, 20 nt, Shigella flexneri 2a str. 301
aaacgacgauaauccgucgc

SEQ ID NO: 3935662 - RNA, 18 nt, Shigella flexneri 2a str. 301
aaacgacgcagaacugaa

SEQ ID NO: 3935663 - RNA, 17 nt, Shigella flexneri 2a str. 301
aaacgacguauugauua

SEQ ID NO: 3935664 - RNA, 20 nt, Shigella flexneri 2a str. 301
aaacgcaaaacugccugaug

SEQ ID NO: 3935665 - RNA, 20 nt, Shigella flexneri 2a str. 301
aaacgcaaaauugccugaug

SEQ ID NO: 3935666 - RNA, 19 nt, Shigella flexneri 2a str. 301
aaacgcaaacaccagcgaa

SEQ ID NO: 3935667 - RNA, 20 nt, Shigella flexneri 2a str. 301
aaacgcaacauugccugaug

SEQ ID NO: 3935668 - RNA, 19 nt, Shigella flexneri 2a str. 301
aaacgcaagguuguugaaa

SEQ ID NO: 3935669 - RNA, 18 nt, Shigella flexneri 2a str. 301
aaacgccaccuguuucuu

SEQ ID NO: 3935670 - RNA, 22 nt, Shigella flexneri 2a str. 301
aaacgccagauacaucagcgac

SEQ ID NO: 3935671 - RNA, 18 nt, Shigella flexneri 2a str. 301
aaacgcccuuaccuuuac

SEQ ID NO: 3935672 - RNA, 15 nt, Shigella flexneri 2a str. 301
aaacgccgcgccaua

SEQ ID NO: 3935673 - RNA, 22 nt, Shigella flexneri 2a str. 301
aaacgccuuauccagccuacaa

SEQ ID NO: 3935674 - RNA, 16 nt, Shigella flexneri 2a str. 301
aaacgccuuauccggc

SEQ ID NO: 3935675 - RNA, 14 nt, Shigella flexneri 2a str. 301
aaacgcgaccgccg

SEQ ID NO: 3935676 - RNA, 13 nt, Shigella flexneri 2a str. 301
aaacgcgcggcgu

SEQ ID NO: 3935677 - RNA, 22 nt, Shigella flexneri 2a str. 301
aaacgcucccugccaguccugc

SEQ ID NO: 3935678 - RNA, 15 nt, Shigella flexneri 2a str. 301
aaacgcucucucagu

SEQ ID NO: 3935679 - RNA, 22 nt, Shigella flexneri 2a str. 301
aaacgcuggcagcauuucucua

SEQ ID NO: 3935680 - RNA, 21 nt, Shigella flexneri 2a str. 301
aaacgcuuauaguaacguuug

SEQ ID NO: 3935681 - RNA, 12 nt, Shigella flexneri 2a str. 301
aaacgcuuuuuu

SEQ ID NO: 3935682 - RNA, 12 nt, Shigella flexneri 2a str. 301
aaacggagcaaa

SEQ ID NO: 3935683 - RNA, 14 nt, Shigella flexneri 2a str. 301
aaacggagcaaaaa

SEQ ID NO: 3935684 - RNA, 15 nt, Shigella flexneri 2a str. 301
aaacggauaaucaug

SEQ ID NO: 3935685 - RNA, 17 nt, Shigella flexneri 2a str. 301
aaacggauggccugaug

SEQ ID NO: 3935686 - RNA, 18 nt, Shigella flexneri 2a str. 301
aaacggcguugagcaauc

SEQ ID NO: 3935687 - RNA, 22 nt, Shigella flexneri 2a str. 301
aaacgggggcgauuuuccucca

SEQ ID NO: 3935688 - RNA, 19 nt, Shigella flexneri 2a str. 301
aaacgguaauuauugauga

SEQ ID NO: 3935689 - RNA, 16 nt, Shigella flexneri 2a str. 301
aaacggugauacugau

SEQ ID NO: 3935690 - RNA, 15 nt, Shigella flexneri 2a str. 301
aaacggugaucaaaa

SEQ ID NO: 3935691 - RNA, 18 nt, Shigella flexneri 2a str. 301
aaacgguugauaaaugag

SEQ ID NO: 3935692 - RNA, 19 nt, Shigella flexneri 2a str. 301
aaacgguuuauccccaagg

SEQ ID NO: 3935693 - RNA, 16 nt, Shigella flexneri 2a str. 301
aaacgugacagcauac

SEQ ID NO: 3935694 - RNA, 22 nt, Shigella flexneri 2a str. 301
aaacgugacagcauaccuucac

SEQ ID NO: 3935695 - RNA, 12 nt, Shigella flexneri 2a str. 301
aaacgugccauu

SEQ ID NO: 3935696 - RNA, 14 nt, Shigella flexneri 2a str. 301
aaacgugcggcugu

SEQ ID NO: 3935697 - RNA, 20 nt, Shigella flexneri 2a str. 301
aaacguuagcacgaaccguc

SEQ ID NO: 3935698 - RNA, 21 nt, Shigella flexneri 2a str. 301
aaacguugcgcggugagcguu

SEQ ID NO: 3935699 - RNA, 12 nt, Shigella flexneri 2a str. 301
aaacuaaaaaca

SEQ ID NO: 3935700 - RNA, 16 nt, Shigella flexneri 2a str. 301
aaacuaacaguguuuc

SEQ ID NO: 3935701 - RNA, 15 nt, Shigella flexneri 2a str. 301
aaacuaaucgacagu

SEQ ID NO: 3935702 - RNA, 22 nt, Shigella flexneri 2a str. 301
aaacuaaucgacaguugcugcg

SEQ ID NO: 3935703 - RNA, 15 nt, Shigella flexneri 2a str. 301
aaacuacaggcaacg

SEQ ID NO: 3935704 - RNA, 14 nt, Shigella flexneri 2a str. 301
aaacucaaucaggc

SEQ ID NO: 3935705 - RNA, 16 nt, Shigella flexneri 2a str. 301
aaacucaggcuggcaa

SEQ ID NO: 3935706 - RNA, 18 nt, Shigella flexneri 2a str. 301
aaacucauaaauucaaag

SEQ ID NO: 3935707 - RNA, 14 nt, Shigella flexneri 2a str. 301
aaacuccagcccuu

SEQ ID NO: 3935708 - RNA, 22 nt, Shigella flexneri 2a str. 301
aaacuccagcccuuuugacgcg

SEQ ID NO: 3935709 - RNA, 21 nt, Shigella flexneri 2a str. 301
aaacuccgccgcaucuuccca

SEQ ID NO: 3935710 - RNA, 20 nt, Shigella flexneri 2a str. 301
aaacucgcgcaggcugacau

SEQ ID NO: 3935711 - RNA, 20 nt, Shigella flexneri 2a str. 301
aaacucgcugccagcacuuu

SEQ ID NO: 3935712 - RNA, 21 nt, Shigella flexneri 2a str. 301
aaagcgcacuuugucaaaaau

SEQ ID NO: 3935713 - RNA, 23 nt, Shigella flexneri 2a str. 301
aaagcgcaggccaacagucuuaa

SEQ ID NO: 3935714 - RNA, 20 nt, Shigella flexneri 2a str. 301
aaagcgcgguuucaauuucc

SEQ ID NO: 3935715 - RNA, 16 nt, Shigella flexneri 2a str. 301
aaagcgcgucaccacc

SEQ ID NO: 3935716 - RNA, 12 nt, Shigella flexneri 2a str. 301
aaagcggccaga

SEQ ID NO: 3935717 - RNA, 18 nt, Shigella flexneri 2a str. 301
aaagcggcgcuaauggca

SEQ ID NO: 3935718 - RNA, 18 nt, Shigella flexneri 2a str. 301
aaagcggcucauugccau

SEQ ID NO: 3935719 - RNA, 16 nt, Shigella flexneri 2a str. 301
aaagcggcucggagag

SEQ ID NO: 3935720 - RNA, 20 nt, Shigella flexneri 2a str. 301
aaagcguacccgccugauag

SEQ ID NO: 3935721 - RNA, 16 nt, Shigella flexneri 2a str. 301
aaagcguauccaucac

SEQ ID NO: 3935722 - RNA, 14 nt, Shigella flexneri 2a str. 301
aaagcguauuaugc

SEQ ID NO: 3935723 - RNA, 23 nt, Shigella flexneri 2a str. 301
aaagcgucaaguugacucucauc

SEQ ID NO: 3935724 - RNA, 13 nt, Shigella flexneri 2a str. 301
aaagcucuucaug

SEQ ID NO: 3935725 - RNA, 22 nt, Shigella flexneri 2a str. 301
aaagcucuuuugacgcccccaa

SEQ ID NO: 3935726 - RNA, 14 nt, Shigella flexneri 2a str. 301
aaagcugauuucug

SEQ ID NO: 3935727 - RNA, 16 nt, Shigella flexneri 2a str. 301
aaagcugauuucuggc

SEQ ID NO: 3935728 - RNA, 15 nt, Shigella flexneri 2a str. 301
aaagcugcaagguga

SEQ ID NO: 3935729 - RNA, 19 nt, Shigella flexneri 2a str. 301
aaagcugcaaggugaaagc

SEQ ID NO: 3935730 - RNA, 16 nt, Shigella flexneri 2a str. 301
aaagcugucaccaauc

SEQ ID NO: 3935731 - RNA, 17 nt, Shigella flexneri 2a str. 301
aaagcugucaccaauca

SEQ ID NO: 3935732 - RNA, 18 nt, Shigella flexneri 2a str. 301
aaaggaaggucauccaaa

SEQ ID NO: 3935733 - RNA, 13 nt, Shigella flexneri 2a str. 301
aaaggauguuuau

SEQ ID NO: 3935734 - RNA, 16 nt, Shigella flexneri 2a str. 301
aaaggcaaaaugccag

SEQ ID NO: 3935735 - RNA, 16 nt, Shigella flexneri 2a str. 301
aaaggcaacaugaaac

SEQ ID NO: 3935736 - RNA, 18 nt, Shigella flexneri 2a str. 301
aaaggcaacaugaaacag

SEQ ID NO: 3935737 - RNA, 16 nt, Shigella flexneri 2a str. 301
aaaggcacaaggguga

SEQ ID NO: 3935738 - RNA, 15 nt, Shigella flexneri 2a str. 301
aaaggcaccuggaaa

SEQ ID NO: 3935739 - RNA, 16 nt, Shigella flexneri 2a str. 301
aaaggccagccaggca

SEQ ID NO: 3935740 - RNA, 12 nt, Shigella flexneri 2a str. 301
aaaggcgaaacc

SEQ ID NO: 3935741 - RNA, 23 nt, Shigella flexneri 2a str. 301
aaaggcgacuaauacaccaucau

SEQ ID NO: 3935742 - RNA, 19 nt, Shigella flexneri 2a str. 301
aaaggcgcgguuucugcuu

SEQ ID NO: 3935743 - RNA, 22 nt, Shigella flexneri 2a str. 301
aaaggcugacaaaucagaggcu

SEQ ID NO: 3935744 - RNA, 11 nt, Shigella flexneri 2a str. 301
aaagggaugcc

SEQ ID NO: 3935745 - RNA, 20 nt, Shigella flexneri 2a str. 301
aaagggcuaacgugcagguu

SEQ ID NO: 3935746 - RNA, 16 nt, Shigella flexneri 2a str. 301
aaagggggcgacauuu

SEQ ID NO: 3935747 - RNA, 17 nt, Shigella flexneri 2a str. 301
aaaggggugaaaaaaac

SEQ ID NO: 3935748 - RNA, 15 nt, Shigella flexneri 2a str. 301
aaagggucagggaga

SEQ ID NO: 3935749 - RNA, 15 nt, Shigella flexneri 2a str. 301
aaagguaauggucag

SEQ ID NO: 3935750 - RNA, 22 nt, Shigella flexneri 2a str. 301
aaaggucccugaugcaucaguc

SEQ ID NO: 3935751 - RNA, 17 nt, Shigella flexneri 2a str. 301
aaagguccuguaaugag

SEQ ID NO: 3935752 - RNA, 20 nt, Shigella flexneri 2a str. 301
aaagguuuccucaugcauaa

SEQ ID NO: 3935753 - RNA, 12 nt, Shigella flexneri 2a str. 301
aaaguaaaaaag

SEQ ID NO: 3935754 - RNA, 14 nt, Shigella flexneri 2a str. 301
aaaguaaacaauaa

SEQ ID NO: 3935755 - RNA, 15 nt, Shigella flexneri 2a str. 301
aaaguaaaccaccag

SEQ ID NO: 3935756 - RNA, 20 nt, Shigella flexneri 2a str. 301
aaaguaaaccagagagaagc

SEQ ID NO: 3935757 - RNA, 21 nt, Shigella flexneri 2a str. 301
aaaguaaaggcacaaggguga

SEQ ID NO: 3935758 - RNA, 13 nt, Shigella flexneri 2a str. 301
aaaguaacaccau

SEQ ID NO: 3935759 - RNA, 19 nt, Shigella flexneri 2a str. 301
aaaguaacugacaguagcc

SEQ ID NO: 3935760 - RNA, 18 nt, Shigella flexneri 2a str. 301
aaaguaagaauugauaaa

SEQ ID NO: 3935761 - RNA, 17 nt, Shigella flexneri 2a str. 301
aaaguaaucaagcccug

SEQ ID NO: 3935762 - RNA, 20 nt, Shigella flexneri 2a str. 301
aaaguacagaugccaaucag

SEQ ID NO: 3935763 - RNA, 22 nt, Shigella flexneri 2a str. 301
aaaguacagaugccaaucaguu

SEQ ID NO: 3935764 - RNA, 18 nt, Shigella flexneri 2a str. 301
aaaguaccaucguccagc

SEQ ID NO: 3935765 - RNA, 17 nt, Shigella flexneri 2a str. 301
aaaguacggacgcggca

SEQ ID NO: 3935766 - RNA, 16 nt, Shigella flexneri 2a str. 301
aaaguacuucacaauc

SEQ ID NO: 3935767 - RNA, 18 nt, Shigella flexneri 2a str. 301
aaaguagaaauuauuucu

SEQ ID NO: 3935768 - RNA, 19 nt, Shigella flexneri 2a str. 301
aaaguagaagcaagaauaa

SEQ ID NO: 3935769 - RNA, 17 nt, Shigella flexneri 2a str. 301
aaaguagggcugauaaa

SEQ ID NO: 3935770 - RNA, 21 nt, Shigella flexneri 2a str. 301
aaaguagggcugauaaacaag

SEQ ID NO: 3935771 - RNA, 20 nt, Shigella flexneri 2a str. 301
aaaguauauaaaaaacaaua

SEQ ID NO: 3935772 - RNA, 21 nt, Shigella flexneri 2a str. 301
aaagucauggcaaacugcgcg

SEQ ID NO: 3935773 - RNA, 19 nt, Shigella flexneri 2a str. 301
aaaguccaggcugcaaagu

SEQ ID NO: 3935774 - RNA, 21 nt, Shigella flexneri 2a str. 301
aaagucuuuguauuuauuuuc

SEQ ID NO: 3935775 - RNA, 21 nt, Shigella flexneri 2a str. 301
aaagugacacaaucaaauccu

SEQ ID NO: 3935776 - RNA, 16 nt, Shigella flexneri 2a str. 301
aaagugagcuuuguuc

SEQ ID NO: 3935777 - RNA, 15 nt, Shigella flexneri 2a str. 301
aaagugaugguggug

SEQ ID NO: 3935778 - RNA, 23 nt, Shigella flexneri 2a str. 301
aaagugccgccagcuucgcuucc

SEQ ID NO: 3935779 - RNA, 22 nt, Shigella flexneri 2a str. 301
aaagugcgcuuaguuuaugccg

SEQ ID NO: 3935780 - RNA, 20 nt, Shigella flexneri 2a str. 301
aaaguggaaaaauaacaaau

SEQ ID NO: 3935781 - RNA, 20 nt, Shigella flexneri 2a str. 301
aaaguggcggggaucacucc

SEQ ID NO: 3935782 - RNA, 17 nt, Shigella flexneri 2a str. 301
aaaguggcguuguguuc

SEQ ID NO: 3935783 - RNA, 22 nt, Shigella flexneri 2a str. 301
aaaguugccagauaaauauuau

SEQ ID NO: 3935784 - RNA, 18 nt, Shigella flexneri 2a str. 301
aaaguugcucucaaagac

SEQ ID NO: 3935785 - RNA, 15 nt, Shigella flexneri 2a str. 301
aaaguuuaauugcca

SEQ ID NO: 3935786 - RNA, 16 nt, Shigella flexneri 2a str. 301
aaaguuuaccagccaa

SEQ ID NO: 3935787 - RNA, 14 nt, Shigella flexneri 2a str. 301
aaauaaaaaacauu

SEQ ID NO: 3935788 - RNA, 13 nt, Shigella flexneri 2a str. 301
aaauaaaaauaag

SEQ ID NO: 3935789 - RNA, 11 nt, Shigella flexneri 2a str. 301
aaauaaaaauu

SEQ ID NO: 3935790 - RNA, 18 nt, Shigella flexneri 2a str. 301
aaauaaacuuacugacau

SEQ ID NO: 3935791 - RNA, 19 nt, Shigella flexneri 2a str. 301
aaauaaauaccguucauua

SEQ ID NO: 3935792 - RNA, 15 nt, Shigella flexneri 2a str. 301
aaauaaauauauaaa

SEQ ID NO: 3935793 - RNA, 23 nt, Shigella flexneri 2a str. 301
aaauaaaugcuugacucuguagc

SEQ ID NO: 3935794 - RNA, 19 nt, Shigella flexneri 2a str. 301
aaauaacaucccuuaacac

SEQ ID NO: 3935795 - RNA, 23 nt, Shigella flexneri 2a str. 301
aaauaacgccccggcaaaaccau

SEQ ID NO: 3935796 - RNA, 23 nt, Shigella flexneri 2a str. 301
aaauaacgccggagagaaaaacc

SEQ ID NO: 3935797 - RNA, 22 nt, Shigella flexneri 2a str. 301
aaauaacuggugcuaacagcaa

SEQ ID NO: 3935798 - RNA, 20 nt, Shigella flexneri 2a str. 301
aaauaagaugcgaguaaaca

SEQ ID NO: 3935799 - RNA, 19 nt, Shigella flexneri 2a str. 301
aaauaagcacgguuaacac

SEQ ID NO: 3935800 - RNA, 19 nt, Shigella flexneri 2a str. 301
aaauaauacacacaucaau

SEQ ID NO: 3935801 - RNA, 12 nt, Shigella flexneri 2a str. 301
aaauaauauccc

SEQ ID NO: 3935802 - RNA, 21 nt, Shigella flexneri 2a str. 301
aaauaaucccgcgcaacaaau

SEQ ID NO: 3935803 - RNA, 21 nt, Shigella flexneri 2a str. 301
aaauaaucgcaauuacccagu

SEQ ID NO: 3935804 - RNA, 22 nt, Shigella flexneri 2a str. 301
aaauaaucgcauucaggaccuc

SEQ ID NO: 3935805 - RNA, 19 nt, Shigella flexneri 2a str. 301
aaauaaucgggaauacaga

SEQ ID NO: 3935806 - RNA, 19 nt, Shigella flexneri 2a str. 301
aaauaaucuauugauuuaa

SEQ ID NO: 3935807 - RNA, 12 nt, Shigella flexneri 2a str. 301
aaauaauuuuaa

SEQ ID NO: 3935808 - RNA, 13 nt, Shigella flexneri 2a str. 301
aaauaauuuuaaa

SEQ ID NO: 3935809 - RNA, 14 nt, Shigella flexneri 2a str. 301
aaauacacuuuaau

SEQ ID NO: 3935810 - RNA, 17 nt, Shigella flexneri 2a str. 301
aaauacacuuuaaugcc

SEQ ID NO: 3935811 - RNA, 13 nt, Shigella flexneri 2a str. 301
aaaucuucguuau

SEQ ID NO: 3935812 - RNA, 16 nt, Shigella flexneri 2a str. 301
aaaugaaaaucaccau

SEQ ID NO: 3935813 - RNA, 14 nt, Shigella flexneri 2a str. 301
aaaugaacugggca

SEQ ID NO: 3935814 - RNA, 21 nt, Shigella flexneri 2a str. 301
aaaugacaaacuuagauugca

SEQ ID NO: 3935815 - RNA, 16 nt, Shigella flexneri 2a str. 301
aaaugaccauaaaagg

SEQ ID NO: 3935816 - RNA, 19 nt, Shigella flexneri 2a str. 301
aaaugaccauaaaaggcac

SEQ ID NO: 3935817 - RNA, 14 nt, Shigella flexneri 2a str. 301
aaaugacucguuau

SEQ ID NO: 3935818 - RNA, 13 nt, Shigella flexneri 2a str. 301
aaaugaggaauua

SEQ ID NO: 3935819 - RNA, 14 nt, Shigella flexneri 2a str. 301
aaaugaucgccgga

SEQ ID NO: 3935820 - RNA, 13 nt, Shigella flexneri 2a str. 301
aaaugaugcacca

SEQ ID NO: 3935821 - RNA, 18 nt, Shigella flexneri 2a str. 301
aaaugauggucuggugua

SEQ ID NO: 3935822 - RNA, 14 nt, Shigella flexneri 2a str. 301
aaaugcaguuuuua

SEQ ID NO: 3935823 - RNA, 23 nt, Shigella flexneri 2a str. 301
aaaugcaucagugacaaauuccg

SEQ ID NO: 3935824 - RNA, 20 nt, Shigella flexneri 2a str. 301
aaaugcaucggcauaaucau

SEQ ID NO: 3935825 - RNA, 13 nt, Shigella flexneri 2a str. 301
aaaugccuuucuc

SEQ ID NO: 3935826 - RNA, 16 nt, Shigella flexneri 2a str. 301
aaaugcgacaacuggc

SEQ ID NO: 3935827 - RNA, 11 nt, Shigella flexneri 2a str. 301
aaaugcgcaug

SEQ ID NO: 3935828 - RNA, 18 nt, Shigella flexneri 2a str. 301
aaaugcgcuuuauucaga

SEQ ID NO: 3935829 - RNA, 22 nt, Shigella flexneri 2a str. 301
aaaugcguggcgcguaccgccg

SEQ ID NO: 3935830 - RNA, 19 nt, Shigella flexneri 2a str. 301
aaaugcugcaauugcggca

SEQ ID NO: 3935831 - RNA, 15 nt, Shigella flexneri 2a str. 301
aaaugcugguuuugu

SEQ ID NO: 3935832 - RNA, 12 nt, Shigella flexneri 2a str. 301
aaauggcaaagc

SEQ ID NO: 3935833 - RNA, 18 nt, Shigella flexneri 2a str. 301
aaauggcacaauggagcu

SEQ ID NO: 3935834 - RNA, 11 nt, Shigella flexneri 2a str. 301
aaauggccccg

SEQ ID NO: 3935835 - RNA, 19 nt, Shigella flexneri 2a str. 301
aaauggccgucaggguugc

SEQ ID NO: 3935836 - RNA, 23 nt, Shigella flexneri 2a str. 301
aaauggcgcuucguguuuaagaa

SEQ ID NO: 3935837 - RNA, 16 nt, Shigella flexneri 2a str. 301
aaauggcugaccagaa

SEQ ID NO: 3935838 - RNA, 19 nt, Shigella flexneri 2a str. 301
aaauggcuggcuauacaca

SEQ ID NO: 3935839 - RNA, 14 nt, Shigella flexneri 2a str. 301
aaaugguaaagaag

SEQ ID NO: 3935840 - RNA, 18 nt, Shigella flexneri 2a str. 301
aaaugguaaagaaggcau

SEQ ID NO: 3935841 - RNA, 16 nt, Shigella flexneri 2a str. 301
aaauggugugcauggu

SEQ ID NO: 3935842 - RNA, 15 nt, Shigella flexneri 2a str. 301
aaauguaaaaccaac

SEQ ID NO: 3935843 - RNA, 18 nt, Shigella flexneri 2a str. 301
aaaugugguuucacuuuc

SEQ ID NO: 3935844 - RNA, 14 nt, Shigella flexneri 2a str. 301
aaauguguaaucag

SEQ ID NO: 3935845 - RNA, 23 nt, Shigella flexneri 2a str. 301
aaauguguuuuuauuugauuuca

SEQ ID NO: 3935846 - RNA, 14 nt, Shigella flexneri 2a str. 301
aaauguuaagacug

SEQ ID NO: 3935847 - RNA, 22 nt, Shigella flexneri 2a str. 301
aaauguuaagacuggcaaagca

SEQ ID NO: 3935848 - RNA, 16 nt, Shigella flexneri 2a str. 301
aaauguugucucagau

SEQ ID NO: 3935849 - RNA, 19 nt, Shigella flexneri 2a str. 301
aaauguuuaguauuguuaa

SEQ ID NO: 3935850 - RNA, 19 nt, Shigella flexneri 2a str. 301
aaauuaaaugguuaacaug

SEQ ID NO: 3935851 - RNA, 23 nt, Shigella flexneri 2a str. 301
aaauuaacgacgcauacucuuug

SEQ ID NO: 3935852 - RNA, 14 nt, Shigella flexneri 2a str. 301
aaauuacaaaaagu

SEQ ID NO: 3935853 - RNA, 22 nt, Shigella flexneri 2a str. 301
aaauuaccgcaccaccagcagc

SEQ ID NO: 3935854 - RNA, 23 nt, Shigella flexneri 2a str. 301
aaauuaccgcaccaccagcagcu

SEQ ID NO: 3935855 - RNA, 23 nt, Shigella flexneri 2a str. 301
aaauuacucccgugccagagcau

SEQ ID NO: 3935856 - RNA, 20 nt, Shigella flexneri 2a str. 301
aaauuacugccuugaugaaa

SEQ ID NO: 3935857 - RNA, 21 nt, Shigella flexneri 2a str. 301
aaauuacugccuugaugaaaa

SEQ ID NO: 3935858 - RNA, 20 nt, Shigella flexneri 2a str. 301
aaauuaggucaaagaaucaa

SEQ ID NO: 3935859 - RNA, 14 nt, Shigella flexneri 2a str. 301
aaauuauaucuuau

SEQ ID NO: 3935860 - RNA, 15 nt, Shigella flexneri 2a str. 301
aaauuauaucuuauu

SEQ ID NO: 3935861 - RNA, 16 nt, Shigella flexneri 2a str. 301
aaauuauccacggcac

SEQ ID NO: 3935862 - RNA, 21 nt, Shigella flexneri 2a str. 301
aaauuauccacggcacaggcg

SEQ ID NO: 3935863 - RNA, 14 nt, Shigella flexneri 2a str. 301
aaauuauccagcuu

SEQ ID NO: 3935864 - RNA, 14 nt, Shigella flexneri 2a str. 301
aaauuauuaccauc

SEQ ID NO: 3935865 - RNA, 15 nt, Shigella flexneri 2a str. 301
aaauuauuucuuuua

SEQ ID NO: 3935866 - RNA, 13 nt, Shigella flexneri 2a str. 301
aaauuauuuuaaa

SEQ ID NO: 3935867 - RNA, 15 nt, Shigella flexneri 2a str. 301
aaauuauuuuaaauu

SEQ ID NO: 3935868 - RNA, 13 nt, Shigella flexneri 2a str. 301
aaauucaaagugu

SEQ ID NO: 3935869 - RNA, 19 nt, Shigella flexneri 2a str. 301
aaauucaagacaucaauaa

SEQ ID NO: 3935870 - RNA, 15 nt, Shigella flexneri 2a str. 301
aaauuccgaacaaaa

SEQ ID NO: 3935871 - RNA, 18 nt, Shigella flexneri 2a str. 301
aaauucgaaauagagaaa

SEQ ID NO: 3935872 - RNA, 23 nt, Shigella flexneri 2a str. 301
aaauucuacagaaaugaaaaaau

SEQ ID NO: 3935873 - RNA, 13 nt, Shigella flexneri 2a str. 301
aaauucuccagcg

SEQ ID NO: 3935874 - RNA, 14 nt, Shigella flexneri 2a str. 301
aaauucugcugauu

SEQ ID NO: 3935875 - RNA, 16 nt, Shigella flexneri 2a str. 301
aaauugacuacaccau

SEQ ID NO: 3935876 - RNA, 20 nt, Shigella flexneri 2a str. 301
aaauugacuacaccauuaac

SEQ ID NO: 3935877 - RNA, 18 nt, Shigella flexneri 2a str. 301
aaauugcaccauccauuu

SEQ ID NO: 3935878 - RNA, 20 nt, Shigella flexneri 2a str. 301
aaauugcagaguacagccuu

SEQ ID NO: 3935879 - RNA, 16 nt, Shigella flexneri 2a str. 301
aaauugcaggaacgau

SEQ ID NO: 3935880 - RNA, 13 nt, Shigella flexneri 2a str. 301
aaauugccccaga

SEQ ID NO: 3935881 - RNA, 23 nt, Shigella flexneri 2a str. 301
aaauugccccagacacaguucuu

SEQ ID NO: 3935882 - RNA, 23 nt, Shigella flexneri 2a str. 301
aaauugcguaaagccugcuggca

SEQ ID NO: 3935883 - RNA, 15 nt, Shigella flexneri 2a str. 301
aaauugcugacgcaa

SEQ ID NO: 3935884 - RNA, 16 nt, Shigella flexneri 2a str. 301
aaauugguagaccaga

SEQ ID NO: 3935885 - RNA, 19 nt, Shigella flexneri 2a str. 301
aaauugucuccaccaauga

SEQ ID NO: 3935886 - RNA, 15 nt, Shigella flexneri 2a str. 301
aaauugugauaaaaa

SEQ ID NO: 3935887 - RNA, 17 nt, Shigella flexneri 2a str. 301
aaauugugauaaaaauc

SEQ ID NO: 3935888 - RNA, 19 nt, Shigella flexneri 2a str. 301
aaauuuaaaacugccugau

SEQ ID NO: 3935889 - RNA, 13 nt, Shigella flexneri 2a str. 301
aaauuuaauaaua

SEQ ID NO: 3935890 - RNA, 15 nt, Shigella flexneri 2a str. 301
aaauuuaauaauaag

SEQ ID NO: 3935891 - RNA, 19 nt, Shigella flexneri 2a str. 301
aaauuuaucgcauauccuc

SEQ ID NO: 3935892 - RNA, 13 nt, Shigella flexneri 2a str. 301
aaauuuauucgcc

SEQ ID NO: 3935893 - RNA, 14 nt, Shigella flexneri 2a str. 301
aaauuuccgcgaaa

SEQ ID NO: 3935894 - RNA, 21 nt, Shigella flexneri 2a str. 301
aaauuucugccauuuugcuuu

SEQ ID NO: 3935895 - RNA, 21 nt, Shigella flexneri 2a str. 301
aaauuucuuaccacugccgca

SEQ ID NO: 3935896 - RNA, 12 nt, Shigella flexneri 2a str. 301
aaauuucuuccc

SEQ ID NO: 3935897 - RNA, 20 nt, Shigella flexneri 2a str. 301
aaauuuggcuccucugacug

SEQ ID NO: 3935898 - RNA, 11 nt, Shigella flexneri 2a str. 301
aaauuuuuccg

SEQ ID NO: 3935899 - RNA, 17 nt, Shigella flexneri 2a str. 301
aacaaaaaaaccgccuc

SEQ ID NO: 3935900 - RNA, 21 nt, Shigella flexneri 2a str. 301
aacaaaacucaacgguccaau

SEQ ID NO: 3935901 - RNA, 14 nt, Shigella flexneri 2a str. 301
aacaaacgcaaaau

SEQ ID NO: 3935902 - RNA, 19 nt, Shigella flexneri 2a str. 301
aacaaacgcaaaauugccu

SEQ ID NO: 3935903 - RNA, 15 nt, Shigella flexneri 2a str. 301
aacaaacgcaaacac

SEQ ID NO: 3935904 - RNA, 14 nt, Shigella flexneri 2a str. 301
aacaaagaaauguu

SEQ ID NO: 3935905 - RNA, 15 nt, Shigella flexneri 2a str. 301
aacaaagaaauguuc

SEQ ID NO: 3935906 - RNA, 18 nt, Shigella flexneri 2a str. 301
aacaaagaacgccauaaa

SEQ ID NO: 3935907 - RNA, 12 nt, Shigella flexneri 2a str. 301
aacaaagccacu

SEQ ID NO: 3935908 - RNA, 14 nt, Shigella flexneri 2a str. 301
aacaaagcgcaccu

SEQ ID NO: 3935909 - RNA, 22 nt, Shigella flexneri 2a str. 301
aacaaaucggcgcggaaucgcc

SEQ ID NO: 3935910 - RNA, 13 nt, Shigella flexneri 2a str. 301
aacaaauucacgc

SEQ ID NO: 3935911 - RNA, 12 nt, Shigella flexneri 2a str. 301
aacaaauuuuuc

SEQ ID NO: 3935912 - RNA, 21 nt, Shigella flexneri 2a str. 301
aacagcucaacgcguggauca

SEQ ID NO: 3935913 - RNA, 19 nt, Shigella flexneri 2a str. 301
aacaggauauguaagcaga

SEQ ID NO: 3935914 - RNA, 12 nt, Shigella flexneri 2a str. 301
aacaggaucugg

SEQ ID NO: 3935915 - RNA, 19 nt, Shigella flexneri 2a str. 301
aacaggcagggccaccagc

SEQ ID NO: 3935916 - RNA, 22 nt, Shigella flexneri 2a str. 301
aacaggcagggccaccagcgug

SEQ ID NO: 3935917 - RNA, 16 nt, Shigella flexneri 2a str. 301
aacaggcccaacuguu

SEQ ID NO: 3935918 - RNA, 21 nt, Shigella flexneri 2a str. 301
aacaggccgacuggcaugcug

SEQ ID NO: 3935919 - RNA, 17 nt, Shigella flexneri 2a str. 301
aacaggcgaucuucccg

SEQ ID NO: 3935920 - RNA, 23 nt, Shigella flexneri 2a str. 301
aacaggcgcagaacuucacucuc

SEQ ID NO: 3935921 - RNA, 24 nt, Shigella flexneri 2a str. 301
aacagggaacuuaucaucgcaaau

SEQ ID NO: 3935922 - RNA, 14 nt, Shigella flexneri 2a str. 301
aacaggggcuggaa

SEQ ID NO: 3935923 - RNA, 15 nt, Shigella flexneri 2a str. 301
aacaggggcuggaag

SEQ ID NO: 3935924 - RNA, 19 nt, Shigella flexneri 2a str. 301
aacagggugcagcgagugc

SEQ ID NO: 3935925 - RNA, 22 nt, Shigella flexneri 2a str. 301
aacagguaaagaccauaaauau

SEQ ID NO: 3935926 - RNA, 17 nt, Shigella flexneri 2a str. 301
aacaggucacgggcaau

SEQ ID NO: 3935927 - RNA, 17 nt, Shigella flexneri 2a str. 301
aacagguugcccagcgc

SEQ ID NO: 3935928 - RNA, 17 nt, Shigella flexneri 2a str. 301
aacagguuuaaacagag

SEQ ID NO: 3935929 - RNA, 19 nt, Shigella flexneri 2a str. 301
aacaguaaacucgacuuuc

SEQ ID NO: 3935930 - RNA, 20 nt, Shigella flexneri 2a str. 301
aacaguaagcacucugacgg

SEQ ID NO: 3935931 - RNA, 15 nt, Shigella flexneri 2a str. 301
aacaguaauaaugcc

SEQ ID NO: 3935932 - RNA, 19 nt, Shigella flexneri 2a str. 301
aacaguaauaaugcccauc

SEQ ID NO: 3935933 - RNA, 11 nt, Shigella flexneri 2a str. 301
aacaguacauu

SEQ ID NO: 3935934 - RNA, 13 nt, Shigella flexneri 2a str. 301
aacaguaucugaa

SEQ ID NO: 3935935 - RNA, 13 nt, Shigella flexneri 2a str. 301
aacagucacuuuc

SEQ ID NO: 3935936 - RNA, 19 nt, Shigella flexneri 2a str. 301
aacagucaguuaucgcauu

SEQ ID NO: 3935937 - RNA, 19 nt, Shigella flexneri 2a str. 301
aacagucccaggcagaagc

SEQ ID NO: 3935938 - RNA, 22 nt, Shigella flexneri 2a str. 301
aacagucgcucggcgacacguu

SEQ ID NO: 3935939 - RNA, 18 nt, Shigella flexneri 2a str. 301
aacagugauuucuucauu

SEQ ID NO: 3935940 - RNA, 20 nt, Shigella flexneri 2a str. 301
aacagugccaugccaaucag

SEQ ID NO: 3935941 - RNA, 23 nt, Shigella flexneri 2a str. 301
aacagugccgcacauagcaccac

SEQ ID NO: 3935942 - RNA, 14 nt, Shigella flexneri 2a str. 301
aacaguucagcagc

SEQ ID NO: 3935943 - RNA, 17 nt, Shigella flexneri 2a str. 301
aacaguucagcagcacu

SEQ ID NO: 3935944 - RNA, 23 nt, Shigella flexneri 2a str. 301
aacaguuccgcaaagcccaucac

SEQ ID NO: 3935945 - RNA, 16 nt, Shigella flexneri 2a str. 301
aacaguucugcagcgu

SEQ ID NO: 3935946 - RNA, 17 nt, Shigella flexneri 2a str. 301
aacaguucuggaagaga

SEQ ID NO: 3935947 - RNA, 12 nt, Shigella flexneri 2a str. 301
aacaguuucugc

SEQ ID NO: 3935948 - RNA, 13 nt, Shigella flexneri 2a str. 301
aacaguuucugca

SEQ ID NO: 3935949 - RNA, 23 nt, Shigella flexneri 2a str. 301
aacaguuuucaagacgccgucca

SEQ ID NO: 3935950 - RNA, 12 nt, Shigella flexneri 2a str. 301
aacaguuuucag

SEQ ID NO: 3935951 - RNA, 15 nt, Shigella flexneri 2a str. 301
aacauaaccugaaag

SEQ ID NO: 3935952 - RNA, 19 nt, Shigella flexneri 2a str. 301
aacauacaaauagccaauu

SEQ ID NO: 3935953 - RNA, 20 nt, Shigella flexneri 2a str. 301
aacauacaaauagccaauuc

SEQ ID NO: 3935954 - RNA, 22 nt, Shigella flexneri 2a str. 301
aacauacugcuccauaauugcc

SEQ ID NO: 3935955 - RNA, 15 nt, Shigella flexneri 2a str. 301
aacauaucagcgcaa

SEQ ID NO: 3935956 - RNA, 19 nt, Shigella flexneri 2a str. 301
aacaucaaaaagcugucgu

SEQ ID NO: 3935957 - RNA, 13 nt, Shigella flexneri 2a str. 301
aacaucaaaccac

SEQ ID NO: 3935958 - RNA, 14 nt, Shigella flexneri 2a str. 301
aacaucaaauuaca

SEQ ID NO: 3935959 - RNA, 18 nt, Shigella flexneri 2a str. 301
aacaucacaccugcucag

SEQ ID NO: 3935960 - RNA, 12 nt, Shigella flexneri 2a str. 301
aacaucacaugc

SEQ ID NO: 3935961 - RNA, 13 nt, Shigella flexneri 2a str. 301
aacaucaggcauu

SEQ ID NO: 3935962 - RNA, 12 nt, Shigella flexneri 2a str. 301
aacaucauaaua

SEQ ID NO: 3935963 - RNA, 13 nt, Shigella flexneri 2a str. 301
aacaucaucuccc

SEQ ID NO: 3935964 - RNA, 17 nt, Shigella flexneri 2a str. 301
aacaucccgguaauaau

SEQ ID NO: 3935965 - RNA, 20 nt, Shigella flexneri 2a str. 301
aacaucccgguaauaaugca

SEQ ID NO: 3935966 - RNA, 18 nt, Shigella flexneri 2a str. 301
aacaucccuguaaaacgc

SEQ ID NO: 3935967 - RNA, 20 nt, Shigella flexneri 2a str. 301
aacaucggcuuauucauauc

SEQ ID NO: 3935968 - RNA, 17 nt, Shigella flexneri 2a str. 301
aacaucgggauaucgcc

SEQ ID NO: 3935969 - RNA, 23 nt, Shigella flexneri 2a str. 301
aacaucguaucuggcaagcagga

SEQ ID NO: 3935970 - RNA, 16 nt, Shigella flexneri 2a str. 301
aacaucuccacaguca

SEQ ID NO: 3935971 - RNA, 14 nt, Shigella flexneri 2a str. 301
aacaucuucggcgu

SEQ ID NO: 3935972 - RNA, 18 nt, Shigella flexneri 2a str. 301
aacaucuuugaugccagc

SEQ ID NO: 3935973 - RNA, 18 nt, Shigella flexneri 2a str. 301
aacaugaaacagaaaauu

SEQ ID NO: 3935974 - RNA, 22 nt, Shigella flexneri 2a str. 301
aacaugacgcgcaucacgacaa

SEQ ID NO: 3935975 - RNA, 19 nt, Shigella flexneri 2a str. 301
aacaugacuaaucugacaa

SEQ ID NO: 3935976 - RNA, 15 nt, Shigella flexneri 2a str. 301
aacaugagaacaguu

SEQ ID NO: 3935977 - RNA, 19 nt, Shigella flexneri 2a str. 301
aacaugagaacaguucagc

SEQ ID NO: 3935978 - RNA, 18 nt, Shigella flexneri 2a str. 301
aacaugcagcccagcauc

SEQ ID NO: 3935979 - RNA, 23 nt, Shigella flexneri 2a str. 301
aacaugcagcccagcaucagacu

SEQ ID NO: 3935980 - RNA, 13 nt, Shigella flexneri 2a str. 301
aacauggaaacca

SEQ ID NO: 3935981 - RNA, 14 nt, Shigella flexneri 2a str. 301
aacauggaaaccau

SEQ ID NO: 3935982 - RNA, 17 nt, Shigella flexneri 2a str. 301
aacauggaaaccaucau

SEQ ID NO: 3935983 - RNA, 15 nt, Shigella flexneri 2a str. 301
aacauggcaaccuuc

SEQ ID NO: 3935984 - RNA, 22 nt, Shigella flexneri 2a str. 301
aacauggcacugcgaucccggc

SEQ ID NO: 3935985 - RNA, 18 nt, Shigella flexneri 2a str. 301
aacauguuccugccaguc

SEQ ID NO: 3935986 - RNA, 14 nt, Shigella flexneri 2a str. 301
aacauuacuuuccg

SEQ ID NO: 3935987 - RNA, 21 nt, Shigella flexneri 2a str. 301
aacauuccacuuucgcggcuu

SEQ ID NO: 3935988 - RNA, 19 nt, Shigella flexneri 2a str. 301
aacauucccaucaguagca

SEQ ID NO: 3935989 - RNA, 21 nt, Shigella flexneri 2a str. 301
aacauugcccggucaggaugg

SEQ ID NO: 3935990 - RNA, 18 nt, Shigella flexneri 2a str. 301
aacauugcgccucaccgg

SEQ ID NO: 3935991 - RNA, 14 nt, Shigella flexneri 2a str. 301
aacauugcugccag

SEQ ID NO: 3935992 - RNA, 12 nt, Shigella flexneri 2a str. 301
aacauuggcuca

SEQ ID NO: 3935993 - RNA, 22 nt, Shigella flexneri 2a str. 301
aacauuggcucaucaaacaacg

SEQ ID NO: 3935994 - RNA, 23 nt, Shigella flexneri 2a str. 301
aacauuguuauucuccuucacga

SEQ ID NO: 3935995 - RNA, 19 nt, Shigella flexneri 2a str. 301
aacauuuucuucugccagg

SEQ ID NO: 3935996 - RNA, 16 nt, Shigella flexneri 2a str. 301
aaccaaaaauuuccac

SEQ ID NO: 3935997 - RNA, 14 nt, Shigella flexneri 2a str. 301
aaccaaaagcuggg

SEQ ID NO: 3935998 - RNA, 14 nt, Shigella flexneri 2a str. 301
aaccaaacagucac

SEQ ID NO: 3935999 - RNA, 20 nt, Shigella flexneri 2a str. 301
aaccaaacguggucgccagc

SEQ ID NO: 3936000 - RNA, 16 nt, Shigella flexneri 2a str. 301
aaccaacaauaaaauu

SEQ ID NO: 3936001 - RNA, 13 nt, Shigella flexneri 2a str. 301
aaccaacaaugca

SEQ ID NO: 3936002 - RNA, 13 nt, Shigella flexneri 2a str. 301
aaccaacaccugu

SEQ ID NO: 3936003 - RNA, 16 nt, Shigella flexneri 2a str. 301
aaccaacaguaucuga

SEQ ID NO: 3936004 - RNA, 20 nt, Shigella flexneri 2a str. 301
aaccaacggcgagccagcgc

SEQ ID NO: 3936005 - RNA, 13 nt, Shigella flexneri 2a str. 301
aaccaaucuccca

SEQ ID NO: 3936006 - RNA, 13 nt, Shigella flexneri 2a str. 301
aaccaaugccacc

SEQ ID NO: 3936007 - RNA, 14 nt, Shigella flexneri 2a str. 301
aaccacaaugaaga

SEQ ID NO: 3936008 - RNA, 13 nt, Shigella flexneri 2a str. 301
aaccacagcgccg

SEQ ID NO: 3936009 - RNA, 14 nt, Shigella flexneri 2a str. 301
aaccaccaaacugc

SEQ ID NO: 3936010 - RNA, 14 nt, Shigella flexneri 2a str. 301
aaccaccaguaaau

SEQ ID NO: 3936011 - RNA, 14 nt, Shigella flexneri 2a str. 301
aaccacccaccagc

SEQ ID NO: 3936012 - RNA, 18 nt, Shigella flexneri 2a str. 301
aaccuguggugcaggcgc

SEQ ID NO: 3936013 - RNA, 15 nt, Shigella flexneri 2a str. 301
aaccuuaaagcauuu

SEQ ID NO: 3936014 - RNA, 13 nt, Shigella flexneri 2a str. 301
aaccuuaaauggc

SEQ ID NO: 3936015 - RNA, 14 nt, Shigella flexneri 2a str. 301
aaccuuacaaguaa

SEQ ID NO: 3936016 - RNA, 22 nt, Shigella flexneri 2a str. 301
aaccuucuucauuaugaauagc

SEQ ID NO: 3936017 - RNA, 19 nt, Shigella flexneri 2a str. 301
aaccuugcacucgcagaag

SEQ ID NO: 3936018 - RNA, 20 nt, Shigella flexneri 2a str. 301
aaccuugcacucgcagaagc

SEQ ID NO: 3936019 - RNA, 16 nt, Shigella flexneri 2a str. 301
aaccuugcuggcgauu

SEQ ID NO: 3936020 - RNA, 21 nt, Shigella flexneri 2a str. 301
aaccuuggucgaagcuucuca

SEQ ID NO: 3936021 - RNA, 20 nt, Shigella flexneri 2a str. 301
aaccuuugcgguuaaaaaua

SEQ ID NO: 3936022 - RNA, 21 nt, Shigella flexneri 2a str. 301
aaccuuugcgguuaaaaauaa

SEQ ID NO: 3936023 - RNA, 20 nt, Shigella flexneri 2a str. 301
aacgaaagcagggcggcagg

SEQ ID NO: 3936024 - RNA, 21 nt, Shigella flexneri 2a str. 301
aacgaaccauaaaaucacagg

SEQ ID NO: 3936025 - RNA, 16 nt, Shigella flexneri 2a str. 301
aacgaagcgccauuca

SEQ ID NO: 3936026 - RNA, 17 nt, Shigella flexneri 2a str. 301
aacgaaguaauaaucaa

SEQ ID NO: 3936027 - RNA, 15 nt, Shigella flexneri 2a str. 301
aacgaauaguuucag

SEQ ID NO: 3936028 - RNA, 15 nt, Shigella flexneri 2a str. 301
aacgaaucaaucgcc

SEQ ID NO: 3936029 - RNA, 14 nt, Shigella flexneri 2a str. 301
aacgaaucugcaaa

SEQ ID NO: 3936030 - RNA, 22 nt, Shigella flexneri 2a str. 301
aacgaaucugcaaaucugcgcc

SEQ ID NO: 3936031 - RNA, 18 nt, Shigella flexneri 2a str. 301
aacgacaaaaauaccacc

SEQ ID NO: 3936032 - RNA, 19 nt, Shigella flexneri 2a str. 301
aacgacaccguuaaauaac

SEQ ID NO: 3936033 - RNA, 19 nt, Shigella flexneri 2a str. 301
aacgacagugacuuccguc

SEQ ID NO: 3936034 - RNA, 15 nt, Shigella flexneri 2a str. 301
aacgaccagaaaugc

SEQ ID NO: 3936035 - RNA, 21 nt, Shigella flexneri 2a str. 301
aacgaccaucagcugccaggg

SEQ ID NO: 3936036 - RNA, 21 nt, Shigella flexneri 2a str. 301
aacgaccggccauuccagcac

SEQ ID NO: 3936037 - RNA, 21 nt, Shigella flexneri 2a str. 301
aacgacgacugccgcucaccu

SEQ ID NO: 3936038 - RNA, 18 nt, Shigella flexneri 2a str. 301
aacgacgagcgcugguga

SEQ ID NO: 3936039 - RNA, 15 nt, Shigella flexneri 2a str. 301
aacgacgcagaacug

SEQ ID NO: 3936040 - RNA, 18 nt, Shigella flexneri 2a str. 301
aacgacugcgagcaaaau

SEQ ID NO: 3936041 - RNA, 19 nt, Shigella flexneri 2a str. 301
aacgagaaaaugacgauga

SEQ ID NO: 3936042 - RNA, 15 nt, Shigella flexneri 2a str. 301
aacgagagucgacac

SEQ ID NO: 3936043 - RNA, 16 nt, Shigella flexneri 2a str. 301
aacgagccaauaaaaa

SEQ ID NO: 3936044 - RNA, 17 nt, Shigella flexneri 2a str. 301
aacgagccaauaaaaau

SEQ ID NO: 3936045 - RNA, 16 nt, Shigella flexneri 2a str. 301
aacgauaacggugcaa

SEQ ID NO: 3936046 - RNA, 14 nt, Shigella flexneri 2a str. 301
aacgaucgcccaga

SEQ ID NO: 3936047 - RNA, 22 nt, Shigella flexneri 2a str. 301
aacgaucgccugguaccagcac

SEQ ID NO: 3936048 - RNA, 17 nt, Shigella flexneri 2a str. 301
aacgaucgcuuucaacg

SEQ ID NO: 3936049 - RNA, 12 nt, Shigella flexneri 2a str. 301
aacgaugacauc

SEQ ID NO: 3936050 - RNA, 19 nt, Shigella flexneri 2a str. 301
aacgaugacaucgcagcaa

SEQ ID NO: 3936051 - RNA, 12 nt, Shigella flexneri 2a str. 301
aacgauggcgcg

SEQ ID NO: 3936052 - RNA, 21 nt, Shigella flexneri 2a str. 301
aacgauggcuaauaauucuga

SEQ ID NO: 3936053 - RNA, 21 nt, Shigella flexneri 2a str. 301
aacgauucaaaagaugagaaa

SEQ ID NO: 3936054 - RNA, 16 nt, Shigella flexneri 2a str. 301
aacgauuuuuuccgca

SEQ ID NO: 3936055 - RNA, 19 nt, Shigella flexneri 2a str. 301
aacgcaaacuguuucaggu

SEQ ID NO: 3936056 - RNA, 13 nt, Shigella flexneri 2a str. 301
aacgcaccaggcg

SEQ ID NO: 3936057 - RNA, 21 nt, Shigella flexneri 2a str. 301
aacgcaccaggcgaaaacgcu

SEQ ID NO: 3936058 - RNA, 18 nt, Shigella flexneri 2a str. 301
aacgcaccgaccaucggc

SEQ ID NO: 3936059 - RNA, 16 nt, Shigella flexneri 2a str. 301
aacgcaccgccaccac

SEQ ID NO: 3936060 - RNA, 13 nt, Shigella flexneri 2a str. 301
aacgcaccugaaa

SEQ ID NO: 3936061 - RNA, 18 nt, Shigella flexneri 2a str. 301
aacgcacgucugauguaa

SEQ ID NO: 3936062 - RNA, 21 nt, Shigella flexneri 2a str. 301
aacgcagcgaguaauagauga

SEQ ID NO: 3936063 - RNA, 17 nt, Shigella flexneri 2a str. 301
aacgcagcuccgggcuc

SEQ ID NO: 3936064 - RNA, 16 nt, Shigella flexneri 2a str. 301
aacgcaugcacaucca

SEQ ID NO: 3936065 - RNA, 23 nt, Shigella flexneri 2a str. 301
aacgcauuuaucuucaaggcaga

SEQ ID NO: 3936066 - RNA, 19 nt, Shigella flexneri 2a str. 301
aacgccaauuacgcgcaau

SEQ ID NO: 3936067 - RNA, 14 nt, Shigella flexneri 2a str. 301
aacgccacauccgg

SEQ ID NO: 3936068 - RNA, 23 nt, Shigella flexneri 2a str. 301
aacgccaccauuuuacguccgcg

SEQ ID NO: 3936069 - RNA, 18 nt, Shigella flexneri 2a str. 301
aacgccaccccacaccag

SEQ ID NO: 3936070 - RNA, 14 nt, Shigella flexneri 2a str. 301
aacgccacgcucac

SEQ ID NO: 3936071 - RNA, 17 nt, Shigella flexneri 2a str. 301
aacgccacgcucacuca

SEQ ID NO: 3936072 - RNA, 14 nt, Shigella flexneri 2a str. 301
aacgccagaucacc

SEQ ID NO: 3936073 - RNA, 20 nt, Shigella flexneri 2a str. 301
aacgccagccuguuccagac

SEQ ID NO: 3936074 - RNA, 23 nt, Shigella flexneri 2a str. 301
aacgccauauucugaucgugcuc

SEQ ID NO: 3936075 - RNA, 18 nt, Shigella flexneri 2a str. 301
aacgcccagcuaaucgag

SEQ ID NO: 3936076 - RNA, 15 nt, Shigella flexneri 2a str. 301
aacgccccaauccac

SEQ ID NO: 3936077 - RNA, 15 nt, Shigella flexneri 2a str. 301
aacgcccguccauca

SEQ ID NO: 3936078 - RNA, 13 nt, Shigella flexneri 2a str. 301
aacgcccuuaccu

SEQ ID NO: 3936079 - RNA, 16 nt, Shigella flexneri 2a str. 301
aacgccgaauaacgcg

SEQ ID NO: 3936080 - RNA, 16 nt, Shigella flexneri 2a str. 301
aacgccgccagaccac

SEQ ID NO: 3936081 - RNA, 16 nt, Shigella flexneri 2a str. 301
aacgccgccaguacgc

SEQ ID NO: 3936082 - RNA, 16 nt, Shigella flexneri 2a str. 301
aacgccgcgccauagu

SEQ ID NO: 3936083 - RNA, 22 nt, Shigella flexneri 2a str. 301
aacgccgcuauacgccucacag

SEQ ID NO: 3936084 - RNA, 21 nt, Shigella flexneri 2a str. 301
aacgccggaaaacguuucaaa

SEQ ID NO: 3936085 - RNA, 15 nt, Shigella flexneri 2a str. 301
aacgccggagagaaa

SEQ ID NO: 3936086 - RNA, 16 nt, Shigella flexneri 2a str. 301
aacgccggagugaaaa

SEQ ID NO: 3936087 - RNA, 18 nt, Shigella flexneri 2a str. 301
aacgccggagugaaaauu

SEQ ID NO: 3936088 - RNA, 19 nt, Shigella flexneri 2a str. 301
aacgccggaugacacauca

SEQ ID NO: 3936089 - RNA, 15 nt, Shigella flexneri 2a str. 301
aacgccggguaaaug

SEQ ID NO: 3936090 - RNA, 24 nt, Shigella flexneri 2a str. 301
aacgccggugaccaucagcaugac

SEQ ID NO: 3936091 - RNA, 22 nt, Shigella flexneri 2a str. 301
aacgccguuauuaaaaagccug

SEQ ID NO: 3936092 - RNA, 16 nt, Shigella flexneri 2a str. 301
aacgccuaauccagcc

SEQ ID NO: 3936093 - RNA, 23 nt, Shigella flexneri 2a str. 301
aacgccugcuuaucgcccugcuc

SEQ ID NO: 3936094 - RNA, 22 nt, Shigella flexneri 2a str. 301
aacgccugggcgagguggauau

SEQ ID NO: 3936095 - RNA, 17 nt, Shigella flexneri 2a str. 301
aacgccuuccgucagca

SEQ ID NO: 3936096 - RNA, 21 nt, Shigella flexneri 2a str. 301
aacgccuuccgucagcaaagu

SEQ ID NO: 3936097 - RNA, 19 nt, Shigella flexneri 2a str. 301
aacgccuuucgcuguaaac

SEQ ID NO: 3936098 - RNA, 21 nt, Shigella flexneri 2a str. 301
aacgcgaaaaugccccagcgc

SEQ ID NO: 3936099 - RNA, 15 nt, Shigella flexneri 2a str. 301
aacgcgaaggccaga

SEQ ID NO: 3936100 - RNA, 21 nt, Shigella flexneri 2a str. 301
aacgcgaggaugcguuuuccg

SEQ ID NO: 3936101 - RNA, 19 nt, Shigella flexneri 2a str. 301
aacgcgaucgacgcgucca

SEQ ID NO: 3936102 - RNA, 13 nt, Shigella flexneri 2a str. 301
aacgcgaucgcga

SEQ ID NO: 3936103 - RNA, 23 nt, Shigella flexneri 2a str. 301
aacgcgauucccagucgcgcaau

SEQ ID NO: 3936104 - RNA, 17 nt, Shigella flexneri 2a str. 301
aacgcgcaaccagcagg

SEQ ID NO: 3936105 - RNA, 19 nt, Shigella flexneri 2a str. 301
aacgcgcaccgugacagua

SEQ ID NO: 3936106 - RNA, 15 nt, Shigella flexneri 2a str. 301
aacgcgcauccggca

SEQ ID NO: 3936107 - RNA, 23 nt, Shigella flexneri 2a str. 301
aacgcgccaagauagaaccacgc

SEQ ID NO: 3936108 - RNA, 20 nt, Shigella flexneri 2a str. 301
aacgcgcccucagcccacau

SEQ ID NO: 3936109 - RNA, 19 nt, Shigella flexneri 2a str. 301
aacgcgcggcuuaucgggc

SEQ ID NO: 3936110 - RNA, 20 nt, Shigella flexneri 2a str. 301
aacgcgcuacugaaucccug

SEQ ID NO: 3936111 - RNA, 18 nt, Shigella flexneri 2a str. 301
aacuaucgacgcaaacgc

SEQ ID NO: 3936112 - RNA, 22 nt, Shigella flexneri 2a str. 301
aacuauuguuuugaugaaucag

SEQ ID NO: 3936113 - RNA, 16 nt, Shigella flexneri 2a str. 301
aacucaaaaauaauca

SEQ ID NO: 3936114 - RNA, 14 nt, Shigella flexneri 2a str. 301
aacucaacgccuuc

SEQ ID NO: 3936115 - RNA, 16 nt, Shigella flexneri 2a str. 301
aacucaaucaggcuau

SEQ ID NO: 3936116 - RNA, 13 nt, Shigella flexneri 2a str. 301
aacucaaucgccu

SEQ ID NO: 3936117 - RNA, 19 nt, Shigella flexneri 2a str. 301
aacucaaucgccucgccga

SEQ ID NO: 3936118 - RNA, 16 nt, Shigella flexneri 2a str. 301
aacucaauuaccaacu

SEQ ID NO: 3936119 - RNA, 17 nt, Shigella flexneri 2a str. 301
aacucaauuaccaacuc

SEQ ID NO: 3936120 - RNA, 12 nt, Shigella flexneri 2a str. 301
aacucacacagc

SEQ ID NO: 3936121 - RNA, 13 nt, Shigella flexneri 2a str. 301
aacucaccaucaa

SEQ ID NO: 3936122 - RNA, 19 nt, Shigella flexneri 2a str. 301
aacucaccaucaaguagca

SEQ ID NO: 3936123 - RNA, 18 nt, Shigella flexneri 2a str. 301
aacucacccaugaagaau

SEQ ID NO: 3936124 - RNA, 20 nt, Shigella flexneri 2a str. 301
aacucacccaugaagaauau

SEQ ID NO: 3936125 - RNA, 14 nt, Shigella flexneri 2a str. 301
aacucaccgaugau

SEQ ID NO: 3936126 - RNA, 22 nt, Shigella flexneri 2a str. 301
aacucaccgaugaucgccauca

SEQ ID NO: 3936127 - RNA, 18 nt, Shigella flexneri 2a str. 301
aacucaccggcauuuuuu

SEQ ID NO: 3936128 - RNA, 14 nt, Shigella flexneri 2a str. 301
aacucaccuuuaaa

SEQ ID NO: 3936129 - RNA, 16 nt, Shigella flexneri 2a str. 301
aacucaccuuuuuugu

SEQ ID NO: 3936130 - RNA, 12 nt, Shigella flexneri 2a str. 301
aacucacgcagg

SEQ ID NO: 3936131 - RNA, 18 nt, Shigella flexneri 2a str. 301
aacucacgccccagauug

SEQ ID NO: 3936132 - RNA, 19 nt, Shigella flexneri 2a str. 301
aacucaggcuggcaagcug

SEQ ID NO: 3936133 - RNA, 15 nt, Shigella flexneri 2a str. 301
aacucauaaauucaa

SEQ ID NO: 3936134 - RNA, 20 nt, Shigella flexneri 2a str. 301
aacucauacaccagcggcac

SEQ ID NO: 3936135 - RNA, 18 nt, Shigella flexneri 2a str. 301
aacucaucaccaucaggc

SEQ ID NO: 3936136 - RNA, 19 nt, Shigella flexneri 2a str. 301
aacucaucaccaucaggca

SEQ ID NO: 3936137 - RNA, 11 nt, Shigella flexneri 2a str. 301
aacucaucacu

SEQ ID NO: 3936138 - RNA, 14 nt, Shigella flexneri 2a str. 301
aacucaucgccgcu

SEQ ID NO: 3936139 - RNA, 18 nt, Shigella flexneri 2a str. 301
aacucauugccaguccua

SEQ ID NO: 3936140 - RNA, 14 nt, Shigella flexneri 2a str. 301
aacuccaccagcac

SEQ ID NO: 3936141 - RNA, 20 nt, Shigella flexneri 2a str. 301
aacuccacgcgcggacgaga

SEQ ID NO: 3936142 - RNA, 12 nt, Shigella flexneri 2a str. 301
aacuccacuuca

SEQ ID NO: 3936143 - RNA, 22 nt, Shigella flexneri 2a str. 301
aacuccacuucaccgcgaauau

SEQ ID NO: 3936144 - RNA, 20 nt, Shigella flexneri 2a str. 301
aacuccauacaucuucauca

SEQ ID NO: 3936145 - RNA, 15 nt, Shigella flexneri 2a str. 301
aacuccaucuuuaac

SEQ ID NO: 3936146 - RNA, 22 nt, Shigella flexneri 2a str. 301
aacucccgcgcggguaauugcu

SEQ ID NO: 3936147 - RNA, 22 nt, Shigella flexneri 2a str. 301
aacuccgccgcaucuucccagg

SEQ ID NO: 3936148 - RNA, 11 nt, Shigella flexneri 2a str. 301
aacuccgucgc

SEQ ID NO: 3936149 - RNA, 15 nt, Shigella flexneri 2a str. 301
aacuccgugaagcuc

SEQ ID NO: 3936150 - RNA, 16 nt, Shigella flexneri 2a str. 301
aacucgaccagcagcu

SEQ ID NO: 3936151 - RNA, 19 nt, Shigella flexneri 2a str. 301
aacucgaggauaaauuuuc

SEQ ID NO: 3936152 - RNA, 17 nt, Shigella flexneri 2a str. 301
aacucgccagccaccau

SEQ ID NO: 3936153 - RNA, 14 nt, Shigella flexneri 2a str. 301
aacucgcugccagc

SEQ ID NO: 3936154 - RNA, 17 nt, Shigella flexneri 2a str. 301
aacucgcugccagcacu

SEQ ID NO: 3936155 - RNA, 21 nt, Shigella flexneri 2a str. 301
aacucgcuuaagccaucauca

SEQ ID NO: 3936156 - RNA, 22 nt, Shigella flexneri 2a str. 301
aacucuaaucccuuagcuaauu

SEQ ID NO: 3936157 - RNA, 17 nt, Shigella flexneri 2a str. 301
aacucucaaaacaacac

SEQ ID NO: 3936158 - RNA, 14 nt, Shigella flexneri 2a str. 301
aacucucuauucca

SEQ ID NO: 3936159 - RNA, 22 nt, Shigella flexneri 2a str. 301
aacucugccgcaaucaucgacc

SEQ ID NO: 3936160 - RNA, 15 nt, Shigella flexneri 2a str. 301
aacucugcggcauca

SEQ ID NO: 3936161 - RNA, 14 nt, Shigella flexneri 2a str. 301
aacucuuccuuaac

SEQ ID NO: 3936162 - RNA, 19 nt, Shigella flexneri 2a str. 301
aacucuuuuuccugcugca

SEQ ID NO: 3936163 - RNA, 21 nt, Shigella flexneri 2a str. 301
aacugaaaggcgcucauuuuc

SEQ ID NO: 3936164 - RNA, 13 nt, Shigella flexneri 2a str. 301
aacugaacaaaaa

SEQ ID NO: 3936165 - RNA, 12 nt, Shigella flexneri 2a str. 301
aacugacaauuc

SEQ ID NO: 3936166 - RNA, 16 nt, Shigella flexneri 2a str. 301
aacugacagagaacau

SEQ ID NO: 3936167 - RNA, 18 nt, Shigella flexneri 2a str. 301
aacugacugacuucaaca

SEQ ID NO: 3936168 - RNA, 18 nt, Shigella flexneri 2a str. 301
aacugacuuccacuuccu

SEQ ID NO: 3936169 - RNA, 18 nt, Shigella flexneri 2a str. 301
aacugagcgccgucgcga

SEQ ID NO: 3936170 - RNA, 20 nt, Shigella flexneri 2a str. 301
aacugaguggaguccagcgc

SEQ ID NO: 3936171 - RNA, 22 nt, Shigella flexneri 2a str. 301
aacugauaaaccuucaucguuu

SEQ ID NO: 3936172 - RNA, 20 nt, Shigella flexneri 2a str. 301
aacugauggcaaaugcagca

SEQ ID NO: 3936173 - RNA, 19 nt, Shigella flexneri 2a str. 301
aacugauuuagcaucagcg

SEQ ID NO: 3936174 - RNA, 17 nt, Shigella flexneri 2a str. 301
aacugccaguaaagcag

SEQ ID NO: 3936175 - RNA, 17 nt, Shigella flexneri 2a str. 301
aacugccaguucccccu

SEQ ID NO: 3936176 - RNA, 16 nt, Shigella flexneri 2a str. 301
aacugcccgaucaacg

SEQ ID NO: 3936177 - RNA, 20 nt, Shigella flexneri 2a str. 301
aacugccgcgccugaaucug

SEQ ID NO: 3936178 - RNA, 12 nt, Shigella flexneri 2a str. 301
aacugccugaug

SEQ ID NO: 3936179 - RNA, 21 nt, Shigella flexneri 2a str. 301
aacugcgccacucgauaccag

SEQ ID NO: 3936180 - RNA, 13 nt, Shigella flexneri 2a str. 301
aacugcgccucaa

SEQ ID NO: 3936181 - RNA, 21 nt, Shigella flexneri 2a str. 301
aacugcgcuauaucgcugaua

SEQ ID NO: 3936182 - RNA, 20 nt, Shigella flexneri 2a str. 301
aacugcuauucaccagcaaa

SEQ ID NO: 3936183 - RNA, 23 nt, Shigella flexneri 2a str. 301
aacugcuggcuuaaaaaacggau

SEQ ID NO: 3936184 - RNA, 16 nt, Shigella flexneri 2a str. 301
aacugcuuaucaucac

SEQ ID NO: 3936185 - RNA, 23 nt, Shigella flexneri 2a str. 301
aacugcuucaaaaaaauucugaa

SEQ ID NO: 3936186 - RNA, 13 nt, Shigella flexneri 2a str. 301
aacuggaaaaaua

SEQ ID NO: 3936187 - RNA, 17 nt, Shigella flexneri 2a str. 301
aacuggaaaaauaauuu

SEQ ID NO: 3936188 - RNA, 15 nt, Shigella flexneri 2a str. 301
aacuggaugaaaaaa

SEQ ID NO: 3936189 - RNA, 15 nt, Shigella flexneri 2a str. 301
aacuggauggcucug

SEQ ID NO: 3936190 - RNA, 13 nt, Shigella flexneri 2a str. 301
aacuggcaggaaa

SEQ ID NO: 3936191 - RNA, 15 nt, Shigella flexneri 2a str. 301
aacuggcaggaaaca

SEQ ID NO: 3936192 - RNA, 20 nt, Shigella flexneri 2a str. 301
aacuggcggucaugacgaua

SEQ ID NO: 3936193 - RNA, 17 nt, Shigella flexneri 2a str. 301
aacuggcguguuucauu

SEQ ID NO: 3936194 - RNA, 19 nt, Shigella flexneri 2a str. 301
aacuggcuugguaacaugc

SEQ ID NO: 3936195 - RNA, 22 nt, Shigella flexneri 2a str. 301
aacugguccagccccugaagcg

SEQ ID NO: 3936196 - RNA, 20 nt, Shigella flexneri 2a str. 301
aacugguguugaaaccgcug

SEQ ID NO: 3936197 - RNA, 21 nt, Shigella flexneri 2a str. 301
aacuguaacgcagaagguuau

SEQ ID NO: 3936198 - RNA, 23 nt, Shigella flexneri 2a str. 301
aacuguacaggcuccuguagcug

SEQ ID NO: 3936199 - RNA, 15 nt, Shigella flexneri 2a str. 301
aacuguaccagcaac

SEQ ID NO: 3936200 - RNA, 17 nt, Shigella flexneri 2a str. 301
aacugucaauaaacgcc

SEQ ID NO: 3936201 - RNA, 18 nt, Shigella flexneri 2a str. 301
aacugucaauaaacgccu

SEQ ID NO: 3936202 - RNA, 17 nt, Shigella flexneri 2a str. 301
aacugucuucaccauag

SEQ ID NO: 3936203 - RNA, 18 nt, Shigella flexneri 2a str. 301
aacugugcacccgcuuca

SEQ ID NO: 3936204 - RNA, 14 nt, Shigella flexneri 2a str. 301
aacuguguaaugcg

SEQ ID NO: 3936205 - RNA, 22 nt, Shigella flexneri 2a str. 301
aacuguugaccauuugugcaua

SEQ ID NO: 3936206 - RNA, 23 nt, Shigella flexneri 2a str. 301
aacuguuucgcgguaaacugcau

SEQ ID NO: 3936207 - RNA, 16 nt, Shigella flexneri 2a str. 301
aacuuaacaguaacaa

SEQ ID NO: 3936208 - RNA, 12 nt, Shigella flexneri 2a str. 301
aacuuaagucuc

SEQ ID NO: 3936209 - RNA, 21 nt, Shigella flexneri 2a str. 301
aacuuacugauaguguuuuau

SEQ ID NO: 3936210 - RNA, 14 nt, Shigella flexneri 2a str. 301
aacuuagauugcaa

SEQ ID NO: 3936211 - RNA, 16 nt, Shigella flexneri 2a str. 301
aagagaaccagcugcc

SEQ ID NO: 3936212 - RNA, 14 nt, Shigella flexneri 2a str. 301
aagagacaaaaaag

SEQ ID NO: 3936213 - RNA, 20 nt, Shigella flexneri 2a str. 301
aagagacagaaucaggccau

SEQ ID NO: 3936214 - RNA, 23 nt, Shigella flexneri 2a str. 301
aagagacagccgaaaagguagaa

SEQ ID NO: 3936215 - RNA, 19 nt, Shigella flexneri 2a str. 301
aagagauaaacgaccacuc

SEQ ID NO: 3936216 - RNA, 13 nt, Shigella flexneri 2a str. 301
aagagcaaauaaa

SEQ ID NO: 3936217 - RNA, 16 nt, Shigella flexneri 2a str. 301
aagagcaaauaaaaca

SEQ ID NO: 3936218 - RNA, 19 nt, Shigella flexneri 2a str. 301
aagagcaaauaaaacauca

SEQ ID NO: 3936219 - RNA, 15 nt, Shigella flexneri 2a str. 301
aagagcgacaauccc

SEQ ID NO: 3936220 - RNA, 19 nt, Shigella flexneri 2a str. 301
aagagcgauccguucagau

SEQ ID NO: 3936221 - RNA, 17 nt, Shigella flexneri 2a str. 301
aagagcgaucggcagcu

SEQ ID NO: 3936222 - RNA, 18 nt, Shigella flexneri 2a str. 301
aagagcgggacaacaaac

SEQ ID NO: 3936223 - RNA, 17 nt, Shigella flexneri 2a str. 301
aagagcgucuggaagaa

SEQ ID NO: 3936224 - RNA, 18 nt, Shigella flexneri 2a str. 301
aagagcuggggcugagcg

SEQ ID NO: 3936225 - RNA, 13 nt, Shigella flexneri 2a str. 301
aagaggaacaaau

SEQ ID NO: 3936226 - RNA, 21 nt, Shigella flexneri 2a str. 301
aagaggcggagguuuuuuccu

SEQ ID NO: 3936227 - RNA, 14 nt, Shigella flexneri 2a str. 301
aagaggugggggau

SEQ ID NO: 3936228 - RNA, 13 nt, Shigella flexneri 2a str. 301
aagaguuccaacg

SEQ ID NO: 3936229 - RNA, 17 nt, Shigella flexneri 2a str. 301
aagaguuuuaaacgcag

SEQ ID NO: 3936230 - RNA, 12 nt, Shigella flexneri 2a str. 301
aagauaaacccc

SEQ ID NO: 3936231 - RNA, 22 nt, Shigella flexneri 2a str. 301
aagauaaaucgcacguugucag

SEQ ID NO: 3936232 - RNA, 16 nt, Shigella flexneri 2a str. 301
aagauagcgucauuuc

SEQ ID NO: 3936233 - RNA, 12 nt, Shigella flexneri 2a str. 301
aagauauguugu

SEQ ID NO: 3936234 - RNA, 14 nt, Shigella flexneri 2a str. 301
aagauauguugugg

SEQ ID NO: 3936235 - RNA, 16 nt, Shigella flexneri 2a str. 301
aagauauguuguggga

SEQ ID NO: 3936236 - RNA, 15 nt, Shigella flexneri 2a str. 301
aagauauugccgauu

SEQ ID NO: 3936237 - RNA, 21 nt, Shigella flexneri 2a str. 301
aagauauuggggguaauuccc

SEQ ID NO: 3936238 - RNA, 22 nt, Shigella flexneri 2a str. 301
aagauauuguuuuccguugugc

SEQ ID NO: 3936239 - RNA, 18 nt, Shigella flexneri 2a str. 301
aagauauuucaccagcgc

SEQ ID NO: 3936240 - RNA, 18 nt, Shigella flexneri 2a str. 301
aagauauuuuuaugcaug

SEQ ID NO: 3936241 - RNA, 16 nt, Shigella flexneri 2a str. 301
aagaucaucggccaga

SEQ ID NO: 3936242 - RNA, 15 nt, Shigella flexneri 2a str. 301
aagaucgaaggcugu

SEQ ID NO: 3936243 - RNA, 15 nt, Shigella flexneri 2a str. 301
aagaucgcucaucag

SEQ ID NO: 3936244 - RNA, 12 nt, Shigella flexneri 2a str. 301
aagaucuuugcg

SEQ ID NO: 3936245 - RNA, 14 nt, Shigella flexneri 2a str. 301
aagaugaaacuuau

SEQ ID NO: 3936246 - RNA, 17 nt, Shigella flexneri 2a str. 301
aagaugaaacuuauuca

SEQ ID NO: 3936247 - RNA, 17 nt, Shigella flexneri 2a str. 301
aagaugaauaauguuua

SEQ ID NO: 3936248 - RNA, 18 nt, Shigella flexneri 2a str. 301
aagaugacauugacaguu

SEQ ID NO: 3936249 - RNA, 16 nt, Shigella flexneri 2a str. 301
aagaugaugucacagc

SEQ ID NO: 3936250 - RNA, 21 nt, Shigella flexneri 2a str. 301
aagaugcgucagcaucgcauc

SEQ ID NO: 3936251 - RNA, 12 nt, Shigella flexneri 2a str. 301
aagaugcuacaa

SEQ ID NO: 3936252 - RNA, 16 nt, Shigella flexneri 2a str. 301
aagaugcuacaacauc

SEQ ID NO: 3936253 - RNA, 21 nt, Shigella flexneri 2a str. 301
aagauguucuaucuuucagac

SEQ ID NO: 3936254 - RNA, 22 nt, Shigella flexneri 2a str. 301
aagauguugacgccgucaaaac

SEQ ID NO: 3936255 - RNA, 18 nt, Shigella flexneri 2a str. 301
aagauuaaaccaguucgu

SEQ ID NO: 3936256 - RNA, 22 nt, Shigella flexneri 2a str. 301
aagauuaagagaaccagcugcc

SEQ ID NO: 3936257 - RNA, 12 nt, Shigella flexneri 2a str. 301
aagauuacugac

SEQ ID NO: 3936258 - RNA, 13 nt, Shigella flexneri 2a str. 301
aagauuacugaca

SEQ ID NO: 3936259 - RNA, 22 nt, Shigella flexneri 2a str. 301
aagauuacugacaauuugccca

SEQ ID NO: 3936260 - RNA, 14 nt, Shigella flexneri 2a str. 301
aagauuagccugaa

SEQ ID NO: 3936261 - RNA, 20 nt, Shigella flexneri 2a str. 301
aagauucaguucaacggugu

SEQ ID NO: 3936262 - RNA, 16 nt, Shigella flexneri 2a str. 301
aagauucguauuuaaa

SEQ ID NO: 3936263 - RNA, 21 nt, Shigella flexneri 2a str. 301
aagauugccggggauaucccc

SEQ ID NO: 3936264 - RNA, 22 nt, Shigella flexneri 2a str. 301
aagauuuugcugugcuuuacac

SEQ ID NO: 3936265 - RNA, 21 nt, Shigella flexneri 2a str. 301
aagauuuuugcuugguucucc

SEQ ID NO: 3936266 - RNA, 14 nt, Shigella flexneri 2a str. 301
aagcaaaaacgcau

SEQ ID NO: 3936267 - RNA, 17 nt, Shigella flexneri 2a str. 301
aagcaaaaacgcauacg

SEQ ID NO: 3936268 - RNA, 14 nt, Shigella flexneri 2a str. 301
aagcaaaaauaaau

SEQ ID NO: 3936269 - RNA, 22 nt, Shigella flexneri 2a str. 301
aagcaaaaauaaaugcuugacu

SEQ ID NO: 3936270 - RNA, 16 nt, Shigella flexneri 2a str. 301
aagcaaaacgccgguu

SEQ ID NO: 3936271 - RNA, 13 nt, Shigella flexneri 2a str. 301
aagcaaaauguua

SEQ ID NO: 3936272 - RNA, 12 nt, Shigella flexneri 2a str. 301
aagcaacaaagu

SEQ ID NO: 3936273 - RNA, 18 nt, Shigella flexneri 2a str. 301
aagcaacgcgcaccguga

SEQ ID NO: 3936274 - RNA, 12 nt, Shigella flexneri 2a str. 301
aagcaacuccau

SEQ ID NO: 3936275 - RNA, 18 nt, Shigella flexneri 2a str. 301
aagcaacugacuggcucu

SEQ ID NO: 3936276 - RNA, 16 nt, Shigella flexneri 2a str. 301
aagcaauaccgcgaau

SEQ ID NO: 3936277 - RNA, 15 nt, Shigella flexneri 2a str. 301
aagcaauuaacagug

SEQ ID NO: 3936278 - RNA, 15 nt, Shigella flexneri 2a str. 301
aagcacccagcaauc

SEQ ID NO: 3936279 - RNA, 16 nt, Shigella flexneri 2a str. 301
aagcacccagcaaucc

SEQ ID NO: 3936280 - RNA, 18 nt, Shigella flexneri 2a str. 301
aagcaccugcgcaggcau

SEQ ID NO: 3936281 - RNA, 21 nt, Shigella flexneri 2a str. 301
aagcacuacucuauacaggau

SEQ ID NO: 3936282 - RNA, 19 nt, Shigella flexneri 2a str. 301
aagcacucguaagaggcgu

SEQ ID NO: 3936283 - RNA, 13 nt, Shigella flexneri 2a str. 301
aagcacugccaga

SEQ ID NO: 3936284 - RNA, 18 nt, Shigella flexneri 2a str. 301
aagcacugucuaacaaca

SEQ ID NO: 3936285 - RNA, 15 nt, Shigella flexneri 2a str. 301
aagcagaaaaagaag

SEQ ID NO: 3936286 - RNA, 19 nt, Shigella flexneri 2a str. 301
aagcagacaacccacacau

SEQ ID NO: 3936287 - RNA, 13 nt, Shigella flexneri 2a str. 301
aagcagagcagac

SEQ ID NO: 3936288 - RNA, 19 nt, Shigella flexneri 2a str. 301
aagcagagcagacgcgaau

SEQ ID NO: 3936289 - RNA, 16 nt, Shigella flexneri 2a str. 301
aagcagagcagggaag

SEQ ID NO: 3936290 - RNA, 15 nt, Shigella flexneri 2a str. 301
aagcagaucuggaag

SEQ ID NO: 3936291 - RNA, 16 nt, Shigella flexneri 2a str. 301
aagcagauucuucgau

SEQ ID NO: 3936292 - RNA, 15 nt, Shigella flexneri 2a str. 301
aagcagcgaugcuuu

SEQ ID NO: 3936293 - RNA, 20 nt, Shigella flexneri 2a str. 301
aagcagcgcgcagaacauau

SEQ ID NO: 3936294 - RNA, 22 nt, Shigella flexneri 2a str. 301
aagcaggucggcucagccgaug

SEQ ID NO: 3936295 - RNA, 23 nt, Shigella flexneri 2a str. 301
aagcaggucggcucagccgauga

SEQ ID NO: 3936296 - RNA, 15 nt, Shigella flexneri 2a str. 301
aagcaggugccuuac

SEQ ID NO: 3936297 - RNA, 21 nt, Shigella flexneri 2a str. 301
aagcaguccagcgccugacgc

SEQ ID NO: 3936298 - RNA, 18 nt, Shigella flexneri 2a str. 301
aagcaguuucaccagcag

SEQ ID NO: 3936299 - RNA, 19 nt, Shigella flexneri 2a str. 301
aagcaguuucaccagcagu

SEQ ID NO: 3936300 - RNA, 13 nt, Shigella flexneri 2a str. 301
aagcauagcccca

SEQ ID NO: 3936301 - RNA, 17 nt, Shigella flexneri 2a str. 301
aagcaucguuguuacaa

SEQ ID NO: 3936302 - RNA, 12 nt, Shigella flexneri 2a str. 301
aagcaugaugcg

SEQ ID NO: 3936303 - RNA, 17 nt, Shigella flexneri 2a str. 301
aagcauucacgccgcau

SEQ ID NO: 3936304 - RNA, 17 nt, Shigella flexneri 2a str. 301
aagcauucguaaugaau

SEQ ID NO: 3936305 - RNA, 11 nt, Shigella flexneri 2a str. 301
aagcauuuaau

SEQ ID NO: 3936306 - RNA, 23 nt, Shigella flexneri 2a str. 301
aagcauuuggugucgcugaaagc

SEQ ID NO: 3936307 - RNA, 18 nt, Shigella flexneri 2a str. 301
aagcauuuucauccauua

SEQ ID NO: 3936308 - RNA, 14 nt, Shigella flexneri 2a str. 301
aagcauuuuuucac

SEQ ID NO: 3936309 - RNA, 20 nt, Shigella flexneri 2a str. 301
aagcauuuuuucacauguuc

SEQ ID NO: 3936310 - RNA, 15 nt, Shigella flexneri 2a str. 301
aagccaaaucaucca

SEQ ID NO: 3936311 - RNA, 15 nt, Shigella flexneri 2a str. 301
aagccaacagcagcc

SEQ ID NO: 3936312 - RNA, 13 nt, Shigella flexneri 2a str. 301
aaguagaaauuau

SEQ ID NO: 3936313 - RNA, 14 nt, Shigella flexneri 2a str. 301
aaguagccuucauc

SEQ ID NO: 3936314 - RNA, 17 nt, Shigella flexneri 2a str. 301
aaguagccuucaucaga

SEQ ID NO: 3936315 - RNA, 20 nt, Shigella flexneri 2a str. 301
aaguagcgccauacugacua

SEQ ID NO: 3936316 - RNA, 19 nt, Shigella flexneri 2a str. 301
aaguagugauuuuaauaaa

SEQ ID NO: 3936317 - RNA, 18 nt, Shigella flexneri 2a str. 301
aaguaguuccagcaugau

SEQ ID NO: 3936318 - RNA, 17 nt, Shigella flexneri 2a str. 301
aaguauauaaaaaacaa

SEQ ID NO: 3936319 - RNA, 18 nt, Shigella flexneri 2a str. 301
aaguaucgcuuuccugga

SEQ ID NO: 3936320 - RNA, 23 nt, Shigella flexneri 2a str. 301
aaguaucgcuuuccuggagagag

SEQ ID NO: 3936321 - RNA, 16 nt, Shigella flexneri 2a str. 301
aaguaugcaauaacaa

SEQ ID NO: 3936322 - RNA, 18 nt, Shigella flexneri 2a str. 301
aaguauggaaaucaccca

SEQ ID NO: 3936323 - RNA, 18 nt, Shigella flexneri 2a str. 301
aagucauuaccagcgagg

SEQ ID NO: 3936324 - RNA, 14 nt, Shigella flexneri 2a str. 301
aagucauuccuuca

SEQ ID NO: 3936325 - RNA, 16 nt, Shigella flexneri 2a str. 301
aaguccaaaagguccu

SEQ ID NO: 3936326 - RNA, 20 nt, Shigella flexneri 2a str. 301
aaguccaaaagguccuucag

SEQ ID NO: 3936327 - RNA, 10 nt, Shigella flexneri 2a str. 301
aagucccccc

SEQ ID NO: 3936328 - RNA, 23 nt, Shigella flexneri 2a str. 301
aaguccccccccucgcaccaaaa

SEQ ID NO: 3936329 - RNA, 22 nt, Shigella flexneri 2a str. 301
aaguccgaggaaggcacguaca

SEQ ID NO: 3936330 - RNA, 17 nt, Shigella flexneri 2a str. 301
aaguccgguaauggaga

SEQ ID NO: 3936331 - RNA, 18 nt, Shigella flexneri 2a str. 301
aaguccguugaaaaugcu

SEQ ID NO: 3936332 - RNA, 14 nt, Shigella flexneri 2a str. 301
aagucggucacagu

SEQ ID NO: 3936333 - RNA, 15 nt, Shigella flexneri 2a str. 301
aagucguaggccuga

SEQ ID NO: 3936334 - RNA, 15 nt, Shigella flexneri 2a str. 301
aagucguucagaucu

SEQ ID NO: 3936335 - RNA, 18 nt, Shigella flexneri 2a str. 301
aagucucaagagugaaca

SEQ ID NO: 3936336 - RNA, 15 nt, Shigella flexneri 2a str. 301
aagucucagaaagua

SEQ ID NO: 3936337 - RNA, 16 nt, Shigella flexneri 2a str. 301
aagucucagaaaguaa

SEQ ID NO: 3936338 - RNA, 13 nt, Shigella flexneri 2a str. 301
aagucuuuguauu

SEQ ID NO: 3936339 - RNA, 16 nt, Shigella flexneri 2a str. 301
aagucuuuguauuuau

SEQ ID NO: 3936340 - RNA, 19 nt, Shigella flexneri 2a str. 301
aagucuuuuuucaacuuua

SEQ ID NO: 3936341 - RNA, 20 nt, Shigella flexneri 2a str. 301
aagucuuuuuucaacuuuau

SEQ ID NO: 3936342 - RNA, 21 nt, Shigella flexneri 2a str. 301
aagucuuuuuucaacuuuauc

SEQ ID NO: 3936343 - RNA, 14 nt, Shigella flexneri 2a str. 301
aagugaagaugaau

SEQ ID NO: 3936344 - RNA, 17 nt, Shigella flexneri 2a str. 301
aagugaauacagaacag

SEQ ID NO: 3936345 - RNA, 20 nt, Shigella flexneri 2a str. 301
aagugaauagcgcccggaaa

SEQ ID NO: 3936346 - RNA, 18 nt, Shigella flexneri 2a str. 301
aagugagaauuuuucacu

SEQ ID NO: 3936347 - RNA, 20 nt, Shigella flexneri 2a str. 301
aagugagguguacuggcaau

SEQ ID NO: 3936348 - RNA, 11 nt, Shigella flexneri 2a str. 301
aagugaguauc

SEQ ID NO: 3936349 - RNA, 18 nt, Shigella flexneri 2a str. 301
aagugaguugguuauuca

SEQ ID NO: 3936350 - RNA, 20 nt, Shigella flexneri 2a str. 301
aagugaugguggugggggaa

SEQ ID NO: 3936351 - RNA, 19 nt, Shigella flexneri 2a str. 301
aagugcgucaucggcggca

SEQ ID NO: 3936352 - RNA, 14 nt, Shigella flexneri 2a str. 301
aaguggacgaacag

SEQ ID NO: 3936353 - RNA, 19 nt, Shigella flexneri 2a str. 301
aaguggacgaacaguucaa

SEQ ID NO: 3936354 - RNA, 23 nt, Shigella flexneri 2a str. 301
aaguggcgcagagccugaauaaa

SEQ ID NO: 3936355 - RNA, 20 nt, Shigella flexneri 2a str. 301
aagugguguucuuuguguug

SEQ ID NO: 3936356 - RNA, 18 nt, Shigella flexneri 2a str. 301
aagugugaugguauucau

SEQ ID NO: 3936357 - RNA, 17 nt, Shigella flexneri 2a str. 301
aagugugcaaacgauaa

SEQ ID NO: 3936358 - RNA, 21 nt, Shigella flexneri 2a str. 301
aaguguguaucuucauccgcc

SEQ ID NO: 3936359 - RNA, 16 nt, Shigella flexneri 2a str. 301
aaguguugcaggaaaa

SEQ ID NO: 3936360 - RNA, 20 nt, Shigella flexneri 2a str. 301
aaguuaauuucgacgggcug

SEQ ID NO: 3936361 - RNA, 12 nt, Shigella flexneri 2a str. 301
aaguuacaaaaa

SEQ ID NO: 3936362 - RNA, 17 nt, Shigella flexneri 2a str. 301
aaguuacaaaaaaaaau

SEQ ID NO: 3936363 - RNA, 15 nt, Shigella flexneri 2a str. 301
aaguuagaggcacau

SEQ ID NO: 3936364 - RNA, 18 nt, Shigella flexneri 2a str. 301
aaguuagaggcacauagc

SEQ ID NO: 3936365 - RNA, 22 nt, Shigella flexneri 2a str. 301
aaguuagaguagccaauaccaa

SEQ ID NO: 3936366 - RNA, 14 nt, Shigella flexneri 2a str. 301
aaguuauaaggcgu

SEQ ID NO: 3936367 - RNA, 23 nt, Shigella flexneri 2a str. 301
aaguuccgauaaucggugcggca

SEQ ID NO: 3936368 - RNA, 17 nt, Shigella flexneri 2a str. 301
aaguuccuguaaagagu

SEQ ID NO: 3936369 - RNA, 21 nt, Shigella flexneri 2a str. 301
aaguugcacgccaggcaccgc

SEQ ID NO: 3936370 - RNA, 18 nt, Shigella flexneri 2a str. 301
aaguugcagcgucaucaa

SEQ ID NO: 3936371 - RNA, 18 nt, Shigella flexneri 2a str. 301
aaguugccggauguguug

SEQ ID NO: 3936372 - RNA, 18 nt, Shigella flexneri 2a str. 301
aaguugcgaaagcgagca

SEQ ID NO: 3936373 - RNA, 15 nt, Shigella flexneri 2a str. 301
aaguugcucaagcug

SEQ ID NO: 3936374 - RNA, 21 nt, Shigella flexneri 2a str. 301
aaguuuaaccgccuaauuaca

SEQ ID NO: 3936375 - RNA, 22 nt, Shigella flexneri 2a str. 301
aaguuuaauugccauuucuggc

SEQ ID NO: 3936376 - RNA, 20 nt, Shigella flexneri 2a str. 301
aaguuugcaacuuucgcuuu

SEQ ID NO: 3936377 - RNA, 18 nt, Shigella flexneri 2a str. 301
aaguuuuuaugaguuugg

SEQ ID NO: 3936378 - RNA, 14 nt, Shigella flexneri 2a str. 301
aaguuuuuucuucc

SEQ ID NO: 3936379 - RNA, 13 nt, Shigella flexneri 2a str. 301
aauaaaaacggcg

SEQ ID NO: 3936380 - RNA, 11 nt, Shigella flexneri 2a str. 301
aauaaaacagg

SEQ ID NO: 3936381 - RNA, 16 nt, Shigella flexneri 2a str. 301
aauaaaacaggcagcu

SEQ ID NO: 3936382 - RNA, 17 nt, Shigella flexneri 2a str. 301
aauaaaagcauaccgga

SEQ ID NO: 3936383 - RNA, 14 nt, Shigella flexneri 2a str. 301
aauaaaaggaaaca

SEQ ID NO: 3936384 - RNA, 14 nt, Shigella flexneri 2a str. 301
aauaaaauaucuuc

SEQ ID NO: 3936385 - RNA, 21 nt, Shigella flexneri 2a str. 301
aauaaacaaugagauauuuaa

SEQ ID NO: 3936386 - RNA, 15 nt, Shigella flexneri 2a str. 301
aauaaacaucagcua

SEQ ID NO: 3936387 - RNA, 21 nt, Shigella flexneri 2a str. 301
aauaaacgccauauucugauc

SEQ ID NO: 3936388 - RNA, 21 nt, Shigella flexneri 2a str. 301
aauaaacguuccccaggguuu

SEQ ID NO: 3936389 - RNA, 16 nt, Shigella flexneri 2a str. 301
aauaaacuggcugugc

SEQ ID NO: 3936390 - RNA, 18 nt, Shigella flexneri 2a str. 301
aauaaauacacuauaaaa

SEQ ID NO: 3936391 - RNA, 12 nt, Shigella flexneri 2a str. 301
aauaaauagauc

SEQ ID NO: 3936392 - RNA, 15 nt, Shigella flexneri 2a str. 301
aauaaauauuaauac

SEQ ID NO: 3936393 - RNA, 22 nt, Shigella flexneri 2a str. 301
aauaaaucaaagucagaucaau

SEQ ID NO: 3936394 - RNA, 18 nt, Shigella flexneri 2a str. 301
aauaaaucgugaaacaau

SEQ ID NO: 3936395 - RNA, 20 nt, Shigella flexneri 2a str. 301
aauaaaucgugaaacaaucu

SEQ ID NO: 3936396 - RNA, 15 nt, Shigella flexneri 2a str. 301
aauaaaucuaaaaga

SEQ ID NO: 3936397 - RNA, 12 nt, Shigella flexneri 2a str. 301
aauaaaugccac

SEQ ID NO: 3936398 - RNA, 23 nt, Shigella flexneri 2a str. 301
aauaaauguguuuuuauuugauu

SEQ ID NO: 3936399 - RNA, 16 nt, Shigella flexneri 2a str. 301
aauaacaucgccagaa

SEQ ID NO: 3936400 - RNA, 20 nt, Shigella flexneri 2a str. 301
aauaaccaacggcgagccag

SEQ ID NO: 3936401 - RNA, 24 nt, Shigella flexneri 2a str. 301
aauaaccagcguuuccagcaccag

SEQ ID NO: 3936402 - RNA, 20 nt, Shigella flexneri 2a str. 301
aauaacccgcuguaaaugcu

SEQ ID NO: 3936403 - RNA, 11 nt, Shigella flexneri 2a str. 301
aauaacccuga

SEQ ID NO: 3936404 - RNA, 17 nt, Shigella flexneri 2a str. 301
aauaaccgcugcaaaaa

SEQ ID NO: 3936405 - RNA, 18 nt, Shigella flexneri 2a str. 301
aauaaccgcugcaaaaaa

SEQ ID NO: 3936406 - RNA, 18 nt, Shigella flexneri 2a str. 301
aauaaccugcaaaauagu

SEQ ID NO: 3936407 - RNA, 21 nt, Shigella flexneri 2a str. 301
aauaacgccccggcaaaacca

SEQ ID NO: 3936408 - RNA, 21 nt, Shigella flexneri 2a str. 301
aauaacgccggagagaaaaac

SEQ ID NO: 3936409 - RNA, 20 nt, Shigella flexneri 2a str. 301
aauaacggcugauaacaaua

SEQ ID NO: 3936410 - RNA, 16 nt, Shigella flexneri 2a str. 301
aauaacucuuugauga

SEQ ID NO: 3936411 - RNA, 21 nt, Shigella flexneri 2a str. 301
aauaacucuuugaugaaacau

SEQ ID NO: 3936412 - RNA, 15 nt, Shigella flexneri 2a str. 301
aauaacugcuauuca

SEQ ID NO: 3936413 - RNA, 21 nt, Shigella flexneri 2a str. 301
aauaacuggugcuaacagcaa

SEQ ID NO: 3936414 - RNA, 14 nt, Shigella flexneri 2a str. 301
aauaagacaauuga

SEQ ID NO: 3936415 - RNA, 19 nt, Shigella flexneri 2a str. 301
aauaagccaaauccagcgc

SEQ ID NO: 3936416 - RNA, 22 nt, Shigella flexneri 2a str. 301
aauaagccccuuucgaaaucau

SEQ ID NO: 3936417 - RNA, 15 nt, Shigella flexneri 2a str. 301
aauaagcuauaaaaa

SEQ ID NO: 3936418 - RNA, 13 nt, Shigella flexneri 2a str. 301
aauaagcuuuuuc

SEQ ID NO: 3936419 - RNA, 17 nt, Shigella flexneri 2a str. 301
aauaaggcuuucgugaa

SEQ ID NO: 3936420 - RNA, 23 nt, Shigella flexneri 2a str. 301
aauaagguuaauuaccuuaucaa

SEQ ID NO: 3936421 - RNA, 16 nt, Shigella flexneri 2a str. 301
aauaauacacacauca

SEQ ID NO: 3936422 - RNA, 21 nt, Shigella flexneri 2a str. 301
aauaauacagcccagacaaau

SEQ ID NO: 3936423 - RNA, 22 nt, Shigella flexneri 2a str. 301
aauaauaccguucucuuuaaaa

SEQ ID NO: 3936424 - RNA, 22 nt, Shigella flexneri 2a str. 301
aauaauacucagugaacaauua

SEQ ID NO: 3936425 - RNA, 15 nt, Shigella flexneri 2a str. 301
aauaauaucuccagc

SEQ ID NO: 3936426 - RNA, 14 nt, Shigella flexneri 2a str. 301
aauaauaucuuuuu

SEQ ID NO: 3936427 - RNA, 20 nt, Shigella flexneri 2a str. 301
aauaaucaacgcaccgacaa

SEQ ID NO: 3936428 - RNA, 22 nt, Shigella flexneri 2a str. 301
aauaaucaacgcgaaaaugccc

SEQ ID NO: 3936429 - RNA, 23 nt, Shigella flexneri 2a str. 301
aauaaucaacgcgauauaauaaa

SEQ ID NO: 3936430 - RNA, 20 nt, Shigella flexneri 2a str. 301
aauaaucaacgcggcaauaa

SEQ ID NO: 3936431 - RNA, 20 nt, Shigella flexneri 2a str. 301
aauaauccccaauacgauua

SEQ ID NO: 3936432 - RNA, 22 nt, Shigella flexneri 2a str. 301
aauaauccccauaucaggcaca

SEQ ID NO: 3936433 - RNA, 19 nt, Shigella flexneri 2a str. 301
aauaaucccgcgcaacaaa

SEQ ID NO: 3936434 - RNA, 22 nt, Shigella flexneri 2a str. 301
aauaaucgaucgcguaauaaaa

SEQ ID NO: 3936435 - RNA, 18 nt, Shigella flexneri 2a str. 301
aauaaucgcaauuaccca

SEQ ID NO: 3936436 - RNA, 18 nt, Shigella flexneri 2a str. 301
aauaaucgggaauacaga

SEQ ID NO: 3936437 - RNA, 21 nt, Shigella flexneri 2a str. 301
aauaaugcccaucgugauaaa

SEQ ID NO: 3936438 - RNA, 17 nt, Shigella flexneri 2a str. 301
aauaaugcgacaacaga

SEQ ID NO: 3936439 - RNA, 21 nt, Shigella flexneri 2a str. 301
aauaaugcgacaacagaaaua

SEQ ID NO: 3936440 - RNA, 23 nt, Shigella flexneri 2a str. 301
aauaaugcgacaacagaaauaau

SEQ ID NO: 3936441 - RNA, 15 nt, Shigella flexneri 2a str. 301
aauaauggccuuuuc

SEQ ID NO: 3936442 - RNA, 14 nt, Shigella flexneri 2a str. 301
aauaauggugaauu

SEQ ID NO: 3936443 - RNA, 14 nt, Shigella flexneri 2a str. 301
aauaauuuuaaaua

SEQ ID NO: 3936444 - RNA, 20 nt, Shigella flexneri 2a str. 301
aauacaaaauuuaacaccau

SEQ ID NO: 3936445 - RNA, 13 nt, Shigella flexneri 2a str. 301
aauacaaaugccu

SEQ ID NO: 3936446 - RNA, 20 nt, Shigella flexneri 2a str. 301
aauacaaggccaauccagcc

SEQ ID NO: 3936447 - RNA, 17 nt, Shigella flexneri 2a str. 301
aauacaccaucauggaa

SEQ ID NO: 3936448 - RNA, 18 nt, Shigella flexneri 2a str. 301
aauacaccuauacuuuug

SEQ ID NO: 3936449 - RNA, 17 nt, Shigella flexneri 2a str. 301
aauacagcaauggaaaa

SEQ ID NO: 3936450 - RNA, 20 nt, Shigella flexneri 2a str. 301
aauacagcaauggaaaaagu

SEQ ID NO: 3936451 - RNA, 22 nt, Shigella flexneri 2a str. 301
aauacagccagccagcaccagg

SEQ ID NO: 3936452 - RNA, 17 nt, Shigella flexneri 2a str. 301
aauacagguccccgcuu

SEQ ID NO: 3936453 - RNA, 19 nt, Shigella flexneri 2a str. 301
aauacauauauuacaacgu

SEQ ID NO: 3936454 - RNA, 17 nt, Shigella flexneri 2a str. 301
aauacauugauauacag

SEQ ID NO: 3936455 - RNA, 19 nt, Shigella flexneri 2a str. 301
aauaccacccggucuuuuc

SEQ ID NO: 3936456 - RNA, 22 nt, Shigella flexneri 2a str. 301
aauaccacccgucgggcagaaa

SEQ ID NO: 3936457 - RNA, 17 nt, Shigella flexneri 2a str. 301
aauaccauggcucacca

SEQ ID NO: 3936458 - RNA, 22 nt, Shigella flexneri 2a str. 301
aauaccauggcucaccagcagc

SEQ ID NO: 3936459 - RNA, 23 nt, Shigella flexneri 2a str. 301
aauaccauggcucaccagcagcg

SEQ ID NO: 3936460 - RNA, 15 nt, Shigella flexneri 2a str. 301
aauacccaaaaaaua

SEQ ID NO: 3936461 - RNA, 22 nt, Shigella flexneri 2a str. 301
aauacccaaaaaauagcaaagu

SEQ ID NO: 3936462 - RNA, 21 nt, Shigella flexneri 2a str. 301
aauacccuguauaauaggaaa

SEQ ID NO: 3936463 - RNA, 18 nt, Shigella flexneri 2a str. 301
aauaccgacuucggccag

SEQ ID NO: 3936464 - RNA, 15 nt, Shigella flexneri 2a str. 301
aauaccgauaucgcc

SEQ ID NO: 3936465 - RNA, 23 nt, Shigella flexneri 2a str. 301
aauaccgcugccgcuggcgguaa

SEQ ID NO: 3936466 - RNA, 22 nt, Shigella flexneri 2a str. 301
aauaccguucauuaacgcccca

SEQ ID NO: 3936467 - RNA, 18 nt, Shigella flexneri 2a str. 301
aauaccugaccguuaauu

SEQ ID NO: 3936468 - RNA, 13 nt, Shigella flexneri 2a str. 301
aauaccugccugu

SEQ ID NO: 3936469 - RNA, 14 nt, Shigella flexneri 2a str. 301
aauaccuucuuccu

SEQ ID NO: 3936470 - RNA, 22 nt, Shigella flexneri 2a str. 301
aauacgcaccgggcuuccggca

SEQ ID NO: 3936471 - RNA, 17 nt, Shigella flexneri 2a str. 301
aauacgcgaggcgcuaa

SEQ ID NO: 3936472 - RNA, 20 nt, Shigella flexneri 2a str. 301
aauacgcuggcgcgccgccu

SEQ ID NO: 3936473 - RNA, 18 nt, Shigella flexneri 2a str. 301
aauacgcuuaaucuguac

SEQ ID NO: 3936474 - RNA, 23 nt, Shigella flexneri 2a str. 301
aauacggauauucaucuccagca

SEQ ID NO: 3936475 - RNA, 20 nt, Shigella flexneri 2a str. 301
aauacguaaugucggugaaa

SEQ ID NO: 3936476 - RNA, 17 nt, Shigella flexneri 2a str. 301
aauacguuucauauccg

SEQ ID NO: 3936477 - RNA, 17 nt, Shigella flexneri 2a str. 301
aauacuccauaacuauu

SEQ ID NO: 3936478 - RNA, 12 nt, Shigella flexneri 2a str. 301
aauacuccccuu

SEQ ID NO: 3936479 - RNA, 21 nt, Shigella flexneri 2a str. 301
aauacucgucccguccuucau

SEQ ID NO: 3936480 - RNA, 15 nt, Shigella flexneri 2a str. 301
aauacugaucaucau

SEQ ID NO: 3936481 - RNA, 11 nt, Shigella flexneri 2a str. 301
aauacuggcag

SEQ ID NO: 3936482 - RNA, 21 nt, Shigella flexneri 2a str. 301
aauacuguuuaucuucccagc

SEQ ID NO: 3936483 - RNA, 16 nt, Shigella flexneri 2a str. 301
aauacuuauaaaccac

SEQ ID NO: 3936484 - RNA, 18 nt, Shigella flexneri 2a str. 301
aauacuuucacaaaaaua

SEQ ID NO: 3936485 - RNA, 19 nt, Shigella flexneri 2a str. 301
aauacuuuuacucucugga

SEQ ID NO: 3936486 - RNA, 13 nt, Shigella flexneri 2a str. 301
aauagaaacuggc

SEQ ID NO: 3936487 - RNA, 20 nt, Shigella flexneri 2a str. 301
aauagaaccuaagaaccaga

SEQ ID NO: 3936488 - RNA, 17 nt, Shigella flexneri 2a str. 301
aauagacacaagaaaua

SEQ ID NO: 3936489 - RNA, 22 nt, Shigella flexneri 2a str. 301
aauagagaaaguaaaccaccag

SEQ ID NO: 3936490 - RNA, 18 nt, Shigella flexneri 2a str. 301
aauagagaucucucuugc

SEQ ID NO: 3936491 - RNA, 15 nt, Shigella flexneri 2a str. 301
aauagaguguuccuc

SEQ ID NO: 3936492 - RNA, 21 nt, Shigella flexneri 2a str. 301
aauagauuuugaguaagcagg

SEQ ID NO: 3936493 - RNA, 22 nt, Shigella flexneri 2a str. 301
aauagcaacugauuuauagauu

SEQ ID NO: 3936494 - RNA, 21 nt, Shigella flexneri 2a str. 301
aauagccaauacgauaaugcc

SEQ ID NO: 3936495 - RNA, 14 nt, Shigella flexneri 2a str. 301
aauagccaaucauu

SEQ ID NO: 3936496 - RNA, 21 nt, Shigella flexneri 2a str. 301
aauagccagcagagcaaaaau

SEQ ID NO: 3936497 - RNA, 23 nt, Shigella flexneri 2a str. 301
aauagccaucacaaaacgugaca

SEQ ID NO: 3936498 - RNA, 17 nt, Shigella flexneri 2a str. 301
aauagccgcagccauca

SEQ ID NO: 3936499 - RNA, 22 nt, Shigella flexneri 2a str. 301
aauagccgccauacggaaaauc

SEQ ID NO: 3936500 - RNA, 20 nt, Shigella flexneri 2a str. 301
aauagcgaacagacaaaaag

SEQ ID NO: 3936501 - RNA, 21 nt, Shigella flexneri 2a str. 301
aauagcgugauuguggcaauc

SEQ ID NO: 3936502 - RNA, 19 nt, Shigella flexneri 2a str. 301
aauagcguuaauggcagau

SEQ ID NO: 3936503 - RNA, 19 nt, Shigella flexneri 2a str. 301
aauagcuaacgaaagaaca

SEQ ID NO: 3936504 - RNA, 13 nt, Shigella flexneri 2a str. 301
aauagcucaauga

SEQ ID NO: 3936505 - RNA, 14 nt, Shigella flexneri 2a str. 301
aauagcucaaugaa

SEQ ID NO: 3936506 - RNA, 14 nt, Shigella flexneri 2a str. 301
aauagcuucuucaa

SEQ ID NO: 3936507 - RNA, 22 nt, Shigella flexneri 2a str. 301
aauaggaaucauuguuauauca

SEQ ID NO: 3936508 - RNA, 19 nt, Shigella flexneri 2a str. 301
aauagguugaguaugucgu

SEQ ID NO: 3936509 - RNA, 21 nt, Shigella flexneri 2a str. 301
aauagugacagauuugauuau

SEQ ID NO: 3936510 - RNA, 19 nt, Shigella flexneri 2a str. 301
aaucaccucaucaccacag

SEQ ID NO: 3936511 - RNA, 22 nt, Shigella flexneri 2a str. 301
aaucaccucaucaccacagaca

SEQ ID NO: 3936512 - RNA, 15 nt, Shigella flexneri 2a str. 301
aaucaccuuuaaccu

SEQ ID NO: 3936513 - RNA, 19 nt, Shigella flexneri 2a str. 301
aaucacgacaaacacaaua

SEQ ID NO: 3936514 - RNA, 19 nt, Shigella flexneri 2a str. 301
aaucacgauugcugccgau

SEQ ID NO: 3936515 - RNA, 14 nt, Shigella flexneri 2a str. 301
aaucacgcaucacu

SEQ ID NO: 3936516 - RNA, 13 nt, Shigella flexneri 2a str. 301
aaucacgcccauu

SEQ ID NO: 3936517 - RNA, 15 nt, Shigella flexneri 2a str. 301
aaucacucaaaauau

SEQ ID NO: 3936518 - RNA, 14 nt, Shigella flexneri 2a str. 301
aaucacugccagaa

SEQ ID NO: 3936519 - RNA, 14 nt, Shigella flexneri 2a str. 301
aaucacuucaucgc

SEQ ID NO: 3936520 - RNA, 13 nt, Shigella flexneri 2a str. 301
aaucacuucuucu

SEQ ID NO: 3936521 - RNA, 21 nt, Shigella flexneri 2a str. 301
aaucacuucuucuuguucauc

SEQ ID NO: 3936522 - RNA, 14 nt, Shigella flexneri 2a str. 301
aaucagaauuuuuc

SEQ ID NO: 3936523 - RNA, 13 nt, Shigella flexneri 2a str. 301
aaucagcaauaaa

SEQ ID NO: 3936524 - RNA, 24 nt, Shigella flexneri 2a str. 301
aaucagcaauuuuuccugguucuc

SEQ ID NO: 3936525 - RNA, 14 nt, Shigella flexneri 2a str. 301
aaucagcacaauaa

SEQ ID NO: 3936526 - RNA, 13 nt, Shigella flexneri 2a str. 301
aaucagcagaacc

SEQ ID NO: 3936527 - RNA, 20 nt, Shigella flexneri 2a str. 301
aaucagcagauaucccgcca

SEQ ID NO: 3936528 - RNA, 24 nt, Shigella flexneri 2a str. 301
aaucagccgcccggggagcaacag

SEQ ID NO: 3936529 - RNA, 11 nt, Shigella flexneri 2a str. 301
aaucagcgcca

SEQ ID NO: 3936530 - RNA, 22 nt, Shigella flexneri 2a str. 301
aaucagcguaacgauggcaauu

SEQ ID NO: 3936531 - RNA, 17 nt, Shigella flexneri 2a str. 301
aaucagcuaauggcugc

SEQ ID NO: 3936532 - RNA, 17 nt, Shigella flexneri 2a str. 301
aaucagcuuuggugaaa

SEQ ID NO: 3936533 - RNA, 17 nt, Shigella flexneri 2a str. 301
aaucaggcaggucuuuc

SEQ ID NO: 3936534 - RNA, 21 nt, Shigella flexneri 2a str. 301
aaucaguaaauugcagcacac

SEQ ID NO: 3936535 - RNA, 16 nt, Shigella flexneri 2a str. 301
aaucaguucaaauuca

SEQ ID NO: 3936536 - RNA, 18 nt, Shigella flexneri 2a str. 301
aaucaguucuaccaucaa

SEQ ID NO: 3936537 - RNA, 19 nt, Shigella flexneri 2a str. 301
aaucauaauaaagaugcca

SEQ ID NO: 3936538 - RNA, 19 nt, Shigella flexneri 2a str. 301
aaucauaauguugcugccu

SEQ ID NO: 3936539 - RNA, 22 nt, Shigella flexneri 2a str. 301
aaucauacaagcggaaacguaa

SEQ ID NO: 3936540 - RNA, 21 nt, Shigella flexneri 2a str. 301
aaucauauaucgcaagucauu

SEQ ID NO: 3936541 - RNA, 14 nt, Shigella flexneri 2a str. 301
aaucauauuaaauu

SEQ ID NO: 3936542 - RNA, 18 nt, Shigella flexneri 2a str. 301
aaucauauuaaauuuuuu

SEQ ID NO: 3936543 - RNA, 15 nt, Shigella flexneri 2a str. 301
aaucaucaaugccag

SEQ ID NO: 3936544 - RNA, 22 nt, Shigella flexneri 2a str. 301
aaucaucacgcgguuacgcacc

SEQ ID NO: 3936545 - RNA, 15 nt, Shigella flexneri 2a str. 301
aaucaucaguaccag

SEQ ID NO: 3936546 - RNA, 13 nt, Shigella flexneri 2a str. 301
aaucaucaucagu

SEQ ID NO: 3936547 - RNA, 21 nt, Shigella flexneri 2a str. 301
aaucaucaucuuuauauauug

SEQ ID NO: 3936548 - RNA, 13 nt, Shigella flexneri 2a str. 301
aaucaucauuaau

SEQ ID NO: 3936549 - RNA, 23 nt, Shigella flexneri 2a str. 301
aaucaucauugcuguuuuacagc

SEQ ID NO: 3936550 - RNA, 23 nt, Shigella flexneri 2a str. 301
aaucaucauuuuuucaccaaagc

SEQ ID NO: 3936551 - RNA, 15 nt, Shigella flexneri 2a str. 301
aaucauccauauuuu

SEQ ID NO: 3936552 - RNA, 19 nt, Shigella flexneri 2a str. 301
aaucauccuaccgccaggu

SEQ ID NO: 3936553 - RNA, 13 nt, Shigella flexneri 2a str. 301
aaucaucgccuua

SEQ ID NO: 3936554 - RNA, 18 nt, Shigella flexneri 2a str. 301
aaucaucgcgugacagcc

SEQ ID NO: 3936555 - RNA, 12 nt, Shigella flexneri 2a str. 301
aaucaugcaaua

SEQ ID NO: 3936556 - RNA, 17 nt, Shigella flexneri 2a str. 301
aaucaugccaaaaauaa

SEQ ID NO: 3936557 - RNA, 17 nt, Shigella flexneri 2a str. 301
aaucauuacaguuucgg

SEQ ID NO: 3936558 - RNA, 18 nt, Shigella flexneri 2a str. 301
aaucauuacaguuucgga

SEQ ID NO: 3936559 - RNA, 13 nt, Shigella flexneri 2a str. 301
aaucauucccauu

SEQ ID NO: 3936560 - RNA, 17 nt, Shigella flexneri 2a str. 301
aaucauucccauuuauu

SEQ ID NO: 3936561 - RNA, 23 nt, Shigella flexneri 2a str. 301
aaucauucgccgguuccagcuuc

SEQ ID NO: 3936562 - RNA, 16 nt, Shigella flexneri 2a str. 301
aaucauuuuuugaagu

SEQ ID NO: 3936563 - RNA, 15 nt, Shigella flexneri 2a str. 301
aauccaaacauggca

SEQ ID NO: 3936564 - RNA, 14 nt, Shigella flexneri 2a str. 301
aauccaacaacaca

SEQ ID NO: 3936565 - RNA, 13 nt, Shigella flexneri 2a str. 301
aauccaaccaucc

SEQ ID NO: 3936566 - RNA, 14 nt, Shigella flexneri 2a str. 301
aauccacagcaaug

SEQ ID NO: 3936567 - RNA, 16 nt, Shigella flexneri 2a str. 301
aauccacgcgcgaaau

SEQ ID NO: 3936568 - RNA, 19 nt, Shigella flexneri 2a str. 301
aauccacgguuuaucggcg

SEQ ID NO: 3936569 - RNA, 16 nt, Shigella flexneri 2a str. 301
aauccacguuccagau

SEQ ID NO: 3936570 - RNA, 12 nt, Shigella flexneri 2a str. 301
aauccagaacac

SEQ ID NO: 3936571 - RNA, 11 nt, Shigella flexneri 2a str. 301
aauccagcaau

SEQ ID NO: 3936572 - RNA, 14 nt, Shigella flexneri 2a str. 301
aauccagcaauaau

SEQ ID NO: 3936573 - RNA, 15 nt, Shigella flexneri 2a str. 301
aauccagcaccguca

SEQ ID NO: 3936574 - RNA, 22 nt, Shigella flexneri 2a str. 301
aauccaggcccgcauuaaaagu

SEQ ID NO: 3936575 - RNA, 23 nt, Shigella flexneri 2a str. 301
aauccagggaucaacauucagau

SEQ ID NO: 3936576 - RNA, 17 nt, Shigella flexneri 2a str. 301
aauccaguaagcugugc

SEQ ID NO: 3936577 - RNA, 15 nt, Shigella flexneri 2a str. 301
aauccaguacaugaa

SEQ ID NO: 3936578 - RNA, 20 nt, Shigella flexneri 2a str. 301
aauccaguguaaaacagcac

SEQ ID NO: 3936579 - RNA, 17 nt, Shigella flexneri 2a str. 301
aauccauaccagcacau

SEQ ID NO: 3936580 - RNA, 15 nt, Shigella flexneri 2a str. 301
aauccauucaucgcc

SEQ ID NO: 3936581 - RNA, 15 nt, Shigella flexneri 2a str. 301
aaucccaaaauaaua

SEQ ID NO: 3936582 - RNA, 13 nt, Shigella flexneri 2a str. 301
aaucccagacuua

SEQ ID NO: 3936583 - RNA, 20 nt, Shigella flexneri 2a str. 301
aaucccauccgcgcugaugc

SEQ ID NO: 3936584 - RNA, 13 nt, Shigella flexneri 2a str. 301
aauccccagaccu

SEQ ID NO: 3936585 - RNA, 15 nt, Shigella flexneri 2a str. 301
aaucccccacuuuua

SEQ ID NO: 3936586 - RNA, 14 nt, Shigella flexneri 2a str. 301
aauccccuucucaa

SEQ ID NO: 3936587 - RNA, 19 nt, Shigella flexneri 2a str. 301
aauccccuucucaaucccu

SEQ ID NO: 3936588 - RNA, 20 nt, Shigella flexneri 2a str. 301
aaucccgccauaacggcugu

SEQ ID NO: 3936589 - RNA, 12 nt, Shigella flexneri 2a str. 301
aaucccuucgac

SEQ ID NO: 3936590 - RNA, 19 nt, Shigella flexneri 2a str. 301
aaucccuuucucuucaaac

SEQ ID NO: 3936591 - RNA, 22 nt, Shigella flexneri 2a str. 301
aauccgagaaucguacucacca

SEQ ID NO: 3936592 - RNA, 16 nt, Shigella flexneri 2a str. 301
aauccgauuacgugaa

SEQ ID NO: 3936593 - RNA, 13 nt, Shigella flexneri 2a str. 301
aauccgcaccaac

SEQ ID NO: 3936594 - RNA, 17 nt, Shigella flexneri 2a str. 301
aauccgcccuaacaucg

SEQ ID NO: 3936595 - RNA, 13 nt, Shigella flexneri 2a str. 301
aauccggaagaau

SEQ ID NO: 3936596 - RNA, 14 nt, Shigella flexneri 2a str. 301
aauccggcaaauaa

SEQ ID NO: 3936597 - RNA, 18 nt, Shigella flexneri 2a str. 301
aauccgggugaacugcca

SEQ ID NO: 3936598 - RNA, 21 nt, Shigella flexneri 2a str. 301
aauccggugccauagacugga

SEQ ID NO: 3936599 - RNA, 22 nt, Shigella flexneri 2a str. 301
aauccgucagcgaguugaucac

SEQ ID NO: 3936600 - RNA, 15 nt, Shigella flexneri 2a str. 301
aauccugccagcgug

SEQ ID NO: 3936601 - RNA, 20 nt, Shigella flexneri 2a str. 301
aauccugccgcaguuucuga

SEQ ID NO: 3936602 - RNA, 19 nt, Shigella flexneri 2a str. 301
aauccugcgcacaagccca

SEQ ID NO: 3936603 - RNA, 21 nt, Shigella flexneri 2a str. 301
aauccuucacuuuugccagac

SEQ ID NO: 3936604 - RNA, 22 nt, Shigella flexneri 2a str. 301
aaucgaaaaugcuccuuuuggc

SEQ ID NO: 3936605 - RNA, 13 nt, Shigella flexneri 2a str. 301
aaucgaaaucaac

SEQ ID NO: 3936606 - RNA, 17 nt, Shigella flexneri 2a str. 301
aaucgaaaucaacaugu

SEQ ID NO: 3936607 - RNA, 23 nt, Shigella flexneri 2a str. 301
aaucgaccaggccaucagcagcg

SEQ ID NO: 3936608 - RNA, 20 nt, Shigella flexneri 2a str. 301
aaucgagcccagaugccgga

SEQ ID NO: 3936609 - RNA, 16 nt, Shigella flexneri 2a str. 301
aaucgauaaaacuucc

SEQ ID NO: 3936610 - RNA, 19 nt, Shigella flexneri 2a str. 301
aaugagaaagccgacugca

SEQ ID NO: 3936611 - RNA, 17 nt, Shigella flexneri 2a str. 301
aaugagagggcgauaaa

SEQ ID NO: 3936612 - RNA, 22 nt, Shigella flexneri 2a str. 301
aaugagagggcgauaaaucucc

SEQ ID NO: 3936613 - RNA, 20 nt, Shigella flexneri 2a str. 301
aaugagauauuuaaaugauu

SEQ ID NO: 3936614 - RNA, 19 nt, Shigella flexneri 2a str. 301
aaugagccggaccucuuuc

SEQ ID NO: 3936615 - RNA, 15 nt, Shigella flexneri 2a str. 301
aaugaggcagcaagg

SEQ ID NO: 3936616 - RNA, 16 nt, Shigella flexneri 2a str. 301
aaugaguacugaugaa

SEQ ID NO: 3936617 - RNA, 15 nt, Shigella flexneri 2a str. 301
aaugagugaugauga

SEQ ID NO: 3936618 - RNA, 18 nt, Shigella flexneri 2a str. 301
aaugagugccaaaaaaau

SEQ ID NO: 3936619 - RNA, 15 nt, Shigella flexneri 2a str. 301
aaugaguuauacaga

SEQ ID NO: 3936620 - RNA, 11 nt, Shigella flexneri 2a str. 301
aaugauaagcc

SEQ ID NO: 3936621 - RNA, 15 nt, Shigella flexneri 2a str. 301
aaugauagccaggcg

SEQ ID NO: 3936622 - RNA, 16 nt, Shigella flexneri 2a str. 301
aaugauauuggucacc

SEQ ID NO: 3936623 - RNA, 15 nt, Shigella flexneri 2a str. 301
aaugauauuuucugc

SEQ ID NO: 3936624 - RNA, 19 nt, Shigella flexneri 2a str. 301
aaugaucagcgguuuugcc

SEQ ID NO: 3936625 - RNA, 15 nt, Shigella flexneri 2a str. 301
aaugaucaguggaag

SEQ ID NO: 3936626 - RNA, 22 nt, Shigella flexneri 2a str. 301
aaugaucggauaucuccuauug

SEQ ID NO: 3936627 - RNA, 15 nt, Shigella flexneri 2a str. 301
aaugaugcggcgcuu

SEQ ID NO: 3936628 - RNA, 16 nt, Shigella flexneri 2a str. 301
aaugauguaaaaauac

SEQ ID NO: 3936629 - RNA, 17 nt, Shigella flexneri 2a str. 301
aaugauguaaaaauacu

SEQ ID NO: 3936630 - RNA, 16 nt, Shigella flexneri 2a str. 301
aaugauucgggcuuuc

SEQ ID NO: 3936631 - RNA, 21 nt, Shigella flexneri 2a str. 301
aaugauugcguuaacugcuga

SEQ ID NO: 3936632 - RNA, 17 nt, Shigella flexneri 2a str. 301
aaugauuuaaaaccacu

SEQ ID NO: 3936633 - RNA, 23 nt, Shigella flexneri 2a str. 301
aaugauuuugauggaagaaacca

SEQ ID NO: 3936634 - RNA, 19 nt, Shigella flexneri 2a str. 301
aaugcaggcgcgccuggug

SEQ ID NO: 3936635 - RNA, 13 nt, Shigella flexneri 2a str. 301
aaugcaucagcca

SEQ ID NO: 3936636 - RNA, 22 nt, Shigella flexneri 2a str. 301
aaugcauccgcuuacucaucca

SEQ ID NO: 3936637 - RNA, 17 nt, Shigella flexneri 2a str. 301
aaugcauggcagauaaa

SEQ ID NO: 3936638 - RNA, 17 nt, Shigella flexneri 2a str. 301
aaugcauuaucagagau

SEQ ID NO: 3936639 - RNA, 21 nt, Shigella flexneri 2a str. 301
aaugccaaauauuucuuuauc

SEQ ID NO: 3936640 - RNA, 21 nt, Shigella flexneri 2a str. 301
aaugccaaguaauagaacuau

SEQ ID NO: 3936641 - RNA, 22 nt, Shigella flexneri 2a str. 301
aaugccaaucuucacaucauca

SEQ ID NO: 3936642 - RNA, 17 nt, Shigella flexneri 2a str. 301
aaugccaccaauaauga

SEQ ID NO: 3936643 - RNA, 17 nt, Shigella flexneri 2a str. 301
aaugccaccagggauaa

SEQ ID NO: 3936644 - RNA, 17 nt, Shigella flexneri 2a str. 301
aaugccacugaauaaag

SEQ ID NO: 3936645 - RNA, 16 nt, Shigella flexneri 2a str. 301
aaugccagauaagaca

SEQ ID NO: 3936646 - RNA, 16 nt, Shigella flexneri 2a str. 301
aaugcccagaaaccag

SEQ ID NO: 3936647 - RNA, 17 nt, Shigella flexneri 2a str. 301
aaugcccauggcaagaa

SEQ ID NO: 3936648 - RNA, 15 nt, Shigella flexneri 2a str. 301
aaugccgcagcggcg

SEQ ID NO: 3936649 - RNA, 14 nt, Shigella flexneri 2a str. 301
aaugccgccgauac

SEQ ID NO: 3936650 - RNA, 18 nt, Shigella flexneri 2a str. 301
aaugccggaaucagaauc

SEQ ID NO: 3936651 - RNA, 19 nt, Shigella flexneri 2a str. 301
aaugccggaugcggcguaa

SEQ ID NO: 3936652 - RNA, 16 nt, Shigella flexneri 2a str. 301
aaugccgucaccagca

SEQ ID NO: 3936653 - RNA, 14 nt, Shigella flexneri 2a str. 301
aaugccuaccgcau

SEQ ID NO: 3936654 - RNA, 16 nt, Shigella flexneri 2a str. 301
aaugccucagagcuaa

SEQ ID NO: 3936655 - RNA, 18 nt, Shigella flexneri 2a str. 301
aaugccucagagcuaacu

SEQ ID NO: 3936656 - RNA, 23 nt, Shigella flexneri 2a str. 301
aaugccugagacagacagccuca

SEQ ID NO: 3936657 - RNA, 21 nt, Shigella flexneri 2a str. 301
aaugccugcacuuugugucag

SEQ ID NO: 3936658 - RNA, 14 nt, Shigella flexneri 2a str. 301
aaugccuuucucag

SEQ ID NO: 3936659 - RNA, 15 nt, Shigella flexneri 2a str. 301
aaugccuuugaaauc

SEQ ID NO: 3936660 - RNA, 21 nt, Shigella flexneri 2a str. 301
aaugccuuugaaaucgaacag

SEQ ID NO: 3936661 - RNA, 21 nt, Shigella flexneri 2a str. 301
aaugcgaaaacgauguuugcu

SEQ ID NO: 3936662 - RNA, 14 nt, Shigella flexneri 2a str. 301
aaugcgaaaauccu

SEQ ID NO: 3936663 - RNA, 15 nt, Shigella flexneri 2a str. 301
aaugcgaucuacccg

SEQ ID NO: 3936664 - RNA, 14 nt, Shigella flexneri 2a str. 301
aaugcgcaaaauuc

SEQ ID NO: 3936665 - RNA, 15 nt, Shigella flexneri 2a str. 301
aaugcgcagccagcg

SEQ ID NO: 3936666 - RNA, 14 nt, Shigella flexneri 2a str. 301
aaugcgcaguugca

SEQ ID NO: 3936667 - RNA, 18 nt, Shigella flexneri 2a str. 301
aaugcgcaucaaagccag

SEQ ID NO: 3936668 - RNA, 20 nt, Shigella flexneri 2a str. 301
aaugcgcccagcgucagcau

SEQ ID NO: 3936669 - RNA, 13 nt, Shigella flexneri 2a str. 301
aaugcgcgagcca

SEQ ID NO: 3936670 - RNA, 17 nt, Shigella flexneri 2a str. 301
aaugcgcguaauuugcg

SEQ ID NO: 3936671 - RNA, 20 nt, Shigella flexneri 2a str. 301
aaugcgcuguuuagcgcggc

SEQ ID NO: 3936672 - RNA, 19 nt, Shigella flexneri 2a str. 301
aaugcggagguuucuuuuu

SEQ ID NO: 3936673 - RNA, 18 nt, Shigella flexneri 2a str. 301
aaugcgggcgaaaacauc

SEQ ID NO: 3936674 - RNA, 17 nt, Shigella flexneri 2a str. 301
aaugcguggcgcguacc

SEQ ID NO: 3936675 - RNA, 15 nt, Shigella flexneri 2a str. 301
aaugcguuccagcau

SEQ ID NO: 3936676 - RNA, 21 nt, Shigella flexneri 2a str. 301
aaugcguugcuggcagauaaa

SEQ ID NO: 3936677 - RNA, 17 nt, Shigella flexneri 2a str. 301
aaugcguuuugagccug

SEQ ID NO: 3936678 - RNA, 22 nt, Shigella flexneri 2a str. 301
aaugcuacgcgcaauauccugc

SEQ ID NO: 3936679 - RNA, 14 nt, Shigella flexneri 2a str. 301
aaugcucaauuccc

SEQ ID NO: 3936680 - RNA, 21 nt, Shigella flexneri 2a str. 301
aaugcucaugaucguggcaau

SEQ ID NO: 3936681 - RNA, 16 nt, Shigella flexneri 2a str. 301
aaugcucucuucgcca

SEQ ID NO: 3936682 - RNA, 16 nt, Shigella flexneri 2a str. 301
aaugcugacaaaaccg

SEQ ID NO: 3936683 - RNA, 15 nt, Shigella flexneri 2a str. 301
aaugcuggaucacuu

SEQ ID NO: 3936684 - RNA, 19 nt, Shigella flexneri 2a str. 301
aaugcuguaaccagcgcag

SEQ ID NO: 3936685 - RNA, 18 nt, Shigella flexneri 2a str. 301
aaugcugugaagauggcu

SEQ ID NO: 3936686 - RNA, 21 nt, Shigella flexneri 2a str. 301
aaugcuguuauccugaccacc

SEQ ID NO: 3936687 - RNA, 13 nt, Shigella flexneri 2a str. 301
aaugcuucuaccg

SEQ ID NO: 3936688 - RNA, 17 nt, Shigella flexneri 2a str. 301
aauggaaacagcaccau

SEQ ID NO: 3936689 - RNA, 17 nt, Shigella flexneri 2a str. 301
aauggaaagcccgcccc

SEQ ID NO: 3936690 - RNA, 22 nt, Shigella flexneri 2a str. 301
aauggaaagcccgccccgcucg

SEQ ID NO: 3936691 - RNA, 20 nt, Shigella flexneri 2a str. 301
aauggagauuguuaauacga

SEQ ID NO: 3936692 - RNA, 11 nt, Shigella flexneri 2a str. 301
aauggcaaaga

SEQ ID NO: 3936693 - RNA, 17 nt, Shigella flexneri 2a str. 301
aauggcaucugauaagc

SEQ ID NO: 3936694 - RNA, 20 nt, Shigella flexneri 2a str. 301
aauggcaucugauaagccca

SEQ ID NO: 3936695 - RNA, 15 nt, Shigella flexneri 2a str. 301
aauggcgauuuuuga

SEQ ID NO: 3936696 - RNA, 19 nt, Shigella flexneri 2a str. 301
aauggcgcauccagccaac

SEQ ID NO: 3936697 - RNA, 14 nt, Shigella flexneri 2a str. 301
aauggcgcgaaaac

SEQ ID NO: 3936698 - RNA, 17 nt, Shigella flexneri 2a str. 301
aauggcgcgaaaacaac

SEQ ID NO: 3936699 - RNA, 21 nt, Shigella flexneri 2a str. 301
aauggcgcuguaaaaggcgcc

SEQ ID NO: 3936700 - RNA, 13 nt, Shigella flexneri 2a str. 301
aauggcugcgggc

SEQ ID NO: 3936701 - RNA, 14 nt, Shigella flexneri 2a str. 301
aauggcuggcuaua

SEQ ID NO: 3936702 - RNA, 17 nt, Shigella flexneri 2a str. 301
aauggcuuuacgcgcca

SEQ ID NO: 3936703 - RNA, 13 nt, Shigella flexneri 2a str. 301
aauggcuuuugcc

SEQ ID NO: 3936704 - RNA, 21 nt, Shigella flexneri 2a str. 301
aauggguuguacuucgcuuca

SEQ ID NO: 3936705 - RNA, 17 nt, Shigella flexneri 2a str. 301
aaugguaacuuucugcc

SEQ ID NO: 3936706 - RNA, 13 nt, Shigella flexneri 2a str. 301
aaugguagccgcc

SEQ ID NO: 3936707 - RNA, 15 nt, Shigella flexneri 2a str. 301
aauggucccgacaac

SEQ ID NO: 3936708 - RNA, 20 nt, Shigella flexneri 2a str. 301
aauggucuggugaccuggga

SEQ ID NO: 3936709 - RNA, 22 nt, Shigella flexneri 2a str. 301
aauggugugcaugguguucaga

SEQ ID NO: 3936710 - RNA, 15 nt, Shigella flexneri 2a str. 301
aauucuaucaugcaa

SEQ ID NO: 3936711 - RNA, 14 nt, Shigella flexneri 2a str. 301
aauucugaguaaua

SEQ ID NO: 3936712 - RNA, 15 nt, Shigella flexneri 2a str. 301
aauucuggcugaacg

SEQ ID NO: 3936713 - RNA, 22 nt, Shigella flexneri 2a str. 301
aauucuggcugaacgacaaauu

SEQ ID NO: 3936714 - RNA, 12 nt, Shigella flexneri 2a str. 301
aauucuucugaa

SEQ ID NO: 3936715 - RNA, 23 nt, Shigella flexneri 2a str. 301
aauucuuuuuaagaauugauggu

SEQ ID NO: 3936716 - RNA, 21 nt, Shigella flexneri 2a str. 301
aauugaaagagccgauaaaca

SEQ ID NO: 3936717 - RNA, 16 nt, Shigella flexneri 2a str. 301
aauugaagguuuaaua

SEQ ID NO: 3936718 - RNA, 14 nt, Shigella flexneri 2a str. 301
aauugacaguuuau

SEQ ID NO: 3936719 - RNA, 23 nt, Shigella flexneri 2a str. 301
aauugaggaugcuaaggcuguug

SEQ ID NO: 3936720 - RNA, 23 nt, Shigella flexneri 2a str. 301
aauugauccgcgauaagucuuug

SEQ ID NO: 3936721 - RNA, 16 nt, Shigella flexneri 2a str. 301
aauugauggaaaauug

SEQ ID NO: 3936722 - RNA, 19 nt, Shigella flexneri 2a str. 301
aauugauucacauccggcc

SEQ ID NO: 3936723 - RNA, 23 nt, Shigella flexneri 2a str. 301
aauugauuuucgaaaaaaaagaa

SEQ ID NO: 3936724 - RNA, 20 nt, Shigella flexneri 2a str. 301
aauugcacauauuuuucacc

SEQ ID NO: 3936725 - RNA, 23 nt, Shigella flexneri 2a str. 301
aauugcaccauccauuuuucacg

SEQ ID NO: 3936726 - RNA, 12 nt, Shigella flexneri 2a str. 301
aauugcagauac

SEQ ID NO: 3936727 - RNA, 13 nt, Shigella flexneri 2a str. 301
aauugcagcagcu

SEQ ID NO: 3936728 - RNA, 19 nt, Shigella flexneri 2a str. 301
aauugcauauuucaacgac

SEQ ID NO: 3936729 - RNA, 12 nt, Shigella flexneri 2a str. 301
aauugccagaca

SEQ ID NO: 3936730 - RNA, 14 nt, Shigella flexneri 2a str. 301
aauugccagacaac

SEQ ID NO: 3936731 - RNA, 13 nt, Shigella flexneri 2a str. 301
aauugccagcccu

SEQ ID NO: 3936732 - RNA, 14 nt, Shigella flexneri 2a str. 301
aauugccagcuugc

SEQ ID NO: 3936733 - RNA, 21 nt, Shigella flexneri 2a str. 301
aauugccauuucuggcgucaa

SEQ ID NO: 3936734 - RNA, 15 nt, Shigella flexneri 2a str. 301
aauugccccagaugc

SEQ ID NO: 3936735 - RNA, 19 nt, Shigella flexneri 2a str. 301
aauugccccccauaacgca

SEQ ID NO: 3936736 - RNA, 18 nt, Shigella flexneri 2a str. 301
aauugcccgaagccaauu

SEQ ID NO: 3936737 - RNA, 17 nt, Shigella flexneri 2a str. 301
aauugcccggucaggug

SEQ ID NO: 3936738 - RNA, 16 nt, Shigella flexneri 2a str. 301
aauugccgcuccaccg

SEQ ID NO: 3936739 - RNA, 21 nt, Shigella flexneri 2a str. 301
aauugccguuaaaacuaaaaa

SEQ ID NO: 3936740 - RNA, 19 nt, Shigella flexneri 2a str. 301
aauugcgcgacuuuuuccu

SEQ ID NO: 3936741 - RNA, 20 nt, Shigella flexneri 2a str. 301
aauugcgggccaaagaccag

SEQ ID NO: 3936742 - RNA, 16 nt, Shigella flexneri 2a str. 301
aauugcguaaagccug

SEQ ID NO: 3936743 - RNA, 22 nt, Shigella flexneri 2a str. 301
aauugcucaguacaggccgcac

SEQ ID NO: 3936744 - RNA, 18 nt, Shigella flexneri 2a str. 301
aauugcucauagagcgca

SEQ ID NO: 3936745 - RNA, 17 nt, Shigella flexneri 2a str. 301
aauugcucccugaauaa

SEQ ID NO: 3936746 - RNA, 17 nt, Shigella flexneri 2a str. 301
aauuggaguaucaccau

SEQ ID NO: 3936747 - RNA, 21 nt, Shigella flexneri 2a str. 301
aauuggcacgccgacaucuuu

SEQ ID NO: 3936748 - RNA, 20 nt, Shigella flexneri 2a str. 301
aauuggcuucguuauugaag

SEQ ID NO: 3936749 - RNA, 18 nt, Shigella flexneri 2a str. 301
aauugguagaccagagcu

SEQ ID NO: 3936750 - RNA, 21 nt, Shigella flexneri 2a str. 301
aauugguagacgcgcuagcuu

SEQ ID NO: 3936751 - RNA, 12 nt, Shigella flexneri 2a str. 301
aauuguaaaucu

SEQ ID NO: 3936752 - RNA, 17 nt, Shigella flexneri 2a str. 301
aauugucuccaccaaug

SEQ ID NO: 3936753 - RNA, 22 nt, Shigella flexneri 2a str. 301
aauugugaacgagaaaaugacg

SEQ ID NO: 3936754 - RNA, 20 nt, Shigella flexneri 2a str. 301
aauugugagaagcgguuaaa

SEQ ID NO: 3936755 - RNA, 15 nt, Shigella flexneri 2a str. 301
aauuguuccggacug

SEQ ID NO: 3936756 - RNA, 14 nt, Shigella flexneri 2a str. 301
aauuguucgacagu

SEQ ID NO: 3936757 - RNA, 20 nt, Shigella flexneri 2a str. 301
aauuguuuaaucaacugccc

SEQ ID NO: 3936758 - RNA, 12 nt, Shigella flexneri 2a str. 301
aauuguuuuaua

SEQ ID NO: 3936759 - RNA, 19 nt, Shigella flexneri 2a str. 301
aauuguuuuauaaagaacu

SEQ ID NO: 3936760 - RNA, 23 nt, Shigella flexneri 2a str. 301
aauuuacagccugccagcaugca

SEQ ID NO: 3936761 - RNA, 19 nt, Shigella flexneri 2a str. 301
aauuuacguuuuaaaccua

SEQ ID NO: 3936762 - RNA, 16 nt, Shigella flexneri 2a str. 301
aauuuagcgacccauu

SEQ ID NO: 3936763 - RNA, 22 nt, Shigella flexneri 2a str. 301
aauuuagcgccacgggcaauaa

SEQ ID NO: 3936764 - RNA, 23 nt, Shigella flexneri 2a str. 301
aauuuagcgccacgggcaauaag

SEQ ID NO: 3936765 - RNA, 18 nt, Shigella flexneri 2a str. 301
aauuuaucgcauauccuc

SEQ ID NO: 3936766 - RNA, 15 nt, Shigella flexneri 2a str. 301
aauuuauguuuccuu

SEQ ID NO: 3936767 - RNA, 21 nt, Shigella flexneri 2a str. 301
aauuucacaguaaugauuuaa

SEQ ID NO: 3936768 - RNA, 18 nt, Shigella flexneri 2a str. 301
aauuucacugccuuucag

SEQ ID NO: 3936769 - RNA, 24 nt, Shigella flexneri 2a str. 301
aauuucacugccuuucagcgcaug

SEQ ID NO: 3936770 - RNA, 13 nt, Shigella flexneri 2a str. 301
aauuucacuugcu

SEQ ID NO: 3936771 - RNA, 13 nt, Shigella flexneri 2a str. 301
aauuucagcgccu

SEQ ID NO: 3936772 - RNA, 18 nt, Shigella flexneri 2a str. 301
aauuucagcgccugauac

SEQ ID NO: 3936773 - RNA, 19 nt, Shigella flexneri 2a str. 301
aauuucagguucugaccgg

SEQ ID NO: 3936774 - RNA, 17 nt, Shigella flexneri 2a str. 301
aauuucaucgccgguaa

SEQ ID NO: 3936775 - RNA, 14 nt, Shigella flexneri 2a str. 301
aauuucauuuacug

SEQ ID NO: 3936776 - RNA, 18 nt, Shigella flexneri 2a str. 301
aauuuccgccaccugauc

SEQ ID NO: 3936777 - RNA, 23 nt, Shigella flexneri 2a str. 301
aauuucgcguaguuaugaaaaua

SEQ ID NO: 3936778 - RNA, 14 nt, Shigella flexneri 2a str. 301
aauuucgcuuucau

SEQ ID NO: 3936779 - RNA, 22 nt, Shigella flexneri 2a str. 301
aauuucucgcccagaucaccaa

SEQ ID NO: 3936780 - RNA, 16 nt, Shigella flexneri 2a str. 301
aauuucugcaaaauag

SEQ ID NO: 3936781 - RNA, 23 nt, Shigella flexneri 2a str. 301
aauuucuggcggcuuauauauua

SEQ ID NO: 3936782 - RNA, 18 nt, Shigella flexneri 2a str. 301
aauuucuuaccacugccg

SEQ ID NO: 3936783 - RNA, 13 nt, Shigella flexneri 2a str. 301
aauuugaggaagc

SEQ ID NO: 3936784 - RNA, 14 nt, Shigella flexneri 2a str. 301
aauuugaggaagcu

SEQ ID NO: 3936785 - RNA, 14 nt, Shigella flexneri 2a str. 301
aauuugcaauuuuc

SEQ ID NO: 3936786 - RNA, 18 nt, Shigella flexneri 2a str. 301
aauuugcagccauaaauu

SEQ ID NO: 3936787 - RNA, 19 nt, Shigella flexneri 2a str. 301
aauuugccaucucugcaac

SEQ ID NO: 3936788 - RNA, 22 nt, Shigella flexneri 2a str. 301
aauuugccguuaaucccagacu

SEQ ID NO: 3936789 - RNA, 13 nt, Shigella flexneri 2a str. 301
aauuugcgcucaa

SEQ ID NO: 3936790 - RNA, 18 nt, Shigella flexneri 2a str. 301
aauuugcuaccccugaga

SEQ ID NO: 3936791 - RNA, 14 nt, Shigella flexneri 2a str. 301
aauuugcuccagaa

SEQ ID NO: 3936792 - RNA, 14 nt, Shigella flexneri 2a str. 301
aauuuggaagaauu

SEQ ID NO: 3936793 - RNA, 15 nt, Shigella flexneri 2a str. 301
aauuuggcuccucug

SEQ ID NO: 3936794 - RNA, 13 nt, Shigella flexneri 2a str. 301
aauuuggcugagu

SEQ ID NO: 3936795 - RNA, 15 nt, Shigella flexneri 2a str. 301
aauuuggggccgucc

SEQ ID NO: 3936796 - RNA, 17 nt, Shigella flexneri 2a str. 301
aauuugguccugaggau

SEQ ID NO: 3936797 - RNA, 14 nt, Shigella flexneri 2a str. 301
aauuuguaacuguc

SEQ ID NO: 3936798 - RNA, 18 nt, Shigella flexneri 2a str. 301
aauuuguaggcuaaaaac

SEQ ID NO: 3936799 - RNA, 17 nt, Shigella flexneri 2a str. 301
aauuuguccaccaauag

SEQ ID NO: 3936800 - RNA, 17 nt, Shigella flexneri 2a str. 301
aauuuguuggcgaaaau

SEQ ID NO: 3936801 - RNA, 22 nt, Shigella flexneri 2a str. 301
aauuuuaaauaucaucaaaauu

SEQ ID NO: 3936802 - RNA, 12 nt, Shigella flexneri 2a str. 301
aauuuuacagcc

SEQ ID NO: 3936803 - RNA, 12 nt, Shigella flexneri 2a str. 301
aauuuuaggaug

SEQ ID NO: 3936804 - RNA, 17 nt, Shigella flexneri 2a str. 301
aauuuuaggaugcugca

SEQ ID NO: 3936805 - RNA, 12 nt, Shigella flexneri 2a str. 301
aauuuuauguuu

SEQ ID NO: 3936806 - RNA, 20 nt, Shigella flexneri 2a str. 301
aauuuuccuugaaaaagagg

SEQ ID NO: 3936807 - RNA, 13 nt, Shigella flexneri 2a str. 301
aauuuucucuuuc

SEQ ID NO: 3936808 - RNA, 14 nt, Shigella flexneri 2a str. 301
aauuuugugcagca

SEQ ID NO: 3936809 - RNA, 16 nt, Shigella flexneri 2a str. 301
aauuuugugcagcaug

SEQ ID NO: 3936810 - RNA, 14 nt, Shigella flexneri 2a str. 301
acaagguacgaaaa

SEQ ID NO: 3936811 - RNA, 22 nt, Shigella flexneri 2a str. 301
acaagguacgaaaaaaauuacu

SEQ ID NO: 3936812 - RNA, 21 nt, Shigella flexneri 2a str. 301
acaaguaaaaggagauaaacc

SEQ ID NO: 3936813 - RNA, 16 nt, Shigella flexneri 2a str. 301
acaaguauaucaaaca

SEQ ID NO: 3936814 - RNA, 17 nt, Shigella flexneri 2a str. 301
acaagucuuuuuugguu

SEQ ID NO: 3936815 - RNA, 17 nt, Shigella flexneri 2a str. 301
acaagugggugcuucac

SEQ ID NO: 3936816 - RNA, 13 nt, Shigella flexneri 2a str. 301
acaaguucuucga

SEQ ID NO: 3936817 - RNA, 14 nt, Shigella flexneri 2a str. 301
acaauaauaucuuu

SEQ ID NO: 3936818 - RNA, 17 nt, Shigella flexneri 2a str. 301
acaauaauaucuuuuuu

SEQ ID NO: 3936819 - RNA, 18 nt, Shigella flexneri 2a str. 301
acaauacauagaaacuca

SEQ ID NO: 3936820 - RNA, 15 nt, Shigella flexneri 2a str. 301
acaauacgcccacgu

SEQ ID NO: 3936821 - RNA, 22 nt, Shigella flexneri 2a str. 301
acaauacgucggcaucgggcag

SEQ ID NO: 3936822 - RNA, 16 nt, Shigella flexneri 2a str. 301
acaauacugaucauca

SEQ ID NO: 3936823 - RNA, 14 nt, Shigella flexneri 2a str. 301
acaauagaaauauu

SEQ ID NO: 3936824 - RNA, 18 nt, Shigella flexneri 2a str. 301
acaauagcaaucuguaac

SEQ ID NO: 3936825 - RNA, 19 nt, Shigella flexneri 2a str. 301
acaauagccacauugcugc

SEQ ID NO: 3936826 - RNA, 12 nt, Shigella flexneri 2a str. 301
acaauaucaaau

SEQ ID NO: 3936827 - RNA, 19 nt, Shigella flexneri 2a str. 301
acaauaucggcaccagcgc

SEQ ID NO: 3936828 - RNA, 16 nt, Shigella flexneri 2a str. 301
acaauaugcucuccac

SEQ ID NO: 3936829 - RNA, 17 nt, Shigella flexneri 2a str. 301
acaauaugcucuccacc

SEQ ID NO: 3936830 - RNA, 20 nt, Shigella flexneri 2a str. 301
acaauauugaugcucacugc

SEQ ID NO: 3936831 - RNA, 13 nt, Shigella flexneri 2a str. 301
acaaucaaauccu

SEQ ID NO: 3936832 - RNA, 14 nt, Shigella flexneri 2a str. 301
acaaucacacuaac

SEQ ID NO: 3936833 - RNA, 20 nt, Shigella flexneri 2a str. 301
acaaucaccaggucaccaga

SEQ ID NO: 3936834 - RNA, 18 nt, Shigella flexneri 2a str. 301
acaaucacgauagccaga

SEQ ID NO: 3936835 - RNA, 12 nt, Shigella flexneri 2a str. 301
acaaucagccag

SEQ ID NO: 3936836 - RNA, 21 nt, Shigella flexneri 2a str. 301
acaaucccgcuuacaucaacu

SEQ ID NO: 3936837 - RNA, 20 nt, Shigella flexneri 2a str. 301
acaaucccugcauaucggua

SEQ ID NO: 3936838 - RNA, 19 nt, Shigella flexneri 2a str. 301
acaaucccuuaguaacgcc

SEQ ID NO: 3936839 - RNA, 20 nt, Shigella flexneri 2a str. 301
acaaucccuuaguaacgcca

SEQ ID NO: 3936840 - RNA, 21 nt, Shigella flexneri 2a str. 301
acaaucccuuaguaacgccag

SEQ ID NO: 3936841 - RNA, 18 nt, Shigella flexneri 2a str. 301
acaauccgguagguucaa

SEQ ID NO: 3936842 - RNA, 14 nt, Shigella flexneri 2a str. 301
acaaucgcuuaauc

SEQ ID NO: 3936843 - RNA, 23 nt, Shigella flexneri 2a str. 301
acaaucgcuucaucgcccacauc

SEQ ID NO: 3936844 - RNA, 17 nt, Shigella flexneri 2a str. 301
acaaucguuucaugcca

SEQ ID NO: 3936845 - RNA, 18 nt, Shigella flexneri 2a str. 301
acaaucucaauuuucacu

SEQ ID NO: 3936846 - RNA, 14 nt, Shigella flexneri 2a str. 301
acaaucucacccgc

SEQ ID NO: 3936847 - RNA, 20 nt, Shigella flexneri 2a str. 301
acaaucuggugguaaucgac

SEQ ID NO: 3936848 - RNA, 14 nt, Shigella flexneri 2a str. 301
acaaugagauauuu

SEQ ID NO: 3936849 - RNA, 22 nt, Shigella flexneri 2a str. 301
acaaugagauauuuaaaugauu

SEQ ID NO: 3936850 - RNA, 18 nt, Shigella flexneri 2a str. 301
acaaugccgauaaauaca

SEQ ID NO: 3936851 - RNA, 12 nt, Shigella flexneri 2a str. 301
acaaugccugau

SEQ ID NO: 3936852 - RNA, 20 nt, Shigella flexneri 2a str. 301
acaaugccugaugcgacgcu

SEQ ID NO: 3936853 - RNA, 22 nt, Shigella flexneri 2a str. 301
acaaugcggugugcggguuuuc

SEQ ID NO: 3936854 - RNA, 18 nt, Shigella flexneri 2a str. 301
acaauggagcuaaacagc

SEQ ID NO: 3936855 - RNA, 20 nt, Shigella flexneri 2a str. 301
acaauggagcuaaacagcgc

SEQ ID NO: 3936856 - RNA, 21 nt, Shigella flexneri 2a str. 301
acaauggcauuuaucuucugg

SEQ ID NO: 3936857 - RNA, 21 nt, Shigella flexneri 2a str. 301
acaauggcggugaucccaaua

SEQ ID NO: 3936858 - RNA, 16 nt, Shigella flexneri 2a str. 301
acaaugggaaaacagg

SEQ ID NO: 3936859 - RNA, 21 nt, Shigella flexneri 2a str. 301
acaauggucaacauucccugc

SEQ ID NO: 3936860 - RNA, 16 nt, Shigella flexneri 2a str. 301
acaauguuucugcaau

SEQ ID NO: 3936861 - RNA, 21 nt, Shigella flexneri 2a str. 301
acaauuacugagagaaaaaaa

SEQ ID NO: 3936862 - RNA, 22 nt, Shigella flexneri 2a str. 301
acaauucgcguaguaaagccuu

SEQ ID NO: 3936863 - RNA, 19 nt, Shigella flexneri 2a str. 301
acaauugaagaauaucuuc

SEQ ID NO: 3936864 - RNA, 15 nt, Shigella flexneri 2a str. 301
acaauugaccaguaa

SEQ ID NO: 3936865 - RNA, 15 nt, Shigella flexneri 2a str. 301
acaauugagauucaa

SEQ ID NO: 3936866 - RNA, 16 nt, Shigella flexneri 2a str. 301
acaauugagauucaaa

SEQ ID NO: 3936867 - RNA, 19 nt, Shigella flexneri 2a str. 301
acaauugccgccagcucac

SEQ ID NO: 3936868 - RNA, 18 nt, Shigella flexneri 2a str. 301
acaauugcgggccaaaga

SEQ ID NO: 3936869 - RNA, 20 nt, Shigella flexneri 2a str. 301
acaauugcgggccaaagacc

SEQ ID NO: 3936870 - RNA, 14 nt, Shigella flexneri 2a str. 301
acaauuguugaccg

SEQ ID NO: 3936871 - RNA, 21 nt, Shigella flexneri 2a str. 301
acaauuucagaauagacaaaa

SEQ ID NO: 3936872 - RNA, 23 nt, Shigella flexneri 2a str. 301
acaauuucgcacguauaaacauc

SEQ ID NO: 3936873 - RNA, 12 nt, Shigella flexneri 2a str. 301
acaauuugccca

SEQ ID NO: 3936874 - RNA, 16 nt, Shigella flexneri 2a str. 301
acacaaauccagcacc

SEQ ID NO: 3936875 - RNA, 15 nt, Shigella flexneri 2a str. 301
acacaacaugcagcc

SEQ ID NO: 3936876 - RNA, 16 nt, Shigella flexneri 2a str. 301
acacaacaugcagccc

SEQ ID NO: 3936877 - RNA, 22 nt, Shigella flexneri 2a str. 301
acacaacaugcagcccagcauc

SEQ ID NO: 3936878 - RNA, 17 nt, Shigella flexneri 2a str. 301
acacaaccgaggcucaa

SEQ ID NO: 3936879 - RNA, 21 nt, Shigella flexneri 2a str. 301
acacaagcguaagagaacaga

SEQ ID NO: 3936880 - RNA, 22 nt, Shigella flexneri 2a str. 301
acacaagguauccagacggcgc

SEQ ID NO: 3936881 - RNA, 16 nt, Shigella flexneri 2a str. 301
acacaauaccuucugc

SEQ ID NO: 3936882 - RNA, 14 nt, Shigella flexneri 2a str. 301
acacaauuuuguag

SEQ ID NO: 3936883 - RNA, 14 nt, Shigella flexneri 2a str. 301
acacacauuuaucc

SEQ ID NO: 3936884 - RNA, 16 nt, Shigella flexneri 2a str. 301
acacacgcccagcuca

SEQ ID NO: 3936885 - RNA, 15 nt, Shigella flexneri 2a str. 301
acacacuucauuuuc

SEQ ID NO: 3936886 - RNA, 20 nt, Shigella flexneri 2a str. 301
acacacuucauuuuccacaa

SEQ ID NO: 3936887 - RNA, 19 nt, Shigella flexneri 2a str. 301
acacacuuuuauuaacuca

SEQ ID NO: 3936888 - RNA, 16 nt, Shigella flexneri 2a str. 301
acacagacgguuuuuc

SEQ ID NO: 3936889 - RNA, 14 nt, Shigella flexneri 2a str. 301
acacagcacuauga

SEQ ID NO: 3936890 - RNA, 13 nt, Shigella flexneri 2a str. 301
acacagccacagg

SEQ ID NO: 3936891 - RNA, 19 nt, Shigella flexneri 2a str. 301
acacagcgacguaaaaaac

SEQ ID NO: 3936892 - RNA, 17 nt, Shigella flexneri 2a str. 301
acacagcgugcauagca

SEQ ID NO: 3936893 - RNA, 14 nt, Shigella flexneri 2a str. 301
acacaggauacgca

SEQ ID NO: 3936894 - RNA, 20 nt, Shigella flexneri 2a str. 301
acacaggaugggcauauuug

SEQ ID NO: 3936895 - RNA, 15 nt, Shigella flexneri 2a str. 301
acacaggcagcaauc

SEQ ID NO: 3936896 - RNA, 16 nt, Shigella flexneri 2a str. 301
acacagguaacuuaaa

SEQ ID NO: 3936897 - RNA, 23 nt, Shigella flexneri 2a str. 301
acacagugguuuuaacgaugucg

SEQ ID NO: 3936898 - RNA, 20 nt, Shigella flexneri 2a str. 301
acacaguucuucaaaaauaa

SEQ ID NO: 3936899 - RNA, 20 nt, Shigella flexneri 2a str. 301
acacauaaacagguaaagac

SEQ ID NO: 3936900 - RNA, 15 nt, Shigella flexneri 2a str. 301
acacauacuuauuau

SEQ ID NO: 3936901 - RNA, 15 nt, Shigella flexneri 2a str. 301
acacauauauuaauu

SEQ ID NO: 3936902 - RNA, 17 nt, Shigella flexneri 2a str. 301
acacauuacugcuugcu

SEQ ID NO: 3936903 - RNA, 16 nt, Shigella flexneri 2a str. 301
acacauuaucucaaca

SEQ ID NO: 3936904 - RNA, 19 nt, Shigella flexneri 2a str. 301
acacauuaucucaacacac

SEQ ID NO: 3936905 - RNA, 20 nt, Shigella flexneri 2a str. 301
acacauugcuguaucacuau

SEQ ID NO: 3936906 - RNA, 22 nt, Shigella flexneri 2a str. 301
acacauugcuguaucacuauga

SEQ ID NO: 3936907 - RNA, 18 nt, Shigella flexneri 2a str. 301
acaccaacaggugccgga

SEQ ID NO: 3936908 - RNA, 14 nt, Shigella flexneri 2a str. 301
acaccaacaucacg

SEQ ID NO: 3936909 - RNA, 15 nt, Shigella flexneri 2a str. 301
acaccaacaucacgc

SEQ ID NO: 3936910 - RNA, 11 nt, Shigella flexneri 2a str. 301
acagacccagg

SEQ ID NO: 3936911 - RNA, 18 nt, Shigella flexneri 2a str. 301
acagaccgcgcaguacca

SEQ ID NO: 3936912 - RNA, 22 nt, Shigella flexneri 2a str. 301
acagaccggagccaaacaugca

SEQ ID NO: 3936913 - RNA, 20 nt, Shigella flexneri 2a str. 301
acagaccugcgucaccacau

SEQ ID NO: 3936914 - RNA, 19 nt, Shigella flexneri 2a str. 301
acagaccuuucgaacccaa

SEQ ID NO: 3936915 - RNA, 21 nt, Shigella flexneri 2a str. 301
acagaccuuucgaacccaacc

SEQ ID NO: 3936916 - RNA, 17 nt, Shigella flexneri 2a str. 301
acagacgagggaaaaua

SEQ ID NO: 3936917 - RNA, 19 nt, Shigella flexneri 2a str. 301
acagacgagggaaaauaaa

SEQ ID NO: 3936918 - RNA, 15 nt, Shigella flexneri 2a str. 301
acagacucaaaccaa

SEQ ID NO: 3936919 - RNA, 22 nt, Shigella flexneri 2a str. 301
acagacuuaauauugccguccg

SEQ ID NO: 3936920 - RNA, 20 nt, Shigella flexneri 2a str. 301
acagagaacaucaauccaaa

SEQ ID NO: 3936921 - RNA, 23 nt, Shigella flexneri 2a str. 301
acagagaaucgggaaauaacauc

SEQ ID NO: 3936922 - RNA, 14 nt, Shigella flexneri 2a str. 301
acagagcaucggua

SEQ ID NO: 3936923 - RNA, 14 nt, Shigella flexneri 2a str. 301
acagauaggcauca

SEQ ID NO: 3936924 - RNA, 20 nt, Shigella flexneri 2a str. 301
acagauaggcaucagcaauu

SEQ ID NO: 3936925 - RNA, 22 nt, Shigella flexneri 2a str. 301
acagaugcaggauuucuucacc

SEQ ID NO: 3936926 - RNA, 22 nt, Shigella flexneri 2a str. 301
acagaugcgacggcaccacauu

SEQ ID NO: 3936927 - RNA, 15 nt, Shigella flexneri 2a str. 301
acagaugcucgccag

SEQ ID NO: 3936928 - RNA, 15 nt, Shigella flexneri 2a str. 301
acagauucaugcugc

SEQ ID NO: 3936929 - RNA, 19 nt, Shigella flexneri 2a str. 301
acagcaaagugcccccaac

SEQ ID NO: 3936930 - RNA, 20 nt, Shigella flexneri 2a str. 301
acagcaaagugcccccaacu

SEQ ID NO: 3936931 - RNA, 18 nt, Shigella flexneri 2a str. 301
acagcacauuucagaaag

SEQ ID NO: 3936932 - RNA, 19 nt, Shigella flexneri 2a str. 301
acagcaccauccgcccaca

SEQ ID NO: 3936933 - RNA, 20 nt, Shigella flexneri 2a str. 301
acagcacgccccggcggccg

SEQ ID NO: 3936934 - RNA, 17 nt, Shigella flexneri 2a str. 301
acagcacggcagcaacg

SEQ ID NO: 3936935 - RNA, 16 nt, Shigella flexneri 2a str. 301
acagcagaacgaccag

SEQ ID NO: 3936936 - RNA, 17 nt, Shigella flexneri 2a str. 301
acagcagaacucgaacc

SEQ ID NO: 3936937 - RNA, 21 nt, Shigella flexneri 2a str. 301
acagcagaacucgaacccguc

SEQ ID NO: 3936938 - RNA, 14 nt, Shigella flexneri 2a str. 301
acagcagagcaugg

SEQ ID NO: 3936939 - RNA, 16 nt, Shigella flexneri 2a str. 301
acagcagcaacgauga

SEQ ID NO: 3936940 - RNA, 16 nt, Shigella flexneri 2a str. 301
acagcagccacaccaa

SEQ ID NO: 3936941 - RNA, 17 nt, Shigella flexneri 2a str. 301
acagcaggcucagaaga

SEQ ID NO: 3936942 - RNA, 20 nt, Shigella flexneri 2a str. 301
acagcagguguuacccgcua

SEQ ID NO: 3936943 - RNA, 13 nt, Shigella flexneri 2a str. 301
acagcaguccagc

SEQ ID NO: 3936944 - RNA, 15 nt, Shigella flexneri 2a str. 301
acagcauaaggcaca

SEQ ID NO: 3936945 - RNA, 13 nt, Shigella flexneri 2a str. 301
acagcauaccuuc

SEQ ID NO: 3936946 - RNA, 18 nt, Shigella flexneri 2a str. 301
acagcaucaucgcaauga

SEQ ID NO: 3936947 - RNA, 14 nt, Shigella flexneri 2a str. 301
acagcaucuggaug

SEQ ID NO: 3936948 - RNA, 21 nt, Shigella flexneri 2a str. 301
acagcauggcuucuuccccgg

SEQ ID NO: 3936949 - RNA, 11 nt, Shigella flexneri 2a str. 301
acagcauuucc

SEQ ID NO: 3936950 - RNA, 15 nt, Shigella flexneri 2a str. 301
acagccaaaucauca

SEQ ID NO: 3936951 - RNA, 18 nt, Shigella flexneri 2a str. 301
acagccaaaucaucagua

SEQ ID NO: 3936952 - RNA, 20 nt, Shigella flexneri 2a str. 301
acagccaaaucaucaguacc

SEQ ID NO: 3936953 - RNA, 13 nt, Shigella flexneri 2a str. 301
acagccaacacau

SEQ ID NO: 3936954 - RNA, 14 nt, Shigella flexneri 2a str. 301
acagccaacacauu

SEQ ID NO: 3936955 - RNA, 13 nt, Shigella flexneri 2a str. 301
acagccaacugga

SEQ ID NO: 3936956 - RNA, 12 nt, Shigella flexneri 2a str. 301
acagccagccaa

SEQ ID NO: 3936957 - RNA, 12 nt, Shigella flexneri 2a str. 301
acagccagcgcu

SEQ ID NO: 3936958 - RNA, 20 nt, Shigella flexneri 2a str. 301
acagccaggugauacgucca

SEQ ID NO: 3936959 - RNA, 19 nt, Shigella flexneri 2a str. 301
acagccaugcgaaugccaa

SEQ ID NO: 3936960 - RNA, 22 nt, Shigella flexneri 2a str. 301
acagccccaggguuuugcccag

SEQ ID NO: 3936961 - RNA, 18 nt, Shigella flexneri 2a str. 301
acagccccgaaaaagagc

SEQ ID NO: 3936962 - RNA, 13 nt, Shigella flexneri 2a str. 301
acagcccggcaug

SEQ ID NO: 3936963 - RNA, 21 nt, Shigella flexneri 2a str. 301
acagcccuuuccugacucagc

SEQ ID NO: 3936964 - RNA, 17 nt, Shigella flexneri 2a str. 301
acagccgacaaugccac

SEQ ID NO: 3936965 - RNA, 21 nt, Shigella flexneri 2a str. 301
acagccgccagacaauugccg

SEQ ID NO: 3936966 - RNA, 19 nt, Shigella flexneri 2a str. 301
acagccggacccacacccc

SEQ ID NO: 3936967 - RNA, 17 nt, Shigella flexneri 2a str. 301
acagccggaugucugga

SEQ ID NO: 3936968 - RNA, 20 nt, Shigella flexneri 2a str. 301
acagccggaugucuggaacg

SEQ ID NO: 3936969 - RNA, 18 nt, Shigella flexneri 2a str. 301
acagccuaccagaccgca

SEQ ID NO: 3936970 - RNA, 20 nt, Shigella flexneri 2a str. 301
acagccucuuuuuucagugc

SEQ ID NO: 3936971 - RNA, 22 nt, Shigella flexneri 2a str. 301
acagccucuuuuuucagugcac

SEQ ID NO: 3936972 - RNA, 14 nt, Shigella flexneri 2a str. 301
acagccuuaacaag

SEQ ID NO: 3936973 - RNA, 14 nt, Shigella flexneri 2a str. 301
acagcgaaaucccu

SEQ ID NO: 3936974 - RNA, 17 nt, Shigella flexneri 2a str. 301
acagcgacaccagccau

SEQ ID NO: 3936975 - RNA, 18 nt, Shigella flexneri 2a str. 301
acagcgacagacgacgac

SEQ ID NO: 3936976 - RNA, 14 nt, Shigella flexneri 2a str. 301
acagcgaccgcaga

SEQ ID NO: 3936977 - RNA, 16 nt, Shigella flexneri 2a str. 301
acagcgacguaaaaaa

SEQ ID NO: 3936978 - RNA, 15 nt, Shigella flexneri 2a str. 301
acagcgacucucuga

SEQ ID NO: 3936979 - RNA, 19 nt, Shigella flexneri 2a str. 301
acagcgagggccguauuga

SEQ ID NO: 3936980 - RNA, 22 nt, Shigella flexneri 2a str. 301
acagcgauugcuucgaucucaa

SEQ ID NO: 3936981 - RNA, 22 nt, Shigella flexneri 2a str. 301
acagcgcaccagaaacaauaag

SEQ ID NO: 3936982 - RNA, 14 nt, Shigella flexneri 2a str. 301
acagcgccagaagg

SEQ ID NO: 3936983 - RNA, 21 nt, Shigella flexneri 2a str. 301
acagcgccaucugcagggcau

SEQ ID NO: 3936984 - RNA, 14 nt, Shigella flexneri 2a str. 301
acagcgcccgccag

SEQ ID NO: 3936985 - RNA, 15 nt, Shigella flexneri 2a str. 301
acagcgcgccagcca

SEQ ID NO: 3936986 - RNA, 14 nt, Shigella flexneri 2a str. 301
acagcgcgcugaca

SEQ ID NO: 3936987 - RNA, 19 nt, Shigella flexneri 2a str. 301
acagcgcugcgaaaguacc

SEQ ID NO: 3936988 - RNA, 19 nt, Shigella flexneri 2a str. 301
acagcggaguaaucgccag

SEQ ID NO: 3936989 - RNA, 17 nt, Shigella flexneri 2a str. 301
acagcggccagccaucc

SEQ ID NO: 3936990 - RNA, 20 nt, Shigella flexneri 2a str. 301
acagcggccagccauccguc

SEQ ID NO: 3936991 - RNA, 22 nt, Shigella flexneri 2a str. 301
acagcgggugcauuuucacuuc

SEQ ID NO: 3936992 - RNA, 23 nt, Shigella flexneri 2a str. 301
acagcggugauuuccgccgccag

SEQ ID NO: 3936993 - RNA, 15 nt, Shigella flexneri 2a str. 301
acagcguguuaaugc

SEQ ID NO: 3936994 - RNA, 14 nt, Shigella flexneri 2a str. 301
acagcguuucgcca

SEQ ID NO: 3936995 - RNA, 19 nt, Shigella flexneri 2a str. 301
acagcuaaucaucaucagu

SEQ ID NO: 3936996 - RNA, 18 nt, Shigella flexneri 2a str. 301
acagcucagguucaacca

SEQ ID NO: 3936997 - RNA, 22 nt, Shigella flexneri 2a str. 301
acagcucgguauggccuuucug

SEQ ID NO: 3936998 - RNA, 18 nt, Shigella flexneri 2a str. 301
acagcucuugcuccacaa

SEQ ID NO: 3936999 - RNA, 19 nt, Shigella flexneri 2a str. 301
acagcuuaaucaccagcgc

SEQ ID NO: 3937000 - RNA, 15 nt, Shigella flexneri 2a str. 301
acagcuuagcgccuu

SEQ ID NO: 3937001 - RNA, 19 nt, Shigella flexneri 2a str. 301
acagcuuagcgccuucuac

SEQ ID NO: 3937002 - RNA, 18 nt, Shigella flexneri 2a str. 301
acagcuuauguugcuuac

SEQ ID NO: 3937003 - RNA, 16 nt, Shigella flexneri 2a str. 301
acagcuuuuuccugcg

SEQ ID NO: 3937004 - RNA, 20 nt, Shigella flexneri 2a str. 301
acaggaacagccacugguga

SEQ ID NO: 3937005 - RNA, 23 nt, Shigella flexneri 2a str. 301
acaggaaugcagucgcuguauuu

SEQ ID NO: 3937006 - RNA, 19 nt, Shigella flexneri 2a str. 301
acaggacaucuugaauaug

SEQ ID NO: 3937007 - RNA, 18 nt, Shigella flexneri 2a str. 301
acaggauaauuagagguc

SEQ ID NO: 3937008 - RNA, 21 nt, Shigella flexneri 2a str. 301
acaggauaauuagaggucagu

SEQ ID NO: 3937009 - RNA, 21 nt, Shigella flexneri 2a str. 301
acaggauauauuucaucaacu

SEQ ID NO: 3937010 - RNA, 23 nt, Shigella flexneri 2a str. 301
acaucccagcagagaucuuucac

SEQ ID NO: 3937011 - RNA, 19 nt, Shigella flexneri 2a str. 301
acaucccgcgaacgagaau

SEQ ID NO: 3937012 - RNA, 17 nt, Shigella flexneri 2a str. 301
acauccggcaaaaacaa

SEQ ID NO: 3937013 - RNA, 11 nt, Shigella flexneri 2a str. 301
acauccggcau

SEQ ID NO: 3937014 - RNA, 18 nt, Shigella flexneri 2a str. 301
acauccguggguugccag

SEQ ID NO: 3937015 - RNA, 14 nt, Shigella flexneri 2a str. 301
acauccucuucaag

SEQ ID NO: 3937016 - RNA, 17 nt, Shigella flexneri 2a str. 301
acauccucuucaagaau

SEQ ID NO: 3937017 - RNA, 20 nt, Shigella flexneri 2a str. 301
acauccugcguuaaucgccg

SEQ ID NO: 3937018 - RNA, 22 nt, Shigella flexneri 2a str. 301
acauccugcguuaaucgccgua

SEQ ID NO: 3937019 - RNA, 19 nt, Shigella flexneri 2a str. 301
acaucgacucaagcguugc

SEQ ID NO: 3937020 - RNA, 17 nt, Shigella flexneri 2a str. 301
acaucgauaagguuaug

SEQ ID NO: 3937021 - RNA, 14 nt, Shigella flexneri 2a str. 301
acaucgcaauccuu

SEQ ID NO: 3937022 - RNA, 13 nt, Shigella flexneri 2a str. 301
acaucgcauucga

SEQ ID NO: 3937023 - RNA, 17 nt, Shigella flexneri 2a str. 301
acaucgcuaccgcgcag

SEQ ID NO: 3937024 - RNA, 19 nt, Shigella flexneri 2a str. 301
acaucgcugauuucaccau

SEQ ID NO: 3937025 - RNA, 20 nt, Shigella flexneri 2a str. 301
acaucguugacauuugcuuu

SEQ ID NO: 3937026 - RNA, 17 nt, Shigella flexneri 2a str. 301
acaucuaaccauuauua

SEQ ID NO: 3937027 - RNA, 18 nt, Shigella flexneri 2a str. 301
acaucuaaccauuauuaa

SEQ ID NO: 3937028 - RNA, 16 nt, Shigella flexneri 2a str. 301
acaucuacaaaaaacu

SEQ ID NO: 3937029 - RNA, 20 nt, Shigella flexneri 2a str. 301
acaucugucugauaaaaaac

SEQ ID NO: 3937030 - RNA, 16 nt, Shigella flexneri 2a str. 301
acaucuucaauccacg

SEQ ID NO: 3937031 - RNA, 19 nt, Shigella flexneri 2a str. 301
acaucuucuccagcgaauc

SEQ ID NO: 3937032 - RNA, 22 nt, Shigella flexneri 2a str. 301
acaucuuucugcgcaucuuccc

SEQ ID NO: 3937033 - RNA, 18 nt, Shigella flexneri 2a str. 301
acaugaaaauaaccauau

SEQ ID NO: 3937034 - RNA, 24 nt, Shigella flexneri 2a str. 301
acaugaaaauaaccauauaugaua

SEQ ID NO: 3937035 - RNA, 14 nt, Shigella flexneri 2a str. 301
acaugaagcacugc

SEQ ID NO: 3937036 - RNA, 14 nt, Shigella flexneri 2a str. 301
acaugagagaaaau

SEQ ID NO: 3937037 - RNA, 15 nt, Shigella flexneri 2a str. 301
acaugagagaaaauc

SEQ ID NO: 3937038 - RNA, 19 nt, Shigella flexneri 2a str. 301
acaugagguccagcgagcc

SEQ ID NO: 3937039 - RNA, 14 nt, Shigella flexneri 2a str. 301
acaugaguugcugg

SEQ ID NO: 3937040 - RNA, 14 nt, Shigella flexneri 2a str. 301
acaugauaugccug

SEQ ID NO: 3937041 - RNA, 22 nt, Shigella flexneri 2a str. 301
acaugauguggugcaaggaaau

SEQ ID NO: 3937042 - RNA, 19 nt, Shigella flexneri 2a str. 301
acaugcaaaccaucaccau

SEQ ID NO: 3937043 - RNA, 20 nt, Shigella flexneri 2a str. 301
acaugcaaaccaucaccauc

SEQ ID NO: 3937044 - RNA, 22 nt, Shigella flexneri 2a str. 301
acaugcaguugauuacacaaau

SEQ ID NO: 3937045 - RNA, 14 nt, Shigella flexneri 2a str. 301
acaugccacuggcc

SEQ ID NO: 3937046 - RNA, 17 nt, Shigella flexneri 2a str. 301
acaugccacuggcccca

SEQ ID NO: 3937047 - RNA, 18 nt, Shigella flexneri 2a str. 301
acaugcgaucccacgccg

SEQ ID NO: 3937048 - RNA, 17 nt, Shigella flexneri 2a str. 301
acaugcgcgacaaaaau

SEQ ID NO: 3937049 - RNA, 23 nt, Shigella flexneri 2a str. 301
acaugcgcgacaaaaauuacugc

SEQ ID NO: 3937050 - RNA, 16 nt, Shigella flexneri 2a str. 301
acaugcggugauuuug

SEQ ID NO: 3937051 - RNA, 19 nt, Shigella flexneri 2a str. 301
acaugcggugauuuugccu

SEQ ID NO: 3937052 - RNA, 23 nt, Shigella flexneri 2a str. 301
acaugcgguucacgcgccagaga

SEQ ID NO: 3937053 - RNA, 17 nt, Shigella flexneri 2a str. 301
acaugcuuagcacacgg

SEQ ID NO: 3937054 - RNA, 22 nt, Shigella flexneri 2a str. 301
acauggcaaccgggucgauaaa

SEQ ID NO: 3937055 - RNA, 13 nt, Shigella flexneri 2a str. 301
acauggcccagcc

SEQ ID NO: 3937056 - RNA, 22 nt, Shigella flexneri 2a str. 301
acauggugggcggguggaguau

SEQ ID NO: 3937057 - RNA, 15 nt, Shigella flexneri 2a str. 301
acauguacauggugc

SEQ ID NO: 3937058 - RNA, 19 nt, Shigella flexneri 2a str. 301
acauguacauggugcacau

SEQ ID NO: 3937059 - RNA, 21 nt, Shigella flexneri 2a str. 301
acauguucaaaaaaaucacau

SEQ ID NO: 3937060 - RNA, 23 nt, Shigella flexneri 2a str. 301
acauguugaaucuucgugcguuu

SEQ ID NO: 3937061 - RNA, 13 nt, Shigella flexneri 2a str. 301
acauguugcugac

SEQ ID NO: 3937062 - RNA, 19 nt, Shigella flexneri 2a str. 301
acauguuguacaugcugcu

SEQ ID NO: 3937063 - RNA, 17 nt, Shigella flexneri 2a str. 301
acauguuuuccagcaca

SEQ ID NO: 3937064 - RNA, 19 nt, Shigella flexneri 2a str. 301
acauuaaaguaggccagau

SEQ ID NO: 3937065 - RNA, 14 nt, Shigella flexneri 2a str. 301
acauuaaauugaua

SEQ ID NO: 3937066 - RNA, 19 nt, Shigella flexneri 2a str. 301
acauuaccacgauuuugac

SEQ ID NO: 3937067 - RNA, 19 nt, Shigella flexneri 2a str. 301
acauuacguccaucacaau

SEQ ID NO: 3937068 - RNA, 16 nt, Shigella flexneri 2a str. 301
acauuagauaaaaaug

SEQ ID NO: 3937069 - RNA, 13 nt, Shigella flexneri 2a str. 301
acauuaucagaca

SEQ ID NO: 3937070 - RNA, 12 nt, Shigella flexneri 2a str. 301
acauucaaugau

SEQ ID NO: 3937071 - RNA, 23 nt, Shigella flexneri 2a str. 301
acauuccaggcccgcguggauaa

SEQ ID NO: 3937072 - RNA, 14 nt, Shigella flexneri 2a str. 301
acauucccugcagu

SEQ ID NO: 3937073 - RNA, 20 nt, Shigella flexneri 2a str. 301
acauucgagaagcccauacc

SEQ ID NO: 3937074 - RNA, 12 nt, Shigella flexneri 2a str. 301
acauugaagaau

SEQ ID NO: 3937075 - RNA, 15 nt, Shigella flexneri 2a str. 301
acauugaccagccaa

SEQ ID NO: 3937076 - RNA, 20 nt, Shigella flexneri 2a str. 301
acauugacgauagcgccgcc

SEQ ID NO: 3937077 - RNA, 13 nt, Shigella flexneri 2a str. 301
acauugauauaca

SEQ ID NO: 3937078 - RNA, 15 nt, Shigella flexneri 2a str. 301
acauugauguuuuca

SEQ ID NO: 3937079 - RNA, 18 nt, Shigella flexneri 2a str. 301
acauugauguuuucagac

SEQ ID NO: 3937080 - RNA, 23 nt, Shigella flexneri 2a str. 301
acauugccaccaccagcguaccg

SEQ ID NO: 3937081 - RNA, 20 nt, Shigella flexneri 2a str. 301
acauugccguaauggucugc

SEQ ID NO: 3937082 - RNA, 12 nt, Shigella flexneri 2a str. 301
acauugcugcug

SEQ ID NO: 3937083 - RNA, 13 nt, Shigella flexneri 2a str. 301
acauugcugcuga

SEQ ID NO: 3937084 - RNA, 18 nt, Shigella flexneri 2a str. 301
acauuggcacaagaagua

SEQ ID NO: 3937085 - RNA, 14 nt, Shigella flexneri 2a str. 301
acauuggugccgga

SEQ ID NO: 3937086 - RNA, 19 nt, Shigella flexneri 2a str. 301
acauuguuaaagccuugcu

SEQ ID NO: 3937087 - RNA, 20 nt, Shigella flexneri 2a str. 301
acauuuaaacaauuucagaa

SEQ ID NO: 3937088 - RNA, 22 nt, Shigella flexneri 2a str. 301
acauuuaaacaauuucagaaua

SEQ ID NO: 3937089 - RNA, 19 nt, Shigella flexneri 2a str. 301
acauuuaacccuucaagaa

SEQ ID NO: 3937090 - RNA, 20 nt, Shigella flexneri 2a str. 301
acauuucagaaaguauauaa

SEQ ID NO: 3937091 - RNA, 21 nt, Shigella flexneri 2a str. 301
acauuucagaaaguauauaaa

SEQ ID NO: 3937092 - RNA, 12 nt, Shigella flexneri 2a str. 301
acauuucugcug

SEQ ID NO: 3937093 - RNA, 11 nt, Shigella flexneri 2a str. 301
acauuuuccau

SEQ ID NO: 3937094 - RNA, 13 nt, Shigella flexneri 2a str. 301
acauuuuccauca

SEQ ID NO: 3937095 - RNA, 16 nt, Shigella flexneri 2a str. 301
accaaaacaccagccc

SEQ ID NO: 3937096 - RNA, 15 nt, Shigella flexneri 2a str. 301
accaaaacgugcagc

SEQ ID NO: 3937097 - RNA, 20 nt, Shigella flexneri 2a str. 301
accaaaacgugcagcugccu

SEQ ID NO: 3937098 - RNA, 23 nt, Shigella flexneri 2a str. 301
accaaaaucaggccgaggcacag

SEQ ID NO: 3937099 - RNA, 22 nt, Shigella flexneri 2a str. 301
accaaacccugagugaauuguu

SEQ ID NO: 3937100 - RNA, 12 nt, Shigella flexneri 2a str. 301
accaaaccugca

SEQ ID NO: 3937101 - RNA, 14 nt, Shigella flexneri 2a str. 301
accaaacugauuua

SEQ ID NO: 3937102 - RNA, 14 nt, Shigella flexneri 2a str. 301
accaaagaaaucag

SEQ ID NO: 3937103 - RNA, 18 nt, Shigella flexneri 2a str. 301
accaaagccccgcuuuug

SEQ ID NO: 3937104 - RNA, 16 nt, Shigella flexneri 2a str. 301
accaaagccuuucacu

SEQ ID NO: 3937105 - RNA, 17 nt, Shigella flexneri 2a str. 301
accaaagccuuucacuu

SEQ ID NO: 3937106 - RNA, 21 nt, Shigella flexneri 2a str. 301
accaaaggcgaguucaaucaa

SEQ ID NO: 3937107 - RNA, 15 nt, Shigella flexneri 2a str. 301
accaaaggcgaugcu

SEQ ID NO: 3937108 - RNA, 21 nt, Shigella flexneri 2a str. 301
accaaaucugauuaauauuga

SEQ ID NO: 3937109 - RNA, 15 nt, Shigella flexneri 2a str. 301
accaacggcgagcca

SEQ ID NO: 3937110 - RNA, 13 nt, Shigella flexneri 2a str. 301
accacucaccgcc

SEQ ID NO: 3937111 - RNA, 15 nt, Shigella flexneri 2a str. 301
accacucaccgccgu

SEQ ID NO: 3937112 - RNA, 13 nt, Shigella flexneri 2a str. 301
accacucaccgcu

SEQ ID NO: 3937113 - RNA, 14 nt, Shigella flexneri 2a str. 301
accacuccggcaug

SEQ ID NO: 3937114 - RNA, 18 nt, Shigella flexneri 2a str. 301
accacucugaccugacaa

SEQ ID NO: 3937115 - RNA, 18 nt, Shigella flexneri 2a str. 301
accacugacacggaacaa

SEQ ID NO: 3937116 - RNA, 14 nt, Shigella flexneri 2a str. 301
accacugcaaugac

SEQ ID NO: 3937117 - RNA, 16 nt, Shigella flexneri 2a str. 301
accacugcgcauaauc

SEQ ID NO: 3937118 - RNA, 15 nt, Shigella flexneri 2a str. 301
accacugcgccagcg

SEQ ID NO: 3937119 - RNA, 22 nt, Shigella flexneri 2a str. 301
accacuggcgauauugccgcga

SEQ ID NO: 3937120 - RNA, 15 nt, Shigella flexneri 2a str. 301
accacuuaauuauua

SEQ ID NO: 3937121 - RNA, 21 nt, Shigella flexneri 2a str. 301
accacuucaugccccauggac

SEQ ID NO: 3937122 - RNA, 20 nt, Shigella flexneri 2a str. 301
accacuuccacguuccccag

SEQ ID NO: 3937123 - RNA, 15 nt, Shigella flexneri 2a str. 301
accacuuccagcaga

SEQ ID NO: 3937124 - RNA, 20 nt, Shigella flexneri 2a str. 301
accacuuccagcagaccagc

SEQ ID NO: 3937125 - RNA, 14 nt, Shigella flexneri 2a str. 301
accacuuccugcuc

SEQ ID NO: 3937126 - RNA, 13 nt, Shigella flexneri 2a str. 301
accacuuuugcuc

SEQ ID NO: 3937127 - RNA, 14 nt, Shigella flexneri 2a str. 301
accagaaacaauaa

SEQ ID NO: 3937128 - RNA, 23 nt, Shigella flexneri 2a str. 301
accagaaaguuuuucaacaccau

SEQ ID NO: 3937129 - RNA, 23 nt, Shigella flexneri 2a str. 301
accagaagcguaaaucccagcac

SEQ ID NO: 3937130 - RNA, 18 nt, Shigella flexneri 2a str. 301
accagacaucccagugca

SEQ ID NO: 3937131 - RNA, 15 nt, Shigella flexneri 2a str. 301
accagacauguggau

SEQ ID NO: 3937132 - RNA, 13 nt, Shigella flexneri 2a str. 301
accagaccaggcg

SEQ ID NO: 3937133 - RNA, 15 nt, Shigella flexneri 2a str. 301
accagaccgcacacc

SEQ ID NO: 3937134 - RNA, 21 nt, Shigella flexneri 2a str. 301
accagaccggcaaucgcgcca

SEQ ID NO: 3937135 - RNA, 24 nt, Shigella flexneri 2a str. 301
accagaccugaaaccgccuucugc

SEQ ID NO: 3937136 - RNA, 14 nt, Shigella flexneri 2a str. 301
accagacgcgggca

SEQ ID NO: 3937137 - RNA, 16 nt, Shigella flexneri 2a str. 301
accagacggcguaauc

SEQ ID NO: 3937138 - RNA, 19 nt, Shigella flexneri 2a str. 301
accagaucggucagugcca

SEQ ID NO: 3937139 - RNA, 21 nt, Shigella flexneri 2a str. 301
accagaucguaauggucguuc

SEQ ID NO: 3937140 - RNA, 23 nt, Shigella flexneri 2a str. 301
accagaugcucuuuucugaagua

SEQ ID NO: 3937141 - RNA, 18 nt, Shigella flexneri 2a str. 301
accagauggcuuuccacc

SEQ ID NO: 3937142 - RNA, 12 nt, Shigella flexneri 2a str. 301
accagcaacaaa

SEQ ID NO: 3937143 - RNA, 22 nt, Shigella flexneri 2a str. 301
accagcaacaaauaaccgccug

SEQ ID NO: 3937144 - RNA, 19 nt, Shigella flexneri 2a str. 301
accagcaaccaacgccagc

SEQ ID NO: 3937145 - RNA, 21 nt, Shigella flexneri 2a str. 301
accagcaaccaacgccagcag

SEQ ID NO: 3937146 - RNA, 22 nt, Shigella flexneri 2a str. 301
accagcaaccaacgccagcagc

SEQ ID NO: 3937147 - RNA, 23 nt, Shigella flexneri 2a str. 301
accagcaacgcuucguagaagcc

SEQ ID NO: 3937148 - RNA, 13 nt, Shigella flexneri 2a str. 301
accagcaauaaca

SEQ ID NO: 3937149 - RNA, 17 nt, Shigella flexneri 2a str. 301
accagcaauaacaacac

SEQ ID NO: 3937150 - RNA, 19 nt, Shigella flexneri 2a str. 301
accagcaauaaugccaguc

SEQ ID NO: 3937151 - RNA, 18 nt, Shigella flexneri 2a str. 301
accagcaauuuacgcuuu

SEQ ID NO: 3937152 - RNA, 18 nt, Shigella flexneri 2a str. 301
accagcaccguguucuca

SEQ ID NO: 3937153 - RNA, 14 nt, Shigella flexneri 2a str. 301
accagcacuucacu

SEQ ID NO: 3937154 - RNA, 17 nt, Shigella flexneri 2a str. 301
accagcagcauuucaaa

SEQ ID NO: 3937155 - RNA, 15 nt, Shigella flexneri 2a str. 301
accagcaucaacaac

SEQ ID NO: 3937156 - RNA, 11 nt, Shigella flexneri 2a str. 301
accagcaucgc

SEQ ID NO: 3937157 - RNA, 17 nt, Shigella flexneri 2a str. 301
accagccauuaaccagc

SEQ ID NO: 3937158 - RNA, 21 nt, Shigella flexneri 2a str. 301
accagccauuaaccagccacu

SEQ ID NO: 3937159 - RNA, 17 nt, Shigella flexneri 2a str. 301
accagccccagaauuca

SEQ ID NO: 3937160 - RNA, 24 nt, Shigella flexneri 2a str. 301
accagccccagaauucacgcacuu

SEQ ID NO: 3937161 - RNA, 15 nt, Shigella flexneri 2a str. 301
accagcccgacgaua

SEQ ID NO: 3937162 - RNA, 23 nt, Shigella flexneri 2a str. 301
accagccgcuaccagcgcggcac

SEQ ID NO: 3937163 - RNA, 20 nt, Shigella flexneri 2a str. 301
accagccguugucagucauc

SEQ ID NO: 3937164 - RNA, 23 nt, Shigella flexneri 2a str. 301
accagccuucuucauccagcgca

SEQ ID NO: 3937165 - RNA, 14 nt, Shigella flexneri 2a str. 301
accagccuugccag

SEQ ID NO: 3937166 - RNA, 21 nt, Shigella flexneri 2a str. 301
accagcgaauggguaaaaccg

SEQ ID NO: 3937167 - RNA, 19 nt, Shigella flexneri 2a str. 301
accagcgacaucaccgccg

SEQ ID NO: 3937168 - RNA, 14 nt, Shigella flexneri 2a str. 301
accagcgauaaaaa

SEQ ID NO: 3937169 - RNA, 17 nt, Shigella flexneri 2a str. 301
accagcgcaauauguuu

SEQ ID NO: 3937170 - RNA, 18 nt, Shigella flexneri 2a str. 301
accagcgccugcgcggca

SEQ ID NO: 3937171 - RNA, 14 nt, Shigella flexneri 2a str. 301
accagcgcuucacu

SEQ ID NO: 3937172 - RNA, 18 nt, Shigella flexneri 2a str. 301
accagcgcuucacuauga

SEQ ID NO: 3937173 - RNA, 23 nt, Shigella flexneri 2a str. 301
accagcggccggaugcgccgcca

SEQ ID NO: 3937174 - RNA, 18 nt, Shigella flexneri 2a str. 301
accagcggguugcugaga

SEQ ID NO: 3937175 - RNA, 17 nt, Shigella flexneri 2a str. 301
accagcgguaaagcggc

SEQ ID NO: 3937176 - RNA, 16 nt, Shigella flexneri 2a str. 301
accagcgucagaaaca

SEQ ID NO: 3937177 - RNA, 17 nt, Shigella flexneri 2a str. 301
accagcgucgcaucagg

SEQ ID NO: 3937178 - RNA, 18 nt, Shigella flexneri 2a str. 301
accagcguuuccagcacc

SEQ ID NO: 3937179 - RNA, 16 nt, Shigella flexneri 2a str. 301
accagcuaccacgccg

SEQ ID NO: 3937180 - RNA, 14 nt, Shigella flexneri 2a str. 301
accagcuccagcag

SEQ ID NO: 3937181 - RNA, 15 nt, Shigella flexneri 2a str. 301
accagcuccagcaga

SEQ ID NO: 3937182 - RNA, 23 nt, Shigella flexneri 2a str. 301
accagcucccggagggguuuuug

SEQ ID NO: 3937183 - RNA, 14 nt, Shigella flexneri 2a str. 301
accagcuccggcac

SEQ ID NO: 3937184 - RNA, 23 nt, Shigella flexneri 2a str. 301
accagcuguccgauuuguucucu

SEQ ID NO: 3937185 - RNA, 21 nt, Shigella flexneri 2a str. 301
accagcuuaugccuguccucu

SEQ ID NO: 3937186 - RNA, 23 nt, Shigella flexneri 2a str. 301
accaggaaacccaacgcaaagag

SEQ ID NO: 3937187 - RNA, 20 nt, Shigella flexneri 2a str. 301
accaggaagauguacgccag

SEQ ID NO: 3937188 - RNA, 17 nt, Shigella flexneri 2a str. 301
accaggaagcgacccgg

SEQ ID NO: 3937189 - RNA, 14 nt, Shigella flexneri 2a str. 301
accaggccagcgca

SEQ ID NO: 3937190 - RNA, 15 nt, Shigella flexneri 2a str. 301
accaggccaucagca

SEQ ID NO: 3937191 - RNA, 19 nt, Shigella flexneri 2a str. 301
accaggccaucagcagcgg

SEQ ID NO: 3937192 - RNA, 20 nt, Shigella flexneri 2a str. 301
accaggccguaaaucaccau

SEQ ID NO: 3937193 - RNA, 19 nt, Shigella flexneri 2a str. 301
accaggcggauaauuucac

SEQ ID NO: 3937194 - RNA, 14 nt, Shigella flexneri 2a str. 301
accaggcguggaua

SEQ ID NO: 3937195 - RNA, 15 nt, Shigella flexneri 2a str. 301
accaggcguggauac

SEQ ID NO: 3937196 - RNA, 18 nt, Shigella flexneri 2a str. 301
accaggcguucugccugg

SEQ ID NO: 3937197 - RNA, 22 nt, Shigella flexneri 2a str. 301
accagggaaauaaucgggaaua

SEQ ID NO: 3937198 - RNA, 22 nt, Shigella flexneri 2a str. 301
accagguugccuugucaucguc

SEQ ID NO: 3937199 - RNA, 14 nt, Shigella flexneri 2a str. 301
accaguaaaccaau

SEQ ID NO: 3937200 - RNA, 23 nt, Shigella flexneri 2a str. 301
accaguaaaccaauuucugugca

SEQ ID NO: 3937201 - RNA, 16 nt, Shigella flexneri 2a str. 301
accaguaaagugcgcu

SEQ ID NO: 3937202 - RNA, 13 nt, Shigella flexneri 2a str. 301
accaguaaggcau

SEQ ID NO: 3937203 - RNA, 15 nt, Shigella flexneri 2a str. 301
accaguaaggcaucu

SEQ ID NO: 3937204 - RNA, 20 nt, Shigella flexneri 2a str. 301
accaguaaggcgagaauauu

SEQ ID NO: 3937205 - RNA, 14 nt, Shigella flexneri 2a str. 301
accaguaccgccac

SEQ ID NO: 3937206 - RNA, 13 nt, Shigella flexneri 2a str. 301
accaguaccgccg

SEQ ID NO: 3937207 - RNA, 15 nt, Shigella flexneri 2a str. 301
accaguaugaugacg

SEQ ID NO: 3937208 - RNA, 22 nt, Shigella flexneri 2a str. 301
accagucagcgaacaccagcag

SEQ ID NO: 3937209 - RNA, 15 nt, Shigella flexneri 2a str. 301
accaguccagcgccu

SEQ ID NO: 3937210 - RNA, 12 nt, Shigella flexneri 2a str. 301
accgauuucacg

SEQ ID NO: 3937211 - RNA, 15 nt, Shigella flexneri 2a str. 301
accgauuuuguaaaa

SEQ ID NO: 3937212 - RNA, 14 nt, Shigella flexneri 2a str. 301
accgcaaaauaggu

SEQ ID NO: 3937213 - RNA, 21 nt, Shigella flexneri 2a str. 301
accgcaaacugccguugcugc

SEQ ID NO: 3937214 - RNA, 17 nt, Shigella flexneri 2a str. 301
accgcaaagguugcugc

SEQ ID NO: 3937215 - RNA, 23 nt, Shigella flexneri 2a str. 301
accgcaaagguugcugcgcccca

SEQ ID NO: 3937216 - RNA, 20 nt, Shigella flexneri 2a str. 301
accgcaaaugauuagugcca

SEQ ID NO: 3937217 - RNA, 15 nt, Shigella flexneri 2a str. 301
accgcaacucauuua

SEQ ID NO: 3937218 - RNA, 17 nt, Shigella flexneri 2a str. 301
accgcaagccaaauaca

SEQ ID NO: 3937219 - RNA, 18 nt, Shigella flexneri 2a str. 301
accgcaauaaccaucagc

SEQ ID NO: 3937220 - RNA, 20 nt, Shigella flexneri 2a str. 301
accgcaauaaccaucagcug

SEQ ID NO: 3937221 - RNA, 14 nt, Shigella flexneri 2a str. 301
accgcaaucgccag

SEQ ID NO: 3937222 - RNA, 14 nt, Shigella flexneri 2a str. 301
accgcacaccgaga

SEQ ID NO: 3937223 - RNA, 16 nt, Shigella flexneri 2a str. 301
accgcaccaccagcag

SEQ ID NO: 3937224 - RNA, 19 nt, Shigella flexneri 2a str. 301
accgcacgcagaaucucug

SEQ ID NO: 3937225 - RNA, 20 nt, Shigella flexneri 2a str. 301
accgcagaagcgauaaccuu

SEQ ID NO: 3937226 - RNA, 19 nt, Shigella flexneri 2a str. 301
accgcagcaucgucaucag

SEQ ID NO: 3937227 - RNA, 15 nt, Shigella flexneri 2a str. 301
accgcagcauugcuc

SEQ ID NO: 3937228 - RNA, 13 nt, Shigella flexneri 2a str. 301
accgcagcccaga

SEQ ID NO: 3937229 - RNA, 16 nt, Shigella flexneri 2a str. 301
accgcagccgccacaa

SEQ ID NO: 3937230 - RNA, 16 nt, Shigella flexneri 2a str. 301
accgcagugaaauuuc

SEQ ID NO: 3937231 - RNA, 16 nt, Shigella flexneri 2a str. 301
accgcaucagcaucgg

SEQ ID NO: 3937232 - RNA, 19 nt, Shigella flexneri 2a str. 301
accgcauccgcuugcguau

SEQ ID NO: 3937233 - RNA, 14 nt, Shigella flexneri 2a str. 301
accgcaucggcauc

SEQ ID NO: 3937234 - RNA, 15 nt, Shigella flexneri 2a str. 301
accgcauuuugacua

SEQ ID NO: 3937235 - RNA, 16 nt, Shigella flexneri 2a str. 301
accgccacagcagccu

SEQ ID NO: 3937236 - RNA, 13 nt, Shigella flexneri 2a str. 301
accgccaccaccg

SEQ ID NO: 3937237 - RNA, 18 nt, Shigella flexneri 2a str. 301
accgccaccaccgaugau

SEQ ID NO: 3937238 - RNA, 17 nt, Shigella flexneri 2a str. 301
accgccacuaccaucag

SEQ ID NO: 3937239 - RNA, 15 nt, Shigella flexneri 2a str. 301
accgccagcaucggc

SEQ ID NO: 3937240 - RNA, 13 nt, Shigella flexneri 2a str. 301
accgccaguaguc

SEQ ID NO: 3937241 - RNA, 19 nt, Shigella flexneri 2a str. 301
accgccauuaaacgcagua

SEQ ID NO: 3937242 - RNA, 19 nt, Shigella flexneri 2a str. 301
accgccauucauacccuga

SEQ ID NO: 3937243 - RNA, 14 nt, Shigella flexneri 2a str. 301
accgcccaccacca

SEQ ID NO: 3937244 - RNA, 18 nt, Shigella flexneri 2a str. 301
accgcccagaccugcguu

SEQ ID NO: 3937245 - RNA, 11 nt, Shigella flexneri 2a str. 301
accgcccagug

SEQ ID NO: 3937246 - RNA, 19 nt, Shigella flexneri 2a str. 301
accgcccagugcagugccu

SEQ ID NO: 3937247 - RNA, 12 nt, Shigella flexneri 2a str. 301
accgccccugca

SEQ ID NO: 3937248 - RNA, 14 nt, Shigella flexneri 2a str. 301
accgccccugcacu

SEQ ID NO: 3937249 - RNA, 14 nt, Shigella flexneri 2a str. 301
accgccccugcgcu

SEQ ID NO: 3937250 - RNA, 22 nt, Shigella flexneri 2a str. 301
accgcccgcgcgguaucaccac

SEQ ID NO: 3937251 - RNA, 20 nt, Shigella flexneri 2a str. 301
accgcccuccgguccgccgu

SEQ ID NO: 3937252 - RNA, 18 nt, Shigella flexneri 2a str. 301
accgcccugagcaucaau

SEQ ID NO: 3937253 - RNA, 16 nt, Shigella flexneri 2a str. 301
accgcccugcggcuga

SEQ ID NO: 3937254 - RNA, 23 nt, Shigella flexneri 2a str. 301
accgcccugcggcugaccaccac

SEQ ID NO: 3937255 - RNA, 17 nt, Shigella flexneri 2a str. 301
accgccgccagcaacau

SEQ ID NO: 3937256 - RNA, 16 nt, Shigella flexneri 2a str. 301
accgccguugccuuua

SEQ ID NO: 3937257 - RNA, 16 nt, Shigella flexneri 2a str. 301
accgccuaccauaauc

SEQ ID NO: 3937258 - RNA, 14 nt, Shigella flexneri 2a str. 301
accgccugaucauu

SEQ ID NO: 3937259 - RNA, 14 nt, Shigella flexneri 2a str. 301
accgccugcgggga

SEQ ID NO: 3937260 - RNA, 14 nt, Shigella flexneri 2a str. 301
accgccuggcgcug

SEQ ID NO: 3937261 - RNA, 15 nt, Shigella flexneri 2a str. 301
accgccuucugcgcc

SEQ ID NO: 3937262 - RNA, 13 nt, Shigella flexneri 2a str. 301
accgccuugcugu

SEQ ID NO: 3937263 - RNA, 13 nt, Shigella flexneri 2a str. 301
accgcgaaauaau

SEQ ID NO: 3937264 - RNA, 21 nt, Shigella flexneri 2a str. 301
accgcgaaucauaacugccgu

SEQ ID NO: 3937265 - RNA, 23 nt, Shigella flexneri 2a str. 301
accgcgaggccuaacaccaucag

SEQ ID NO: 3937266 - RNA, 13 nt, Shigella flexneri 2a str. 301
accgcgaguaauc

SEQ ID NO: 3937267 - RNA, 20 nt, Shigella flexneri 2a str. 301
accgcgaguaaucacaucaa

SEQ ID NO: 3937268 - RNA, 16 nt, Shigella flexneri 2a str. 301
accgcgcaggcggauu

SEQ ID NO: 3937269 - RNA, 14 nt, Shigella flexneri 2a str. 301
accgcgcaguacca

SEQ ID NO: 3937270 - RNA, 18 nt, Shigella flexneri 2a str. 301
accgcgcguuuaggcgca

SEQ ID NO: 3937271 - RNA, 23 nt, Shigella flexneri 2a str. 301
accgcguaauacaucagcuaaau

SEQ ID NO: 3937272 - RNA, 12 nt, Shigella flexneri 2a str. 301
accgcgucgauc

SEQ ID NO: 3937273 - RNA, 17 nt, Shigella flexneri 2a str. 301
accgcgugcgcggcagc

SEQ ID NO: 3937274 - RNA, 13 nt, Shigella flexneri 2a str. 301
accgcguuuucca

SEQ ID NO: 3937275 - RNA, 20 nt, Shigella flexneri 2a str. 301
accgcuauuugccgcgacgc

SEQ ID NO: 3937276 - RNA, 17 nt, Shigella flexneri 2a str. 301
accgcuauuugcgccug

SEQ ID NO: 3937277 - RNA, 14 nt, Shigella flexneri 2a str. 301
accgcucagcuccu

SEQ ID NO: 3937278 - RNA, 17 nt, Shigella flexneri 2a str. 301
accgcucccagcaugac

SEQ ID NO: 3937279 - RNA, 17 nt, Shigella flexneri 2a str. 301
accgcuccgccaucuuc

SEQ ID NO: 3937280 - RNA, 22 nt, Shigella flexneri 2a str. 301
accgcuccgccaucuucuugca

SEQ ID NO: 3937281 - RNA, 19 nt, Shigella flexneri 2a str. 301
accgcucugcgaucugcgc

SEQ ID NO: 3937282 - RNA, 22 nt, Shigella flexneri 2a str. 301
accgcugacggcagcgaagggu

SEQ ID NO: 3937283 - RNA, 15 nt, Shigella flexneri 2a str. 301
accgcugacuuucaa

SEQ ID NO: 3937284 - RNA, 23 nt, Shigella flexneri 2a str. 301
accgcugacuuucaaacgccaca

SEQ ID NO: 3937285 - RNA, 22 nt, Shigella flexneri 2a str. 301
accgcugagcgauaaaaucaga

SEQ ID NO: 3937286 - RNA, 21 nt, Shigella flexneri 2a str. 301
accgcugggcaccacgccgga

SEQ ID NO: 3937287 - RNA, 11 nt, Shigella flexneri 2a str. 301
accgcugucac

SEQ ID NO: 3937288 - RNA, 23 nt, Shigella flexneri 2a str. 301
accgcuguccacgccuuaugcca

SEQ ID NO: 3937289 - RNA, 21 nt, Shigella flexneri 2a str. 301
accgcuguccagucgcaaacc

SEQ ID NO: 3937290 - RNA, 21 nt, Shigella flexneri 2a str. 301
accgcuucgcucacaucaugc

SEQ ID NO: 3937291 - RNA, 16 nt, Shigella flexneri 2a str. 301
accgcuuggcgauacc

SEQ ID NO: 3937292 - RNA, 21 nt, Shigella flexneri 2a str. 301
accgcuuggcgauaccccaac

SEQ ID NO: 3937293 - RNA, 19 nt, Shigella flexneri 2a str. 301
accgcuuuacgccaccgca

SEQ ID NO: 3937294 - RNA, 17 nt, Shigella flexneri 2a str. 301
accgcuuuugucggcac

SEQ ID NO: 3937295 - RNA, 16 nt, Shigella flexneri 2a str. 301
accggaaaaggcguuc

SEQ ID NO: 3937296 - RNA, 14 nt, Shigella flexneri 2a str. 301
accggaaaaggugu

SEQ ID NO: 3937297 - RNA, 16 nt, Shigella flexneri 2a str. 301
accggaaaagguguuc

SEQ ID NO: 3937298 - RNA, 15 nt, Shigella flexneri 2a str. 301
accggaacaucacca

SEQ ID NO: 3937299 - RNA, 12 nt, Shigella flexneri 2a str. 301
accggaaccagc

SEQ ID NO: 3937300 - RNA, 13 nt, Shigella flexneri 2a str. 301
accggaaccagcg

SEQ ID NO: 3937301 - RNA, 13 nt, Shigella flexneri 2a str. 301
accggacaauaaa

SEQ ID NO: 3937302 - RNA, 21 nt, Shigella flexneri 2a str. 301
accggacacacuucauuuucc

SEQ ID NO: 3937303 - RNA, 19 nt, Shigella flexneri 2a str. 301
accggacaguuugaucagu

SEQ ID NO: 3937304 - RNA, 22 nt, Shigella flexneri 2a str. 301
accggacgaaauccccccggug

SEQ ID NO: 3937305 - RNA, 22 nt, Shigella flexneri 2a str. 301
accggagaauuagcguccggcu

SEQ ID NO: 3937306 - RNA, 18 nt, Shigella flexneri 2a str. 301
accggagccaaacaugca

SEQ ID NO: 3937307 - RNA, 15 nt, Shigella flexneri 2a str. 301
accggagucugugcu

SEQ ID NO: 3937308 - RNA, 16 nt, Shigella flexneri 2a str. 301
accggauaaucggcaa

SEQ ID NO: 3937309 - RNA, 20 nt, Shigella flexneri 2a str. 301
accggauuuccgaaaaaagc

SEQ ID NO: 3937310 - RNA, 16 nt, Shigella flexneri 2a str. 301
accuugcggaaacugu

SEQ ID NO: 3937311 - RNA, 19 nt, Shigella flexneri 2a str. 301
accuugcggaaacugucaa

SEQ ID NO: 3937312 - RNA, 15 nt, Shigella flexneri 2a str. 301
accuugcuuauccuc

SEQ ID NO: 3937313 - RNA, 20 nt, Shigella flexneri 2a str. 301
accuugcuuauccucuguaa

SEQ ID NO: 3937314 - RNA, 13 nt, Shigella flexneri 2a str. 301
accuuggcacuga

SEQ ID NO: 3937315 - RNA, 13 nt, Shigella flexneri 2a str. 301
accuugucaugca

SEQ ID NO: 3937316 - RNA, 15 nt, Shigella flexneri 2a str. 301
accuuguuucugagc

SEQ ID NO: 3937317 - RNA, 13 nt, Shigella flexneri 2a str. 301
accuuuaaacaga

SEQ ID NO: 3937318 - RNA, 15 nt, Shigella flexneri 2a str. 301
accuuuaaucaggcu

SEQ ID NO: 3937319 - RNA, 18 nt, Shigella flexneri 2a str. 301
accuuuaaucaggcuggu

SEQ ID NO: 3937320 - RNA, 16 nt, Shigella flexneri 2a str. 301
accuuucagaacggca

SEQ ID NO: 3937321 - RNA, 21 nt, Shigella flexneri 2a str. 301
accuuugaacaaccagaaaga

SEQ ID NO: 3937322 - RNA, 15 nt, Shigella flexneri 2a str. 301
accuuugaacugcug

SEQ ID NO: 3937323 - RNA, 14 nt, Shigella flexneri 2a str. 301
accuuugccuucca

SEQ ID NO: 3937324 - RNA, 18 nt, Shigella flexneri 2a str. 301
accuuugcgguuaaaaau

SEQ ID NO: 3937325 - RNA, 15 nt, Shigella flexneri 2a str. 301
acgaaaacagcgcag

SEQ ID NO: 3937326 - RNA, 13 nt, Shigella flexneri 2a str. 301
acgaaaacugcgc

SEQ ID NO: 3937327 - RNA, 24 nt, Shigella flexneri 2a str. 301
acgaaagcagggcggcaggcagcg

SEQ ID NO: 3937328 - RNA, 17 nt, Shigella flexneri 2a str. 301
acgaaagcgcaguaagc

SEQ ID NO: 3937329 - RNA, 19 nt, Shigella flexneri 2a str. 301
acgaaaguuaauccacagc

SEQ ID NO: 3937330 - RNA, 16 nt, Shigella flexneri 2a str. 301
acgaaauugaggaugc

SEQ ID NO: 3937331 - RNA, 12 nt, Shigella flexneri 2a str. 301
acgaaccauuuc

SEQ ID NO: 3937332 - RNA, 16 nt, Shigella flexneri 2a str. 301
acgaacccgaacgcgc

SEQ ID NO: 3937333 - RNA, 14 nt, Shigella flexneri 2a str. 301
acgaaccgagcggu

SEQ ID NO: 3937334 - RNA, 19 nt, Shigella flexneri 2a str. 301
acgaaccguccccucgccc

SEQ ID NO: 3937335 - RNA, 23 nt, Shigella flexneri 2a str. 301
acgaacuaccgugcuguacagca

SEQ ID NO: 3937336 - RNA, 14 nt, Shigella flexneri 2a str. 301
acgaagccgugcca

SEQ ID NO: 3937337 - RNA, 14 nt, Shigella flexneri 2a str. 301
acgaaggccugcau

SEQ ID NO: 3937338 - RNA, 13 nt, Shigella flexneri 2a str. 301
acgaaguacucaa

SEQ ID NO: 3937339 - RNA, 17 nt, Shigella flexneri 2a str. 301
acgaauaccuucuuccu

SEQ ID NO: 3937340 - RNA, 14 nt, Shigella flexneri 2a str. 301
acgaauaguuucag

SEQ ID NO: 3937341 - RNA, 19 nt, Shigella flexneri 2a str. 301
acgaauaguuucagccucu

SEQ ID NO: 3937342 - RNA, 23 nt, Shigella flexneri 2a str. 301
acgaauauagcgccacgcuguuc

SEQ ID NO: 3937343 - RNA, 17 nt, Shigella flexneri 2a str. 301
acgaaucaaucgccccu

SEQ ID NO: 3937344 - RNA, 15 nt, Shigella flexneri 2a str. 301
acgaaucccgcgauu

SEQ ID NO: 3937345 - RNA, 14 nt, Shigella flexneri 2a str. 301
acgaaucgccgcau

SEQ ID NO: 3937346 - RNA, 16 nt, Shigella flexneri 2a str. 301
acgaaucgccgcauag

SEQ ID NO: 3937347 - RNA, 15 nt, Shigella flexneri 2a str. 301
acgaaucuauucauu

SEQ ID NO: 3937348 - RNA, 21 nt, Shigella flexneri 2a str. 301
acgaaucuauucauuuauguu

SEQ ID NO: 3937349 - RNA, 21 nt, Shigella flexneri 2a str. 301
acgaaugacauaaugcaaaau

SEQ ID NO: 3937350 - RNA, 16 nt, Shigella flexneri 2a str. 301
acgaauuccaagcaga

SEQ ID NO: 3937351 - RNA, 14 nt, Shigella flexneri 2a str. 301
acgaauugcaggac

SEQ ID NO: 3937352 - RNA, 22 nt, Shigella flexneri 2a str. 301
acgacaaucucaauuuucacuu

SEQ ID NO: 3937353 - RNA, 19 nt, Shigella flexneri 2a str. 301
acgacaugugccagcgauu

SEQ ID NO: 3937354 - RNA, 13 nt, Shigella flexneri 2a str. 301
acgaccaccaccg

SEQ ID NO: 3937355 - RNA, 14 nt, Shigella flexneri 2a str. 301
acgaccacccaccg

SEQ ID NO: 3937356 - RNA, 12 nt, Shigella flexneri 2a str. 301
acgaccaccgaa

SEQ ID NO: 3937357 - RNA, 18 nt, Shigella flexneri 2a str. 301
acgaccaucagcugccag

SEQ ID NO: 3937358 - RNA, 19 nt, Shigella flexneri 2a str. 301
acgaccguuccauucaaac

SEQ ID NO: 3937359 - RNA, 18 nt, Shigella flexneri 2a str. 301
acgaccuccacucucgaa

SEQ ID NO: 3937360 - RNA, 15 nt, Shigella flexneri 2a str. 301
acgacgacaggcaag

SEQ ID NO: 3937361 - RNA, 15 nt, Shigella flexneri 2a str. 301
acgacgccaagaaag

SEQ ID NO: 3937362 - RNA, 19 nt, Shigella flexneri 2a str. 301
acgacgcugacgauuguag

SEQ ID NO: 3937363 - RNA, 18 nt, Shigella flexneri 2a str. 301
acgacgcugaugucagca

SEQ ID NO: 3937364 - RNA, 14 nt, Shigella flexneri 2a str. 301
acgacggcugccau

SEQ ID NO: 3937365 - RNA, 15 nt, Shigella flexneri 2a str. 301
acgacgguuuccacc

SEQ ID NO: 3937366 - RNA, 14 nt, Shigella flexneri 2a str. 301
acgacguaccagcg

SEQ ID NO: 3937367 - RNA, 20 nt, Shigella flexneri 2a str. 301
acgacucaaaucacgcaguu

SEQ ID NO: 3937368 - RNA, 17 nt, Shigella flexneri 2a str. 301
acgacugcgagcaaaau

SEQ ID NO: 3937369 - RNA, 21 nt, Shigella flexneri 2a str. 301
acgagaaaugucggcccgcau

SEQ ID NO: 3937370 - RNA, 22 nt, Shigella flexneri 2a str. 301
acgagagccggaagaauuucau

SEQ ID NO: 3937371 - RNA, 13 nt, Shigella flexneri 2a str. 301
acgagauaaaauu

SEQ ID NO: 3937372 - RNA, 20 nt, Shigella flexneri 2a str. 301
acgagauagcgaaguagaca

SEQ ID NO: 3937373 - RNA, 13 nt, Shigella flexneri 2a str. 301
acgagcaaaacgc

SEQ ID NO: 3937374 - RNA, 17 nt, Shigella flexneri 2a str. 301
acgagccguuccuaaca

SEQ ID NO: 3937375 - RNA, 16 nt, Shigella flexneri 2a str. 301
acgagcgcaaugaaaa

SEQ ID NO: 3937376 - RNA, 13 nt, Shigella flexneri 2a str. 301
acgaggagacugc

SEQ ID NO: 3937377 - RNA, 15 nt, Shigella flexneri 2a str. 301
acgaggggagaccuc

SEQ ID NO: 3937378 - RNA, 18 nt, Shigella flexneri 2a str. 301
acgaggggagaccucacu

SEQ ID NO: 3937379 - RNA, 17 nt, Shigella flexneri 2a str. 301
acgagucaacgcuucag

SEQ ID NO: 3937380 - RNA, 18 nt, Shigella flexneri 2a str. 301
acgagucaacgcuucagc

SEQ ID NO: 3937381 - RNA, 18 nt, Shigella flexneri 2a str. 301
acgagucacaaacaucau

SEQ ID NO: 3937382 - RNA, 23 nt, Shigella flexneri 2a str. 301
acgagugcaucugguaagugcca

SEQ ID NO: 3937383 - RNA, 18 nt, Shigella flexneri 2a str. 301
acgaguggcggacgggug

SEQ ID NO: 3937384 - RNA, 18 nt, Shigella flexneri 2a str. 301
acgaguggugucgucaaa

SEQ ID NO: 3937385 - RNA, 17 nt, Shigella flexneri 2a str. 301
acgauaaucucugcuuu

SEQ ID NO: 3937386 - RNA, 20 nt, Shigella flexneri 2a str. 301
acgauaauuaggauacuuau

SEQ ID NO: 3937387 - RNA, 13 nt, Shigella flexneri 2a str. 301
acgauaauucagc

SEQ ID NO: 3937388 - RNA, 18 nt, Shigella flexneri 2a str. 301
acgauacagaagcaccgu

SEQ ID NO: 3937389 - RNA, 12 nt, Shigella flexneri 2a str. 301
acgauaccgccg

SEQ ID NO: 3937390 - RNA, 22 nt, Shigella flexneri 2a str. 301
acgauauguucaggauauuuau

SEQ ID NO: 3937391 - RNA, 22 nt, Shigella flexneri 2a str. 301
acgauauuuuuccggcaguucu

SEQ ID NO: 3937392 - RNA, 16 nt, Shigella flexneri 2a str. 301
acgaucagccauaccg

SEQ ID NO: 3937393 - RNA, 13 nt, Shigella flexneri 2a str. 301
acgaucagugccg

SEQ ID NO: 3937394 - RNA, 23 nt, Shigella flexneri 2a str. 301
acgaucaucgacaguaccagcag

SEQ ID NO: 3937395 - RNA, 14 nt, Shigella flexneri 2a str. 301
acgauccaccaccg

SEQ ID NO: 3937396 - RNA, 19 nt, Shigella flexneri 2a str. 301
acgaucgauaaccaucuuc

SEQ ID NO: 3937397 - RNA, 23 nt, Shigella flexneri 2a str. 301
acgaucgccugguaccagcaccg

SEQ ID NO: 3937398 - RNA, 17 nt, Shigella flexneri 2a str. 301
acgaucuucggcgucag

SEQ ID NO: 3937399 - RNA, 16 nt, Shigella flexneri 2a str. 301
acgaugaccgcaucaa

SEQ ID NO: 3937400 - RNA, 21 nt, Shigella flexneri 2a str. 301
acgaugaccgcaucaaugacc

SEQ ID NO: 3937401 - RNA, 19 nt, Shigella flexneri 2a str. 301
acgaugccugaugcgacgc

SEQ ID NO: 3937402 - RNA, 18 nt, Shigella flexneri 2a str. 301
acgaugccugcaaugccg

SEQ ID NO: 3937403 - RNA, 19 nt, Shigella flexneri 2a str. 301
acgaugcuaaaaacaucau

SEQ ID NO: 3937404 - RNA, 19 nt, Shigella flexneri 2a str. 301
acgauggaaccguacagca

SEQ ID NO: 3937405 - RNA, 12 nt, Shigella flexneri 2a str. 301
acgauggcgcgc

SEQ ID NO: 3937406 - RNA, 15 nt, Shigella flexneri 2a str. 301
acgauguucugagcg

SEQ ID NO: 3937407 - RNA, 16 nt, Shigella flexneri 2a str. 301
acgauucggcaaucac

SEQ ID NO: 3937408 - RNA, 14 nt, Shigella flexneri 2a str. 301
acgcaaaaccucuu

SEQ ID NO: 3937409 - RNA, 16 nt, Shigella flexneri 2a str. 301
acgcaaaacugccuga

SEQ ID NO: 3937410 - RNA, 14 nt, Shigella flexneri 2a str. 301
acgcaaaauugccu

SEQ ID NO: 3937411 - RNA, 15 nt, Shigella flexneri 2a str. 301
acgccgaccagaccg

SEQ ID NO: 3937412 - RNA, 17 nt, Shigella flexneri 2a str. 301
acgccgacgcccugcgc

SEQ ID NO: 3937413 - RNA, 20 nt, Shigella flexneri 2a str. 301
acgccgacgggucagcgggg

SEQ ID NO: 3937414 - RNA, 19 nt, Shigella flexneri 2a str. 301
acgccgauugacuggaugc

SEQ ID NO: 3937415 - RNA, 15 nt, Shigella flexneri 2a str. 301
acgccgcaucaggca

SEQ ID NO: 3937416 - RNA, 18 nt, Shigella flexneri 2a str. 301
acgccgcauccggcauaa

SEQ ID NO: 3937417 - RNA, 19 nt, Shigella flexneri 2a str. 301
acgccgcauccggcaugaa

SEQ ID NO: 3937418 - RNA, 20 nt, Shigella flexneri 2a str. 301
acgccgcauccggcauuuug

SEQ ID NO: 3937419 - RNA, 21 nt, Shigella flexneri 2a str. 301
acgccgcaucuggcauaaaca

SEQ ID NO: 3937420 - RNA, 16 nt, Shigella flexneri 2a str. 301
acgccgccagaccaau

SEQ ID NO: 3937421 - RNA, 21 nt, Shigella flexneri 2a str. 301
acgccgccagaccaauagaaa

SEQ ID NO: 3937422 - RNA, 15 nt, Shigella flexneri 2a str. 301
acgccgcccagagaa

SEQ ID NO: 3937423 - RNA, 20 nt, Shigella flexneri 2a str. 301
acgccgcccagagaacuggc

SEQ ID NO: 3937424 - RNA, 14 nt, Shigella flexneri 2a str. 301
acgccgccgagcac

SEQ ID NO: 3937425 - RNA, 22 nt, Shigella flexneri 2a str. 301
acgccgccgagcgucacuucgg

SEQ ID NO: 3937426 - RNA, 21 nt, Shigella flexneri 2a str. 301
acgccgccgcuucgcccaaau

SEQ ID NO: 3937427 - RNA, 20 nt, Shigella flexneri 2a str. 301
acgccgccggaaguauuuca

SEQ ID NO: 3937428 - RNA, 22 nt, Shigella flexneri 2a str. 301
acgccgccggaaguauuucaau

SEQ ID NO: 3937429 - RNA, 19 nt, Shigella flexneri 2a str. 301
acgccgccguuagcuucag

SEQ ID NO: 3937430 - RNA, 15 nt, Shigella flexneri 2a str. 301
acgccgcgaggcaaa

SEQ ID NO: 3937431 - RNA, 15 nt, Shigella flexneri 2a str. 301
acgccgcgcgccacc

SEQ ID NO: 3937432 - RNA, 15 nt, Shigella flexneri 2a str. 301
acgccgcguuugcgc

SEQ ID NO: 3937433 - RNA, 23 nt, Shigella flexneri 2a str. 301
acgccgcugucuaccagcaccug

SEQ ID NO: 3937434 - RNA, 18 nt, Shigella flexneri 2a str. 301
acgccgggaaauuuuucc

SEQ ID NO: 3937435 - RNA, 22 nt, Shigella flexneri 2a str. 301
acgccggugaccaucagcauga

SEQ ID NO: 3937436 - RNA, 23 nt, Shigella flexneri 2a str. 301
acgccggugaccaucagcaugac

SEQ ID NO: 3937437 - RNA, 19 nt, Shigella flexneri 2a str. 301
acgccguucuucagcgucc

SEQ ID NO: 3937438 - RNA, 21 nt, Shigella flexneri 2a str. 301
acgccguuuuuacccagcagc

SEQ ID NO: 3937439 - RNA, 23 nt, Shigella flexneri 2a str. 301
acgccucgggaaggucagguuug

SEQ ID NO: 3937440 - RNA, 14 nt, Shigella flexneri 2a str. 301
acgccucuauuaaa

SEQ ID NO: 3937441 - RNA, 17 nt, Shigella flexneri 2a str. 301
acgccugauagcccgca

SEQ ID NO: 3937442 - RNA, 24 nt, Shigella flexneri 2a str. 301
acgccugcauccgccauccaccag

SEQ ID NO: 3937443 - RNA, 15 nt, Shigella flexneri 2a str. 301
acgccugccagcucu

SEQ ID NO: 3937444 - RNA, 14 nt, Shigella flexneri 2a str. 301
acgccugccgcauc

SEQ ID NO: 3937445 - RNA, 19 nt, Shigella flexneri 2a str. 301
acgccuggcucaagcacca

SEQ ID NO: 3937446 - RNA, 20 nt, Shigella flexneri 2a str. 301
acgccugggcgagguggaua

SEQ ID NO: 3937447 - RNA, 22 nt, Shigella flexneri 2a str. 301
acgccuguaccagcggcuucca

SEQ ID NO: 3937448 - RNA, 22 nt, Shigella flexneri 2a str. 301
acgccuuaguuauaaacuuuuc

SEQ ID NO: 3937449 - RNA, 19 nt, Shigella flexneri 2a str. 301
acgccuuauccagccuaca

SEQ ID NO: 3937450 - RNA, 19 nt, Shigella flexneri 2a str. 301
acgccuuauccgaccuaca

SEQ ID NO: 3937451 - RNA, 20 nt, Shigella flexneri 2a str. 301
acgccuuauccgaccuacaa

SEQ ID NO: 3937452 - RNA, 20 nt, Shigella flexneri 2a str. 301
acgccuuauccggccuacga

SEQ ID NO: 3937453 - RNA, 14 nt, Shigella flexneri 2a str. 301
acgccuucccuuuc

SEQ ID NO: 3937454 - RNA, 20 nt, Shigella flexneri 2a str. 301
acgccuucuccggcuuacaa

SEQ ID NO: 3937455 - RNA, 22 nt, Shigella flexneri 2a str. 301
acgccuuguuccugcuuggcgc

SEQ ID NO: 3937456 - RNA, 17 nt, Shigella flexneri 2a str. 301
acgccuuguuucuucaa

SEQ ID NO: 3937457 - RNA, 21 nt, Shigella flexneri 2a str. 301
acgcgacaagcgucgcaucag

SEQ ID NO: 3937458 - RNA, 13 nt, Shigella flexneri 2a str. 301
acgcgaccggcgu

SEQ ID NO: 3937459 - RNA, 19 nt, Shigella flexneri 2a str. 301
acgcgaccggcgucgcauc

SEQ ID NO: 3937460 - RNA, 21 nt, Shigella flexneri 2a str. 301
acgcgaccgugggcaauuucu

SEQ ID NO: 3937461 - RNA, 23 nt, Shigella flexneri 2a str. 301
acgcgauaaaagacgccgacauc

SEQ ID NO: 3937462 - RNA, 19 nt, Shigella flexneri 2a str. 301
acgcgcagcgucgcaucag

SEQ ID NO: 3937463 - RNA, 14 nt, Shigella flexneri 2a str. 301
acgcgcagcguuca

SEQ ID NO: 3937464 - RNA, 22 nt, Shigella flexneri 2a str. 301
acgcgcagggugcagaaucaau

SEQ ID NO: 3937465 - RNA, 17 nt, Shigella flexneri 2a str. 301
acgcgcauccggcagga

SEQ ID NO: 3937466 - RNA, 21 nt, Shigella flexneri 2a str. 301
acgcgccagagagaacugcgc

SEQ ID NO: 3937467 - RNA, 13 nt, Shigella flexneri 2a str. 301
acgcgccagcacc

SEQ ID NO: 3937468 - RNA, 20 nt, Shigella flexneri 2a str. 301
acgcgccagcgucgcaucag

SEQ ID NO: 3937469 - RNA, 14 nt, Shigella flexneri 2a str. 301
acgcgccuuaaaaa

SEQ ID NO: 3937470 - RNA, 18 nt, Shigella flexneri 2a str. 301
acgcgcuagccucaggug

SEQ ID NO: 3937471 - RNA, 20 nt, Shigella flexneri 2a str. 301
acgcgcuagcgucgcaucag

SEQ ID NO: 3937472 - RNA, 23 nt, Shigella flexneri 2a str. 301
acgcggaaaagguuaaaccgcca

SEQ ID NO: 3937473 - RNA, 23 nt, Shigella flexneri 2a str. 301
acgcggcaauaauagccccaacc

SEQ ID NO: 3937474 - RNA, 20 nt, Shigella flexneri 2a str. 301
acgcggcauuuuuacugcgc

SEQ ID NO: 3937475 - RNA, 16 nt, Shigella flexneri 2a str. 301
acgcggcccaggcggc

SEQ ID NO: 3937476 - RNA, 18 nt, Shigella flexneri 2a str. 301
acgcgggcaaucggcugc

SEQ ID NO: 3937477 - RNA, 14 nt, Shigella flexneri 2a str. 301
acgcgggcagcaga

SEQ ID NO: 3937478 - RNA, 15 nt, Shigella flexneri 2a str. 301
acgcgggcagcagaa

SEQ ID NO: 3937479 - RNA, 20 nt, Shigella flexneri 2a str. 301
acgcggguaaguacgccauc

SEQ ID NO: 3937480 - RNA, 17 nt, Shigella flexneri 2a str. 301
acgcgguauuggugaaa

SEQ ID NO: 3937481 - RNA, 16 nt, Shigella flexneri 2a str. 301
acgcgguuaucccaaa

SEQ ID NO: 3937482 - RNA, 17 nt, Shigella flexneri 2a str. 301
acgcguaaaacagccag

SEQ ID NO: 3937483 - RNA, 16 nt, Shigella flexneri 2a str. 301
acgcguagagaaucca

SEQ ID NO: 3937484 - RNA, 21 nt, Shigella flexneri 2a str. 301
acgcgucaagcgucgcaucag

SEQ ID NO: 3937485 - RNA, 20 nt, Shigella flexneri 2a str. 301
acgcgucagcgucgcaucug

SEQ ID NO: 3937486 - RNA, 22 nt, Shigella flexneri 2a str. 301
acgcgucuuaucaggccuacag

SEQ ID NO: 3937487 - RNA, 20 nt, Shigella flexneri 2a str. 301
acgcgucuugagagugcgaa

SEQ ID NO: 3937488 - RNA, 20 nt, Shigella flexneri 2a str. 301
acgcguuagcaucgcaucag

SEQ ID NO: 3937489 - RNA, 15 nt, Shigella flexneri 2a str. 301
acgcguucacugccg

SEQ ID NO: 3937490 - RNA, 23 nt, Shigella flexneri 2a str. 301
acgcguuuuuucgauaucaagcc

SEQ ID NO: 3937491 - RNA, 19 nt, Shigella flexneri 2a str. 301
acgcuaauuuugccaucag

SEQ ID NO: 3937492 - RNA, 22 nt, Shigella flexneri 2a str. 301
acgcuacauccgacaaaacgau

SEQ ID NO: 3937493 - RNA, 15 nt, Shigella flexneri 2a str. 301
acgcuacuggacauu

SEQ ID NO: 3937494 - RNA, 21 nt, Shigella flexneri 2a str. 301
acgcucaauauuugcaccuaa

SEQ ID NO: 3937495 - RNA, 15 nt, Shigella flexneri 2a str. 301
acgcucacgcgcugc

SEQ ID NO: 3937496 - RNA, 12 nt, Shigella flexneri 2a str. 301
acgcucacugca

SEQ ID NO: 3937497 - RNA, 21 nt, Shigella flexneri 2a str. 301
acgcucaggcgaugaaacaaa

SEQ ID NO: 3937498 - RNA, 15 nt, Shigella flexneri 2a str. 301
acgcucaggguuuuc

SEQ ID NO: 3937499 - RNA, 14 nt, Shigella flexneri 2a str. 301
acgcucaucaggcc

SEQ ID NO: 3937500 - RNA, 13 nt, Shigella flexneri 2a str. 301
acgcuccagcagg

SEQ ID NO: 3937501 - RNA, 16 nt, Shigella flexneri 2a str. 301
acgcucccagcagaga

SEQ ID NO: 3937502 - RNA, 15 nt, Shigella flexneri 2a str. 301
acgcucccugccagu

SEQ ID NO: 3937503 - RNA, 11 nt, Shigella flexneri 2a str. 301
acgcucggcaa

SEQ ID NO: 3937504 - RNA, 22 nt, Shigella flexneri 2a str. 301
acgcucggcaacaccucagcca

SEQ ID NO: 3937505 - RNA, 21 nt, Shigella flexneri 2a str. 301
acgcucggcuguuucuggaug

SEQ ID NO: 3937506 - RNA, 22 nt, Shigella flexneri 2a str. 301
acgcucuccugcggaaugcugu

SEQ ID NO: 3937507 - RNA, 13 nt, Shigella flexneri 2a str. 301
acgcucucuucaa

SEQ ID NO: 3937508 - RNA, 23 nt, Shigella flexneri 2a str. 301
acgcucuucaauggucagccaca

SEQ ID NO: 3937509 - RNA, 16 nt, Shigella flexneri 2a str. 301
acgcucuuccagggua

SEQ ID NO: 3937510 - RNA, 17 nt, Shigella flexneri 2a str. 301
acggcuaucuacgcgua

SEQ ID NO: 3937511 - RNA, 18 nt, Shigella flexneri 2a str. 301
acggcugauaugccagac

SEQ ID NO: 3937512 - RNA, 22 nt, Shigella flexneri 2a str. 301
acggcugcugcuuucgccgcga

SEQ ID NO: 3937513 - RNA, 12 nt, Shigella flexneri 2a str. 301
acggcuggaaca

SEQ ID NO: 3937514 - RNA, 14 nt, Shigella flexneri 2a str. 301
acggcuggccacaa

SEQ ID NO: 3937515 - RNA, 17 nt, Shigella flexneri 2a str. 301
acggcugggaaaucacc

SEQ ID NO: 3937516 - RNA, 18 nt, Shigella flexneri 2a str. 301
acggcugucauccagcag

SEQ ID NO: 3937517 - RNA, 19 nt, Shigella flexneri 2a str. 301
acggcugucauccagcagc

SEQ ID NO: 3937518 - RNA, 21 nt, Shigella flexneri 2a str. 301
acggcuguuggaaucacucau

SEQ ID NO: 3937519 - RNA, 15 nt, Shigella flexneri 2a str. 301
acggcuuguggugaa

SEQ ID NO: 3937520 - RNA, 20 nt, Shigella flexneri 2a str. 301
acgggaagggguucuccuua

SEQ ID NO: 3937521 - RNA, 13 nt, Shigella flexneri 2a str. 301
acgggcaagaaua

SEQ ID NO: 3937522 - RNA, 17 nt, Shigella flexneri 2a str. 301
acgggcaagccagcaua

SEQ ID NO: 3937523 - RNA, 14 nt, Shigella flexneri 2a str. 301
acgggcaaucuccu

SEQ ID NO: 3937524 - RNA, 22 nt, Shigella flexneri 2a str. 301
acgggcaauuucacguucaccc

SEQ ID NO: 3937525 - RNA, 18 nt, Shigella flexneri 2a str. 301
acgggcgaggaaauugcg

SEQ ID NO: 3937526 - RNA, 17 nt, Shigella flexneri 2a str. 301
acgggcugauuucaccc

SEQ ID NO: 3937527 - RNA, 18 nt, Shigella flexneri 2a str. 301
acggggacuccacaccgg

SEQ ID NO: 3937528 - RNA, 19 nt, Shigella flexneri 2a str. 301
acggggcugccagcucuca

SEQ ID NO: 3937529 - RNA, 20 nt, Shigella flexneri 2a str. 301
acggguaaaacgugccauua

SEQ ID NO: 3937530 - RNA, 15 nt, Shigella flexneri 2a str. 301
acggguuuuccccuu

SEQ ID NO: 3937531 - RNA, 18 nt, Shigella flexneri 2a str. 301
acgguaaguucacgcagg

SEQ ID NO: 3937532 - RNA, 16 nt, Shigella flexneri 2a str. 301
acgguaauaaaugccg

SEQ ID NO: 3937533 - RNA, 12 nt, Shigella flexneri 2a str. 301
acgguaauacaa

SEQ ID NO: 3937534 - RNA, 16 nt, Shigella flexneri 2a str. 301
acgguaauggcaaaga

SEQ ID NO: 3937535 - RNA, 16 nt, Shigella flexneri 2a str. 301
acgguacucaucacgu

SEQ ID NO: 3937536 - RNA, 21 nt, Shigella flexneri 2a str. 301
acgguacucaucacgucgccu

SEQ ID NO: 3937537 - RNA, 21 nt, Shigella flexneri 2a str. 301
acgguaguggcaaccagcaga

SEQ ID NO: 3937538 - RNA, 16 nt, Shigella flexneri 2a str. 301
acgguaguugaacucg

SEQ ID NO: 3937539 - RNA, 17 nt, Shigella flexneri 2a str. 301
acggucaggcuaaagaa

SEQ ID NO: 3937540 - RNA, 20 nt, Shigella flexneri 2a str. 301
acggucaggcuaaagaaaac

SEQ ID NO: 3937541 - RNA, 22 nt, Shigella flexneri 2a str. 301
acgguccuuaccaugcugcagu

SEQ ID NO: 3937542 - RNA, 21 nt, Shigella flexneri 2a str. 301
acggucgaggcaaccagcacg

SEQ ID NO: 3937543 - RNA, 15 nt, Shigella flexneri 2a str. 301
acggugaacucacac

SEQ ID NO: 3937544 - RNA, 22 nt, Shigella flexneri 2a str. 301
acggugaagaagcggaaaucac

SEQ ID NO: 3937545 - RNA, 17 nt, Shigella flexneri 2a str. 301
acggugauaaucauccc

SEQ ID NO: 3937546 - RNA, 18 nt, Shigella flexneri 2a str. 301
acggugaugaucgcgcug

SEQ ID NO: 3937547 - RNA, 15 nt, Shigella flexneri 2a str. 301
acggugaugcuccac

SEQ ID NO: 3937548 - RNA, 16 nt, Shigella flexneri 2a str. 301
acggugcaccgcaucg

SEQ ID NO: 3937549 - RNA, 20 nt, Shigella flexneri 2a str. 301
acggugccauugaccagcug

SEQ ID NO: 3937550 - RNA, 22 nt, Shigella flexneri 2a str. 301
acggugccauugaccagcugcc

SEQ ID NO: 3937551 - RNA, 15 nt, Shigella flexneri 2a str. 301
acggugguaaagccg

SEQ ID NO: 3937552 - RNA, 23 nt, Shigella flexneri 2a str. 301
acgguguaccggauaaauuuaaa

SEQ ID NO: 3937553 - RNA, 19 nt, Shigella flexneri 2a str. 301
acgguguuaguaaacgcgu

SEQ ID NO: 3937554 - RNA, 17 nt, Shigella flexneri 2a str. 301
acgguuaaaaacagcca

SEQ ID NO: 3937555 - RNA, 18 nt, Shigella flexneri 2a str. 301
acgguuaaaaacagccag

SEQ ID NO: 3937556 - RNA, 21 nt, Shigella flexneri 2a str. 301
acgguuaaaaacagccagcag

SEQ ID NO: 3937557 - RNA, 14 nt, Shigella flexneri 2a str. 301
acgguucagcgucg

SEQ ID NO: 3937558 - RNA, 17 nt, Shigella flexneri 2a str. 301
acgguugaugccguucc

SEQ ID NO: 3937559 - RNA, 15 nt, Shigella flexneri 2a str. 301
acgguugcgaagucg

SEQ ID NO: 3937560 - RNA, 22 nt, Shigella flexneri 2a str. 301
acgguuuaaaccugauuuugcc

SEQ ID NO: 3937561 - RNA, 14 nt, Shigella flexneri 2a str. 301
acguaaaaaacacu

SEQ ID NO: 3937562 - RNA, 15 nt, Shigella flexneri 2a str. 301
acguaaacgcagcau

SEQ ID NO: 3937563 - RNA, 14 nt, Shigella flexneri 2a str. 301
acguaacagagcau

SEQ ID NO: 3937564 - RNA, 17 nt, Shigella flexneri 2a str. 301
acguaaccguugaccag

SEQ ID NO: 3937565 - RNA, 17 nt, Shigella flexneri 2a str. 301
acguaaguacugauuga

SEQ ID NO: 3937566 - RNA, 20 nt, Shigella flexneri 2a str. 301
acguaauuauaugccagccc

SEQ ID NO: 3937567 - RNA, 22 nt, Shigella flexneri 2a str. 301
acguaauuuauaaucuuuaaaa

SEQ ID NO: 3937568 - RNA, 19 nt, Shigella flexneri 2a str. 301
acguacaaaacgcaccacu

SEQ ID NO: 3937569 - RNA, 14 nt, Shigella flexneri 2a str. 301
acguaccaaaacac

SEQ ID NO: 3937570 - RNA, 14 nt, Shigella flexneri 2a str. 301
acguaccaacugau

SEQ ID NO: 3937571 - RNA, 16 nt, Shigella flexneri 2a str. 301
acguacgcaauccucu

SEQ ID NO: 3937572 - RNA, 12 nt, Shigella flexneri 2a str. 301
acguagaaacca

SEQ ID NO: 3937573 - RNA, 14 nt, Shigella flexneri 2a str. 301
acguaggccugaua

SEQ ID NO: 3937574 - RNA, 16 nt, Shigella flexneri 2a str. 301
acguaggcgaucccgg

SEQ ID NO: 3937575 - RNA, 18 nt, Shigella flexneri 2a str. 301
acguagugaaaucgccaa

SEQ ID NO: 3937576 - RNA, 13 nt, Shigella flexneri 2a str. 301
acguaucaauuag

SEQ ID NO: 3937577 - RNA, 15 nt, Shigella flexneri 2a str. 301
acguauuaaauucca

SEQ ID NO: 3937578 - RNA, 14 nt, Shigella flexneri 2a str. 301
acguauuauauaua

SEQ ID NO: 3937579 - RNA, 16 nt, Shigella flexneri 2a str. 301
acguauugagaucacc

SEQ ID NO: 3937580 - RNA, 22 nt, Shigella flexneri 2a str. 301
acgucacaggccaucacauccu

SEQ ID NO: 3937581 - RNA, 12 nt, Shigella flexneri 2a str. 301
acgucaccaucc

SEQ ID NO: 3937582 - RNA, 16 nt, Shigella flexneri 2a str. 301
acgucagcacaaacau

SEQ ID NO: 3937583 - RNA, 22 nt, Shigella flexneri 2a str. 301
acgucagccucgcuggucagcg

SEQ ID NO: 3937584 - RNA, 23 nt, Shigella flexneri 2a str. 301
acgucaguaaccgcuuuuucaau

SEQ ID NO: 3937585 - RNA, 16 nt, Shigella flexneri 2a str. 301
acgucauuaccgcgaa

SEQ ID NO: 3937586 - RNA, 22 nt, Shigella flexneri 2a str. 301
acguccaccccagcagaauccg

SEQ ID NO: 3937587 - RNA, 12 nt, Shigella flexneri 2a str. 301
acguccagccag

SEQ ID NO: 3937588 - RNA, 22 nt, Shigella flexneri 2a str. 301
acguccagccaggaaucagaua

SEQ ID NO: 3937589 - RNA, 19 nt, Shigella flexneri 2a str. 301
acguccggcaauauagaua

SEQ ID NO: 3937590 - RNA, 17 nt, Shigella flexneri 2a str. 301
acguccuguacuguuuc

SEQ ID NO: 3937591 - RNA, 18 nt, Shigella flexneri 2a str. 301
acgucgauuuuuaaugaa

SEQ ID NO: 3937592 - RNA, 20 nt, Shigella flexneri 2a str. 301
acgucgauuuuuaaugaacg

SEQ ID NO: 3937593 - RNA, 16 nt, Shigella flexneri 2a str. 301
acgucgcaagacgaaa

SEQ ID NO: 3937594 - RNA, 13 nt, Shigella flexneri 2a str. 301
acgucgcccaccg

SEQ ID NO: 3937595 - RNA, 18 nt, Shigella flexneri 2a str. 301
acgucgccuuuuacggcu

SEQ ID NO: 3937596 - RNA, 22 nt, Shigella flexneri 2a str. 301
acgucgcuuuauagguggcaaa

SEQ ID NO: 3937597 - RNA, 20 nt, Shigella flexneri 2a str. 301
acgucggcaucgggcagcau

SEQ ID NO: 3937598 - RNA, 15 nt, Shigella flexneri 2a str. 301
acgucgucaggcaac

SEQ ID NO: 3937599 - RNA, 14 nt, Shigella flexneri 2a str. 301
acgucgucgucuuc

SEQ ID NO: 3937600 - RNA, 17 nt, Shigella flexneri 2a str. 301
acgucucaaucaccacc

SEQ ID NO: 3937601 - RNA, 13 nt, Shigella flexneri 2a str. 301
acgucuccaucaa

SEQ ID NO: 3937602 - RNA, 17 nt, Shigella flexneri 2a str. 301
acgucuccaucaauaca

SEQ ID NO: 3937603 - RNA, 17 nt, Shigella flexneri 2a str. 301
acgucuccggugcuuua

SEQ ID NO: 3937604 - RNA, 23 nt, Shigella flexneri 2a str. 301
acgucuuucggcagacgggcaac

SEQ ID NO: 3937605 - RNA, 18 nt, Shigella flexneri 2a str. 301
acgugaacggcuucgccu

SEQ ID NO: 3937606 - RNA, 16 nt, Shigella flexneri 2a str. 301
acgugaagaugccaac

SEQ ID NO: 3937607 - RNA, 17 nt, Shigella flexneri 2a str. 301
acgugacaaaaauugcg

SEQ ID NO: 3937608 - RNA, 13 nt, Shigella flexneri 2a str. 301
acgugacagcaua

SEQ ID NO: 3937609 - RNA, 14 nt, Shigella flexneri 2a str. 301
acgugacauucuga

SEQ ID NO: 3937610 - RNA, 16 nt, Shigella flexneri 2a str. 301
acuauuaaaauuucau

SEQ ID NO: 3937611 - RNA, 16 nt, Shigella flexneri 2a str. 301
acuauuaaagaaagua

SEQ ID NO: 3937612 - RNA, 13 nt, Shigella flexneri 2a str. 301
acuauucagcucu

SEQ ID NO: 3937613 - RNA, 22 nt, Shigella flexneri 2a str. 301
acuauuggucuggaacuggcug

SEQ ID NO: 3937614 - RNA, 13 nt, Shigella flexneri 2a str. 301
acuauuuccuugg

SEQ ID NO: 3937615 - RNA, 13 nt, Shigella flexneri 2a str. 301
acuauuucuuugu

SEQ ID NO: 3937616 - RNA, 14 nt, Shigella flexneri 2a str. 301
acuauuucuuugua

SEQ ID NO: 3937617 - RNA, 12 nt, Shigella flexneri 2a str. 301
acucaaaacuac

SEQ ID NO: 3937618 - RNA, 14 nt, Shigella flexneri 2a str. 301
acucaaacagggca

SEQ ID NO: 3937619 - RNA, 21 nt, Shigella flexneri 2a str. 301
acucaaacagggcaauuaaaa

SEQ ID NO: 3937620 - RNA, 17 nt, Shigella flexneri 2a str. 301
acucaaaccccgcagca

SEQ ID NO: 3937621 - RNA, 17 nt, Shigella flexneri 2a str. 301
acucaacaaccagaagg

SEQ ID NO: 3937622 - RNA, 16 nt, Shigella flexneri 2a str. 301
acucaaccccagccau

SEQ ID NO: 3937623 - RNA, 12 nt, Shigella flexneri 2a str. 301
acucaccagaca

SEQ ID NO: 3937624 - RNA, 21 nt, Shigella flexneri 2a str. 301
acucaccagacaucccagugc

SEQ ID NO: 3937625 - RNA, 22 nt, Shigella flexneri 2a str. 301
acucaccagacaucccagugca

SEQ ID NO: 3937626 - RNA, 14 nt, Shigella flexneri 2a str. 301
acucaccgaugauc

SEQ ID NO: 3937627 - RNA, 19 nt, Shigella flexneri 2a str. 301
acucaccgaugaucgccau

SEQ ID NO: 3937628 - RNA, 12 nt, Shigella flexneri 2a str. 301
acucaccggcgu

SEQ ID NO: 3937629 - RNA, 16 nt, Shigella flexneri 2a str. 301
acucaccggcguuuca

SEQ ID NO: 3937630 - RNA, 18 nt, Shigella flexneri 2a str. 301
acucaccgggcaucucag

SEQ ID NO: 3937631 - RNA, 22 nt, Shigella flexneri 2a str. 301
acucaccugcuuuacccagcca

SEQ ID NO: 3937632 - RNA, 13 nt, Shigella flexneri 2a str. 301
acucaccuuuaaa

SEQ ID NO: 3937633 - RNA, 16 nt, Shigella flexneri 2a str. 301
acucaccuuuuuuguu

SEQ ID NO: 3937634 - RNA, 15 nt, Shigella flexneri 2a str. 301
acucacgccagcagc

SEQ ID NO: 3937635 - RNA, 19 nt, Shigella flexneri 2a str. 301
acucacgccguuaacuuca

SEQ ID NO: 3937636 - RNA, 12 nt, Shigella flexneri 2a str. 301
acucagcaucug

SEQ ID NO: 3937637 - RNA, 16 nt, Shigella flexneri 2a str. 301
acucagcgccugcugc

SEQ ID NO: 3937638 - RNA, 19 nt, Shigella flexneri 2a str. 301
acucagcggcugccagcau

SEQ ID NO: 3937639 - RNA, 18 nt, Shigella flexneri 2a str. 301
acucaggcuggcaagcug

SEQ ID NO: 3937640 - RNA, 20 nt, Shigella flexneri 2a str. 301
acucaggcuggcaagcugcu

SEQ ID NO: 3937641 - RNA, 22 nt, Shigella flexneri 2a str. 301
acucaguguuggauggcggcuu

SEQ ID NO: 3937642 - RNA, 19 nt, Shigella flexneri 2a str. 301
acucauaaauucaaagugu

SEQ ID NO: 3937643 - RNA, 16 nt, Shigella flexneri 2a str. 301
acucauacugagcaag

SEQ ID NO: 3937644 - RNA, 18 nt, Shigella flexneri 2a str. 301
acucauacugagcaaggc

SEQ ID NO: 3937645 - RNA, 18 nt, Shigella flexneri 2a str. 301
acucauaugcagcaucca

SEQ ID NO: 3937646 - RNA, 15 nt, Shigella flexneri 2a str. 301
acucaucaccaucag

SEQ ID NO: 3937647 - RNA, 15 nt, Shigella flexneri 2a str. 301
acucauccacugccu

SEQ ID NO: 3937648 - RNA, 20 nt, Shigella flexneri 2a str. 301
acucaucuuauugaucaucc

SEQ ID NO: 3937649 - RNA, 16 nt, Shigella flexneri 2a str. 301
acucaugggucugcgg

SEQ ID NO: 3937650 - RNA, 12 nt, Shigella flexneri 2a str. 301
acucauugccag

SEQ ID NO: 3937651 - RNA, 14 nt, Shigella flexneri 2a str. 301
acucauugcccgca

SEQ ID NO: 3937652 - RNA, 14 nt, Shigella flexneri 2a str. 301
acucauuuuuuaau

SEQ ID NO: 3937653 - RNA, 14 nt, Shigella flexneri 2a str. 301
acuccaccagcacc

SEQ ID NO: 3937654 - RNA, 14 nt, Shigella flexneri 2a str. 301
acuccacuggcugc

SEQ ID NO: 3937655 - RNA, 15 nt, Shigella flexneri 2a str. 301
acuccacuuccugcc

SEQ ID NO: 3937656 - RNA, 22 nt, Shigella flexneri 2a str. 301
acuccagaauaccgccaauauc

SEQ ID NO: 3937657 - RNA, 11 nt, Shigella flexneri 2a str. 301
acuccagcaga

SEQ ID NO: 3937658 - RNA, 12 nt, Shigella flexneri 2a str. 301
acuccagcagac

SEQ ID NO: 3937659 - RNA, 12 nt, Shigella flexneri 2a str. 301
acuccagcgcca

SEQ ID NO: 3937660 - RNA, 18 nt, Shigella flexneri 2a str. 301
acuccagucccaguucau

SEQ ID NO: 3937661 - RNA, 14 nt, Shigella flexneri 2a str. 301
acuccaguuucaca

SEQ ID NO: 3937662 - RNA, 21 nt, Shigella flexneri 2a str. 301
acuccaguuuguucagcugcg

SEQ ID NO: 3937663 - RNA, 14 nt, Shigella flexneri 2a str. 301
acuccauccagcaa

SEQ ID NO: 3937664 - RNA, 15 nt, Shigella flexneri 2a str. 301
acuccauccagcaac

SEQ ID NO: 3937665 - RNA, 17 nt, Shigella flexneri 2a str. 301
acuccauccagcaacaa

SEQ ID NO: 3937666 - RNA, 20 nt, Shigella flexneri 2a str. 301
acuccauccagcaacaacag

SEQ ID NO: 3937667 - RNA, 21 nt, Shigella flexneri 2a str. 301
acuccauccagcaacaacagc

SEQ ID NO: 3937668 - RNA, 20 nt, Shigella flexneri 2a str. 301
acuccauugaagagcauccg

SEQ ID NO: 3937669 - RNA, 17 nt, Shigella flexneri 2a str. 301
acuccccgcaacaguga

SEQ ID NO: 3937670 - RNA, 16 nt, Shigella flexneri 2a str. 301
acuccccgcacaacgg

SEQ ID NO: 3937671 - RNA, 20 nt, Shigella flexneri 2a str. 301
acuccccgcauuuacucuca

SEQ ID NO: 3937672 - RNA, 16 nt, Shigella flexneri 2a str. 301
acucccugccccaucu

SEQ ID NO: 3937673 - RNA, 18 nt, Shigella flexneri 2a str. 301
acuccgccgcaucuuccc

SEQ ID NO: 3937674 - RNA, 19 nt, Shigella flexneri 2a str. 301
acuccgccgcaucuuccca

SEQ ID NO: 3937675 - RNA, 23 nt, Shigella flexneri 2a str. 301
acuccggaaaaacagaggcccgc

SEQ ID NO: 3937676 - RNA, 21 nt, Shigella flexneri 2a str. 301
acuccggcuugaaccagccaa

SEQ ID NO: 3937677 - RNA, 15 nt, Shigella flexneri 2a str. 301
acuccugaaagcgaa

SEQ ID NO: 3937678 - RNA, 18 nt, Shigella flexneri 2a str. 301
acuccugaagaagcguuc

SEQ ID NO: 3937679 - RNA, 20 nt, Shigella flexneri 2a str. 301
acuccugccaccacugcaau

SEQ ID NO: 3937680 - RNA, 23 nt, Shigella flexneri 2a str. 301
acuccugguaucuuuacagcgcu

SEQ ID NO: 3937681 - RNA, 19 nt, Shigella flexneri 2a str. 301
acuccuguaucgucacugg

SEQ ID NO: 3937682 - RNA, 20 nt, Shigella flexneri 2a str. 301
acuccuucuaaagccugagc

SEQ ID NO: 3937683 - RNA, 21 nt, Shigella flexneri 2a str. 301
acuccuuucugagcaucacau

SEQ ID NO: 3937684 - RNA, 22 nt, Shigella flexneri 2a str. 301
acucgacgcccuggaagaaaaa

SEQ ID NO: 3937685 - RNA, 16 nt, Shigella flexneri 2a str. 301
acucgagcagcugacu

SEQ ID NO: 3937686 - RNA, 19 nt, Shigella flexneri 2a str. 301
acucgaggauaaauuuucu

SEQ ID NO: 3937687 - RNA, 18 nt, Shigella flexneri 2a str. 301
acucgauaauaaagcggc

SEQ ID NO: 3937688 - RNA, 20 nt, Shigella flexneri 2a str. 301
acucgauaauaaagcggcuc

SEQ ID NO: 3937689 - RNA, 16 nt, Shigella flexneri 2a str. 301
acucgauuaauucaua

SEQ ID NO: 3937690 - RNA, 23 nt, Shigella flexneri 2a str. 301
acucgcacguucaguuuugggga

SEQ ID NO: 3937691 - RNA, 15 nt, Shigella flexneri 2a str. 301
acucgccagaccgca

SEQ ID NO: 3937692 - RNA, 18 nt, Shigella flexneri 2a str. 301
acucgccagaccgcagaa

SEQ ID NO: 3937693 - RNA, 19 nt, Shigella flexneri 2a str. 301
acucgcccccgaagagggg

SEQ ID NO: 3937694 - RNA, 16 nt, Shigella flexneri 2a str. 301
acucgccgcuguggau

SEQ ID NO: 3937695 - RNA, 20 nt, Shigella flexneri 2a str. 301
acucgcuuugcccagaggau

SEQ ID NO: 3937696 - RNA, 14 nt, Shigella flexneri 2a str. 301
acucggcaguauca

SEQ ID NO: 3937697 - RNA, 14 nt, Shigella flexneri 2a str. 301
acucggcgcggaug

SEQ ID NO: 3937698 - RNA, 21 nt, Shigella flexneri 2a str. 301
acucgguugauucgcucugcg

SEQ ID NO: 3937699 - RNA, 22 nt, Shigella flexneri 2a str. 301
acucgucacgucgucaggcaac

SEQ ID NO: 3937700 - RNA, 18 nt, Shigella flexneri 2a str. 301
acucgugcgucgcauccg

SEQ ID NO: 3937701 - RNA, 18 nt, Shigella flexneri 2a str. 301
acucuacaaccagcuuau

SEQ ID NO: 3937702 - RNA, 17 nt, Shigella flexneri 2a str. 301
acucuaccguuaaaaua

SEQ ID NO: 3937703 - RNA, 13 nt, Shigella flexneri 2a str. 301
acucuacuucuuc

SEQ ID NO: 3937704 - RNA, 16 nt, Shigella flexneri 2a str. 301
acucucaaaacaacac

SEQ ID NO: 3937705 - RNA, 17 nt, Shigella flexneri 2a str. 301
acucucaaaacaacaca

SEQ ID NO: 3937706 - RNA, 20 nt, Shigella flexneri 2a str. 301
acucucaucuuugaaaucac

SEQ ID NO: 3937707 - RNA, 14 nt, Shigella flexneri 2a str. 301
acucucauuuuuca

SEQ ID NO: 3937708 - RNA, 15 nt, Shigella flexneri 2a str. 301
acucuccuguuuaau

SEQ ID NO: 3937709 - RNA, 21 nt, Shigella flexneri 2a str. 301
acucucgggaaggcccuuucc

SEQ ID NO: 3937710 - RNA, 12 nt, Shigella flexneri 2a str. 301
acugcgugcuga

SEQ ID NO: 3937711 - RNA, 12 nt, Shigella flexneri 2a str. 301
acugcgugguga

SEQ ID NO: 3937712 - RNA, 19 nt, Shigella flexneri 2a str. 301
acugcgugucguaagccac

SEQ ID NO: 3937713 - RNA, 21 nt, Shigella flexneri 2a str. 301
acugcgugucguaagccaccg

SEQ ID NO: 3937714 - RNA, 22 nt, Shigella flexneri 2a str. 301
acugcgugucguaagccaccgc

SEQ ID NO: 3937715 - RNA, 20 nt, Shigella flexneri 2a str. 301
acugcucagacggugaccag

SEQ ID NO: 3937716 - RNA, 17 nt, Shigella flexneri 2a str. 301
acugcuccuguaugacc

SEQ ID NO: 3937717 - RNA, 13 nt, Shigella flexneri 2a str. 301
acugcucgcagaa

SEQ ID NO: 3937718 - RNA, 15 nt, Shigella flexneri 2a str. 301
acugcugaaugaggc

SEQ ID NO: 3937719 - RNA, 17 nt, Shigella flexneri 2a str. 301
acugcugaaugaggcuu

SEQ ID NO: 3937720 - RNA, 14 nt, Shigella flexneri 2a str. 301
acugcugacgcaga

SEQ ID NO: 3937721 - RNA, 18 nt, Shigella flexneri 2a str. 301
acugcugauguuguuucu

SEQ ID NO: 3937722 - RNA, 21 nt, Shigella flexneri 2a str. 301
acugcugauguuguuucucuu

SEQ ID NO: 3937723 - RNA, 17 nt, Shigella flexneri 2a str. 301
acugcugcucaaucugc

SEQ ID NO: 3937724 - RNA, 18 nt, Shigella flexneri 2a str. 301
acugcuggcuuaaaaaac

SEQ ID NO: 3937725 - RNA, 15 nt, Shigella flexneri 2a str. 301
acugcuuaacugcgc

SEQ ID NO: 3937726 - RNA, 21 nt, Shigella flexneri 2a str. 301
acugcuuaauauuaacuuaau

SEQ ID NO: 3937727 - RNA, 14 nt, Shigella flexneri 2a str. 301
acugcuuaucauca

SEQ ID NO: 3937728 - RNA, 22 nt, Shigella flexneri 2a str. 301
acugcuuaucaucacgcaucac

SEQ ID NO: 3937729 - RNA, 13 nt, Shigella flexneri 2a str. 301
acugcuugaagcg

SEQ ID NO: 3937730 - RNA, 14 nt, Shigella flexneri 2a str. 301
acugcuugaagcgc

SEQ ID NO: 3937731 - RNA, 21 nt, Shigella flexneri 2a str. 301
acuggaaaaauaauuuuaaau

SEQ ID NO: 3937732 - RNA, 14 nt, Shigella flexneri 2a str. 301
acuggaugaaaaaa

SEQ ID NO: 3937733 - RNA, 17 nt, Shigella flexneri 2a str. 301
acuggcaaagcaggcca

SEQ ID NO: 3937734 - RNA, 16 nt, Shigella flexneri 2a str. 301
acuggcaaaugacaua

SEQ ID NO: 3937735 - RNA, 17 nt, Shigella flexneri 2a str. 301
acuggcaaccagaagag

SEQ ID NO: 3937736 - RNA, 13 nt, Shigella flexneri 2a str. 301
acuggcaauccag

SEQ ID NO: 3937737 - RNA, 18 nt, Shigella flexneri 2a str. 301
acuggcaauccagcucuu

SEQ ID NO: 3937738 - RNA, 15 nt, Shigella flexneri 2a str. 301
acuggcaaucgccag

SEQ ID NO: 3937739 - RNA, 12 nt, Shigella flexneri 2a str. 301
acuggcaaugac

SEQ ID NO: 3937740 - RNA, 18 nt, Shigella flexneri 2a str. 301
acuggcaaugacgggcuu

SEQ ID NO: 3937741 - RNA, 17 nt, Shigella flexneri 2a str. 301
acuggcagagaaagaaa

SEQ ID NO: 3937742 - RNA, 17 nt, Shigella flexneri 2a str. 301
acuggcagcaccgggcc

SEQ ID NO: 3937743 - RNA, 20 nt, Shigella flexneri 2a str. 301
acuggcaggauaaacaagcc

SEQ ID NO: 3937744 - RNA, 18 nt, Shigella flexneri 2a str. 301
acuggcagguaaugaaug

SEQ ID NO: 3937745 - RNA, 20 nt, Shigella flexneri 2a str. 301
acuggcaugcuguccagcag

SEQ ID NO: 3937746 - RNA, 16 nt, Shigella flexneri 2a str. 301
acuggcauuacggcau

SEQ ID NO: 3937747 - RNA, 18 nt, Shigella flexneri 2a str. 301
acuggcgagauccggauc

SEQ ID NO: 3937748 - RNA, 23 nt, Shigella flexneri 2a str. 301
acuggcgauugucauucgccuga

SEQ ID NO: 3937749 - RNA, 18 nt, Shigella flexneri 2a str. 301
acuggcgcgagccuguuu

SEQ ID NO: 3937750 - RNA, 15 nt, Shigella flexneri 2a str. 301
acuggcgcuacggcu

SEQ ID NO: 3937751 - RNA, 14 nt, Shigella flexneri 2a str. 301
acuggcggcaaaaa

SEQ ID NO: 3937752 - RNA, 16 nt, Shigella flexneri 2a str. 301
acuggcgguuuucuuc

SEQ ID NO: 3937753 - RNA, 13 nt, Shigella flexneri 2a str. 301
acuggcgugggca

SEQ ID NO: 3937754 - RNA, 16 nt, Shigella flexneri 2a str. 301
acuggcuacugucuaa

SEQ ID NO: 3937755 - RNA, 15 nt, Shigella flexneri 2a str. 301
acuggcuaugggaua

SEQ ID NO: 3937756 - RNA, 19 nt, Shigella flexneri 2a str. 301
acuggcucugaauaaagcg

SEQ ID NO: 3937757 - RNA, 13 nt, Shigella flexneri 2a str. 301
acuggcugccagc

SEQ ID NO: 3937758 - RNA, 22 nt, Shigella flexneri 2a str. 301
acuggcugcgugguuuguuccg

SEQ ID NO: 3937759 - RNA, 14 nt, Shigella flexneri 2a str. 301
acuggcuuuccagc

SEQ ID NO: 3937760 - RNA, 16 nt, Shigella flexneri 2a str. 301
acugggcgaagguggc

SEQ ID NO: 3937761 - RNA, 17 nt, Shigella flexneri 2a str. 301
acugggcgauuaauaaa

SEQ ID NO: 3937762 - RNA, 16 nt, Shigella flexneri 2a str. 301
acugggucaguaugga

SEQ ID NO: 3937763 - RNA, 22 nt, Shigella flexneri 2a str. 301
acuggguuggguucacuuuccc

SEQ ID NO: 3937764 - RNA, 19 nt, Shigella flexneri 2a str. 301
acugguagcuguagguaaa

SEQ ID NO: 3937765 - RNA, 21 nt, Shigella flexneri 2a str. 301
acuggucaucaaauuacgaua

SEQ ID NO: 3937766 - RNA, 22 nt, Shigella flexneri 2a str. 301
acugguccagccccugaagcgu

SEQ ID NO: 3937767 - RNA, 14 nt, Shigella flexneri 2a str. 301
acuggugagcggug

SEQ ID NO: 3937768 - RNA, 13 nt, Shigella flexneri 2a str. 301
acuggugccauga

SEQ ID NO: 3937769 - RNA, 18 nt, Shigella flexneri 2a str. 301
acugguggcaggaaaaca

SEQ ID NO: 3937770 - RNA, 20 nt, Shigella flexneri 2a str. 301
acugguggcaggaaaacaau

SEQ ID NO: 3937771 - RNA, 19 nt, Shigella flexneri 2a str. 301
acugguucccaacaacagc

SEQ ID NO: 3937772 - RNA, 23 nt, Shigella flexneri 2a str. 301
acuguaaauaaaccaccuggguc

SEQ ID NO: 3937773 - RNA, 15 nt, Shigella flexneri 2a str. 301
acuguaggccaguau

SEQ ID NO: 3937774 - RNA, 22 nt, Shigella flexneri 2a str. 301
acuguaggccggauaaggcauu

SEQ ID NO: 3937775 - RNA, 15 nt, Shigella flexneri 2a str. 301
acuguagugcuccca

SEQ ID NO: 3937776 - RNA, 19 nt, Shigella flexneri 2a str. 301
acugucaauaaacgccugc

SEQ ID NO: 3937777 - RNA, 16 nt, Shigella flexneri 2a str. 301
acuguccgucagacca

SEQ ID NO: 3937778 - RNA, 14 nt, Shigella flexneri 2a str. 301
acugucgcgcagca

SEQ ID NO: 3937779 - RNA, 23 nt, Shigella flexneri 2a str. 301
acugucguuaaauccagauccug

SEQ ID NO: 3937780 - RNA, 22 nt, Shigella flexneri 2a str. 301
acugucugcuucugccugggcc

SEQ ID NO: 3937781 - RNA, 17 nt, Shigella flexneri 2a str. 301
acugugcacccgcuuca

SEQ ID NO: 3937782 - RNA, 22 nt, Shigella flexneri 2a str. 301
acugugcacccgcuucagugac

SEQ ID NO: 3937783 - RNA, 20 nt, Shigella flexneri 2a str. 301
acugugcagguggaauaucc

SEQ ID NO: 3937784 - RNA, 13 nt, Shigella flexneri 2a str. 301
acugugccagcgu

SEQ ID NO: 3937785 - RNA, 16 nt, Shigella flexneri 2a str. 301
acuguggcgcgaccaa

SEQ ID NO: 3937786 - RNA, 18 nt, Shigella flexneri 2a str. 301
acugugggauugcuucag

SEQ ID NO: 3937787 - RNA, 22 nt, Shigella flexneri 2a str. 301
acuguguuagccuggaagugcu

SEQ ID NO: 3937788 - RNA, 16 nt, Shigella flexneri 2a str. 301
acuguuacugucggca

SEQ ID NO: 3937789 - RNA, 13 nt, Shigella flexneri 2a str. 301
acuguuccagcac

SEQ ID NO: 3937790 - RNA, 18 nt, Shigella flexneri 2a str. 301
acuguucugauaguuaaa

SEQ ID NO: 3937791 - RNA, 19 nt, Shigella flexneri 2a str. 301
acuguugaccauuugugca

SEQ ID NO: 3937792 - RNA, 16 nt, Shigella flexneri 2a str. 301
acuguuuucuaacuca

SEQ ID NO: 3937793 - RNA, 15 nt, Shigella flexneri 2a str. 301
acuuaaauaaugcuu

SEQ ID NO: 3937794 - RNA, 15 nt, Shigella flexneri 2a str. 301
acuuaacaggaucug

SEQ ID NO: 3937795 - RNA, 15 nt, Shigella flexneri 2a str. 301
acuuaacccauuaca

SEQ ID NO: 3937796 - RNA, 22 nt, Shigella flexneri 2a str. 301
acuuaaccccagaccaaucccg

SEQ ID NO: 3937797 - RNA, 16 nt, Shigella flexneri 2a str. 301
acuuaaggucacagaa

SEQ ID NO: 3937798 - RNA, 21 nt, Shigella flexneri 2a str. 301
acuuaauauugccguccggca

SEQ ID NO: 3937799 - RNA, 19 nt, Shigella flexneri 2a str. 301
acuuaaucaucaaugccag

SEQ ID NO: 3937800 - RNA, 20 nt, Shigella flexneri 2a str. 301
acuuaaugucauacacuuca

SEQ ID NO: 3937801 - RNA, 16 nt, Shigella flexneri 2a str. 301
acuuaauuauuaacaa

SEQ ID NO: 3937802 - RNA, 12 nt, Shigella flexneri 2a str. 301
acuuacacauca

SEQ ID NO: 3937803 - RNA, 16 nt, Shigella flexneri 2a str. 301
acuuacacaucaagau

SEQ ID NO: 3937804 - RNA, 19 nt, Shigella flexneri 2a str. 301
acuuacgaaaaaagggcau

SEQ ID NO: 3937805 - RNA, 17 nt, Shigella flexneri 2a str. 301
acuuacucauuaaugca

SEQ ID NO: 3937806 - RNA, 18 nt, Shigella flexneri 2a str. 301
acuuacugauaguguuuu

SEQ ID NO: 3937807 - RNA, 20 nt, Shigella flexneri 2a str. 301
acuuacugauaguguuuuau

SEQ ID NO: 3937808 - RNA, 11 nt, Shigella flexneri 2a str. 301
acuuaucauca

SEQ ID NO: 3937809 - RNA, 19 nt, Shigella flexneri 2a str. 301
acuuaucuuuuacaagcaa

SEQ ID NO: 3937810 - RNA, 22 nt, Shigella flexneri 2a str. 301
acuuuucaccgcuuugccaaac

SEQ ID NO: 3937811 - RNA, 22 nt, Shigella flexneri 2a str. 301
acuuuucggcaaccgcauccag

SEQ ID NO: 3937812 - RNA, 22 nt, Shigella flexneri 2a str. 301
acuuuugaaugaguacugauga

SEQ ID NO: 3937813 - RNA, 22 nt, Shigella flexneri 2a str. 301
acuuuugagccaaaaugccuga

SEQ ID NO: 3937814 - RNA, 18 nt, Shigella flexneri 2a str. 301
acuuuuuaugucauuaac

SEQ ID NO: 3937815 - RNA, 13 nt, Shigella flexneri 2a str. 301
acuuuuucaagaa

SEQ ID NO: 3937816 - RNA, 22 nt, Shigella flexneri 2a str. 301
acuuuuuccaguccacguucaa

SEQ ID NO: 3937817 - RNA, 13 nt, Shigella flexneri 2a str. 301
agaaaaaaaagca

SEQ ID NO: 3937818 - RNA, 13 nt, Shigella flexneri 2a str. 301
agaaaaaaaguag

SEQ ID NO: 3937819 - RNA, 22 nt, Shigella flexneri 2a str. 301
agaaaaaaugaccggccagcau

SEQ ID NO: 3937820 - RNA, 17 nt, Shigella flexneri 2a str. 301
agaaaaaccuccggcgu

SEQ ID NO: 3937821 - RNA, 14 nt, Shigella flexneri 2a str. 301
agaaaaacuggcgc

SEQ ID NO: 3937822 - RNA, 23 nt, Shigella flexneri 2a str. 301
agaaaacgaaagcgccaucaaug

SEQ ID NO: 3937823 - RNA, 14 nt, Shigella flexneri 2a str. 301
agaaaacgaauacu

SEQ ID NO: 3937824 - RNA, 20 nt, Shigella flexneri 2a str. 301
agaaaacgguugauauacca

SEQ ID NO: 3937825 - RNA, 12 nt, Shigella flexneri 2a str. 301
agaaaagcaaaa

SEQ ID NO: 3937826 - RNA, 16 nt, Shigella flexneri 2a str. 301
agaaaagccaaccugc

SEQ ID NO: 3937827 - RNA, 18 nt, Shigella flexneri 2a str. 301
agaaaagccaaugaaauu

SEQ ID NO: 3937828 - RNA, 16 nt, Shigella flexneri 2a str. 301
agaaaaucgugccaga

SEQ ID NO: 3937829 - RNA, 18 nt, Shigella flexneri 2a str. 301
agaaaaucucaauguauu

SEQ ID NO: 3937830 - RNA, 22 nt, Shigella flexneri 2a str. 301
agaaaaugcccauggcaagaau

SEQ ID NO: 3937831 - RNA, 18 nt, Shigella flexneri 2a str. 301
agaaaauuagccaguuca

SEQ ID NO: 3937832 - RNA, 19 nt, Shigella flexneri 2a str. 301
agaaaauuuuagggaagua

SEQ ID NO: 3937833 - RNA, 22 nt, Shigella flexneri 2a str. 301
agaaacaaaaaaaacagcgccc

SEQ ID NO: 3937834 - RNA, 15 nt, Shigella flexneri 2a str. 301
agaaacaaccugagc

SEQ ID NO: 3937835 - RNA, 12 nt, Shigella flexneri 2a str. 301
agaaacaauaag

SEQ ID NO: 3937836 - RNA, 15 nt, Shigella flexneri 2a str. 301
agaaacaccagaaug

SEQ ID NO: 3937837 - RNA, 19 nt, Shigella flexneri 2a str. 301
agaaacagagguuucucau

SEQ ID NO: 3937838 - RNA, 12 nt, Shigella flexneri 2a str. 301
agaaacagccau

SEQ ID NO: 3937839 - RNA, 14 nt, Shigella flexneri 2a str. 301
agaaacagccauaa

SEQ ID NO: 3937840 - RNA, 21 nt, Shigella flexneri 2a str. 301
agaaacagccauaaccccacc

SEQ ID NO: 3937841 - RNA, 15 nt, Shigella flexneri 2a str. 301
agaaacgccagcagc

SEQ ID NO: 3937842 - RNA, 17 nt, Shigella flexneri 2a str. 301
agaaacgccagcagcag

SEQ ID NO: 3937843 - RNA, 19 nt, Shigella flexneri 2a str. 301
agaaacgcuuaaaacgcuc

SEQ ID NO: 3937844 - RNA, 18 nt, Shigella flexneri 2a str. 301
agaaacggaccugggaga

SEQ ID NO: 3937845 - RNA, 17 nt, Shigella flexneri 2a str. 301
agaaagaggcggauaaa

SEQ ID NO: 3937846 - RNA, 16 nt, Shigella flexneri 2a str. 301
agaaagcgccagcaag

SEQ ID NO: 3937847 - RNA, 22 nt, Shigella flexneri 2a str. 301
agaaagcggaucaguuccagca

SEQ ID NO: 3937848 - RNA, 23 nt, Shigella flexneri 2a str. 301
agaaagcugcugaccaccagcac

SEQ ID NO: 3937849 - RNA, 17 nt, Shigella flexneri 2a str. 301
agaaaggcagagugcaa

SEQ ID NO: 3937850 - RNA, 17 nt, Shigella flexneri 2a str. 301
agaaaggcguuguccuu

SEQ ID NO: 3937851 - RNA, 11 nt, Shigella flexneri 2a str. 301
agaaaggggga

SEQ ID NO: 3937852 - RNA, 16 nt, Shigella flexneri 2a str. 301
agaaaguaaucuauau

SEQ ID NO: 3937853 - RNA, 17 nt, Shigella flexneri 2a str. 301
agaaaguacggccacug

SEQ ID NO: 3937854 - RNA, 21 nt, Shigella flexneri 2a str. 301
agaaaguauauaaaaaacaau

SEQ ID NO: 3937855 - RNA, 20 nt, Shigella flexneri 2a str. 301
agaaaguugccagauaaaua

SEQ ID NO: 3937856 - RNA, 22 nt, Shigella flexneri 2a str. 301
agaaaguugccagauaaauauu

SEQ ID NO: 3937857 - RNA, 13 nt, Shigella flexneri 2a str. 301
agaaaguuguuuu

SEQ ID NO: 3937858 - RNA, 15 nt, Shigella flexneri 2a str. 301
agaaaguuuuucaac

SEQ ID NO: 3937859 - RNA, 22 nt, Shigella flexneri 2a str. 301
agaaauaaucgcaauuacccag

SEQ ID NO: 3937860 - RNA, 14 nt, Shigella flexneri 2a str. 301
agaaauaccacccg

SEQ ID NO: 3937861 - RNA, 19 nt, Shigella flexneri 2a str. 301
agaaauaccccgccagcag

SEQ ID NO: 3937862 - RNA, 9 nt, Shigella flexneri 2a str. 301
agaaaucag

SEQ ID NO: 3937863 - RNA, 18 nt, Shigella flexneri 2a str. 301
agaaaucaguaaauugca

SEQ ID NO: 3937864 - RNA, 16 nt, Shigella flexneri 2a str. 301
agaaaucccauuagac

SEQ ID NO: 3937865 - RNA, 17 nt, Shigella flexneri 2a str. 301
agaaaucccauuagacu

SEQ ID NO: 3937866 - RNA, 18 nt, Shigella flexneri 2a str. 301
agaaauccggggcuguuu

SEQ ID NO: 3937867 - RNA, 16 nt, Shigella flexneri 2a str. 301
agaaaugaaaaaauag

SEQ ID NO: 3937868 - RNA, 17 nt, Shigella flexneri 2a str. 301
agaaaugaaaaaauaga

SEQ ID NO: 3937869 - RNA, 14 nt, Shigella flexneri 2a str. 301
agaaaugccaguaa

SEQ ID NO: 3937870 - RNA, 15 nt, Shigella flexneri 2a str. 301
agaaauggcccaaaa

SEQ ID NO: 3937871 - RNA, 13 nt, Shigella flexneri 2a str. 301
agaaauuauuucu

SEQ ID NO: 3937872 - RNA, 17 nt, Shigella flexneri 2a str. 301
agaaauuuggcuccucu

SEQ ID NO: 3937873 - RNA, 19 nt, Shigella flexneri 2a str. 301
agaaauuuggcuccucuga

SEQ ID NO: 3937874 - RNA, 17 nt, Shigella flexneri 2a str. 301
agaacaaauaaauagau

SEQ ID NO: 3937875 - RNA, 22 nt, Shigella flexneri 2a str. 301
agaacaacccggcgaaagagcu

SEQ ID NO: 3937876 - RNA, 18 nt, Shigella flexneri 2a str. 301
agaacaagauugccugau

SEQ ID NO: 3937877 - RNA, 16 nt, Shigella flexneri 2a str. 301
agaacaauaauaacuc

SEQ ID NO: 3937878 - RNA, 17 nt, Shigella flexneri 2a str. 301
agaacaccaccugccag

SEQ ID NO: 3937879 - RNA, 18 nt, Shigella flexneri 2a str. 301
agaacacuucuucugucg

SEQ ID NO: 3937880 - RNA, 17 nt, Shigella flexneri 2a str. 301
agaacagcggugcaaga

SEQ ID NO: 3937881 - RNA, 19 nt, Shigella flexneri 2a str. 301
agaacaguucagcagcacu

SEQ ID NO: 3937882 - RNA, 15 nt, Shigella flexneri 2a str. 301
agaacauaaacagcg

SEQ ID NO: 3937883 - RNA, 13 nt, Shigella flexneri 2a str. 301
agaacaucuuacc

SEQ ID NO: 3937884 - RNA, 17 nt, Shigella flexneri 2a str. 301
agaaccaacgcugccag

SEQ ID NO: 3937885 - RNA, 13 nt, Shigella flexneri 2a str. 301
agaaccacaauga

SEQ ID NO: 3937886 - RNA, 23 nt, Shigella flexneri 2a str. 301
agaaccacggaauaaccagcgaa

SEQ ID NO: 3937887 - RNA, 13 nt, Shigella flexneri 2a str. 301
agaaccagcugcc

SEQ ID NO: 3937888 - RNA, 21 nt, Shigella flexneri 2a str. 301
agaaccagggaaaaaagcccc

SEQ ID NO: 3937889 - RNA, 11 nt, Shigella flexneri 2a str. 301
agaaccaugca

SEQ ID NO: 3937890 - RNA, 21 nt, Shigella flexneri 2a str. 301
agaaccaugcaauuaccgcca

SEQ ID NO: 3937891 - RNA, 15 nt, Shigella flexneri 2a str. 301
agaaccuaagaacca

SEQ ID NO: 3937892 - RNA, 19 nt, Shigella flexneri 2a str. 301
agaaccuaagaaccagaau

SEQ ID NO: 3937893 - RNA, 15 nt, Shigella flexneri 2a str. 301
agaaccugaacgccg

SEQ ID NO: 3937894 - RNA, 13 nt, Shigella flexneri 2a str. 301
agaaccuuccaug

SEQ ID NO: 3937895 - RNA, 13 nt, Shigella flexneri 2a str. 301
agaacgacaguga

SEQ ID NO: 3937896 - RNA, 15 nt, Shigella flexneri 2a str. 301
agaacgacagugacu

SEQ ID NO: 3937897 - RNA, 18 nt, Shigella flexneri 2a str. 301
agaacgaccaucagcugc

SEQ ID NO: 3937898 - RNA, 16 nt, Shigella flexneri 2a str. 301
agaacgcauaacagcc

SEQ ID NO: 3937899 - RNA, 19 nt, Shigella flexneri 2a str. 301
agaacgccuguguccuguu

SEQ ID NO: 3937900 - RNA, 20 nt, Shigella flexneri 2a str. 301
agaacgcgccuuaaaaacca

SEQ ID NO: 3937901 - RNA, 16 nt, Shigella flexneri 2a str. 301
agaacggauucaguga

SEQ ID NO: 3937902 - RNA, 17 nt, Shigella flexneri 2a str. 301
agaacggauucagugag

SEQ ID NO: 3937903 - RNA, 11 nt, Shigella flexneri 2a str. 301
agaacggcaga

SEQ ID NO: 3937904 - RNA, 22 nt, Shigella flexneri 2a str. 301
agaacggcgcaccagaauaccu

SEQ ID NO: 3937905 - RNA, 14 nt, Shigella flexneri 2a str. 301
agaacgugccggga

SEQ ID NO: 3937906 - RNA, 24 nt, Shigella flexneri 2a str. 301
agaacgugcuacgguugacugaaa

SEQ ID NO: 3937907 - RNA, 14 nt, Shigella flexneri 2a str. 301
agaacucggaagca

SEQ ID NO: 3937908 - RNA, 22 nt, Shigella flexneri 2a str. 301
agaacucguucagcgcauucca

SEQ ID NO: 3937909 - RNA, 21 nt, Shigella flexneri 2a str. 301
agaacugagcgccgucgcgaa

SEQ ID NO: 3937910 - RNA, 14 nt, Shigella flexneri 2a str. 301
agacaguuugccuu

SEQ ID NO: 3937911 - RNA, 15 nt, Shigella flexneri 2a str. 301
agacauagcacauaa

SEQ ID NO: 3937912 - RNA, 12 nt, Shigella flexneri 2a str. 301
agacaucaaacc

SEQ ID NO: 3937913 - RNA, 16 nt, Shigella flexneri 2a str. 301
agacaucaauaaacaa

SEQ ID NO: 3937914 - RNA, 19 nt, Shigella flexneri 2a str. 301
agacaucaauaaacaauga

SEQ ID NO: 3937915 - RNA, 22 nt, Shigella flexneri 2a str. 301
agacaucgcccgauucacauaa

SEQ ID NO: 3937916 - RNA, 14 nt, Shigella flexneri 2a str. 301
agacaucuguuauc

SEQ ID NO: 3937917 - RNA, 19 nt, Shigella flexneri 2a str. 301
agacauuccuuuacuuaga

SEQ ID NO: 3937918 - RNA, 19 nt, Shigella flexneri 2a str. 301
agacauucgcgcacggugc

SEQ ID NO: 3937919 - RNA, 21 nt, Shigella flexneri 2a str. 301
agaccaaaacgugcagcugcc

SEQ ID NO: 3937920 - RNA, 22 nt, Shigella flexneri 2a str. 301
agaccaaaacgugcagcugccu

SEQ ID NO: 3937921 - RNA, 14 nt, Shigella flexneri 2a str. 301
agaccaaacagcau

SEQ ID NO: 3937922 - RNA, 13 nt, Shigella flexneri 2a str. 301
agaccaauagaaa

SEQ ID NO: 3937923 - RNA, 14 nt, Shigella flexneri 2a str. 301
agaccaaucaccac

SEQ ID NO: 3937924 - RNA, 22 nt, Shigella flexneri 2a str. 301
agaccaauccagccggcaaagu

SEQ ID NO: 3937925 - RNA, 12 nt, Shigella flexneri 2a str. 301
agaccagacugc

SEQ ID NO: 3937926 - RNA, 19 nt, Shigella flexneri 2a str. 301
agaccagacugcuccugua

SEQ ID NO: 3937927 - RNA, 22 nt, Shigella flexneri 2a str. 301
agaccagacugcuccuguauga

SEQ ID NO: 3937928 - RNA, 19 nt, Shigella flexneri 2a str. 301
agaccagauuaaucagcag

SEQ ID NO: 3937929 - RNA, 14 nt, Shigella flexneri 2a str. 301
agaccagcaaaaau

SEQ ID NO: 3937930 - RNA, 20 nt, Shigella flexneri 2a str. 301
agaccaguaaagugcgcuuu

SEQ ID NO: 3937931 - RNA, 16 nt, Shigella flexneri 2a str. 301
agaccauguuugaaau

SEQ ID NO: 3937932 - RNA, 12 nt, Shigella flexneri 2a str. 301
agacccaguuuu

SEQ ID NO: 3937933 - RNA, 19 nt, Shigella flexneri 2a str. 301
agacccugcucuuucagca

SEQ ID NO: 3937934 - RNA, 21 nt, Shigella flexneri 2a str. 301
agacccugcucuuucagcacc

SEQ ID NO: 3937935 - RNA, 13 nt, Shigella flexneri 2a str. 301
agaccgcagaagc

SEQ ID NO: 3937936 - RNA, 14 nt, Shigella flexneri 2a str. 301
agaccgcuucugcg

SEQ ID NO: 3937937 - RNA, 15 nt, Shigella flexneri 2a str. 301
agaccgcuucugcgu

SEQ ID NO: 3937938 - RNA, 17 nt, Shigella flexneri 2a str. 301
agaccggcaaccagcac

SEQ ID NO: 3937939 - RNA, 18 nt, Shigella flexneri 2a str. 301
agaccggcaaccagcacc

SEQ ID NO: 3937940 - RNA, 18 nt, Shigella flexneri 2a str. 301
agaccguugcucagaauc

SEQ ID NO: 3937941 - RNA, 14 nt, Shigella flexneri 2a str. 301
agaccuaccaucuc

SEQ ID NO: 3937942 - RNA, 22 nt, Shigella flexneri 2a str. 301
agaccugaauuugcuccagaaa

SEQ ID NO: 3937943 - RNA, 17 nt, Shigella flexneri 2a str. 301
agaccugauacauagca

SEQ ID NO: 3937944 - RNA, 17 nt, Shigella flexneri 2a str. 301
agaccuggcgcuucacu

SEQ ID NO: 3937945 - RNA, 19 nt, Shigella flexneri 2a str. 301
agaccuuaauugcuggcgc

SEQ ID NO: 3937946 - RNA, 22 nt, Shigella flexneri 2a str. 301
agaccuuaucacaaucggcuuu

SEQ ID NO: 3937947 - RNA, 13 nt, Shigella flexneri 2a str. 301
agacgagagugac

SEQ ID NO: 3937948 - RNA, 14 nt, Shigella flexneri 2a str. 301
agacgagcauaaaa

SEQ ID NO: 3937949 - RNA, 16 nt, Shigella flexneri 2a str. 301
agacgagggaaaauaa

SEQ ID NO: 3937950 - RNA, 22 nt, Shigella flexneri 2a str. 301
agacgauaguaauuucaucugc

SEQ ID NO: 3937951 - RNA, 17 nt, Shigella flexneri 2a str. 301
agacgaugcgucuugcc

SEQ ID NO: 3937952 - RNA, 22 nt, Shigella flexneri 2a str. 301
agacgauuacucgccuuucaca

SEQ ID NO: 3937953 - RNA, 17 nt, Shigella flexneri 2a str. 301
agacgcacccucaaaau

SEQ ID NO: 3937954 - RNA, 20 nt, Shigella flexneri 2a str. 301
agacgcacccucaaaauuuc

SEQ ID NO: 3937955 - RNA, 14 nt, Shigella flexneri 2a str. 301
agacgcgaccggcg

SEQ ID NO: 3937956 - RNA, 16 nt, Shigella flexneri 2a str. 301
agacgcgcagcuucac

SEQ ID NO: 3937957 - RNA, 20 nt, Shigella flexneri 2a str. 301
agacgcgcagcuucacuucu

SEQ ID NO: 3937958 - RNA, 23 nt, Shigella flexneri 2a str. 301
agacgcgcuagcgucgcaucagg

SEQ ID NO: 3937959 - RNA, 18 nt, Shigella flexneri 2a str. 301
agacgcgcuagcuucagg

SEQ ID NO: 3937960 - RNA, 19 nt, Shigella flexneri 2a str. 301
agacgcgucuggcaucacc

SEQ ID NO: 3937961 - RNA, 19 nt, Shigella flexneri 2a str. 301
agacgcguuaauaccugau

SEQ ID NO: 3937962 - RNA, 18 nt, Shigella flexneri 2a str. 301
agacgcguuuacagagcc

SEQ ID NO: 3937963 - RNA, 21 nt, Shigella flexneri 2a str. 301
agacgcuacuuuuuucaccca

SEQ ID NO: 3937964 - RNA, 15 nt, Shigella flexneri 2a str. 301
agacgcucugcggua

SEQ ID NO: 3937965 - RNA, 20 nt, Shigella flexneri 2a str. 301
agacgcucuucaauggucag

SEQ ID NO: 3937966 - RNA, 20 nt, Shigella flexneri 2a str. 301
agacggcgcaacauccgcuu

SEQ ID NO: 3937967 - RNA, 18 nt, Shigella flexneri 2a str. 301
agacggcgcuuacucaug

SEQ ID NO: 3937968 - RNA, 17 nt, Shigella flexneri 2a str. 301
agacggcggaaagggcc

SEQ ID NO: 3937969 - RNA, 20 nt, Shigella flexneri 2a str. 301
agacggcugucauccagcag

SEQ ID NO: 3937970 - RNA, 21 nt, Shigella flexneri 2a str. 301
agacggcugucauccagcagc

SEQ ID NO: 3937971 - RNA, 15 nt, Shigella flexneri 2a str. 301
agacgguacccgcug

SEQ ID NO: 3937972 - RNA, 16 nt, Shigella flexneri 2a str. 301
agacgguuaaaaacag

SEQ ID NO: 3937973 - RNA, 22 nt, Shigella flexneri 2a str. 301
agacgguuaaaaacagccagca

SEQ ID NO: 3937974 - RNA, 18 nt, Shigella flexneri 2a str. 301
agacgguuauauuuacaa

SEQ ID NO: 3937975 - RNA, 22 nt, Shigella flexneri 2a str. 301
agacgguuuaucucaucuucca

SEQ ID NO: 3937976 - RNA, 20 nt, Shigella flexneri 2a str. 301
agacgguuugcggcacaguc

SEQ ID NO: 3937977 - RNA, 18 nt, Shigella flexneri 2a str. 301
agacguccggcgcugcaa

SEQ ID NO: 3937978 - RNA, 18 nt, Shigella flexneri 2a str. 301
agacguuaacuacaauca

SEQ ID NO: 3937979 - RNA, 15 nt, Shigella flexneri 2a str. 301
agacguucuuccugu

SEQ ID NO: 3937980 - RNA, 21 nt, Shigella flexneri 2a str. 301
agacguucuuccuguggaucg

SEQ ID NO: 3937981 - RNA, 15 nt, Shigella flexneri 2a str. 301
agacguuucgccagc

SEQ ID NO: 3937982 - RNA, 20 nt, Shigella flexneri 2a str. 301
agacuauuuuuuugauaauc

SEQ ID NO: 3937983 - RNA, 22 nt, Shigella flexneri 2a str. 301
agacucauauaaaaaccggugc

SEQ ID NO: 3937984 - RNA, 13 nt, Shigella flexneri 2a str. 301
agacucccagccu

SEQ ID NO: 3937985 - RNA, 20 nt, Shigella flexneri 2a str. 301
agacucccagccucccauuu

SEQ ID NO: 3937986 - RNA, 16 nt, Shigella flexneri 2a str. 301
agacucucauuuuuca

SEQ ID NO: 3937987 - RNA, 14 nt, Shigella flexneri 2a str. 301
agacugaauacgcu

SEQ ID NO: 3937988 - RNA, 15 nt, Shigella flexneri 2a str. 301
agacugaucaucgcc

SEQ ID NO: 3937989 - RNA, 22 nt, Shigella flexneri 2a str. 301
agacugaugacaaacacaaaac

SEQ ID NO: 3937990 - RNA, 15 nt, Shigella flexneri 2a str. 301
agacugcaagaauag

SEQ ID NO: 3937991 - RNA, 23 nt, Shigella flexneri 2a str. 301
agacugcagcggucacauguucc

SEQ ID NO: 3937992 - RNA, 13 nt, Shigella flexneri 2a str. 301
agacugcgcgccg

SEQ ID NO: 3937993 - RNA, 17 nt, Shigella flexneri 2a str. 301
agacugcgcuaccagga

SEQ ID NO: 3937994 - RNA, 15 nt, Shigella flexneri 2a str. 301
agacugcuccuguau

SEQ ID NO: 3937995 - RNA, 16 nt, Shigella flexneri 2a str. 301
agacuggagcacugcg

SEQ ID NO: 3937996 - RNA, 23 nt, Shigella flexneri 2a str. 301
agacuggcaaagcaggccagaua

SEQ ID NO: 3937997 - RNA, 19 nt, Shigella flexneri 2a str. 301
agacuggcaaaugacauaa

SEQ ID NO: 3937998 - RNA, 15 nt, Shigella flexneri 2a str. 301
agacuuaagccuguu

SEQ ID NO: 3937999 - RNA, 15 nt, Shigella flexneri 2a str. 301
agacuuaauccgggc

SEQ ID NO: 3938000 - RNA, 20 nt, Shigella flexneri 2a str. 301
agacuuaauccgggcaugau

SEQ ID NO: 3938001 - RNA, 17 nt, Shigella flexneri 2a str. 301
agacuuggcuuucucuu

SEQ ID NO: 3938002 - RNA, 14 nt, Shigella flexneri 2a str. 301
agacuuuagcgcaa

SEQ ID NO: 3938003 - RNA, 18 nt, Shigella flexneri 2a str. 301
agacuuuagucaucaguc

SEQ ID NO: 3938004 - RNA, 13 nt, Shigella flexneri 2a str. 301
agacuuugcugcc

SEQ ID NO: 3938005 - RNA, 23 nt, Shigella flexneri 2a str. 301
agacuuuuuucaugggugccaga

SEQ ID NO: 3938006 - RNA, 15 nt, Shigella flexneri 2a str. 301
agagaaaaaaaagca

SEQ ID NO: 3938007 - RNA, 12 nt, Shigella flexneri 2a str. 301
agagaaaauaau

SEQ ID NO: 3938008 - RNA, 13 nt, Shigella flexneri 2a str. 301
agagaaaaucaca

SEQ ID NO: 3938009 - RNA, 16 nt, Shigella flexneri 2a str. 301
agagaaacgccagcag

SEQ ID NO: 3938010 - RNA, 15 nt, Shigella flexneri 2a str. 301
agauagcugucccag

SEQ ID NO: 3938011 - RNA, 20 nt, Shigella flexneri 2a str. 301
agauaguugauuaauuucau

SEQ ID NO: 3938012 - RNA, 20 nt, Shigella flexneri 2a str. 301
agauaucccgccagcaccag

SEQ ID NO: 3938013 - RNA, 21 nt, Shigella flexneri 2a str. 301
agauaucccgccagcaccagc

SEQ ID NO: 3938014 - RNA, 17 nt, Shigella flexneri 2a str. 301
agauauucgcucgccac

SEQ ID NO: 3938015 - RNA, 15 nt, Shigella flexneri 2a str. 301
agauauucuccagcu

SEQ ID NO: 3938016 - RNA, 15 nt, Shigella flexneri 2a str. 301
agauauuuaaaugau

SEQ ID NO: 3938017 - RNA, 14 nt, Shigella flexneri 2a str. 301
agauauuucaccag

SEQ ID NO: 3938018 - RNA, 23 nt, Shigella flexneri 2a str. 301
agauauuuuuaugcaugaccuac

SEQ ID NO: 3938019 - RNA, 16 nt, Shigella flexneri 2a str. 301
agaucaccugcuggac

SEQ ID NO: 3938020 - RNA, 14 nt, Shigella flexneri 2a str. 301
agaucacgcaucac

SEQ ID NO: 3938021 - RNA, 15 nt, Shigella flexneri 2a str. 301
agaucacgcaucacc

SEQ ID NO: 3938022 - RNA, 15 nt, Shigella flexneri 2a str. 301
agaucagaccaaucc

SEQ ID NO: 3938023 - RNA, 13 nt, Shigella flexneri 2a str. 301
agaucagauaaua

SEQ ID NO: 3938024 - RNA, 14 nt, Shigella flexneri 2a str. 301
agaucagggaaggg

SEQ ID NO: 3938025 - RNA, 18 nt, Shigella flexneri 2a str. 301
agaucauccaugauaauu

SEQ ID NO: 3938026 - RNA, 22 nt, Shigella flexneri 2a str. 301
agaucauccugcggcagcucca

SEQ ID NO: 3938027 - RNA, 22 nt, Shigella flexneri 2a str. 301
agauccaaaccgacugccugca

SEQ ID NO: 3938028 - RNA, 17 nt, Shigella flexneri 2a str. 301
agauccagcaccuuuug

SEQ ID NO: 3938029 - RNA, 20 nt, Shigella flexneri 2a str. 301
agauccagcaccuuuugcug

SEQ ID NO: 3938030 - RNA, 15 nt, Shigella flexneri 2a str. 301
agauccaggaacaga

SEQ ID NO: 3938031 - RNA, 23 nt, Shigella flexneri 2a str. 301
agauccagugcguaucaauagca

SEQ ID NO: 3938032 - RNA, 21 nt, Shigella flexneri 2a str. 301
agauccagugcucauccuuca

SEQ ID NO: 3938033 - RNA, 17 nt, Shigella flexneri 2a str. 301
agauccauaagguccuc

SEQ ID NO: 3938034 - RNA, 20 nt, Shigella flexneri 2a str. 301
agauccauaagguccuccag

SEQ ID NO: 3938035 - RNA, 12 nt, Shigella flexneri 2a str. 301
agauccgccagu

SEQ ID NO: 3938036 - RNA, 16 nt, Shigella flexneri 2a str. 301
agauccgccaguuugu

SEQ ID NO: 3938037 - RNA, 17 nt, Shigella flexneri 2a str. 301
agauccgggcauauuuc

SEQ ID NO: 3938038 - RNA, 15 nt, Shigella flexneri 2a str. 301
agauccugaaauucc

SEQ ID NO: 3938039 - RNA, 17 nt, Shigella flexneri 2a str. 301
agauccugaaauuccug

SEQ ID NO: 3938040 - RNA, 23 nt, Shigella flexneri 2a str. 301
agauccugauccugcaacagcac

SEQ ID NO: 3938041 - RNA, 16 nt, Shigella flexneri 2a str. 301
agaucgaacacgguga

SEQ ID NO: 3938042 - RNA, 12 nt, Shigella flexneri 2a str. 301
agaucgccgcug

SEQ ID NO: 3938043 - RNA, 16 nt, Shigella flexneri 2a str. 301
agaucgcgcaucagcu

SEQ ID NO: 3938044 - RNA, 19 nt, Shigella flexneri 2a str. 301
agaucgcggcaauuuuuac

SEQ ID NO: 3938045 - RNA, 15 nt, Shigella flexneri 2a str. 301
agaucgcucaucagc

SEQ ID NO: 3938046 - RNA, 16 nt, Shigella flexneri 2a str. 301
agaucgcucaucagcu

SEQ ID NO: 3938047 - RNA, 16 nt, Shigella flexneri 2a str. 301
agaucgguugccauaa

SEQ ID NO: 3938048 - RNA, 18 nt, Shigella flexneri 2a str. 301
agaucgguuuuuuucgaa

SEQ ID NO: 3938049 - RNA, 18 nt, Shigella flexneri 2a str. 301
agaucgugaaacucagcc

SEQ ID NO: 3938050 - RNA, 21 nt, Shigella flexneri 2a str. 301
agaucguugccgaagcggcgu

SEQ ID NO: 3938051 - RNA, 16 nt, Shigella flexneri 2a str. 301
agaucucucuugcuau

SEQ ID NO: 3938052 - RNA, 18 nt, Shigella flexneri 2a str. 301
agaucuggcgauuauuuu

SEQ ID NO: 3938053 - RNA, 14 nt, Shigella flexneri 2a str. 301
agaucuugauuuac

SEQ ID NO: 3938054 - RNA, 17 nt, Shigella flexneri 2a str. 301
agaucuuuaaugcacgg

SEQ ID NO: 3938055 - RNA, 15 nt, Shigella flexneri 2a str. 301
agaugaaaacgcuga

SEQ ID NO: 3938056 - RNA, 15 nt, Shigella flexneri 2a str. 301
agaugaagcuggcaa

SEQ ID NO: 3938057 - RNA, 16 nt, Shigella flexneri 2a str. 301
agaugaauaauguuua

SEQ ID NO: 3938058 - RNA, 23 nt, Shigella flexneri 2a str. 301
agaugaucgccgcacuuucuccu

SEQ ID NO: 3938059 - RNA, 21 nt, Shigella flexneri 2a str. 301
agaugauggcauucucacucc

SEQ ID NO: 3938060 - RNA, 11 nt, Shigella flexneri 2a str. 301
agaugauuuuu

SEQ ID NO: 3938061 - RNA, 13 nt, Shigella flexneri 2a str. 301
agaugcagcggua

SEQ ID NO: 3938062 - RNA, 16 nt, Shigella flexneri 2a str. 301
agaugcaggaguagaa

SEQ ID NO: 3938063 - RNA, 22 nt, Shigella flexneri 2a str. 301
agaugccauuggcauaaauaau

SEQ ID NO: 3938064 - RNA, 14 nt, Shigella flexneri 2a str. 301
agaugcgacgcuga

SEQ ID NO: 3938065 - RNA, 16 nt, Shigella flexneri 2a str. 301
agaugcggcuucgcuu

SEQ ID NO: 3938066 - RNA, 14 nt, Shigella flexneri 2a str. 301
agaugcuacaacau

SEQ ID NO: 3938067 - RNA, 23 nt, Shigella flexneri 2a str. 301
agaugcucuuuucugaaguacac

SEQ ID NO: 3938068 - RNA, 17 nt, Shigella flexneri 2a str. 301
agaugcugcaaggugau

SEQ ID NO: 3938069 - RNA, 15 nt, Shigella flexneri 2a str. 301
agaugcuuucagcac

SEQ ID NO: 3938070 - RNA, 22 nt, Shigella flexneri 2a str. 301
agauggaaaaguuacaaaaaaa

SEQ ID NO: 3938071 - RNA, 16 nt, Shigella flexneri 2a str. 301
agauggauugcugaaa

SEQ ID NO: 3938072 - RNA, 18 nt, Shigella flexneri 2a str. 301
agauggauugcugaaaua

SEQ ID NO: 3938073 - RNA, 20 nt, Shigella flexneri 2a str. 301
agauggauugcugaaauaca

SEQ ID NO: 3938074 - RNA, 23 nt, Shigella flexneri 2a str. 301
agauggcccacgacgucuccauc

SEQ ID NO: 3938075 - RNA, 16 nt, Shigella flexneri 2a str. 301
agauggcgcgcagaaa

SEQ ID NO: 3938076 - RNA, 23 nt, Shigella flexneri 2a str. 301
agauggcuauaaucacucaaaau

SEQ ID NO: 3938077 - RNA, 16 nt, Shigella flexneri 2a str. 301
agauggcuucaucccg

SEQ ID NO: 3938078 - RNA, 17 nt, Shigella flexneri 2a str. 301
agauggcuuugcccuuu

SEQ ID NO: 3938079 - RNA, 19 nt, Shigella flexneri 2a str. 301
agauggcuuugcccuuucu

SEQ ID NO: 3938080 - RNA, 13 nt, Shigella flexneri 2a str. 301
agaugguggucau

SEQ ID NO: 3938081 - RNA, 23 nt, Shigella flexneri 2a str. 301
agaugguuacuuuuuaugucauu

SEQ ID NO: 3938082 - RNA, 17 nt, Shigella flexneri 2a str. 301
agaugucggggccagaa

SEQ ID NO: 3938083 - RNA, 17 nt, Shigella flexneri 2a str. 301
agaugucuuuacccgga

SEQ ID NO: 3938084 - RNA, 15 nt, Shigella flexneri 2a str. 301
agaugugauaacgcu

SEQ ID NO: 3938085 - RNA, 16 nt, Shigella flexneri 2a str. 301
agaugugcaguuccug

SEQ ID NO: 3938086 - RNA, 21 nt, Shigella flexneri 2a str. 301
agaugugcaguuccugcaacu

SEQ ID NO: 3938087 - RNA, 16 nt, Shigella flexneri 2a str. 301
agaugugcgguggcuu

SEQ ID NO: 3938088 - RNA, 20 nt, Shigella flexneri 2a str. 301
agaugugggcaaucucacuc

SEQ ID NO: 3938089 - RNA, 19 nt, Shigella flexneri 2a str. 301
agauguucuaucuuucaga

SEQ ID NO: 3938090 - RNA, 20 nt, Shigella flexneri 2a str. 301
agauguugucucagcuucag

SEQ ID NO: 3938091 - RNA, 17 nt, Shigella flexneri 2a str. 301
agauuaacgugaccgcc

SEQ ID NO: 3938092 - RNA, 20 nt, Shigella flexneri 2a str. 301
agauuaagagaaccagcugc

SEQ ID NO: 3938093 - RNA, 12 nt, Shigella flexneri 2a str. 301
agauuaaucgcg

SEQ ID NO: 3938094 - RNA, 20 nt, Shigella flexneri 2a str. 301
agauuaccagcgacaucacc

SEQ ID NO: 3938095 - RNA, 14 nt, Shigella flexneri 2a str. 301
agauuagccgguaa

SEQ ID NO: 3938096 - RNA, 23 nt, Shigella flexneri 2a str. 301
agauuagccgguaaaucaccagc

SEQ ID NO: 3938097 - RNA, 18 nt, Shigella flexneri 2a str. 301
agauuagccguuaaguuu

SEQ ID NO: 3938098 - RNA, 17 nt, Shigella flexneri 2a str. 301
agauuauaagccaguaa

SEQ ID NO: 3938099 - RNA, 14 nt, Shigella flexneri 2a str. 301
agauucagccacau

SEQ ID NO: 3938100 - RNA, 18 nt, Shigella flexneri 2a str. 301
agauucagcgucgucagc

SEQ ID NO: 3938101 - RNA, 16 nt, Shigella flexneri 2a str. 301
agauucaugcugcggc

SEQ ID NO: 3938102 - RNA, 23 nt, Shigella flexneri 2a str. 301
agauucaugguacgggacagcag

SEQ ID NO: 3938103 - RNA, 22 nt, Shigella flexneri 2a str. 301
agauuccccgcaguuacagcag

SEQ ID NO: 3938104 - RNA, 13 nt, Shigella flexneri 2a str. 301
agauucgccagau

SEQ ID NO: 3938105 - RNA, 23 nt, Shigella flexneri 2a str. 301
agauucgcggguaagcgcggagg

SEQ ID NO: 3938106 - RNA, 12 nt, Shigella flexneri 2a str. 301
agauucuuaaag

SEQ ID NO: 3938107 - RNA, 20 nt, Shigella flexneri 2a str. 301
agauugaacgcuggcggcag

SEQ ID NO: 3938108 - RNA, 16 nt, Shigella flexneri 2a str. 301
agauugaauuagcaag

SEQ ID NO: 3938109 - RNA, 19 nt, Shigella flexneri 2a str. 301
agauugcaaauucucuauu

SEQ ID NO: 3938110 - RNA, 20 nt, Shigella flexneri 2a str. 301
agcacaaacauccaucugcu

SEQ ID NO: 3938111 - RNA, 14 nt, Shigella flexneri 2a str. 301
agcacaaagcgaug

SEQ ID NO: 3938112 - RNA, 18 nt, Shigella flexneri 2a str. 301
agcacaacaggcuauuuu

SEQ ID NO: 3938113 - RNA, 23 nt, Shigella flexneri 2a str. 301
agcacaaucaaaucgacagccag

SEQ ID NO: 3938114 - RNA, 23 nt, Shigella flexneri 2a str. 301
agcacacauaagagcgggacaac

SEQ ID NO: 3938115 - RNA, 22 nt, Shigella flexneri 2a str. 301
agcacacugguucccaacaaca

SEQ ID NO: 3938116 - RNA, 23 nt, Shigella flexneri 2a str. 301
agcacacugguucccaacaacag

SEQ ID NO: 3938117 - RNA, 24 nt, Shigella flexneri 2a str. 301
agcacacugguucccaacaacagc

SEQ ID NO: 3938118 - RNA, 20 nt, Shigella flexneri 2a str. 301
agcacacuguaagccaccga

SEQ ID NO: 3938119 - RNA, 13 nt, Shigella flexneri 2a str. 301
agcacaucacuca

SEQ ID NO: 3938120 - RNA, 21 nt, Shigella flexneri 2a str. 301
agcacaucagccagaugcacc

SEQ ID NO: 3938121 - RNA, 16 nt, Shigella flexneri 2a str. 301
agcacaucaucaaagc

SEQ ID NO: 3938122 - RNA, 18 nt, Shigella flexneri 2a str. 301
agcacaucaucaaagcca

SEQ ID NO: 3938123 - RNA, 23 nt, Shigella flexneri 2a str. 301
agcacaucuggcgagucaccaua

SEQ ID NO: 3938124 - RNA, 15 nt, Shigella flexneri 2a str. 301
agcacaugcugacau

SEQ ID NO: 3938125 - RNA, 16 nt, Shigella flexneri 2a str. 301
agcacaugcugacauu

SEQ ID NO: 3938126 - RNA, 13 nt, Shigella flexneri 2a str. 301
agcacauuucaga

SEQ ID NO: 3938127 - RNA, 14 nt, Shigella flexneri 2a str. 301
agcaccaccgcccg

SEQ ID NO: 3938128 - RNA, 13 nt, Shigella flexneri 2a str. 301
agcaccagauaau

SEQ ID NO: 3938129 - RNA, 19 nt, Shigella flexneri 2a str. 301
agcaccagauaaugagaaa

SEQ ID NO: 3938130 - RNA, 15 nt, Shigella flexneri 2a str. 301
agcaccagcagguga

SEQ ID NO: 3938131 - RNA, 17 nt, Shigella flexneri 2a str. 301
agcaccagggaaauaau

SEQ ID NO: 3938132 - RNA, 21 nt, Shigella flexneri 2a str. 301
agcaccauccgcccacaccag

SEQ ID NO: 3938133 - RNA, 15 nt, Shigella flexneri 2a str. 301
agcacccagcaaucc

SEQ ID NO: 3938134 - RNA, 14 nt, Shigella flexneri 2a str. 301
agcacccgccagcg

SEQ ID NO: 3938135 - RNA, 14 nt, Shigella flexneri 2a str. 301
agcacccgcgcugg

SEQ ID NO: 3938136 - RNA, 20 nt, Shigella flexneri 2a str. 301
agcacccugaguuuucagua

SEQ ID NO: 3938137 - RNA, 14 nt, Shigella flexneri 2a str. 301
agcaccgaacagcu

SEQ ID NO: 3938138 - RNA, 19 nt, Shigella flexneri 2a str. 301
agcaccggacuauccgccu

SEQ ID NO: 3938139 - RNA, 21 nt, Shigella flexneri 2a str. 301
agcaccugcuugaacgcaccg

SEQ ID NO: 3938140 - RNA, 16 nt, Shigella flexneri 2a str. 301
agcacgaaugucguuu

SEQ ID NO: 3938141 - RNA, 17 nt, Shigella flexneri 2a str. 301
agcacgacuuucucuuc

SEQ ID NO: 3938142 - RNA, 13 nt, Shigella flexneri 2a str. 301
agcacgauuuugu

SEQ ID NO: 3938143 - RNA, 18 nt, Shigella flexneri 2a str. 301
agcacgauuuuguaggcc

SEQ ID NO: 3938144 - RNA, 21 nt, Shigella flexneri 2a str. 301
agcacgcagugagaagccacc

SEQ ID NO: 3938145 - RNA, 17 nt, Shigella flexneri 2a str. 301
agcacgcuuuucagugc

SEQ ID NO: 3938146 - RNA, 17 nt, Shigella flexneri 2a str. 301
agcacggucaggcuaaa

SEQ ID NO: 3938147 - RNA, 18 nt, Shigella flexneri 2a str. 301
agcacguaaaucuuuacc

SEQ ID NO: 3938148 - RNA, 16 nt, Shigella flexneri 2a str. 301
agcacgucaucugcac

SEQ ID NO: 3938149 - RNA, 18 nt, Shigella flexneri 2a str. 301
agcacguuaaucaaauca

SEQ ID NO: 3938150 - RNA, 19 nt, Shigella flexneri 2a str. 301
agcacguuaaucaaaucaa

SEQ ID NO: 3938151 - RNA, 21 nt, Shigella flexneri 2a str. 301
agcacguuuagcuuuggugcc

SEQ ID NO: 3938152 - RNA, 21 nt, Shigella flexneri 2a str. 301
agcacuauccgacaucccgcc

SEQ ID NO: 3938153 - RNA, 15 nt, Shigella flexneri 2a str. 301
agcacuccugccacc

SEQ ID NO: 3938154 - RNA, 21 nt, Shigella flexneri 2a str. 301
agcacugauuuuuuccaacag

SEQ ID NO: 3938155 - RNA, 13 nt, Shigella flexneri 2a str. 301
agcacugcaucaa

SEQ ID NO: 3938156 - RNA, 15 nt, Shigella flexneri 2a str. 301
agcacugcaucaaug

SEQ ID NO: 3938157 - RNA, 13 nt, Shigella flexneri 2a str. 301
agcacuggcggca

SEQ ID NO: 3938158 - RNA, 18 nt, Shigella flexneri 2a str. 301
agcacuggcggcagcagg

SEQ ID NO: 3938159 - RNA, 19 nt, Shigella flexneri 2a str. 301
agcacuggcggcagcaggu

SEQ ID NO: 3938160 - RNA, 15 nt, Shigella flexneri 2a str. 301
agcacuguaaaccuc

SEQ ID NO: 3938161 - RNA, 17 nt, Shigella flexneri 2a str. 301
agcacuguaaaccucuu

SEQ ID NO: 3938162 - RNA, 19 nt, Shigella flexneri 2a str. 301
agcacuguaaaccucuuuc

SEQ ID NO: 3938163 - RNA, 21 nt, Shigella flexneri 2a str. 301
agcacugucuaacaacaugac

SEQ ID NO: 3938164 - RNA, 18 nt, Shigella flexneri 2a str. 301
agcacuucacccaucgcc

SEQ ID NO: 3938165 - RNA, 23 nt, Shigella flexneri 2a str. 301
agcacuucacccaucgccagaua

SEQ ID NO: 3938166 - RNA, 17 nt, Shigella flexneri 2a str. 301
agcacuucacugacauu

SEQ ID NO: 3938167 - RNA, 14 nt, Shigella flexneri 2a str. 301
agcacuugcaggaa

SEQ ID NO: 3938168 - RNA, 17 nt, Shigella flexneri 2a str. 301
agcacuugcaggaacag

SEQ ID NO: 3938169 - RNA, 14 nt, Shigella flexneri 2a str. 301
agcacuugcaggcg

SEQ ID NO: 3938170 - RNA, 19 nt, Shigella flexneri 2a str. 301
agcacuuuucgcacugcag

SEQ ID NO: 3938171 - RNA, 16 nt, Shigella flexneri 2a str. 301
agcagaaaaagaagcc

SEQ ID NO: 3938172 - RNA, 13 nt, Shigella flexneri 2a str. 301
agcagaaaagcca

SEQ ID NO: 3938173 - RNA, 13 nt, Shigella flexneri 2a str. 301
agcagaaagcgac

SEQ ID NO: 3938174 - RNA, 18 nt, Shigella flexneri 2a str. 301
agcagaaccagggaaaaa

SEQ ID NO: 3938175 - RNA, 20 nt, Shigella flexneri 2a str. 301
agcagaccaauguuacgacc

SEQ ID NO: 3938176 - RNA, 15 nt, Shigella flexneri 2a str. 301
agcagaccagcaaua

SEQ ID NO: 3938177 - RNA, 16 nt, Shigella flexneri 2a str. 301
agcagaccagcaauaa

SEQ ID NO: 3938178 - RNA, 20 nt, Shigella flexneri 2a str. 301
agcagagaaacgccagcagc

SEQ ID NO: 3938179 - RNA, 14 nt, Shigella flexneri 2a str. 301
agcagagaucuuuc

SEQ ID NO: 3938180 - RNA, 13 nt, Shigella flexneri 2a str. 301
agcagagcagacg

SEQ ID NO: 3938181 - RNA, 14 nt, Shigella flexneri 2a str. 301
agcagaguugcuga

SEQ ID NO: 3938182 - RNA, 17 nt, Shigella flexneri 2a str. 301
agcagaguuuuuuaugc

SEQ ID NO: 3938183 - RNA, 16 nt, Shigella flexneri 2a str. 301
agcagauaucccgcca

SEQ ID NO: 3938184 - RNA, 20 nt, Shigella flexneri 2a str. 301
agcagauaucccgccagcac

SEQ ID NO: 3938185 - RNA, 22 nt, Shigella flexneri 2a str. 301
agcagauauugccccacaccgc

SEQ ID NO: 3938186 - RNA, 17 nt, Shigella flexneri 2a str. 301
agcagauguagcucacc

SEQ ID NO: 3938187 - RNA, 18 nt, Shigella flexneri 2a str. 301
agcagauguagcucaccu

SEQ ID NO: 3938188 - RNA, 21 nt, Shigella flexneri 2a str. 301
agcagcaaugcaggcaccugc

SEQ ID NO: 3938189 - RNA, 22 nt, Shigella flexneri 2a str. 301
agcagcaaugcaggcaccugcc

SEQ ID NO: 3938190 - RNA, 14 nt, Shigella flexneri 2a str. 301
agcagcacaccaca

SEQ ID NO: 3938191 - RNA, 13 nt, Shigella flexneri 2a str. 301
agcagcagauaug

SEQ ID NO: 3938192 - RNA, 20 nt, Shigella flexneri 2a str. 301
agcagcagcgccaacgguga

SEQ ID NO: 3938193 - RNA, 21 nt, Shigella flexneri 2a str. 301
agcagcagcgguugagagaag

SEQ ID NO: 3938194 - RNA, 17 nt, Shigella flexneri 2a str. 301
agcagccacaccaauca

SEQ ID NO: 3938195 - RNA, 13 nt, Shigella flexneri 2a str. 301
agcagccaccacu

SEQ ID NO: 3938196 - RNA, 16 nt, Shigella flexneri 2a str. 301
agcagccagccagacg

SEQ ID NO: 3938197 - RNA, 18 nt, Shigella flexneri 2a str. 301
agcagcccugccggaacg

SEQ ID NO: 3938198 - RNA, 15 nt, Shigella flexneri 2a str. 301
agcagcccuugugcc

SEQ ID NO: 3938199 - RNA, 13 nt, Shigella flexneri 2a str. 301
agcagccgguauc

SEQ ID NO: 3938200 - RNA, 20 nt, Shigella flexneri 2a str. 301
agcagccuauuucgucgcua

SEQ ID NO: 3938201 - RNA, 16 nt, Shigella flexneri 2a str. 301
agcagcgaagcauuca

SEQ ID NO: 3938202 - RNA, 19 nt, Shigella flexneri 2a str. 301
agcagcgaaucagcccagc

SEQ ID NO: 3938203 - RNA, 16 nt, Shigella flexneri 2a str. 301
agcagcgaauuucuca

SEQ ID NO: 3938204 - RNA, 22 nt, Shigella flexneri 2a str. 301
agcagcgaauuucucauccgca

SEQ ID NO: 3938205 - RNA, 23 nt, Shigella flexneri 2a str. 301
agcagcgaauuucucauccgcag

SEQ ID NO: 3938206 - RNA, 22 nt, Shigella flexneri 2a str. 301
agcagcgccaacggugaaaaac

SEQ ID NO: 3938207 - RNA, 20 nt, Shigella flexneri 2a str. 301
agcagcgccacacgagucau

SEQ ID NO: 3938208 - RNA, 15 nt, Shigella flexneri 2a str. 301
agcagcggagaaaug

SEQ ID NO: 3938209 - RNA, 19 nt, Shigella flexneri 2a str. 301
agcagcggcagaucaaauu

SEQ ID NO: 3938210 - RNA, 18 nt, Shigella flexneri 2a str. 301
agcauuuucauccauuac

SEQ ID NO: 3938211 - RNA, 14 nt, Shigella flexneri 2a str. 301
agcauuuuuucaca

SEQ ID NO: 3938212 - RNA, 13 nt, Shigella flexneri 2a str. 301
agccaaaacugca

SEQ ID NO: 3938213 - RNA, 13 nt, Shigella flexneri 2a str. 301
agccaaaaugccu

SEQ ID NO: 3938214 - RNA, 19 nt, Shigella flexneri 2a str. 301
agccaaacaugcaaaccau

SEQ ID NO: 3938215 - RNA, 16 nt, Shigella flexneri 2a str. 301
agccaaaucauccaga

SEQ ID NO: 3938216 - RNA, 20 nt, Shigella flexneri 2a str. 301
agccaaaucauccagaccgc

SEQ ID NO: 3938217 - RNA, 12 nt, Shigella flexneri 2a str. 301
agccaacagcag

SEQ ID NO: 3938218 - RNA, 15 nt, Shigella flexneri 2a str. 301
agccaacggcucaac

SEQ ID NO: 3938219 - RNA, 19 nt, Shigella flexneri 2a str. 301
agccaagcgccgccucagc

SEQ ID NO: 3938220 - RNA, 22 nt, Shigella flexneri 2a str. 301
agccaagcgccgccucagccag

SEQ ID NO: 3938221 - RNA, 20 nt, Shigella flexneri 2a str. 301
agccaauaaaugccaccaca

SEQ ID NO: 3938222 - RNA, 22 nt, Shigella flexneri 2a str. 301
agccaauaaaugccaccacacc

SEQ ID NO: 3938223 - RNA, 13 nt, Shigella flexneri 2a str. 301
agccaaucccgga

SEQ ID NO: 3938224 - RNA, 20 nt, Shigella flexneri 2a str. 301
agccaaucccggaagccacc

SEQ ID NO: 3938225 - RNA, 13 nt, Shigella flexneri 2a str. 301
agccaaugcaggc

SEQ ID NO: 3938226 - RNA, 22 nt, Shigella flexneri 2a str. 301
agccaauggggacaaucaccau

SEQ ID NO: 3938227 - RNA, 17 nt, Shigella flexneri 2a str. 301
agccaauuacgcaggca

SEQ ID NO: 3938228 - RNA, 12 nt, Shigella flexneri 2a str. 301
agccacaauaaa

SEQ ID NO: 3938229 - RNA, 23 nt, Shigella flexneri 2a str. 301
agccacaggcuuuccugauaauc

SEQ ID NO: 3938230 - RNA, 16 nt, Shigella flexneri 2a str. 301
agccacagggugauca

SEQ ID NO: 3938231 - RNA, 20 nt, Shigella flexneri 2a str. 301
agccacagggugaucaccag

SEQ ID NO: 3938232 - RNA, 17 nt, Shigella flexneri 2a str. 301
agccacauugcugcaca

SEQ ID NO: 3938233 - RNA, 22 nt, Shigella flexneri 2a str. 301
agccacauuugcggcgaacugc

SEQ ID NO: 3938234 - RNA, 16 nt, Shigella flexneri 2a str. 301
agccaccacgccaaga

SEQ ID NO: 3938235 - RNA, 20 nt, Shigella flexneri 2a str. 301
agccaccacgccaagaaaca

SEQ ID NO: 3938236 - RNA, 13 nt, Shigella flexneri 2a str. 301
agccaccagcacc

SEQ ID NO: 3938237 - RNA, 12 nt, Shigella flexneri 2a str. 301
agccaccaugcg

SEQ ID NO: 3938238 - RNA, 18 nt, Shigella flexneri 2a str. 301
agccaccaugcgguguca

SEQ ID NO: 3938239 - RNA, 12 nt, Shigella flexneri 2a str. 301
agccaccgccag

SEQ ID NO: 3938240 - RNA, 18 nt, Shigella flexneri 2a str. 301
agccaccgcccagagaau

SEQ ID NO: 3938241 - RNA, 13 nt, Shigella flexneri 2a str. 301
agccaccucaacg

SEQ ID NO: 3938242 - RNA, 22 nt, Shigella flexneri 2a str. 301
agccacgagugagucuucccuu

SEQ ID NO: 3938243 - RNA, 19 nt, Shigella flexneri 2a str. 301
agccacgccgaaccauguc

SEQ ID NO: 3938244 - RNA, 16 nt, Shigella flexneri 2a str. 301
agccacggcuccagca

SEQ ID NO: 3938245 - RNA, 19 nt, Shigella flexneri 2a str. 301
agccacggcuccagcaaug

SEQ ID NO: 3938246 - RNA, 20 nt, Shigella flexneri 2a str. 301
agccacggcuccagcaaugu

SEQ ID NO: 3938247 - RNA, 13 nt, Shigella flexneri 2a str. 301
agccacugcgcca

SEQ ID NO: 3938248 - RNA, 14 nt, Shigella flexneri 2a str. 301
agccagaaagaacc

SEQ ID NO: 3938249 - RNA, 18 nt, Shigella flexneri 2a str. 301
agccagaaaguacggcca

SEQ ID NO: 3938250 - RNA, 20 nt, Shigella flexneri 2a str. 301
agccagaaaguacggccacu

SEQ ID NO: 3938251 - RNA, 18 nt, Shigella flexneri 2a str. 301
agccagaacagcggugca

SEQ ID NO: 3938252 - RNA, 15 nt, Shigella flexneri 2a str. 301
agccagacagcauca

SEQ ID NO: 3938253 - RNA, 13 nt, Shigella flexneri 2a str. 301
agccagacgccag

SEQ ID NO: 3938254 - RNA, 16 nt, Shigella flexneri 2a str. 301
agccagacgccagcca

SEQ ID NO: 3938255 - RNA, 15 nt, Shigella flexneri 2a str. 301
agccagauggcugcc

SEQ ID NO: 3938256 - RNA, 16 nt, Shigella flexneri 2a str. 301
agccagcaccaggcuu

SEQ ID NO: 3938257 - RNA, 19 nt, Shigella flexneri 2a str. 301
agccagcagcgaaucagcc

SEQ ID NO: 3938258 - RNA, 12 nt, Shigella flexneri 2a str. 301
agccagccaagc

SEQ ID NO: 3938259 - RNA, 18 nt, Shigella flexneri 2a str. 301
agccagccaagcauguca

SEQ ID NO: 3938260 - RNA, 12 nt, Shigella flexneri 2a str. 301
agccagccagaa

SEQ ID NO: 3938261 - RNA, 21 nt, Shigella flexneri 2a str. 301
agccagccgcuaacuuccugc

SEQ ID NO: 3938262 - RNA, 18 nt, Shigella flexneri 2a str. 301
agccagccguugcccgua

SEQ ID NO: 3938263 - RNA, 14 nt, Shigella flexneri 2a str. 301
agccagcgcauccu

SEQ ID NO: 3938264 - RNA, 18 nt, Shigella flexneri 2a str. 301
agccagcgcgccuucauu

SEQ ID NO: 3938265 - RNA, 14 nt, Shigella flexneri 2a str. 301
agccagcgcuggca

SEQ ID NO: 3938266 - RNA, 19 nt, Shigella flexneri 2a str. 301
agccagcgcuggcaauaaa

SEQ ID NO: 3938267 - RNA, 15 nt, Shigella flexneri 2a str. 301
agccagcucgcgcca

SEQ ID NO: 3938268 - RNA, 24 nt, Shigella flexneri 2a str. 301
agccaggaaauacgcuggcugaac

SEQ ID NO: 3938269 - RNA, 17 nt, Shigella flexneri 2a str. 301
agccaggagccaacacu

SEQ ID NO: 3938270 - RNA, 22 nt, Shigella flexneri 2a str. 301
agccaggagccaacacuuucac

SEQ ID NO: 3938271 - RNA, 23 nt, Shigella flexneri 2a str. 301
agccaggagccaacacuuucacu

SEQ ID NO: 3938272 - RNA, 18 nt, Shigella flexneri 2a str. 301
agccagggucaacauaaa

SEQ ID NO: 3938273 - RNA, 21 nt, Shigella flexneri 2a str. 301
agccaggguuauauaaaaccg

SEQ ID NO: 3938274 - RNA, 19 nt, Shigella flexneri 2a str. 301
agccagguuuaccagcagc

SEQ ID NO: 3938275 - RNA, 17 nt, Shigella flexneri 2a str. 301
agccaguauaauauaca

SEQ ID NO: 3938276 - RNA, 14 nt, Shigella flexneri 2a str. 301
agccagucaguaac

SEQ ID NO: 3938277 - RNA, 15 nt, Shigella flexneri 2a str. 301
agccagucaguaacg

SEQ ID NO: 3938278 - RNA, 16 nt, Shigella flexneri 2a str. 301
agccaguccagaaaug

SEQ ID NO: 3938279 - RNA, 17 nt, Shigella flexneri 2a str. 301
agccagugauuaacgcg

SEQ ID NO: 3938280 - RNA, 18 nt, Shigella flexneri 2a str. 301
agccaguucucaccaaag

SEQ ID NO: 3938281 - RNA, 21 nt, Shigella flexneri 2a str. 301
agccaguuuacccagcgaauc

SEQ ID NO: 3938282 - RNA, 20 nt, Shigella flexneri 2a str. 301
agccaguuuuucuuuuucaa

SEQ ID NO: 3938283 - RNA, 21 nt, Shigella flexneri 2a str. 301
agccauaaccccaccagcaug

SEQ ID NO: 3938284 - RNA, 22 nt, Shigella flexneri 2a str. 301
agccauaaccccaccagcauga

SEQ ID NO: 3938285 - RNA, 24 nt, Shigella flexneri 2a str. 301
agccauaaucacucuuccccgcuu

SEQ ID NO: 3938286 - RNA, 12 nt, Shigella flexneri 2a str. 301
agccaucaccau

SEQ ID NO: 3938287 - RNA, 16 nt, Shigella flexneri 2a str. 301
agccaucccagacacc

SEQ ID NO: 3938288 - RNA, 17 nt, Shigella flexneri 2a str. 301
agccauccgucauccau

SEQ ID NO: 3938289 - RNA, 20 nt, Shigella flexneri 2a str. 301
agccaugcccgugcugacag

SEQ ID NO: 3938290 - RNA, 23 nt, Shigella flexneri 2a str. 301
agccaugcggcaucuucuccacg

SEQ ID NO: 3938291 - RNA, 23 nt, Shigella flexneri 2a str. 301
agccaugcuuugcaucccagaaa

SEQ ID NO: 3938292 - RNA, 20 nt, Shigella flexneri 2a str. 301
agccauguuuaacuccuucu

SEQ ID NO: 3938293 - RNA, 17 nt, Shigella flexneri 2a str. 301
agccauuaaacaccagu

SEQ ID NO: 3938294 - RNA, 21 nt, Shigella flexneri 2a str. 301
agccauuaaacaccaguaccu

SEQ ID NO: 3938295 - RNA, 14 nt, Shigella flexneri 2a str. 301
agccauucccccuu

SEQ ID NO: 3938296 - RNA, 12 nt, Shigella flexneri 2a str. 301
agccauucccuc

SEQ ID NO: 3938297 - RNA, 14 nt, Shigella flexneri 2a str. 301
agcccaaccaaagc

SEQ ID NO: 3938298 - RNA, 13 nt, Shigella flexneri 2a str. 301
agcccaauaauca

SEQ ID NO: 3938299 - RNA, 23 nt, Shigella flexneri 2a str. 301
agcccacauccaugugggcugcc

SEQ ID NO: 3938300 - RNA, 16 nt, Shigella flexneri 2a str. 301
agcccacaugccugca

SEQ ID NO: 3938301 - RNA, 19 nt, Shigella flexneri 2a str. 301
agcccacgagcaaaacgcu

SEQ ID NO: 3938302 - RNA, 17 nt, Shigella flexneri 2a str. 301
agcccacgccgcccaga

SEQ ID NO: 3938303 - RNA, 19 nt, Shigella flexneri 2a str. 301
agcccacgccgcccagaga

SEQ ID NO: 3938304 - RNA, 11 nt, Shigella flexneri 2a str. 301
agcccagaaca

SEQ ID NO: 3938305 - RNA, 14 nt, Shigella flexneri 2a str. 301
agcccagaugccgg

SEQ ID NO: 3938306 - RNA, 13 nt, Shigella flexneri 2a str. 301
agcccagccccca

SEQ ID NO: 3938307 - RNA, 19 nt, Shigella flexneri 2a str. 301
agcccaguucagcggcuga

SEQ ID NO: 3938308 - RNA, 23 nt, Shigella flexneri 2a str. 301
agcccaucaguacaccaccuaac

SEQ ID NO: 3938309 - RNA, 22 nt, Shigella flexneri 2a str. 301
agcccaugaaucagcaaggaaa

SEQ ID NO: 3938310 - RNA, 18 nt, Shigella flexneri 2a str. 301
agccugugucaggccggc

SEQ ID NO: 3938311 - RNA, 19 nt, Shigella flexneri 2a str. 301
agccuguuccagacgcugc

SEQ ID NO: 3938312 - RNA, 14 nt, Shigella flexneri 2a str. 301
agccuuaacaagau

SEQ ID NO: 3938313 - RNA, 15 nt, Shigella flexneri 2a str. 301
agccuucagugccgu

SEQ ID NO: 3938314 - RNA, 16 nt, Shigella flexneri 2a str. 301
agccuuccuugugcaa

SEQ ID NO: 3938315 - RNA, 21 nt, Shigella flexneri 2a str. 301
agccuucgccaccguguucau

SEQ ID NO: 3938316 - RNA, 22 nt, Shigella flexneri 2a str. 301
agccuucgggcuggcauuuuuu

SEQ ID NO: 3938317 - RNA, 19 nt, Shigella flexneri 2a str. 301
agccuugccaaauguuguc

SEQ ID NO: 3938318 - RNA, 19 nt, Shigella flexneri 2a str. 301
agccuugccguuugcugcu

SEQ ID NO: 3938319 - RNA, 12 nt, Shigella flexneri 2a str. 301
agccuuucucag

SEQ ID NO: 3938320 - RNA, 21 nt, Shigella flexneri 2a str. 301
agcgaaaaagucccuucccag

SEQ ID NO: 3938321 - RNA, 18 nt, Shigella flexneri 2a str. 301
agcgaaaacgaauacgcc

SEQ ID NO: 3938322 - RNA, 13 nt, Shigella flexneri 2a str. 301
agcgaaacagcug

SEQ ID NO: 3938323 - RNA, 17 nt, Shigella flexneri 2a str. 301
agcgaaaguaacaccau

SEQ ID NO: 3938324 - RNA, 23 nt, Shigella flexneri 2a str. 301
agcgaaagucaggauagauagau

SEQ ID NO: 3938325 - RNA, 14 nt, Shigella flexneri 2a str. 301
agcgaaaucgccuu

SEQ ID NO: 3938326 - RNA, 13 nt, Shigella flexneri 2a str. 301
agcgaacaccagc

SEQ ID NO: 3938327 - RNA, 21 nt, Shigella flexneri 2a str. 301
agcgaacaggaguagcucugg

SEQ ID NO: 3938328 - RNA, 15 nt, Shigella flexneri 2a str. 301
agcgaagcccacgcc

SEQ ID NO: 3938329 - RNA, 17 nt, Shigella flexneri 2a str. 301
agcgaagcggcacugcu

SEQ ID NO: 3938330 - RNA, 14 nt, Shigella flexneri 2a str. 301
agcgaaggaucacc

SEQ ID NO: 3938331 - RNA, 23 nt, Shigella flexneri 2a str. 301
agcgaauaauaaaaaaccggagc

SEQ ID NO: 3938332 - RNA, 21 nt, Shigella flexneri 2a str. 301
agcgaauaccgggcaguacca

SEQ ID NO: 3938333 - RNA, 16 nt, Shigella flexneri 2a str. 301
agcgaauccagcaugc

SEQ ID NO: 3938334 - RNA, 18 nt, Shigella flexneri 2a str. 301
agcgaaugaggcagcaag

SEQ ID NO: 3938335 - RNA, 14 nt, Shigella flexneri 2a str. 301
agcgaauuccaguu

SEQ ID NO: 3938336 - RNA, 19 nt, Shigella flexneri 2a str. 301
agcgacagggccaggaauc

SEQ ID NO: 3938337 - RNA, 20 nt, Shigella flexneri 2a str. 301
agcgacaggucagcgccugg

SEQ ID NO: 3938338 - RNA, 18 nt, Shigella flexneri 2a str. 301
agcgaccauacagcagca

SEQ ID NO: 3938339 - RNA, 13 nt, Shigella flexneri 2a str. 301
agcgacguaaaaa

SEQ ID NO: 3938340 - RNA, 19 nt, Shigella flexneri 2a str. 301
agcgacucgguugcacaga

SEQ ID NO: 3938341 - RNA, 16 nt, Shigella flexneri 2a str. 301
agcgacugcgccgugu

SEQ ID NO: 3938342 - RNA, 14 nt, Shigella flexneri 2a str. 301
agcgacuugggcga

SEQ ID NO: 3938343 - RNA, 17 nt, Shigella flexneri 2a str. 301
agcgacuuugccuggcg

SEQ ID NO: 3938344 - RNA, 18 nt, Shigella flexneri 2a str. 301
agcgacuuugccuggcgg

SEQ ID NO: 3938345 - RNA, 19 nt, Shigella flexneri 2a str. 301
agcgacuuuggugccguga

SEQ ID NO: 3938346 - RNA, 18 nt, Shigella flexneri 2a str. 301
agcgagagcaaugcgcau

SEQ ID NO: 3938347 - RNA, 21 nt, Shigella flexneri 2a str. 301
agcgagcuggcgcugauaaau

SEQ ID NO: 3938348 - RNA, 16 nt, Shigella flexneri 2a str. 301
agcgagggagaaaacc

SEQ ID NO: 3938349 - RNA, 21 nt, Shigella flexneri 2a str. 301
agcgagguauuuucugaaacg

SEQ ID NO: 3938350 - RNA, 19 nt, Shigella flexneri 2a str. 301
agcgaguuuuucaguccac

SEQ ID NO: 3938351 - RNA, 15 nt, Shigella flexneri 2a str. 301
agcgauaacguguuc

SEQ ID NO: 3938352 - RNA, 20 nt, Shigella flexneri 2a str. 301
agcgauaacguguuccaguu

SEQ ID NO: 3938353 - RNA, 16 nt, Shigella flexneri 2a str. 301
agcgauacaucaucac

SEQ ID NO: 3938354 - RNA, 21 nt, Shigella flexneri 2a str. 301
agcgauacaucaucacugcca

SEQ ID NO: 3938355 - RNA, 23 nt, Shigella flexneri 2a str. 301
agcgaucauguaccguugcugcc

SEQ ID NO: 3938356 - RNA, 14 nt, Shigella flexneri 2a str. 301
agcgaugaugcugu

SEQ ID NO: 3938357 - RNA, 21 nt, Shigella flexneri 2a str. 301
agcgaugcccagugaccaaag

SEQ ID NO: 3938358 - RNA, 22 nt, Shigella flexneri 2a str. 301
agcgaugcugauguacccgcug

SEQ ID NO: 3938359 - RNA, 23 nt, Shigella flexneri 2a str. 301
agcgaugguacuucaaucgccac

SEQ ID NO: 3938360 - RNA, 21 nt, Shigella flexneri 2a str. 301
agcgaugguggugggggaagg

SEQ ID NO: 3938361 - RNA, 22 nt, Shigella flexneri 2a str. 301
agcgaugguggugggggaagga

SEQ ID NO: 3938362 - RNA, 14 nt, Shigella flexneri 2a str. 301
agcgauuaucgcca

SEQ ID NO: 3938363 - RNA, 16 nt, Shigella flexneri 2a str. 301
agcgauuaugaaacaa

SEQ ID NO: 3938364 - RNA, 15 nt, Shigella flexneri 2a str. 301
agcgauuccaguucg

SEQ ID NO: 3938365 - RNA, 17 nt, Shigella flexneri 2a str. 301
agcgauucguugguaau

SEQ ID NO: 3938366 - RNA, 17 nt, Shigella flexneri 2a str. 301
agcgauuuugccagccg

SEQ ID NO: 3938367 - RNA, 19 nt, Shigella flexneri 2a str. 301
agcgauuuugccagccgca

SEQ ID NO: 3938368 - RNA, 15 nt, Shigella flexneri 2a str. 301
agcgcaaauggugac

SEQ ID NO: 3938369 - RNA, 14 nt, Shigella flexneri 2a str. 301
agcgcaaauugcug

SEQ ID NO: 3938370 - RNA, 17 nt, Shigella flexneri 2a str. 301
agcgcaagggccgcagc

SEQ ID NO: 3938371 - RNA, 18 nt, Shigella flexneri 2a str. 301
agcgcaagggccgcagcu

SEQ ID NO: 3938372 - RNA, 22 nt, Shigella flexneri 2a str. 301
agcgcaauucgcgucggcguca

SEQ ID NO: 3938373 - RNA, 11 nt, Shigella flexneri 2a str. 301
agcgcacaugc

SEQ ID NO: 3938374 - RNA, 21 nt, Shigella flexneri 2a str. 301
agcgcacuuugucaucagucu

SEQ ID NO: 3938375 - RNA, 14 nt, Shigella flexneri 2a str. 301
agcgcagacaccag

SEQ ID NO: 3938376 - RNA, 13 nt, Shigella flexneri 2a str. 301
agcgcagcaccca

SEQ ID NO: 3938377 - RNA, 15 nt, Shigella flexneri 2a str. 301
agcgcagcagcgcgc

SEQ ID NO: 3938378 - RNA, 22 nt, Shigella flexneri 2a str. 301
agcgcagcucuggcauaacgcc

SEQ ID NO: 3938379 - RNA, 24 nt, Shigella flexneri 2a str. 301
agcgcaggaaagauaagcgaacau

SEQ ID NO: 3938380 - RNA, 12 nt, Shigella flexneri 2a str. 301
agcgcagugaca

SEQ ID NO: 3938381 - RNA, 20 nt, Shigella flexneri 2a str. 301
agcgcagugacauucaccuc

SEQ ID NO: 3938382 - RNA, 14 nt, Shigella flexneri 2a str. 301
agcgcauaaaagcu

SEQ ID NO: 3938383 - RNA, 16 nt, Shigella flexneri 2a str. 301
agcgcauaaaccgggc

SEQ ID NO: 3938384 - RNA, 23 nt, Shigella flexneri 2a str. 301
agcgcauaaaccgggcguggauc

SEQ ID NO: 3938385 - RNA, 12 nt, Shigella flexneri 2a str. 301
agcgcaucacuu

SEQ ID NO: 3938386 - RNA, 19 nt, Shigella flexneri 2a str. 301
agcgcaucaggcaaucucu

SEQ ID NO: 3938387 - RNA, 16 nt, Shigella flexneri 2a str. 301
agcgcaucaggcaaug

SEQ ID NO: 3938388 - RNA, 22 nt, Shigella flexneri 2a str. 301
agcgcauccgacuuaucacugc

SEQ ID NO: 3938389 - RNA, 15 nt, Shigella flexneri 2a str. 301
agcgcaucugccgga

SEQ ID NO: 3938390 - RNA, 22 nt, Shigella flexneri 2a str. 301
agcgcaugaucguucaccuaaa

SEQ ID NO: 3938391 - RNA, 17 nt, Shigella flexneri 2a str. 301
agcgcauucggcaagau

SEQ ID NO: 3938392 - RNA, 12 nt, Shigella flexneri 2a str. 301
agcgccaacggu

SEQ ID NO: 3938393 - RNA, 16 nt, Shigella flexneri 2a str. 301
agcgccaacggugaaa

SEQ ID NO: 3938394 - RNA, 14 nt, Shigella flexneri 2a str. 301
agcgccaccacccu

SEQ ID NO: 3938395 - RNA, 21 nt, Shigella flexneri 2a str. 301
agcgccaccgguuuauuauug

SEQ ID NO: 3938396 - RNA, 19 nt, Shigella flexneri 2a str. 301
agcgccaccgucagugcga

SEQ ID NO: 3938397 - RNA, 16 nt, Shigella flexneri 2a str. 301
agcgccacgcaacaga

SEQ ID NO: 3938398 - RNA, 18 nt, Shigella flexneri 2a str. 301
agcgccagacacuggaaa

SEQ ID NO: 3938399 - RNA, 20 nt, Shigella flexneri 2a str. 301
agcgccagcaagagcaaaua

SEQ ID NO: 3938400 - RNA, 15 nt, Shigella flexneri 2a str. 301
agcgccagccagaug

SEQ ID NO: 3938401 - RNA, 17 nt, Shigella flexneri 2a str. 301
agcgccagccagauggg

SEQ ID NO: 3938402 - RNA, 19 nt, Shigella flexneri 2a str. 301
agcgccaguugcucgacac

SEQ ID NO: 3938403 - RNA, 23 nt, Shigella flexneri 2a str. 301
agcgccaucccuaccgcccgcgc

SEQ ID NO: 3938404 - RNA, 16 nt, Shigella flexneri 2a str. 301
agcgccaucugcaggg

SEQ ID NO: 3938405 - RNA, 17 nt, Shigella flexneri 2a str. 301
agcgccccgagaaguac

SEQ ID NO: 3938406 - RNA, 15 nt, Shigella flexneri 2a str. 301
agcgcccgcuugcga

SEQ ID NO: 3938407 - RNA, 14 nt, Shigella flexneri 2a str. 301
agcgcccugcaaug

SEQ ID NO: 3938408 - RNA, 23 nt, Shigella flexneri 2a str. 301
agcgcccugcaaugucaucagca

SEQ ID NO: 3938409 - RNA, 19 nt, Shigella flexneri 2a str. 301
agcgccgacagcagcccuu

SEQ ID NO: 3938410 - RNA, 18 nt, Shigella flexneri 2a str. 301
agcgucgcgguugcuguc

SEQ ID NO: 3938411 - RNA, 23 nt, Shigella flexneri 2a str. 301
agcgucugcuccuccuucucacc

SEQ ID NO: 3938412 - RNA, 15 nt, Shigella flexneri 2a str. 301
agcgucuggaagaag

SEQ ID NO: 3938413 - RNA, 19 nt, Shigella flexneri 2a str. 301
agcgucuggaagaaguaaa

SEQ ID NO: 3938414 - RNA, 17 nt, Shigella flexneri 2a str. 301
agcgucuucugguuuuu

SEQ ID NO: 3938415 - RNA, 18 nt, Shigella flexneri 2a str. 301
agcgugaaacaaaucacu

SEQ ID NO: 3938416 - RNA, 21 nt, Shigella flexneri 2a str. 301
agcgugacaccagcacaucau

SEQ ID NO: 3938417 - RNA, 12 nt, Shigella flexneri 2a str. 301
agcgugagggaa

SEQ ID NO: 3938418 - RNA, 21 nt, Shigella flexneri 2a str. 301
agcgugauuguggcaaucaua

SEQ ID NO: 3938419 - RNA, 15 nt, Shigella flexneri 2a str. 301
agcgugcaaauauac

SEQ ID NO: 3938420 - RNA, 16 nt, Shigella flexneri 2a str. 301
agcgugcauagcagca

SEQ ID NO: 3938421 - RNA, 16 nt, Shigella flexneri 2a str. 301
agcgugccaggcgcgc

SEQ ID NO: 3938422 - RNA, 14 nt, Shigella flexneri 2a str. 301
agcgugcucucaaa

SEQ ID NO: 3938423 - RNA, 23 nt, Shigella flexneri 2a str. 301
agcguggaacuugacgaucugcu

SEQ ID NO: 3938424 - RNA, 17 nt, Shigella flexneri 2a str. 301
agcguggagagcagcau

SEQ ID NO: 3938425 - RNA, 18 nt, Shigella flexneri 2a str. 301
agcguggauuggguacaa

SEQ ID NO: 3938426 - RNA, 19 nt, Shigella flexneri 2a str. 301
agcguguaaaaagauaaac

SEQ ID NO: 3938427 - RNA, 14 nt, Shigella flexneri 2a str. 301
agcguguugcggag

SEQ ID NO: 3938428 - RNA, 14 nt, Shigella flexneri 2a str. 301
agcguuaaaacuuu

SEQ ID NO: 3938429 - RNA, 15 nt, Shigella flexneri 2a str. 301
agcguuaaucaucaa

SEQ ID NO: 3938430 - RNA, 21 nt, Shigella flexneri 2a str. 301
agcguuaaugauaucccugcu

SEQ ID NO: 3938431 - RNA, 20 nt, Shigella flexneri 2a str. 301
agcguuacgccccaacacaa

SEQ ID NO: 3938432 - RNA, 16 nt, Shigella flexneri 2a str. 301
agcguuauagcgcaug

SEQ ID NO: 3938433 - RNA, 22 nt, Shigella flexneri 2a str. 301
agcguugaaugcaugcccggca

SEQ ID NO: 3938434 - RNA, 21 nt, Shigella flexneri 2a str. 301
agcguugcccgauugguucag

SEQ ID NO: 3938435 - RNA, 13 nt, Shigella flexneri 2a str. 301
agcguuucaagug

SEQ ID NO: 3938436 - RNA, 15 nt, Shigella flexneri 2a str. 301
agcguuuccagccag

SEQ ID NO: 3938437 - RNA, 15 nt, Shigella flexneri 2a str. 301
agcguuugcggcugu

SEQ ID NO: 3938438 - RNA, 19 nt, Shigella flexneri 2a str. 301
agcguuuuauaccaacaaa

SEQ ID NO: 3938439 - RNA, 15 nt, Shigella flexneri 2a str. 301
agcuaaacagcccaa

SEQ ID NO: 3938440 - RNA, 17 nt, Shigella flexneri 2a str. 301
agcuaacagagccgcga

SEQ ID NO: 3938441 - RNA, 21 nt, Shigella flexneri 2a str. 301
agcuaacgaaaauggccugau

SEQ ID NO: 3938442 - RNA, 15 nt, Shigella flexneri 2a str. 301
agcuaacgaaagaac

SEQ ID NO: 3938443 - RNA, 16 nt, Shigella flexneri 2a str. 301
agcuaacgaaagaaca

SEQ ID NO: 3938444 - RNA, 23 nt, Shigella flexneri 2a str. 301
agcuaacgaaagaacaguuaaca

SEQ ID NO: 3938445 - RNA, 18 nt, Shigella flexneri 2a str. 301
agcuaacucuaaucccuu

SEQ ID NO: 3938446 - RNA, 20 nt, Shigella flexneri 2a str. 301
agcuaaucaucaucagugcu

SEQ ID NO: 3938447 - RNA, 20 nt, Shigella flexneri 2a str. 301
agcuaauccccuccagcgag

SEQ ID NO: 3938448 - RNA, 21 nt, Shigella flexneri 2a str. 301
agcuaaugcaaaucacgcugc

SEQ ID NO: 3938449 - RNA, 12 nt, Shigella flexneri 2a str. 301
agcuaauuuuug

SEQ ID NO: 3938450 - RNA, 13 nt, Shigella flexneri 2a str. 301
agcuaccagcccc

SEQ ID NO: 3938451 - RNA, 16 nt, Shigella flexneri 2a str. 301
agcuaccggauuuuuu

SEQ ID NO: 3938452 - RNA, 17 nt, Shigella flexneri 2a str. 301
agcuauucuuauaaaga

SEQ ID NO: 3938453 - RNA, 15 nt, Shigella flexneri 2a str. 301
agcucaauaaaagaa

SEQ ID NO: 3938454 - RNA, 16 nt, Shigella flexneri 2a str. 301
agcucaauaaaagaaa

SEQ ID NO: 3938455 - RNA, 19 nt, Shigella flexneri 2a str. 301
agcucaauaaaagaaauca

SEQ ID NO: 3938456 - RNA, 16 nt, Shigella flexneri 2a str. 301
agcucaauacaaccca

SEQ ID NO: 3938457 - RNA, 17 nt, Shigella flexneri 2a str. 301
agcucaaucaacuccau

SEQ ID NO: 3938458 - RNA, 23 nt, Shigella flexneri 2a str. 301
agcucaaugguguuuuccaccgu

SEQ ID NO: 3938459 - RNA, 19 nt, Shigella flexneri 2a str. 301
agcucacggccggucauuu

SEQ ID NO: 3938460 - RNA, 19 nt, Shigella flexneri 2a str. 301
agcucagcuggauagagua

SEQ ID NO: 3938461 - RNA, 15 nt, Shigella flexneri 2a str. 301
agcucagugaccgaa

SEQ ID NO: 3938462 - RNA, 19 nt, Shigella flexneri 2a str. 301
agcucaguuaacggcauaa

SEQ ID NO: 3938463 - RNA, 21 nt, Shigella flexneri 2a str. 301
agcucauaacggcaacggcgg

SEQ ID NO: 3938464 - RNA, 16 nt, Shigella flexneri 2a str. 301
agcucauauuugcugg

SEQ ID NO: 3938465 - RNA, 22 nt, Shigella flexneri 2a str. 301
agcucauccagcguuucgugaa

SEQ ID NO: 3938466 - RNA, 22 nt, Shigella flexneri 2a str. 301
agcuccacaagaaugccugcca

SEQ ID NO: 3938467 - RNA, 15 nt, Shigella flexneri 2a str. 301
agcuccaccaguucg

SEQ ID NO: 3938468 - RNA, 18 nt, Shigella flexneri 2a str. 301
agcuccaccgauuuugag

SEQ ID NO: 3938469 - RNA, 19 nt, Shigella flexneri 2a str. 301
agcuccaccgauuuugaga

SEQ ID NO: 3938470 - RNA, 21 nt, Shigella flexneri 2a str. 301
agcuccaccgauuuugagaac

SEQ ID NO: 3938471 - RNA, 14 nt, Shigella flexneri 2a str. 301
agcuccagcaaaaa

SEQ ID NO: 3938472 - RNA, 11 nt, Shigella flexneri 2a str. 301
agcuccagguc

SEQ ID NO: 3938473 - RNA, 22 nt, Shigella flexneri 2a str. 301
agcucccacaguuucagcccca

SEQ ID NO: 3938474 - RNA, 20 nt, Shigella flexneri 2a str. 301
agcucccggagggguuuuug

SEQ ID NO: 3938475 - RNA, 18 nt, Shigella flexneri 2a str. 301
agcuccgggcugguuuuc

SEQ ID NO: 3938476 - RNA, 23 nt, Shigella flexneri 2a str. 301
agcuccgggcugguuuucagcga

SEQ ID NO: 3938477 - RNA, 24 nt, Shigella flexneri 2a str. 301
agcuccgggcugguuuucagcgaa

SEQ ID NO: 3938478 - RNA, 19 nt, Shigella flexneri 2a str. 301
agcuccguccagccaccgc

SEQ ID NO: 3938479 - RNA, 20 nt, Shigella flexneri 2a str. 301
agcuccguuaaccgugggaa

SEQ ID NO: 3938480 - RNA, 15 nt, Shigella flexneri 2a str. 301
agcuccugcauugac

SEQ ID NO: 3938481 - RNA, 16 nt, Shigella flexneri 2a str. 301
agcucgacaccaaaca

SEQ ID NO: 3938482 - RNA, 17 nt, Shigella flexneri 2a str. 301
agcucgacaccaaacag

SEQ ID NO: 3938483 - RNA, 16 nt, Shigella flexneri 2a str. 301
agcucgaccgcugccg

SEQ ID NO: 3938484 - RNA, 16 nt, Shigella flexneri 2a str. 301
agcucgacuccugacu

SEQ ID NO: 3938485 - RNA, 20 nt, Shigella flexneri 2a str. 301
agcucgcaagccacgccgaa

SEQ ID NO: 3938486 - RNA, 17 nt, Shigella flexneri 2a str. 301
agcucggcaaucuguua

SEQ ID NO: 3938487 - RNA, 19 nt, Shigella flexneri 2a str. 301
agcucgguauggccuuucu

SEQ ID NO: 3938488 - RNA, 19 nt, Shigella flexneri 2a str. 301
agcucgguggcgauguaau

SEQ ID NO: 3938489 - RNA, 20 nt, Shigella flexneri 2a str. 301
agcucguuguuuaugccgga

SEQ ID NO: 3938490 - RNA, 19 nt, Shigella flexneri 2a str. 301
agcucguuuacaaccugau

SEQ ID NO: 3938491 - RNA, 11 nt, Shigella flexneri 2a str. 301
agcucugccac

SEQ ID NO: 3938492 - RNA, 15 nt, Shigella flexneri 2a str. 301
agcucugcgccgucu

SEQ ID NO: 3938493 - RNA, 19 nt, Shigella flexneri 2a str. 301
agcucuggcauaacgccac

SEQ ID NO: 3938494 - RNA, 18 nt, Shigella flexneri 2a str. 301
agcucuguauauaaaugu

SEQ ID NO: 3938495 - RNA, 23 nt, Shigella flexneri 2a str. 301
agcucuucuucacucucaccacg

SEQ ID NO: 3938496 - RNA, 22 nt, Shigella flexneri 2a str. 301
agcucuuuuaacuuacgcguca

SEQ ID NO: 3938497 - RNA, 15 nt, Shigella flexneri 2a str. 301
agcucuuuuccagcc

SEQ ID NO: 3938498 - RNA, 16 nt, Shigella flexneri 2a str. 301
agcugaaaaucagauc

SEQ ID NO: 3938499 - RNA, 13 nt, Shigella flexneri 2a str. 301
agcugaacaaagc

SEQ ID NO: 3938500 - RNA, 13 nt, Shigella flexneri 2a str. 301
agcugaauuucau

SEQ ID NO: 3938501 - RNA, 16 nt, Shigella flexneri 2a str. 301
agcugacgacgaagaa

SEQ ID NO: 3938502 - RNA, 18 nt, Shigella flexneri 2a str. 301
agcugacgacgaagaaac

SEQ ID NO: 3938503 - RNA, 13 nt, Shigella flexneri 2a str. 301
agcugacguagca

SEQ ID NO: 3938504 - RNA, 16 nt, Shigella flexneri 2a str. 301
agcugacuuccagccg

SEQ ID NO: 3938505 - RNA, 13 nt, Shigella flexneri 2a str. 301
agcugagaaaaag

SEQ ID NO: 3938506 - RNA, 16 nt, Shigella flexneri 2a str. 301
agcugagcacaaaaca

SEQ ID NO: 3938507 - RNA, 23 nt, Shigella flexneri 2a str. 301
agcugauacgggaggucaucagc

SEQ ID NO: 3938508 - RNA, 19 nt, Shigella flexneri 2a str. 301
agcugauccuucuguucuu

SEQ ID NO: 3938509 - RNA, 15 nt, Shigella flexneri 2a str. 301
agcugauucagauaa

SEQ ID NO: 3938510 - RNA, 20 nt, Shigella flexneri 2a str. 301
aggacuauuuuaagaauaga

SEQ ID NO: 3938511 - RNA, 16 nt, Shigella flexneri 2a str. 301
aggacuucuuugcgcc

SEQ ID NO: 3938512 - RNA, 16 nt, Shigella flexneri 2a str. 301
aggagaaugggauggu

SEQ ID NO: 3938513 - RNA, 13 nt, Shigella flexneri 2a str. 301
aggagacgcgcaa

SEQ ID NO: 3938514 - RNA, 19 nt, Shigella flexneri 2a str. 301
aggagcgauuaugaaacaa

SEQ ID NO: 3938515 - RNA, 19 nt, Shigella flexneri 2a str. 301
aggagcuccagguccuccu

SEQ ID NO: 3938516 - RNA, 18 nt, Shigella flexneri 2a str. 301
aggaggcguaauuuccac

SEQ ID NO: 3938517 - RNA, 20 nt, Shigella flexneri 2a str. 301
aggaggcguaauuuccacgc

SEQ ID NO: 3938518 - RNA, 23 nt, Shigella flexneri 2a str. 301
aggagucauccucccuuacccuu

SEQ ID NO: 3938519 - RNA, 16 nt, Shigella flexneri 2a str. 301
aggauaaacuccugca

SEQ ID NO: 3938520 - RNA, 19 nt, Shigella flexneri 2a str. 301
aggauaaacuccugcacgc

SEQ ID NO: 3938521 - RNA, 15 nt, Shigella flexneri 2a str. 301
aggauaaauuuucug

SEQ ID NO: 3938522 - RNA, 14 nt, Shigella flexneri 2a str. 301
aggauacuuaucug

SEQ ID NO: 3938523 - RNA, 17 nt, Shigella flexneri 2a str. 301
aggauauguaagcagaa

SEQ ID NO: 3938524 - RNA, 16 nt, Shigella flexneri 2a str. 301
aggaucacaagaccua

SEQ ID NO: 3938525 - RNA, 16 nt, Shigella flexneri 2a str. 301
aggaucguuacgcccc

SEQ ID NO: 3938526 - RNA, 22 nt, Shigella flexneri 2a str. 301
aggaugcacucgcauccucuuu

SEQ ID NO: 3938527 - RNA, 15 nt, Shigella flexneri 2a str. 301
aggaugcagaaacca

SEQ ID NO: 3938528 - RNA, 21 nt, Shigella flexneri 2a str. 301
aggaugcgggucaggccagga

SEQ ID NO: 3938529 - RNA, 23 nt, Shigella flexneri 2a str. 301
aggauggcuggccgugcagaccg

SEQ ID NO: 3938530 - RNA, 13 nt, Shigella flexneri 2a str. 301
aggauggucgcuu

SEQ ID NO: 3938531 - RNA, 20 nt, Shigella flexneri 2a str. 301
aggauguuacaaccuccucc

SEQ ID NO: 3938532 - RNA, 15 nt, Shigella flexneri 2a str. 301
aggauuaauaaauuu

SEQ ID NO: 3938533 - RNA, 20 nt, Shigella flexneri 2a str. 301
aggauuaauaaauuuuauau

SEQ ID NO: 3938534 - RNA, 17 nt, Shigella flexneri 2a str. 301
aggauugaucaauucua

SEQ ID NO: 3938535 - RNA, 12 nt, Shigella flexneri 2a str. 301
aggauuucuccc

SEQ ID NO: 3938536 - RNA, 14 nt, Shigella flexneri 2a str. 301
aggauuucuccccc

SEQ ID NO: 3938537 - RNA, 20 nt, Shigella flexneri 2a str. 301
aggauuucuccccccucuga

SEQ ID NO: 3938538 - RNA, 17 nt, Shigella flexneri 2a str. 301
aggcaaaaaaaaugccc

SEQ ID NO: 3938539 - RNA, 21 nt, Shigella flexneri 2a str. 301
aggcaaaauacguucucaccu

SEQ ID NO: 3938540 - RNA, 14 nt, Shigella flexneri 2a str. 301
aggcaaaaugccag

SEQ ID NO: 3938541 - RNA, 17 nt, Shigella flexneri 2a str. 301
aggcaaaaugccagccc

SEQ ID NO: 3938542 - RNA, 22 nt, Shigella flexneri 2a str. 301
aggcaaacuucucgccaucaaa

SEQ ID NO: 3938543 - RNA, 15 nt, Shigella flexneri 2a str. 301
aggcaaccagcacgc

SEQ ID NO: 3938544 - RNA, 19 nt, Shigella flexneri 2a str. 301
aggcaagagcgaucggcag

SEQ ID NO: 3938545 - RNA, 13 nt, Shigella flexneri 2a str. 301
aggcaagccacaa

SEQ ID NO: 3938546 - RNA, 20 nt, Shigella flexneri 2a str. 301
aggcaagccgcuaacagcag

SEQ ID NO: 3938547 - RNA, 18 nt, Shigella flexneri 2a str. 301
aggcaaguagcgccauac

SEQ ID NO: 3938548 - RNA, 15 nt, Shigella flexneri 2a str. 301
aggcaauaaugacgc

SEQ ID NO: 3938549 - RNA, 17 nt, Shigella flexneri 2a str. 301
aggcaauaaugacgcug

SEQ ID NO: 3938550 - RNA, 13 nt, Shigella flexneri 2a str. 301
aggcaauccauaa

SEQ ID NO: 3938551 - RNA, 15 nt, Shigella flexneri 2a str. 301
aggcacaaaaccugc

SEQ ID NO: 3938552 - RNA, 14 nt, Shigella flexneri 2a str. 301
aggcacaaggguga

SEQ ID NO: 3938553 - RNA, 21 nt, Shigella flexneri 2a str. 301
aggcacaagggugagggagga

SEQ ID NO: 3938554 - RNA, 22 nt, Shigella flexneri 2a str. 301
aggcacaaguuuuuaggcauga

SEQ ID NO: 3938555 - RNA, 12 nt, Shigella flexneri 2a str. 301
aggcacagaaaa

SEQ ID NO: 3938556 - RNA, 18 nt, Shigella flexneri 2a str. 301
aggcacagcaggccaaga

SEQ ID NO: 3938557 - RNA, 15 nt, Shigella flexneri 2a str. 301
aggcaccuggaaauu

SEQ ID NO: 3938558 - RNA, 20 nt, Shigella flexneri 2a str. 301
aggcacgauaaguuugcgca

SEQ ID NO: 3938559 - RNA, 15 nt, Shigella flexneri 2a str. 301
aggcagaaacaaacg

SEQ ID NO: 3938560 - RNA, 18 nt, Shigella flexneri 2a str. 301
aggcagaagcgcgugcua

SEQ ID NO: 3938561 - RNA, 15 nt, Shigella flexneri 2a str. 301
aggcagauacaacca

SEQ ID NO: 3938562 - RNA, 16 nt, Shigella flexneri 2a str. 301
aggcagauccaguuac

SEQ ID NO: 3938563 - RNA, 15 nt, Shigella flexneri 2a str. 301
aggcagcauccggca

SEQ ID NO: 3938564 - RNA, 22 nt, Shigella flexneri 2a str. 301
aggcagcaucucgcgcucuucu

SEQ ID NO: 3938565 - RNA, 12 nt, Shigella flexneri 2a str. 301
aggcagcauucg

SEQ ID NO: 3938566 - RNA, 15 nt, Shigella flexneri 2a str. 301
aggcagccuuucuca

SEQ ID NO: 3938567 - RNA, 12 nt, Shigella flexneri 2a str. 301
aggcagcuuaga

SEQ ID NO: 3938568 - RNA, 16 nt, Shigella flexneri 2a str. 301
aggcagcuuagaaauc

SEQ ID NO: 3938569 - RNA, 16 nt, Shigella flexneri 2a str. 301
aggcagcuuagaaauu

SEQ ID NO: 3938570 - RNA, 19 nt, Shigella flexneri 2a str. 301
aggcaggcaucaaugaaag

SEQ ID NO: 3938571 - RNA, 16 nt, Shigella flexneri 2a str. 301
aggcaggcaucaucag

SEQ ID NO: 3938572 - RNA, 17 nt, Shigella flexneri 2a str. 301
aggcagggccaccagcg

SEQ ID NO: 3938573 - RNA, 20 nt, Shigella flexneri 2a str. 301
aggcagggcuaucuggagau

SEQ ID NO: 3938574 - RNA, 18 nt, Shigella flexneri 2a str. 301
aggcaggucuuucaccug

SEQ ID NO: 3938575 - RNA, 20 nt, Shigella flexneri 2a str. 301
aggcaggucuuucaccugau

SEQ ID NO: 3938576 - RNA, 18 nt, Shigella flexneri 2a str. 301
aggcaguuuauccagcca

SEQ ID NO: 3938577 - RNA, 19 nt, Shigella flexneri 2a str. 301
aggcaguuuauccagccac

SEQ ID NO: 3938578 - RNA, 16 nt, Shigella flexneri 2a str. 301
aggcaguuuugcguuu

SEQ ID NO: 3938579 - RNA, 14 nt, Shigella flexneri 2a str. 301
aggcauagaaaaag

SEQ ID NO: 3938580 - RNA, 20 nt, Shigella flexneri 2a str. 301
aggcaucacuuuaccgguuu

SEQ ID NO: 3938581 - RNA, 14 nt, Shigella flexneri 2a str. 301
aggcaucagacaaa

SEQ ID NO: 3938582 - RNA, 13 nt, Shigella flexneri 2a str. 301
aggcaucagcaau

SEQ ID NO: 3938583 - RNA, 14 nt, Shigella flexneri 2a str. 301
aggcaucagcaauu

SEQ ID NO: 3938584 - RNA, 16 nt, Shigella flexneri 2a str. 301
aggcaucccgcaccag

SEQ ID NO: 3938585 - RNA, 22 nt, Shigella flexneri 2a str. 301
aggcaucggugcacuccgccac

SEQ ID NO: 3938586 - RNA, 20 nt, Shigella flexneri 2a str. 301
aggcaucggugcuggccuau

SEQ ID NO: 3938587 - RNA, 15 nt, Shigella flexneri 2a str. 301
aggcaucgugcacca

SEQ ID NO: 3938588 - RNA, 13 nt, Shigella flexneri 2a str. 301
aggcaugaucagc

SEQ ID NO: 3938589 - RNA, 16 nt, Shigella flexneri 2a str. 301
aggcaugaugcgccaa

SEQ ID NO: 3938590 - RNA, 18 nt, Shigella flexneri 2a str. 301
aggcauuaaauccugaaa

SEQ ID NO: 3938591 - RNA, 17 nt, Shigella flexneri 2a str. 301
aggcauucucgccgugg

SEQ ID NO: 3938592 - RNA, 16 nt, Shigella flexneri 2a str. 301
aggcauucuuuuucau

SEQ ID NO: 3938593 - RNA, 19 nt, Shigella flexneri 2a str. 301
aggcauucuuuuucauuau

SEQ ID NO: 3938594 - RNA, 13 nt, Shigella flexneri 2a str. 301
aggcauuggcaaa

SEQ ID NO: 3938595 - RNA, 23 nt, Shigella flexneri 2a str. 301
aggcauuuacgccgcauccggca

SEQ ID NO: 3938596 - RNA, 20 nt, Shigella flexneri 2a str. 301
aggccaaaaaacagccccug

SEQ ID NO: 3938597 - RNA, 12 nt, Shigella flexneri 2a str. 301
aggccaaagccg

SEQ ID NO: 3938598 - RNA, 18 nt, Shigella flexneri 2a str. 301
aggccaaagccgccgagc

SEQ ID NO: 3938599 - RNA, 17 nt, Shigella flexneri 2a str. 301
aggccaacggcccauac

SEQ ID NO: 3938600 - RNA, 17 nt, Shigella flexneri 2a str. 301
aggccaaucagcaauaa

SEQ ID NO: 3938601 - RNA, 16 nt, Shigella flexneri 2a str. 301
aggccaauccagcccu

SEQ ID NO: 3938602 - RNA, 21 nt, Shigella flexneri 2a str. 301
aggccaauccagcccugccag

SEQ ID NO: 3938603 - RNA, 22 nt, Shigella flexneri 2a str. 301
aggccagcaauuuugguggcuu

SEQ ID NO: 3938604 - RNA, 19 nt, Shigella flexneri 2a str. 301
aggccagcggcuucgacga

SEQ ID NO: 3938605 - RNA, 16 nt, Shigella flexneri 2a str. 301
aggccagcguaccuug

SEQ ID NO: 3938606 - RNA, 13 nt, Shigella flexneri 2a str. 301
aggccaucagcag

SEQ ID NO: 3938607 - RNA, 16 nt, Shigella flexneri 2a str. 301
aggcccgcgugccgga

SEQ ID NO: 3938608 - RNA, 15 nt, Shigella flexneri 2a str. 301
aggccgacagcaggc

SEQ ID NO: 3938609 - RNA, 15 nt, Shigella flexneri 2a str. 301
aggccgacuggcaug

SEQ ID NO: 3938610 - RNA, 21 nt, Shigella flexneri 2a str. 301
agggcaauaaucucuacacca

SEQ ID NO: 3938611 - RNA, 22 nt, Shigella flexneri 2a str. 301
agggcaccggcguaacgccacg

SEQ ID NO: 3938612 - RNA, 22 nt, Shigella flexneri 2a str. 301
agggcacuuuuauccugucagu

SEQ ID NO: 3938613 - RNA, 13 nt, Shigella flexneri 2a str. 301
agggcaucaagaa

SEQ ID NO: 3938614 - RNA, 17 nt, Shigella flexneri 2a str. 301
agggcaucgcaggccag

SEQ ID NO: 3938615 - RNA, 11 nt, Shigella flexneri 2a str. 301
agggcauggcg

SEQ ID NO: 3938616 - RNA, 22 nt, Shigella flexneri 2a str. 301
agggcauucuuaccgggucgca

SEQ ID NO: 3938617 - RNA, 17 nt, Shigella flexneri 2a str. 301
agggcgaauucuugccu

SEQ ID NO: 3938618 - RNA, 16 nt, Shigella flexneri 2a str. 301
agggcgauuagcagca

SEQ ID NO: 3938619 - RNA, 20 nt, Shigella flexneri 2a str. 301
agggcgauuagcagcaugau

SEQ ID NO: 3938620 - RNA, 15 nt, Shigella flexneri 2a str. 301
agggcgauuugcucc

SEQ ID NO: 3938621 - RNA, 18 nt, Shigella flexneri 2a str. 301
agggcuacaaguccggga

SEQ ID NO: 3938622 - RNA, 17 nt, Shigella flexneri 2a str. 301
agggcuaucuggagaua

SEQ ID NO: 3938623 - RNA, 15 nt, Shigella flexneri 2a str. 301
agggcugauaaacaa

SEQ ID NO: 3938624 - RNA, 16 nt, Shigella flexneri 2a str. 301
agggcuuacugaaaau

SEQ ID NO: 3938625 - RNA, 16 nt, Shigella flexneri 2a str. 301
agggcuuucacugccc

SEQ ID NO: 3938626 - RNA, 20 nt, Shigella flexneri 2a str. 301
agggcuuuuucaauuccauu

SEQ ID NO: 3938627 - RNA, 18 nt, Shigella flexneri 2a str. 301
aggggacauuuagcggcc

SEQ ID NO: 3938628 - RNA, 19 nt, Shigella flexneri 2a str. 301
aggggacguuauggugccu

SEQ ID NO: 3938629 - RNA, 16 nt, Shigella flexneri 2a str. 301
aggggcuucuuccggc

SEQ ID NO: 3938630 - RNA, 14 nt, Shigella flexneri 2a str. 301
aggggcuuucccgu

SEQ ID NO: 3938631 - RNA, 18 nt, Shigella flexneri 2a str. 301
agggguuuuugccagcaa

SEQ ID NO: 3938632 - RNA, 17 nt, Shigella flexneri 2a str. 301
aggguaaacaacaugcu

SEQ ID NO: 3938633 - RNA, 20 nt, Shigella flexneri 2a str. 301
aggguaguguccauaaaaca

SEQ ID NO: 3938634 - RNA, 21 nt, Shigella flexneri 2a str. 301
agggucuuccagcaaauccau

SEQ ID NO: 3938635 - RNA, 23 nt, Shigella flexneri 2a str. 301
agggucuuccagcaaauccauca

SEQ ID NO: 3938636 - RNA, 12 nt, Shigella flexneri 2a str. 301
agggugccggga

SEQ ID NO: 3938637 - RNA, 20 nt, Shigella flexneri 2a str. 301
aggguggcucaaucgccacc

SEQ ID NO: 3938638 - RNA, 12 nt, Shigella flexneri 2a str. 301
aggguuaaaucu

SEQ ID NO: 3938639 - RNA, 18 nt, Shigella flexneri 2a str. 301
aggguuauauaaaaccgc

SEQ ID NO: 3938640 - RNA, 22 nt, Shigella flexneri 2a str. 301
aggguuucggcuuuuuccugcc

SEQ ID NO: 3938641 - RNA, 20 nt, Shigella flexneri 2a str. 301
agguaacaaaugugccauua

SEQ ID NO: 3938642 - RNA, 17 nt, Shigella flexneri 2a str. 301
agguaacaauaaacacc

SEQ ID NO: 3938643 - RNA, 22 nt, Shigella flexneri 2a str. 301
agguaacgucgguuucaucaca

SEQ ID NO: 3938644 - RNA, 15 nt, Shigella flexneri 2a str. 301
agguaagagugaauu

SEQ ID NO: 3938645 - RNA, 19 nt, Shigella flexneri 2a str. 301
agguaagaguuucaacauc

SEQ ID NO: 3938646 - RNA, 23 nt, Shigella flexneri 2a str. 301
agguaaggcgcgagguuuuccuu

SEQ ID NO: 3938647 - RNA, 12 nt, Shigella flexneri 2a str. 301
agguacaaagcc

SEQ ID NO: 3938648 - RNA, 13 nt, Shigella flexneri 2a str. 301
agguacaaagcca

SEQ ID NO: 3938649 - RNA, 19 nt, Shigella flexneri 2a str. 301
agguacaaagccaacagca

SEQ ID NO: 3938650 - RNA, 14 nt, Shigella flexneri 2a str. 301
agguacaaccaucc

SEQ ID NO: 3938651 - RNA, 19 nt, Shigella flexneri 2a str. 301
agguacaaccgcaaagguu

SEQ ID NO: 3938652 - RNA, 20 nt, Shigella flexneri 2a str. 301
agguaccagcauuagcaaug

SEQ ID NO: 3938653 - RNA, 15 nt, Shigella flexneri 2a str. 301
agguacgcuccagca

SEQ ID NO: 3938654 - RNA, 16 nt, Shigella flexneri 2a str. 301
agguacgcuccagcag

SEQ ID NO: 3938655 - RNA, 15 nt, Shigella flexneri 2a str. 301
agguacuuuugaaug

SEQ ID NO: 3938656 - RNA, 23 nt, Shigella flexneri 2a str. 301
agguaggcagucauaaaaucaau

SEQ ID NO: 3938657 - RNA, 23 nt, Shigella flexneri 2a str. 301
agguauaccggaccaauaacgcu

SEQ ID NO: 3938658 - RNA, 21 nt, Shigella flexneri 2a str. 301
agguaucgcgaaaaaaaagau

SEQ ID NO: 3938659 - RNA, 17 nt, Shigella flexneri 2a str. 301
agguaucuguaccccug

SEQ ID NO: 3938660 - RNA, 15 nt, Shigella flexneri 2a str. 301
agguauuuugucagc

SEQ ID NO: 3938661 - RNA, 22 nt, Shigella flexneri 2a str. 301
aggucaaccuagccuuccuugu

SEQ ID NO: 3938662 - RNA, 21 nt, Shigella flexneri 2a str. 301
aggucacagaagagagauaau

SEQ ID NO: 3938663 - RNA, 20 nt, Shigella flexneri 2a str. 301
aggucacaucauaaccgagc

SEQ ID NO: 3938664 - RNA, 17 nt, Shigella flexneri 2a str. 301
aggucacccaacaugcc

SEQ ID NO: 3938665 - RNA, 23 nt, Shigella flexneri 2a str. 301
aggucacgggcaauuuucgccau

SEQ ID NO: 3938666 - RNA, 16 nt, Shigella flexneri 2a str. 301
aggucagagagccagc

SEQ ID NO: 3938667 - RNA, 20 nt, Shigella flexneri 2a str. 301
aggucagagagccagcccca

SEQ ID NO: 3938668 - RNA, 18 nt, Shigella flexneri 2a str. 301
aggucagguuugacauaa

SEQ ID NO: 3938669 - RNA, 16 nt, Shigella flexneri 2a str. 301
aggucaucacauccca

SEQ ID NO: 3938670 - RNA, 20 nt, Shigella flexneri 2a str. 301
aggucaucauugcagucaua

SEQ ID NO: 3938671 - RNA, 21 nt, Shigella flexneri 2a str. 301
aggucauugcgacgagaaaau

SEQ ID NO: 3938672 - RNA, 16 nt, Shigella flexneri 2a str. 301
agguccccgagcacau

SEQ ID NO: 3938673 - RNA, 18 nt, Shigella flexneri 2a str. 301
agguccccgagcacaugc

SEQ ID NO: 3938674 - RNA, 16 nt, Shigella flexneri 2a str. 301
agguccggauggcaaa

SEQ ID NO: 3938675 - RNA, 21 nt, Shigella flexneri 2a str. 301
agguccguauagaucagcggu

SEQ ID NO: 3938676 - RNA, 13 nt, Shigella flexneri 2a str. 301
agguccuccagcu

SEQ ID NO: 3938677 - RNA, 22 nt, Shigella flexneri 2a str. 301
agguccuccuguaccuucacgc

SEQ ID NO: 3938678 - RNA, 18 nt, Shigella flexneri 2a str. 301
agguccuguaaugagaau

SEQ ID NO: 3938679 - RNA, 19 nt, Shigella flexneri 2a str. 301
agguccuucaggcccugcu

SEQ ID NO: 3938680 - RNA, 16 nt, Shigella flexneri 2a str. 301
aggucgaugcgcucgc

SEQ ID NO: 3938681 - RNA, 13 nt, Shigella flexneri 2a str. 301
aggucgcacugcu

SEQ ID NO: 3938682 - RNA, 13 nt, Shigella flexneri 2a str. 301
aggucgcuggcgu

SEQ ID NO: 3938683 - RNA, 14 nt, Shigella flexneri 2a str. 301
aggucggcuuugaa

SEQ ID NO: 3938684 - RNA, 17 nt, Shigella flexneri 2a str. 301
aggucguugggaggagg

SEQ ID NO: 3938685 - RNA, 15 nt, Shigella flexneri 2a str. 301
aggugaaaaauaaaa

SEQ ID NO: 3938686 - RNA, 14 nt, Shigella flexneri 2a str. 301
aggugacaucgugc

SEQ ID NO: 3938687 - RNA, 15 nt, Shigella flexneri 2a str. 301
aggugaccagcagac

SEQ ID NO: 3938688 - RNA, 14 nt, Shigella flexneri 2a str. 301
aggugauacaucaa

SEQ ID NO: 3938689 - RNA, 23 nt, Shigella flexneri 2a str. 301
aggugauuugcgccugcuuaaca

SEQ ID NO: 3938690 - RNA, 21 nt, Shigella flexneri 2a str. 301
aggugcagcccguaagcaaaa

SEQ ID NO: 3938691 - RNA, 14 nt, Shigella flexneri 2a str. 301
aggugcauugcugg

SEQ ID NO: 3938692 - RNA, 21 nt, Shigella flexneri 2a str. 301
aggugcugaaagggcaaauaa

SEQ ID NO: 3938693 - RNA, 17 nt, Shigella flexneri 2a str. 301
aggugcuuuaacgaaag

SEQ ID NO: 3938694 - RNA, 20 nt, Shigella flexneri 2a str. 301
agguggcggaauugguagac

SEQ ID NO: 3938695 - RNA, 20 nt, Shigella flexneri 2a str. 301
agguggcguuugccaccugu

SEQ ID NO: 3938696 - RNA, 17 nt, Shigella flexneri 2a str. 301
aggugguagcugccccc

SEQ ID NO: 3938697 - RNA, 16 nt, Shigella flexneri 2a str. 301
agguguauuguucugg

SEQ ID NO: 3938698 - RNA, 16 nt, Shigella flexneri 2a str. 301
aggugucaaccagcca

SEQ ID NO: 3938699 - RNA, 14 nt, Shigella flexneri 2a str. 301
aggugucacaugca

SEQ ID NO: 3938700 - RNA, 22 nt, Shigella flexneri 2a str. 301
agguguuacccgcuaacuggug

SEQ ID NO: 3938701 - RNA, 13 nt, Shigella flexneri 2a str. 301
agguguugcguuu

SEQ ID NO: 3938702 - RNA, 17 nt, Shigella flexneri 2a str. 301
agguuaaaguacucuuu

SEQ ID NO: 3938703 - RNA, 12 nt, Shigella flexneri 2a str. 301
agguuaacugug

SEQ ID NO: 3938704 - RNA, 18 nt, Shigella flexneri 2a str. 301
agguuaauaaauauuaau

SEQ ID NO: 3938705 - RNA, 23 nt, Shigella flexneri 2a str. 301
agguuaauaaauauuaauacaac

SEQ ID NO: 3938706 - RNA, 15 nt, Shigella flexneri 2a str. 301
agguuauaaauaaaa

SEQ ID NO: 3938707 - RNA, 21 nt, Shigella flexneri 2a str. 301
agguuccacggaauauuucac

SEQ ID NO: 3938708 - RNA, 18 nt, Shigella flexneri 2a str. 301
agguucggaguggcagcc

SEQ ID NO: 3938709 - RNA, 22 nt, Shigella flexneri 2a str. 301
agguucggaguggcagccccag

SEQ ID NO: 3938710 - RNA, 14 nt, Shigella flexneri 2a str. 301
agucggugccaugg

SEQ ID NO: 3938711 - RNA, 12 nt, Shigella flexneri 2a str. 301
agucguaaacaa

SEQ ID NO: 3938712 - RNA, 13 nt, Shigella flexneri 2a str. 301
agucgugccgcau

SEQ ID NO: 3938713 - RNA, 20 nt, Shigella flexneri 2a str. 301
agucguguuaucgcgcugaa

SEQ ID NO: 3938714 - RNA, 17 nt, Shigella flexneri 2a str. 301
agucguuuuaguaacaa

SEQ ID NO: 3938715 - RNA, 13 nt, Shigella flexneri 2a str. 301
agucucaagggag

SEQ ID NO: 3938716 - RNA, 14 nt, Shigella flexneri 2a str. 301
agucuccauuuuuu

SEQ ID NO: 3938717 - RNA, 16 nt, Shigella flexneri 2a str. 301
agucuccauuuuuuug

SEQ ID NO: 3938718 - RNA, 23 nt, Shigella flexneri 2a str. 301
agucuccuuuauagugugcaauc

SEQ ID NO: 3938719 - RNA, 23 nt, Shigella flexneri 2a str. 301
agucucucuccguuaucacagca

SEQ ID NO: 3938720 - RNA, 13 nt, Shigella flexneri 2a str. 301
agucugcauuuuc

SEQ ID NO: 3938721 - RNA, 17 nt, Shigella flexneri 2a str. 301
agucugccguugccacg

SEQ ID NO: 3938722 - RNA, 18 nt, Shigella flexneri 2a str. 301
agucugcugaccaccugu

SEQ ID NO: 3938723 - RNA, 18 nt, Shigella flexneri 2a str. 301
agucuggacaaagagcuu

SEQ ID NO: 3938724 - RNA, 21 nt, Shigella flexneri 2a str. 301
agucugugcugaaccguaggc

SEQ ID NO: 3938725 - RNA, 11 nt, Shigella flexneri 2a str. 301
agucuuccugc

SEQ ID NO: 3938726 - RNA, 16 nt, Shigella flexneri 2a str. 301
agucuucgccgacuuc

SEQ ID NO: 3938727 - RNA, 23 nt, Shigella flexneri 2a str. 301
agucuuugcgaggcgcgucccag

SEQ ID NO: 3938728 - RNA, 16 nt, Shigella flexneri 2a str. 301
agucuuuuuucaacuu

SEQ ID NO: 3938729 - RNA, 21 nt, Shigella flexneri 2a str. 301
agugaaagaggcggagguuuu

SEQ ID NO: 3938730 - RNA, 16 nt, Shigella flexneri 2a str. 301
agugaagucgggcaga

SEQ ID NO: 3938731 - RNA, 15 nt, Shigella flexneri 2a str. 301
agugaauacagaaca

SEQ ID NO: 3938732 - RNA, 16 nt, Shigella flexneri 2a str. 301
agugaauacagaacag

SEQ ID NO: 3938733 - RNA, 19 nt, Shigella flexneri 2a str. 301
agugaauagcgcccggaaa

SEQ ID NO: 3938734 - RNA, 18 nt, Shigella flexneri 2a str. 301
agugaauauuuaaccuga

SEQ ID NO: 3938735 - RNA, 20 nt, Shigella flexneri 2a str. 301
agugaaucgggaccagcauu

SEQ ID NO: 3938736 - RNA, 18 nt, Shigella flexneri 2a str. 301
agugaauuguuuuauaaa

SEQ ID NO: 3938737 - RNA, 22 nt, Shigella flexneri 2a str. 301
agugaauuguuuuauaaagaac

SEQ ID NO: 3938738 - RNA, 16 nt, Shigella flexneri 2a str. 301
agugacagcccggcau

SEQ ID NO: 3938739 - RNA, 21 nt, Shigella flexneri 2a str. 301
agugacaguguuauucccaac

SEQ ID NO: 3938740 - RNA, 19 nt, Shigella flexneri 2a str. 301
agugaccaucuuccagcau

SEQ ID NO: 3938741 - RNA, 21 nt, Shigella flexneri 2a str. 301
agugaccaucuuccagcauca

SEQ ID NO: 3938742 - RNA, 18 nt, Shigella flexneri 2a str. 301
agugacccgcagccagca

SEQ ID NO: 3938743 - RNA, 15 nt, Shigella flexneri 2a str. 301
agugaccuuaaucag

SEQ ID NO: 3938744 - RNA, 13 nt, Shigella flexneri 2a str. 301
agugacgcggcga

SEQ ID NO: 3938745 - RNA, 19 nt, Shigella flexneri 2a str. 301
agugacucuuuauuucauu

SEQ ID NO: 3938746 - RNA, 20 nt, Shigella flexneri 2a str. 301
agugacucuuuauuucauuu

SEQ ID NO: 3938747 - RNA, 21 nt, Shigella flexneri 2a str. 301
agugagcacugaauaugaguc

SEQ ID NO: 3938748 - RNA, 17 nt, Shigella flexneri 2a str. 301
agugagcgauucaaauu

SEQ ID NO: 3938749 - RNA, 22 nt, Shigella flexneri 2a str. 301
agugagcuuuguucaugccgga

SEQ ID NO: 3938750 - RNA, 18 nt, Shigella flexneri 2a str. 301
agugaggcuauuccacgc

SEQ ID NO: 3938751 - RNA, 19 nt, Shigella flexneri 2a str. 301
agugaggcuauuccacgca

SEQ ID NO: 3938752 - RNA, 18 nt, Shigella flexneri 2a str. 301
agugaguaucaauuauau

SEQ ID NO: 3938753 - RNA, 23 nt, Shigella flexneri 2a str. 301
agugaguguggcguggcgcucca

SEQ ID NO: 3938754 - RNA, 15 nt, Shigella flexneri 2a str. 301
agugaugaaaacgaa

SEQ ID NO: 3938755 - RNA, 15 nt, Shigella flexneri 2a str. 301
agugauggugguggg

SEQ ID NO: 3938756 - RNA, 21 nt, Shigella flexneri 2a str. 301
agugaugguggugggggaagg

SEQ ID NO: 3938757 - RNA, 23 nt, Shigella flexneri 2a str. 301
agugaugguggugggggaaggau

SEQ ID NO: 3938758 - RNA, 19 nt, Shigella flexneri 2a str. 301
agugauuaacgcuuguaaa

SEQ ID NO: 3938759 - RNA, 23 nt, Shigella flexneri 2a str. 301
agugcaacgugacucaauggcau

SEQ ID NO: 3938760 - RNA, 17 nt, Shigella flexneri 2a str. 301
agugcaaucaguggugu

SEQ ID NO: 3938761 - RNA, 20 nt, Shigella flexneri 2a str. 301
agugcacgaaccagagacag

SEQ ID NO: 3938762 - RNA, 19 nt, Shigella flexneri 2a str. 301
agugcauaaauaccggcau

SEQ ID NO: 3938763 - RNA, 20 nt, Shigella flexneri 2a str. 301
agugcauaaauaccggcaug

SEQ ID NO: 3938764 - RNA, 16 nt, Shigella flexneri 2a str. 301
agugcauccagcagcc

SEQ ID NO: 3938765 - RNA, 22 nt, Shigella flexneri 2a str. 301
agugcaucucaccguugccaac

SEQ ID NO: 3938766 - RNA, 14 nt, Shigella flexneri 2a str. 301
agugcauugagucc

SEQ ID NO: 3938767 - RNA, 17 nt, Shigella flexneri 2a str. 301
agugcauugagucccau

SEQ ID NO: 3938768 - RNA, 19 nt, Shigella flexneri 2a str. 301
agugcauugagucccaucu

SEQ ID NO: 3938769 - RNA, 19 nt, Shigella flexneri 2a str. 301
agugccaaaaaaauaagca

SEQ ID NO: 3938770 - RNA, 23 nt, Shigella flexneri 2a str. 301
agugccagucgccgacguagaag

SEQ ID NO: 3938771 - RNA, 13 nt, Shigella flexneri 2a str. 301
agugcccccaacu

SEQ ID NO: 3938772 - RNA, 19 nt, Shigella flexneri 2a str. 301
agugcccgaccacuucaug

SEQ ID NO: 3938773 - RNA, 14 nt, Shigella flexneri 2a str. 301
agugccgcccacca

SEQ ID NO: 3938774 - RNA, 21 nt, Shigella flexneri 2a str. 301
agugccggauaugaaauccgg

SEQ ID NO: 3938775 - RNA, 21 nt, Shigella flexneri 2a str. 301
agugccucacgaucacagcag

SEQ ID NO: 3938776 - RNA, 18 nt, Shigella flexneri 2a str. 301
agugccucgcuaaucucu

SEQ ID NO: 3938777 - RNA, 14 nt, Shigella flexneri 2a str. 301
agugcgcaacaaaa

SEQ ID NO: 3938778 - RNA, 17 nt, Shigella flexneri 2a str. 301
agugcgcucuucaacuu

SEQ ID NO: 3938779 - RNA, 18 nt, Shigella flexneri 2a str. 301
agugcggcagcggcuuca

SEQ ID NO: 3938780 - RNA, 20 nt, Shigella flexneri 2a str. 301
agugcggcgcaccagcaggc

SEQ ID NO: 3938781 - RNA, 17 nt, Shigella flexneri 2a str. 301
agugcgguaaauuuuuu

SEQ ID NO: 3938782 - RNA, 13 nt, Shigella flexneri 2a str. 301
agugcguacccag

SEQ ID NO: 3938783 - RNA, 23 nt, Shigella flexneri 2a str. 301
agugcguaucaauagcaguaauu

SEQ ID NO: 3938784 - RNA, 21 nt, Shigella flexneri 2a str. 301
agugcgucgcugcucuucagu

SEQ ID NO: 3938785 - RNA, 15 nt, Shigella flexneri 2a str. 301
agugcgugcgcugcu

SEQ ID NO: 3938786 - RNA, 17 nt, Shigella flexneri 2a str. 301
agugcguuauucaccuc

SEQ ID NO: 3938787 - RNA, 20 nt, Shigella flexneri 2a str. 301
agugcugaguuucagaccaa

SEQ ID NO: 3938788 - RNA, 22 nt, Shigella flexneri 2a str. 301
agugcuggccaaccggcacaau

SEQ ID NO: 3938789 - RNA, 22 nt, Shigella flexneri 2a str. 301
agugcuucuccguguucgucac

SEQ ID NO: 3938790 - RNA, 19 nt, Shigella flexneri 2a str. 301
agugcuuucugaacugaac

SEQ ID NO: 3938791 - RNA, 19 nt, Shigella flexneri 2a str. 301
aguggaagacguugauuca

SEQ ID NO: 3938792 - RNA, 21 nt, Shigella flexneri 2a str. 301
aguggacucuauggcuggcaa

SEQ ID NO: 3938793 - RNA, 16 nt, Shigella flexneri 2a str. 301
aguggaucagcaaauc

SEQ ID NO: 3938794 - RNA, 19 nt, Shigella flexneri 2a str. 301
aguggaugcgccauaccau

SEQ ID NO: 3938795 - RNA, 15 nt, Shigella flexneri 2a str. 301
aguggcaaauucuug

SEQ ID NO: 3938796 - RNA, 18 nt, Shigella flexneri 2a str. 301
aguggcgacaucuuuacc

SEQ ID NO: 3938797 - RNA, 13 nt, Shigella flexneri 2a str. 301
aguggcgcagagc

SEQ ID NO: 3938798 - RNA, 17 nt, Shigella flexneri 2a str. 301
aguggcgcucucaagcc

SEQ ID NO: 3938799 - RNA, 18 nt, Shigella flexneri 2a str. 301
aguggcucagacucucau

SEQ ID NO: 3938800 - RNA, 14 nt, Shigella flexneri 2a str. 301
aguggguuucugcc

SEQ ID NO: 3938801 - RNA, 17 nt, Shigella flexneri 2a str. 301
aguggucaggauuaugu

SEQ ID NO: 3938802 - RNA, 14 nt, Shigella flexneri 2a str. 301
aguggugcggcuga

SEQ ID NO: 3938803 - RNA, 20 nt, Shigella flexneri 2a str. 301
aguguaaaacagcacuccug

SEQ ID NO: 3938804 - RNA, 18 nt, Shigella flexneri 2a str. 301
aguguaacgcuugcugau

SEQ ID NO: 3938805 - RNA, 19 nt, Shigella flexneri 2a str. 301
aguguagcgcaucaggcuu

SEQ ID NO: 3938806 - RNA, 12 nt, Shigella flexneri 2a str. 301
aguguaguucug

SEQ ID NO: 3938807 - RNA, 15 nt, Shigella flexneri 2a str. 301
agugucauucagauc

SEQ ID NO: 3938808 - RNA, 16 nt, Shigella flexneri 2a str. 301
agugucauucagaucu

SEQ ID NO: 3938809 - RNA, 16 nt, Shigella flexneri 2a str. 301
aguuuaauugccauuu

SEQ ID NO: 3938810 - RNA, 16 nt, Shigella flexneri 2a str. 301
aguuuacgcagcagau

SEQ ID NO: 3938811 - RNA, 14 nt, Shigella flexneri 2a str. 301
aguuuauccagcca

SEQ ID NO: 3938812 - RNA, 17 nt, Shigella flexneri 2a str. 301
aguuucaccaaacuuca

SEQ ID NO: 3938813 - RNA, 20 nt, Shigella flexneri 2a str. 301
aguuucaccaaacuucagcc

SEQ ID NO: 3938814 - RNA, 13 nt, Shigella flexneri 2a str. 301
aguuucacgcugg

SEQ ID NO: 3938815 - RNA, 15 nt, Shigella flexneri 2a str. 301
aguuucagaaaaagc

SEQ ID NO: 3938816 - RNA, 12 nt, Shigella flexneri 2a str. 301
aguuucagaaua

SEQ ID NO: 3938817 - RNA, 14 nt, Shigella flexneri 2a str. 301
aguuucagaccaau

SEQ ID NO: 3938818 - RNA, 23 nt, Shigella flexneri 2a str. 301
aguuucagaccaauaauccccaa

SEQ ID NO: 3938819 - RNA, 16 nt, Shigella flexneri 2a str. 301
aguuucagccucugcc

SEQ ID NO: 3938820 - RNA, 13 nt, Shigella flexneri 2a str. 301
aguuucagcggcg

SEQ ID NO: 3938821 - RNA, 20 nt, Shigella flexneri 2a str. 301
aguuucggcaucagcagaau

SEQ ID NO: 3938822 - RNA, 15 nt, Shigella flexneri 2a str. 301
aguuugaucaguucu

SEQ ID NO: 3938823 - RNA, 21 nt, Shigella flexneri 2a str. 301
aguuugauuauucacaauuca

SEQ ID NO: 3938824 - RNA, 19 nt, Shigella flexneri 2a str. 301
aguuugcaccucugcugcu

SEQ ID NO: 3938825 - RNA, 16 nt, Shigella flexneri 2a str. 301
aguuugccguugaucu

SEQ ID NO: 3938826 - RNA, 19 nt, Shigella flexneri 2a str. 301
aguuugccguugaucucuc

SEQ ID NO: 3938827 - RNA, 21 nt, Shigella flexneri 2a str. 301
aguuugccuucacaggccgcc

SEQ ID NO: 3938828 - RNA, 22 nt, Shigella flexneri 2a str. 301
aguuuggucuggcaaaaauaag

SEQ ID NO: 3938829 - RNA, 18 nt, Shigella flexneri 2a str. 301
aguuuggugagaacacca

SEQ ID NO: 3938830 - RNA, 19 nt, Shigella flexneri 2a str. 301
aguuuggugagaacaccaa

SEQ ID NO: 3938831 - RNA, 19 nt, Shigella flexneri 2a str. 301
aguuugucuggcaauccua

SEQ ID NO: 3938832 - RNA, 22 nt, Shigella flexneri 2a str. 301
aguuuuauacucagucaggcuu

SEQ ID NO: 3938833 - RNA, 18 nt, Shigella flexneri 2a str. 301
aguuuucacccuuucguu

SEQ ID NO: 3938834 - RNA, 15 nt, Shigella flexneri 2a str. 301
aguuuucauauaccg

SEQ ID NO: 3938835 - RNA, 18 nt, Shigella flexneri 2a str. 301
aguuuuccaucaguugau

SEQ ID NO: 3938836 - RNA, 22 nt, Shigella flexneri 2a str. 301
aguuuucgccacuccccacuuc

SEQ ID NO: 3938837 - RNA, 14 nt, Shigella flexneri 2a str. 301
aguuuucuuugcca

SEQ ID NO: 3938838 - RNA, 21 nt, Shigella flexneri 2a str. 301
aguuuugucuucggccauuga

SEQ ID NO: 3938839 - RNA, 15 nt, Shigella flexneri 2a str. 301
aguuuuuccccugcc

SEQ ID NO: 3938840 - RNA, 23 nt, Shigella flexneri 2a str. 301
aguuuuugcaaucagauaaaaua

SEQ ID NO: 3938841 - RNA, 12 nt, Shigella flexneri 2a str. 301
aguuuuuucuuc

SEQ ID NO: 3938842 - RNA, 24 nt, Shigella flexneri 2a str. 301
auaaaaaaaacgccagcaacacau

SEQ ID NO: 3938843 - RNA, 16 nt, Shigella flexneri 2a str. 301
auaaaaaaaguauuuu

SEQ ID NO: 3938844 - RNA, 16 nt, Shigella flexneri 2a str. 301
auaaaaauaagaaaga

SEQ ID NO: 3938845 - RNA, 14 nt, Shigella flexneri 2a str. 301
auaaaaauuaaauc

SEQ ID NO: 3938846 - RNA, 15 nt, Shigella flexneri 2a str. 301
auaaaacgccugaua

SEQ ID NO: 3938847 - RNA, 21 nt, Shigella flexneri 2a str. 301
auaaaacguugucaguucuuu

SEQ ID NO: 3938848 - RNA, 13 nt, Shigella flexneri 2a str. 301
auaaaagaaaaaa

SEQ ID NO: 3938849 - RNA, 15 nt, Shigella flexneri 2a str. 301
auaaaauaaccacaa

SEQ ID NO: 3938850 - RNA, 19 nt, Shigella flexneri 2a str. 301
auaaaaucaauaugcauaa

SEQ ID NO: 3938851 - RNA, 14 nt, Shigella flexneri 2a str. 301
auaaaaucccauaa

SEQ ID NO: 3938852 - RNA, 17 nt, Shigella flexneri 2a str. 301
auaaaaugaguuuuuuu

SEQ ID NO: 3938853 - RNA, 17 nt, Shigella flexneri 2a str. 301
auaaaaugauuucgcaa

SEQ ID NO: 3938854 - RNA, 10 nt, Shigella flexneri 2a str. 301
auaaacaaag

SEQ ID NO: 3938855 - RNA, 23 nt, Shigella flexneri 2a str. 301
auaaacaacggcaagaucagcau

SEQ ID NO: 3938856 - RNA, 19 nt, Shigella flexneri 2a str. 301
auaaacaagcguacaaaau

SEQ ID NO: 3938857 - RNA, 15 nt, Shigella flexneri 2a str. 301
auaaacaaugagaua

SEQ ID NO: 3938858 - RNA, 20 nt, Shigella flexneri 2a str. 301
auaaacaaugagauauuuaa

SEQ ID NO: 3938859 - RNA, 15 nt, Shigella flexneri 2a str. 301
auaaacaccagcaau

SEQ ID NO: 3938860 - RNA, 15 nt, Shigella flexneri 2a str. 301
auaaacauagcgcau

SEQ ID NO: 3938861 - RNA, 21 nt, Shigella flexneri 2a str. 301
auaaacauagcgcaucaggca

SEQ ID NO: 3938862 - RNA, 15 nt, Shigella flexneri 2a str. 301
auaaacaucagcuau

SEQ ID NO: 3938863 - RNA, 22 nt, Shigella flexneri 2a str. 301
auaaaccaccugggucugcaga

SEQ ID NO: 3938864 - RNA, 23 nt, Shigella flexneri 2a str. 301
auaaaccaccugggucugcagau

SEQ ID NO: 3938865 - RNA, 22 nt, Shigella flexneri 2a str. 301
auaaaccugccuuacauaucaa

SEQ ID NO: 3938866 - RNA, 14 nt, Shigella flexneri 2a str. 301
auaaacgccagguu

SEQ ID NO: 3938867 - RNA, 22 nt, Shigella flexneri 2a str. 301
auaaacgccauauucugaucgu

SEQ ID NO: 3938868 - RNA, 22 nt, Shigella flexneri 2a str. 301
auaaacgccggaugacacauca

SEQ ID NO: 3938869 - RNA, 22 nt, Shigella flexneri 2a str. 301
auaaacggucuacauugcucau

SEQ ID NO: 3938870 - RNA, 21 nt, Shigella flexneri 2a str. 301
auaaacuuacugacaucaaac

SEQ ID NO: 3938871 - RNA, 16 nt, Shigella flexneri 2a str. 301
auaaagaaaaucugaa

SEQ ID NO: 3938872 - RNA, 21 nt, Shigella flexneri 2a str. 301
auaaagaugccauuggcauaa

SEQ ID NO: 3938873 - RNA, 22 nt, Shigella flexneri 2a str. 301
auaaagaugccauuggcauaaa

SEQ ID NO: 3938874 - RNA, 16 nt, Shigella flexneri 2a str. 301
auaaagcacugucuaa

SEQ ID NO: 3938875 - RNA, 15 nt, Shigella flexneri 2a str. 301
auaaagcagagcagg

SEQ ID NO: 3938876 - RNA, 13 nt, Shigella flexneri 2a str. 301
auaaagcgauaaa

SEQ ID NO: 3938877 - RNA, 19 nt, Shigella flexneri 2a str. 301
auaaagcugaucacauaac

SEQ ID NO: 3938878 - RNA, 15 nt, Shigella flexneri 2a str. 301
auaaaggucaucaca

SEQ ID NO: 3938879 - RNA, 23 nt, Shigella flexneri 2a str. 301
auaaaggucaucacaucccagca

SEQ ID NO: 3938880 - RNA, 17 nt, Shigella flexneri 2a str. 301
auaaaggucgacagcag

SEQ ID NO: 3938881 - RNA, 19 nt, Shigella flexneri 2a str. 301
auaaaggucgacagcagcc

SEQ ID NO: 3938882 - RNA, 22 nt, Shigella flexneri 2a str. 301
auaaaggucgacagcagccccg

SEQ ID NO: 3938883 - RNA, 14 nt, Shigella flexneri 2a str. 301
auaaaguagaaauu

SEQ ID NO: 3938884 - RNA, 16 nt, Shigella flexneri 2a str. 301
auaaaguagaaauuau

SEQ ID NO: 3938885 - RNA, 17 nt, Shigella flexneri 2a str. 301
auaaagucgauuugcaa

SEQ ID NO: 3938886 - RNA, 14 nt, Shigella flexneri 2a str. 301
auaaagucuuucuu

SEQ ID NO: 3938887 - RNA, 23 nt, Shigella flexneri 2a str. 301
auaaaguguugagcuuuauccug

SEQ ID NO: 3938888 - RNA, 13 nt, Shigella flexneri 2a str. 301
auaaauaaaaauu

SEQ ID NO: 3938889 - RNA, 20 nt, Shigella flexneri 2a str. 301
auaaauaaacucucuauucc

SEQ ID NO: 3938890 - RNA, 18 nt, Shigella flexneri 2a str. 301
auaaauaacuuuuaucug

SEQ ID NO: 3938891 - RNA, 18 nt, Shigella flexneri 2a str. 301
auaaauacuccauaacua

SEQ ID NO: 3938892 - RNA, 20 nt, Shigella flexneri 2a str. 301
auaaauauaaucaacaugau

SEQ ID NO: 3938893 - RNA, 23 nt, Shigella flexneri 2a str. 301
auaaauauggugaaaguaaaaaa

SEQ ID NO: 3938894 - RNA, 15 nt, Shigella flexneri 2a str. 301
auaaauauuaauaca

SEQ ID NO: 3938895 - RNA, 21 nt, Shigella flexneri 2a str. 301
auaaauauuaauacaacaaca

SEQ ID NO: 3938896 - RNA, 11 nt, Shigella flexneri 2a str. 301
auaaaucagau

SEQ ID NO: 3938897 - RNA, 16 nt, Shigella flexneri 2a str. 301
auaaauccaacaacac

SEQ ID NO: 3938898 - RNA, 16 nt, Shigella flexneri 2a str. 301
auaaauccaucgggcu

SEQ ID NO: 3938899 - RNA, 22 nt, Shigella flexneri 2a str. 301
auaaauccuuuguacaggauau

SEQ ID NO: 3938900 - RNA, 17 nt, Shigella flexneri 2a str. 301
auaaaucgugaaacaau

SEQ ID NO: 3938901 - RNA, 13 nt, Shigella flexneri 2a str. 301
auaaauggcgaac

SEQ ID NO: 3938902 - RNA, 15 nt, Shigella flexneri 2a str. 301
auaaauguguaauca

SEQ ID NO: 3938903 - RNA, 15 nt, Shigella flexneri 2a str. 301
auaaauguuaagacu

SEQ ID NO: 3938904 - RNA, 24 nt, Shigella flexneri 2a str. 301
auaaauuaacugcgcgauuaucau

SEQ ID NO: 3938905 - RNA, 13 nt, Shigella flexneri 2a str. 301
auaaauuccccgc

SEQ ID NO: 3938906 - RNA, 23 nt, Shigella flexneri 2a str. 301
auaaauugcuguaaauucucaau

SEQ ID NO: 3938907 - RNA, 15 nt, Shigella flexneri 2a str. 301
auaaauuggcugggg

SEQ ID NO: 3938908 - RNA, 14 nt, Shigella flexneri 2a str. 301
auaacaccagccag

SEQ ID NO: 3938909 - RNA, 19 nt, Shigella flexneri 2a str. 301
auaaucgauugcacauucc

SEQ ID NO: 3938910 - RNA, 20 nt, Shigella flexneri 2a str. 301
auaaucgcaccgcuggcaga

SEQ ID NO: 3938911 - RNA, 16 nt, Shigella flexneri 2a str. 301
auaaucgcauucagga

SEQ ID NO: 3938912 - RNA, 19 nt, Shigella flexneri 2a str. 301
auaaucgcgcuaauuccag

SEQ ID NO: 3938913 - RNA, 14 nt, Shigella flexneri 2a str. 301
auaaucgggaauac

SEQ ID NO: 3938914 - RNA, 14 nt, Shigella flexneri 2a str. 301
auaaucguaaucag

SEQ ID NO: 3938915 - RNA, 17 nt, Shigella flexneri 2a str. 301
auaaucguaaucagcau

SEQ ID NO: 3938916 - RNA, 21 nt, Shigella flexneri 2a str. 301
auaaucguaaucagcaucuca

SEQ ID NO: 3938917 - RNA, 23 nt, Shigella flexneri 2a str. 301
auaaucuauugauuuaacagcaa

SEQ ID NO: 3938918 - RNA, 19 nt, Shigella flexneri 2a str. 301
auaaucucccguuccuggu

SEQ ID NO: 3938919 - RNA, 15 nt, Shigella flexneri 2a str. 301
auaaucucuacacca

SEQ ID NO: 3938920 - RNA, 17 nt, Shigella flexneri 2a str. 301
auaaucuguuucaucuc

SEQ ID NO: 3938921 - RNA, 13 nt, Shigella flexneri 2a str. 301
auaaucuuuaaaa

SEQ ID NO: 3938922 - RNA, 16 nt, Shigella flexneri 2a str. 301
auaaucuuuaaaaaaa

SEQ ID NO: 3938923 - RNA, 23 nt, Shigella flexneri 2a str. 301
auaaugaacgccaccccacacca

SEQ ID NO: 3938924 - RNA, 17 nt, Shigella flexneri 2a str. 301
auaaugacggagaguac

SEQ ID NO: 3938925 - RNA, 18 nt, Shigella flexneri 2a str. 301
auaaugacggagaguacu

SEQ ID NO: 3938926 - RNA, 18 nt, Shigella flexneri 2a str. 301
auaaugaucaguggaaga

SEQ ID NO: 3938927 - RNA, 22 nt, Shigella flexneri 2a str. 301
auaaugaugucucuguuuugaa

SEQ ID NO: 3938928 - RNA, 11 nt, Shigella flexneri 2a str. 301
auaaugcccag

SEQ ID NO: 3938929 - RNA, 13 nt, Shigella flexneri 2a str. 301
auaaugcccagca

SEQ ID NO: 3938930 - RNA, 19 nt, Shigella flexneri 2a str. 301
auaaugcccagcaacgaaa

SEQ ID NO: 3938931 - RNA, 20 nt, Shigella flexneri 2a str. 301
auaaugcccgaaugcagcuc

SEQ ID NO: 3938932 - RNA, 18 nt, Shigella flexneri 2a str. 301
auaaugcccgaugaccuu

SEQ ID NO: 3938933 - RNA, 22 nt, Shigella flexneri 2a str. 301
auaaugcccgaugaccuuguca

SEQ ID NO: 3938934 - RNA, 14 nt, Shigella flexneri 2a str. 301
auaaugccggauac

SEQ ID NO: 3938935 - RNA, 22 nt, Shigella flexneri 2a str. 301
auaaugccguuuggcaaauaca

SEQ ID NO: 3938936 - RNA, 12 nt, Shigella flexneri 2a str. 301
auaaugccugau

SEQ ID NO: 3938937 - RNA, 13 nt, Shigella flexneri 2a str. 301
auaaugcugacaa

SEQ ID NO: 3938938 - RNA, 16 nt, Shigella flexneri 2a str. 301
auaaugcugacaaaac

SEQ ID NO: 3938939 - RNA, 11 nt, Shigella flexneri 2a str. 301
auaauggcugu

SEQ ID NO: 3938940 - RNA, 17 nt, Shigella flexneri 2a str. 301
auaaugggcgcgggcga

SEQ ID NO: 3938941 - RNA, 13 nt, Shigella flexneri 2a str. 301
auaaugucugaug

SEQ ID NO: 3938942 - RNA, 17 nt, Shigella flexneri 2a str. 301
auaauguggccccugaa

SEQ ID NO: 3938943 - RNA, 15 nt, Shigella flexneri 2a str. 301
auaauguguucaacu

SEQ ID NO: 3938944 - RNA, 22 nt, Shigella flexneri 2a str. 301
auaauguuucaguguuaaacgc

SEQ ID NO: 3938945 - RNA, 13 nt, Shigella flexneri 2a str. 301
auaauuaaaaaua

SEQ ID NO: 3938946 - RNA, 15 nt, Shigella flexneri 2a str. 301
auaauuaaaaauagu

SEQ ID NO: 3938947 - RNA, 16 nt, Shigella flexneri 2a str. 301
auaauuacuuacaucu

SEQ ID NO: 3938948 - RNA, 19 nt, Shigella flexneri 2a str. 301
auaauuaggauacuuaucu

SEQ ID NO: 3938949 - RNA, 14 nt, Shigella flexneri 2a str. 301
auaauuaugaagug

SEQ ID NO: 3938950 - RNA, 12 nt, Shigella flexneri 2a str. 301
auaauuauuaua

SEQ ID NO: 3938951 - RNA, 14 nt, Shigella flexneri 2a str. 301
auaauuauuauaau

SEQ ID NO: 3938952 - RNA, 20 nt, Shigella flexneri 2a str. 301
auaauuccugcgcugcguag

SEQ ID NO: 3938953 - RNA, 13 nt, Shigella flexneri 2a str. 301
auaauucuguaau

SEQ ID NO: 3938954 - RNA, 22 nt, Shigella flexneri 2a str. 301
auaauugaccagaucuucauca

SEQ ID NO: 3938955 - RNA, 17 nt, Shigella flexneri 2a str. 301
auaauugucaacggcac

SEQ ID NO: 3938956 - RNA, 22 nt, Shigella flexneri 2a str. 301
auaauuucauuuacuggaugga

SEQ ID NO: 3938957 - RNA, 21 nt, Shigella flexneri 2a str. 301
auaauuucugcacaucuaacc

SEQ ID NO: 3938958 - RNA, 22 nt, Shigella flexneri 2a str. 301
auaauuucuucguucgcugcau

SEQ ID NO: 3938959 - RNA, 16 nt, Shigella flexneri 2a str. 301
auacaaaauuuaacac

SEQ ID NO: 3938960 - RNA, 14 nt, Shigella flexneri 2a str. 301
auacaaccaaucgc

SEQ ID NO: 3938961 - RNA, 13 nt, Shigella flexneri 2a str. 301
auacaacgccaug

SEQ ID NO: 3938962 - RNA, 15 nt, Shigella flexneri 2a str. 301
auacaacgccaugaa

SEQ ID NO: 3938963 - RNA, 20 nt, Shigella flexneri 2a str. 301
auacaacucgcuuaagccau

SEQ ID NO: 3938964 - RNA, 17 nt, Shigella flexneri 2a str. 301
auacaaggccaauccag

SEQ ID NO: 3938965 - RNA, 13 nt, Shigella flexneri 2a str. 301
auacacacaucaa

SEQ ID NO: 3938966 - RNA, 16 nt, Shigella flexneri 2a str. 301
auacaccaucauggaa

SEQ ID NO: 3938967 - RNA, 22 nt, Shigella flexneri 2a str. 301
auacaccguuuuacaacgcugu

SEQ ID NO: 3938968 - RNA, 17 nt, Shigella flexneri 2a str. 301
auacacgccgccgagca

SEQ ID NO: 3938969 - RNA, 17 nt, Shigella flexneri 2a str. 301
auacacuaacagaacaa

SEQ ID NO: 3938970 - RNA, 20 nt, Shigella flexneri 2a str. 301
auacacuaacagaacaauaa

SEQ ID NO: 3938971 - RNA, 20 nt, Shigella flexneri 2a str. 301
auacacuucacacacuuuua

SEQ ID NO: 3938972 - RNA, 21 nt, Shigella flexneri 2a str. 301
auacagauucgcuugucacuu

SEQ ID NO: 3938973 - RNA, 23 nt, Shigella flexneri 2a str. 301
auacagcaauggaaaaaguuuua

SEQ ID NO: 3938974 - RNA, 15 nt, Shigella flexneri 2a str. 301
auacagcccagacaa

SEQ ID NO: 3938975 - RNA, 20 nt, Shigella flexneri 2a str. 301
auacagccgacaaugccaca

SEQ ID NO: 3938976 - RNA, 22 nt, Shigella flexneri 2a str. 301
auacagcgcggaccccacgcuc

SEQ ID NO: 3938977 - RNA, 14 nt, Shigella flexneri 2a str. 301
auacagcggccagc

SEQ ID NO: 3938978 - RNA, 16 nt, Shigella flexneri 2a str. 301
auacaggaacagccac

SEQ ID NO: 3938979 - RNA, 15 nt, Shigella flexneri 2a str. 301
auacaggaagcgaau

SEQ ID NO: 3938980 - RNA, 22 nt, Shigella flexneri 2a str. 301
auacaggcggguaaucuuucca

SEQ ID NO: 3938981 - RNA, 14 nt, Shigella flexneri 2a str. 301
auacaggugcagcc

SEQ ID NO: 3938982 - RNA, 13 nt, Shigella flexneri 2a str. 301
auacagguuucaa

SEQ ID NO: 3938983 - RNA, 20 nt, Shigella flexneri 2a str. 301
auacaguuaucccguacucg

SEQ ID NO: 3938984 - RNA, 21 nt, Shigella flexneri 2a str. 301
auacauaaagucuuucuuacc

SEQ ID NO: 3938985 - RNA, 16 nt, Shigella flexneri 2a str. 301
auacauagcacaacag

SEQ ID NO: 3938986 - RNA, 17 nt, Shigella flexneri 2a str. 301
auacauagcacaacagg

SEQ ID NO: 3938987 - RNA, 15 nt, Shigella flexneri 2a str. 301
auacaucgcauaaaa

SEQ ID NO: 3938988 - RNA, 21 nt, Shigella flexneri 2a str. 301
auacaucgcgcuuaucgccag

SEQ ID NO: 3938989 - RNA, 19 nt, Shigella flexneri 2a str. 301
auacaucugcaaauccugu

SEQ ID NO: 3938990 - RNA, 13 nt, Shigella flexneri 2a str. 301
auacaugaaugau

SEQ ID NO: 3938991 - RNA, 19 nt, Shigella flexneri 2a str. 301
auacaugaaugaugauuug

SEQ ID NO: 3938992 - RNA, 14 nt, Shigella flexneri 2a str. 301
auacaugcuuagca

SEQ ID NO: 3938993 - RNA, 18 nt, Shigella flexneri 2a str. 301
auaccaaaaucaucaauu

SEQ ID NO: 3938994 - RNA, 23 nt, Shigella flexneri 2a str. 301
auaccaagucucaagagugaaca

SEQ ID NO: 3938995 - RNA, 16 nt, Shigella flexneri 2a str. 301
auaccaccagugccau

SEQ ID NO: 3938996 - RNA, 15 nt, Shigella flexneri 2a str. 301
auaccacgucugaag

SEQ ID NO: 3938997 - RNA, 15 nt, Shigella flexneri 2a str. 301
auaccagaccuuuac

SEQ ID NO: 3938998 - RNA, 17 nt, Shigella flexneri 2a str. 301
auaccagauuaauuauu

SEQ ID NO: 3938999 - RNA, 11 nt, Shigella flexneri 2a str. 301
auaccagccuu

SEQ ID NO: 3939000 - RNA, 17 nt, Shigella flexneri 2a str. 301
auaccagccuucuucau

SEQ ID NO: 3939001 - RNA, 23 nt, Shigella flexneri 2a str. 301
auaccagccuucuucauccagcg

SEQ ID NO: 3939002 - RNA, 15 nt, Shigella flexneri 2a str. 301
auaccaucacaccuc

SEQ ID NO: 3939003 - RNA, 17 nt, Shigella flexneri 2a str. 301
auaccaucaccaacgau

SEQ ID NO: 3939004 - RNA, 13 nt, Shigella flexneri 2a str. 301
auaccaucggcag

SEQ ID NO: 3939005 - RNA, 23 nt, Shigella flexneri 2a str. 301
auaccaucggcagcgccaaucgc

SEQ ID NO: 3939006 - RNA, 12 nt, Shigella flexneri 2a str. 301
auaccaugcacc

SEQ ID NO: 3939007 - RNA, 17 nt, Shigella flexneri 2a str. 301
auaccauggcucaccag

SEQ ID NO: 3939008 - RNA, 21 nt, Shigella flexneri 2a str. 301
auacccacugcgcaguguuug

SEQ ID NO: 3939009 - RNA, 19 nt, Shigella flexneri 2a str. 301
auagcaauauuuuguugca

SEQ ID NO: 3939010 - RNA, 21 nt, Shigella flexneri 2a str. 301
auagcaaucuguaacaaggug

SEQ ID NO: 3939011 - RNA, 12 nt, Shigella flexneri 2a str. 301
auagcacacuuu

SEQ ID NO: 3939012 - RNA, 15 nt, Shigella flexneri 2a str. 301
auagcacacuuucgc

SEQ ID NO: 3939013 - RNA, 17 nt, Shigella flexneri 2a str. 301
auagcacccgccagcgc

SEQ ID NO: 3939014 - RNA, 21 nt, Shigella flexneri 2a str. 301
auagcaguaauugcagcagcu

SEQ ID NO: 3939015 - RNA, 18 nt, Shigella flexneri 2a str. 301
auagcauccaccacaucg

SEQ ID NO: 3939016 - RNA, 18 nt, Shigella flexneri 2a str. 301
auagcaucuuccagcgug

SEQ ID NO: 3939017 - RNA, 19 nt, Shigella flexneri 2a str. 301
auagcauuggagacugaug

SEQ ID NO: 3939018 - RNA, 15 nt, Shigella flexneri 2a str. 301
auagccaaagcacca

SEQ ID NO: 3939019 - RNA, 20 nt, Shigella flexneri 2a str. 301
auagccacgcucauaugcuu

SEQ ID NO: 3939020 - RNA, 15 nt, Shigella flexneri 2a str. 301
auagccacuucaucg

SEQ ID NO: 3939021 - RNA, 18 nt, Shigella flexneri 2a str. 301
auagccacuugcuggaag

SEQ ID NO: 3939022 - RNA, 18 nt, Shigella flexneri 2a str. 301
auagccagccucauccau

SEQ ID NO: 3939023 - RNA, 21 nt, Shigella flexneri 2a str. 301
auagccagccucauccauacg

SEQ ID NO: 3939024 - RNA, 21 nt, Shigella flexneri 2a str. 301
auagccagguuuaccagcagc

SEQ ID NO: 3939025 - RNA, 15 nt, Shigella flexneri 2a str. 301
auagcccaugcaucg

SEQ ID NO: 3939026 - RNA, 14 nt, Shigella flexneri 2a str. 301
auagccgcaaagau

SEQ ID NO: 3939027 - RNA, 19 nt, Shigella flexneri 2a str. 301
auagccuuuauuaaugaca

SEQ ID NO: 3939028 - RNA, 15 nt, Shigella flexneri 2a str. 301
auagccuuucaauaa

SEQ ID NO: 3939029 - RNA, 17 nt, Shigella flexneri 2a str. 301
auagcgaaguagacagc

SEQ ID NO: 3939030 - RNA, 18 nt, Shigella flexneri 2a str. 301
auagcgacaggcuuucuu

SEQ ID NO: 3939031 - RNA, 20 nt, Shigella flexneri 2a str. 301
auagcgaccauacagcagca

SEQ ID NO: 3939032 - RNA, 23 nt, Shigella flexneri 2a str. 301
auagcgacuugggcgauuuuugc

SEQ ID NO: 3939033 - RNA, 17 nt, Shigella flexneri 2a str. 301
auagcgcacgcgcuuca

SEQ ID NO: 3939034 - RNA, 14 nt, Shigella flexneri 2a str. 301
auagcggcugcgca

SEQ ID NO: 3939035 - RNA, 15 nt, Shigella flexneri 2a str. 301
auagcgucauuucua

SEQ ID NO: 3939036 - RNA, 17 nt, Shigella flexneri 2a str. 301
auagcgucccaguaacg

SEQ ID NO: 3939037 - RNA, 20 nt, Shigella flexneri 2a str. 301
auagcuaacucuaaucccuu

SEQ ID NO: 3939038 - RNA, 23 nt, Shigella flexneri 2a str. 301
auagcuaaucaucuguugugcca

SEQ ID NO: 3939039 - RNA, 20 nt, Shigella flexneri 2a str. 301
auaggaaagcuuauuuuaca

SEQ ID NO: 3939040 - RNA, 14 nt, Shigella flexneri 2a str. 301
auaggaauuaaaac

SEQ ID NO: 3939041 - RNA, 17 nt, Shigella flexneri 2a str. 301
auaggaauuaaaacccc

SEQ ID NO: 3939042 - RNA, 18 nt, Shigella flexneri 2a str. 301
auaggaugagguuucccg

SEQ ID NO: 3939043 - RNA, 18 nt, Shigella flexneri 2a str. 301
auaggcaaaaaaaaugcc

SEQ ID NO: 3939044 - RNA, 19 nt, Shigella flexneri 2a str. 301
auaggcaaaaaaaaugccc

SEQ ID NO: 3939045 - RNA, 21 nt, Shigella flexneri 2a str. 301
auaggcaaaaaaaaugcccgc

SEQ ID NO: 3939046 - RNA, 14 nt, Shigella flexneri 2a str. 301
auaggcaccgccaa

SEQ ID NO: 3939047 - RNA, 21 nt, Shigella flexneri 2a str. 301
auaggcaggcaucaucagauu

SEQ ID NO: 3939048 - RNA, 13 nt, Shigella flexneri 2a str. 301
auaggcaucagca

SEQ ID NO: 3939049 - RNA, 14 nt, Shigella flexneri 2a str. 301
auaggcuuccaccg

SEQ ID NO: 3939050 - RNA, 19 nt, Shigella flexneri 2a str. 301
auaggcuuccaccguuucu

SEQ ID NO: 3939051 - RNA, 19 nt, Shigella flexneri 2a str. 301
auaggcuuugcuuagcgca

SEQ ID NO: 3939052 - RNA, 14 nt, Shigella flexneri 2a str. 301
auagguggcaaaga

SEQ ID NO: 3939053 - RNA, 17 nt, Shigella flexneri 2a str. 301
auaggugucaaccagcc

SEQ ID NO: 3939054 - RNA, 16 nt, Shigella flexneri 2a str. 301
auagguugaaauaaac

SEQ ID NO: 3939055 - RNA, 16 nt, Shigella flexneri 2a str. 301
auaguaauuucaucug

SEQ ID NO: 3939056 - RNA, 19 nt, Shigella flexneri 2a str. 301
auaguacgggcaauuucac

SEQ ID NO: 3939057 - RNA, 15 nt, Shigella flexneri 2a str. 301
auaguagccagccag

SEQ ID NO: 3939058 - RNA, 14 nt, Shigella flexneri 2a str. 301
auagucaucucuuc

SEQ ID NO: 3939059 - RNA, 15 nt, Shigella flexneri 2a str. 301
auagucaucucuucc

SEQ ID NO: 3939060 - RNA, 20 nt, Shigella flexneri 2a str. 301
auagucaucucuuccggcac

SEQ ID NO: 3939061 - RNA, 13 nt, Shigella flexneri 2a str. 301
auagugccugaug

SEQ ID NO: 3939062 - RNA, 14 nt, Shigella flexneri 2a str. 301
auaguggcucagac

SEQ ID NO: 3939063 - RNA, 15 nt, Shigella flexneri 2a str. 301
auaguggcucagacu

SEQ ID NO: 3939064 - RNA, 16 nt, Shigella flexneri 2a str. 301
auaguguuuuauguuc

SEQ ID NO: 3939065 - RNA, 20 nt, Shigella flexneri 2a str. 301
auaguuaaaauucaagacau

SEQ ID NO: 3939066 - RNA, 19 nt, Shigella flexneri 2a str. 301
auaguugauuaauuucauu

SEQ ID NO: 3939067 - RNA, 16 nt, Shigella flexneri 2a str. 301
auauaaaaauccgccu

SEQ ID NO: 3939068 - RNA, 16 nt, Shigella flexneri 2a str. 301
auauaaaccaucggcg

SEQ ID NO: 3939069 - RNA, 16 nt, Shigella flexneri 2a str. 301
auauaaagcaucaauu

SEQ ID NO: 3939070 - RNA, 21 nt, Shigella flexneri 2a str. 301
auauaaauguuaagacuggca

SEQ ID NO: 3939071 - RNA, 12 nt, Shigella flexneri 2a str. 301
auauaaauuuca

SEQ ID NO: 3939072 - RNA, 21 nt, Shigella flexneri 2a str. 301
auauaaccccacagggugagc

SEQ ID NO: 3939073 - RNA, 17 nt, Shigella flexneri 2a str. 301
auauaagcauguucuuu

SEQ ID NO: 3939074 - RNA, 14 nt, Shigella flexneri 2a str. 301
auauaauaaaccug

SEQ ID NO: 3939075 - RNA, 13 nt, Shigella flexneri 2a str. 301
auauaauuaaaaa

SEQ ID NO: 3939076 - RNA, 14 nt, Shigella flexneri 2a str. 301
auauaauuaaaaau

SEQ ID NO: 3939077 - RNA, 15 nt, Shigella flexneri 2a str. 301
auauaauuaaaaaua

SEQ ID NO: 3939078 - RNA, 17 nt, Shigella flexneri 2a str. 301
auauaauuccacgccau

SEQ ID NO: 3939079 - RNA, 22 nt, Shigella flexneri 2a str. 301
auauaauuccauucaccauuuu

SEQ ID NO: 3939080 - RNA, 22 nt, Shigella flexneri 2a str. 301
auauaauugaccagaucuucau

SEQ ID NO: 3939081 - RNA, 14 nt, Shigella flexneri 2a str. 301
auauacaaucacac

SEQ ID NO: 3939082 - RNA, 18 nt, Shigella flexneri 2a str. 301
auauacaaucacacuaac

SEQ ID NO: 3939083 - RNA, 23 nt, Shigella flexneri 2a str. 301
auauacaggcggguaaucuuucc

SEQ ID NO: 3939084 - RNA, 17 nt, Shigella flexneri 2a str. 301
auauacccgccaaacca

SEQ ID NO: 3939085 - RNA, 20 nt, Shigella flexneri 2a str. 301
auauacgccaucgccagcag

SEQ ID NO: 3939086 - RNA, 14 nt, Shigella flexneri 2a str. 301
auauagaaaaugga

SEQ ID NO: 3939087 - RNA, 15 nt, Shigella flexneri 2a str. 301
auauagacaaaguaa

SEQ ID NO: 3939088 - RNA, 14 nt, Shigella flexneri 2a str. 301
auauagccagccuc

SEQ ID NO: 3939089 - RNA, 19 nt, Shigella flexneri 2a str. 301
auauagcgcacaugcaacu

SEQ ID NO: 3939090 - RNA, 17 nt, Shigella flexneri 2a str. 301
auauaggucacaucacc

SEQ ID NO: 3939091 - RNA, 18 nt, Shigella flexneri 2a str. 301
auauauccgaaaaaggau

SEQ ID NO: 3939092 - RNA, 22 nt, Shigella flexneri 2a str. 301
auauaugggucguuggugauau

SEQ ID NO: 3939093 - RNA, 14 nt, Shigella flexneri 2a str. 301
auauauuaaucauc

SEQ ID NO: 3939094 - RNA, 15 nt, Shigella flexneri 2a str. 301
auauauuaaucauca

SEQ ID NO: 3939095 - RNA, 16 nt, Shigella flexneri 2a str. 301
auauauuaaucaucau

SEQ ID NO: 3939096 - RNA, 22 nt, Shigella flexneri 2a str. 301
auauauuacaacguauuauaua

SEQ ID NO: 3939097 - RNA, 23 nt, Shigella flexneri 2a str. 301
auauauugaauuagcaauauuuu

SEQ ID NO: 3939098 - RNA, 17 nt, Shigella flexneri 2a str. 301
auauauugaauuugcau

SEQ ID NO: 3939099 - RNA, 18 nt, Shigella flexneri 2a str. 301
auauauugggaucaaaaa

SEQ ID NO: 3939100 - RNA, 17 nt, Shigella flexneri 2a str. 301
auauauuucaucaacug

SEQ ID NO: 3939101 - RNA, 17 nt, Shigella flexneri 2a str. 301
auauauuuuuaaauaua

SEQ ID NO: 3939102 - RNA, 18 nt, Shigella flexneri 2a str. 301
auauauuuuuaaauauaa

SEQ ID NO: 3939103 - RNA, 20 nt, Shigella flexneri 2a str. 301
auaucaaaacgcucugagcu

SEQ ID NO: 3939104 - RNA, 15 nt, Shigella flexneri 2a str. 301
auaucaaacgccuga

SEQ ID NO: 3939105 - RNA, 13 nt, Shigella flexneri 2a str. 301
auaucaaauaaaa

SEQ ID NO: 3939106 - RNA, 12 nt, Shigella flexneri 2a str. 301
auaucaaccuga

SEQ ID NO: 3939107 - RNA, 20 nt, Shigella flexneri 2a str. 301
auaucaagaucaucaaacuu

SEQ ID NO: 3939108 - RNA, 14 nt, Shigella flexneri 2a str. 301
auaucaagccaugc

SEQ ID NO: 3939109 - RNA, 17 nt, Shigella flexneri 2a str. 301
auauugccguccggcau

SEQ ID NO: 3939110 - RNA, 22 nt, Shigella flexneri 2a str. 301
auauugccguccggcaucgcaa

SEQ ID NO: 3939111 - RNA, 12 nt, Shigella flexneri 2a str. 301
auauugcgcaug

SEQ ID NO: 3939112 - RNA, 14 nt, Shigella flexneri 2a str. 301
auauugcuguacuu

SEQ ID NO: 3939113 - RNA, 21 nt, Shigella flexneri 2a str. 301
auauuggagaguugcaccagc

SEQ ID NO: 3939114 - RNA, 12 nt, Shigella flexneri 2a str. 301
auauugguguug

SEQ ID NO: 3939115 - RNA, 14 nt, Shigella flexneri 2a str. 301
auauugguguugug

SEQ ID NO: 3939116 - RNA, 16 nt, Shigella flexneri 2a str. 301
auauugguguugugaa

SEQ ID NO: 3939117 - RNA, 18 nt, Shigella flexneri 2a str. 301
auauugguguugugaagu

SEQ ID NO: 3939118 - RNA, 19 nt, Shigella flexneri 2a str. 301
auauugucuucaagaucag

SEQ ID NO: 3939119 - RNA, 23 nt, Shigella flexneri 2a str. 301
auauuuaaacggcguaaaauuca

SEQ ID NO: 3939120 - RNA, 13 nt, Shigella flexneri 2a str. 301
auauuuaaauauu

SEQ ID NO: 3939121 - RNA, 18 nt, Shigella flexneri 2a str. 301
auauuuaaucaguucuac

SEQ ID NO: 3939122 - RNA, 18 nt, Shigella flexneri 2a str. 301
auauuuagccagcaacug

SEQ ID NO: 3939123 - RNA, 19 nt, Shigella flexneri 2a str. 301
auauuuccccuguugcaaa

SEQ ID NO: 3939124 - RNA, 15 nt, Shigella flexneri 2a str. 301
auauuucuauauccu

SEQ ID NO: 3939125 - RNA, 18 nt, Shigella flexneri 2a str. 301
auauuucucggcaaauuc

SEQ ID NO: 3939126 - RNA, 23 nt, Shigella flexneri 2a str. 301
auauuuugaaucggcggcggcag

SEQ ID NO: 3939127 - RNA, 17 nt, Shigella flexneri 2a str. 301
auauuuuuaaauauaaa

SEQ ID NO: 3939128 - RNA, 11 nt, Shigella flexneri 2a str. 301
auauuuuuccg

SEQ ID NO: 3939129 - RNA, 20 nt, Shigella flexneri 2a str. 301
auauuuuuuuccuaaacccu

SEQ ID NO: 3939130 - RNA, 18 nt, Shigella flexneri 2a str. 301
aucaaaacgcucugagcu

SEQ ID NO: 3939131 - RNA, 12 nt, Shigella flexneri 2a str. 301
aucaaaaucauc

SEQ ID NO: 3939132 - RNA, 14 nt, Shigella flexneri 2a str. 301
aucaaaaucaucau

SEQ ID NO: 3939133 - RNA, 15 nt, Shigella flexneri 2a str. 301
aucaaacaauuuuca

SEQ ID NO: 3939134 - RNA, 20 nt, Shigella flexneri 2a str. 301
aucaaacggugguuguuccu

SEQ ID NO: 3939135 - RNA, 17 nt, Shigella flexneri 2a str. 301
aucaaacgugacauucu

SEQ ID NO: 3939136 - RNA, 19 nt, Shigella flexneri 2a str. 301
aucaaacgugacauucuga

SEQ ID NO: 3939137 - RNA, 20 nt, Shigella flexneri 2a str. 301
aucaaacgugacauucugac

SEQ ID NO: 3939138 - RNA, 13 nt, Shigella flexneri 2a str. 301
aucaaagaugaug

SEQ ID NO: 3939139 - RNA, 22 nt, Shigella flexneri 2a str. 301
aucaaagaugaugucacagccg

SEQ ID NO: 3939140 - RNA, 15 nt, Shigella flexneri 2a str. 301
aucaaagguuuuuca

SEQ ID NO: 3939141 - RNA, 19 nt, Shigella flexneri 2a str. 301
aucaaagucuccuuugcca

SEQ ID NO: 3939142 - RNA, 13 nt, Shigella flexneri 2a str. 301
aucaaauaaaaau

SEQ ID NO: 3939143 - RNA, 16 nt, Shigella flexneri 2a str. 301
aucaaauaccaccagc

SEQ ID NO: 3939144 - RNA, 21 nt, Shigella flexneri 2a str. 301
aucaaauacuucaauauaugc

SEQ ID NO: 3939145 - RNA, 13 nt, Shigella flexneri 2a str. 301
aucaaaucaccau

SEQ ID NO: 3939146 - RNA, 22 nt, Shigella flexneri 2a str. 301
aucaaaucaccauauucagcag

SEQ ID NO: 3939147 - RNA, 23 nt, Shigella flexneri 2a str. 301
aucaaaucaccauauucagcagc

SEQ ID NO: 3939148 - RNA, 15 nt, Shigella flexneri 2a str. 301
aucaaaucucgccgu

SEQ ID NO: 3939149 - RNA, 18 nt, Shigella flexneri 2a str. 301
aucaaaugcguuaucggc

SEQ ID NO: 3939150 - RNA, 16 nt, Shigella flexneri 2a str. 301
aucaaauuauuaccau

SEQ ID NO: 3939151 - RNA, 14 nt, Shigella flexneri 2a str. 301
aucaaauucaagau

SEQ ID NO: 3939152 - RNA, 22 nt, Shigella flexneri 2a str. 301
aucaacaauaaaaccaguaaug

SEQ ID NO: 3939153 - RNA, 23 nt, Shigella flexneri 2a str. 301
aucaacaauugcgggccaaagac

SEQ ID NO: 3939154 - RNA, 13 nt, Shigella flexneri 2a str. 301
aucaacacaucca

SEQ ID NO: 3939155 - RNA, 17 nt, Shigella flexneri 2a str. 301
aucaacaggcacuacgu

SEQ ID NO: 3939156 - RNA, 15 nt, Shigella flexneri 2a str. 301
aucaacaguuuguug

SEQ ID NO: 3939157 - RNA, 17 nt, Shigella flexneri 2a str. 301
aucaacaguuuguugca

SEQ ID NO: 3939158 - RNA, 17 nt, Shigella flexneri 2a str. 301
aucaacauauuccccug

SEQ ID NO: 3939159 - RNA, 13 nt, Shigella flexneri 2a str. 301
aucaacaucaucu

SEQ ID NO: 3939160 - RNA, 17 nt, Shigella flexneri 2a str. 301
aucaacaugaaaauaac

SEQ ID NO: 3939161 - RNA, 18 nt, Shigella flexneri 2a str. 301
aucaacauguuccugcca

SEQ ID NO: 3939162 - RNA, 14 nt, Shigella flexneri 2a str. 301
aucaacauucagau

SEQ ID NO: 3939163 - RNA, 18 nt, Shigella flexneri 2a str. 301
aucaacauucagaucggu

SEQ ID NO: 3939164 - RNA, 20 nt, Shigella flexneri 2a str. 301
aucaacccugcccuucaggg

SEQ ID NO: 3939165 - RNA, 21 nt, Shigella flexneri 2a str. 301
aucaaccgcacucuacuucuu

SEQ ID NO: 3939166 - RNA, 19 nt, Shigella flexneri 2a str. 301
aucaacgacaaaaauacca

SEQ ID NO: 3939167 - RNA, 18 nt, Shigella flexneri 2a str. 301
aucaacgcgaaaaugccc

SEQ ID NO: 3939168 - RNA, 22 nt, Shigella flexneri 2a str. 301
aucaacuagcuguuguaaugau

SEQ ID NO: 3939169 - RNA, 17 nt, Shigella flexneri 2a str. 301
aucaacuccgccagcaa

SEQ ID NO: 3939170 - RNA, 18 nt, Shigella flexneri 2a str. 301
aucaacuccgccagcaac

SEQ ID NO: 3939171 - RNA, 15 nt, Shigella flexneri 2a str. 301
aucaacucugcaaug

SEQ ID NO: 3939172 - RNA, 20 nt, Shigella flexneri 2a str. 301
aucaacugcguucugucgau

SEQ ID NO: 3939173 - RNA, 18 nt, Shigella flexneri 2a str. 301
aucaacuggcaaccagaa
